United States Patent 10,329,575 (REGULATORY SEQUENCE FOR PLANTS) - sequence listing, part 20

SEQ ID NO: 32213 - DNA, 3000 bp, Unknown
  misc_feature (1)..( 3000): 2750-1469P.txt file - cDNA_ID_3050117; gDNA_ID_1621135; Annot_ID_172634
gtaaaactatgctaaaagccttaaattatactatccctcgaaaccaatttcggttaatccttaaccggtcctctagttgggtatttaagcccttttgtctttttaaccgtttttctctctgccgccgtcgccgtcaccagagttactcatcgtggtttgtcaaacgctagcgaggctcatgtatcggacgatcatgccttcgaattctacgtttaaagacctctgtctagatttaggggttttgcttctagggtttatcgttatctgaggtttttctgtgtaccgtatgttcggtcacgttttctccagaagaacgagcttcctggtacgttgctttcacgttgctaagaaattctcgaatcctgagccggaagatattctctttagtgctctctgtttgaatttaagacagagaagatggaacactcttcatcaattctcctcgagtctcacaaatccgttgataagtcgagttcttcgcgagtttcgaagctcgccgaagttagctctagagttctacaattgggttttaaggagtaacactgtggctaagtctgagaatcgattcgaagcctcttgtgtgatgattcatttgctggttggttcgagaagatttgatgatgctttatcaataatggcgaatttgatgtctgtagaaggtgaaaagttgagtcctttacatgttttgtcgggtttgattcgaagttaccaagcttgtggttcgagtcctgatgtgtttgattcattggttagagcttgtacacagaatggtgatgcgcaaggagcttatgaagtgattgagcagacgagagcagaaggtttttgtgtttctgttcatgcgttgaataattttatgggttgtttattgaatgtgaatgagattgataggttttggaaggtttacaaggaaatggattctttagggtatgttgagaatgtgaatacatttaatctggttatatattcgttttgtaaggagagtaagttgtttgaagcgttatctgtgttttaccggatgttgaaatgtggggtttggcctaatgttgttagctttaatatgatgattgatggagcttgtaagacgggtgatatgagatttgccttgcagcttttagggaagatgggaatgatgtctggaaactttgtttcacctaatgctgtgacgtacaattctgttatcaacgggttttgcaaggccgggagattggatttggcggaaagaatccgtggtgacatggtcaaatcaggtgttgattgcaatgaaagaacctatggagctttggtggatgcgtatggtagagctggaagctcagatgaagccttaaggttgtgtgatgagatgacgagtaagggacttgtggtaaatacagttatctataactctattgtttattggctgtttatggaaggtgacatagaaggagctatgtctgtgttgcgtgatatgaatagtaaaaatatgcaaattgatcgatttactcaagccattgttgtcagaggtctatgcagaaacggatatgtaaaggaagctgttgagtttcagagacagatttcagagaagaagctcgtggaagatatagtttgtcacaacacgcttatgcaccattttgtaagggataaaaagctggcgtgtgctgatcagattctagggagtatgttggttcaaggtttgagtctcgatgcgatttcgtttggtactttgattgatggatacctaaaggaaggtaagttggaaagagctctcgagatatatgatggtatgatcaagatgaataaaacatcgaatcttgtgatttacaattcaattgtgaatggattaagtaaaagaggaatggctggtgcagctgaagcagttgtgaacgctatggaaatcaaggacattgtaacttacaacacgctgttgaacgagtctctcaaaaccgggaatgtcgaagaagctgacgatatcttatctaaaatgcagaaacaggacggtgagaaatcggttagtcttgtgactttcaacattatgatcaatcacttatgcaagtttggttcttatgagaaagcgaaggaagttttgaagtttatggttgaaagaggtgttgttccggattctataacatatggaactttgattacatcgtttagtaagcatcgcagtcaagaaaaagtcgttgagcttcatgattacttgattcttcaaggagttacacctcatgaacatatatatctatctatagttcgtcctcttcttgatagagaaaatggaaggccttagtcaacaaagccaatgaaagcttgtttcagttttaggaagaaactactgaactgtccagagggtttgttttggaggtacggtacggatcagattcgtatcctgttcgtacacgtggacccttggacgattctttgtaatcaacggtcagtgttggaaacaggatcgcttgacgtggacctgtaaagcggggattgtctgacacgtggcgctaatgcaccggccaaacaatttggttgtcacgagctattacgatactttccacgtgatttgtttaagattagccgtccagattatgtaatgttggtagacaccgtaaggaatataatctgagaagcagacgaatattattttccacattatacaaacaaatggctgcgtgtgagagactgcgattgtaaaatctggtgttgttattttgctagatgtcaacaaatcagagcaccattggtttaatttcatgaataaaagccactgttatgataaatataataatattaatcaacacatgtattctctgaataaattggaataaaataatgaatgagatgagtttcagacttcggtgattgagaagtgtggtgtggtgaggcagtggagtcagggggctgcttcaacaacaaacattctctctctcttgtctaagcaaagcaacccatataagatatatacctgaagtacacgaccactttctttctccatctcgtctctctttctgtcttcttctttcttcggcagctatg

SEQ ID NO: 32214 - DNA, 3003 bp, Unknown; identical to SEQ ID NO: 21624
  misc_feature (1)..( 3003): 2750-1469P.txt file - cDNA_ID_3050138; gDNA_ID_1621136; Annot_ID_172667

SEQ ID NO: 32215 - DNA, 3003 bp, Unknown
  misc_feature (1)..( 3003): 2750-1469P.txt file - cDNA_ID_3050197; gDNA_ID_1621137; Annot_ID_172718
agacctccgcctggtggcaattgtctttcaggaatttaatatccttgtacgacttcgtcttgcagggttaatctctcaagcagcaaagctaggtgcacaaggtgtgccctcattccggtcattttcttttgaagagttaaaggaagccacagacgatttcgattcatcacgtttcttagctttggaattatgcaggaaaatggctaaaacagagggcgatgtgtacaactttggattcatacttctggaatctctgataggaccagtacctactacaaaaaggagaggcctatcttctcaacgaaatggtatcatatagggtaaagaaaagaagcaaatcttcatcattgttaatagctgttgctgcaatgttgtatttgcagacgtcatttgggagccaagactgtcgacagaaaataggaagtccaacggtcctaacaacaagctcgcaggagtctttacccaattgccatctcaatcgccaataaatgtgttttgcttgaaccttctgcaagacttcctttaaagatgttctctggaacttaccatatgcagctcaaatgcagtctgccgcagacgctgaacgcaaatctgataagtcgtcgtgaatccaaaggctaacctgatgattgatagttgttttcggatttataaatgttatgttttataagtttggtttttcagtagaaaaatgtaatactctagcggctaaaaaacatagtttcttgtctctcttgaaactttattcgtttaacaaatattgattgaagaagatgttgagttttgtagttggcgagaacttctcaatcttcaagaacaaggtactgaggcaggagacttgtcaaatgttcttggagaattttgtctttgaattgcagaatcgatcccaaatattttattattataaaagctacaagaatacagtttctaatacatgtattagcaaaaaagtaacagtaaaaccaagggctacacacttttcttaaacaggaactttggagtccactgatttgagaacctcctcacccatttccttgcatcccaccagtttctgcattttcaaaacacaaaaagacttctttaagtatattgtcattaacttatacaaaacaaaagacagaaatcatcatacacatacatttccgggggagtagatgtctccggttctgaaacctttgttcagagcatccacgaccgcgtcttcaatcatctttgcagccttttcttctccaagtccatacttgagaagcatcgccgcactgagaatggtggccaatgggtttgccttgtcttgtccagctatatctggtgctgaaccatgtataggttcaaagagtccaggtccctagttttcatcacaagtttaacaatcaatatatgataataataaacagaggaaccttgaaatattagatttagtcttacttaccgattcaccaagacttgcagatggaagcatcccaatgctaccagtgatcattgaagcttcatcagacaatatatcaccaaaaatgttattggtgacgattgtgtcaaactgcaataatgtttttaaaaatgccgtgagtactacaagttccacttctgtgttagcttaatcaacggctaagctttatatatgcgcgaagatcacctgtttcgggtcacggacaagctgcatcgcagcattatcgacatacatatgtgatagttcaacatctggatattcagaggctaaagctgttactcttttcctccacaatattgatgcctatacgaaacaaaacaaaaaaataattgtataacgaaaaacacacaagagtggagtggaaaaacaattcaaaacatacatccaagacattggctttgtcaacagaacacagcttgccacgccttttcctagcagtctcgaatgcaacacgagcaattctgtcaatctgaagaagataaagcaatgcattaatacacatacattgtcacagagcagcagattgtgaagagtaagtagtacctcgtgagcagcgtagatctctgtattaaaaccgacttcttcgccattttcgttgatcgtaatgcctcttggctctccaaagtaaatacctccagtgagctcccttacaatcatcatatcaacaccttgtgctacttctttcttcagtgtggaagcatcaactagctgaacaagcaaaaacagaaaaatttgagtatatttacaactagaaagcaaagtgataagcaaatcaatacctgtggtaaaactgtagcaggtctcaaattagcaaagacattgagatctcttcgaatgttaagcagacccatctcaggtctcagatgtttctcattcttgtcccatttgtacctgaacaaaaaatcatcataaagagaataaatttgctgaagaaacaacacacacacgcattacacataccctccgatagctccaagaagaatggcatcagactgtttagcagcagtggaagtttcctccggcaatggaactccgaccaaatccaaagctgctccgccgaaaggcatctcctggaaatcaaactctagtccttggagaaatccagctttctgaagcacattcttagcaacagatataacttctggaccgataccatcgccgggaagcagagtgatgttataccgttttttcaccggtgaagcggcggcgcacctaattcgatacggcgcacgaaacttatgatcggtgagagaactgtatcttcccggtatgatctccagacggatgttagtttgcaaaaacgccgccatctttttttcgagtttagggcaccaccatcggcaaaaactaaccatttgagtatactacagagaccggttatctctggttatttgttaacctgattttggttcaatgttctcattaatttcaattttaagttctatcagctttttggactctctcatgtccaccatccgttcacttggccgcgttcatataaaccaaaaaccgaacaacaacaaaaattcgaaaattctccggcgacaccaacaatg

SEQ ID NO: 32216 - DNA, 3003 bp, Unknown
  misc_feature (1)..( 3003): 2750-1469P.txt file - cDNA_ID_3050201; gDNA_ID_1621137; Annot_ID_172716
tagaagctgaagctgccagcatgatctggtaatcgctacatacgacatacacacatcactaaacttctttataatttatgcacacacatacagctcttaatggccacaactcaaagttataattagtgcatgatctctagttatttgactgcttttaatatatgtttatggattcacgcatgtgtgtgtatgtacataatttacatgcatgcactttgtgtatggtacacatcaatttgaacccgttcaaaattctgtttttattagtatatatatagatgtatgtggtgtgtgtgtcagtgtgtgtgtgtgtttatagatagtagtactaggtcatcctgcagcttcagtcactaaatcaccaacaatgcaaaaaagatataaacacttcatttcatgagaaaggcgtttccgccttaacttttacgatccctctatcaccattggagaggtaacgatacatttacttgtcattttcttaattttacttcctatagtaaatccaatccaattatgtgttattttcaaagtatcacatcttcattctccgaaatatacgcatatatgtcttagttactgtgtataatcaatatgtccacaagttcatgtttgttggtagctagcgacgcgtttacatgtgcctatgtgtttctttctcttgacctattatacttagatctattattaaataaacatatatcttgtgacaaagaaaaaaaagaagcgtattagtttagtgacaagacccatgatattaacaacaatttatcttatattggagacttaggaaatatttcaataaaatatatataagttattaatgaacttaaatacaattggcttgttacacatcactctaatccatgtgatagatgttctacaaaatatacgtttttattttaacatggaatcttatgattgctttattgtacatacaatgagagctaatagatcaaacttgtttgaatgtaaataatttggaatcttttttgtggggatatagagttgggttttataatctcctcgagttagaaacaagcattattggttttagatacatctaagattaatcttgcatactattgccatttttttggctgattgttactcatatatagttcgaccagagaaaaatcaacgtctacacttttcatgtacaactgactacggctcaagccttctctaatatagattgtgccatatgcaaatgtaaccaatcatcgacattgagattctctgctttgatcagcaacttctgtttgttttaaagattcttaattgaaggattcataatggaatttttttttaagatcgtgaagattatacttccttatagtttggttttaaagatgtaaaatttatttcatatggtttctgatgtcttttgatcatttgtaagtatattagttgtttgtgcaaacaatattactagttccatgcatcgatacatatttgattaagaacattcgccaaatggtcaatacaatggggtatcagatcaaagatacaaaccaaattaagacccttggaatctgtaacaaatatggtgctggagatagatatcacaattcataataattaattataggatttataatcaccattttaatattgatgtatcaattaatggaaacaattgcacggacctacttgcagtatatgcaaaatgaaattggtttgagctatgttttggtattaacttgctttgtaacgtttgaatctttttttctaaatatattcacattttaatataacattgtacaattacagatgtatgagaactataatatctaaacaaagccatgattaatgacaaataataaattttcgaaagtgaatatattattatagaacttaattatttatttaaaaagtaaaaactaatcataactcatgaagtaaaaaaatagttggtctagccaattgcaaagtagtcacatataaccacttcggttaagacattggcaaagatcaaaaagtcacaaacatacttttttctctggttgactaaatcgtcgaaccaccacatgtaattaatttgacttaaactaacaattaaaaagtaaaaataaaaagaatagtggtattttactgatgggaggacatttttccaacgattattttgtttcacgagaaaatgactatgtacgaaatcttcatatatgtgagaaatcggttttagtcaactcacgacttgggccagatttggaagtttaattctttagaacattttcaacgggagttctcttgaataattagatggattctcttgaattagtagaataaaaataaatataaacggattaaaaaacagagaactagctctctcaaaagagtttcgacttttgagtaagtgatagaaccggacatgtgtcaaatagataaaataatacatgacgtaaaaaacaaaaacaaaaaatgtattaggaaaatagttaccttacttttaatttacttatctatatgtcgtgatttctggttggttgccttcagagacgaggacatgagaaatgagacctctgtaaatactgctactagtttgtataaaaccaaaacactaaagattgtagcatcaagttgtattgtaagcgtcactctgaatttgttattgtaaagaaaacattctacgcagacaatatcagatcaaataacatcattgtctaagcaaatcacttatttttattttttttaattggaaattaagaatcatctcttttaattttagtgtctcaaattttaaactacattttctaccggttgtcattatttcttatgttttgcatatatttttcttatgttttgctcatttatgtatattttgctagttgaattttttgttcaaaatttccagtatttataacatattcaattttaaatttagcattaattttttaataaatttaatttgatattttgaatttgtttaattattttgtttttatataatgatataatgtgtgttaaaaaagtgggtttgactctattaacaaagagataaatatg

SEQ ID NO: 32217 - DNA, 3000 bp, Unknown; identical to SEQ ID NO: 7283
  misc_feature (1)..( 3000): 2750-1469P.txt file - cDNA_ID_3050205; gDNA_ID_1621137; Annot_ID_172708

SEQ ID NO: 32218 - DNA, 3003 bp, Unknown
  misc_feature (1)..( 3003): 2750-1469P.txt file - cDNA_ID_3050221; gDNA_ID_1621139; Annot_ID_172775
acttctaatgtgtttattcatttattccatgttattattattttctatatagctagagatcaatgttattaactataaccacaaatacatctgatcacttgtttaaaattaaacagttgcatttagattatacgatactcgtgagactggattcattgaaccggaggaggtacgtatgtaaactttgtctcaaaaaaaagaaaaagtcatgattaattatatttgacggttttcctcgacttggagaaatctataggtgaaagagatgataatagacgttctagaggaatcagaacttatgctatccgagagtatcattgattctatcgtgtctaaggtgtgtataacgcttaagtttatgagcttgatttaacattatagtgattttacttactatttttgtttacttatatttggcaaagacatttgaagaggccgattggaaaaaagatgggataatagatttggaagaatgggagaattttgttgccacctatcctttgacactaaagaacatgactatccctttcttgaagtaattcgtttgtttgtttttcctaaccattttcttaatattcgctgataaattgcatgttttagatacatctttcgttttacaaaaaaagtaatatatatacatctttcaaaaacagcttttatatatgtgtgtttatgcatatattactattatcttcttttattttatttttcttgttttataaatcgagataattattctaaaattaacttttattgtacagggacattccgaggattttcccaacctttctccggtaaaatcagatgaggtgtttgctagaggtttttgtttaaaaatatttttatccgaaaatcacataggtaatttgttataagaaatatagaaggttaattattatataaacatattaactatcgaaagaaatctttaatatttaacgaggatagaaagtaattgtttttaaccacaaagctaaagctgtgatatgaaaacttaaaagcaaagatcggttcgtgaagacaaaatggggttttggaaaaggaaaagaggaaaaagaaaaagaacaaacgtgtgaaaattcgagaaaaatggtaacacaaaaagaaattggacatgatataagttgccaaaaccaaagagaaaaaattgacatgatataccaatcaaatttttgaatcaggtcaactaatcaaattcacaacaatcatccacaatattatttagatttgacgctttcactgtttcacatgaaaattttacatttgacgcgatgacttgtggagtcacgatcattttagtcactcgttttaaacggatgcttcattcaaaaaatgtaacttatattcagaagactcctaacgtccgattcagatttacaaaaaaacaatatcattgaatcggaaaacagaaaagcatagtaatattctaagtatttaattataatcgtgaggaaatagttccgtaataatgggggaaaaatatatatatgataaaaccaaaatgagatttgcctgaagatgccatatgtctgatcaaacactctgagctgttgtgtcgatgaactcaccatatgccaagatacgctattagcgacaacacatttgtattgtcaaatgtcattaattaacatccacaggtccaacaacagagaaacaaaataattatcacaagtaaaatataaaattagtaatatacttgtacttataatttttggcttatgccttttaatttattttaacactagactcgacgaaactcatcactaacatgaccacaaaaaaaaaagattacaattctaaaacacaaagattaaaaaagaaaacataacgaagtaaaattaagactagacatcaactttacaagttgaaggagcgagaagaggaacttgtccgttagaagatggattaaatctcaaccacacatcacatctggcgtaaaatccataccgtccagtcttaatcgcaccagctttccaacgtagcctcccaaaaatcaccactctcatcaaaacgacgccgtaagcttcatcattttttaaaccattagctacttccggcgagactggtataccgttgcctcccatcaccggagctatcacaaccgtagatttatgtcctaaacgaagcggtggtagtggaagcggcggtgttatgatctgatctttgtacgttacgtacatagagagcttgtcgtagtgaatggagactctccggttagggtttcttgctaaaacgctgaactgaacggaggttgagattaacggcggcgctgtgaaattcaggtcgtagatggcggctccgacgacggtgagacgtggtttatgtggacggtagacgagccaaaggattaaggctatgatacctagtatgacaaggatggtgaagatcgcgccgcagattgcgcggcgagcatctccaccgcctcctccgccttctttagagtaagattctggcgttgaagaagcggagggagcgttcttgtgatctgctttggctgcgtgctctgcttttgcttctccttctcccatggctatactctacagatataagtgttaaagtgtgtatgtataggtatgtgtgtgtctatacgagaatcagagggttcggtgaagagtgaagactctaaagaaggaggaggagaagaaagaagataagtagatgcaaggttttgtctcttttctagttaataagagtaaacagtcttctagagtacagttttattaattgtttattaacttagaaagcttgtagttgtaattatgtgttaaagctaatctttttataaagtagccgtaaattactactgtttttacattgtgattttattttgttataatacttaatgtaataatataagatagagaagtactttcgaaagactccaaatctcggtgcaaccgttcacgtgacggatctgatgagtgatgaattttttaaaaatgaaaaatccaatgtaacgtgtatacatatggctatacataatcaaatactttgttgtcaatg

SEQ ID NO: 32219 - DNA, 3000 bp, Unknown; identical to SEQ ID NO: 7318
  misc_feature (1)..( 3000): 2750-1469P.txt file - cDNA_ID_3050248; gDNA_ID_1621140; Annot_ID_172800

SEQ ID NO: 32220 - DNA, 3003 bp, Unknown
  misc_feature (1)..( 3003): 2750-1469P.txt file - cDNA_ID_3050256; gDNA_ID_1621140; Annot_ID_56607
ctgagaaaaagatcttcctttattatgcttaggcacatcaagattattgatacttgatatgagaagcatggattcctccttcaatggtacgcttgtaggacttttttttttgcaccacgcttgtagaacgtaactccactgtcagatgcagtctcgattaagtatcatgttggaatgtatgctaccaatgaggttttggatcttgatatgccaagagcttaagacgtaactgatatgcatcttaaaaagctcagacgttatctcactagtgtattgttagttttgcaggactttgtttcagaacgtgccaaccttttcccttttgtcagaatattgtcatgattctgcatattttcatagactgacatattcaataacaaaatcaagctttgtctggatccctattgatcgtgattttttttcaattttattgtttttgtgtgagttttttcagcggctctcagcactatgcttcagacatccctttactatattttatcatgtgtactaatgcagaactaagcctttataagtgcgagacaagaaggaaagaggcccgccggttcaagacacaaacattataaaacagagcggctactaatcttaaccataatcagaagaacctgtacgttgttacctttctctctctctttttcttggtactttaaccaaaaaaatgagagaattaggacccagtatttacattttctgtttcaaaacttttagatgagaaataagagatgatggttctagttttgcttgcttgaatatgaaaaaagattacttgcttccttgtgtcagtttcctttaacacaagaatcctacttaaacttctcaccaagtaatcatctctctcatttggaaacactcaaaattttctctcttcattgctttcacttaactcttttctcctttagttgtacttcaatgtctcaccaccactatgaaaccaaccctcatttcgttcaattttccttgcaggatcaacatcaaggtggtccttctagctcatggaactctccgcaccatcaccagatcccacaggctcactcagttgctccacccagggtgaaaataaagactcggggacgccaccagactgagccacctgaaacaatccatgaatcgccttcctcaagacccttgccactgagaccggaggaaccattaccaccacgccataatccaaactctgccaggccattgcaattgagccctgaggagcaacgacctccacaccgtggctatggatctgaaccaactccatggagaagagctccaacacgaccagcttatcagcaaggcccaaagaggaccaaacccatgacattgccagccacaatctgctgtgcaattctcctgatcgtcctaattttatcaggtctcattctcctcttagtctacctcgccaaccgtccacgctcaccatacttcgacatctcagcagcaaccctaaacaccgccaatctggacatgggatatgttctaaatggagatctcgcggttgtggtaaacttcacaaatccaagcaagaaaagcagtgtggacttcagctacgtgatgttcgagctctacttctacaacacactcatagcgactgaacacatcgagccattcattgtaccaaagggaatgtcaatgttcacaagcttccatctcgtcagcagtcaggtacaaattcagatgattcagagtcaggacttgcagctgcagctcggaactggtccagtgttgttgaatttgagaggaacgtttcacgctcgctcgaaccttgggtcgttgatgagatactcttattggttgcacacacagtgcagcatctctttaaatacccctcctgcagggaccatgcgagcaagaagatgcaatacaaaacgctagcgatttgcagcatttctgactgaatacattgcttcttttcttgatgcgtttgatgataatataggcaaatagatagtttttgtatttttctgctacttttagaaataacaaaatgacaaaggggaaaatgcatttgattttgtatttcgaattatagaattgatcttaaattgtatgtaatttgattataatattagagatgaagatatattatctaaaaatccataattattcattttgattataatgttctagctagctttaataatgtagaaataagatcttatattacttttgtaaaagtgaaatatgtgcgaataaagtgtttaactttgtgcatgttacacgaaaagaaaaaggatatatcccctaaaacagtcattactgagaaatatcataagaacaaaaatttcttgaaaattattgcaatcctagattaacatttgtcaacaatcaacatgcaacttgtatattacatgttttaaaactaaattacgaatacataacactaaaccatataattttattttatttcaaactactaaaatttactatgtttaaaaaaaaaacttaaagacaatatttctatgaaattaataaaaatgtatcataatattgatttattatcatgtttatttcagtacaaaccacagataagaaaaagtgatcggcccattaaattgatagcccaatatgattttacagtttatggcccatatttgtggtttgcccggagctcaagaaacgatctctttcttcttcttctcgtcgtcgtttgtcactttagagctacttcttcttcttctctgctaagcctttcctctcgacttgatacttttctccagtaaggtacgtttccgatccttaatcgagctctagtatcattgatttggctatgttaatgaagatgagggtttagggttcttatacagacaccaatgtatctcgtgctagatctgatttgaagttatgagagaaaaactctttgattgacatctgattttggtttatctccttctggatcagcttatttttattgtagcttctctgattttcgatgggtacttatattttttttttcaatttgggatttttcatgattctgtagggtttgcaaagatg

SEQ ID NO: 32221 - DNA, 3003 bp, Unknown; identical to SEQ ID NO: 32220
  misc_feature (1)..( 3003): 2750-1469P.txt file - cDNA_ID_3050256; gDNA_ID_1621140; Annot_ID_172788

SEQ ID NO: 32222 - DNA, 3003 bp, Unknown; identical to SEQ ID NO: 18434
  misc_feature (1)..( 3003): 2750-1469P.txt file - cDNA_ID_3050285; gDNA_ID_1621141; Annot_ID_172834

SEQ ID NO: 32223 - DNA, 3003 bp, Unknown; identical to SEQ ID NO: 27664
  misc_feature (1)..( 3003): 2750-1469P.txt file - cDNA_ID_3050325; gDNA_ID_1621142; Annot_ID_172885

SEQ ID NO: 32224 - DNA, 3000 bp, Unknown; identical to SEQ ID NO: 7368
  misc_feature (1)..( 3000): 2750-1469P.txt file - cDNA_ID_3050341; gDNA_ID_1621142; Annot_ID_172871

SEQ ID NO: 32225 - DNA, 3003 bp, Unknown; identical to SEQ ID NO: 18445
  misc_feature (1)..( 3003): 2750-1469P.txt file - cDNA_ID_3050343; gDNA_ID_1621142; Annot_ID_172865

SEQ ID NO: 32226 - DNA, 3000 bp, Unknown
  misc_feature (1)..( 3000): 2750-1469P.txt file - cDNA_ID_3050347; gDNA_ID_1621142; Annot_ID_172864
aaagcaaagaataagattaaaaaaaacacatagttgagtctcgaaaattcagtaatatacagtgacatataacaagagggcacaaggatcaaatacctgtggtcgcgtggactgttgtcatcaagccttcaagaataccaaattcctcatgcaccacctgccagatacaagtgcttaagggccatagacaactttatttgactttaatgaagctcttcataatgagctatatacaggacaaaaatgcaatgctacaaaccttggcaagaggtgcaagacaattggtggtacaacttgcattggagactatatccatgttaggcaggtatgtcttttcatttactccaacaacaaacatgggcgcgtccgctgaaggtgcagaaatgatgaccttcttagcaccaccctgcacagacaatgaaaggtcaagaaaatcatagaccattttaggagttgaatgtttggaattattaataatataaggcttggtattaaatgttagcatcaatgaaactagtagatcaacaagcgtgttcaaatgaaagtgcataccttcaaatgtgatgaagcttgtccaacggtggtgaatacccctgaagactcaacaacatactcagctccaagatcagcccacgggatttcagctgggtctctgaggaagaacaattaagatgttagactctaaaaaaggataagcataaaaccctaccaataggatattagtggaaattgattcataatttgaccatactagacagatacacatgagtcaacattttgaggcaatacctcttgctgacaactttgacttgttttccattgatctccaaagttgaatcatcaattacattgatagttcctttgtaatttccatgagtagaatcatacttgaacatgtaagcctgcataagaggaggagagaagatttggtttaagtttgatatattatcccatgcctttaagtatgattaatattacgtgttcaagcacgtggatcagttactatgagtaaggaaaactaaatgggaaaagagtatgagcaacagttataagatattcctggcgaaaaatacattagaaactagtaagagcaaaaacggcattgtaagttgcatctactacttaccatgtacttggcatctatgaatggatcgttgactgctacaacctcgatatcatccctaaaggttgcgatgcggaggaccaatcttccaattcgaccaaaacctgtctcgcacatataaaatacagtcatcaataagaaatgaaaaggtagaggactagaagcaagtcagacggaataaactatctgatgatgttgaatttcaaaatgaatccagcaatggaaacaaaaaataccgttgatcccaacctttgtctttccactgctccttgaccctatacaagtcaatcaaatcgaagttactgtcagaatgcagcaacaaacacaagtaagaacatcaattaaatttgtcttcttactatgaacagcaggaggtgcttccgtagctgtggccttgatgggttgaaccctcttcgcattgtattttctgtacatttgaacattaaaacattgttgagaaccaaaagaaagcatcgtaaaagatttacatgtactacagagtttgtcacataactgtaaagttgaagattacccggttgaaactgcagcaccagaaaatctagacgaggtcaggctatgactgaatccaagacttgacgtgacctgatcatttgagacaaaacatataataaactcactgaaactttaatgctgcctatcatcgattcagatgctcatcagttaactcaggccaaacgactaggaattcaatatttcaactacatgtgaggactcaagtagagaagatagcgatactatagaaacaccaagttgactttacactgagaaattgaaaccagaaccaaagacaaaacatcacctcctactatctagtatctaccaaaactccaagcgagctaaaacatattaaatggaacacaaacgcaagagtgagaaacgaaaacgtttaatacctgagaatgattgtacgatgacgatggataaagctcgacacgaggagctgcggcggaagtggcggcagatctgaggagagaagataaggccattgctaagctaccagaaacagagagatctcgccgccaaaaatcctaaccccttccgctgaatggcttttgagtgtagctctggagccacgaaaatgttcgtttgagtaaaaaaatgagacaaatgcaaattgcaattgcaatttctcatgtaaaatatgcttacgattctgcaaagacgatgactgtgttctgatgcgtcgcggcccatcgtaactacttttgcgatgagatctaagggttgagatttcacggaggaaaactacaaagccgcgtgtaccggatcggcgtcaaggcccatgatttggtgggcctttggtcatatttgaataacgttgacgtatcttttgttgtttattgagttttgccacgcgaaaataaaatgggcctgatttagtttgacacgtgtcaagtccagctggctctccctctaaaaatggcttctgtactgttaaaacttaaacgacgacgaggctgagccagctccgatatgccaggtggcattttcttcgaaagaatcgtgctgtttctgcagttggctcgtctcacagtcccctctgtgtgattaatttgcttttttggctctcccgtcaaaaatggcgaaccgtcgaattctctgtatctcttgaatttcccagagattaatttgaatcttcatcatcttcttctctctggattcgccgagaaaccttcttcctctgcttctctcgtcgatattctcttccttcccgcttaagccttcggctaggtctgatatttcgattttcttctttacatttggcaaacatgttacttatggatgttgttaacgatgtgttctaaataagcttctgtttcctcttgtttttcgtttgtttctgatagatatcaatg

SEQ ID NO: 32227 - DNA, 3000 bp, Unknown; identical to SEQ ID NO: 7355
  misc_feature (1)..( 3000): 2750-1469P.txt file - cDNA_ID_3050355; gDNA_ID_1621142; Annot_ID_56647

SEQ ID NO: 32228 - DNA, 3000 bp, Unknown; identical to SEQ ID NO: 7355
  misc_feature (1)..( 3000): 2750-1469P.txt file - cDNA_ID_3050355; gDNA_ID_1621142; Annot_ID_172859

SEQ ID NO: 32229 - DNA, 3000 bp, Unknown; identical to SEQ ID NO: 7405
  misc_feature (1)..( 3000): 2750-1469P.txt file - cDNA_ID_3050385; gDNA_ID_1621143; Annot_ID_172924

SEQ ID NO: 32230 - DNA, 3000 bp, Unknown; identical to SEQ ID NO: 7416
  misc_feature (1)..( 3000): 2750-1469P.txt file - cDNA_ID_3050424; gDNA_ID_1621144; Annot_ID_172964

SEQ ID NO: 32231 - DNA, 3000 bp, Unknown; identical to SEQ ID NO: 7424
  misc_feature (1)..( 3000): 2750-1469P.txt file - cDNA_ID_3050428; gDNA_ID_1621144; Annot_ID_172961

SEQ ID NO: 32232 - DNA, 3000 bp, Unknown; identical to SEQ ID NO: 7425
  misc_feature (1)..( 3000): 2750-1469P.txt file - cDNA_ID_3050432; gDNA_ID_1621144; Annot_ID_172959

SEQ ID NO: 32233 - DNA, 3003 bp, Unknown
  misc_feature (1)..( 3003): 2750-1469P.txt file - cDNA_ID_3050452; gDNA_ID_1621145; Annot_ID_173020
cctgtaaggaccaatttcaaactgctattgagtcttaagatcgcatgaagcgtaatagaccttggttccaaatattaatatcctcgtaaaagtgaaggagcacaaaattaaaaatgaccaaattgaggaaataaatattttgatgatctcttgaagagagtgaatgatctctaaaagagacataaacatgacacatgaaacattcaagtacttgacaatgaagagatctatctagctatgtcatgtcaaaatataatggaatcaaaagcaaatcgacgtcataatatatttgcatgctatgagcagttgatattatagacaaaaaagaggatcatgaaagaaagtctattgaaaagtgtacacaaagtaatgattagccaaaaaaaaaatggaaaagaagaaatagacatataattataatctctagtagagatatttggactagtactctatgcacatgatgtgtaaaaccagtggaaaataaatgagtctttatgtgaaagaatagtgaaattaatgagattttcacaaagataagaaatgtattatgaagagatatattctcttgtggtggatgtaatattttttaagtatctaaagtctggcaataagagacggaacactggatatgacatttatatgaaattcttgaaagatataatctctgaaggattaatgatatgagaattatgttctctagaactctactcgatcgaataaaaagaaatatgtaacatgacatataatcatataaatatatatttacgttgagtttgtcaaaatatattgatcaaactaatatttgttttgaaaatcattaaaactcctatagagttatcataagtaatacgatgacaataatctatgataaaatatcactagataatgatatttataagtctatatgaaaaccatataattttgatcattaagattatggttattcattccaacgagatattgtatttgattgaaaatcatctcctgaagaagatgtttccgagggggagattgaatgatatgcgtggatgtaccctttttccttatcatagtttttatcccacatgatttttctatgacaaggtttttaacgagacattaaagaacacgcaaataatacacttgatgaatattaggaaattctatcaatcatccaaatgaatattatacactaatgatatttagagaaataaataagatggtcaagatgaatcatctaaaagatgatatgtatatttttcataagaaactattccaaatcaaaatcgtatacttactataattctacatatacatcccatctacgagattttatatgtatatgtgaatataatataattaagtagatattatatatcaattgattaatactgaaacatgttgacctgaataaattaatcaaatacacagcaaaacaactatggttaaaaaatacccattatcatcaatgaaggcgtgaacgtgtaacgaaataaaagtcatcgatttcgtttgtggataaccatatcaattatttatttgtactcgtactcaaataaccattaacaaaagcgaatagagacatatatgttctctatcatatcaatttaattagtatttatttgtatctaatgtacagaaacgagttctagtcatcaattaagaaattcactaaatcttaacatcgtaatctaattatgataaacgaacaagttcaagtgaattgtataattttgtttttctatgctttactaattagatttcataaatttaaacaagttaaaaacaaattacaattattcatctatatcaaaatatggatttaactagagtcaaattcagtattaaaaacatagactttgatactattgaaaggaatttgtactgttttataacgatttataaatactaacaacaaattcaattgcaaggaactgtgtaaataaagaattaaatctagatcataggatttgaatatacctggatattatgcagcggaaatatgaatcatgttaattcgagattggtttagcactccaagaattgtgcctctactggtatccacacgcatacaaactggatcaaacccagaatgctagttcctttgagatctaatctcaaaacttagaaaaacaatatttctctttgtttttatgagttgaagataatttatcaaattttcagagaacataaccgtaataacggtaaccgtggtcatgcctacatttaaaacatattaatcatgccaaaatagacataccatcatcagtcgttaaaacaatttgataaattatcttcgactttctttctcttctctctcttaatccttcagagagagaatgtctccgatggttgtttttggtggcaacgacatgtttcttcacttgcgttggctctcatatgcccaacacagttggttacctcaacgacggtgactggttttctcgtccgatttcggtggattcatctccgccgttggtcggctcccgtccggaattgtctggctcacatagtagaggtgtccggctttcgtccagcaccgtcgcgtttccacggtggcatgtggctagctttctcctatgcatcctctttcctttgtttatctgtgtttttacttttgtttgcttttaataatctcacatacatgggttggtaatgacagtgtaagtaatctagctttctactgttatgttccgatctatttcatgttgagacttaattgcagaaatcaaataagagatctgagaatgatgatgaagataagaagtggaatccgtcgcttattaatcattgccaatctgctgatgtatctttaattggagcctctttactatctaccggtgagaaacccttaagaatccatgttagatagtcctatcatcagtgattctgtcaccggaactgaagctccaacggtggaggttgaagtcggtttgcttaagattgctcatctgacacgtggttatgtcgacgtgtgtttcaggattgagtcaaatccagttttcttcttctgtgagcaagatg

SEQ ID NO: 32234 - DNA, 3000 bp, Unknown
  misc_feature (1)..( 3000): 2750-1469P.txt file - cDNA_ID_3050466; gDNA_ID_2926138; Annot_ID_197321
taagagtttctcattacaactatagagtatagtcctttgacctgagttcgtcatgatttcttattcatggattagttcgctttgactctgtcaaacgtcagccgtaaaaggtgattataaagacagtgattgggcgcgttatgaattgtttaaggaacatggatggaacaagatgggatttgttcctcccatataacgggagataaatatctttgggcctatcaaaaatttgatactgaaaaatgcgtggctgcactcaaacgaggtgaatgtcagtcgtttgttttatcagtataaatcgaagttcgataaacatgatctagccgaataaggatgacaatttttttccttatgctgagatcgagatatagagacaaagggattatgggaataaatgattccagtacaagtgggagattgttgggaaagtcctgaaatcgtttgtactttattctaggtaaagttgtaatgtcgaggtttgacaatcacataatattaggtggttataatgttttgctagagagcgcttataatctatgagtttataattcattgctaatattatacgaacctacaggatcacacacctaaacaaattgaatcaaatataaaattgagtttaattttgattaactaatattgggttaaaagatttattatatatatatatatgatatataaattaaagtaaaagtatataatatatatatgatatatagatatacttatatttgtatttgagcacttaaataaataatgttatatatatataagatatacatatgtgcactaatactaatatgttgtttattctcgtagacaaagtcacgttgcatggattgggcttcgcccattgactttatatgcgttacgttacgtgaagctattataaaagtgatgcattatgacttttgagatcagccgttttgataaaaccctaaaaacaaagaggcaaattgtttttctaagttttgagattagatttcaaaggaactagcattccaggtttgatccagtttgtatgcatgtggataccagtagaggcacaacacttggggtgctaaaataacctcgaattaacatggttcatatttctgttgtaccatattcaggtatatacaaactttatgatctagatttaattctttgtttacatagttcctggcaattaaattcgttgttagtatttataaatcgttataaaacggtacgagttcctttcaaataatcttgcaaatgattcggccagctgaggaagaaagtatgtttggtgggtttagaaatcaattgatctgtgtttttgatgatataatgagatgtaaatttaaagagtatatataggttctacacgattaggtcaatcatatcttgatggccaagggaaatttattggtactttaactaattaggaattaatcattaatgaattttgtcaagatttaaggaagtgattatgcaatagtttttagtactacttaataatatccattttagtaagaaattaatgcaatatttgaattgttgatgaaaaatttgttcattgtcctaatgagaactaggttttaacacgcggtttaccgcgggcaatcggtttatttggttcttatactaaatatttgaataaatttgatatcctaaacttataaatataaatttctagtgattagtgaagaatcgtaatatatgatttagatattattaattattgattttgtgattgaatatagtgtttttagggatggaatgtgattatattttgatttcaaaaacgacatagattccttatttttgttgaacggtttagattgaagggaattaattttattgaatggtttagattgaatcggatcatataaagtttaggagattgttaagaccaaattacccttaatgattttgaatagcaaagaataaaatccaaatttgaaatcaaaattgaggccaaattagacaaaatttcaatttgtacttcccttttaataataaagggatatcttgtttcattaaatttgtaaggactaaacatataattaggaagttgactaaggatttttcaacccagaatacttactaaaaatgtatatatggataactaaatttaaatacatctttcttcaatatattttcttattttacatttttataaaaaaaaattaatataagaatcgtaaattttaaaaatatcattcaatgagataggtattgtgattaaatggctatcgtacttaaagatgaagtactaataaatttggagagattaataatcaattattttatttttttacaaatttaataaaatagaaatttatatgtagatactttttatattatttagtgacaaaatatttagaaaactttctatattttcaaatcttctttaattttcatatattgttttttccattttacaaaaaatctaaaaaatagaagataataataatttcataaatgaagtcattatcctaataaagttttcgatctactaattctctattgagaatctctaaaatccagtattttggtgtcccttgacactaggggtggtgtcgattgacacctacgcaaatttacgtctccaaattgcttttgcatcataagttctctgttttgatccagaatgttccataatctcaaaatgcatcccaaacatgtaaagacctgaaaaagactataaaagagtctagaaataacaaaaaaactctaaaaaccagtatttttatgcccggtccgaccggttgaaccgtgacccgaacatttttttggtttgggtttagtgctaaaacctgacaagttcaaaaccgtaaaaacccacaaaaactcaccattaacccgtgactcggttaaaccggacgggtgtgggttttaaaaattctcttgattttggaataaaatatgagatttaagactttattcaatcatttgtagaaatgttttcagttcttaaactcatttgatgttttagattttgatgaagacttcacaatgccgccttaaaaaatg

SEQ ID NO: 32235 - DNA, 3000 bp, Unknown; identical to SEQ ID NO: 32234
  misc_feature (1)..( 3000): 2750-1469P.txt file - cDNA_ID_3050466; gDNA_ID_1621145; Annot_ID_173008

SEQ ID NO: 32236 - DNA, 3000 bp, Unknown
  misc_feature (1)..( 3000): 2750-1469P.txt file - cDNA_ID_3050498; gDNA_ID_1621146; Annot_ID_56739
gtacctagcgccggaatatgcatcaagtggaaaattgactgatagatccgatgtattctcattcggggttgttctcttagagcttgtaactggacggaaaccagttgaccagactcagcctctaggagaagagagtttggttgaatgggtaagaatccaactttcaaacattcttcaataatagtaagattggccctagtatacttatatagtacttataaatgaactcacaggcgcgcccgctgcttctcaaagccattgagaccggagatttaagcgaactgattgatacacggcttgaaaagcgttatgtggagcatgaagtcttcagaatgatcgagacagccgctgcatgtgttagacattctggtccaaaacgcccacgcatggttcaggtaattctgactaaccaaaagtccaaagctcccatatatagtaacaagtgatttctcacatctgaaaacttatctactcttcgaaataaggttgtgagagcattggactgcgacggagactcgggagatattagcaacggaatcaaaattgggcaaagcacaacttatgactcagggcaatacaatgaagacattatgaaattcaggaaaatggcgtttggtggtgataacagcgtagagtcaggattgtacagtggaaactactctgccaaaagctcttcagatttctcagggaatgaatctgagactcggcctttcaacaaccgacggttctgatcatacaataggtgaaagtaacagatacctctgcctcctcgttctaaagccattcttttcgtatattacatttattggtaggtgcctttagtttttgccctctaatggcgaagttccctcagaaaaaagaaagaaatagaacctagataagttgtgaaagagttatttgtatctccgttctgtgttcttaatttttgtttgagtgaagaggatagtgaagaactctgtattctgataaaaaacgttcttcttataaatttgttgattctttaaccatgattcttacaaaatatactcagaaatattatggattttatttagtacctttgatatgtagagagacgactttatacatcacaccaagagactaataagaagtttgatagcttcagcactaagttccatacccataagaagaatcaaccagaaaagaaaaaaagcacaaaagaaatgaaagtgaggaagtaataaagacatatcaagtgatttgttcttaaacaaattaagatcattagtgtcctggtcggaactcgaaggaaggacctccacgtctgatctctcctttagaatgatgatctccattttccggtagcttgaacctcactgcatgtttgatattcggtggaggtggtcctcctccgcctccgccttcgcggcctctttcacctctcttgttatcaaacccgaattctatgtcctctcctccgtctcttccagaaggtttctcaattggttcaggccgtttcatatcgaaaccaaaatccatatcacctctctccctcggctcacgctccacaggccgaatctcacggctcttcttggaagaagctttctcatgcttcggatgcttgctatgttgctgcttagccgcgcggctttcacggttacatagccttccaaagacacaagcaagagccgacaagacaaagatcacggctaggactatgaagaccgtcccaaagtttccgcttgagccagaggaagaagaaggttttgtagaagggtctggatactgtttattgtaagcgtttggatacacaacaataggctgttgcatttgttgtactccttgatctcccattttctcttctaggttttggttttttgtttggttcttaaagataaatcaagacgtgttataagaagatgttggagttgtgagattttaatttttgtggagttccttgagtagagatcaaggagggttactcagaaggtacttgtgaaacaagaaatgtgaatatgcttcattccatgtgagattaggggtaatgcattattagtagaatttttggtttgaagaagttactatttaatattgtatcatacaaaagcgacaggtaatgcaaggaataaaagactaatgcgtctgaaaccaagatttttaaaattgagagaacattctttgttgtttttctttcttttctttttataaagaaagaacactaaagatattctttgtgatgtgtaagtgcaaggaagagagttgaactttggaacaaaaatctggaataaagtgggattttgtacaatttactctttcccaataaaattcaaaagatttatggagtgggctttaccaatcattgactcctttatattcccattactcactgttttacacacaatacgttctaattatatggtttaaagttcattgacaaaaaataaaaaaattggtttaaagttttaaacaacgtagggatagggattagtaaatagtaacgcacatttttgtgttcttttcatgccatttttgttttctttcactaaactgtgtctctttaaatagttgaatgttacctgtggttgattttgatttatcttttttttcccttcactaaattgtgccttctatctacagtatctatatcaacgctagccgcaaaggattttttttcttttaagaaaatctttcattccctcactaatcctagtgggcttataggtccattaacattcctcatgtagctcttgcttgtacgtcaagaaagaagtcacaagaattgagcttcctagttttttttttctctgccgtaagtaaacgtaccctacacacttcaccttcgcttattatttcagtttcttactatattttgtctaaatcttaatccaacttttatctacggtccctgaaaccatctctttgtcttttggcatatttccctccttaagtcaactatctctttgtctctatatcatctttctctcggacactctctttggatcgtcattttctctctatcgactaaattttaagagtggaatg

SEQ ID NO: 32237 - DNA, 3000 bp, Unknown
  misc_feature (1)..( 3000): 2750-1469P.txt file - cDNA_ID_3050502; gDNA_ID_1621146; Annot_ID_173048
gtttcgttggtcgtaaacagagaatttaacgtcgttgctgtgtttctcgagggttggacctaaatctggaaaacagaagaggtttgcggcggagcagaagtcggggaggcgatccggaagagcgttttcggaggcgagtttggcgaaggtggcggaggcgacggcggtaagtggtgaagccttggagaggagaaaggctgagccgggtgattggtgatggatctgtttgttccagtaacgtactaaagacgctttgggtgtgaacggatttatctccggtgaaaaaccgccgttagttaaccgttctcctccggctataactacctgcattgttggaagttacaaaaatttcaaaaatgatcaaaagaataaacggaaacaaatccaataaaatctgaagtgaatcgattatagagaaatgaaacaaacggattcaaatgaacgatttaggtttgacttacatggtagagacgtgacaagaaaggcagaagaaaaacaaattgtttgcgcatttttgttgagagttagaggaaacattcgatggagacagagagagtgttggtgagttattatcgatgcaaatgtgtgtatatacacatttctaagttggaagttggaagttggaaccaaggcttatatagtttttaatctatgaatcaatcaataccgaaatgtcacattttactctattaaaatctctgaataaatcgtattagaaaattttgattaagaggaagagataaggaaacagctctaaagactaaaaaggactaaacgcactaaacattgcccacttaacactcatgaaaagatacattactttttgttggtagaaactgtttcttcactaactattttagtattcatacctattattcgtttattatatcaagtttgaagtttcattaccgatacgtgacaaggacaaacatataaaaatgtaagaagataaacatattaaaagacaaaggaaaccaagaagccatcagtcatgacgcaatgatgacacacatttgaagtcccatcacttcacacgacaacatttcttctccacaatcattaacaaagtgattcaagcccatctcgagttgcattttggttaaacttctatttttatatataaccccaaaatagaaagataatcattatggtcgttgatcaacagaggcttgcagttactgtttacttcactaagaatatggattttttgaaacgaggcaaagacaaagagagtaataatgtagcacaaaagccttagcgtgtatgatgacattacaaaagaaaaggtatcacgaagtcataacctaagccaaaagctctgcattcaacttttagagccatcatcactcttacatagcttagtgcaagacatcagctgatcagggtttaactcttttcttgacgctaacataaacggttacggatttgacttgtttattcttgagggcgtttctcctagtggtatttcgaggaatttgtcactcattcaacgacgtttacgagctcatactcgataagggacatgttggtgtcttctttcactttgaagctcgcaggctctgtgacttcaacacgaccccacttgtctacagctagcctcattgatcctttatacatgtcgattttcgcattgcgtagagttacagttgatccctctttcattaagtccactacacacaaaaccaaatcaagatattactagctaccctgtaacattactagaatcaagtacacaaaccgttatatgaacgttttgtttttcaaatgatttattgactgaagtaaagtaccttggtcatttcttgcggtaaagacgatcactcctgtctcgtcaccaacaatgcattcagaaatccgcaactggcgagcttgaggaccatcagcacgacctttctgtaacaccattttcgtgctgacaatcttcacattgacattgtgtccgctagtcccaggacgcagctgatcaaccttagtgaaagctggcttcttcaaccctgctttggtggaatctgccattttcaataacaagagcctgcattgacaatcaatcatttcacttcttaaccaatttaaaatagatcaaatcttctaatgcaaatgctgatttataagatttagataagattgacacaagaattagaaagcagaacaatgaaggacattccatataatcttaacaacagaaatttcatgtaaaggagatgactttcgaccgagttataacaatgaggcaaaacccgaaacaaagggaaatcgaactcaagcattaaacatagtgcatgcatcattattacaaaaagctgggcagatttgaaatcaagacaacaacacatgaacagcaatgtatgagtataagagattcaaaatcaaatatcagggatttagttttttttatcaatagcttacctttggataaatcgaaggcggagacgaacgagaaatatctgattgacgatttccaaaaacaatcgagctcggagaaagttttctcccttctcttttttctagttctggggaaatggacggtggatctttaatctctaccaaggacccaatcataatttaacacgtgtactgatcgtgcttcgttgtgcgcggtttctatggttaatctcatcgtgcctagatgatcgacttttagtactgcgttttctcaactgttgggcttattcataaagcccaatttaaagtttaggcccattaatgtcgattgtatcttcttacgtaaaaattgtacattgtaatgttcaaaaaccgaagtgttttgtgattgttctagacttctgtagttctaaaagaaatgaaacaaagatgaatcacaaaatcagcaccagatcaaaaacgattatgggccacaatttttgtgatataaacattaaaatgacaaccacaagaaaatatcaaccaatcaaagaaagccacgaaacagagtattttaaaaacagaggaaagcgaaagagataagccttttagacaaaactagtggcagactgaaaaatg

SEQ ID NO: 32238 - DNA, 3003 bp, Unknown
  misc_feature (1)..( 3003): 2750-1469P.txt file - cDNA_ID_3050534; gDNA_ID_1621146; Annot_ID_56735
tggacatggaatcggtatatcatcaaattcctagataatatccttttcaaaccaaattataattctctttttgcaaaatctttggaatgatcgcagcattgaaagtcttgggaaggataacacgacaggcattgtaacacaagttgtcttggacactgcgttgttgagagagacaactaatggactcagaatcaaaacataccaggtaaacaactaaaagcttgatcaaatctttaataaaacttcgatttggtttgatccgcatcaattttttctcttacgagcagggaggttctggttacgttcagggtattcgattcacaaacgtagagatgcaagatgttgcaaaccctatactcatcgatcagttctactgtgattcttcaactacatgttaaaaccaggtttccttataatatacaatacaaacttgtaattgtgattcttatatcgaaccaatactcagttatgttctcttcccttttttggtataaatgcagacctccgcggttaaaatcagccatataatgtaccggaacataaccaaaagtgcgaaagccatcaaatttgcgtgcagcgacacagtcccttgcagccacattgtcctcaacaatgtgaatcttgaaggcaaagacggtcaagtcgaagcgtactgtaattcagctgaaggatttgggtatggagtctactcgcacaacgacaaaggcttggaccagactcacaagtcagaggaagccgagactggccacgatgagctttgatggtgatgttcaaagtgttgttgtagtgagggatgataggtaaaatagtttaatgaagcatatggtacagtaaaatgatcttatgtttgtgttcataatcaaccataactaaggttgttgttaacagcatttgtccaccttttgtatcaaatatttttctttccccatacaaattcatgtgcaagtattttttcaacataaatttttgaacttggaagtttattgtttatgaaactgaaatacgtattgatatcggaaactaagttatatagtagatgtttagataagttagttaattgtcttagactttgggattagaggaacaagaacaacacatcacatggggactccaaaggtcgcaattgatatgaattgtttgatatgtctgtcacgtgtgaaaaactcttcctttcttcacaattatcattttctatatatatatatatatatatttgtcaaacaattattttctaattaatattcccaatttgtgtgtagctgtaaacatcaatgaccaatgccaacccattttatttactctttcaataacaactcaacaactacatcacctaagaataagatatagtcttggcttgcaatttgcctgtaatgtgaaatcaaatgatcgattatatggtataataatataatgataacatattaattccctcatatggtatgaatagtgaattggttttgtctatatccataagaatgaaaataaagaaataatttccttaaaacaaagaaataaccaaactatatgctataatggacccggagaatctaagtcgtgcgagaataatgattttgtttaccattaaaaacaaataattgttcatgctcattccatttccaaattattctgaacaaacaagatagagagagtgcaagttgtaagaagcagattttttttggtttttctctaaaaccaaactaaggagatctctaagttgtggcagagaagaaagcttctaaggtaaaatcacaaactctccactttttccaatatcttattgactcatattgcatttgctttcaagttctgataaatctctaaaaggtttatgacttttagaattactctttttgatatttaaacacattgttcatatgactatgcagatccagatcattgttttttttccagcttttgaaactaaacattcacaaatccaaccctacatcatattccttgtgacaacattgttgtttttttgttgtctatatgtttttcaagtaatacaagtatagaaaaagctttatctacaatattttcatcctgaaaagaagccaaaagcaaatttgttacaacattcttgataaaataacacgtcattagagaattaacaaagttttgaagcagagggaggaatgttcaatactagaaaattaagaccaaaaagtcaacatcacttttataagagaaaaaaacgagtacaactgtaacatttacttcgactttatctacgagagtattgaacaagtgggatgcaattgacaacctaaatcatggctcatagttacaaattatatatgactaatcattttccttttctcttaaagttgtttatagtttagacaataataataggagatgaagagaatgtgatgctactaactcttatttaaatgaggaatataaacaagatctggtcctgacattgttatgaatcttcaaactcaggacacaaaccaagatctcgtgtagaggaaaaaaaacctttcctccatgtttaagttttgagcttctggttggtttcaagtcctgtggagaaaaatgtcaccatttttgaagttctttctctttctctatgattatctttcaccttcctctttctttctggtaaatcatttcatctctctctgttttacatactcttgatgattcttgatttcacaatttatttaatcctttttttttcttggttttgtggggtttaaggtccaaagaaataccttaggagcatcattagatactacagatggggttgtgagaagtggcataattggagagattatatacatttggaagcagacaagaatctttgtctttataccaatcttgaaatgcttagtgacaatatgtttggtaatgtcccttttgttgttcatagaaagagtttatatgagcatagtagtagtgtttgtgaaattacttagacgaacacctgagaaagtacacaagtgggaacctataaacgatgatgaccttgagcttgccaatacaaactacccaatg

SEQ ID NO: 32239 - DNA, 3003 bp, Unknown; identical to SEQ ID NO: 23731
  misc_feature (1)..( 3003): 2750-1469P.txt file - cDNA_ID_3050534; gDNA_ID_1621146; Annot_ID_173026

SEQ ID NO: 32240 - DNA, 1588 bp, Unknown; identical to SEQ ID NO: 7435
  misc_feature (1)..( 1588): 2750-1469P.txt file - cDNA_ID_3050538; gDNA_ID_1621146; Annot_ID_173025

SEQ ID NO: 32241 - DNA, 3003 bp, Unknown
  misc_feature (1)..( 3003): 2750-1469P.txt file - cDNA_ID_3050542; gDNA_ID_1621147; Annot_ID_173082
ttctcatagcccatattgttacacagctgtagaagttgctgtgcagagccaaaaaaacacactcaatgaagatgataagataaatttataatgttttgtctgctcttgcgatattgacaaacatacctcgtatgtcatatgatcagtatccatccttaattcttggtagggatcagtatccatcctcaaaccctatatcaataccaaacatacagaaactcaggatcaaacaagcataaacccaattcaaatccagaaataagaaggaagatgctcttagtacgactgcaataaaaatttatatcatattaacaacaatttagctatggtttaattcacagcatataaaaatatgaaaaacctctcatttcttgtacataatttttagaatcaaacctataatatattaggaaaatttaaactaaaaatgtggatagtttggtcaacaagagaggagccaggcgaatatattaacaagtgcgcaatgtgcatacattccaaaagagttgggtatcagatcctttttctatgaataacttcattcatgtcccgttacttttcccttacccttgtttctttcgagagaggggaactacaagaagcaaagaaaaaatcgaattttcccggaaataaaaacaaaatttctgacgatagaatgaaaaggagattactttttctatgtgcttgacaaaataagaagctaagaaattaggtagtttaagaatcaacgaagaagaagtgaacaagccagtgaaatcttgttcccttatatcgatatccaaccttgagaaactcagaatcaaacaagcataaactcaagtcaaacccaaaaatatacaaaaaccctattctattcgagtaaacccttattagaaaacaaaaactaaatcgatatgaaaccctaatctattcggaaaaaaaactgaacaaaaactagcaaaaaaccctaaatacctttggtcgcttccggagctttttttttcgttttgtggcttgattacgtcgatggaggtggtctgtataaccttctgccgatttgacttctttgattgacatatcgaaaataaatggaaagtaattattacaatcatacatgcatgtcaaataaaaaaataaaataaaaattccatttatttaatataatgttcgtttgttttcgagatgtaatacgaacgtgaactagtcaatgggagctaattgagaaaaaataggaactaaaaattaatcactaacaaacttcattttaattatgcaaaaagaaaatttaaagtgtccatgatttattttcctagaaaaggcatagcttaatacaaaaaacaaatacctgcaaaatcttcatcgctactgttaacagtttcttctcttggtgggattttatttaaatcaaacaaaaattcatctccatcatcactataaacagttttttctggaatttcatttaaatcaaacaaaaattcattctcttcacttagaagtgacatactcaaataaaaatttggaattgtgaagaaaattagaaatcatttttttttaaaaacttacataaacatgaatgattcagaaaagttttagtttggctccgatgtaaaatttttgaaattttttgtttaaaattaattatgtaatggttgcacaaaaaaaataatcaattatgtaaaaagttgctccattttttcaagtaatttgggttgtttgagagtttaatgcgtaacgtttaatattactctttaattgttttaattactttacttgattgtttttattaaataatagttttgttaattactgtgctaaacctcaaaacatctgatatattgagtaatttatatatccaaataacctaggagaccaaaagtctattaggttaaatgaagacgagttctagaactctcataaaacctttgaaaaaagctattaaaaaaaatctttttttttttgagttatatatcttgatactgtctagcctaattatcaatgcttaattttcgtacttaaatactatcatcaattcatcatggatttcagagcggatactccaatcttctttgcattttatcttttttttaccgtttaaggttaacataaaaaaaaatatattctaaattttttttttactgaaaaaagattctattagaaatctaagtgcaaaaaaaaatgttgattgatggaggttaagatcaaaatatgaattttgtcttcttgcatattaaaaatctaacctatattttacatgaacgtaaatagatgattttatgagtggcaaaaacgaactcaccataaaaccattagtaacacatgtagtacaaacccaatattgaataggaaccgtactacttttctaattatttaaaattgcaggagtggtatgtcttggagaatcgaggagacacgcatcgagtttaaatgtgtggtcggagagaataaaagtgtgtgcagatttgcttaaagagtgaagggaaggtgctataaaaaaggatcttgttggccacgagcttcttccttttcgtcttctccgccgcaccctttgggtcaacagttaaaccctctccattacgcgtgtgaatatacacatataatattcacattatataagattatgtttcataacgtagatcctgcctgttctatatacaacaggttttggtatgagacgttagatactttaattcatctggtcaaatgcctagctagaataaatatctttaatcacgttcaaaattgattttatacgaatacacttataattaatttaattatgatatatggtacttgctttaccggccttcttgtaaccttccttcaaactctagctgctcatcaattgaattaacaaacaaaaacaaatccaagtcaagtgatcttaaatccagctcattcttattcacgtgccatgcaaaatgatgcatacagtatatataagggacacacacaaagacatgtaaatattataccatccaccgattaagctacatatcctctcagttaattctctaattcgccatg

SEQ ID NO: 32242 - DNA, 3000 bp, Unknown; identical to SEQ ID NO: 7495
  misc_feature (1)..( 3000): 2750-1469P.txt file - cDNA_ID_3050566; gDNA_ID_1621148; Annot_ID_173146

SEQ ID NO: 32243 - DNA, 3000 bp, Unknown
  misc_feature (1)..( 3000): 2750-1469P.txt file - cDNA_ID_3050570; gDNA_ID_1621148; Annot_ID_173145
attacgcccaaagcatttcgtggaggattctctttttccaatcaagtaagaatgaaacaaattatatcaaacagcttataatttcagaatatttaatttattattgttatcttgcgtttgaacttgcagcttctacaaagttttgggatatcgctcatgttcttcaccggaaacttttttcattggagaacattagctcttttaagtaactatattttttctctaaatgaactatatctcaaatcataaaaaattataatgtgtgtacttaattcacattatttaacttattcttgattttcaatctatgactaggtgcaatcccatgtggtatccaaatgatatgtttattttttattcctgaatcacctagatggctggtaattcacacacttaaagtttgttttttatttgtttaattggtaatattatatttaaaaggtacagtctacatattaatgttcatcttaggctatgtatggtagagaacgagagcttgaggttactttgaagaggctaagaggagaaaatggtgatattctcgaagaagcagctgaaatcagagtattattgtttgttccgaaaatactactactactttggctaacatatacgtattttggttaactattaattcggtttaaaatgtgaaacaggaaacagtggaaacctctagaagagaatctcgaagtggactaaaagatttgttcaatatgaaaaacgcacatccgttaatcgtaagtctcatcaaatacctatcatttatacaaataatttagaagagatcgagttcttatctagttttgtgacctattgatgatcaacttaataaacagatagacatgtatttatgcgtatgtagatctaacattctgcctatacgtatgaatgaaatactcccaagtcctaacggaaaaaaatgttttaacttgtttagtgaaataaataaagattaatttgtttttgtttgtttattaattcgttgaaaacgattagattggattgggcctaatgctcttgcaacaattttgtgggagttcggcgataagtgcttatgctgctcgtattttcgacacagccggtaaaccatgatttaaaaaaaaaaaaaaaaaaaaaaatcattggcatgtcatatcttgtttgattttgtatcgcatttcatctcacgatttttgaatatattgtcttgggtatttaggttttccaagcgacataggaacatccatccttgcagttattttggtaaatcaaaacattgtctttttagtatttaacattttataatcgaaaatatagtatttcacattttcactacaacttattcttgtttttaggtaccgcaatctattattgtcatgtttgccgtcgaccgatgtggacgccgaccacttttgatggtaatcatttcattaccttcgttatatataatttgcgtaattgatttccctagataaatattttatttgtggtttgaaactttttttgcagagctcttctatcggtctgtgcatatgttcatttttaattggcctctcttactatcttcaggtttagtcatcttaactattttattctttgtaacttcgtttgatttttggttattatagactaaatattatttatcccccacaagcagaaccatggtgattttcaagagttttgttcccctatcttaatcgtcggtttagtggtacgtgaatgccaatcttgtttcagtcaattactatttttggtttaattcatatattactttgttgaaaccacaacactaatcaaccaagtcatactatataccagggttatgtcttatcctttggcattggtctaggtggactaccatgggttattatgtctgaggtatttgtttttttttttattttaaactagaaatatttcataatgtaatcattatctttttttttttttggacaacaatttattcattatctatggcaggtgtttccggtgaatgtgaaaattaccgccggtagtcttgtaacagtgtcaaactggtttttcagttggattatcattttcagttttaatttcatgatgcaatggagtgctttcggtaaatttctatccattaatttgacatttttgtttcttcagaatattacacatctaacacaaaaatgctttatttcgacagtatttaataattattacaataaaatgaaaataaataaataaacaaacaaccagctcttaaaattgtttaaagagtatagggttatgtataatcaaatcatggtaaatatatcttttaaattattaaaaatactaaaacgggaagattagagaattttatgttaggaatgtcccctcgaattaatattttcattatataataacttagatatgaaattaaagagaatgattatatagttattttgttttattggaatttgcaggaacatatttcatatttgctggagtttctctgatgtcattcgtatttgtatggactttggtgcctgagacgaaaggccgaacacttgaagatattcaacaatcactaggccaactttcataaatccaaagttgattctttactccacaatgccagacattgttcttttatgttacatttataagtcatgtattatccgatttggaggggggggatatggatttccgaatttttttactttgataaattttgtcaatatattttgttgacagaaaaaagaataatcaatatactgtatgtggtattattctaacaatattttttaaacgtataatatgattatgtaccaatatttataaccatatcatatgattatgtacttttgtaaaaaaaattcacaccccacttaaaacttggttactactaattggatcttgcaactcaattttctaaatcgcattacaaaatactgaatgagcaaattaataaaagattagtcaaatgtgacaacgaccaatgaggcatggccaaataaaagcttgaagagactattcaaagttaaggataagaatcaaagaaagaagatg

SEQ ID NO: 32244 - DNA, 3000 bp, Unknown; identical to SEQ ID NO: 7497
  misc_feature (1)..( 3000): 2750-1469P.txt file - cDNA_ID_3050574; gDNA_ID_1621148; Annot_ID_173142

SEQ ID NO: 32245 - DNA, 3000 bp, Unknown; identical to SEQ ID NO: 7498
  misc_feature (1)..( 3000): 2750-1469P.txt file - cDNA_ID_3050578; gDNA_ID_1621148; Annot_ID_173141

SEQ ID NO: 32246 - DNA, 3003 bp, Unknown
  misc_feature (1)..( 3003): 2750-1469P.txt file - cDNA_ID_3050586; gDNA_ID_1621148; Annot_ID_173133
gcgaatattttaaggtaacaaccagtacaacccacatctgatgtacccattgcgaaggacaaagagaaagatgaagaggacaggtccatgtgaaatataatagcttattatgttgattttacttacaaccattaaggttgcagcatggaccaagaaatataatagctttatgatgattttaggcaagttgctgaacttgattcctatgaaaaatgagatgcacgcatgtcaaaagttcttcaagtgaaagaaaagtgctatttgataccatcttagttttctctcttcagttattaactatttgtagtagtggactattcgggaacaactcatttctaatgaaattttaaagcttggcattatgtaagaacacatatatatttcagattaggttttcgtttgactgacgagaaacaaaataaagaatgtgcaagaaaaattggtatacaaattatttaactatttttacaaaactgtgtaatcttccaaacctaatttcaatgatattatacttctggtgacgtgaacgttctcgtaaaacaaaaaacaaaaatcatcgaaattatacttacggacaaagagttatggactatctattttggaaggagaaaaagagaaccatcagaaattgcctacaagagaaccatcaatgataaactcagattttgacttttgtacccgaaagagaaagaaccatcaatgaaactgcttgcgcgttagtctcccaatatttttcccagctttgatgtttccttaaattcctttttgggcaaggttacaaagaactaggctatgctatattgtataatctaagcttttcactttgattgatttcatatcaaaaaaaaaaagaaagaaagaaggagcatatgtgatgtaattggagagttgtttagactaagagaaaaatgtattcagtggaggctaaagaaattcttctcgaaatctgatgcaaaacccataactgaaagaaaagaagaagaaagaactctttgaattagttcccgagccaaagatcatatacataaccagaattacgacgaaggagttacggatgtttaggacgagagccaaagatgttctaacaatatgtaaccaaatgaagactttccaaatattaaaaagagcccttatgagataaaaaaaaaaaactttgttggcctgtttttcaatgcccaaatatagcgatcaagattttgagatgaaagttatgaccattaaaggagtatatatatccaattgtccatactagccagcgaccgtgaatgctgcccaataaccaacaagccaaaatgaccattgtttacaaatgtctttctcatttgctgttttccgacagatagagtaagtgtatatatagaatagtactgaaagagagggccgggggacttatatacgttttgaggaaaaagataaacaacattagagtaagagcgagatatatacacttatataaagtcatgtctataagaaagttcaaatccaacttaaaaatatatactcacaacaaataaaagttacatcacttcgattatttagagtttataaaactaattagaaaccgaactctttttttcttcaaggtcgtgttttggttttaggcttttagccctaatttacaggtctttctaaggctaaatctactataaaatgtaattgcatgcctagggttcaaacatgaagtctcctctccctcaaataatgtcaacttggaagacaacacgattgtctccctgtattacatgtctaccgagaatagatgtacaatgtaatttcatggattatgtttaacccgataataaattggtgtgggatgtaatgatttattttctttaatttaagaaattataagagttgacacaataaaaattagagaaaaaaaaaacatggcttttctttttactttatttatttaccctgcttcaaaacacaagagaataagagaaaagtgtattttgaaacgtttttgaatgttagtttggttttgtttgatttatagtactgtttaacatcagaaaagacaaatgagtttaaaaaaataataccaaaaaaagaatttactagatacaattttaaagtggaaatatttttaataacttggatcctcgtctaatttattcataacatttatgtgatatattatatatataggaaatgatttattagatagttgactaaaactatatattagatgctattatttgcataattcatatagttatttattatgaaaaaagagaagaataatcagttatgtaaaagtagaattttttttttttttttaaatgttatcggaaaaactgtatacagtaataaaaaagagaaaaaaaaaaaaaaccatatctttgtcgatggattaaaaacaacattttcattacgcagcgcttcttcgccctcagattcttcttcaccttgaaagaccattaacatcattccttgcccagatccaaacaatgccatctccactctctctatttagggttctctccaacttttcaaatccctaattcttgctccctcccttcaatcaattccgatcatcatcgaggtctctctactccccgaatttaaagatcagagccgcgacttcctctgccttcttttcctcggaatttttcagctacgttttccaggtggtgtgtattgtcaatcagttgacctttgcttttgtagccagatcgttcgtgctttgagtttagggctcttttacaaggtttcgtgttggtggaatttctctacctaggtttgggggaagagttcagtaatttcgttgtagatcgtgatttgggcttttagggtttcggtttactggttgctggaatttatggtagcgttattgaattcggactctctgcatgtgtaagcgttgaagtttgaagtttcaccgggttttgtttcttctgctgaagagtcgagattattttacgcattaagaatcgattcagaaggtttttaggaattagtttctgtggattgtaactatataactactgggaggggatg

SEQ ID NO: 32247 - DNA, 3003 bp, Unknown; identical to SEQ ID NO: 18506
  misc_feature (1)..( 3003): 2750-1469P.txt file - cDNA_ID_3050615; gDNA_ID_1621149; Annot_ID_173179

SEQ ID NO: 32248 - DNA, 3003 bp, Unknown
  misc_feature (1)..( 3003): 2750-1469P.txt file - cDNA_ID_3050623; gDNA_ID_1621149; Annot_ID_173175
gattctcagatctccaccatcgttacggattatccacaattgcttgtagctgatgctgagaaatcacttgctcccaagcttcagtttttgcagtctagaggagcttcaagctctgagctcactgagattgtttctacagttcctaaaatcttgggaaagagaggccacaaaactatcagcgtattctatgatttcatcaaagaaactttacttgataagagttccaagtccgaaaagtcatgtcaaccttttccacagggtaatctggagaacaagatcagaaatttatctgttttgagagaattggggatgcctcacaagttgttattccccttgctcatctcttgtgacgtacctgtcttcggtaaagaaaaatttgaagaatccctcaagaaagttgttgagatgggttttgatccatccacctcaaagtttgtggaagctttgtgcgttgttcaaagattgagcgacaaaaacatagaagataaagtcaatgcgtataaaaggttaggctttgatgtggaatatgtatggacagtgttcaagaggtggccaaactttctgacacactcggagaagaagatattgaacaccattgaaacatttctaggcctagggttcagcagagatgagtttagcgtgttaattaagcgctttcctcagggcattggattatccgcggagatggttaaaaagaagactgagtttttggtaaagaagatgaattggccactaaaggctcttgtttcaaaccctgcggtgcttggatacagcctagagaagaggactgtcccaaggggtaacgtagttcaagctctcatctccaagggattgatcggaagtgaactcccttcgatatcgcgtgtcttcgtatgtaccgatcaggtgttcttaaacaggtatgtgaagaggcatgaggacaagcagctggagactgagttgatggctatctatcgtgcttcatagatcacaaggctgatcaaggattttggtttctatctttaaatatctgaaatcctcaatttagactttagttctcaatttcatatcgatccaaactgtttgtctctctctatagatgcttgaaattgtaagttttgaatccattttctgctatattactgaagttaaattccaaattctttgtgaccttgttcggatatagatttgaatgatgcaatgcagctcctgcattcttgaattggtcatgtaagccttttctatttctcagttagtgtttactttcacattattctttaaattttgggattggagtactgaaattacagctactgataccaaaatcctcttatggtacaataaagtctttgctttatatattctttgctcctgagatcctggagtcctcatgtaagctctgtctttgctttatatattctttgatcatatgattcatctgatttgtggaatgtttgtatttcagatttgtgatcttggtttttactcgtacacgttttttgtgagctttatattacattgtcttgaatatattgtcaggggcactggaaacctatcctacatcattaggacacatcaatcagataatcatccagtccaaggtggtaaaatctttatatctagcttctagctgaagaagcttgggacgttgaacgttgttttgagcttttgctatggctaacgacctctggagtgaatactcaagttttctctctttgactcgcaaggtaatatgcttattagcgttattataggtacattgagatagtataatgtgttggttgtttattaatgtgctcattcaatgcatttgctcgatatctctaggctatctatcagaactatcttttcctttacttgatcttattgagttttagacgtatgagatatggttcccttgaaagaatgcaatctacaagtttacaatggtacgtcaaaactgtgttaagtttctttcatcattgaagaattcagaatcttgtttcaacttggactcagcaaacacttttggcaattgaatctcttatttattctaggaaaattacattatcaactatttgttcgttcttgataggaacttgagggtgaatctcttggcgcagaaaaaatgtttcagagaactttttcttatagtttgtgattctcatatctttttttttcagtgatgaatccagaaactattgaagagagctattcatacagactatagagcagtcaccattgttacatcagagcagtcactaatgttgcatcagagcagtcaccaatgttgcatgttaattttgtaggatcacatttggttgacagtaaccagattacaaatgtactctggtatacatacagttggttcgtgatcaacaattgaatagtatctaaaccagaccaaaatgaatccggttctgcttggttaataataccaagtcttttaaattgatgcagaacgtgagatcctagtgaaccaaactgaaacaatatctgaagatgacaggaggcgtaatgaggctagagtatgcaatttgaggtcattcctaaatagataaagcaaatgacatttggtgaatgaagaagctctacaaccatatgttcgcaatttaaaacaaaccgatatcgtttgagatctcagaaatagtgtgatcaccttttttctcctccaatttttgaagatctcaaactttgttttgggcttgaaacataatgtccatatccgcctgccgtgatactatatgggccgagtcaggcctgtcaggcacctgactcttttgagaaaaaaaaagaatcataattgaaattcttcaaggtttactatcggtggagcaacacataaaccctaaattttgggatttagggtttcgcgatttggaagcggattcatggtgagtttcttgttattgttcgtaattccagagaaattttggtatctatgattcatgactgcgcgattcatcttctcgaattgaaacagagagtagttgggtcggaatagctttcaacactgtagcatttgtagcattgtcttttgtaatg

SEQ ID NO: 32249 - DNA, 3003 bp, Unknown
  misc_feature (1)..( 3003): 2750-1469P.txt file - cDNA_ID_3050626; gDNA_ID_1621149; Annot_ID_173174
gaaagggcacaaaactatcagcgtatactatgatttcatcaaagacactttgcttgagaagagttccaagaacgaaaagttatgtcattctttgccacagggtaatctggagaacaagatcagaaatgtatcggttttaagagaattgggaatgcctcacaagttgttattctccttgctcatctccgatagccaacctgtatgtggaaaagaaaaatttgaagaaaccctcaagaaagttgttgagatgggttttgatcctaccacctcaaagtttgtcgaagctctacaagttatttacaaaatgaacgagaaaacaatcgaagaaaaagtccatctctataaaagcttaggctttgatgtgggagatgtatggtcaagttttaaaaagtggccaatctcgctgagagtatcggagaagaagatgttggactccattgaaacatttcttggcctaggattcagcagagatgagtttgccaagatggtcaagcactttcctccgtgcattggattatctacagagacggtcaaaaagaaaactgagtttctggtgaagaagatgaattggccactaaaggctgttgtttcaaaccctgcggtatttggatatagcctggagaagaggattgttccaaggggtaacgtaatcaaagctctcatgtccaaaggattgatgagaaatgaactcccttcgatatcgtgtgtcctcatgtgtaccaagcaggtgtttttaaacaggtatgtggcgaatcacgtggacaagcagctggtgacggagttgatggctatctatcgtgcttcataaatttaaactctttctctctctttaaactgtaattttcccatatattactgaggtttctagccaaagagctgcaggggacatgtgaatccaaattctatgtttgttgatttcttctaaagcagagatagtttctgaattcactgtgacattgtttggatatggagttgaatgatgcaatgcagctcttgagttctacgattgatcacgtaagccttttccgttcctcaagtagtgtttgatctttattttcacttttttctttaacagttttgagataggagtacactgaatcacagctggtcataccaaaatcctcttatgataattaaaatcttgctctgtcgttgctttatatcattcatttgatttgtgagatgttttaattctcagattggtgatcttggtctttacttgctatggcgtttcatactcattttttctgagcttatggtacattgtcccacatcattaggactcataaatcatattatcatccaatccaggttggtaaaatctggaatctagctattactctagaaacttcaaagctctggatggtttgaagtttggtgagtttttgcgatggctgacgaccattggagtgaacacactcaagtttatttctctgtttgacctacaaggtaatatgctttttagtgtacacactcaagcttattactctaggtttattgaataaatcgaaggatatgatcatcgaaaccgtttcacactcaacgttgttatggggtatcattgagataatgtattgctttggttgttcattaatgtgctcactcaacgcatttgcccccaatatctctggaaactaattgtaacagaactctcttttccttttttttagtcttattgtgtttttagccatatgagatatggttcccttgtaaaaaaggcaatctacaagtttacaagggtacgttaaaagttaaaactatggtaagttcctttcatctttgaagaattcagaatctattttcataaaagtttgcacctttaacctgaatttagctatgggatgatcgaaggccatttactttacttcttagagctttgtttactcagcgatggacctgtgcaattgtgagttgctagaaatatttctcggaaaaccttattcgcagtcgtatttgtggctattcaggtcttgagaaggaaaggagaattaggaagtcagaagagatgagaaatgtttcaaaatagctctttgaaaagttgaaatatcggttgaaaatgcttggtggtttaaaggtggaggtgcaggtcctgtggctatatagagggtttaatattttggctgagggattatctattgttgagaagcttggtggttcgtatactgaaggtaaattatgatctttgtacagtttctgataccgtcatatactctcattgatgaacttattctggactgggtgctggtgatgtctaattctctgtattccggaagaggtaaaaggacttgcattttagcagaatcacggggaggaaccaaaaagcaaagctttctatggaaaaaatccaaggccttttacttttacttgttagagccagaaaaatggataagctttgtttgccctgcgtttgagggtttcttaaattgttttggatgatgaaatgaagaagtttctgttgttgcttgacattaagttctgttgtcttgttactttggtgttctaacaaaccgaccttaactcgtgcatgatatacttaacttcaatgttgtcacgacaagtccagctccggttccttggttattcaaagataactgtacacaacacacaacacacactcttcactagacataatttgtaagaaatcattactctaagaatctcctcaaatcaaaatatgactttgctctgtgatgcatttatagtctttggaaaactcagtaaaaatcttcacatctctacaatattcatggaatttataaaacactctctttgtagctgtagccaagtggtgagacctgggttcgaatcccagcagtaacattaaccttattaattttgttaaagagaataaattaaaggacgacgtataccaattggcaaatcattagggtttatgaaattttgagtgattttcagagaagtttgaggatgactgtgtgattctacttctcgaattgaaatagatagttgggtcataatcgcatatccttgtcttctgtcatg

SEQ ID NO: 32250 - DNA, 3003 bp, Unknown
  misc_feature (1)..( 3003): 2750-1469P.txt file - cDNA_ID_3050629; gDNA_ID_1621149; Annot_ID_173173
atgatcaaagagattatctcagaagttgatgctgataatgtaagtcgaatatctcaatttataaaataccaaacacaatttgtttagtttaatgatagttttaaaatgttctaattcatatttttgtttgtttttaaaaaaggatggaagtataaattatcaagagttttgcaatatgatgaagagctgctcacaatcacaccaatcaaaattggttcaaccgaattaaggaccataatctccgatttaattcatttttagttcagtacataaaatttcgaatgtaatttggataaataaactgtccataatattcctcatacaatttgtttttggtccatcattggtattgtactctccgtaaaccgatttcggtttaagaattaaccgaattattttttttggcgaaaaagggttgttcgtcgtctacaactagcgattcatttctcaaaattgagtcagatagttcggtagaatcttttcaagccgtgtcatttcttgttcggtaacagttttttctcttgtcatgtatgctctgatacaccatggaagaaggttggtccagttacagaaattgtctaatttcagagtttcagttcaaaacggatctgctttgtccaattccttctcttttgctagtgttgctgatgcgacccttatagatagccttaaaggtaacaactttacagtctcttacctagttgattcattgggtttaaccacaaagctcgcagaatcgatctccaagaaagtaagcttcgaggagaggagaaatccggattctgttctgagtcttcttacaagttatgggttcacaaagtctcagatttcaagtatcattactatctacccacgattgcttgcattagatgctgagaaatccattgctcccaagcttcagtctctgcagtccagaggagcttcaagctctgagctcactcagattgtttctactgttcctaaaatcttggggaagagagggcacaaatctataactgtatactatgatttcgtcaaagacattatagaagctgataagagttctagttacgaaaagttatgtcattcttttccacagggtaacaagaagaataagatcagaaatatctctgttttgagagaattgggtgtggctcagcgtttgttattccctttgctcatctcagatggccaacctgtctgtggtaaagaaagatttgaagaatctctcaagaaggttgttgagatgggttttgatccggagactacaaagttcgttgaagctctgcgagttatttaccgtatgagtgacaaaacaatagaagaaaaagtcaatgtctacaaaaggttaggctttggtgtggctgatgtatgggcaatcttcaagaagtggccttcttttttgtcatactcagagaagaagataactcatacttttgaaacccttaagagttgtggtctgcttaaacacgaggtcctgttattgttgaagaagcatccaaaatgcatttgttcttcagagcagaagattgtgaactccatagaaacattcttaggcctaggattcagcagagatgagtttgcgatgatggtcaagcgatatcctcagtgcattgactatactgctgagacagtgaagaagaaaactgagtttattgtgaagaatatgaattggccactagaggctttggtttcgatccctcaggtatttggatacagcctggagaagagaactgtcccaaggtgtaatgtaatcaaaactctcatctcaaaaggactgatgaaagacggaagtgaagcccctccaatgtcatctgttttaacaagtaccgatcaggcgtttttaaggaggtatgtgatgaagcacgacaagttggcacctgagttgatggctatcttcactggagaaaatgggaagtgaaaagaggagcttctatatatagtcagaacacctaccacacaacaagagcatcattaaggtttgtattgttgtgttagttttagattcttccatgaatctgttgacatcaggccatgagaagtgaaaagaggagtttcatttatatatctctgatacctatttagacttttgtaatctcaatttgactcattttaatatacaatccaacattgaaaataagtagcaatacttttcaatcttttttgagtcttgaactcttttagtggcctagaaacgtggagatatgttcttctttgcattcacatgaagcacatatcttggttagtcaggtaacttacaatatattgatcaatcctaagagcaagttttcgaagatagtggtttggttccagatttgatatcataaagaactctggttatatcattccattgaggttgcagccgaggagaagaagttgttacgctccatctttacatggttcttagcgaatgtgacctttgtccctttgtataaatagcaaaagtttcagcttaccatttgtgttcctggttttgcttttggctacttcttgtaagggaagatgattctcagttacagtttcaatagcataccatattaccgtaatcttaaacgaatgactttatccattaggtcagtgcaaccgtgcaactgcaggtacagatttgtctacagttaaaaaatgttatgccaagcaaagagagagagcaaaagcaattggaaccgttagattgatatgttttaaaaacaataattagaaccctccgatcattttatatttcgttatcttataagaaaatgctgacatcagcagatcctaaaatcaatttgcctatcataatcatcataaaccctaaaaaatcgttttttttttccttctcctcaaatttgaacccttgaaagatccatcactcatcaactctttaacggcacgagtcaccactgatcgatgattgagtcttttgtcttccctgctcaacataagtttgagatttgtgctcgaattgagttagattgattggtagaattgcttcaaaaattgttattttcgggatttgtagtaatcgcattgcctgttgtcatg

SEQ ID NO: 32251 - DNA, 3003 bp, Unknown
  misc_feature (1)..( 3003): 2750-1469P.txt file - cDNA_ID_3050633; gDNA_ID_1621149; Annot_ID_173172
gttttatatttttaaatttcaactttagccagaaaatagagatttctacaggtgaaaatacttgaattaagaaagaacaaaacgctctagaggtacttttgtagcaataatggaataacattaggtccatcaattcactattacattgtatacttgcatagttaagaaatgatatagtacatttttatagtcagatattttagtgtttgatatgattcttcataataacaatttacacgttcattgacttgatgctttatagttatcgattctcgaagaactatagttactttttaattttcaatggcttaaaaaatcagagaatatatatttgtttatctacttaatctgcatcttgtaggaaaaatttattctaaacatatactatacatccgacttaaacaataatgaaacattattctctagaatatctttacgaagagccaatggtggtcataatctaatatttgtcacctaaagtttcaacagagcttacgctacatattctatttcatttttttcaatattatttgtagaaaactttttaatattttttttcaacaaagttaatttattaaatgttgcaggtttggttgccatgacaaggcaaatatcaaagatattggtgttaagatgcgaagaacagaaatgagtttgtgcaagaatggattttacgagttcgggatttgtacctatgtctcgccggaattatatctaggaaactcaagatcaattgctctatacttgagcttttcttccggtttcagtggctaagaaaacagaagtagataacaaagttgtttataacaacgactcaaaaaacacttgcaccaactaggacaaataagacaatcaaattggaatcctcaaacatcatccaagagttcactaaatcaaaatccaagtccaactttaagactgaatgatcatagtagaagcacctacaagtgctaggtcagcaacatagacaatttgacatgtgctagttagccacgggcaatgcgagtaaatcttcttctcgagtgtaaccgcggagaacgaatttcttgaggattgcagagttttttgcaaagtacaatgcaagtttcaattcatacgatggtgtatgctttttatctctacaaactcgagcaatgacagcaaacactgaggtgcgaacgagaggaatccattcagcctcatactgctaccaagtacagtctgtaaaatacacaacacaaagatgattgaagttcagataccgttaaacacatttcacaagttttctaactaaactgaagagtttgtgcaagtttccgactttcgcaaactggaaaatgtcgttttcattctcaggttcgttctcaggagagctactagctgaaatttttttccggaagacacaatgtctctccacccattgaagtcgagacaccagctctgttcttccaatctaggcactttgctcttaagaacaagcactccttccttttgaccagaaggagacctgaatgacacgaaattatcgagttctgtctgagttgtagctgttcctccaggttttactgctgatgcagagatggcatccatgacgcaatgcgtcctctaaggccccgttattctggtttgacacaacaatgatcacaattagcaaaagccacaaaaagcaaaccatcttttactctctgtaactgtaaggaacgagataaatatcacctaaaaaccgaagaccaagattttgactttaagaatctcacgtgagatatgggctacaggatagtttccagattgacttattaggctcacttggttcagactgacaaaatatttttgcttcacctccaaggtatagatagaaagtttgattgctacggtttctcttaacatagcattgaacaagtgatcctcctggaccaggctataagaaatatcagagcaaagattattagtctgaagaagcacacaagtcagttataaagtaaaacatagaatgtgacctgtttcaaggagattggaaaagtgaatttgctagaaacctcaggaacgttaacgatctctttgaatatttgtcgccagttcttacacacacctacacaagaaacaacattcttcctagaaggccaagtgtcttcggatcgctctatcctcatcagaacatctctcagaagctcaggaggcatattagcccaacagctcagttcttaaaccattccttgagacttcccccatttttcccacaatacccaaatctcacatcgaatctctttcgagacgacatagctctaccacacttcaagcaatgctgacttttcaagaaccctaacaaggaaacaatagtaactatgagatctcaactgatccctacaacttatgaatattggaaatatggaaatgtgttcctcttctcaaggaacaagaccgattcttcggccttttaatagaaatatttggaccaaatttctccttcatattcatcctttggatttggttctatctagcatttaaggagctaattaaagacagccacttgaagttttatacaaacatatatttcgttaacctaagctcaaaaaaaaatcatgacattttttcttctgtaaatgtgtagttgtatataggattaaatataaatgaagatggagatattttttgttacttttatcaatcagccatttttttctatctatgaattcactacttataacatgcctgccacttaaagagccaatcacattgatatagttttgtataaactctttagtttcttgggtgtccatggaaaatttcaaagataccacacgaaaatttcaatttttaatatagagaaatataaaacaagaataaaatgttgctagttgttgaaatttatatttattcttggtgttatctcatatttgacttggaacatatttcactaacgtgcttaggtgtccttatgaaatccaataaatacattaaacacaccaaatctcttaactcttctaaggctatgtcctaagatttccttgttcagtacaaaaaatg

SEQ ID NO: 32252 - DNA, 3000 bp, Unknown
  misc_feature (1)..( 3000): 2750-1469P.txt file - cDNA_ID_3050644; gDNA_ID_1621149; Annot_ID_173167
atcgatcattcgccaaccataaaagtaaaacaaacaaatgtgtggattacatattacatgtatgcatgagaaacatacaaaataaataatagagatgaataatttgatttcctgataaagactaaagtgttaagtggactactccacgaattaataaaaagacatctttagagaagaaaagtagacatccaacaaagttggaacccgtgagactgatcggtgatttgctattttcttcgtctcaaattgacaacatacatccctagtttaaagtttaaacctgccccaaggatactcaggtcaatgatccatcacatttactagcatgtccattacttaactggtcgtttttaattgaatctgaaaaagttggaccttttatcggattatttaggtttgggccctttggggccgggtttttctctgccaaccatcagcccaataaatttttgttttatatttgtcaagaaaagatctataaaaaaaaaacagtttcgcaaatccaaaccacaaaaacgaatactagcagtacaattgttcaaaatttatttgacaactgtgggatttgaacccacgccctttcggaccagagcctaaatctggcgccttagaccactcggccaaattgtcaattgttaagagcatcataaactatttatataaagcaatccacattttaatgttattattaaagatcatccaatttttttttatgtgaaagcatgaaatattcagcgttacgttgatagttcaaatggtgtactagacttttattttttatcttactgaagaaaactttaaaaatcatgaattcggatactggctgcaatgaagaaaccagtttaacatgttatgtcctccagtgtgaggaataataagttttcaagtttcactatagaacatcttgatcatcttaaagcgtaagattatattcgatttttaaattctttattatgaaagtaaattgtttctcttgggtctttttataaaatttattcaaatatctcatgaaatatgaagatgaaacgaaaacatatgtcactgttaaagttaatctttataagccagaaaaagaatgacaagatcttcggtcactcacaagtcacaacctaggggataatgaatttgggtgatctcaaaactcaaaaaggaaaattaaggtggtgtgacaatataaggaaagaaaattggttgattttaatattagaacgtgggcctgtaaaggcccattaatagtccagcattatgatctggatccctctttaatcttatctccaaaagcagtaagcacggttccgctcacgtgaccataccctacgccttaagcatagtcacgtgccattagtgttccatttcttcagcacgacgaacctatcagaaagtaaaaaatcaataaataatatgaaagttaattattttgtattttcttgtttcacctatgaaagttaattatttgatttacagtttatgttttttttggtggtgaactgtaatttacctattattttagggggtctcttatttttatccgtaaaacgacatattgtagaaatttttctagttaaaaagttgacttagaataatcgtgtatgacttttgcccataactaataatatatacacgtatcctaaagagtctgaaattaatacgaacacaattcattcactaattcactttgtactttgtagaatgattgatttattatacttgttacatgctttaagattatggacaaaaaatataaaattatggacaaagaattgaaaattatgggcaagaaagtaaaaactttctaatgtaacaacatatttggttgaattaaatacgaccacaataatagccttacttattatatcacatatctttcatgtccccaagtcgcgaagttataaatgcgatccaatattctcaattttggaccggcttaaaccaacaggcgttataacagctccaacggtttggttctgttaatttatttcgcggtacgatgaacattcaatttagctgatgtactagctactagctttttttttggtcattgaggttaattttcaatgaagttatttttttttgtcaatttatagtcttgttttagagaatttactttcaagtacaatcgatttcacgataataaatttattataggctaaacaacgatcattagaataactccaaacttgtaatccaaaaataacatttacactaaaaaaaattcaacttattatacaaaactaaaaaatttggtatcacttcaaaagtttaacttcggataaaattgagacattctcatttttatataaaaatttattcgagatattcttttttttcatctccaactaaaataacaacaaaaccgattataaacaaaacaagcaaagtagcaaaaaaactattaaacatcattaagatttttaaaactaaataattacctaataatactaaattatatgatcctcaacaatcattcggttaatttggataaatcagaacccggtttaaatttgatatgatatgaaatccggttaagttccggtaccggtccgggttttggttttgtttaatttccactatggaaagagtgagagagagatagagaaaaaggtggggggaatttaatggaggagtaataaatgctctcaagcgctctctcttcccttctcttctcccacaacagactgtgttcattactcgtggggtcggtctctctcctctctatctctctctttctctgtgaagacgaagacagctgtttctgagtttcccttttgtttttgtgtctatcttctcaaccaagttttttggtgtccaaaattcgcaaagaaacgcctttctcttcttctccttagatttctcggactttctttcaatagtgggaaaaagacacagaatctcaaaaaagtcctctcttgtccaaagtccaaagcttttgaaagagaccataaaaacagagcttaatctctctctgtctctgtctctctctcttttggaggcttgaggatg

SEQ ID NO: 32253 - DNA, 3003 bp, Unknown; identical to SEQ ID NO: 21369
  misc_feature (1)..( 3003): 2750-1469P.txt file - cDNA_ID_3050688; gDNA_ID_1621150; Annot_ID_173215

SEQ ID NO: 32254 - DNA, 3003 bp, Unknown; identical to SEQ ID NO: 18515
  misc_feature (1)..( 3003): 2750-1469P.txt file - cDNA_ID_3050692; gDNA_ID_1621150; Annot_ID_173212

SEQ ID NO: 32255 - DNA, 3003 bp, Unknown; identical to SEQ ID NO: 18516
  misc_feature (1)..( 3003): 2750-1469P.txt file - cDNA_ID_3050696; gDNA_ID_1621150; Annot_ID_173209

SEQ ID NO: 32256 - DNA, 3003 bp, Unknown; identical to SEQ ID NO: 18519
  misc_feature (1)..( 3003): 2750-1469P.txt file - cDNA_ID_3050699; gDNA_ID_1621150; Annot_ID_173206

SEQ ID NO: 32257 - DNA, 3003 bp, Unknown
  misc_feature (1)..( 3003): 2750-1469P.txt file - cDNA_ID_3050703; gDNA_ID_1621150; Annot_ID_173205
attccttatttgcctcaaatcattactttcggattctactgtcttgaactgtgttcatgtgtgtattccctcatcaatcaccttcaattcatattttcctatttccaaaaataaaaagatacagtatctatgtatttaattatatatcatatcaattatatcataataatcataagatcctttttatcgaaataaaaaaggaaacaaatccaatcatagcaagctttttcttttatttaataaacaaaaataaaaagcttcccgaaatggttaaaatccagaaccactaaagtcaaccaaatttgtcaaattcatccacgtcatcagttccatctataaaacgctcacgccattcgtcaagtcccaaaacaagagtccaccatgaaactcacaaacgctctcttcttcttcttccttatctgtctcctctctttatcgtcagcttcatcgaacaagcctcagctttcaaatggctcgaccatcttattcacgacgatagggagacccactttcgaattcgacatctttactctccccacgagccaccgtccaccgtcacccgccgatgagcaccgtctcaccgatggcaaatctattaacttcaacggctatttcgcttctccttctacggcgttaatctcacttctacccaaaagaactcagattcaaccacaagacgtgcatctcatctacgtcactgagagagccggaactcctagcttaaactacgacgtcgttcacagcgataacgttggatctagaattcaggttccgttattttccggcgaggaacaacagagtggtatgaatgtaaattccatgaaagacacgcctgttttaacaaacggctatcttgtccacgtgtcgacacatgagaatccgggtaagcccatggcgagttgggccgctgtttactcgactgagttacgaactaagtcgactcggcggcttacaccactgggtatcgctgacttttctccggctgtgtctccgtctgggaagtggactgccgtggcttcgtttggagagaaaggctggacttggagcatggtagagaaagagattagttcagacgtctacgttttcctgactcaggatggaactcagcgagtcaaggtggtcgagcaaggcgggtggccgagatgggtcgatgactcgactctgtatttccaccggaaaagcgacgacggttggatcagcgtgtaccgagcgattttacccaaaaccggaccggttaccaccaaatcggttacgattcaaagagtcacaccaccgggtcttcacgctttcacacccgccacgtcaccaaacaataacaacttcatcgcggtggctacaaggaggcctggatcagaaatccgccacgtggagcttttcgatttaaagaagaacgagttcgtcgagttgactcgtttagtctcgccgaagagtcatcactttaacccgtttctttcccctgactcgtcccgagtcggataccatagctgcagaggtgacgcaactggacgtaaaactcctcggaatctcctccaaagcctcaaaacaacttcaaacgacctctctctcttcagattcgacggtgcgttcccgtctatctcgccggaaggtgacagattcgcgttcgtctctttcacaggcgttttcgtggtgaacccagatggttcaggtctacgtcaattgcttccacaaatgggatttggaacagtttgggatcctattcgacatggaatcgtctacacaagctcaggtccagctttagctccaggaaagtctcaaatcgatattctcgccataaacgtcgatgcacctagtccagcaaccgccgttaaaaaactaacgactaccggtgaaaacaacgcttttccgtggccatcacctgacggtaaacggatcgtgttccgttctgcgcggtccggtactaaaaacctttacataatggacgcagagaaaggtgaatccggtggtttgttccggttaacgaacggaaactggaacgatacgatagctacttggtcacctgatggtaattggattgtgtttgcatccaaccgggaatttcccggtacgttgttgatgaatatatatgtggttcatccggatgggaccggtttaaggaagctggcgcaaaacttgaccggtttggtatcgatgcatccgatgtttagtcccgacagtaagagaatcgtgtttactaccatttatgctggaatctcggcggagcagatcggtaatccgcattttaacgtcccgagtagtgagatttttaccgtgaacttggacggctctggtttgacgaggctaacgcataactcggtggaagatggaccacccatgtggttccctaagatcaaagctactggtgatgtggcttggcctaagaggtttggccctagttgctctatccaagatttcaagacgcaaaatactaccgtgaaaatgaaaatgaataagcccgcaacaatgtcatcaatgtgtgttgttccttcacaatgatttgttatgtaacttattcttctaataaaaaactccgctagttcatatcttgttaagtatttggttagcctaagaaattatatagcttgaggtttcacattttcaatattttttaaaaataatttgggtcaatattgatgttggaaatgaaatcaacggttgaattattgtcgtgtgctgcttgcaccatggtccatgctagatggaccgaccactatttttccaaacagtgcctatcctatcaagtagatattttctgaatacgtagataattgtagaatacaagaaaagaaatatcctctgtggaataaatgaataatatacttttgtcagaaacgttacaagttaaaattccacgactgattgccacgtgtaagcttatctcaaaagggccctacagtaccatgatgacgtcatctcttacaccactctctgaaaaattcctccgccttataaaaaaactcgattatcgtcttcacttagtagccaaccaccgaccaatccgccatg

SEQ ID NO: 32258 - DNA, 3000 bp, Unknown; identical to SEQ ID NO: 7531
  misc_feature (1)..( 3000): 2750-1469P.txt file - cDNA_ID_3050707; gDNA_ID_1621150; Annot_ID_173202

SEQ ID NO: 32259 - DNA, 3000 bp, Unknown
  misc_feature (1)..( 3000): 2750-1469P.txt file - cDNA_ID_3050714; gDNA_ID_1621150; Annot_ID_173199
aatcttataacaatgtatgttgaatagatgatcaatgaggtactcaatattccttttctctgtataggtgggtttctcttcagctcttcatatgatagaactatccttatatggtctctgaaggtacatatgcgtataaagttagtgataggtcctttatagatttttgtttatgttcttctcagcagctctctgatagtaaggtccttaattcgagctatataaatcgtcatgcaaaacacgctatatgcaggacttctcccatgtgcatacatttaaaggtcatcaggataaagtaatggccttgatacacatcgagggaacagaaccagtatgtgttagtggcgatggtggaggaggtatctttgtatggagcactacttttcctctggaagaacagccgctaagaaagtggtatgagccaaaagactggcgatatactggcattcatgcattggcatactcagaatatgggcatgtgtacactggcagtggagataacactatcaaagcttggtcactgcaagtaagttaatttccctgtacacctgtaattctgataagattttttcttcttcatattatctgatgatgattattttcccaggatggaagcctgctttgcactatgagtggtcataaatctgtagtctcaacgcttgttgtggtaaatggagtactatacagtggaagttgggatggaaccgttcgtttgtggagtctaagtgacaacagtttgttgacagtgttgggggaagagactccaggtattgtaagatctattctgtctctagctgcagacgatcaaactctagttgcagcttatcaaaacggagatatacaggtctatatgtttccttaaaaacaatttacttgatgtgcttcatttcaatcgtattgccagtctctaaacctgaacccttctgattccttttccagatatggagggatgatacattgatgaagtcaatgaaaatacagaatggcgcaatcctcagcattgccgtgaatggtaaatggctattcactggaggttgggacaaaaccatcaatgtacaggtaatccactagtttcttgacaaagctagtgacgaataatctttatcggaagtgtaaaaagaaaatcaatactttatccattacttgatgacggattttcctcctaataatctgttaccgaacaccggtttgtaggaattgtcaggagatgagatatcagtaaactgtgctcacgttggttcaatcccaggttcatcagtaatcacatctttgttatattgggaaggcaagctctttgcagggtttgcagataaaaccattaaggtgataatagtccaaattgtctgtctttttctttgcattcatgatttacctctgttgttaaatttggcatgtaacaagagaagttttgtctccatttcttacaggtatactattttggacgctaacaaaaactattgtgctctccagttttgctcatcttgtttttgaagattctttcttccataagttcctccgtagatgccactctcgccaaaacatgttgtgtgaatatctaaatgtaaatatatgtgaatatgaatccttcgtaccaatctgttgatgatatatacgtgattcgcatttttcttatttctcttagaacatctttatgcgttgagatcaaatcaatacaagaagagataaattcttaagttgtagtgacatactgcgaaagtctaaaatgtcgagggacttaaaagtgaaatattcataaaaagatgatccttcaaattgagtaatttagcgccaccgaacggtatagggaggcaaaacaatttgagtgaaaaatacgacagagagcttctcagttctcatccatggatacttgacctcaacaacgagaaagtcactataacgaagcaattttttttgtaaaatgggttctgtttctaatcttgtgagccctaatatttgccatccagctcccccttgtctcacatctcgaagtaataagtttccgtggacaaaaccaatatctggtcttttgttctatcggtccgtcacgccgattaagaggtgtcaccttgttcgaagaagctgtgtcgtctcagcttccctaacggtatgatatgcgtcaactctcttagtaatgtaatcgtataactctgtctgttcgttggcgcacaccaactgttcgatcatttgtctcgtctctatttcctgtgaatattttgtctactaacgattttctgtgcgatgcttttctgagactgggatgagaattttatctctcaacattctcagtggtattttacttcttttcatgttttatttatttactttagtttcattcatatttcaggggaatttgggtcgtttgaagaggaatgtacaagattttacgagcatgaattattgggttgtccgggactactaccgtctggtggaatctgtcaattcccttgaaccacagattcaaagcctttccgatgaacaggttaaacttagtgttcactgcttgagacgttttatttattgatatgtttctttaatgtattttgactttggtttgtttttgtccatagctgaaagctaaaactgctgaatttcgagaaagattagcacgaggggagtccctagcagatatgcaagctggtttgatcaatatcttactttgaatttagttaccctttattttaacaatgtacgttgttttgatagtctatgcgcttactctctcacttttgtgcgtgtgtgtgtgtgtgtgtgtgtgtgtgtgtgtgtttcccctgtctagaggcatttgctgttgtccgtgaagctgcaaagagaacaattggaatgcgtcattttgacgtgcaggtctgtctatatctttaccctcaagttttagtccatgctatttcttgggtgcatttctataatcttgaagagaggttgttaagtatacttatgtttcatttgttccatcagataattggtggaggagtgcttcatgatggatccattgcggagatg

SEQ ID NO: 32260 - DNA, 3003 bp, Unknown
  misc_feature (1)..( 3003): 2750-1469P.txt file - cDNA_ID_3050718; gDNA_ID_1621150; Annot_ID_173197
gatgtgaagcattctgatagagcaaatcatcagtctaggaatgatacaagtcacaagtcaagggaaactggatcctctagtgcccttcatcagaaatacagcaacaaaagcttacaccaacaatctacgtccctgctaggaaaatctccccccaatgtctttgcagaggtaacagtagtccgtcagaaagaaaacaatggtatgcatcagctggcaaatgtaacgggaagcagacaatctagtcaagcgtctgtaagtacattccaactgtgtctacaattacataaaatacactcagtaagttggttgcattctaaggtcgtagttttgtttctccagttttcatctcggttctgtgatatttttctggtcaatctttgcttccatgcatttttcttaccacaaagtttacatcagtcttgctttataattctgcaataacctgtctctactcagaaaaaagatggttctaatgtgaagtctaaaacctcaatcctcgagaaagccataagggaactggagaaggtggttgtggaatgtgagttttaatatttttcaagtgtgaccaactagaatagcatttggtgattttcaacttacaagaatttatgatttataagcagcaaggcctcctgctatcactgaaaatcaagaagctgatacctcatcccaggcagtgaagagaagattgcccagggatgttaaattgaaacttgctaaagttgctaggattgcggtactagagcttttccatttgttcttctcatttttttgaaacttgaaacggtatgagaaaaaactaatatgccttttgtggcagcaggcaagccagggaaaacattcaacagagttaatcaaccgtcttatgagcattgttggtcacctaatccagcttaggtctcttaaggtaaaattttctgtctcctgtatcctagtctttctgttactaaagcagacttgttaggactttcgtcaaggtgtttaaatagttagtcttcttcaggacattcatgttccagtgaaaaactcttctgtttcaggtacaagcaaacaaaatatggtttcttactctttgtaatgcttattttgcagaggaacttgaaaatcatgattgatatgggagattctgcaacccgagaaaaggatactaggttcaagcaaatcaacaatgaagttcttgatatgataaaggccaaagtttctttgatggaatcacaggttctctctctctctctctgttctaatcttaagttgcttgataggcatttctttcatccatggcttttctatcttattacattcttggaagtgtcattaacttttatgaaatctggagttctctctgataatggttttccgtagatcaagctcttcattcttttgttttcgatgttccctgtgggtcaatctgcctttgtagcgtattttcctcctattaatatgttgaggcacctgtgacatttatgatatttcttgcactatcattttatgttccataggcaatcaaaccagaaggtgcaacatcagacgattttcaggactcagtagaaaagccatctttgaagaagtttgtcatggatgcggcattggaggataaattgtgtgacctatatgacatatttatcgacgtaattatcatttacctttataatctgccatgccaattctagacatagaattagagtcaaaacggttttgttcctgttttttggtatattagggattggatgaagatcaaggtccacaaacaaaaaagctatatgtcaatgtaagcccttctccattcccgattatttttggtattctggttttttttgttccaagcttatctcatgtcttaaatcaccaattagacctagccaaaagctcaaggtggtttgttagagcttgatgaatattgttttggaattattcatgctccagttggctgaactctggccaaatagattgatggattatcgtgggatcaaacatgcaattttccgggcaaaggagagacgaaaagcattgtatggaaaccttgcgaaagagatggtagttaaagaattttctcagccctttacctctttgcattaaaattttcgcaatttgctttgcttgattagattctgctttgttaaaggatcaaacaaagatgaagaagagtatgaagcagttggtaccaagaacagactgtactgctcagcccaacaccgaattagtggttcagagacaacacagtggggaaaaaaaattgattgttgatccaaatgcaaccagcacttccgtggtcactagtcaaactatggttgacagatcaaatcagcagcagcctgagaagctaaagggaatctcaagctcttgcaatcctacagaggaaacaagagtggtcaagagaaagaacgaggctgtaatggctgagaaacaagtcgttcttgccctgaagaagcccgaacatccacagacacgtgtaatcccagctcctcagaatctgaacatcccacgaacaaccccggacctgaacttgccaagttgacatcacgattgacaaaggagctcttagaaacgccggagacaataacctctggcctcttccttccttgtattttgaggtggcacggcattagtcctggcgatgccgatgcttggtttttttagctacaaagcatggtttataaagttgtctgtattccagtttggctcttattaagttagttactctatttacgtgtcctttttcaaaactctaatgtataaagttatgattttacgggcaactctttacttttgagtaaaaaaaacagagcaggttttagtactgaattttgggtaacgtagttgaaaatttgatttcggacgataatgtaaaattgatgaaatacatcaaaatgactacattaatccttttgacacaatatgaataatcaattttaattaatattattattacttgtaaaacagtataaatatggctcattatttcacagattctcaacactctctcattctccacaatttacgatg

SEQ ID NO: 32261 - DNA, 3003 bp, Unknown; identical to SEQ ID NO: 18523
  misc_feature (1)..( 3003): 2750-1469P.txt file - cDNA_ID_3050722; gDNA_ID_2936548; Annot_ID_193958

SEQ ID NO: 32262 - DNA, 3003 bp, Unknown; identical to SEQ ID NO: 18523
  misc_feature (1)..( 3003): 2750-1469P.txt file - cDNA_ID_3050722; gDNA_ID_1621150; Annot_ID_173196

SEQ ID NO: 32263 - DNA, 3000 bp, Unknown; identical to SEQ ID NO: 7523
  misc_feature (1)..( 3000): 2750-1469P.txt file - cDNA_ID_3050726; gDNA_ID_2936548; Annot_ID_193957

SEQ ID NO: 32264 - DNA, 3000 bp, Unknown; identical to SEQ ID NO: 7523
  misc_feature (1)..( 3000): 2750-1469P.txt file - cDNA_ID_3050726; gDNA_ID_1621150; Annot_ID_173195

SEQ ID NO: 32265 - DNA, 3000 bp, Unknown; identical to SEQ ID NO: 7545
  misc_feature (1)..( 3000): 2750-1469P.txt file - cDNA_ID_3050763; gDNA_ID_1621151; Annot_ID_173239

SEQ ID NO: 32266 - DNA, 3003 bp, Unknown; identical to SEQ ID NO: 18528
  misc_feature (1)..( 3003): 2750-1469P.txt file - cDNA_ID_3050774; gDNA_ID_1621152; Annot_ID_173311

SEQ ID NO: 32267 - DNA, 3003 bp, Unknown; identical to SEQ ID NO: 18531
  misc_feature (1)..( 3003): 2750-1469P.txt file - cDNA_ID_3050778; gDNA_ID_1621152; Annot_ID_173305

SEQ ID NO: 32268 - DNA, 3003 bp, Unknown
  misc_feature (1)..( 3003): 2750-1469P.txt file - cDNA_ID_3050782; gDNA_ID_1621152; Annot_ID_173303
attttctttctttagattttattggttaaaacttaaaactgtgataaccattttcttgaactctttttattgataggagtgacaagagtgtggagggatgaccgaccatcggataagattctttcgataaccagcttctcaataattaggacgagacctgaaccctatgaatcctctgtttttgaggctgttggttacaaatggtaaagatcttagtatatcttacactctatcccattttttttttgttaattatatcttttgagctaattatgatgcaaataaataaatcaggagattggttttgtacgtgaatggtaatgaaaaggacggtggaaaagatcatgtttcactttacgcgaagatcgtagagacagaatctcttccagtaggatgggaagtgaatgttgatctcaaactctttgtctacaatggaaagctaaacaaatatttgattgttacaggtactttaaactgtgaatggatttttattagatccatatatatattctagcggaaaacggtctatttctccacgataagtatgacatcataacagatagagcccaggctttaacctcgtgctagatatgatgtcatattctagctctatatgttatgatgtcatattctagccattgctattttaagaaagtagacttcaaatactagtctcattagtaaatgaaccgatagttgattgtgatttgccttttttttttttgcataattgtggattgtagatggtacagtgaaacgatacaacaatgcgacaaaagagttgggttacggacaacttattcctcaatcaacattctacgacgggaacgatgggtaccgtgagcaggacactggtacatttggtgctgagatctacatcgttaaaccagcccaacaaaaagagaaagtcacattcatatcaaaccctccagacaatgttttcacttggaagatacttcatttctctaccttggaagataaagtctatcagtctaacgagtttcttgttggagaccgatactggttagtcattttcgtaaccggatattttagaccaaagtccaaattaatcttaaaagcttgttactgttatgtgactttcacagtattattgtataatcaggaaattaggattaaacccgaaaggaggcttagtcccaatcttcctatatgctcaaggctttaaggcaaacgcagttgttacaaccacttatgcagcgactaatctgcggttaaagaatcaacgaagcagcaaccacgtaacaacatatagtaagaaaactaacctaagaataaaagtttatctccaggagaaaaaaacaacaatgaatgaaactaggaatagctaaagtaaatttgtttatgctgctctgttttttctttgcagctgcatattggtacctgattccaagcggattaggtttgggagtgaacactataccgttatcagatgtaaaagatgcatcgaaaggatatgtggtgaatgattccattatcattgaagttgaaatgcttacggtctcggtgacgaacattgtatccgcttaaagatctctacttctttaccatagttcaaacaaccttatgaagaaagagatgtttgtaataagacaacgttaatgtttgtgatgtagtcgttacttcggtttttccgagttttctcttttctgttttgttatcaatgaaaataaaactctccgggttttaaattttataaaaaatgttgaggacgtgaagtgttaaaaatcgacttatctggagtcagaaataaacttataatttactttacataatttgttttgtagccaaattcaaacataacccaaaagaaaaaagtattgaatgtttttttttgtagccacattctatttatgcgaccgttgcccgttggagtaagggtcatgccctgatctacaattttcaatgtacaacgttttgaacgctttaatttgaccactataattcattactctcattaagttaaccatatttatctcgaaagttcatcaaccaatatatgtttcattccacttctaacatttcttatttctaccacttttaccacctctattttaagcatttcgcattagtaccggttgatattatatatgtatcaagtttaacaagattctaactcaaaaataagtggcaacaaacaagtgaggaaatgcatatttactatatatttgtgttgaattacctttacttttaagattggttatatacccatttgtgtttattagattttaaaatcaattaccaaataagttattatgagttcatttgaaaagttatgagctgccaactcaagactatgtgaatggattgtcatataagtatgttatgggcttgattggtataactaattaattatagtagagttgtagcaattacgagcaaagcaagtaagttgatgaagttgtaatctgttatatattaggttgatgatatatatataaataagttgttgctgaaattgaccaagttttgatcaggtggtcatgaacgatggtgaatgaagatgaatgatggtcaatgagagataattgagtgatgatagctcaaacctctggatattggaatgcaaggtttatccgtctacgtacgtggatatgaacattgattttgactactcggtcatgatccacagttatcgattggtagattcggccttccgcgatgatcggtatgtctatggtcattaattagaggtaagggtggtgtgatgtgagtccttacttcatagcttcatatgattggattgttaagcttaacaatccaatcatatttaatattttgaacattatgctacccacatcgaatctgatacttgacacattccaagtcaaatacaaaaataataataagtgaatgtgcatatatatatattctaccatgaatccactttcagtattatatagtagtaacttaacttgttcaataagtaactttgtctatatatatgtaaaagtcttaccaatgtctagctcatctaagaaaatg

SEQ ID NO: 32269 - DNA, 3003 bp, Unknown
  misc_feature (1)..( 3003): 2750-1469P.txt file - cDNA_ID_3050787; gDNA_ID_1621152; Annot_ID_173298
ttcccccacctttttaatatattgtaatatctcgtgtacaacgttttgcctaataatataatcatatttcgaaaacttgccacccactacctcgaggtctctcccacaaatctataaaaatattgtttaataatagaaatgggaacttgcaaaaagcattaaaataacaataacatccaaagtcaaacaaaaacaagaaaaaatgatttgtgtaaaaacatatacatatacatatacatatacatatctctcgcttttctgttcatcacttcagctgagtttctcattcaacatgtaacttttttttgaaatatgttgcaaaaacaaattccaacatatttataaaactagtaacattattatttataatttgcaaaataggtcatgaatcccttttttaatcttttttttttttcatttcccctcatgtttaattattaaactacttaatagtataatatttttcaaattttctatttatatacaaaagcctatgtttttttttctataatttgatatgtagtgtctaataaattcaaaaacatttttattcatacatctcattaattgttaagatgtatacaaattgatacatttttattcgtacaacttatttagtatacattagctatgaatatatgaataaaatatgtatattatgtacatttgtatactaaatgtgttgtatgactcttagtatacaaaacaacacaaaaaactttatcaaaaaaaaaaaaaaagctcccagacccgactcccgaggaaacctaagcttcttcttgctatggccttcgtggccgccggcgaggaccctcccttgccagaaccccctgacccgcctgatcctccctccatcttcgcccaaaccttcatacccgatccaccttctacttcttctctctttccaccttcatcgagtctagatctagatctatgttctaccgtttcttcctatggtgttactcctttcgtttttttgcgattctttactgctgtgtgcagtcccttctatcagatctgtacccgttccgtgtctttgcggttctttactgctctatgcagtccatggaaactagcctattcccagatcttgggatatcctctcgtttcaagtggatatgtttcacaggccataacctttgatgtccacgctgcccctcctacctcaactcagagagcctctcctactcgttccatggcccagacacgacaacggtttgttacttctgtaagatggtgtatgtctttgtttctggttttacccctcattcaaaatttcgtagtggtgcgatttaatgctgcagtatgcagtctctttgaactcaatctggccttttgtgctgtttgttttgtttctctttcttggtggcagtttgaaaagaaactaattaatacacctcgcctgatgaatctggttttatcgggtatttggtaccctagtagcttcttatcggagctagttatcttcccaaagttccctcctcagtggagtggtttggatgtccaagagtcgtcggtattgcaaggatcttcctcccgattgatgttcttctctgcatttgatgcagttcttgtaacctcttgtgttacgttggatacagtcttccaagaatctagccagatcgttcttattgttcgttttgccttatgttattcttatgacttctgttgcatatctatctatcctttaaccattgttatatggtctgttttggcttctgttgttgtgttttatgtagttttcttcatgttggttgtaattcctctttctgaggctcctaaaatttagtgaaaacaactattggtttgaaaaaaaaaaaaaaaaaagaatcttagtatacaaaacaaagagtaaaattgtctattttgcaaattgtaaatagtagtgttactagttacataattatgtttccaaaagtaactatatttccaacaaacccttttttaatgtatttttttgatagatatattagtagattttttttaacaatggaaaacgaacaaggttataagggcagatgagcagagtacaactgttcttaaagtctcatggcaaatcttggcacacttgtgttatctgaaatagccagtctttagattttcttgtactttttattttgttgattggagtttgaagagtgttgagagaggagcgacgaggacaataacaaatttctcagtgattaaaggtagcagagaaccctatacaattatgggttccgcattatcctttcgtaacctagattttttttttatatatagttaaactcctagcctaaaactaaaacacagttgatgactaattggtggagaaccattaaaaaaaaaaaaaaaagacagagtagactaacgaaaccacacctttacatttttctatttatctcaccttcctaaataaaaaatatttattttaaacaaaaacacattttctgtacagacgtgggtttcgtaatgtccataagtccatccatagtctaccatataatttaacatctacttctctccagtggacgcaaaagcttcgaattgaatgtgggcgttgcttctctcgtgtctaatataaaatttggataatcatgaattcttcgatgatagtgatataccgttgacactgagtagttcattgcaataagtaagatcttgtttttgctaaaaagattcaatcatattttgaacacttgccacccaccacttccaaaacttccacaaattcatagatatagtaatacacaggttacttgacaaaaggaataaaagtacaatatgatgctttacacattctcagtcaaacaaaaacgataaaatgaatgtgtaagataatattgtttaaaaaagaaaaaaagaacaaaaaaaagataatattgttttcccgacgactaatccactttcagtattttataaaataactgaactcaagttgctcgatcaaacaagtacccttaaatgtctctctgtctatataaatgtacactcttcccaaacaaaaccatatctcaaaatatg

SEQ ID NO: 32270 - DNA, 3003 bp, Unknown
  misc_feature (1)..( 3003): 2750-1469P.txt file - cDNA_ID_3050787; gDNA_ID_1620787; Annot_ID_168180
tcccccacctttttaatatattgtaatatctcgtgtacaacgttttgcctaataatataatcatatttcgaaaacttgccacccactacctcgaggtctctcccacaaatctataaaaatattgtttaataatagaaatgggaacttgcaaaaagcattaaaataacaataacatccaaagtcaaacaaaaacaagaaaaaatgatttgtgtaaaaacatatacatatacatatacatatacatatctctcgcttttctgttcatcacttcagctgagtttctcattcaacatgtaacttttttttgaaatatgttgcaaaaacaaattccaacatatttataaaactagtaacattattatttataatttgcaaaataggtcatgaatcccttttttaatcttttttttttttcatttcccctcatgtttaattattaaactacttaatagtataatatttttcaaattttctatttatatacaaaagcctatgtttttttttctataatttgatatgtagtgtctaataaattcaaaaacatttttattcatacatctcattaattgttaagatgtatacaaattgatacatttttattcgtacaacttatttagtatacattagctatgaatatatgaataaaatatgtatattatgtacatttgtatactaaatgtgttgtatgactcttagtatacaaaacaacacaaaaaactttatcaaaaaaaaaaaaaaagctcccagacccgactcccgaggaaacctaagcttcttcttgctatggccttcgtggccgccggcgaggaccctcccttgccagaaccccctgacccgcctgatcctccctccatcttcgcccaaaccttcatacccgatccaccttctacttcttctctctttccaccttcatcgagtctagatctagatctatgttctaccgtttcttcctatggtgttactcctttcgtttttttgcgattctttactgctgtgtgcagtcccttctatcagatctgtacccgttccgtgtctttgcggttctttactgctctatgcagtccatggaaactagcctattcccagatcttgggatatcctctcgtttcaagtggatatgtttcacaggccataacctttgatgtccacgctgcccctcctacctcaactcagagagcctctcctactcgttccatggcccagacacgacaacggtttgttacttctgtaagatggtgtatgtctttgtttctggttttacccctcattcaaaatttcgtagtggtgcgatttaatgctgcagtatgcagtctctttgaactcaatctggccttttgtgctgtttgttttgtttctctttcttggtggcagtttgaaaagaaactaattaatacacctcgcctgatgaatctggttttatcgggtatttggtaccctagtagcttcttatcggagctagttatcttcccaaagttccctcctcagtggagtggtttggatgtccaagagtcgtcggtattgcaaggatcttcctcccgattgatgttcttctctgcatttgatgcagttcttgtaacctcttgtgttacgttggatacagtcttccaagaatctagccagatcgttcttattgttcgttttgccttatgttattcttatgacttctgttgcatatctatctatcctttaaccattgttatatggtctgttttggcttctgttgttgtgttttatgtagttttcttcatgttggttgtaattcctctttctgaggctcctaaaatttagtgaaaacaactattggtttgaaaaaaaaaaaaaaaaaagaatcttagtatacaaaacaaagagtaaaattgtctattttgcaaattgtaaatagtagtgttactagttacataattatgtttccaaaagtaactatatttccaacaaacccttttttaatgtatttttttgatagatatattagtagattttttttaacaatggaaaacgaacaaggttataagggcagatgagcagagtacaactgttcttaaagtctcatggcaaatcttggcacacttgtgttatctgaaatagccagtctttagattttcttgtactttttattttgttgattggagtttgaagagtgttgagagaggagcgacgaggacaataacaaatttctcagtgattaaaggtagcagagaaccctatacaattatgggttccgcattatcctttcgtaacctagatttttttttttatatatagttaaactcctagcctaaaactaaaacacagttgatgactaattggtggagaaccattaaaaaaaaaaaaaaaagacagagtagactaacgaaaccacacctttacatttttctatttatctcaccttcctaaataaaaaatatttattttaaacaaaaacacattttctgtacagacgtgggtttcgtaatgtccataagtccatccatagtctaccatataatttaacatctacttctctccagtggacgcaaaagcttcgaattgaatgtgggcgttgcttctctcgtgtctaatataaaatttggataatcatgaattcttcgatgatagtgatataccgttgacactgagtagttcattgcaataagtaagatcttgtttttgctaaaaagattcaatcatattttgaacacttgccacccaccacttccaaaacttccacaaattcatagatatagtaatacacaggttacttgacaaaaggaataaaagtacaatatgatgctttacacattctcagtcaaacaaaaacgataaaatgaatgtgtaagataatattgtttaaaaaagaaaaaaagaacaaaaaaaagataatattgttttcccgacgactaatccactttcagtattttataaaataactgaactcaagttgctcgatcaaacaagtacccttaaatgtctctctgtctatataaatgtacactcttcccaaacaaaaccatatctcaaaatatg

SEQ ID NO: 32271 - DNA, 3000 bp, Unknown
  misc_feature (1)..( 3000): 2750-1469P.txt file - cDNA_ID_3050824; gDNA_ID_1621153; Annot_ID_173352
acgttggggatgatgtcacttgacaagacagatcctgcagaatgattgatatgaaaacaaaaaagctaaaatcgtgaacaatccaccattggagacgtgccatcttcatcctctgagatgtggagattctgcttcttcttatcgttactattctttgatgttagcgcggtgaaatctgcagaatcgattttcctcccaagtcaaatcggagttgaagattcccgcgtctttgaatctcttagtcttagtcctgtatgctccgcggctgatccaaacctcaactacaagccggtcatcgggattctgacccaccctggcgaaggtcgatgggacgctcgtcttcactctctgaaaaactacgcctacgcgacgaacatatcgtacatcgcagcttcgtatgtgaagttagctgagactggtggagctcgtgtgattcctcttatctacaacgagcctgaagaaatcttgtttcaggtttactctgatgattttgctcttatggattccgttcactatgtagccttctttaatcactaatcttacaactatttattctacttgaacttggctacacctgatttgtttacatcacataaacaggcaatttgaaataagttcaaggttgatgttaccatgttattgttttggctattgcttgtcaaaattagttcatgttatcttagtgaatttcatttttgagttgcagaagctagaattggtaaatggtgtgatattcacaggtggttgggctaaaacagggttatattacgatgttgtggagaaaatcttcaatgtaagttctcattatgcaaacactctctgttgctttcatgtgttagctgagctgtacaacgtaatagtcttttgaaatccttatgtttctcacagaaagttatggagaaaaatgatgctggagaacattttccggtgtacgccatgtgtcttggattcgagattttgtcaatgatcataagtcaggtcactcttttggcttcttgcttcttttgttgcttaagtaacttccatatatgtaaagcaatgtttcacactgcctaaaatttaaaagagctttaagctgcatatcttgagctgagagggatatgcagtttccatcctaaatttctgacgattttgtgtgttttgaaacagaacagagacattcttgagaggtttaactcagtaaactatgcatcaagtctccagttttttaaaaacgttaatatcgaagcaaccgtgttccaaaggtgcatatatagctatgctttaaacttttcagtgatccaaagaacaatatcccataattgtaatgtttcatatttgcagatttcctccagagctgttgaaaaagctcagtgcagactgtttggttatgcagaaccactatgttagtatctctctaattttctgcagaatatgaatataggctatagctctcaccttttgttgctcttaagtatactttgattgctgttttcttcttataagtatctttaatcctatacagttacacaattttatatttcctgttttcttgttcatgaatgatttattatattctctctgcttttctgaaatgaaatgctattgtttcccagtttggtatctcaccagacaactttcaaggcaatccttatctgtctagtttcttcaatatcgtcacaaccagcgccgataaagacagcaaggtatagttaatatgttcctatacaccgattatacaaattccacaagctgacaatttcaatgaagggataaatttatcttttttctttccagacttttgtttcaactattcgatcaaaacgataccctgtgaccgccttccaatggcatccagaggtattacacacaagttaacttgtgtctctcattagtcttctcaatcctttgttaacttatatcttttactatgctatatgctttataatggatatatgtttctaaaaagatccttaaaatatactctgcagaaaaatgcattcgaatggggatcatctgaaatcccacactctgaggacgcaattcaggtgactcaacatgctgcaaattatctagtcaggttagttctctattgatcaatgttggaaagtatcattaaaagaattatgtagtggttcaattttcttatttgaatgttggtgcagtgaagccagaaagtcaatgaacagaccatcttctgagaaagtgctgagcaatctcatctacaactacaagcctacgtactccggatacaaagggtacaacaaaaaaaaagccacttcataattggagtccaatccttacagttcttgctgtatgttaacaaatattggatcatgtatgatcaacctcgttgggtttttttttgcaggagcggtgacgacgaggtttatattttcacgtaacaaagatcccttctctgtgtgttttcgccaaaacatagcaatttatattagttactaagagcaatacagtgtttctccttatccaccattgattgtaagttgtaaccaaggtgttgaactataatttaaaaaaacacagtatagatcacatgaggcgtgaggacgcaatcacttgttcccatatcttcctctaaaacctaaatcctaaaaaatcccttttcaaagatcaagttttaaggcaaaaaagcaatcatgattttggccagacacagcgaaaggaccttgtctgtttcgaaaaactcatttaatcatgtgttattaatttattattatcaacaatacaatcgtactgggtgaccaataatgagacgcacccatcaaattgggccctccacggctccaccactgagagggatacacgaaagtcgttttacaaaaacacctattaaaaataaatgtgcataaaaatctattaccacgtgtacggtgaagattaggttctcgattttgtataagaaggtcgaagtgtgaagaaatcaaaaacccaaaatcgtgaaagttcatttctcctccattgatctttctttactcagatctttcctcttcctctgagatg

SEQ ID NO: 32272 - DNA, 3003 bp, Unknown; identical to SEQ ID NO: 18539
  misc_feature (1)..( 3003): 2750-1469P.txt file - cDNA_ID_3050832; gDNA_ID_1621153; Annot_ID_173346

SEQ ID NO: 32273 - DNA, 3000 bp, Unknown; identical to SEQ ID NO: 7575
  misc_feature (1)..( 3000): 2750-1469P.txt file - cDNA_ID_3050853; gDNA_ID_1621153; Annot_ID_173323

SEQ ID NO: 32274 - DNA, 3000 bp, Unknown
  misc_feature (1)..( 3000): 2750-1469P.txt file - cDNA_ID_3050902; gDNA_ID_1621154; Annot_ID_56971
agaaagaagagaagaaagaacaagaagaagaagaataaaaaggagaagaagaagaagaagtgttgcacttgcatgtggacttggttgtgctcagtattttcaaagtgagtgtgtgacttgcgttgctctacaaatggagaaagtgtggctgctgctgcaagcaaacaatgtttttgtaatcatgagagttatgtattgacatttaaacaactatctttatttgcatccttaatgcttaatgtattcttacgctaatggttaacagttttcttctatgctttgattccagactattatttatttcattatagaaaatgataatgtattacgaatacaagctgtatgggaaaaatatgatgagtggggttgattataagacaatggattggagaggcatggaagatgcacaattattttgacttttaataataagctcataccaaacacactatctatatacattatacacattcgtcaattatcaagttgttcgaattattacaagttctttgatttggttgattaaaattacaataataccctcaatgccaagagatccgtataacggctgggggatgaataataacttctctggtcatcgaaacaaaggcaaatcatttcaaagcgaaaggaaaaggagaaacgtaaagagggcaaagcccttcttcttcttgttcgagaaggagctgcagcctcagataaggattcttttgatgcccagttgataaaggaagcgactttattttaaccaacgagattttatcatcaggtaagcaaagctgtttgattcgttgattcttttgtatatattgaatatgtttttgttcgctgttgattggtttcttctttggcttttatctataatagggttggttaattggtttgttatttgacaaggatcattgatcaccctcttgagaacatctcgagctttcccagatctatctgagctcctgggtttataaatcgcttccttcacatatcgatggggtgcgtttcttcttccgatttctgtttttgactttatgcagaatgttttggtatttgattgatttggatttgagattctgtttgatgggctttgttcctgcgttatgtgctgcttgggattcatgttcatgatagataaaccctaattttattgctggggaatggtgtttataaggttgttttatgcagatgagatagctatctctgaaagttttatagaaaaatgttttgctaaggaaataaggatgttttttgggcaatgatcaaaagttatggttttgtaacagagcagtggctgcgtgggttgctacagagaacacagatcaactgccgccagtctgaaggatccaccttccaattccattgctcgaccgtgtaagaaaccgagtgtctctgaagatttctggtcaacaagcacagttgatatggacaacatcaccttcccttcacaggggagcttatcatcatccaatcagacttttgattctcaatctgctgctagaaactctaatgctcctcctgaatatgtaaatcaaggtactttcttttttggatttcacggaaggggagcgttgtggtctagtgttttgtgatggttatatatgaagtgggtttgtgtgtttgcaggtcttcttctttggaatcagacacgggagcgttgggtgggaaaggataaacccaacaacccggtggatcacaatcaaggagccaagttaaagtgagtggctctgttacacactattgtttgctgaaagctaagggctaaagtctggcaatgttacattttatatgtctatcatttgcagttggaacacagcaacgtatgatagcttgctggggagcaacaagttatttccccaacccattcctctcaccgtaagtaatcaaactcctccgagtgcaggaaaaaaacccagtcaactaactgtgttactgattgaaaacaggaaatggtggattttctagtggacatttgggaacaagaaggtctatatgactgaacaagacttggaagacacacacacatactggttcgggcatttctgatttattttttcttttcggttttcttttcttttctcaaagcccttgttgttaccacttatcatcttccatttggagttgatcgagaatactgggaaatgtggcttatacgttttcaccgtaaatgagaaatatcctttgtttaccatctttcagtccaaaagaattaagagcaatatctcggtttgactaatcagtatcttaatatgggacatgttcttgtgtatttttgttttgttttgttaaggacatgttcttgtgtctcatgtcccacttgcacattgatcctaccttccaggtgatctgtccagtgtttgatttccacatatatgtacattttattttaataaaatgattagaggacattccttaaattagtgctcttcactaattattagggattagacttgtgccaacaagagaatctgaacctaaaagtatcaaagcaaaaaaaatgttccgaatagtaattgggctgttgatttgggcttttagcatggagagtagtagtaggagagtgggaataaaacagaaaaagaatattcggcgtgaaaacagcagcggtcacgtaccggacctcaacaccactctccattctactttattaagcgggaaacagatacttccttatccatcgatgaaacgtcgaccacactggatacgtgtcgttctcaaagaggtctgtcactaaactatcacgtcgacccagtgtaaatttatcatccacgctctcgtggattacgtggaggaagaaatatcatttcttgtttgaaataaaaaaagaataaaaaaaattaggacagaacagaagagacacgcaaacatatccattagggtcacaacggttcttacagcttctattaccagaaaggaaagaaagccgaaatttgtttcaagataaagtaatttaagttggagcttgtttcttggtcgtacagtgtcaggtgaatagagaagaagaagatg

SEQ ID NO: 32275 - DNA, 2159 bp, Unknown; identical to SEQ ID NO: 9540
  misc_feature (1)..( 2159): 2750-1469P.txt file - cDNA_ID_3050909; gDNA_ID_1972143; Annot_ID_179285

SEQ ID NO: 32276 - DNA, 3003 bp, Unknown
  misc_feature (1)..( 3003): 2750-1469P.txt file - cDNA_ID_3050909; gDNA_ID_1621154; Annot_ID_173410
aatattataacttgaagacagaagatattagtacaattaaagacagctattctacaaatggtaatgtgatgttatgcttactccggacaagacacggtgtcgtagccgtttaatgcggcggtgaaacggccctccccctcggcgggtccagtaagtatataatttgagatacgaatattaatattaaatcaaaacatcacatcagagccgtctaattccaatcaaagcagattgatttatcttttcttggtcacgatccgccgccttctctgccagattcgaaaccctagaggattagtcagtgagccatcggaagggacttgaacgttgtttgatttttctcaaaatgttttatactgaaatcacttaatcagataattcgccaagaaggaagaagaatcaccaaatcggaaagtttgattttgtacagaaatgggaaattgtccgaaaacaaagaaagacagataatttacaaataaccagagtctgttgatcaaatcgaaaaatcaaatttaaagttttttataacaaagaacacacacatacaaaaaagaagaagaagaaagatgaaagacagtgtatactattttttcctcatgaatattattaatcctgacgcctacctcgatctacgtttcggcggccttttcctcggattaactttcttccccggcggattctttccaaacgcagagcaacaaccgcatgacgaaattctcggagacggcgggtccactgccggagaaactcttccggttgttctatgatgtcgttgagctcctccaccgttagatcgactcctctctattcctcctggtgctcctccaccggttttaatcggtctaagcttgtctttctcatcgattggtttgacctgttcagagctttccgacataggcttaggttgttcgtcgcgttgactttcgtctttctgctcgttgtttcccgatttgttgagttcggcgatgagacgatcgtcaaacactataccggaagatccctgacggcggaaagagattgttgatctttgaagaccctccatggatctatctctctctctgttgatgagctaaaagaagggcaaaactaggaaaagtgagtttaggccttataagtgattaatcaatcattgtgtttcagacttggtttccttttatttctgtcctcattattttttcatggggtcggtccactatttattgtttatttttatgatgatgcttccagtttctatttatttctttgtaacaacaatcatcggaaattaatgtaagcggattaacgatatcattcaaccggattattcaaacattaattgtaataaaaaaaaaaaagtaaaaaccattactgttattgatgattaaggcagagaattacatgttaattttttgtttgttttcacatctttaatcggattctcaacaccacataggcacataagtcctcttatatccatatttgttattttattccaaacttttggtttctttaaactcaaaaggggtaagactttttgtaattactattgttttatcagcaaattgcaaggattagataatagattagaaatgaacaggagaattgacttataggacacactaatttaatatttccttcttccccatttcggtaaaccaaatagactatttccttcttccccatttcggtaaaccaaatctattaggtgaggatgttattaaaatgccaaatctctctttataaaaacttgaaaggaaaaacaatacaaagtggtgaaagtgagtcaaagtaattcggttaccaatttgtattcaaagtcaacatcattgtactataatatggtataacttttgttcaataattcaccttcttatatcgtctgtttcttctcaggatcaccactaactaaaacatacgcatgtggtgggtttagcaaaactgtattctttggattaaagtaatgtgcataacacaaattaataaccccgtctgagttggcacaactcaccaatgttgaagattgagataaagaatttgggcccaatcgccgaatagaagtctatattcattactctcaggcccatccataaatacaattgtcaaaaagaaaataaaaaattggtggtccagctgggaacgagccagcaggccatggtgaatctgagtggcgtcgagctgtgatccgtccactgctgagagcgggaggtgatcgctgctctgtgaaaccagcctcacgcattgccctccactgcaagaaccgcctgagccaagccttcgcttaacacacacggatcactctcagcttggactgggcagcccggaacaatgccacaacagatccgacccgtgggccgagccagtgttccaccaacttattgtccccacacgggtcacaagcccacgttactgagctcgacgtacaagtattgatttaatttcatatataaagtaaaacattttgaggtatgtaaccgatgtgggacaaaatacaagtttgggcttcccagatcccacatttggtggaacacatatataaagagtctcttcgttgattagcttcccagatcccacatttcaggtaaaaacatcgtctgggctctttgccattttagcgaatgtggaaaggtgtggtttttttttgctctgctatggattttttttttcaaatcagggtttctctgttgaagtcatatcaggagcttgacatttgtttgtttgggaattagaagctagatacgtatattatatagcatcgtacatatcaaattttggtgtgtgttctaattgaatctgtacttgtttgtgtgttagtgggaggagctcttctcagaccttaagactattgctttagtggaatgcttctcgtaaatgtataagtgaggaaagaaactccattcgtatctatctactaccctaagccgtttatgcattttctgtccatcagaagatcaacacctgtttctggaggattccattgatttaagggattagatggatgatggaccatgtgggattcagtagatg

SEQ ID NO: 32277 - DNA, 3000 bp, Unknown; identical to SEQ ID NO: 7620
  misc_feature (1)..( 3000): 2750-1469P.txt file - cDNA_ID_3050916; gDNA_ID_1621154; Annot_ID_173403

SEQ ID NO: 32278 - DNA, 3000 bp, Unknown; identical to SEQ ID NO: 7629
  misc_feature (1)..( 3000): 2750-1469P.txt file - cDNA_ID_3050927; gDNA_ID_1621154; Annot_ID_173397

SEQ ID NO: 32279 - DNA, 3000 bp, Unknown; identical to SEQ ID NO: 7610
  misc_feature (1)..( 3000): 2750-1469P.txt file - cDNA_ID_3050931; gDNA_ID_1621154; Annot_ID_173394

SEQ ID NO: 32280 - DNA, 3000 bp, Unknown
  misc_feature (1)..( 3000): 2750-1469P.txt file - cDNA_ID_3050933; gDNA_ID_1621154; Annot_ID_173392
tgagctcgagaggcgttcttcagcgattttgggggtttccaatgaaatcgaatggagccagaccttttgttaactgttaattaatcgattttattttgttatttcgcgcattaaatataacgactgtgacctaggttgacccaaataaaggtatttaacgggcccaaaaagaaatttgtaggccttttaatgggccatacactttcagagcccatttaataggttgcgttgttactacgaactcattataaatatgaaccgtagccccaatcagagagattcgataccgtctgcaactctcagctactttttccccaattttgagctcaacatcgaaccctagctcaacgaaccaatcatgtcttccaagcaaggtacgttgctgttatacagagatttgagttggtgattcgttcaccgaataaagtgattagagacatcgtttacgatctgctcatcttattttggttttaaacaggaggaaaggcgaaacctttgaagcagcctaaagctgataagaaggaatacgacgaggtgactctactgtttcttttttcttttaagagttggattttctgttgatttgccttcagctaaatcggcttatattgttagctttagacctcgaatcaaacgatgcttttgctctggatctggttttgattgtccaactaacttgaattcttaaaatttgttaacattcagtgactcataaatcattaattttgctcggattcaatgatttatacgcaagttcgaattttgatccagtgtttttaagggcacagtcttgacttcttcacttgattttgtttgcatactatttgtgtattaatgactcttagacattctctaattgctgaaatgttgatttggtatcaatgcagactgacttagctaacattcagaagaagaaagatgaggaaaaggtgagttcccactttgatgctctgacttgttttctctttttgttcatatgaagttttgtgattggaaaaatgcatctagttaaacttatatgtttgggctcctctttcaatggaaagctataaaatacgaatcaaagattgtatcttcacaagagagcttctgtttagatacataggtttgtaaaggttttgtaaaggttgtgcattaatatgttccactttgtcagtttggtctactaatcaagctgactctaattatgactttatagctggtgactacaactagatgggtcatttctattaattatttgttagtttaggggtattcattacagattcttttgagatgatatggactagtttcttcttactttgatgaaatagtgaccatttgcccatgttaggatgtttagtctactttttttccacccaattgtgtgaaagactcattagcctttctttcgcatgagaagtacagtgatcatttgttaccgaaagcctgacctgttttgttttgaatgaaaatgataaaacaggcccttaaagagcttagagccaaggcatcgcagaagggatcctttggaggttctggacttaagaagagtggcaagaaatgatccgttttatccatgaagtgtgttttaaaatgcaaatttatcaagtgaaaaaaacagataatcctgtgttgatgtaactttttatcataattcgagaagagtaacttcgcttctccatacatatgtttgctttctccattttttcatgaaaaagaaaagtggtatctaccctaaaatcattttgtcaagaatcgagtagtagggtgtcacatctctatcttcagatatagtattataaactgtaagttgtcataacttgaagtggaaaatatgttgcattgatagtagttgagaataggagcgtaacttgactctacaagatgaggtagaaactgagggtggtgacaggtgattttaccaaagcggtgtgtgtaatggttaacactgttcttaagaagtgcatactctatagatgaaagaactacagatagcccgtgaaagcaaagctgatccagaggaactttaaagcctgaaggagcctgcctttctccttgaaccgttgatcttagcagaggtacgaggatcagagaactcgtaatacatgtctgtgaagaaattgtcaacaatgtcaagatacacaggacttctgatgcttgaatagcatcgaagcgcttcccttacatccaatgcgtgatccacgtctctcagatccaccatattgagatctttcatcttttgcgccaacgcgtcacctcttttctttgcatcctcgaatggctcagcgactttcttcggtttctttttatgttggttgttgagactcttctggtgtgttgtatctgccacagccgtgtcacaacagataacggtgtagctttctttggtttgggtttgggaatcttctggacagcggcggctgcaggagtaagggctcaagagaggagtgtcgttaggtaagtttttgtaatcactagagcagatagtggacttgatgctcccaagagtcttctttaagaaacgaccaactctctgaattgattttgatgtaggtttcatcatctttcttgctgctcatttttttgagaagataaccatatttatgtcactagggatctcaaaaggaaacctaacattgatttagtggcatgtagtagttgaagaagcaagctgatagtgtcagactttaagaaggtgtcatcttgttgattgtgttgtccacttttataggtaagcaatcgtcatcacattgataagcagtgttcaaaattggtcccctacttatcattgccaccaccactcactactcatattatatatactgtatgccagttgactcgaggtaatatcagaaccaggcccatgaagcccattaagaagcccatatttttggcggtaaccaatgaagatccattttgggtaggaaaaaccctaaaggacgctacacagtcgtcttctcggagccgcaaagatttctgtagagcaaactttgatcatcccctgcatctgcggcaatg

SEQ ID NO: 32281 - DNA, 3003 bp, Unknown; identical to SEQ ID NO: 18553
  misc_feature (1)..( 3003): 2750-1469P.txt file - cDNA_ID_3050935; gDNA_ID_1621154; Annot_ID_173391

SEQ ID NO: 32282 - DNA, 3003 bp, Unknown; identical to SEQ ID NO: 18563
  misc_feature (1)..( 3003): 2750-1469P.txt file - cDNA_ID_3050972; gDNA_ID_1621154; Annot_ID_173373

SEQ ID NO: 32283 - DNA, 3003 bp, Unknown
  misc_feature (1)..( 3003): 2750-1469P.txt file - cDNA_ID_3051020; gDNA_ID_1621155; Annot_ID_173486
atccaccattgaatctcttcaagaagctttcttgggagattggtctctgtgattttggtggaaagaggttagggagcgagaaaggctttcgtggttctgatcttttctcggataacaccgacatagggctaaaagttgcggttttcagagcttccatgactctctctctctcagattctccttctacaccaagaattgtccactccgtatcatcaaacttttcccaacgattaaagatgatgaagaagaagtggaagaaaagtgtcaaggacaagagcattgagccgtttctagagagctgacgtggactgtgtaatcaatcctagccaccgcttgcttgacacgtggaatattcggatgagatacctcttgatcatgttttggtgtagaggactaaagcatagtgacttacttagtccgaaattgcatgtcaaatgtgtggccagagaatattgaagatgcttcaagagaagcctctgcatatttaccaaaatgtcctttatctagaacacaaagaacagagactagactagatacaaaaggttcctcagcatttgatttaagtgaacaaagaggatcaagtataacattaagaaaacataacatgatgcaatgtatggaacttacaatagatcaaagaaataatctaaaccttgtccgatttcccagattgaaatgccgattccccagagacgagcattctcaagccgtagaaggattgacatcaatgtaggatagaaaacagcatgcttgatgttcttatcatctctatacatgaaaagatgttcgccgctctctttatcccaacggaaagttggcttgtgtttctggagtaatgcgaggtaatcccttccggtgattgctcctccacctcctgaatcttgcgcaaaagaaaacagtttatgtcagttggttttgaaagaaaggcgggaagagaacaagttgcttatataagcttggatgctttatatacctccagagattacaaaatcgttgccgtaaaagttgataccaagaagaaccttcctggctatgtttgagtctatgttgttggatgacccaagcaggagcttgagagttaaatctatccacttgacaggagcattggggccagggttctggggatttgagaaatcataggtcataagagagaacccatcaaccgaatctttcaagaattgaagatcttctggcccaaaatcgtacatttggagcttctctgaacgaggcggaccaacgacatacatgaactgcatatgttgctggttgtttcttggtgagctcgttgagtgaagagcgtctccaagttgttttacgaatttcagtgcctagaagatttataaaaaagcttgctgacatgatgcattatgtggaaaaaaaatcgcagcggcctggaagagattacagggcataccattttccgcaaatcagggtcatgcaaaacgccataagctgcccaccttgaccaagactctaacacgataccattgtattccatttccctagagttcaaggcaaacatgatgacaaggtaagtgttaaaattcacaagctctaatgtaaagaaattcatccttttcagagcatgaaatatacaggaattgtagagctttgggagacccttacttgcactctgtgacaataagactgatagctttctctcttagtttttttttgttaagcatctccccaggaattgcttctagaacaactcttggtaatatctacataaaaggggaaaaaagtccagacaatcaaagaaggaaaaacaagttaaacatcagcattttccgggtaccgatctctggccaattcagagaaggaagaaaaataggtgtgctggttaaactaccagtgcattgcctcttgaccgaagctcttgaatccatcccttatcagcattatgtctcccttccaaaaccaatccagacccttggctaccagaaacagaaaccaaaaatgtcactactattttgtggaaaccatgagataattgcaggaacttagaactcattaacaaatgtatacaatatacctcttcaggtcgtaccataccggcgataaatgtgtaaactttgagttgaatatctttgccatatcatagcctttagagttcctacacagcatttttagcatatgaatccaatccctactgccctcagtgacaacaatttgtatattttcaatatctcaaatctaaaaatgttccaaagaaaccaaccatggagtaatgtaagctaacactggataatcatagtgcctagttgaattctctgaagccttggaatgttcctgaaacaaattcaaaccaaatttaatgaaaattcatcctaaagttttcagcttttcttctttgaattgcaacattgacccaaaactatggaactcacagtgaggatttcttggaaattaatatcagttttaacgattcccttttgacgtattgatgattccgtttggatgactcgatcagcgaatttgactttgtacacagcaatcgaaacggcgggaatcacaatgaagaagattacgaaaatggtgatgagtctccgatctgaatcttgttgtacgacttgacacagtgactcgtatccgtcgttccgccgtttcaaactctccgccgccgatgaacgtcgcctcctcgccatcgagtttctcaccagtgaaacagagaacgaaacaacatcgttagaactaggagatttttggaatgatgttaattccatatttacccctgcttctggtcaaatattacgttaaagaccaataagaggatatcagagagatggacacatcattctggaaaaaagaagagggttttatgacttttatcgttaaaccccaatccaaatcttcgcgaccagaaacagattcttctgcagaacctcttactagattgaaccgaagggataaggtaagatttttttatttcctggaatcaatttttcgtcggagaatacttattaggagttatcaatttacaggcttggagtctcagaaatg

SEQ ID NO: 32284 - DNA, 3003 bp, Unknown; identical to SEQ ID NO: 29141
  misc_feature (1)..( 3003): 2750-1469P.txt file - cDNA_ID_3051024; gDNA_ID_2926150; Annot_ID_197996

SEQ ID NO: 32285 - DNA, 3000 bp, Unknown; identical to SEQ ID NO: 7660
  misc_feature (1)..( 3000): 2750-1469P.txt file - cDNA_ID_3051024; gDNA_ID_1621155; Annot_ID_173485

SEQ ID NO: 32286 - DNA, 3000 bp, Unknown; identical to SEQ ID NO: 22887
  misc_feature (1)..( 3000): 2750-1469P.txt file - cDNA_ID_3051028; gDNA_ID_2926150; Annot_ID_198000

SEQ ID NO: 32287 - DNA, 3003 bp, Unknown; identical to SEQ ID NO: 18568
  misc_feature (1)..( 3003): 2750-1469P.txt file - cDNA_ID_3051028; gDNA_ID_1621155; Annot_ID_173481

SEQ ID NO: 32288 - DNA, 3003 bp, Unknown; identical to SEQ ID NO: 18569
  misc_feature (1)..( 3003): 2750-1469P.txt file - cDNA_ID_3051032; gDNA_ID_1621155; Annot_ID_173478

SEQ ID NO: 32289 - DNA, 3000 bp, Unknown; identical to SEQ ID NO: 29151
  misc_feature (1)..( 3000): 2750-1469P.txt file - cDNA_ID_3051042; gDNA_ID_2926150; Annot_ID_198013

SEQ ID NO: 32290 - DNA, 3003 bp, Unknown; identical to SEQ ID NO: 18571
  misc_feature (1)..( 3003): 2750-1469P.txt file - cDNA_ID_3051042; gDNA_ID_1621155; Annot_ID_173468

SEQ ID NO: 32291 - DNA, 3000 bp, Unknown
  misc_feature (1)..( 3000): 2750-1469P.txt file - cDNA_ID_3051046; gDNA_ID_2926150; Annot_ID_198014
agtatatggactatgatgttggagaaatctgcaatgatgattggagattagctcagaagcttatggttcatggatgcgatccgttgcctagaagacggtgcttctcccgtggcccgcagttataccacaaaccgtttccaatcaacgagtctttatggaagcttccggataatcggaatgtgagatggggacagtataagtgcaagaactttgcttgcctagcaagcaacacaacagcacgaaaagggttctttaaatgcactgattgcttcaacctcacgcaccacgaatctccgagatggcttaaccgaggcgaaatcgatcctgagacgaaccaaactgcggatttctcgatagctgaagtactcgagattaaaccgggagagattagaatcggactggatttcagcattggcactggaactttcgcagcaagaatgagagaacagaacgtcacgattgtatcagcaacaatcaaccttggcgctccattcaacgagatgatcgctctgcgcggtttagtcccgttgtacttaaccgtgaaccaacggttaccgttcttcgacagcacgcttgatatgattcacacgacgaggtttctcgatggatggattgatctaatacttcttgatttcgtgctgtttgattgggacagggttttaaggccaggtggattgttgtggatcgatggtttcttttgtctgaaagaagatgtgagtgattacatggaagcgtttaaagcgttgaggtataggaaacataagtgggttgtggtacctaagaaagataaagatgataaagaagttttcttctctgctgtgttagagaaacctccaagaccctttagatgattgatcattgcatagtctctgtctttactattatctttgtaatcatattcttaaaacaaaacagaatgtcaaaataaactgagttatattttagttatatgttccaatttgcttgtataaattcagactaagaatttcaccaaaagtgttatatgtttgacatttatgtttgtaatccattgtgatcaatatgatacgacgtagtaatgtaactctctgagcgagaaagagggttctccattttgttgttaacaacaaaagcaatctccactaggttcgggatgaacgaaccaacaggctcggaccgtggaacgcgcggtatataaacaactttgcctctttgttcatcgattccgttacatcggctcattggaggaaatcggagaatggaggaggagaagctagaaatcgtcgggcctttggaggagccgttgatgggaaacatcgtaccagaggagatcaatggcttggattcgcttacgtcgtcggattctgatagcgagaaaccagattcccccgttcccataaatgctccgatctaccggatgtttggaagagaacgaccaattcacatggttctcggcggaggtaaacgtatgaaacattctctacactcgttcccattttcatttctcacagattggttcggtctgatgatatatcgcacttagggtttggatgatgattagattgcgtgtgaaactgtagaaatagagattaatggggattgattgaatatgtgacctaatttgttgaagctgctgatgtgttgctatggagagacaagaaggtcacgttaggattactcagtgcagtgactgtgatttggcttttgtttggatttggtggtcgtcgtcttctcacatctctttgtcgtggatccattctctttctgcttctatcattcctctggtccaatgccctcaacaagtaaagttctttttgttcgccacataaccctgaaatatgttttaagtaaaaactcaatccttgtttgctaatctatcatttatagatctccagagaacatgatggatatttacatacctgagaagccattactccaagctgcttctgcgatgacatttgagcttaattgtgcttttgcaaccttaaggagcattgctttagaaagagacatcaagaactttgtaatggtacttgtttagtttctcaagtctttttttagagaagcctctgatatgatgattgctttctttttgttctgaaacataggcagtcataggactttggctagtatcggtcatcggaaactggttcagcttcttgtcattgctctacatttgtaagtacacactggttcttctcagactcttgttttttctttctatttagggataatgtcatgacctaaatgaaaccaacaggttttgtactaattcacacggtgccaatgctttatgagaagtatgaagatgagattgatccaattgcagagaaggctgtgattgagatgaagaaacattaccaagtttttgaagctaagtttttaagtaagatccctcattagccaaaccactcaaaacatcgaaattgaattagattcgatttgcttagtttagttcattcatttattctttctttagagtccaaatcatttcgagtcattcctctgttcatgtggttttggttacttcgtcctcaagtcatctaaacttttgtggatacaaaattggctgggccttgaaaataattctctacatagctatgaaattctaaagcttacagtttaaattagttaagtttatgtgtttattttttctttagctaagatagcaacaaatcacacaaaaaacaaccctttaacgaacaaaacaaaaaaaagaacacatttgaatgggcttaacttcaatgtttcaagcccaatagacaccgacagatccaacattacaacccgattttaaaacgggtaaacaaataataaacacttcccaatcgccattgttactctgttttgagatctccctccacgcacatatcatcagatctacacttcccactcaaaattttccagaattcccaaattcttctctgtatatttcctctaacactctcgaattcactccctaacttgtgatttaaaacaagtcttctcaaattttgttcatctccagctacaaaaaaaatg

SEQ ID NO: 32292 - DNA, 3003 bp, Unknown
  misc_feature (1)..( 3003): 2750-1469P.txt file - cDNA_ID_3051046; gDNA_ID_1621155; Annot_ID_173467
aagagtatatggactatgatgttggagaaatctgcaatgatgattggagattagctcagaagcttatggttcatggatgcgatccgttgcctagaagacggtgcttctcccgtggcccgcagttataccacaaaccgtttccaatcaacgagtctttatggaagcttccggataatcggaatgtgagatggggacagtataagtgcaagaactttgcttgcctagcaagcaacacaacagcacgaaaagggttctttaaatgcactgattgcttcaacctcacgcaccacgaatctccgagatggcttaaccgaggcgaaatcgatcctgagacgaaccaaactgcggatttctcgatagctgaagtactcgagattaaaccgggagagattagaatcggactggatttcagcattggcactggaactttcgcagcaagaatgagagaacagaacgtcacgattgtatcagcaacaatcaaccttggcgctccattcaacgagatgatcgctctgcgcggtttagtcccgttgtacttaaccgtgaaccaacggttaccgttcttcgacagcacgcttgatatgattcacacgacgaggtttctcgatggatggattgatctaatacttcttgatttcgtgctgtttgattgggacagggttttaaggccaggtggattgttgtggatcgatggtttcttttgtctgaaagaagatgtgagtgattacatggaagcgtttaaagcgttgaggtataggaaacataagtgggttgtggtacctaagaaagataaagatgataaagaagttttcttctctgctgtgttagagaaacctccaagaccctttagatgattgatcattgcatagtctctgtctttactattatctttgtaatcatattcttaaaacaaaacagaatgtcaaaataaactgagttatattttagttatatgttccaatttgcttgtataaattcagactaagaatttcaccaaaagtgttatatgtttgacatttatgtttgtaatccattgtgatcaatatgatacgacgtagtaatgtaactctctgagcgagaaagagggttctccattttgttgttaacaacaaaagcaatctccactaggttcgggatgaacgaaccaacaggctcggaccgtggaacgcgcggtatataaacaactttgcctctttgttcatcgattccgttacatcggctcattggaggaaatcggagaatggaggaggagaagctagaaatcgtcgggcctttggaggagccgttgatgggaaacatcgtaccagaggagatcaatggcttggattcgcttacgtcgtcggattctgatagcgagaaaccagattcccccgttcccataaatgctccgatctaccggatgtttggaagagaacgaccaattcacatggttctcggcggaggtaaacgtatgaaacattctctacactcgttcccattttcatttctcacagattggttcggtctgatgatatatcgcacttagggtttggatgatgattagattgcgtgtgaaactgtagaaatagagattaatggggattgattgaatatgtgacctaatttgttgaagctgctgatgtgttgctatggagagacaagaaggtcacgttaggattactcagtgcagtgactgtgatttggcttttgtttggatttggtggtcgtcgtcttctcacatctctttgtcgtggatccattctctttctgcttctatcattcctctggtccaatgccctcaacaagtaaagttctttttgttcgccacataaccctgaaatatgttttaagtaaaaactcaatccttgtttgctaatctatcatttatagatctccagagaacatgatggatatttacatacctgagaagccattactccaagctgcttctgcgatgacatttgagcttaattgtgcttttgcaaccttaaggagcattgctttagaaagagacatcaagaactttgtaatggtacttgtttagtttctcaagtctttttttagagaagcctctgatatgatgattgctttctttttgttctgaaacataggcagtcataggactttggctagtatcggtcatcggaaactggttcagcttcttgtcattgctctacatttgtaagtacacactggttcttctcagactcttgttttttctttctatttagggataatgtcatgacctaaatgaaaccaacaggttttgtactaattcacacggtgccaatgctttatgagaagtatgaagatgagattgatccaattgcagagaaggctgtgattgagatgaagaaacattaccaagtttttgaagctaagtttttaagtaagatccctcattagccaaaccactcaaaacatcgaaattgaattagattcgatttgcttagtttagttcattcatttattctttctttagagtccaaatcatttcgagtcattcctctgttcatgtggttttggttacttcgtcctcaagtcatctaaacttttgtggatacaaaattggctgggccttgaaaataattctctacatagctatgaaattctaaagcttacagtttaaattagttaagtttatgtgtttattttttctttagctaagatagcaacaaatcacacaaaaaacaaccctttaacgaacaaaacaaaaaaaagaacacatttgaatgggcttaacttcaatgtttcaagcccaatagacaccgacagatccaacattacaacccgattttaaaacgggtaaacaaataataaacacttcccaatcgccattgttactctgttttgagatctccctccacgcacatatcatcagatctacacttcccactcaaaattttccagaattcccaaattcttctctgtatatttcctctaacactctcgaattcactccctaacttgtgatttaaaacaagtcttctcaaattttgttcatctccagctacaaaaaaaatg

SEQ ID NO: 32293 - DNA, 3000 bp, Unknown; identical to SEQ ID NO: 32291
  misc_feature (1)..( 3000): 2750-1469P.txt file - cDNA_ID_3051046; gDNA_ID_2926150; Annot_ID_139274

SEQ ID NO: 32294 - DNA, 3000 bp, Unknown
  misc_feature (1)..( 3000): 2750-1469P.txt file - cDNA_ID_3051048; gDNA_ID_2926150; Annot_ID_198015
ccactcaagacgtgtaagatgcaaaaacttcttttcagattgcactgcagtctactcttttttattctcaggcccaaggacaggttttggttgggaaaagtacagttgttgacgaggatgcaatatcgagtggcgtggctgaaaatgagttagcagtagatgaaatctacacttgtgaggcaagcttttctatgaaaaagaaaaaacctataattgttgttataatcttgtttatgatgtttgtctctgacttgtttagatttgcaccggttgagtctctcgagctcgccaaaccctgtttcccatctccaagttactttatgttgtgtgttctacaaaatcgttgagaataattcattggattctatagtttgagactgaactctgatcttttgaatctcctggaacttaatggtttcgatgcaaaagattgaggcctctattcttcaaagcctaatccttgagtcccctatggcagcgcttatattattttgtgtatttccatgctactctgtagattccactttcttgtttgatgatcaagatttctgctttgatttcaggaattacttaacagatctggtgcaagaactttggaaccaaggacgatgacgaaagagagcactaaagttgatctatagttttcactttcctagtacagtactgtgtgagtgtgagtggattgatgatgtacagcagctgacattttccctctgtaatttctctaatatacagcagctgatatttccactataaattatgggatgtgtatcaatatggaaatatattaagataaatactttattaaaaggttttgatttataagctttctcattacttgctgctaaatttattagtttcctccttgaattcagcaacttttcttgggtttagccttgtaccatcgtggcatttcctataaacttcagaaatctccatgtgcattctactacgcttgtgctttaagtatgttgaatactattagataatttcccaaggattatattaattccactaatccctaggttagctgcaagatgaagttaaagttcacaactttatctctgcaactagattttgagtattttgcttctcatttcagatcttctctaagaaaagacaaaagaagatggtgttagcttgtgttcttgttgattttgtctgagcttgagggatggggaagacgaatgtattatcgaagatcagagctttcaatggcgtcaatagacccatctatgtgttggcaggtttggcttttcttatctcagtagctacattagctaagttcaactacatcactccactacgcttctctgatcggttctgtaactatcatggaagctttgacggcgacaactacaacatcggaagccaaatgagaaagacaatcgaaaccgccatttttaaaatccaccaagaaatggatgatctcaaggctttagaagctaattcttctactcctccatcctctgtttcatcagcttcaggatccatgtttaggcatgtagcttttcttgcggatgttctttcgctagttcagtcggttcatatggaattgccttcgttcgaagagagatccgtagcagatcatccgttgaagcagcagaaaggtgaccctggtgagcattttatgagagaagagataaagaagtacataaagatcaaacctaaccggctcgggaagcagaatttcatgggagctaacggaacattcacctcgatcgggcacgcttgttttgcgatgaagaaagatctagaagagtatatggactatgatgttggagaaatctgcaatgatgattggagattagctcagaagcttatggttcatggatgcgatccgttgcctagaagacggtgcttctcccgtggcccgcagttataccacaaaccgtttccaatcaacgagtctttatggaagcttccggataatcggaatgtgagatggggacagtataagtgcaagaactttgcttgcctagcaagcaacacaacagcacgaaaagggttctttaaatgcactgattgcttcaacctcacgcaccacgaatctccgagatggcttaaccgaggcgaaatcgatcctgagacgaaccaaactgcggatttctcgatagctgaagtactcgagattaaaccgggagagattagaatcggactggatttcagcattggcactggaactttcgcagcaagaatgagagaacagaacgtcacgattgtatcagcaacaatcaaccttggcgctccattcaacgagatgatcgctctgcgcggtttagtcccgttgtacttaaccgtgaaccaacggttaccgttcttcgacagcacgcttgatatgattcacacgacgaggtttctcgatggatggattgatctaatacttcttgatttcgtgctgtttgattgggacagggttttaaggccaggtggattgttgtggatcgatggtttcttttgtctgaaagaagatgtgagtgattacatggaagcgtttaaagcgttgaggtataggaaacataagtgggttgtggtacctaagaaagataaagatgataaagaagttttcttctctgctgtgttagagaaacctccaagaccctttagatgattgatcattgcatagtctctgtctttactattatctttgtaatcatattcttaaaacaaaacagaatgtcaaaataaactgagttatattttagttatatgttccaatttgcttgtataaattcagactaagaatttcaccaaaagtgttatatgtttgacatttatgtttgtaatccattgtgatcaatatgatacgacgtagtaatgtaactctctgagcgagaaagagggttctccattttgttgttaacaacaaaagcaatctccactaggttcgggatgaacgaaccaacaggctcggaccgtggaacgcgcggtatataaacaactttgcctctttgttcatcgattccgttacatcggctcattggaggaaatcggagaatg

SEQ ID NO: 32295 - DNA, 3003 bp, Unknown; identical to SEQ ID NO: 18572
  misc_feature (1)..( 3003): 2750-1469P.txt file - cDNA_ID_3051048; gDNA_ID_1621155; Annot_ID_173466

SEQ ID NO: 32296 - DNA, 3000 bp, Unknown; identical to SEQ ID NO: 32294
  misc_feature (1)..( 3000): 2750-1469P.txt file - cDNA_ID_3051048; gDNA_ID_2926150; Annot_ID_139275

SEQ ID NO: 32297 - DNA, 3003 bp, Unknown
  misc_feature (1)..( 3003): 2750-1469P.txt file - cDNA_ID_3051057; gDNA_ID_1621155; Annot_ID_173460
aatttggggtttagatctcagcactttgattctaccacctttaccatcaggtccaatagagatgagatcatcttttcttggaacagaacctcctagtgatggagttgcttcgtttctctctccatgtttgctccatctaccaaggtttctatttgttccacttgactgccaaatgtttccactacctgcattggacaatcttcaatctactactacactcaagaacttgaattcatgatgtacaacaaaagtaccattgctgtaaggtgacactgatgatgtcgggtcttttctgatgttgaactttatatccttcaccatggaattatcacctttctcttcaatattagtattccaatctctaatgccagaagtgttggtttcaggaacataatcatcatctacatctataaccgagtctgttctgctaacgaaggagtcttctcttccccttaagcatgatccttgaatggtaaagccatccttttcttctaatttaccaggtggtgtggagattttctccactttgttgtctgatgaaagcattctgaaagaagacatgctctcgattgcaggctcggaaacttctgtgtaactgcatttctttgaaacgtttatgtcccgtagagctctgttctctctctcttcagttatcaactcaagttccctcattcgtttctggtcatagaataaacataataagagccagatatagaagacacaaagaagatcgagataaacaccaaaacacacacctttagtttttctatcttttccaaagctttttcaagtttctcagaagatcgtgcttcgcctcttcccagctgattgcacttggctagcaattccttataactcctgtcagagtaagaaagattgttttttattagagacttcataaaagaaaattcaaagacctaagagaaaagaaacgcaatgttcaatcctcctttcctcaaattcttgaccatacctacttatgaaatttcgtaatttcagtttaacaagttgttgttacgaatgaactaaggtaaatcaccatttcataagtcactgaaggtcaaattaatcttttttaatcggattacactgctgtagacatgacaaatgggaaataatgaaccaagttcactaagtcaatgaccaaaatgagagcagggaaggagtgacaactaagtgctaagcacctacctatatcaaataaccaaaactaagtgaagccatgtgaactgagtggaactaatctatgtgacaaacctattccgaataaccaaggacttgactagtgtgtctattgtatctttcgtcttcgcgttattccccaacaaggccaacttcagtacatcatcttcctccaagcttaaatcagaaaccctggatgcaaaacaagatattagactcagaaaaggtttaaccatacgagtgaatgattaaattagaacctgaagacactaaaagagcaatatgaaagatgttatcttacaatttaagcgatgcgagctccttggcaagagccacagttctctcctgtagcttaacacactgtgagttaagctggatacattcctgtaacaaacaaacacactaagaaactcaacacaaaattctgcctgtgaagcaaaaaggatctaaaatctaaggatgttgtatagtttaaacaaacctcagattttaacttaagcaaatgctgagtcgttgatatttcttgaagagcctcccaccttttcactttatcctccttcaattgctcattgcattgatgcaactgagacacacacaaacaaaaacaaaaaaaaaaaaaatcacataaccttatcttatcttataaaccattctaatcaaacgaaatgaacaaaattaaccttatcagagacttcaacattctcctttttcttcgcctccagagccgaagtaagattctgtaccttcccttcaagccgcttcacttctcctctcaacaaaaccggatcttcttcgattccaacaaccttatccgaggcaatcgaatcggtttgattcccagaagactgaaagtaaagtcgacaaggatcctttagagagcacttctgcttacaaatcggacaatttcgcttgttcgtactcgggcaatactcaaaccattgctgcaaactagggtttccgaaagaaatcgattaaacacataaatctataaaatttcggagataataaacttcattagagaattgattttgccgtactaaccaaagttcgtgaaagacatggccacaagcggagattgattgcagattctcaaccaccggtttaagatcttcgtagcagattgaacaaattgcattccccgccgcgttttcttcggccatagctatctctccggcaatcaccgactagtcagtttccgacacagtcaccattttcttctcgagaaaatcaaaaggcaaatatcagagagcaaacacatggcgcggataaaaagttgaaatttcaatggtaagcgcgaaaatctggggaaggatagcacgtgtaagtcacgtgagataaaaacataaacaaccagtggcttgtattaggcccaacgtttttaccctataggtccattaaagcccaaatcagctattgatcagtggtcaaacacaatgtttaaattaatgttgacttaactcgtttttagtaatactagtacatcttttcgcatgcactaattaactcactctcgagagtagcgttcgtgagtctcgaggtttctcactattttttcttccgcagcgtcaccgactcagatttggtggtgctaggtcaccgtgttcttcacggcgttcgggagaatgtcttagttaccccagcttctccctaaggaaactccactactgttcaaaatccctttcctacacatctgtagttaaatgtcacataatctgttgaattacttgaggcttaaggtgtaaatgttatttttccttggcagagacctaaggtttatgtgtgtcttccagtttaaattatgtgtgggtgactcagagaatg

SEQ ID NO: 32298 - DNA, 3003 bp, Unknown; identical to SEQ ID NO: 18574
  misc_feature (1)..( 3003): 2750-1469P.txt file - cDNA_ID_3051064; gDNA_ID_1621155; Annot_ID_173457

SEQ ID NO: 32299 - DNA, 3003 bp, Unknown; identical to SEQ ID NO: 18583
  misc_feature (1)..( 3003): 2750-1469P.txt file - cDNA_ID_3051072; gDNA_ID_1621156; Annot_ID_173519

SEQ ID NO: 32300 - DNA, 3003 bp, Unknown; identical to SEQ ID NO: 18584
  misc_feature (1)..( 3003): 2750-1469P.txt file - cDNA_ID_3051076; gDNA_ID_1621156; Annot_ID_173518

SEQ ID NO: 32301 - DNA, 3003 bp, Unknown
  misc_feature (1)..( 3003): 2750-1469P.txt file - cDNA_ID_3051080; gDNA_ID_1621156; Annot_ID_173515
gcagccactcctgctcaccctgaaggattatatggttagagctctctcactagttcattatcatattagaggccatggttatatcacttatggcatttcccatcatgatgacattttacttgtttttgatcagtcttatatgcaagttgtttggttggaaatttggttgagcaactttggaattttgcttggccgtccgccattgcaatgctatatccgagcttactacctgtggcagtcatggggtttgtcactaaattggcgataattgctggaggccctgtggttggaaagtttatggattatagtccgagagttcctacatatatctcgttgaatgtcattcaggtaaacttttcaaaaaacactgaatgaaaacatcacacatgactttgtggttactttccttcaacttttgtcacctgacattggaattaagtgtccatgtcataaacttattttatgtctacatgtttaggcagccgctcaagtgctatctgcaggaatgataattcatgcatacacggttccttccacatcggcgtcatcaattcttctgcagccttggttttttgcattgttattcgcaggggccattgacagtctatgtggaatagcatctggagtcgccattgaacgtgattgggttgtattggtatgctttctttgtgatgccatagaatacctgtttttataagaagataaaccgactgaagtaattaatttatcatttggtagttggccggcataaacagaccaatcgctcttgctcaagcaaatgctgttctccacagaatagatctgctttgcgaggtatagtaattttctctatggaatctatgtactttatgccctttgaacttttgaactccagtaattcatcaattgacataattgtaaccttaaatagatagctgggacgatgttatttggcattctcctatccaaatatgaccctgtgacctgcttaaagtttgctgccacactaatggtgggttctttgccaaccatggtaagtagcacctataaacttgtggttattcttctttcgtccaagctaaataagggaaacacaaagctgctgtgttgtacgaggctgaactatgtgtaatagaatcattcctgtttcctatgtttcaagtttcgaattcttttttcttcaattaaaaaggcagtctttctcgtttaggttttggataattggagcttagcctagatggagtattattagttcttttaactagataaataagctgtcatcaacattggagtgatactgttctgcttcagatcctagaagcaattccacttgcgctttaccaatttatatgggacttcttaccatcttgcacttctaatagaagaaatctgttttcttcagacagctcttatatggctgaccaacaagttctcctctggagttctggaccgtcctaaatgctccttgaacagctgttctgctgaaggatctcgtactaataccgacagtatttgtaaggaaaccttttactttatactacttggatacgcataatttatgatttgagcatgtagtagacatcacaaaataccatttgctttgttcatcagttgatattggcatggaaactatcaagctcggatggaaagaatatattcaacagccagttcttcctgctagcctcgcatatgtccttctctactttaacatcgtcctcaccccaggcagcttgatgactgcatttctaacacaacgatgtatgctacttcgactcggtcccttacttttctttagtgcttggatgaaaatcgtaattaatcttgcgagagtctttgtgctattacctattactctttcaaattagtcaccaatctgtcttttttcaacaggtgtgaatccatcagttattggtggtttcagtggattatgcgctgttatgggcgtcgccgcaaccttcttatcagcaaacttggtcaaacgagttggcattttaaaggtgaaatgttttcccgccatttgttatcttgagcttgtattgcgttcaagctgattaatgttattgcgtttgcgttttaaaacgatgcaggcgggtgcagtaggattgtttttccaagcttcactccttgccgttgctgttgctgtgtattgtagctcttctctatcccataaaagcccactcttcttcttcttgtccatgatcgtaagttgtttcttcactctctctctcgaccagtaatatgcggttttggtgttgactaaaaggtaacaaacaaatgcaggtattatcaaggctaggtcacatgtcttacggcgttgtgggagctcaaatacttcaaaccggcattccatcatccaaggctaatctcatcggcgcaacggagatctcagtggcaagtctagctgaatcgcttatgctcggagtagccatagcggcgaatgacgcttcccatttcgggtttctcgcggttctgtctcttttatcagttgttgcggcctcattgatattctgcagattgctgagaaatcccactgatgaacaaagacgactcttctccttcgaccctctctcaaattgatttggagcttttacattgaaatatttgtatagtagtttcactttcagtgtataaattctttatataaagtaaagaaaaaaattgactttggtgtgaaaaattcaagaagtattccacttccaccattactactctaaacaaaaagtactaaactggctaaaccttagttatttttctaaaccgagaattaacgagataatttaacaatcgatttcaaaaaccagcaaaccgaaatcacccaatttttggtcggtttggttcgattttgttttctttcacccctgacgaagaaaaaaaaaaccctagtcacactcagataacataaacctttgacaacaaattttgatgctccttcgtcttacggctcgctctattcgtcgtttcacaacttcttcttcgtctctaccattgctctcatcgtcttcgttttgtactgttccaacaatg

SEQ ID NO: 32302 - DNA, 3003 bp, Unknown
  misc_feature (1)..( 3003): 2750-1469P.txt file - cDNA_ID_3051084; gDNA_ID_1621156; Annot_ID_173514
cctcctcttctagtcttcttatgattatttttcttcctcatcttgttttttttttttcagacaaaaacctagatagctaaacatgccttgtttgttcatcttcatagctttgcttctaagttcttgtattggaacgttgaaagcccttgatcagacttgtggcaacaaagtcgtgaacacaatcgtcgtcgaccaagccggttcaggtaagttccgtactgttcaagctgccattgattcggttggtgaattgaattctctatggatcaaaatcaaagtaaaacgaggtgtttacgtgtaagtaaataccaactctctactgtttttctttttccaattttagaactcagcgttcttgaccacaattttctagcatttgatttgtttcgaatgtaaaatattactgtcgttggtgtagaaataatgacctagtagcacttgacttcatcttaggcctctccacaattctacatttatactcaaataatttttctagtttcttcgttgttttggagagaattaaagcatagttgatatcattaaatcttgaattcgtgatgttctggttcatagaattctagaaccgtaattaatctaatttacaacgatttcgatggatttgcaattgttaattttcttaatagtaagattaacattaatagtaacatattgttttgtatgataatgaatgtataaaacagagagaaggtgataataccatataataaaccgtgcataatagtagaaggagagggacaaagagtcaccaccatcacgtataatggtcatgcagccactgacgtcagctcaactttcacttcatatccatcccatattgtcgtccgaaacttatcaatcatggtacgtaacggaacggaccaacatatcttttgacttatatactatattttgttacgtaacaatataattttgataatgataacattttatatgtttttgtggcagaacacttataatcgtttgactagtctaactaaagcaaacggtatgagttgggatataaagccagcggttgcgatttcggtttatggcgataaatcagcgttttacaactgtgatttcttggggttgcaagatacagtgtgggataatcttggcagacatcacttcaaaaattgttacatcgaaggtgctatcgatttcatttttggaagtggccaatctgtttacgaggtatgtatacttaatatctctctctattacgtacacttcgattttcaatggcaaaacacgaaaactgtacttgatcactatttacacaaagactgttacattcacagtacaaacacacttttataaaatctttgtttcaaaacgccctagaaaggagctaggcacagccacaccctgtactaaaatcagctttttgttctagaaaaagtaacatttcagtcattcaaataatagaaacaaacttggttaaaaccttgtttgtagcatgttttttcctagaacaaaactaaacatgtgacttgactagctaggaggactgattttttgtaagtcaacaagttgattttgagacaccaacgattaagatctatgtgaaacatgcatgaatcgtataaaatgtttgacaggactgtcatataaacgcaacggcaggagcattggcatcaaaagtgtcgtttgggtacataacggctcaaggaagaagtagcgattcggacccaagtgggttcgtgttcctacgaggtagtgtttcagggagcaccagtgtctatcttggacgagcctatggtccattcagtcgagtgatattcatccaaaccgatctctcttccgtcgtgcaccctgagggttggtactcttggcactatggtggatacgagtaagcacatctctaactataatatatcatatataccattatcaaactatatgtgataatgatgtttttttttgtgtgttaggatgagtttcacgtatgcagaagttgagtgtaaaggagcaggatcggatatgtcacgaagagttccttggattgataaacttcattctttttacactaaacaacaattctctatctctaatttcattgaccaagatcaatggatctctaatattcctcgtttttaaataaatcactttctcttttgttagattctagttgttttatgtaatttgtatttttcctttcttgttgaatattattgtctctttgaagtttgaactatgaagactttttattttcttaccttgtattcaaaccaaactgaaccgactatatatgtatgttttctcgtttcgattctggtacatttcgatcgctctttttatatgacttcggttttcatttcaattcggttcatctattacccgagtaaaccaaattgttattattattggttcattcattcattgtatttcaaattttgattctttatatttagtactctgccaattttcatcaaaattgcactaaaacaaaaacaaaaaaattagccaaattgtaaacgaatttgaaccaatatttggtaaaactgaaccgcaattccattcccagaattataccgaaccgttataaatacggttcaaagttcaatctcttcaactaaaaccgaacttttatctattcgaaccgaaccaacagacccaatggccatggatgatatggttagccaggtggctatggattactggttacaaataaatctacgtggcttaatctcccttacacaaaactctctgtgccttttcttccccacttgagctaattcgcttaaacggcgtgcttcgcgacgaaccgccacagataaggttcttctttttttttccaatatctctggattttttttcccctcgttgaagaaaatctagtggtgattaagccataggggaaacaaaacccagagagacgagtttgctagattttttttttttttggaggctgcatgagtttggagaagaaggcgagtagtacaaattacaactccagaaaggagaagaggagaatcaatttatagaatggttgtttcaatg

SEQ ID NO: 32303 - DNA, 3000 bp, Unknown; identical to SEQ ID NO: 7667
  misc_feature (1)..( 3000): 2750-1469P.txt file - cDNA_ID_3051091; gDNA_ID_1621156; Annot_ID_173501

SEQ ID NO: 32304 - DNA, 51 bp, Unknown
  misc_feature (1)..( 51): 2750-1469P.txt file - cDNA_ID_3051116; gDNA_ID_1621156; Annot_ID_57040
cttaatcattattttgaaatttgtaatgacttatgttctcttgttttcatg

SEQ ID NO: 32305 - DNA, 1943 bp, Unknown; identical to SEQ ID NO: 7672
  misc_feature (1)..( 1943): 2750-1469P.txt file - cDNA_ID_3051118; gDNA_ID_1621156; Annot_ID_173538

SEQ ID NO: 32306 - DNA, 3003 bp, Unknown
  misc_feature (1)..( 3003): 2750-1469P.txt file - cDNA_ID_3051169; gDNA_ID_1621157; Annot_ID_173590
ttcagttcccacttggtactcatacccgagaatctgaaagaagaaaatccaatggctcctttggaaagtccagcaaccgcttcttcaagcgaagttgagagttcttctgaagagatctttaagtcttcttctgaagaaagcaaacccaaagatcctgtcacagttccttcctctaaaaccctaaaatctccttccgccgctgtgaattctaagacagattcttctgatgactcagagaagcagtcattcgtcttaaccaggcggaagaagaaagaaggtgctgctgaatcaccggcggtgaagtcagggaagaagcgagctggtgaaggaagcacctcaagggacatgcatgtcaaaagagttaagaaagaggacgataacaaaaaggcgaatcctcagagagtatggagtgaagaagatgagatctctcttctacaggcagtgattgatttcaaagctgagacaggtacaagtccttgggatcataagaatgcgttttttgatatcgccaagaaatctataagctttgatgttagtcatgtccagttctttgacaagattagaagattaaagaataagtattttgttaaccggaagaacaaaagtggtgaatcgaatcatgataagaaatgtttgggtttggctgttttgatttggggatctgatggtatgaacgttgaatctcctgtgaagaaagatgaatctattcttgttaagggtaaggctaatagcaaggagaagaaggtggagaaacctttggttatagaagatgagcaagtgattcttggagcagattcggagtggtttgaggagtcttttcttgttccggttatcgcgaatctcggtttggatgagtattctgtgaagaagaagtggagcaaggtgtctctggagactaagaagaagattcaagagaagatgaaggttgtggacgctaagaaatgtgagttgttgttggcggagatggatgttttgaaggatgtgacttcggtgcttgctcaaaccaactaagaagaagaagaagaagaagctatcttagggattgtatagggttaatctaaggatgtaatgccctcttttgttatctatcttagggtttatctttctatctacgtttatggatttttagtcttttggattctcgtgtgagaattagctataacaagattaagataagttgtctaacaaaccttttggtcgatggttgtaatgaacttttaggattttgtaaatgtgcttctttttttaatgtctctctactcaaaactcatgaccagagttattacaaaacaaagaaacacacaatagaatggattcacaaacatattcaacaagagttctaaatagcttatatggtgataggttcaacctcattaaacaaaatggattctgaaatgatgtttgtaaattgtatatttattgtttatgataattacgtgcagtttgagttattctggtgacactagttcctctttctcaagtaccaaatgcaaccaaaataaaacatatacatttagttacaatctttcacagaagttattatgtctataataaaaaaattaagagattctgcatcttgaaactgcaaagtaggtgaggaaataaaaagaaacataaattgtgtttatgagcatgcttgttgttagagtcccaatatgtagtagagtagcttgcaagaaatcagagttaattatgcgtttaagagcatgcttgtgtgtgtaagtgtttcaagtaaaactataataagtatgtgtgtttgtatcttgtaagagaatcacccaagttttattatcaagacatcatgctcttaaacgtgttcttgtttctctctaaagaaaacaaaagcaaaacagagtgacaagagagtgagagtgctgacctcaaaagaatgttggaagaggtagtttgagagtgaaagtgtgattttcaacagatatcttcctcacgtagaagaagttgaatggttaatatcaatattgttatgtataaccaagaaagctatagaattgcactatgatattgtgaagctgcagaaaaataaacaacagtaaagtacatacttgaacaagaaaatgaactttgttagtccgcgtacttgtcttaactcttatgcaggggtagccaagcaatatgaaacatttagtgtggcccattttttttttttcaaattctttaacaaaaattatttacaaaatggccccaattttattgattttaacgataattggccctaaattttaaaacctttcaaaataatcttggattttttgtttttttgtatgttgcccataaaaccgtcaggtcttaggtaaaacatctataaattaatattcaataaattaataaactttataaattaataaattcattcaatcccgagttgaaaccagtgtaagaattgatacaaatcgataaattaataaaataataactttttgtgaaaatcatatgtaaatatttggtcccatcaatattataaattcactaatttatatatatatatatatagatatatactaaaatatgaatatagtattcaatttgtattaattctttgtagaatttaattctaatatttttactaaatcgaaaaatttagttttggtttttaaacttgataattgtttaataattgtaattggtttcaaaaatattattgattataagaaaagaaaaaaaataccttttttgattgaatattataagaaattacataatttgtaaaatttctttataaattaatatctcttcaaattaataaattttatcaatcttaaaattattaatttatagagattttacctaatatgcatttttaactaaaagtcataatgttatatattttatttatatttagagaataatatatatattaaaaaaaaaaaaaaaaaaggttgacaagtggaaatatgtgaccggcaatagtaagttaagttgaccaaaaccaaaaccaataaaatcaaaatcgagagactctttcttcccccaagcgaagaagcgatg

SEQ ID NO: 32307 - DNA, 3003 bp, Unknown
  misc_feature (1)..( 3003): 2750-1469P.txt file - cDNA_ID_3051180; gDNA_ID_1972020; Annot_ID_178030
tcattcattaactcgctcttggttgcttattcaagatttatttgaatggatggtacgaatgtaacatgtgcagtaaatattagatttaatgtcttagtgagcattttgcaataaaaatctgtggatttcatgtttattacaaacagtttcttataaaacatttccttcattattcattaagaaaattaattaagagcacaaacatttccttgttcgtttgccctagacaaggcaataaatcatatcctagagaagcgtaatcgatcattcgattttctttacctaagcgtacaattgaatgttttcttatattatttcttccgttcctttgtcttattattccttaagtctatgttcttacttacgttcactctttttttcttggttactcggacagattccaagtttcttattctacaagataaatgaatcttggttaaaatcaaacgtggaggttgtgaagaaatggacaagacaagtcagttgcctgatgaattgctggtgaaggtattatcatttcttccaacaaaagatgctgtaagaacgagtcttttatcgatgcgatggaagtctctttggatgtggctgccgaaactggagtacgattttaggcattattcagtttcggaaggccaagggttagctagatttattactttgagtctactaggacataaagctccggccattgaaagcttgagtctcaagcttaggtatggagcaattggatcaattaaacctgaagatatctatctctgggtttcacttgcagttcatgatagcaacgtccgtgagttaagtctcaagctttgtacttttgcggagcgtccaactaaattgcccaaaagcttatataaatgcaaatcgattgtgatcttgaaactgaaagacgagattctcgttgatgttcctcgtaaggtatgtctcccctccttgaaaacattgttccttggacgtgtgacttactcggatgaagattctcttcaccgacttctctccaactgccctgttcttgaggatctagttgtggaacgagatagaattgacaatttggggaaattgagtgtggttgtcaagtccttgcagagactaaccctaaagatgtcttgtccttgtcatcttgatgggattatgatgaatactccttctttgaagtatttgaaagtcactgatgaaaggcaagagagtgatagtgataatgagagtgatagtgatagtcctcgatacttctacgattttgaagatatgcctaagttggaggaggcagattttgtattgacattccaaaatatcaaaaagttctttaaatttgtcacatctattaagcgtctttcgttatgcttgggagtctacaccgaagaggtaatctgtttccatcaatctatcaaacttatttttgaacaatattcttgaagttgaatcttttgtcatcttatgcagtctttatatcatgagggtcttgtcttcaaccagcttgaacaattgaagatatgttcatgtgattcagattggtcaattttactttctcggttactcgaaagttctcccaatttacgagagctcgaggcttacgtgatagaagtaagtttcttcgttagagacatattccattggttcaatttactatattgtttaagccaaacttctcatgtttgatcacaggatcatccagataggcgtgtggatctaccaaatcagtggggcaatcagctgaattgtgttcctaaatgtttgttgtcgagtctcgaaacgttcaagtggagtgagatgtatggattgctgcagaaccagatggatgtggctaaatatatcttgagaaatgctcgatgcttaaagtctgcgacaatcttttttccgacaacctatgctaaagaaacaagagatgagatgatcgaggagttgtcactttcttttcaaggtccagagacatgccaagtcttcttccattgaggatgtgaatcataaggattcaaacttgcatttccatagacactaccctccatattacaatggttttttatttgcagcaacttgatctaaacttaaggtgttttttttgtctttgttttttttgtatactttatctttgagcatactatttttcttgagacattggctttatctttttctgagatcttaacaaataaccgaactttgaagagacaagacatgacatgaacttttatttgcagcaacttgatcataacacaagactcaaacacaagactcaaacacaagactcttcagcttatagatcataaagtagatcaatagcacaaaaagatatcaattagaagatcagtcaacaatatagatgttgtagaaatttgcatcctaataaagttcattacaaagaaatgacccaagtttcccacacatatccgcatcaaaaaaacaagtgccataacattgcattaagattcatattcatattaccaaacagagcacttgcacacatacatcaacacaaaaccggcaagaacatcataggaacactcatttgaaaaaacccaaggaatagattcgactatgtaaacacaaacaagtatctaggaaaatcaaaaacataagtaatagaagaatatgttaccttcaaagaagaacgagattttctcagcgctctcaaacccgggttctcaaacccgaaccggaccggaaccggaccattacccatttaacccgacggtttacccataagccgagccctaattttttcaaagaaaagggccctaaacttttcgtcttctcgcttcccttcctctatctcgtcttctcgcttcccttactctatcccatagaaaaaccctgaatttggtttggccaatgatgtcaaaactcttcattgatacttaagaaagttttctccattgttcttcttatggtctcattcacatttggtaagtctcttcaacgattttggttttgtgagcacttacttcttcttacaagaattacatgtctttgttcaggttgtaactgttgatctgtttctgtcacaaaatg

SEQ ID NO: 32308 - DNA, 3000 bp, Unknown; identical to SEQ ID NO: 7706
  misc_feature (1)..( 3000): 2750-1469P.txt file - cDNA_ID_3051180; gDNA_ID_1621157; Annot_ID_173575

SEQ ID NO: 32309 - DNA, 3000 bp, Unknown
  misc_feature (1)..( 3000): 2750-1469P.txt file - cDNA_ID_3051184; gDNA_ID_1621157; Annot_ID_173571
acttagaaaggaatattcaaacctttttggcacgtttcacagcaaaggttttgccatctctgagtttgaccttgtaaacagtgccaaaaccgccttgtccgatcctaaaggacggagagaagttcttggtcgcgtcgtagatttcatcgaaggtgaatcttgtatgctctgtttcgtttgcatttccataactcctctgtacactactacttcctgttgagctacgtctactacggatattattgtctgctcacacagagaccaaataaaatcatcatcaactgtttccactaaaagtctaaaatctaagaattactgatcaaactataccggaagaggactttgaattgtcgatgtagttggaggaaacggaatcgggaggagtgaagcagttgatgaagataccggagatgcgacgagcgatggaggtggttgtgtcggtggatgtacgggcaggggttgtcgggaaggaacgatcggtgaaagtagtgttactgtaattggaagatgtggttgcaggagatccgacggtgtagctatgtctccgacgactgggcatcggaaagttcgtggagaacgtgtagcaatggtgaacacggaaggaaggaagagtcggagagactgactttacaattttttcaactttttcttctccgttgaaaaagacgactgttttgggtatttattgacgccagctgtacaacttgacgttctctgattaacaaaatttaaactcgacaagctaagataattaatgtgtataatttcctttttttttattacattttgtctaatgatttgtaataagcttttttattccttagatttaaattcgataattattaattttgaaaaaaaacgattggtttcaaattttattgaataactaaatactttgtatataatagtagttctcggcgttcagttatccattccgttatcgattttttcggttttaaagtttagtatccattcggttatttgaaagttctgttcggtttcgattttaaaatttagtatccattcggttatttcatttaaaatatttcggttattttgaatatttttaaatatttttagatatttccaaatatttttactattttatttatattttcaagtatttttagttatttagtctagaaataattaacacttttaaaaatatatttatactttagatattttacccaaaatattttggtttgtatttattcggttttatttcagatatttcggttatagaatttaatatttattcgactagtttccaatttttggttcggttcgatttaattttttttttcttcaattttggttcggtaaattcgattcaatttatttacagtagtactttaattcggtttaaacgctccaaaacagcacgtacatggaaaattgcatatgtaagattattaaataattttagtatttagaacatctactaaattctgtcattattgaatttatagaggataattagttcaatgccagacgtaatctatccgaatgatttgaaaattttcaactaatatcttgttagcgattattccgccgccaccatattaaatgccagatgggtctatctctattaatgcaataatcgaactcgcatttaatttgtatttttttttacaacaaagataccaagaaaaaggtataatatttttcttataaagttactattagatacattttatatgaaaaaggcttagattagaggaaataataaaatggtagattaaattactttgattagaagtcaatcaatattaggttacggttaacaaggaagattcataggcaggtgaaggatgatgagaattgagaccttaccagcaaaatattcaatagcctctgatagcgacagagggtttgaccttctgtagaatggaccatggtctaaaatgtttatagcccatgtttcagaaaacaaaagcccaatgattagcccgtatccttaaccgacgtcgtactatttaaaaggtatttaatgagatttgagaataattaggcaaactaaataaagtaaagtaggattacagtataattacttactatgatgaggttattcgactagagaaaaggagctctgtgtgtcgaaaccctccgtcgccagcatttattcttctcacttttcttcaccggagaatcacgacaacatcaaattctccggcgacatctcaggttatcttcgtttactgctctcatcggttaattattccatctctttttttgtttcccggagtcggctttcgtgtactttttgtttttggtcttttcggcttcttcaattttagggttcgcgtactgtttagtgttgtttagtttctgatttagatgtgcttactgtgttcatgttgtcgtctattcttatgagaagatcttatggtagagttacatatcaatgatgttaccaattttgaaggttattgtgttgtgtttgattaaaattggctcaagtgtgaaatgcttttgctcgcgtcactgttttcattgcaacttgactgaatcctagaggttgttttagaatatagattcaagtttcagctattgatgggacattacaacagagcataaggaacattcccatacctttgtgtttcttatggataactttggcatcagatcaactttttcttttgtcattttgcttattaacactgtaataatcacttgttattgggatttctcaagtctgctttgattaatcttgtttcgtaatgttcttctcactattcactcttcccatacctttgtgtttcttatggatgactttgccatcagaccaacttttcttttgtcattttgcttactaacactgtaataatcactttttttttattggggtttcttaagagtacttttgattaatcttgttgcattcaagtaatcgttgttcagttcactcttttcctgcagtggcagtgcatctgtaaaatgcttcaaggactgttgttcgctactcttgcttaattattactatagctggtgaaaatg

SEQ ID NO: 32310 - DNA, 3000 bp, Unknown
  misc_feature (1)..( 3000): 2750-1469P.txt file - cDNA_ID_3051191; gDNA_ID_1621157; Annot_ID_173567
ttagagatgctaaacttgtttgtgtggttgaaacgtctaagctttgggaaatagctgcacctatagctttcaacattctttgtaattacggtgttaactccttcacaagcatcttcgttggccatatcggcgatcttgagctttctgccgtcgccatcgctctctccgtcgtctctaatttctcctttggtttcttggtgattaaaataaccttcctctactctgcttttttcctcctctgtttcttgcgttttctctaactttctagaaaaaaactgcagctgggaatggcgagtgcgttggaaacgttatgtggacaagcgtttggagcgggacaaatggatatgttaggtgtttatatgcagcgttcttggcttatcctcctcggaacttccgtctgcttgcttcctctctacatctacgcaactccacttctcattttactcggccaagaacccgaaatcgcagagatctctggcaaattcactacacaaatcatccctcaaatgtttgcgctcgctatcaacttcccgactcagaagtttctccagtcacagagcaaagtagggatcatggcatggatcggtttcttcgctttgacccttcacattttcatcctctacctctttataaacgttttcaagtgggggctaaacggtgcagcggctgcatttgatgtctcggcttggggaatcgcgatcgcgcaggttgtttatgttgtagggtggtgtaaagacggttggaaagggctgtcttggttagcgtttcaagacgtttggccgtttttgaaactgtcgtttgcgtctgcggttatgctttgtctagagatttggtacttcatgacgatcattgtcttaactggacatcttgaagaccctgtcatagccgttggatctctctcaatctggttaaccgttagacctcttcacaaactcaaagatttacattttcttctatatctgataacacttttctttctctcagtatgaacattaatggatgggaaggaatgttgttcataggaatcaatgcagctataaggtaaaaagcaaaagcaatctttgtgtcttctaaaagaaggcgttagacttatatatatgtttctttcagtgttagggtgtcgaatgagctaggatcgggacatccacgagctgcgaaatactccgtgatcgtaacggtgatagagtctctcgtcattggagtagtgtgtgcaattgtaattctgataacacgagatgactttgctgtgatttttacggagagtgaagagatgagaaaggcggtagctgatcttgcgtacctgctcggtataacgatgattctcaacagtttacaaccagttatatcaggagttgcagtaggaggaggatggcaagcaccggtggcttatataaacttgttttgttactacgcttttggattacctctagggtttttgttaggttataaaacaagccttggcgtacaggtaaagccacatagcctccggtctaattattttggtttaagttgatgaaattgctttatgtggtttttcaggggatatggattggtatgatatgtgggactagtcttcagactctcatacttttgtacatgatctacataaccaattggaacaaagaggtacccccactcatttcaggttttataatcaaatctttcacacaaattgaagtaaaatgattcactatcttaatttattaggtggaacaagcttcggagagaatgaaacaatggggagctggatatgagaaattagaaaaaatagcaacttaaatgattttgggaaaaaaaattatatatacacttcactttatatcttatgttatacagcaatatatttttcattgtatatatcaattttttttgtaataccaaattgtatatgtcatcaaaatataatttatcatacatttgtaaatttttaatcttatcaaaatgatgatttaaatctactaattcgaccttattcaatcatttcattatttttacctactacggccgattgtcaggaataaattaggccggacaaaaatccagaatcggttatccgaatcgaaatcaacccaaaaaattggatccgaaatcaaactcgaacccgaagatttatcctattaggtcttaaattcttctaccgaaaaaaacgaacccgaatccgaaaatactcaaatattttattcaaaaatctaaattttacctgaaactcaaaattttacccgaaaatctggatatttacccaaaaaatctggatatttacccaaaaattcggatatcgattccaaaaaagggtctaaaaatctatatccaaactcgattggacccgaaccgaaattgaaccgacattttagatttaccctattggatcctaaacttctaacccgaaaaatctgtatccgattggattttatccgaatccgactcgcttacccgaatgtccagtaaatgaaaccggtctacccattacccggtttggtctttgcttcccagagaataattcttttgtagagtatattttcacacttgcagcgcaatcgaggcggtttttggttgcaatcgtctcatcacaatcacatcatcatcgtcttcgtcttcttcttcgtcggcacatactttgtcttctcatctcctccattattttgatcttatcgcaacagatctctcatctccttcacttgttgactgtgtaagtctatccgattctttcgtcttccctggatttttttctccgtcaacgatcctttgttcagatcgatctgtttcgtctagtctcagtttcaatttcgtgctttgattggtttatgagtttgatttattggaatatatgatcttatcttatccatggttgacgatcgtgtctagaatcgaagttgctgaatagctttgatcgtcgttagcttatatgaattctgatggtttttgttattggatcagcttaagattattcttgttgatttgttgttatttgatcaaattttgtagttataccacaggacaatg

SEQ ID NO: 32311 - DNA, 3000 bp, Unknown
  misc_feature (1)..( 3000): 2750-1469P.txt file - cDNA_ID_3051195; gDNA_ID_2926128; Annot_ID_196772
cagtttgttcagagagaaggagattactaggcagattactcaagtacatgataaaagatatgataaaagaggaaataaattgcttaaactgggaaaacataaagcatcaaatgttcaacgacaaaaaccaaaagaaatcaaagacaaaaaccaaaagttcaaaagagaagagataaagagaagcgatgaatgatcctgataagtgatagcagacaaaactaagcatctctcgagacaccatcttcctcagtgttccttgagctagaatgactatcgacaggtttcttttttagtttcagccgtttgggtgcggcaaaagaaacctcttcaagcgtcatgtctttaaattcttccttgtcttcaataaacgttgcaacttcctttatagatttaaacctctttcgtctaggagccaatgattcatagtaaacatcgactttcacgcagtttgttctcacgaccaaaactctcttcaaaccttgaggggttttgggtatactatgttcatcctgaaaccaacgcatagtaagggaatcaaagttcattaccatatctccaggttcttcacatctcttgcattcaaaaaacttttccagtgttttactacgaatctcttcataatcttcttgtgactctatagatctcactttaagacacttccaacattgtgcagcgtatgagtcaattaacgtggttttcactacacacataaaaccaaacaaagactaagataaaaataaaacattgtcgataccttgtgagatgcaatgataaaaaacgaatcttcatgtaatgataaaaataaaacaccatatttcaagttttgggatcttcatgcattgacaaaacaaatcttcatgcaataataaaaataaaatattgtcgataccttgtgagatgtagcttgagtagtcttcctcaccatatttcaagttttgagagagataaaaatatttttttgggagtttagccttttagttgaagtgaagaagaactaaatatatcctttagattcgtaaagtgaagtgaagaaggaatgaaatctttactgcaatagcatttaagttggcttttaagccttataagaagtatctaatcaagtactattataaccagaactcgaagagatagtagcttgcggtgattcgaaaagtcggagccattaattttgattttgcatgtactttctccaaggagaggaaaaacaatgctttgaaaattgtattaacgtaaatttggacgcttgagatacatgtaggttagggctagccttacatcagtaggacaggcgttttagttccttcaaccctagataatattaaaagttccaattcttaaaaaaactttaatatgcagcccaatagaatcctatagcgtcagtgaccacttcatttggtgtcaaccaattaaaaactgatcagttatagaaatattaaactagtgataatgcgcattttgaatgtaagacaagcatacatataaaagttttatgagttatttaaattattcaattttggtttaagattttaaatgatgtggacatatataagaaggcaaaaccatatactgtactgtattatataatccattcttcgtaacatttggtctgttcttggctcggaaattgtctctgaccagagcagtgttctacatgattatgcaatgtctcggagccatctgtggtgccatctttaagactagtgaatatcggcgcatctttaagcctagtgaatttcggcccatcttcaagactagtatggaggcctgttaagggtcttctaatacagctcaacatgcctttttgtgtaagcctagtgaatttctaatacactttgtctctggtcaaacactttcatgcgttttttttataaatatgtttaatgagcataaatgtgcggctcaaagcggtgcaactcccaacggtcaaataaacaaattaagctcaactgctcaagtagtgagaacaagatcaacctaacttgcacaacgaagaatttttgttgttgttgtggtcatatatatttttacactaactaattattttgacaaaagtaatcaatttgtgacattctacaaaaaaaaatataaaaataatcgaatataatttttttattggtcaaaatatcgattgcaaaatacaaaaatcaaggcataacaagttaatctataaattatagtcgtgttttaaaattaagtcgtgtgttttgcggttttgtcctcgattttgttccttcctttgtgtcgaattagtcctacattttatagagaggtcttcttgaccctaatccacgtgggattttgactcgagccaccgcctctattgaaatgataagatcgtttctagaatgaggttacggcccgtattggtccggttcttgtcggttttggctaacactgatctttcataaagctttctagaatatcctttattattttccctattttgatgggttaagaaatttaacagagtttattcaatatcatctccaagatttaaattattcccaacagtaatgcaattaaaatctaatatcaactatatattggtttagtaactaaaccaatatatagttgatatctaagctacattaaatctaaaacttttctaacaacttcacttcaactaaataattaaacccaaatctaagacaaagtctctaaaaagattatagacaattcgactgtgtcaacaatatcaccacatgtatagatgcatataatcattttcatataatgaattcgacatgtggccctacactttacgctcttagtggatatttcatagttaatgacatatacatatatatatatatatatcatattcattcacatagatatagattatagatataacccactgaattaatattacggtcttcaatataggtgcatttaaaacataacgttccctctcttgtcttcttatttttgctctctgttctttagaactgccattaacgagagtgagagagagagacacacacacagcgagtgaaaatg

SEQ ID NO: 32312 - DNA, 3000 bp, Unknown; identical to SEQ ID NO: 32311
  misc_feature (1)..( 3000): 2750-1469P.txt file - cDNA_ID_3051195; gDNA_ID_1972020; Annot_ID_178043

SEQ ID NO: 32313 - DNA, 3003 bp, Unknown
  misc_feature (1)..( 3003): 2750-1469P.txt file - cDNA_ID_3051195; gDNA_ID_1621157; Annot_ID_173560
tagcagtttgttcagagagaaggagattactaggcagattactcaagtacatgataaaagatatgataaaagaggaaataaattgcttaaactgggaaaacataaagcatcaaatgttcaacgacaaaaaccaaaagaaatcaaagacaaaaaccaaaagttcaaaagagaagagataaagagaagcgatgaatgatcctgataagtgatagcagacaaaactaagcatctctcgagacaccatcttcctcagtgttccttgagctagaatgactatcgacaggtttcttttttagtttcagccgtttgggtgcggcaaaagaaacctcttcaagcgtcatgtctttaaattcttccttgtcttcaataaacgttgcaacttcctttatagatttaaacctctttcgtctaggagccaatgattcatagtaaacatcgactttcacgcagtttgttctcacgaccaaaactctcttcaaaccttgaggggttttgggtatactatgttcatcctgaaaccaacgcatagtaagggaatcaaagttcattaccatatctccaggttcttcacatctcttgcattcaaaaaacttttccagtgttttactacgaatctcttcataatcttcttgtgactctatagatctcactttaagacacttccaacattgtgcagcgtatgagtcaattaacgtggttttcactacacacataaaaccaaacaaagactaagataaaaataaaacattgtcgataccttgtgagatgcaatgataaaaaacgaatcttcatgtaatgataaaaataaaacaccatatttcaagttttgggatcttcatgcattgacaaaacaaatcttcatgcaataataaaaataaaatattgtcgataccttgtgagatgtagcttgagtagtcttcctcaccatatttcaagttttgagagagataaaaatatttttttgggagtttagccttttagttgaagtgaagaagaactaaatatatcctttagattcgtaaagtgaagtgaagaaggaatgaaatctttactgcaatagcatttaagttggcttttaagccttataagaagtatctaatcaagtactattataaccagaactcgaagagatagtagcttgcggtgattcgaaaagtcggagccattaattttgattttgcatgtactttctccaaggagaggaaaaacaatgctttgaaaattgtattaacgtaaatttggacgcttgagatacatgtaggttagggctagccttacatcagtaggacaggcgttttagttccttcaaccctagataatattaaaagttccaattcttaaaaaaactttaatatgcagcccaatagaatcctatagcgtcagtgaccacttcatttggtgtcaaccaattaaaaactgatcagttatagaaatattaaactagtgataatgcgcattttgaatgtaagacaagcatacatataaaagttttatgagttatttaaattattcaattttggtttaagattttaaatgatgtggacatatataagaaggcaaaaccatatactgtactgtattatataatccattcttcgtaacatttggtctgttcttggctcggaaattgtctctgaccagagcagtgttctacatgattatgcaatgtctcggagccatctgtggtgccatctttaagactagtgaatatcggcgcatctttaagcctagtgaatttcggcccatcttcaagactagtatggaggcctgttaagggtcttctaatacagctcaacatgcctttttgtgtaagcctagtgaatttctaatacactttgtctctggtcaaacactttcatgcgttttttttataaatatgtttaatgagcataaatgtgcggctcaaagcggtgcaactcccaacggtcaaataaacaaattaagctcaactgctcaagtagtgagaacaagatcaacctaacttgcacaacgaagaatttttgttgttgttgtggtcatatatatttttacactaactaattattttgacaaaagtaatcaatttgtgacattctacaaaaaaaaatataaaaataatcgaatataatttttttattggtcaaaatatcgattgcaaaatacaaaaatcaaggcataacaagttaatctataaattatagtcgtgttttaaaattaagtcgtgtgttttgcggttttgtcctcgattttgttccttcctttgtgtcgaattagtcctacattttatagagaggtcttcttgaccctaatccacgtgggattttgactcgagccaccgcctctattgaaatgataagatcgtttctagaatgaggttacggcccgtattggtccggttcttgtcggttttggctaacactgatctttcataaagctttctagaatatcctttattattttccctattttgatgggttaagaaatttaacagagtttattcaatatcatctccaagatttaaattattcccaacagtaatgcaattaaaatctaatatcaactatatattggtttagtaactaaaccaatatatagttgatatctaagctacattaaatctaaaacttttctaacaacttcacttcaactaaataattaaacccaaatctaagacaaagtctctaaaaagattatagacaattcgactgtgtcaacaatatcaccacatgtatagatgcatataatcattttcatataatgaattcgacatgtggccctacactttacgctcttagtggatatttcatagttaatgacatatacatatatatatatatatatcatattcattcacatagatatagattatagatataacccactgaattaatattacggtcttcaatataggtgcatttaaaacataacgttccctctcttgtcttcttatttttgctctctgttctttagaactgccattaacgagagtgagagagagagacacacacacagcgagtgaaaatg

SEQ ID NO: 32314 - DNA, 3000 bp, Unknown; identical to SEQ ID NO: 9192
  misc_feature (1)..( 3000): 2750-1469P.txt file - cDNA_ID_3051205; gDNA_ID_1972020; Annot_ID_178048

SEQ ID NO: 32315 - DNA, 3003 bp, Unknown; identical to SEQ ID NO: 28372
  misc_feature (1)..( 3003): 2750-1469P.txt file - cDNA_ID_3051205; gDNA_ID_1621157; Annot_ID_173556

SEQ ID NO: 32316 - DNA, 2059 bp, Unknown
  misc_feature (1)..( 2059): 2750-1469P.txt file - cDNA_ID_3051209; gDNA_ID_2926139; Annot_ID_197325
cgtgacgttacaatatatgcacacgagtcacaacaaaatattatatctataatcgacggttgaaacaagaactctagctaatgttttggttacactcggttttcggacatggtttagaaaagcacaactcttccttaagagaatgacaaaacgtcgtcgttaactttagattaatgacttggtcaatgaaaacaatcgcatttggtgtaataatctcaaatactacgtgttctccatattccataaccagccaagcaaaagcaccaatgaccaattacgtctctcctctttggccgcgcccactcaattcttataatttatctatttgcaccctctttctctaaaaagttacaatttgacccctatagtttcactttcacttattcttataatttatctatttgcacctttttcctctaaacgttacaatttgacccctatattttcacttttattcatacaagcccattttgtttttctctctgctttcatgctcgcagacaacaatcctcgtcactgccatgtctcaaattcagagctttgagagatcaattatttaccggtgaggctaatgatgaaggctgttgaaaaaatctctgcaaaatacttttcttccatgtaaagcttctaactttttctctctctctctctctctctcctctgttgtttctgtagagaggaatagaagatgatgggcccattttccaactgtgattgttctctttatatttctttctcctgtggaggctagcaaaggccacgacgttgtggttgtcaaattggcataaagttttccacttttttactctgattttttctcccatttctctctcactttttctttgcctttgcccaattcagagaactaatggctttgtcggtcatcgatagataaacaaaatttaatctttatctctctctttctcttgtttgtcaaaagatgcccaccaacacagaaatgaggaaaaaaagatctcttttttatttgaatgttgaacagtaagaagaaggtttattctattctattgggttgggttgttcatcaactttggaaatttaaagatgcattttttatgatccttttttctccgcctttgttgttgatttgatcgtgtatgattacggaagcttgggggggtttttatcagacagaacctggaaaagttgtcagatgaaacaatgtggcttggagattggatcatcaacttttcctctgttttcaactttataagctatcattttgcttaatcttcttcattctcttctctcggccttggctttgaagaaatctcaattttcttcttcttcttcttctaccgttttgtccggcgatcagagctggttcaggagaaaccttaagtcttggtatcaaaagaaagaaagttttggaatttacctctgctgctgcaacttgcaacactttttttatatatattggatttttctatggctttgctcaaacgtaagcaaagcagatgaaatctagctacaatcgctgttgcccttgtatgaagtttggaatttaaggaattcaggagaatctaagaggtactttcttgtactttcctcttctgtctttttccaatagggaaaggtatcttatttgctccattagtctgtatctctcaggctttgtgttctcttagttctccttaatctttgccttattagttgaacaagtaagcaaattataaaaggagtttgctttagggaactggtagaggatcctttacttcttacttgttatcttaatttatttctcaagaattccattgcagtgtttaggaaggctaattctttcttctctttttaagtactcctaagcgtggaaattttttggtcttgttctcttgttgtttgttactcaaggatctgagattgttgtccataagtagaatttaccggagttgtaatttctatatctgaaactcattattgtaccgttgtgtgtggtgtgtcttatagtttgctgcttaatagttttcttgttcttcttcagcatttctaaaggggcaacgttatagaaggttaggaaggagcatttgtatagaaagtcatg

SEQ ID NO: 32317 - DNA, 3000 bp, Unknown; identical to SEQ ID NO: 7688
  misc_feature (1)..( 3000): 2750-1469P.txt file - cDNA_ID_3051209; gDNA_ID_1621157; Annot_ID_173553

SEQ ID NO: 32318 - DNA, 3000 bp, Unknown; identical to SEQ ID NO: 29154
  misc_feature (1)..( 3000): 2750-1469P.txt file - cDNA_ID_3051230; gDNA_ID_2926151; Annot_ID_198069

SEQ ID NO: 32319 - DNA, 3003 bp, Unknown; identical to SEQ ID NO: 18617
  misc_feature (1)..( 3003): 2750-1469P.txt file - cDNA_ID_3051230; gDNA_ID_1621158; Annot_ID_173615

SEQ ID NO: 32320 - DNA, 3003 bp, Unknown; identical to SEQ ID NO: 18618
  misc_feature (1)..( 3003): 2750-1469P.txt file - cDNA_ID_3051234; gDNA_ID_1621158; Annot_ID_173612

SEQ ID NO: 32321 - DNA, 3003 bp, Unknown
  misc_feature (1)..( 3003): 2750-1469P.txt file - cDNA_ID_3051249; gDNA_ID_1621159; Annot_ID_173659
gtttctctcaaaaaaatccccaagtgtttccgatctagtgtctcttttgtccaaaaacgacagtgtttaggaaacctaggagaatgaatgacccgatggtccgaatccgattcgaaattggttcgaattgtaataactaacatacaatattccggtttgaatgataagaaaaaacacattcgatccggttagaacaatatattaacaggcccattaaaacatatgggccgatcttgatcaactgggctattcatcgttgatacatgcggccgcacaggattaaaatccagttccgttttataaaaggatactagtttccaaacgaacggtggttgtctcctttccagaacaatctaacgctttctcgaacatcttcttcttcttctttctcgaaattatttttccagtaatcaatttcttctcttctagatttttacaggaactaattttctgctctgaggtatcagatgagtagccgatggaatcgtacgatctacgttgggaatttgcctggagatattcgcaagtgtgaggttgaagatctcttctacaaggtttgaaaattcctcttttctctcgataaaaattgaattcattatgacttgtttgggttcataaatttgcaattctgtcttgctgagacaatttaaatcgactcttatgtatatttgtttcagtatggaccaattgtggacattgatttgaagattccaccgagacctcctggttatgcctttgtcgaggtatattgatcaagtacaaatttgtttttttcttcttcttgtaatagtataggctaatgactaagatagtttgttattggtggcagtttgaagatcctcgtgatgcagacgatgcaatttatggacgtgatggttatgattttgatgggtgtcgacttcgggttagtaaacgcatgatgaaagctagcttaattttctgtaatttcttgtaaaggtgttatctttgtgtgatgtttttaggttgagattgcacatggtggtcgtagattttcaccatcagttgataggtacagcagcagctacagtgcgagccgtgcaccttcaagacgctctgactaccgcggtttgtagagtcttctcgattgtgttatttggtgttgtgtaaaattttatatttgaaaactcatttttactacctaaacatgtagtgcttgtgaccggattaccgccttctgcttcgtggcaggaccttaaggtaagggacactatatagtctttttctctgaatgttggttctctatatcatgttttggatttatctcttttctgaaatgatgttatttgctatttacgggtgattaggatcacatgcgcaaagctggagatgtctgcttctctgaagttttccctgaccgtaaaggtgagttgacattcgatagtttggataagcttttgattgatgtgttagtaaattagtctttgtgaaggagaataggtgttaagcatctgaactgctaaactcacattcagtatttctttgtaggcatgtctggggttgtggattatagcaactatgatgatatgaagtacgcagtaagttttatatctttgcaacgcaaatgttcctggacttatgccttagactgcttttgtttcatagtataccgagctgaatttatcttcctggaggccagtgttggatctttgatgttcccttaaaatttttgatgtgacagataaggaaacttgatgccactgaatttcgaaatgctttctctagtgcttatatacgggtatgttgtattgctttctttgattttgttaagcataagtggatatggagtcatctctgaatttactgttcaggtgagggaatatgagtcgaggagtgtgagtcgaagcccagatgattctaaaagctatagaagcaggagtcggagccgtggtccaagctgtagctatagtagcaagagcaggaggtctttttttttttttttttttcataaacctaagacatataagggatttttattgtaacttatttatgaaattaactgacttctaaatgcaatgcagtgtgtcacctgctagatccatttccccgcgttcacggccccttagtcgttctcgctcgctatacagctctgtctcaaggtatgagtgttagatttgtatcattattatatatgtagttaccccttcatggatcacttgttcttgcatagtgaactccttactagctttattacttacaactaagcaccttttgttgcttccgtacacagttgaatttgtttgagtcttttttccctcatagtggactagtctattgtcacttgattttcttcctttgttgatgttttctatgtcatgcaaactccaatatgggtaaaggttacctccttgtttgggattaccagagttccttttcatttcttacacgtgaatgtgtttgttttttatgttttgagttcttgacagagatgctcccatcatatttagtccttttcctttctctttgtgtcgttctcttctggatgtttccttctgataaagctttacttcttaacttttttccagcgacggtgaatttattacgtatcaatcttcattatccgacttataatttaaagaacacttagctagatgtttcactttttgaaaatttatttctatcggaagggggaagatggatttctgaggcatgtcctcgatcatttaccgtgattacaattgtattgcgttgtttgttttctagatctggctcactgctacgagctggggattggatctagatgggtcatctagatggattcttggactggatttacaaagctggattagcatgaacttgaacttctgtttttacggtctggtctggtctggtactccgcgcgtatcagctgtaggatctgatcgcaaagttttggactatgattactctgattcctcaatatatttatctttttgacaatagtggattctgtgttgagttcttttctaggacagcatttaagctcccgggactagatgggagatg

SEQ ID NO: 32322 - DNA, 3003 bp, Unknown; identical to SEQ ID NO: 18622
  misc_feature (1)..( 3003): 2750-1469P.txt file - cDNA_ID_3051250; gDNA_ID_1621159; Annot_ID_173646

SEQ ID NO: 32323 - DNA, 3000 bp, Unknown; identical to SEQ ID NO: 7743
  misc_feature (1)..( 3000): 2750-1469P.txt file - cDNA_ID_3051283; gDNA_ID_1621160; Annot_ID_173682

SEQ ID NO: 32324 - DNA, 3000 bp, Unknown; identical to SEQ ID NO: 7744
  misc_feature (1)..( 3000): 2750-1469P.txt file - cDNA_ID_3051287; gDNA_ID_1621160; Annot_ID_173681

SEQ ID NO: 32325 - DNA, 3000 bp, Unknown
  misc_feature (1)..( 3000): 2750-1469P.txt file - cDNA_ID_3051291; gDNA_ID_1621160; Annot_ID_173676
gtctcttcctcacaaacaaacaaacaaacaaaaggatttttttctattttttgttttcgtaaagtttggtaattttgtaacttgagcaattatttgcttgtgaaaatgtttgactctttttcgcaatccacaaaagaaagagattttttcccttttttttgttatttcgtaaatgttggtaattttgcaatttgagtaacttatttacttgtgtaaatgtatgggtatgtgtaattgtcaagaatttacttttgctcaaatattattaatttaggatttttaaaacactagttcagatttacttgtgaaaaatataaaattatcattaaaaataatattttctaacgatttaatacacgacaaaagaaaaacttaattttataaggttggagcggtttgagttttcgattttgtgaaatgtatgtatattgtcatgaaaccctagtttggatttacttgaaaaatataagatcatcattgaaaatagtactttttaacagacacgacaaaaaaattaattttatcttgttggatcggtttgaggttttagatttttccaatagtgttaaagatatgcatgtgtattgtcatgaaaccctagtttgaattttcttgaaaaatgtaatatcatcattagaaatagtattttctaacgacaaaaaaaacttaattttattggattagaacggtttgagttttggatttttctaattttttgaaaatgtatgtgtcatgtacatgaaacatttactttaatttaggatttcaaaaccctagtttagatttgcttatcaaatgtataagatcatcattgttaaaaataatattttctaatgacgtaatacacgacaaaaaaaccctaatttgtacggtttgatcagtttgaattttggatctttctaattttgtacaaaaaaacaagtctcaaatagaaccattttattcaagtttgcatcttattatataaaatagggtttttaaagttgctaactaacgtgatcacgcacgagtcaactacattgatgagatatcgacatgtgtcaaatctaagtttttgttaaaatatttaaaaacaaaaaatagaaaatttcctaaccgaaaagaatctatatacatgaatcacaaaaaattaattatatattcgtaattattaattatttattatataataagataattcataatataacagatttataaaaaatggggaccttccaaataagtttttttagtatttgtcaaaaaatttctctttttcctattgctatgttaagataactataaaatatagatctcaacaaaacacataaatggtgtgatgcatagataaagattataatgggaaaactcaatagtacaaagatgaatgagaattaagtataattatgtttgagtaaaacgttaaggataagttactaatatttaaagtcttttttatcgtcactaatatttaaagtttaagttacacagtagtaattatttagtaaacaacaaaaataactgacgttatttaaagatatattgagagaataaataaattgagataaaagtaaaaacactaaatatagaaaaaatgtgtggtttactattaaaattttaaatatcattaaaaaaaaacaattaagatagaatatgtgtttttttttttgggtcacaagagtgttatttttatatatgaaccattaaaatggacaaacccatagtaaacaaaaacctatcaactagtacaaaacaagattactgagactaaacttgacaatcactaagacatggagatgactaacaattaaagactccaaagcaattcactactagaaactcttcaccacaagaaaggttacaaacaaaagccttgaagaaaaccaaatcattagaatgccttcaaaagagaaagcccgagaaaagggctaaaccgagctcacacaaccactacctcagcagaaatgaagacggataatcaaatagagtagagcaaagaaccaaactaatactaccttccagcaaccaaagaagacgagaaagcaaaggtacaaggagaaaacttgatatccgaaggggaaaatgccaaagaggaccctcatttcttacacgaggacatttgtagacccaaccaaagccttaaaactaaggcttcaatccacaaccattctcaaaaaatcagtaaacgacaccacaattctttagccaagaactcagtcccaaactaaaaacagaatgaatagccgagaaagagaagtaaagcccaactaagaacaccaaatcgcctacaacgatgaaaataatattcaaagtggtgatagaaggacaaaacctccgatctagcaaccttccaagatgacatatgaaagaattaacaaaggagctcagcaccgccgacttcactccacaccaacgtcaccatcttcaccccaaattgaatcagatttgtcacttccaaagcaaaggctaatcaaccaccaaagatttcaaggctaaattgagtggatcaacaagtaaatttctttcttttataaattaaactggttaagtatcttgatccattaaaaatattattttatcatcatgttttcaaggatgattgcttaaataagtatattgattaatgattactaagtaccaagacaataatatcataaaaataaattgaatatattaagagtttgttggtcaattaagcaaattaccattaattttctttattaagtatagatgaattatattttcccgactgcctattatttgtcttgtataatgaaaattgactttgaaacaatggaataatgagccaataatttattgacacgtgtaacaataaacaaaagttacttaagatttttgtcgtaaagaagggaaagaaattgtaactttgacacacacacacacacacacagataaagagtaattaaaattggagtttctgatttctagggcacaaaatctttagattcggtgaagtcattcattacttcattgccaaagcttgtaaccaaaactcccatg

SEQ ID NO: 32326 - DNA, 3003 bp, Unknown; identical to SEQ ID NO: 18635
  misc_feature (1)..( 3003): 2750-1469P.txt file - cDNA_ID_3051299; gDNA_ID_1621160; Annot_ID_173673

SEQ ID NO: 32327 - DNA, 341 bp, Unknown; identical to SEQ ID NO: 278
  misc_feature (1)..( 341): 2750-1469P.txt file - cDNA_ID_3051331; gDNA_ID_1563306; Annot_ID_147438

SEQ ID NO: 32328 - DNA, 3 bp, Unknown
  misc_feature (1)..( 3): 2750-1469P.txt file - cDNA_ID_3051342; gDNA_ID_1563308; Annot_ID_147441
gac

SEQ ID NO: 32329 - DNA, 278 bp, Unknown
  misc_feature (1)..( 278): 2750-1469P.txt file - cDNA_ID_3051389; gDNA_ID_1563324; Annot_ID_147470
tcggcgtcttcttccacgagttcgccgactatcggaggtctctctttgcttttctccggcgcttccgtcaaatcatcttcctcttcttcctcatcgcatccatccgtagagaggaattagcttcaatacgccatgatcgtagcgaggatcggaccttaagcggatccttctgttattctccgagcaaattcattggttcttcatacctaaaacgagatcatcaaagccctgtctcggtgcttcacggtccaatttcatctggtaacagtcctccgatg

SEQ ID NO: 32330 - DNA, 3 bp, Unknown
  misc_feature (1)..( 3): 2750-1469P.txt file - cDNA_ID_3051454; gDNA_ID_1563348; Annot_ID_147518
tct

SEQ ID NO: 32331 - DNA, 31 bp, Unknown
  misc_feature (1)..( 31): 2750-1469P.txt file - cDNA_ID_3051488; gDNA_ID_1563356; Annot_ID_147533
aaatgacagtattgaagcaatctcatctatg

SEQ ID NO: 32332 - DNA, 3000 bp, Unknown; identical to SEQ ID NO: 9080
  misc_feature (1)..( 3000): 2750-1469P.txt file - cDNA_ID_3051510; gDNA_ID_1971978; Annot_ID_177620

SEQ ID NO: 32333 - DNA, 732 bp, Unknown; identical to SEQ ID NO: 285
  misc_feature (1)..( 732): 2750-1469P.txt file - cDNA_ID_3051510; gDNA_ID_1563361; Annot_ID_147542

SEQ ID NO: 32334 - DNA, 92 bp, Unknown
  misc_feature (1)..( 92): 2750-1469P.txt file - cDNA_ID_3051514; gDNA_ID_1563362; Annot_ID_147544
cgtaccacaaatttctaactaaagcattcatagtctctcgaaagcctcttttcagaaccgaagctctttactttcgtccaccgggaaatatg

SEQ ID NO: 32335 - DNA, 277 bp, Unknown
  misc_feature (1)..( 277): 2750-1469P.txt file - cDNA_ID_3051520; gDNA_ID_1563367; Annot_ID_147553
atctagataatttgaataatgtaatctagatcttatgtaagaactctctagacttaagattaaaatattttagatattttgtagtttggaggctataaatatctcctccccctctcaaatgttgcaatgttgtgaagttgtcttcaagtttaaagcaaagtaataaaagttctatttcctaaaaaactctctcaaaacacttaaacactttctccattacctctaaaagaattttactctaacaaagtggtatcagagcttgaagatcctaaagatg

SEQ ID NO: 32336 - DNA, 257 bp, Unknown; identical to SEQ ID NO: 287
  misc_feature (1)..( 257): 2750-1469P.txt file - cDNA_ID_3051561; gDNA_ID_1563381; Annot_ID_147576

SEQ ID NO: 32337 - DNA, 133 bp, Unknown; identical to SEQ ID NO: 292
  misc_feature (1)..( 133): 2750-1469P.txt file - cDNA_ID_3051713; gDNA_ID_1563432; Annot_ID_147668
  misc_feature (127)..(127): n is a, c, g, or t

SEQ ID NO: 32338 - DNA, 3 bp, Unknown
  misc_feature (1)..( 3): 2750-1469P.txt file - cDNA_ID_3051821; gDNA_ID_1563472; Annot_ID_147745
gag

SEQ ID NO: 32339 - DNA, 436 bp, Unknown
  misc_feature (1)..( 436): 2750-1469P.txt file - cDNA_ID_3051890; gDNA_ID_1563491; Annot_ID_147783
cagtacgtagaaactttctgatccaaaggtattttattcacaagaccaactttatatgtctgtcgggtacttgagatatagtgagattaatattttataatttagatggtatttggtataatctggtctatgatcttgggaagaagagacagattgaccatcgatttgtgcatgtggtctcaaatcaggaaataaatatgcagtgattctgatattgttctctgtttaattgtttgaggacaataataagttgttgaaataatgtaccaaatccccaattcaaggggaagagagggtcaaggggggagttagttatatgaatgtcttaaattagtgttaagagagtttttgctttcttactttctttatatttgtgaaaagcttctgacatagtatatttttatgttcaacaattcagcataactcaaacacaatg

SEQ ID NO: 32340 - DNA, 17 bp, Unknown
  misc_feature (1)..( 17): 2750-1469P.txt file - cDNA_ID_3051925; gDNA_ID_1563505; Annot_ID_147808
aaaaaaaaaaaaaaatg

SEQ ID NO: 32341 - DNA, 256 bp, Unknown
  misc_feature (1)..( 256): 2750-1469P.txt file - cDNA_ID_3051977; gDNA_ID_1563519; Annot_ID_147829
agatgtaatattaccgatgtagagagcagcactaagtttacattcatattcaaaaagtcaaaatctatcatctactcgttacgcagataatctttctctcgacatctctatggattcgaagacagagtcgaagctcctatcgctcacatctcaaataatgtctcccgcaaaacaaataagatttgatcttgattgggttggtgaaaagaggatgaattctttcattactaaagtaatgtctctcgtcagctcaatg

SEQ ID NO: 32342 - DNA, 246 bp, Unknown; identical to SEQ ID NO: 298
  misc_feature (1)..( 246): 2750-1469P.txt file - cDNA_ID_3052021; gDNA_ID_1563537; Annot_ID_147861

SEQ ID NO: 32343 - DNA, 3003 bp, Unknown
  misc_feature (1)..( 3003): 2750-1469P.txt file - cDNA_ID_3052024; gDNA_ID_1620345; Annot_ID_154137
ctccaagtggttcttatcaccactatgaattaaaagacttgcaaaggtttaaccagaatcaacagagattgtcatatcagaacgattatgttaatcaatcttataggtatgatactattggtggtggtaatgggatgcttaacaatagtttcttgaatggagttccttgtgcttcaagaaacaatgtttcagattactacactaatatttttgggtatggagttaacaattcttggaggagtaatgaaggttgtacctataatcaagatcaggcggcctcgtcgatggagaatgggaggggctcgtacttttccattgctacagaccgagtatggagcaaggaattggagaagactatctttgtgggtactaaagagacgattgatatgattttcgatggtctcattgtcggtatttgtgagttgatggttgatccttttggtaatgatgttgttaagctgcttatcggaaaatgcagctctgaacagatcattctgattgttgatgttgtcactcggcacatttctaagtttgttaacatatgctttaatccgatcgggtacacacttctaatcattattctttaactttgagatatgattgtgcattgtttccttggatcttgattttctataattctttcttttggagatatcagaactttggcaatacaagttctgttaactagtattcatgagcgtgctaacaatcaaatcccgcgcattatggatgctataagctcggtagcacttcaattgacaaggaacaccaatgccaaatatgtgattctagcatgtttccgcatgtttacttcgtcgcagtgtagggtaagcatctcattcacatattaatctacttcagttctcaaaacctatatagaatatttgtttcttgtcatggagttgtttgctagttttgtttaagcttcaagtcactttcttataccatatagttgatgaaagaatctactatagaacacctcaagtagattaatcaatttgatgtttgagtttgcttgttatcggttaattttgcaatgtttgttttcttaagttcctagaatctgtatgttttaattgagcagatctgacctcaattattttctatcacgtggtataagtaaaatgtgccattattgaccatggatcacaagtttaatcttctttcacaagtattcttgagaaatgacaatctttcttctgtttttacagcgtcttcttgaagttgtctctcaacattgttaccagatagcgattgatcaaaacggatgctgcttgcttcagcaatgttttgacaaggaacgtgttccgaatcatgagataaggcaacgtttgatttcggaagttatcgaacatgcgttgaaactctgcttgaactgtcatgggtaaacatgatatgaatgatatctacacaactctactttctcatatatgatccactttattttttactcacaagtatgttctccttcagaaactatgtggttcaatatgtcgtggagctcgataatcaacatgaaacagatttgctcgtgaataagctacttaggaactatgcgcatctagcccgcaacaaatatggaagtcatgttgtgcagaagttgttgaaactaaggggtatcgactctaagctgattgttgttgacttgcttagagggattgatacacttcttcttgacccgtttggtaactatgtcattcaaaccgcatggtttgtgtctaaggtaatgtcttacagttttttttcattacggtgatctgattagagattttgcgagattatgagaatcttgtttggtgtgtgcaggaagatgtgcgccagatgttgaggtattatatagagcgtaacattcgattgatgaggtgcaacaaatttgggaacaaaattctggagaaactcaatatctagagagagctgaatggtagaaagaagaatttgtttttgatgttgtttagttggtttgttatgattgattcattgtgttgtcattggtaatgatgatggttcttatgtgttttcttgtaactttcgttgaatcttaggaaattgttagacaaaactagacaatgttctcaccaaaacagaatgtctttctcttgtaaggtttgtgtgttgtgttgtgtttttagctttttttctctatgtaaatgattgaattgttcaaagtttattttattttttattttttattttttatttttttttgtcaaggaattcaaagtttattcattttttttttttttataatgtttttctgctctgttttttttcattgcttacttaggtaattttctatattttgatgatatttcttttcgaatgatttgagctttttattctaatttcgttcagaaagaattctacgaaagctaaaaaagataaatacaaataataattactggttgtgatcaaatacaaaattgagactagtcggttgagttggtttagcagatacaaccaacgatagtagatgtgatatattccgaaaagtatttggtttaaatttttgtgaacttcaactaatcaaacttgttttaatgctcgtctagtttaataattcgcaaaaagatttagaattctagaaattaggcataactaactcacgacaatggcttccacaatctgcatatcataatccacctttttccgtttttttccataattactttgtttgatgtgtttaatccgcaccgtttctcaatttgccggtctcccactcacatacctacctttatcagacatggtaagaagagttatgattcgttgacttcacaagacttgttcaaacagacacgtggcactacattattcgttattctaaccaaaaaaaatattgaatcatgaaaccaccgtgagagacaaattccattcactctctctctctctctcttcctttcttctcatttttcaaggacgacggagccacggtggagttgactccgcttaaaccccctccgtcgccaccggcgttcttcaatttcaaaccccaatccaccacccatg

SEQ ID NO: 32344 - DNA, 32 bp, Unknown; identical to SEQ ID NO: 299
  misc_feature (1)..( 32): 2750-1469P.txt file - cDNA_ID_3052024; gDNA_ID_1563538; Annot_ID_147863

SEQ ID NO: 32345 - DNA, 21 bp, Unknown
  misc_feature (1)..( 21): 2750-1469P.txt file - cDNA_ID_3052036; gDNA_ID_1563541; Annot_ID_147868
caaacattaaaaagatagatg

SEQ ID NO: 32346 - DNA, 3000 bp, Unknown; identical to SEQ ID NO: 2693
  misc_feature (1)..( 3000): 2750-1469P.txt file - cDNA_ID_3052046; gDNA_ID_1620577; Annot_ID_161007

SEQ ID NO: 32347 - DNA, 973 bp, Unknown; identical to SEQ ID NO: 301
  misc_feature (1)..( 973): 2750-1469P.txt file - cDNA_ID_3052046; gDNA_ID_1563544; Annot_ID_147874

SEQ ID NO: 32348 - DNA, 3 bp, Unknown
  misc_feature (1)..( 3): 2750-1469P.txt file - cDNA_ID_3052078; gDNA_ID_1563559; Annot_ID_147899
aca

SEQ ID NO: 32349 - DNA, 325 bp, Unknown
  misc_feature (1)..( 325): 2750-1469P.txt file - cDNA_ID_3052160; gDNA_ID_1563586; Annot_ID_147948
  misc_feature (30)..(30): n is a, c, g, or t
  misc_feature (32)..(32): n is a, c, g, or t
  misc_feature (143)..(143): n is a, c, g, or t
  misc_feature (205)..(205): n is a, c, g, or t
  misc_feature (220)..(220): n is a, c, g, or t
aaattagagtcttgcttattacagataaancntatacatgcacttgcaaaaaataccactaccaaaacacctgcgtcatcaatcacacacaaatgatatattgagtggaaaattgttttatgtgaggtcttggttatctgtantgatttgttttttttgctagtataaaacaggatggttctctgaagcgctgcttgacaatttngagactccgtgtagnctgtgaggtttgtatctgtgtttcctgagccaggtttcgaagacgtttttaaatctattcaagaagagtttgagaggtctgaaaagacacgaattcagaaagatg

SEQ ID NO: 32350 - DNA, 185 bp, Unknown; identical to SEQ ID NO: 307
  misc_feature (1)..( 185): 2750-1469P.txt file - cDNA_ID_3052173; gDNA_ID_1563592; Annot_ID_147957

SEQ ID NO: 32351 - DNA, 577 bp, Unknown; identical to SEQ ID NO: 308
  misc_feature (1)..( 577): 2750-1469P.txt file - cDNA_ID_3052265; gDNA_ID_1563621; Annot_ID_148009
  misc_feature (14)..(14): n is a, c, g, or t
  misc_feature (107)..(107): n is a, c, g, or t

SEQ ID NO: 32352 - DNA, 868 bp, Unknown; identical to SEQ ID NO: 309
  misc_feature (1)..( 868): 2750-1469P.txt file - cDNA_ID_3052285; gDNA_ID_1563627; Annot_ID_148020

SEQ ID NO: 32353 - DNA, 1134 bp, Unknown
  misc_feature (1)..( 1134): 2750-1469P.txt file - cDNA_ID_3052325; gDNA_ID_1591401; Annot_ID_150932
  misc_feature (668)..(668): n is a, c, g, or t
aaggagatgtacatctctatgttatacatagttgattcatgtttcataggttagataagtggcatcaattgggttttcttagaagatttatatctcttatggtctacaataggtccttcatgtgtcaaaaagtggattcgaggtcgcaaaatccaagtgttttccgataagtttgcctactagtccatatattcttatgtatgtcatggggtaggaacttattttatattcttaaaagaaagaacaacgattagcttagctccccaaatcatcaagctcagtcttttagcaacctttgatttgaggcagttctcatttctttgttcctaacataaatcagtacttcgttgcactcaacatgaagtgattgctaaagccttgaaaccaattcttcctgcaggttcgtggccctacttgtgcgagaaggctcgtgaattatcttgatgagaagaaagaagatactggaatcaaaaacatcatgatcttggaacgcggctttaacggttgggaagcttctggaaaaccggtctgccgctgtgcagaggttccttgcaagggcgattgcgcctaaaccctactaaaccatattgggacctaattgatgttccacattgtcatgtactaaagttgaatgaagattatcataaataatctcttatcagtatgtntggtttacatggagcacaaacaccaaacttgcaacaacaatactaaaagggcttttatggtattgcacgtttgtggagcgtcaaagccacgttgatatcttaacgccgtcaaaataataatggatttttcggtatcttctctggaagaggcacgttactttattaacgccgtcaaaactctctcgctgatacagagtgtttgctttcttttgtagatttttaaagtcataaagcaaaagcaacgacgacttcagagaactacaatcataatttgtgatctctctccaattttcatcttttggtcgaaattcccaattccctgagtcaagaaccctaatttcaacatggtaagatttgttcgatatcgcttgtttttttttatggatctagcttccgtttgtctatcttgcggcttccatttcagattgtttgaagaaattcctgaattttgtaggtttgcgttatg

SEQ ID NO: 32354 - DNA, 3003 bp, Unknown
  misc_feature (1)..( 3003): 2750-1469P.txt file - cDNA_ID_3052325; gDNA_ID_2926221; Annot_ID_142428
ataactatatccactaacagcaaagggatttgaacaacttcataacaaccacaaaccttccctccacttcgtcgctgctgaaaccacttgttgatgcaggaatatccatacaagtgtccacagggaagacaacttgtaccatcacaccagattaaaaaagaaaagagaacattagttgcactcaaaatattagacgtgaccagagtaatcaaatagttaaaagagatactaatcacaatccagttcgaaagttttgtatgacaaaaacctaatcaactaagaactatataattgccagtagcaaattactgtcataattcatcaaaattgatagacctagatcatgagattatcaaattgctaaaacaaaacataatctatacactatagcctctaaagagccaacgaattccaaagctaaattactggaatcgagaataccagacttggtgttggccaccgctggtccaaacttccatacagatagaacaagacaatccctcagtgtcaccttgtttccattcgacatcctcctgcgatccggaagacgatgaacaaacaccttgtgacctattctgattctctatcccttcactctcgttctgtgaaaccctaacaggtgagtctaggacatcgatgtattccctggtttggcgttcggaatcttcttcctcctcttcctcctcgtcttcctcttgtacttcaccatagtcgacatatgcttcctcttcgtcttcctcttcttcgtcttcttcttctccatagtgtccaaatgcttccccaaattcaatgaatcgtgcaattgtacctccgtgaccactgaaggggtaactccggcgaggcggcattaggttcgtttctgttactgtatcagatttcggaagagaagaaggccaaaacgtctcggcagagtcgcagaggtatcgaataagagagactcccggaattaataaaaataatatttaaaagtaaaaaaaaatagttaaaagataaaatattataacaatgcggtgagcgtggatcgaacacgcgaccttcagatcttcagtctgacgctctcccaactgagctatccccgcttgttgttatcatttaatatttaaactttaataatctctaaacgtaagcgtcacgtcaaattggtcgcagtcttcaatgaaatgttcgtgacttttagggaagaaaaggtgtttggagagatatggggagaagcatattttcctttttcactaagaagaaaaaaatggcgatggcgagaagcatctcttacatcacctctactcagcttctccctcttcatcgtcgtcccaacatcgccatcatcgatgtcaggtataacataatcgatttatttccgtcgattttagtcactaatctgatcctttaccaaattttagttcgaatcaatcccgattattgttcttaggtttgattttgctctactatgtaatactgatatgcgttttaagagattactttacttttgaactctggggatcaattaattatgaacatgttttctaaaactggatattttgtagaatctctgtcgaaaaacaactattagggacctcatgagcttggaacaaaggttttgtggttagatgggctgagaaagaaacagactttttgtaatacttatataggttcttctgatacatagttatggcttaaacaaatttagactttttatgaacctattgtatagctcacattggaggaattgtatgtttttaagggatgaagagaggaattatgacgggcatatagctggatcgctacactatgcgagtggctcgtttgatgacaagatctcacatcttgttcaaaatgtcaaggacaaagacacacttgtcttccattgtgccttgagccaggtgtgtgttttacactcttttcacttccccataagatcttcttttcctcttttttgagaaacaacacataggttagataagcggcatcaattggctattcgtagaaggagatgtacatctctatgttatacatagttgattcatgtttcataggttagataagtggcatcaattgggttttcttagaagatttatatctcttatggtctacaataggtccttcatgtgtcaaaaagtggattcgaggtcgcaaaatccaagtgttttccgataagtttgcctactagtccatatattcttatgtatgtcatggagtaggaacttattttatattcttaaaagaaagaacaaagaacaacgattagcttagctccccaaatcatcaagctcagtcttttagcaacctttgatttgaggcagttctcatttctttgttcctaacataaatcagtacttcgttgcactcaacatgaagtgattgctaaagccttgaaaccaattcttcctgcaggttcgtggccctacttgtgcgagaaggctcgtgaattatcttgatgagaagaaagaagatactggaatcaaaaacatcatgatcttggaacgcggctttaacggttgggaagcttctggaaaaccggtctgccgctgtgcagaggttccttgcaagggcgattgcgcctaaaccctactaaaccatattgggacctaattgatgttccacattgtcatgtactaaagttgaatgaagattatcataaataatctcttatcagtatgtttggtttacatggagcacaaacaccaaacttgcaacaacaatactaaaagggcttttatggtattgcacgtttgtggagcgtcaaagccacgttgatatcttaacgccgtcaaaataataatggatttttcggtatcttctctggaagaggcacgttactttattaacgccgtcaaaactctctcgctgatacagagtgtttgctttcttttgtagatttttaaagtcataaagcaaaagcaacgacgacttcagagaactacaatcataatttgtgatctctctccaattttcatcttttggtcgaaattcccaattccctgagtcaagaaccctaatttcaacatg

SEQ ID NO: 32355 - DNA, 3003 bp, Unknown; identical to SEQ ID NO: 32354
  misc_feature (1)..( 3003): 2750-1469P.txt file - cDNA_ID_3052325; gDNA_ID_2926221; Annot_ID_203312

SEQ ID NO: 32356 - DNA, 3003 bp, Unknown
  misc_feature (1)..( 3003): 2750-1469P.txt file - cDNA_ID_3052345; gDNA_ID_1620619; Annot_ID_46977
tgagccgctcggatccttcgtatacagaggcgttgcagttcctgcgcaagctcagcgcacagcgattaaaacctcatgttaaacgggaacctgggatacatgattgattaaccatggttaggttaaccgaagatgaaccaaaggtcattggttttggctaattgacgctatagtttttttcatttcttgtgtgtacataacaagaaccacgcttaggctcttttgtttcattttacacattgtttcatctgtattactggattacacaattggaagtaaatataaagattctcaatttcatttgccagtgttcttaaactcgtgatgaataacgaacgatgatgattttaataacaagaaaaagaattaaaaaaataatcacgtgacttgtggaagcaagcaaggcaacgcgttacaaaagcacgtgacgtagcgtattggtggcaatttctcattttttcctcagaatacttactttagagcactaatccaattatcatacgacgcgtgtcccacgtttacttccttctctcatataacaacaaacaacccactccgaattttctggtattattactaatttgccattacgtcgtactgtagtgttttcttaaatttgacgtaagaatgaatgaatgttggaagagtaaaagaaaatgttaataatgtccaacattaatataaactggtttcattttcacatttaccttaagtgatacactgagatcttacatttattaaattttcttcgaacaacaaactatattaattcatagatgatagatcgaactcatatttcatggaatgcttttgcaattttaaaatgaaaaaataaaaagagcatgattaagggtattttggtcaatgtctaagagagatagctgtttccaagacttgttctccaagctggtagtgcaagatctcgttaagtataaaaagggaagctgaggaacacaattttgatacttttgagatacaacgtagaagagaagctctaaggttttcaagttctgctcaacaccactgcttactaattaaggtatccaatgattaatgtgttcatctattttaatcattagttaatcttcttaaccatcatacttccttcaagcaagctctaattattaatgtgttcatctattatgtggttaatgattagtgtgattactacattaaaggcttgcttggtatagtttccattataatccactaaaagagggaaaaagaagaagaaaatggattgaattaaaagtttgttattattttttgggtaaaaaaagggaagcttgtttagcacatttactcagttactcgtccaccaaaatcttttctatgttttattttgggtataatcttgttttcttttcacacaatcacacatcgatttcgggtaacctaagttataatatgtcattgttttgctttctgcacacacttatatatatcagcatatcgctaatcatgcacaaattatacatcacgatttctacccaacaatgacacactcattggaaaaatcccatacgtatgcaaatgtgcatatcttgataagaataatcacattttattgattaaaaatatttcgttgaatagaatgatataggcagatagtttcttcctaagtgtttttttctttggtgtgtctcgttttttgtttgttgcttaatctacatttatactcaacccattagccgcccctatataataacaaacacatatttgcatgaattttaattgtgtgatgccccgttgcttttaatcttgaaactgttagaaattaaagagaatatctagcgagagataacaaaaatatatggctatatgctgcatttttaaatatataaaacaagtcaacacaattaaatacgagacttatcgtgtaagaacttaaataacacacattttcaaataccatttcgggtagggccatatacattttaatcgtcacaattcacatcgtcgtatcgattatcacacgtttgagaagatcagaaaaatacttatactattaactctgtgtgtagattcatgtctaatatagagaaatactcaaatacaaataactaatgagataaggagttgatgactcatcacataatcataactatatattgtctaactccagtgcatggaaaactaaaacagtgcgtaacattttttagccattacattatatatagtttagtgagtaaatacatttttatcaattatatatgtaaatgcaacaatatttcgaagttttttttgtagttctttcataaacaaacaaaaaaattgtagttctttaacaacgaaaaaacagtactttgtagtgtcaatccttagaaagattgtgtgtgtttattttccttcaaagagggatattgtgaatacgttacatattggtgacgcacacaaaaacaaaaacagaaatgtatagaatacgtttaatatcaatttgacacgcacacaaaaacaaaaacagtagattgtgaaaaaagatgatttgttttgtaagtattggcgtaggccaaaaggcggcttaagtagagagtaaacgtttgcttcccgcgttatacaaagccctaattctcatcatcatcatgcgtgcaagctattttccatttcctttaacgattctcattcttactctcttcaagcttcttctttctttccccaatatcttttctcttttatattcattatttttctccctttttctctcccaaatcttttttttttctttttcccggaaaattctctctgttgttgttgttgttgttgtctctctcctgataagctcgaccaagtttatctctttctcgctaatcatttctctttaaacttctctcatcgttgaaccattttgttttagtacataaagattcttcttcattctttttgtacgcgtttctatgttacaaacgcatttctatcataaaagttattattacttgagctcaatcttcattggtttattcatatattcagatcaatcgagttcggtactgcgacgttctaatg

SEQ ID NO: 32357 - DNA, 3003 bp, Unknown; identical to SEQ ID NO: 32356
  misc_feature (1)..( 3003): 2750-1469P.txt file - cDNA_ID_3052345; gDNA_ID_1620619; Annot_ID_162195

SEQ ID NO: 32358 - DNA, 3003 bp, Unknown; identical to SEQ ID NO: 32356
  misc_feature (1)..( 3003): 2750-1469P.txt file - cDNA_ID_3052345; gDNA_ID_2926207; Annot_ID_141781

SEQ ID NO: 32359 - DNA, 3003 bp, Unknown; identical to SEQ ID NO: 32356
  misc_feature (1)..( 3003): 2750-1469P.txt file - cDNA_ID_3052345; gDNA_ID_2926207; Annot_ID_202297

SEQ ID NO: 32360 - DNA, 205 bp, Unknown
  misc_feature (1)..( 205): 2750-1469P.txt file - cDNA_ID_3052391; gDNA_ID_1563671; Annot_ID_148094
  misc_feature (133)..(133): n is a, c, g, or t
tgcaggacatggaactctaaatcctacacgatggccatcacttaggagtgagctgattcagtttctactggagaaatcaaatgcccatgattctagtacatgtgtaacatctcgattgaattatttgaacctntaccatctgctagaaatggatactgaagccactttagatgtcctaagatatgcatttgtagaaaatgaaatg

SEQ ID NO: 32361 - DNA, 715 bp, Unknown
  misc_feature (1)..( 715): 2750-1469P.txt file - cDNA_ID_3052423; gDNA_ID_1563684; Annot_ID_148118
  misc_feature (213)..(213): n is a, c, g, or t
  misc_feature (230)..(230): n is a, c, g, or t
  misc_feature (241)..(241): n is a, c, g, or t
  misc_feature (287)..(287): n is a, c, g, or t
  misc_feature (367)..(367): n is a, c, g, or t
  misc_feature (373)..(373): n is a, c, g, or t
  misc_feature (376)..(376): n is a, c, g, or t
  misc_feature (378)..(378): n is a, c, g, or t
  misc_feature (525)..(526): n is a, c, g, or t
  misc_feature (543)..(543): n is a, c, g, or t
  misc_feature (563)..(563): n is a, c, g, or t
  misc_feature (570)..(570): n is a, c, g, or t
  misc_feature (683)..(683): n is a, c, g, or t
  misc_feature (686)..(686): n is a, c, g, or t
  misc_feature (702)..(703): n is a, c, g, or t
gatggcggacatcgacatcgccgtcgggaaagagccgctgataaaccatgaaaacaacaacaacacgaacaagatcttcaatcgctgcgtttcacaccaacaagacgagctacacagcttccgcaaatacctaaggtggatgtgtgtagatcactctagtccatggacagcgattctctcttggaccatgttcatcgtcttcacactcgtcgnttccggcgatctctcanttcctcctcgnttgtgctgattgcgacagttaccattcaagaccttacgactccgtnttcagctttctctaagcagcgtcgccaccgtctctttcctctgtctcaccagattcgttagcaagtatggtcttcgacgnttcctnttntnttgataaactctgggacgagagcgaaaccgttcgacgaaattataccaatcaactcaatgtgagtttctctattttcgaatcacaagtttttttatttctttacaaattctgtaatcgcaaaaaaagaaaaaaataataatcatatnntgtcacaaactcatatntgtcatatctgttaatattnctattanttttaggattatgtcaaataatttgtccaaagaataaagtgagatttgaaaaaaaataatagaataaagtagaagaatcatgaatattataaagtaaggaaacaactcgacgnatnttaaggattgagcaannaaaacaattatg

SEQ ID NO: 32362 - DNA, 46 bp, Unknown
  misc_feature (1)..( 46): 2750-1469P.txt file - cDNA_ID_3052589; gDNA_ID_1563738; Annot_ID_148213
gatcttcaccactgtgattagcgggtggtgtagcaatggaagtatg

SEQ ID NO: 32363 - DNA, 5 bp, Unknown
  misc_feature (1)..( 5): 2750-1469P.txt file - cDNA_ID_3052627; gDNA_ID_1563752; Annot_ID_148238
ggatg

SEQ ID NO: 32364 - DNA, 323 bp, Unknown; identical to SEQ ID NO: 319
  misc_feature (1)..( 323): 2750-1469P.txt file - cDNA_ID_3052635; gDNA_ID_1563754; Annot_ID_148241

SEQ ID NO: 32365 - DNA, 112 bp, Unknown
  misc_feature (1)..( 112): 2750-1469P.txt file - cDNA_ID_3052638; gDNA_ID_1563755; Annot_ID_148243
ttctctcttcagtcttcagcctccgcccgttattgttgaaaagttttagcctttttgttaattactactttactactcttgttgtgaatttgctgctactgttgaagccatg

SEQ ID NO: 32366 - DNA, 647 bp, Unknown
  misc_feature (1)..( 647): 2750-1469P.txt file - cDNA_ID_3052649; gDNA_ID_1563760; Annot_ID_148252
aggtcggttttgttaagctactgataatagtttattatatacgttaataacttgttggagaatctaatcaagtcctgattataagaaggataaagaaaagggaattagaaaagaagacattgattccgattggattctgcttttttcttttcacgtttccgattgtttctggaactttttgtgagcctaaggtttatctctctcttctagtcgtcgattctggtcatcgaagattccaatcagctaaggttacattcatctctctctctctctcgttgtcttggttttgattttggcagattgtgcttggaatcaacagtttcggttattcgatatatgagtactgttaattctagggttctatcactttcctcttcggatcttttgcctatgggttccagaataaaagttttagggttcttcttccctttattgcgaattaagtcatatgcattgcctctgattgtgcgaatcatgttgtagttccaatctttctcttaatacgatgagaataattgtagttagttgctaatgaaccttggtttaacaatttctaggtaaagtgctatatctcgtttcccctgtctcggttcaagctttcaagagaattgtgattgattctataagggctctttgtcagtacaatg

SEQ ID NO: 32367 - DNA, 519 bp, Unknown; identical to SEQ ID NO: 320
  misc_feature (1)..( 519): 2750-1469P.txt file - cDNA_ID_3052666; gDNA_ID_1563768; Annot_ID_148263
  misc_feature (457)..(457): n is a, c, g, or t

SEQ ID NO: 32368 - DNA, 216 bp, Unknown; identical to SEQ ID NO: 322
  misc_feature (1)..( 216): 2750-1469P.txt file - cDNA_ID_3052707; gDNA_ID_1563786; Annot_ID_148294

SEQ ID NO: 32369 - DNA, 261 bp, Unknown
  misc_feature (1)..( 261): 2750-1469P.txt file - cDNA_ID_3052812; gDNA_ID_1563824; Annot_ID_148358
tatgaagcctaattactgtaagaaactgtggaaaaattgaatctaacctttgagttccttaatgtatagccttagtccataacgttcttgattcagaaaaatctcctgcaaatggcattttatcatataaaacagatttgattatattagaaaaagaaaagttgtatatgtctatgtaactatgaagtttatagcatcctcataattcatgatcaattatttgatgttttctagatttagcactaaggaggcgcggagatg

SEQ ID NO: 32370 - DNA, 3003 bp, Unknown
  misc_feature (1)..( 3003): 2750-1469P.txt file - cDNA_ID_3052858; gDNA_ID_1971876; Annot_ID_176720
ttaatttgacttctaacaaaccttgaattcctcaaatgtcagattaggaatatcttttggatcacctccactgtcaacaccatatgtattttctggggataaggcctaataaaagtgaaaacagtagtagctgatttcatcagaaccactatatcaaggaaattcaaatatgtctcagattatctaacaaggtttttgttccaagtgtccaaacgactctttcatgatggctatatcatttagttgattaataaggtcaaaacccaagatcaggttaaaccaacaacgagaaacttctagttatagtaagcaaaacacaatacttgcctgttgagcaattcgccctaaaatattatcaggctgtgaatagacccctttcatctcattaaaaacaacacctgaaatcaaacatcaacaatgagataggatgagtgggtatctgaagtagctgataaactaaaagatatcatcgatactaagaaaagtagaggaaaagagctctaaaatggaatcctaggtaaataaaacctttgtaagatatgtcttccgagggatcattaagttcatagtgccagccctcttgctgaaaggtgtgagcgtcatccacacacttggggaagaagacagcatccaaatatacatcgacaagattgtaaaaatcctaccatagatagtgatagtgatgagttgtgatcagaaatagactcactttagataacaataacagaaagaaagaggttagcccactgaggacaacaaaagaaggacttaatgtttggctcattgtacctttgtattggtggaagcaactgggtagcaggtcctatcaggatatgtgaatgcatttagaaaagtatgcaaacttcccttgagtagttcaacaaatggctcttttaccgggtactttcttgacccacatagaacgctatgttccagtatgtgcggaatgccagtggaatccttcctgcattaacaacgaaactatgatctaaaattgcttccattattagtttttgcaagtctttcacaaggaggtgcctgtgggaccaatatctactgaaagtgcagttgctcatatcgacttttaacaaagcgttaagtaatttgacaagttgtaacctccaaaacttagaccactttacaagtaccaatatattagaagaagaaacgaaatgactaggtctaatcagaaaaaaaaagctttgatgagtagagataaacttgaccatttcaattagttaaattcaaggagtgaagctttaggtaccaatttcaattgcctaatacatactcaggtcaaatttacagagagtaaaaattattatgaagtaaacttacggaggagttctgaaaacaacaccgaagaccttgttctcatcctcatttgacacagacatcacctcgcaaccagttttcttgtgtttgaagagtatcgcctttgatttacactctgagatgaattcttccgacactttttcaaatccaagcttctcagcctcatcttgacctacatctgaatccaaacaaccaaaaataaggaaaatcacgcatcagcagaggttacacatggctccatttgattacaaagtagacacaaagcatgagatgaaaaatgcaccacacggaccacacctatctacaattcacaacctatcctaaagtaagaaccacaatttcacaagtgccacaaatcaacatgtccgaattaagagaacaaatcaattagcaattaaacttcaaacagattgaaaaaaagaagtatatgtgaaaaattccaaccaggataaagtggagcgggttgtgtggcgacggcgcgaacagagaggcgagagaactgcccattgacactgcgaactgcggcggagggaatcctcaaacctcgtcggagcaaaagacgtctaccggcgactgagggagaggaaattcggcgaagattgcgactggggacacggagagctgccgtcgacgatgtgagagacatgtaagagcgagggaactgacgaaagaagcgaaagaatagagaggacgagctgcgcgaagctaaacaagagacggttcggagcatagctaccggaaaaaaaatattcccggcggagactgctactgacggagacgaaattaaggatattgcaaagaagctaaataaacccaacggcaagaggttttatccttgtgtagttgtgtgtttttgcttgtagaggaaaaaagtaaaataaaataaaatgaaatacctcatttcttgtacaacacacaaaattattgtgaaaaatattctctattttactaaattggcattttatttttctgaatttttaagtcgggacaaaaaagaggtgctgatttgcaagaaaggaaacgtggttctcatatagccaaatgtgtttgagtgttgcaatttgctatcctccaaaaatataatgactacaaaatatcttaaatcttttttcatgatattaaacttaagtgaaagtattacaaaatctgatcaagttaaaagtttacaccagacatatactttccaggtatttgattcagaaaaaatcatattgatcagatttaaacaaattttaaattatatataagttttttcttacacacaaattaaacctttgatcagtactagactactggtagcatgcgatgagcttgcagtagtttctctcgcacattagttatgggccgagagctaggcccatgtccagggacggataaaataatcttccagatgtttctttattatccacgtggcgtgatcacgtgaccacgtctcgtctcgtctagtcctagattagcagagcctctctttcggccagcgggttaccttattatcgtcacaagacgaaactttcagaaaaaggcaaaaatcactgtcaaaactcaaaagccttgagaccaaatttccgattttttctcctctgaagaaatccaacaaattgtaccatgattccagcttcactctacttcttctagggttcgttcgttttctggagctgttgcgcaatg

SEQ ID NO: 32371 - DNA, 912 bp, Unknown; identical to SEQ ID NO: 582
  misc_feature (1)..( 912): 2750-1469P.txt file - cDNA_ID_3052886; gDNA_ID_1592113; Annot_ID_151985
  misc_feature (1)..(1): n is a, c, g, or t

SEQ ID NO: 32372 - DNA, 788 bp, Unknown; identical to SEQ ID NO: 358
  misc_feature (1)..( 788): 2750-1469P.txt file - cDNA_ID_3052886; gDNA_ID_1564341; Annot_ID_149285

SEQ ID NO: 32373 - DNA, 5 bp, Unknown
  misc_feature (1)..( 5): 2750-1469P.txt file - cDNA_ID_3052967; gDNA_ID_1563881; Annot_ID_148454
agatg

SEQ ID NO: 32374 - DNA, 268 bp, Unknown; identical to SEQ ID NO: 330
  misc_feature (1)..( 268): 2750-1469P.txt file - cDNA_ID_3053090; gDNA_ID_1563924; Annot_ID_148524

SEQ ID NO: 32375 - DNA, 385 bp, Unknown
  misc_feature (1)..( 385): 2750-1469P.txt file - cDNA_ID_3053265; gDNA_ID_1563985; Annot_ID_148634
  misc_feature (4)..(5): n is a, c, g, or t
  misc_feature (114)..(114): n is a, c, g, or t
taanntctgataacgaagatttagtgggaaatcttagcgattctgagatcatgtcaccagcatctaggcattcttgggactgtccaaaataggtttgacagtcttttctctccntccctctttcagcagagcttcattttctccagagtcatctgtctgcagagaggcgaagaagcgactttctgaaagatgggcgttgatgtcagtatcgggaagaactcaaccgcttaaacatgtttcaagaacctcaagcaccttaggggaaatgcttgcacttacagagaccaaagtgacaactgaatccggggaagggagctatgaaatagtaccagcaacgagggtatcaacatcatgcataactagtgatctgagtcaagtggaaatg

SEQ ID NO: 32376 - DNA, 430 bp, Unknown
  misc_feature (1)..( 430): 2750-1469P.txt file - cDNA_ID_3053309; gDNA_ID_1564002; Annot_ID_148664
caattatccaataattaattatggccaaatccaagttctagagttttctctagaaatatcatcatttccacctccttaaaagattctagaaattttctagaatcatcttccacctccttaaacataaaaaatctagatactctaatagaataatctagataatttgaataatgtaatctagatcttatgtaagaactctctagacttatgattaaaatattttagatattttgtagtttggaggctataaatacctcctccccctctcaaatgttgcaatgttgtgaagttgtcttcaagtttaaagcaaagtaataaaagttctatttcctaaataactctctcaaaacacttaaacactttctccattacctctaaaagaattttactctaacaaagtggtatccagagcttgaagatcctaaagatg

SEQ ID NO: 32377 - DNA, 756 bp, Unknown
  misc_feature (1)..( 756): 2750-1469P.txt file - cDNA_ID_3053335; gDNA_ID_1564011; Annot_ID_148680
ataaaactggataaatcgtgactaggggctggagatcaataaatcgtgacttccctccaactgatacggattctacaactatttgaattttataaggaatttcaataacttgttcactttttaaatatacaatagttttgtacaactagtaaaaaatattcatatttccattataatcatttatcattccattctgcttttttttttgggttctcaattctgccattccaccatgtttcttatcggaatctaaggaattaatgcattaagtagttgaagatgataattttatttgtttccaaccattttgatggttaacttaaaaaacataaaattttaggtttggtggaaaaaagaaagggacacttggccttacgacaaagcgaagggtcacatgttaatacaacaatttcaggatattcgaatctctaatattggaatccctaatacatggctcactctctttgattcaaacataaactgcactcgtttatttaatctttgtttgacagctaaaaagatttttattttcgggttgataaacctataactcctccaacggacaaaatttactagatagatctataacttttcgtgggctatatataacttctcgtaggcttcgaggcccaaaaatgtttaaaagtgttgaaaaccaagacaaaaaaaaatggagtgaaaaagatgaaatccctaaattgaatcgcaaatcgcaatttgaaaaaaaaaagatctctctctgaagaatccgtcatg

SEQ ID NO: 32378 - DNA, 533 bp, Unknown; identical to SEQ ID NO: 337
  misc_feature (1)..( 533): 2750-1469P.txt file - cDNA_ID_3053350; gDNA_ID_1564016; Annot_ID_148689

SEQ ID NO: 32379 - DNA, 19 bp, Unknown
  misc_feature (1)..( 19): 2750-1469P.txt file - cDNA_ID_3053452; gDNA_ID_1564051; Annot_ID_148755
catcggtttaccagcaatg

SEQ ID NO: 32380 - DNA, 611 bp, Unknown
  misc_feature (1)..( 611): 2750-1469P.txt file - cDNA_ID_3053631; gDNA_ID_1564125; Annot_ID_148898
  misc_feature (173)..(174): n is a, c, g, or t
  misc_feature (593)..(594): n is a, c, g, or t
aacttttgcatttatatagatatttcctttattttcattataatttttccacattgccacaaaaaatgatatccacaattaattaattttaatttgtagttggatctaaatctaatatgaaagaaaaaagaaaaaacatattgagtctgaatcatatggatacacataccaannaatcagagatcacggcaagacaactttttgtcttatcttttagttttttatttgtcaacgttgtttgttgtcttactaatttattttaattattttttcccgaatctcatttttctaagagggaaaaagaaaaacatttcttttttctcttatgcaataaaactcgcttcttttgtctttgatattaggaaacggacaaatcagtctagtcaaatagagccattcaaagtacggcaacacaaaccaagagagtgtaagttaagcgacatgtgttagagatatccggagatctcaaccgttggattctttctccttcaaatcaaattataaatcccatcaaacagagagagagagagaagaggaggagaattcgaagaataaaagataagaactttgacgttttgaagcttaaagcttknnmmcttgttwcatccatg

SEQ ID NO: 32381 - DNA, 589 bp, Unknown
  misc_feature (1)..( 589): 2750-1469P.txt file - cDNA_ID_3053643; gDNA_ID_1564131; Annot_ID_148907
aatcawatttgttttgtctgattaaaaaaagtttaawatatgkaaattaagkaagracmtcaatgaacmttwaacatagaaaatattwacaaagagcagttwactatcaaggggrccaatttgattaaaraaattattttttgttcccattaraaattggcaawaacgttgaggktgttytytcaaattaaaaaaaaaaatattttctattttgttggtgtgctcttaaattccccattgttacattgaggttgccctctaaattttaaaatattttatttttttgttggtgtgcccttaaatcacccattacacaacaaacaaaaaaagagactaaccaaaaaataattttataattaattttgtttcttcctacctacaagtatttacttaaccattgcctcgatcttttaaaccatccacattttttgaatcaccatcaacatctttctctcttctctttcttctctctatctgagtccagaaacattcacattaattacaaactgaaaaaacattgaaacttttgaataaactcacgagaagtactctgttttctcttcttactctgtttcttgttgatacaatg

SEQ ID NO: 32382 - DNA, 809 bp, Unknown
  misc_feature (1)..( 809): 2750-1469P.txt file - cDNA_ID_3053665; gDNA_ID_1564139; Annot_ID_148922
aaaaaaaaaagttcmccaatttcaaaatacttctatagttatatttcmcctagaaatagcatcatgaaccaattatcaaaataagaataaacagaatctttattaaaaaaaaagtaccccggccctttatacagtcttttgtgcaaattgatgatggtcgtatacagtgtgcgctacggcaaggagacgattatattgattaaaaaaacttctgcatacagtattgcgaagttaacgtcgacgtttgatatgtctttgtggatagcgattacatgtttaagtcaattgagtttaagtcccatagacgcgtttatgccagtaagattattaaatttgagaaagaaaaaatataaagggtagactagttacgatttatgcgtattcgtaaacctattattttcttgctatcacatttaatcttgtgtccaatactttgtaccaagattagattgtagactgatttttttctggttattactgaatatcacactaaaatttgtttcgtggtcaaatcaaagcgtattagtatacacgtcaaaaagatagcacaaacaagaaaattaaaattcaaaattgagaatatatgacggcatgatcgttaccaatccattggttggtataaacatatatacttttcttttttgcttcaactacaatgaaattacatattaatatatttgattattaatttaaattaaaaacataagtccccacatctatataaacacatcgattcaagactcaaatctcatcaatcaaaatcttcaaacacaaacttctcgtttctcaaaacagttggtcttatgatg

SEQ ID NO: 32383 - DNA, 3000 bp, Unknown; identical to SEQ ID NO: 1756
  misc_feature (1)..( 3000): 2750-1469P.txt file - cDNA_ID_3053837; gDNA_ID_1620444; Annot_ID_157257

SEQ ID NO: 32384 - DNA, 286 bp, Unknown; identical to SEQ ID NO: 350
  misc_feature (1)..( 286): 2750-1469P.txt file - cDNA_ID_3053909; gDNA_ID_1564215; Annot_ID_149054

SEQ ID NO: 32385 - DNA, 106 bp, Unknown; identical to SEQ ID NO: 353
  misc_feature (1)..( 106): 2750-1469P.txt file - cDNA_ID_3053939; gDNA_ID_1564228; Annot_ID_149077

SEQ ID NO: 32386 - DNA, 629 bp, Unknown; identical to SEQ ID NO: 355
  misc_feature (1)..( 629): 2750-1469P.txt file - cDNA_ID_3054102; gDNA_ID_1564282; Annot_ID_149174

SEQ ID NO: 32387 - DNA, 3 bp, Unknown
  misc_feature (1)..( 3): 2750-1469P.txt file - cDNA_ID_3054145; gDNA_ID_1564302; Annot_ID_149209
ccg

SEQ ID NO: 32388 - DNA, 3003 bp, Unknown
  misc_feature (1)..( 3003): 2750-1469P.txt file - cDNA_ID_3054173; gDNA_ID_1972174; Annot_ID_179960
atagattaaacacactcacctaccaaagttgcataccagccgttagattactcataagtgtattccaccgtcggatttaactactttttaaagagtcaacctcaataagaatcttgttcccaaagataagggtttgtgttgagtttaagaccggtttaatctgaaaactccgtcaaaccaaaaccaaaccgatttatcataaaaaaattcatatcatctacttccattggctagagacagattgtaacggtgtcgtcgtcgccaaacgatttgcctcttcctaaaggtaggttcttcatttctctcagtgcccctttgcgtgtttcagcttcttctttatgatctaattcatgtctatgtttcgtttgattctttgttcaattctgaattgagaaaatggcgattcgagatctgtctcttcggttttttagttcgactgatttgggaatgtgaagagatcagattgatttgttgacagagtcttgggggttttcaatcttattcctctagattttcgaaattcgattcctttacatcagatttcgcttaattctctgtcctagtgagttttacgatctttagtcttctggtttgtcaaattctatgtcttttcatgttcttctgagttttaatggttgatcttcaattacttggccacaatctctagagtttgagactcttgacttgtcttgcatatattcctctgtagattggttttatgtttggtttcaattccttgttgaactattctgatacggaagttttcctttctaaggtttggtgtttcctttttctgataaatagtgatgaagatcgattatgatgatcatgtaagaatataatctagctttggtgtttgtattggtttacctgagggaagaaaagtctttctctttgggactttaaactttgattacttaactccaacattatcatagttgggttctgtagttcatttcacttatagcagtaataactcattgattgatgcaatcaatcaatcctgtgatggaaatggaatcatggaaattgagggattcagggaggattgattgattagaatttcatatttatgagagaataagagaactgatgtgtgtttcttttcctacttcttaaagttgtgctctttcctatttctataagctcttgtggataacaacagttgattaacgttcttatgcttgtttagggtacaacaagaatggaagaagagtatgagagtcgtcgattgaggagatgggaagagttggacactgacatcttagtaagaattttccagaagtttagcgtctttgagttgacttcgggattagctcatgtttgtagaggatggagagctgcttgttgcgatccgattctttggaagacggtggatttgtcaaacatgagatctagtttcatcaagatcccattagagccttatgtctatgtggaacgccgatctgatgaggccctaacccgcatcctgaaactctccatgaaccttagcggaggaagcacgaggaccttgatttttcatttcaacttgttcttgagtgatgatcagcttacttacaccgcagaaaggtatgtccttttcgttcttccacttatttgtcttccaaattgtttcatcatggccgtaaactatggttttttagtcaaaagttggttcagtttttggtttggttaagttcatgtacccactttcagtcaaaattgctgaattacaattaagctgaatctcgcaaatgctaaaagttgaaaaatttgttgtactgaatattttgcaggtgtccagggttgagacgggtcgtcctaccggcttggaacagaataaagaagactggtatatgcaaagcgataagaatctggaaagatctagagtcactaacaatgccaagcatcgcaaacccgccttatctcttaacagaaattgccaagaactgcaagaattttaaagagctgaagatcatgggtccattcgaggtcttctttgcaaacacgctcatcacttgcctcccaaacatcaaaacactcagcatcagatgctcggcgataaagcgggaagcactgatgaaaatccttgacggattaccaagccttgaagtgctcaacatatcacactctcacctagtggagtacagcggttggcagcctcagcagaaggtgattgttagagagctcgataagacgataatggagaaaacagcaaggctaaagaaattcttgacttgcatggatcacaagacgtgtgtgatgtgtcagaggactgaaaacgatgaagggattgtgagatggtacaagtatgaggaaggagactggaaggttgatgaagtgagttctcttcatctttgatgtttctgctgtgatcattctctgtgaaggacttaacttgttattgttctcatctttgactgttgaattgtttatttctttgtgttgtttgttttgatttgaatcgtattatgtgtatatatctgtaggctatgccaatgaatgtctgtagtgatcaacttttgatcaccaccaaccttgcacaccaaataggaaaataaaacaatattgttacaattatttgtcttgatattagcattattagtcacatttgttttgcaaatcatctaccttttttttttggtctatatcttattcttcttagttcttacctaccagtcttctccggcggcattaacgacaccgttttatcgagctcagccaccactagttaggtaacgatatatattcttaaaaacgtttagaaaatttctatgtatgtttcacacgaacaaaaagaaaatatttttcagacatcaacggtcattatggacgacgactgttaaacaaaatcgtttaaaattcttgttgcgtaatttgaccattttattttattttataccaaaaattgaagatattatatatatgttttaattcgatcgcaaataaatctgaaaattaaaacacaaaacgttactcttctctctcattctctttcgcttctcgatagcttctcaaatcatg

SEQ ID NO: 32389 - DNA, 80 bp, Unknown; identical to SEQ ID NO: 357
  misc_feature (1)..( 80): 2750-1469P.txt file - cDNA_ID_3054173; gDNA_ID_1564312; Annot_ID_149225

SEQ ID NO: 32390 - DNA, 3000 bp, Unknown; identical to SEQ ID NO: 2614
  misc_feature (1)..( 3000): 2750-1469P.txt file - cDNA_ID_3054206; gDNA_ID_1620565; Annot_ID_160684

SEQ ID NO: 32391 - DNA, 60 bp, Unknown
  misc_feature (1)..( 60): 2750-1469P.txt file - cDNA_ID_3054238; gDNA_ID_1564332; Annot_ID_149264
ttcytsattaattgagtttttttttttggaatgcaaatagtytgagattataataacatg

SEQ ID NO: 32392 - DNA, 7 bp, Unknown
  misc_feature (1)..( 7): 2750-1469P.txt file - cDNA_ID_3054262; gDNA_ID_1564339; Annot_ID_149280
aaaaatg

SEQ ID NO: 32393 - DNA, 668 bp, Unknown
  misc_feature (1)..( 668): 2750-1469P.txt file - cDNA_ID_3054324; gDNA_ID_1564359; Annot_ID_149319
cgtaagctagaatattacaggatagatgagattaaagaaatagtcccaaatagcaagcaacaaaactaaaacattaacacaaacaaattctaaaaatagagacacaaacttaacaaagatacaatgaaacctcaatgaattaatactcgatatactaataccttaaaatattttttctagttctaaattaataatttaacctaaaaatatcacttctataaattaataattacgataatttaatgaaatttagtaaaccattaatctcaatattcttaatttatagaggttttactaaattgtagaaacaactaattcgagtacatccctgaattaataaattttagaaatgtgaattaacgaatacttttgttcttgtgaatggttaaaaaaaagttacttatcaagacaagtatgaagtatcacgtgattaaacgtttaatgacaccaacctaatgacaatttgtttgatttatttgtcacctaactagagactctctcacagtcaacgcagcttatgtgtcatagtaagactttttgtctactatagaagaaagacgaatttataacccctttaggtkttttctaacacacgcctctaatctccgcgcacacacacacaccctcacgaagaagaagaagaagaagaagacgaagaagaatcaatg

SEQ ID NO: 32394 - DNA, 312 bp, Unknown; identical to SEQ ID NO: 363
  misc_feature (1)..( 312): 2750-1469P.txt file - cDNA_ID_3054388; gDNA_ID_1564379; Annot_ID_149354

SEQ ID NO: 32395 - DNA, 49 bp, Unknown
  misc_feature (1)..( 49): 2750-1469P.txt file - cDNA_ID_3054406; gDNA_ID_1564385; Annot_ID_149365
cactcaacaagttcatgaaatggtggatgtaagaaatgacgagmcaatg

SEQ ID NO: 32396 - DNA, 10 bp, Unknown
  misc_feature (1)..( 10): 2750-1469P.txt file - cDNA_ID_3054564; gDNA_ID_1564448; Annot_ID_149473
ggagaatatg

SEQ ID NO: 32397 - DNA, 3003 bp, Unknown
  misc_feature (1)..( 3003): 2750-1469P.txt file - cDNA_ID_3054609; gDNA_ID_2214471; Annot_ID_133087
gatatgaaacaacagaatcaggaaaatttgttaaaatgtcagaaaatggaaaaatctctaactgaacaaaagtaacaaaaaaaactcccttagaaacagaggaatcatgatgagagacaaaattatacagagacgtggagatgtctgtaacgttgtctcatccatcatcatgtcttcttcttctcttccttctcttttccggtcatccctccgtcctcggaacctccatccccgacgcggtgaacacggcggcgcgtttggtaaacagagcgagaagagcaaaactgtcgagagaatttctacaagcgcacaacgatgcacgtgtttcttcaggcgtgccaacgctcggatgggacagagacctggcccgattcgctgataaatgggctaaacaacgtaagtccgattgcagtatgatacattcaggtgggccttacggtgagaacattttctggcaccggcgtaagaagacgtggtcgccggagaaagtggtgacgagatggtttgaggaaaggtttaactacgacgtgaaaacaaacacgtgcgcaccgggaaagatgtgcggccattacacgcagatggtgtggagagagaccacagccgttggatgcgcacgtgtgaaatgccataacggtcgtggctatcttgtggtgtgtgaatatgatccacgcgggaattacgaaggtgaaagaccattttgatcaaaacagttaaaatgaaaaaattgttagagattcaaaatattttttcttcttctaatgtaatgaagatggtatattattcttggtccttacatatatacagccatgtattgaagaggtataaattcaaatggttcggaatcttttaattttatatattaaagatcaataataaaaaaaaacgtcgacagcagggttcgaacctgcgcgggcgaagcccaatagatttcaagtctatctccttaaccactcggacatatcgacttgttgtatttgtttcgtaagatttgaatacaaaaccgaattctctgttgcctaaatcggagcttttcatcccttgactctctaagacatctgaagcagctaaagtgttggatgtttcacataacgacatgggcggcaagcacccagtggacacaacaaggtacctttgttcttggccgccctctaattcgggtgaaattggaagagaggtgcttggtatatactaggatgcgtatttggtgcttagagatttgatgaaactgaagcagttagatattagagacaacgacctaatatttgcaggtgaagagttcagctcttttgtccgccaggtttttccaaagcttgtatggcttgatggccacaaactcgcaagttaaagataaatgttaggccacttgttttaattaaagtataaaactctttcgtttttttggattcattttcatgaaatcaaaagactacaagtctacacgtgcttcaagcttgaggctctaaatgaagtggtaggaaagaatgaaataataataaaaaaagtcagaaaaatggatggtctgagatcaaagtgaaacctactccacatacacatcccaacttcttccccgccatgtggacttttctttttcctactttctctctctgcattctctcttacacctgtctttatctgaaaaataaccgatgagctcgtcgccgtcaagaaatccaacgaacgccgaagcacctccgccaccaccaacatcgacggatgctgtggcagagggttcgtctaagaaagtgaggaaaccatataccatcaccaagtcaagagagagctggacagaggaagagcacgataagtttcttgaagcacttcaactgtaataatttatctctgtttctctgtttttagagacttcaaatttcttagtttgctgctgatttctgagtttagttagttatagactgaacaaacagaggaaagtttatgttacttagcttaggtctagtagtaacttagctataaaaaatctgcttagctaaaaagatctgcttcttggagcacttcaactgtaataaatttatagttgtgttgactttttgaaagtgttattgatgtaactaggacctgattctgctgatactactactcctctatgttccttaggtttgatcgtgactggaagaagattgaagattttgttggttcaaagactgtgattcaggttttaaaatagcttactctgcatttttggtcgcagttactttgtggcaatgttttcaacttatttgactttgtactgcagataaggagtcatgctcaaaaatactttctcaaggttcagaaaaacgggacattagctcatgtgccacctcctcgacctaagcgcaaagcagctcatccgtatcctcaaaaggcatcaaagaacggttcgaatattttataatacttcttagtttggttatagagttgagtttttaactcacattttcttgcagctcaaatgccacttcaagtttccacgtcttttactactacgcgaaatggcgacatgccgggatatgcttcatgggatgatgcctcaatgctgctaaacagagttatttcaccacaacatgaacttgctactcttcgtggagcagaaggcatgcacatttgtctatcctttttgttttcttcattttattggtagttgtagtaagaataggttccatcaaaggacgtttcatgtgcttattatggcatataacgccactgattcagctgatattggatcaaagggcttattaaatgttagtagcccttctacatctggcatgggaagctcaagccgaacagtatcaggttctgagattgtaagaaaggctaaacagcctccagtgcttcacggtaaccatctgtgaacaattccatgttttttcactaacttttatgcatgatggagactgtactgatactatctttgtaggtgttcctgattttgctgaagtttataatttcattgggagtgtctttgatcctgaaacgagaggccatgtggaaaagctcaaggaaatg

SEQ ID NO: 32398 - DNA, 3000 bp, Unknown
  misc_feature (1)..( 3000): 2750-1469P.txt file - cDNA_ID_3054714; gDNA_ID_2926147; Annot_ID_197825
ttcggttctttctaagggaattcaggttttgtttacccttgtcaaagagaaatttcagtgaattaacaagcaagaggtgcggttgcaaagtacaaagattgtgaggcctagtggccgaaccctactttgaagaaggcctcgaggacgaattagggtcggagtctcctgagtttttcaagaatggtcagagataagtgttacatctgtcttgagacctaagtctcggactcggggttaagcatttaatatctcaaaagttcgctgataaaacaagttattccactcattgcaaatttgcaatgcataagagaagatgaaaaaattgaaaggctatgttcgactaatttacaagaaaacttagtaattttagaaaaactttaaaccgtctccaatcaaataacgtcataaactgtccgacattaggcctttagtgtcgtgtcctaactttaccacaagacatgccaatgtactaaggaggaaacgaaaaagaggtgagcataaaaatcaattttcgttacaatccctctacaacactctaatctaatctacctaaaatcggtaagccattttttcacagcaaatccattgcctctctcaccttcaaaaatttgactgatatattctgcatatttctatggacgaaaatgacaaccaaaaaaggtggtggaaaacatgattacgaaacaaaaattcttaaagaatataatagtaaagttgcaaaattaaaagaataatcaaaaggataaacggttgaaagagaagtggaggatcaaaatttgttgtacaaaagccaaaaacatttatttaagaatcccattaaattaaggggaatcttggttctcaaccagacgttaatttagtcttaattcaactccattttccattcttttgacttgatgctcacattacgtggagtcataagaatttatagcaagaaaaaaaattatgatccaaaatttaagattgttattgcatcattttaaaagtacataaaaattacaaaagatttcacggagcaatactcttaaaatacaatttcaaagcatcatttttttgtttttcttttcaacaatcatcacgtttgaaaaatagtatatattcggtaccaagattttttcacttgaaattaaaatatatagaaacttaggaaaaagtatatattaggatattatcaaaaatataaagtatatatcgaaaacataaagccaacgattttaaaaatgctcaacgttatcttgttcaaagagtgtggtacattaaaacgtgtcgtattctcatttgtacagtaagcaagtggaatccaagttgagttatgcaatttaaccgcgagataaaataagtaacgaagcttatttgtctgaaatcagcagcaaaatatccgtttctgttgaccgacgcctaccttactcatttagtcattacctacttttgtctgactcactcaccgtccatactttttacatttatgtgtagacataccaaagtttgttatatccaatcaagaactatgtgtaaacttaaattaaaccaaaaagaaacaagcaaaactgattatggtagttagaaaatagtctaactattatggacgttttaacaatcttttgtgttttcgtgacgatttttgtgtaaacgcgttcccgtgacgatttttgtgtttccgaaacgtttcgaaaacaggaaacggacctcggaacgggtttccatgcaacctaagacgtaacccgacctagatttgaaatcacaatgccttttttaagtcgagaatatataaagttgagagattacctgtttctggaaactctttgctaagtcttcaaaatgctttcaagtactctttgaaaatgtcattgtctaatcatgctaatctgatatattataagattttatttcggcccaactggtacaataatgtaaacgccattaactatgttgattggtacttttttgcggacaaataatacaccttatacttgttgacgttgtgcttatcatcttcagttctagccatgtttctagtaatatttgcatgtccatgaccataattctactttcgtcatttgataggagtgttctgatcaaaagatttggtgtaatatcgttgcatcttactatgttggattcatatatttctaaaaattagatcaggatatattattattattattattattgttattttgtttcgttgtatcaccatccaaatcaaactcgaataatacgttgttttttataaaaaaaattacataatcttatctgaaaattgctttaaatcataacattttaatagattttgttgttgtcaaacctacatgttttacaaacatgttttggttgagaatcaaaattttatgaaccttgtttttcgtgttttaacacataaacgcaagaccgttttcacatatatgtaatgtatgctttgcattaccggtttaaatttctaatttattttatttaatataattttagtgaaacaaaattttctctaataataaaatagaaacattgtatctttcacctttaccaaatcaaacaaaattttatgtttcttactagtaaaccccccaaagtagttgatatcttgtttgatagatttttcatgcatataatgaacatttaaattttacaaaacaaaaccattttttctttatttgtttcttggtcctctcaaatccaacccaccaagacaaagaaatagatattccctttcttatgtaaagacaaaagtccataaatactctctttcaacacctctctcacactcaccatgcaatttttctttccttgtgaccaagacttctctccaactctaaaccaaaaaacacccagattttttctctctgatttcaagattccccaaaactttttctccaagaccctctacaactttcttggtaagcctcttctacttcttcccaagtttgatcactcagcgaaacaaagcaaactaagtaacaaagttaaaaaaacaaagaatttgattgtttttttttcttatagatg

SEQ ID NO: 32399 - DNA, 3000 bp, Unknown; identical to SEQ ID NO: 32398
  misc_feature (1)..( 3000): 2750-1469P.txt file - cDNA_ID_3054714; gDNA_ID_2926147; Annot_ID_139157

SEQ ID NO: 32400 - DNA, 3000 bp, Unknown; identical to SEQ ID NO: 32398
  misc_feature (1)..( 3000): 2750-1469P.txt file - cDNA_ID_3054714; gDNA_ID_1620633; Annot_ID_47299

SEQ ID NO: 32401 - DNA, 3000 bp, Unknown; identical to SEQ ID NO: 32398
  misc_feature (1)..( 3000): 2750-1469P.txt file - cDNA_ID_3054714; gDNA_ID_1620633; Annot_ID_162766

SEQ ID NO: 32402 - DNA, 154 bp, Unknown
  misc_feature (1)..( 154): 2750-1469P.txt file - cDNA_ID_3054729; gDNA_ID_1564506; Annot_ID_149570
gtgtataactggaaaattacgttgttgtctcccgagactttggtttgtctcattccccattcgcgttcttatataaagctcacagttcgagagagacaagagaccaacgaaacgaactagagacagtttgattcgaaaatcttgtcggaaaatg

SEQ ID NO: 32403 - DNA, 3 bp, Unknown
  misc_feature (1)..( 3): 2750-1469P.txt file - cDNA_ID_3054754; gDNA_ID_1564516; Annot_ID_149586
atg

SEQ ID NO: 32404 - DNA, 648 bp, Unknown
  misc_feature (1)..( 648): 2750-1469P.txt file - cDNA_ID_3054765; gDNA_ID_1564520; Annot_ID_149592
cgccttctgcagacgttatttggaccgcattggtgaaaccaaatacttaatggctctaaagaatctttgtgactctggcattgttcaggtaatttcttacacaatctagatgatgattcatttatctcggatctatcctgagatctaaatacacttaaatcttgctctctgtwttatttcagccgtatcctcctctgtgtgatgtgaaaggaagctatgtatcacasyttgaacacaccattttactgcgacctacttgcaaagaagttctctccaagggagmcgactactgattcagatcctctgttttgctctgtttacctttatcatctcatactgttgtcgagattgtacacttgcttgttttcttttgtccgtcgttaacacaagctttgaatccttttataaaaagcttcagtgcctctgttaaaaaaaaactatgtatttgccatgaacatgaatttgctcatcaatcttactagaagttgattgataaagctccttgctttggagaattggtaaagctactaatttgacaagatcatataaaaagatatataaatrcagatatggtaaagaagagagaacactgggatcacacagagatcttagccaatagacttttgagctactcgaggcatttccatg

SEQ ID NO: 32405 - DNA, 4 bp, Unknown
  misc_feature (1)..( 4): 2750-1469P.txt file - cDNA_ID_3054773; gDNA_ID_1564526; Annot_ID_149603
catg

SEQ ID NO: 32406 - DNA, 54 bp, Unknown; identical to SEQ ID NO: 378
  misc_feature (1)..( 54): 2750-1469P.txt file - cDNA_ID_3054783; gDNA_ID_1564528; Annot_ID_149606

SEQ ID NO: 32407 - DNA, 659 bp, Unknown; identical to SEQ ID NO: 271
  misc_feature (1)..( 659): 2750-1469P.txt file - cDNA_ID_3054802; gDNA_ID_1564532; Annot_ID_149614

SEQ ID NO: 32408 - DNA, 452 bp, Unknown
  misc_feature (1)..( 452): 2750-1469P.txt file - cDNA_ID_3054903; gDNA_ID_1564573; Annot_ID_149679
tttcctggraagatacaagccattatactctaaaagaatataaacaaaarcaaatatattattcaacattggaatatatatactgtatgtaaaggcttccttagagaagtagaagaagagaagtatctggagagagagaggcgtgcgatttccgcatcgaagaaacagtacggagttttatccgctccgattctggtgagttttttttcgatttcgttgtccgtgttcttcgctttctcggaatttgtgtgtttttggattcttcgtatattatatgttgctttgacactgatctctgatttgatttatgcggctactcgatttttgaaatctgatcgttgttttattcgaagattcgtcgtttgttttcaatctctgttttctcatagtgtaacttgaagctgacaattagatttgaatgattttgatctctttgacagtggaagataatg

SEQ ID NO: 32409 - DNA, 49 bp, Unknown; identical to SEQ ID NO: 383
  misc_feature (1)..( 49): 2750-1469P.txt file - cDNA_ID_3054977; gDNA_ID_1564597; Annot_ID_149724

SEQ ID NO: 32410 - DNA, 126 bp, Unknown; identical to SEQ ID NO: 387
  misc_feature (1)..( 126): 2750-1469P.txt file - cDNA_ID_3055110; gDNA_ID_1564641; Annot_ID_149799

SEQ ID NO: 32411 - DNA, 3003 bp, Unknown
  misc_feature (1)..( 3003): 2750-1469P.txt file - cDNA_ID_3055197; gDNA_ID_1971713; Annot_ID_175144
gccttgaatgcaggatgctacttgcgttactctaactataccttctataatgaacgtggattgcttgctatgagtatgtctctgtctctgtctcataacacttgtgttatttgtaaaaattgtgatccgtttgtattatgatcataacatttcttgtatgtttttcttgtaggcttcactaaagaaaaccttacgtatatatttgttatttccatggtgggtgtgttggctattgcagctggattttggtgtggaaaatgcttctatatgcgaactagtccaaagaagaagattaaaggtaagttccacaagactatattgtgctcataaaggaactaagactaaaaagtttcatttgtttggacatctaaggatagagaaagagtcagagtcaatatgtactgagtcacacttgatgagctttgagtattcaactcttaaaaaagcaaccaacaacttcaatgagagttgcaagcttggtgttggtggatatggtgaagtcttcaaggtttctctcttctctgtataactatctttctttacactttaccactatgttgattgattaaaaatccttattgtctttttgacagggaactctgtctgacggtagagaaattgcgattaaacgactacatgtatcaggaaagaagccacgggatgagatccataatgaaatagatgtgattagtagatgccaacacaagaacttggttaggctcttaggttgctgcttcactaacatgaatagtttcattgtttatgagttcctcgccaatacaagccttgatcatatcttgtttagtaagacactcttctctaatcacgcacatatcttcttacttgtttgaaaagtttctaaacattttttccttgacatggaaatgaagacccggagaagaagaaagagcttgactggaagaagaggcgaaccataatcttaggaacagctgaagggttagagtatcttcacgaaacgtgcaagatcattcacagagatatcaaagcaagcaacattctgttagacttaaagtacaaacctaaaatatcagattttggattagccaagttttatccagaaggtggcaaagacatccctgcttcttctctttctccttcttcaattgcgggcactctgtaagtcctttcaatacaaagaacttcgtagaggtccttactattggtctgatttagaatgtgaatgttacattgtttacagaggatatatggctcctgaatacattagcaagggaagactaagcaataaaatcgatgcttatagcttcggagttcttgttctcgaaataaccagcggttttcgaaacaataagttccggtctgataactcccttgaaaccttagttactcaagtgagtctccatcttcatcacatcaatctttaactctccgagtgaccttcatatataacccattttcgaaccttttaatttcttgaacaggtttggaaatgttttgcttcaaacaagatggaagagatgatagacaaagatatgggagaagatacagataagcaagaaatgaagagagtgatgcagatcggtttgttgtgcacacaagagtctccacaacttcgtccaacaatgtctaaggttatacaaatggttagttccacagatattgtattgcccactcctactaaaccacctttccttcatgattccatgtaaaaattcatgtagaatttatatagattcctcaattccttattgttaataacacattactagaaaacatacaaataatcattgtgtatttcgtacgaataactattaaaaattatgtttatttttcttctaagttatgtagatagattcaaaatatatatttttgagattcatcccaatattaacacctatatatatgtttatatatgattaatctcaaaatataatacaatgtgataaaataaatgaatgagataaagactggtctgacgaatgtgtatcattgtctgataagttagttagtgccttgtgttgttatttgtggaaggcttgtactgttccaaccgtccattactttttttgagaaaatttgttgagagggcaattttcaagtttgtaaatttgccacttcaataacttctttgatttgatttgtcaattaggtagttcttacttcttactacattgatgtcatgcactttcatttagctgtcattttagagaagaaattacaaaaacgttattattttaactaactacttatgtggaatactatctcatttcgggggtacattgttttaacggtggcgataaaaagtgttttgtaacagtgaatagagaataatatactgttgacacatgatagtgtaaaagtgaacattatataacgaacaagtgtgtggtaaatactatcaccagggtaaagtaaagacattgttgtattaatgtgacccatgctgacgaaaatatgtatgtctgtgactcataatgacaaaaattattaatcatacatcatgtcatcactttgccttaatttgttggttaatatagagcatatgttggctaataaaaagaagaagaagaaactatcaaaataaaaattacgagaacgttacaaaagtaaaaaaattagatgcatacatgtgttaaatgttttataaagtttaatttgtgtggagtatatcatttttgaacaaataaccataaatagaaaaacaagaaaatactcaattcttaagtcaaaaatagtattaccaaagtcaaaaatagatgtacgcatgtgttcttcgagtatctcaattctttcgaaggtattatatattttatatttatgctaaaattttacagcttctatgatagagagtgacttattatactatataaacgctagaccattgagtgatgcaaatcacaaagcttctttaataacacacatacagattctttcaacagctgccactacctttcgaaatgtaagcatctcctctaatctccatcatttttcagaatgtgttacaaatgaaatataataaaaatg

SEQ ID NO: 32412 - DNA, 755 bp, Unknown
  misc_feature (1)..( 755): 2750-1469P.txt file - cDNA_ID_3055219; gDNA_ID_1590963; Annot_ID_150338
  misc_feature (30)..(30): n is a, c, g, or t
  misc_feature (45)..(46): n is a, c, g, or t
  misc_feature (52)..(52): n is a, c, g, or t
ttgatgggtcataaagttcataggaatcgnctgttttggagaagnnaataanccaaggagatgtatgtatcactcgaagagaaacacaagcttcgtgccatgttttgcagacagcagaagcacggatgttatctttcaacgggagacgagaaattaccagttgtaagagatcacaaggaaggtttatgaaagtttgatacttttctttttccttgctactctgtttcttccttttcgtcttcttcttcttcttcgacctgtaaaagtaaaacccaaagtctcaaaatctcaaagctacaaatcatatttttaagccgaatttgaaatttttgaaaactcaagatccaagctttgaccttcttctggtaaccatggtgaagaatgggagattaaggattaggttttggggtccgacgaagtcgtaacgggaaagaagcacaagatatcggagaagagtctcctggccgttagattaggacgacgacgactgatccaacggtgatctctgatcgttctcttggtctcttcgccgttgaattttcagattagtcataagcaaatcatccaaagaggaccggttcggttttatacggtcttaaagttattaaattatactattaattacgatgatctaaacggcgtcgtatcaaattcatctcatatgcttacgataacgtcccattgccaagctggttctttcactcttcaggagaaagagagagagagagagagagttatcagagatagcaaaaatg

SEQ ID NO: 32413 - DNA, 2681 bp, Unknown; identical to SEQ ID NO: 432
  misc_feature (1)..( 2681): 2750-1469P.txt file - cDNA_ID_3055223; gDNA_ID_1590964; Annot_ID_150342
  misc_feature (2)..(2): n is a, c, g, or t
  misc_feature (24)..(24): n is a, c, g, or t
  misc_feature (85)..(85): n is a, c, g, or t
  misc_feature (103)..(103): n is a, c, g, or t
  misc_feature (162)..(162): n is a, c, g, or t
  misc_feature (225)..(225): n is a, c, g, or t

SEQ ID NO: 32414 - DNA, 2669 bp, Unknown; identical to SEQ ID NO: 428
  misc_feature (1)..( 2669): 2750-1469P.txt file - cDNA_ID_3055241; gDNA_ID_1590947; Annot_ID_150303
  misc_feature (2394)..(2394): n is a, c, g, or t
  misc_feature (2410)..(2411): n is a, c, g, or t

SEQ ID NO: 32415 - DNA, 2057 bp, Unknown
  misc_feature (1)..( 2057): 2750-1469P.txt file - cDNA_ID_3055249; gDNA_ID_1590949; Annot_ID_150307
ttatggcctgttttcggtatggattaggatcctagatatttttataatcaaccctgcatgtgacatgtgaaatgtcaatgtgcttattaaatctgtagtcaatcaatacatgtcatgtcaatgtgcttattaaattattatatgccatatatcaacgtacgttcccacttgagatgattaggttttggtcaatgccttggtggtggctctatacgcgtaaatcgtatcttctacatcggttgacaaaaaaaactggtatcttctacacttttatcttttgagcttctctgttttgtcgccacctaatgtgtaatgtcttttattcaatgcaaaacccgtatcttctacatttcgttgacaaaacaaattggtatcttctacactgtgtagtgaccacaatgtatcatcaactggtattgcatcagctcagaagcgagtcatttgggcattgtatattctacggaccaatttttttcatttttagcaaacaaattttacaaactacatatcggttgtccataaagaaaacaagtacgtagaaaaataagaaaacaagtacgtatacttaacgctaataaatagcaaccgacttttgaattatttgatttaactctttaaattatttcttagaaagagttatggaagaattaaaagttttaaaaacatttgatgctaatctagtttttctttggtgactttttttcaaccaatttgagatgttttaaatggggatctgacaagtaactattgtaccaggaatacgcaccatttcctttttttgtgcttataaatacatatttatttattttatttatataataatttgaaaacttagaaattacactaatttattaattctttacttacaaacaattggttttagtttttaaaattatccaaggctgatttcacctaattaaaataactatgactagattttaatccgcggtataccgcggggacaacttattttttaaattagtatatataaaagtttgcaaattaaatctatttatttttattttatagtttacaattgttattaagtaacgtcctaccaaacccgtctcgccaaatccgtcccgtaaaaaaaaaccgcggtacaccgctaatttaaatatataattaaaataaatattttacgggattgcaattgtattttggtttgtcaaacaaatatttgtttaaaatagttgccaaaatctagttcaaattttggagaaaaaagatttattggatagataaagaatgtatttaggtgggttttgatcattttaagggattgcaattatatttttgtttgtcaaacattttttgttttaaatagttgctgaatatatttagaatatttttagtttgttaatcaatttatcgctggaaaaaaatcaataattaatagttaatggtaaccattgtaaataagtcctaactctaggatttatttcacaaaatggctgtaaaaatgtatatatagatgattcattatttcattttatgcggtaggagtaaaaacaacattaactagcaaaaactataatacacacacaacagtaactactcatcgagtatggcattcatggatacgaatcaaatctcaaatcgtaaaagcctggccattattttattttacaatatttgataatgtgctacctaaatatcaaaattttagaatattctgaaataaaatgtcgaatttttgtgatagccttaaattactacatgctcacgtatgtaaattttctattctttcatagttaattttctattaaaatgtacaatttccagtttgatggtatgaagatcaacaaagtaccataaaaatgtataatttctatttcttcctaattaatattctttaaagtgtaattttccacttcatccttgttaattttcttaaataataaaatgtaaaacttacaaatttcacggactttattaacagaaatgtaaataattgtaaataaatgtaaacatactgtgtcacaagaagacatgacaaaaaataaaaacagtagaaataaactttttttctgggtgcgtgtggtaaaacaaacatg

SEQ ID NO: 32416 - DNA, 3003 bp, Unknown; identical to SEQ ID NO: 20283
  misc_feature (1)..( 3003): 2750-1469P.txt file - cDNA_ID_3055249; gDNA_ID_1620723; Annot_ID_165860

SEQ ID NO: 32417 - DNA, 3003 bp, Unknown; identical to SEQ ID NO: 20283
  misc_feature (1)..( 3003): 2750-1469P.txt file - cDNA_ID_3055249; gDNA_ID_2926187; Annot_ID_200710

SEQ ID NO: 32418 - DNA, 3000 bp, Unknown
  misc_feature (1)..( 3000): 2750-1469P.txt file - cDNA_ID_3055265; gDNA_ID_2936586; Annot_ID_195100
ataatcttcttacttcaaacgtcgtactgtagttattttttttttttgttaaagcaaacgtcgtagttattaaaggatgttatataacttttagggcaaatagttacatgattaattacgtatcctaccacttttatttccacaatcgaaaaatggaaagaaggaggttttccttggttggtagaacaaatacaaggaacagaattattttcccaacatctctctgatcatgtacccttcaacaatctgcaataggataattaattagtcaattcaattttgtatgtacataattaaatagttagaacatttgtgtaagaacttcataaacatgggatctatataattataagtttctaatattttcgtttataattagcatgtttcgtttatattagcatgtctctacattataatgttttcaaattaaaaaaaaatagagtaaaacgatatcaaatctaatagtaataacttaccatctccttttttccgcaagctttttaggaacataaaaaagatagcaacaaagaccaatgccgctactcctcctacaacaatcgccaacgacttccccgtgtttacttttgaaccttcttctgtcaaaagaaacaattcgcaacttaagtacataatcaactgatatttgttttggttcagttttctttaataactgtacgtaccgtggtatgaatcattgggaagttcatgtgggtgatatgtataaccgacgtggcacccttctaagtatatttgtccggctatggaccaccgacactcttctgctgctgctgccgcggctgaacttatgcactcgccgcaatcgcaagcttcaacgtggccgtcgcattgagccacaacgtggaggagcttgtagctatcctcatagaatccgtgaccgtcaacaactcctgtttcggctgcagtgagtgcctccgtcctcatctcttcgaatccggggaaagtctccgcggtagctccatcgcatatcttgtggatgagaccgtgttccggggtctcaaataacttgtacttgtgatgattattaacttcttccaaaaataacaagaatcatatttattttacgtaatgaatcgtttactttaatgtgaattcaacttaatttgtttatcactatccttcaatttttctcgcgagtggaaaatttatatacctaagaaataatatattttttgataaaagtataagaaattttactataagaccaaataagtaagaaattttccaaccatttttttctgtacacgattttatgattttttgtcaacaacaaagatgaatacttacgagcgccaggggtatcaatacgttcgaatttgtatatcaaatgacatcctcgaagatgaatacgagctgacgtggcatttccacacgatctagacgaaatttcacgaagatcaccaacacatttatggcagatctcactcggataatcttctctgcattggaaccatccagagacagcgtgtttttcgttaccaactagagtcttcaagaatttagatcgagaggattctgattcgagtttgcgtaagaaagaagaaagggcttgtgcacgaagaaagagattctgattcgagtaatttggagattttgttgttgctttttggaggatgtttgcgtccaatggatcgcattgtttgaaaacaagagtgtcgtaatcaagttgagaagtgttgatgatagagggaagagacagaatgattagggctagggtttgtgtgaggagagagatcaagtggacaaccatgtttgagtcaaaactacagggaagagagatatatttttaattcattgaatatatacattggtgaatggagagggaagttgtggtagattagattttgtctacgtatgtctaccacttgtctacatatgttaaagatttagttgtgacttaggaggtcgtcaagcgcacgtgctaagcacaccaacgatttcttgatcttttcttcttgttggtatgaatatgatcctagaggttagtttaacaattttctaatgattttatgtatagtgaaacagtaatattattcacaatttgtggaactggctgatccaaaatatgttaaaaatgacattcggctactagcggaggtctgattcttagcctaacccttattcaattcttttaatactactagtgttggtttgaagtaagagaataataatgtacgtaaatgtatgtaatttgaaagtaagaaaagctttcgatgaagtcttagacagtaacaaactaacaaacatatccgctcaactaaatttacctaacaaatttccatagttttcaaccaagatttaaattaaaaatacactggaaattctaaacaaccctaaattatgttttttttttgttgtgtgagagcgaaatagtcggaattagagtaagaccaatcaaattttaaatatttatcgtaacttttatttcaagttgctttatatgatgtcttgaatctcaattgccttgccaagaaaaacaagcgctgacatatataaaaagcctaaaattacagaagaaaaatacaaagagctagaagaaaaagaaattcccctgttcttccgtaaatatcgttaattcgttatgacagagtttcattctctttgactagatctttatttttttctttacaccgatacaagtcaaaactcttaacaaacaaatatttagatcaacatagaccaaagagtcaaagaaataatgtctgtctccataaagtctccaacttttataacaaattttccgttgaatatgacagtaaataaaccaacggtctagttcttatcatgtctaaaaaccacaagctccttcctcatcttacgctcccctctttacctctccttttattctccttctcattctcctctcaacaactgatcgtataatcattctcacggagacgagtgaccaaaacaaggtctcccgcttcttgcgaagattaaacgaatccatttagattttaaaaaccacacaaaaaaaatatg

SEQ ID NO: 32419 - DNA, 791 bp, Unknown
  misc_feature (1)..( 791): 2750-1469P.txt file - cDNA_ID_3055265; gDNA_ID_1590940; Annot_ID_150291
  misc_feature (11)..(11): n is a, c, g, or t
  misc_feature (30)..(30): n is a, c, g, or t
  misc_feature (123)..(123): n is a, c, g, or t
  misc_feature (133)..(133): n is a, c, g, or t
ttgaaagtaanaaaagctttcgatgaagtnttagacagtaacaaactaacaaacatatccgctcaactaaatttacctaacaaatttccatagttttcaaccaagatttaaattaaaaatacnctggaaattntaaacaaccctaaattatgttttttttttgttgtgtgagagcgaaatagtcggaattagagtaagaccaatcaaattttaaatatttatcgtaacttttatttaaagttgctttatatgatgtcttgaatctcaattgccttgccaagaaaaacaagcgctgacatatataaaaagcctaaaattacagaagaaaaatacaaagagctagaagaaaaagaaattcccctgttcttccgtaaatatcgttaattcgttatgacagagtttcattctctttgactagatctttatttttttctttacaccgatacaagtcaaaactcttaacaaacaaatatttagatcaacatagaccaaagagtcaaagaaataatgtctgtctccataaagtctccaacttttataacaaattttccgttgaatatgacagtaaataaaccaacggtctagttcttatcatgtctaaaaaccacaagctccttcctcatcttacgctcccctctttacctctccttttattctccttctcattctcctctcaacaactgatcgtataatcattctcacggagacgagtgaccaaaacaaggtctcccgcttcttgcgaagattaaacgaatccatttagattttaaaaaccacacaaaaaaaatatg

SEQ ID NO: 32420 - DNA, 1559 bp, Unknown; identical to SEQ ID NO: 424
  misc_feature (1)..( 1559): 2750-1469P.txt file - cDNA_ID_3055286; gDNA_ID_1590931; Annot_ID_150275

SEQ ID NO: 32421 - DNA, 23 bp, Unknown
  misc_feature (1)..( 23): 2750-1469P.txt file - cDNA_ID_3055310; gDNA_ID_1590918; Annot_ID_150250
gtactgtcacatataactcaatg

SEQ ID NO: 32422 - DNA, 3000 bp, Unknown; identical to SEQ ID NO: 8757
  misc_feature (1)..( 3000): 2750-1469P.txt file - cDNA_ID_3055352; gDNA_ID_1971875; Annot_ID_176699

SEQ ID NO: 32423 - DNA, 3 bp, Unknown
  misc_feature (1)..( 3): 2750-1469P.txt file - cDNA_ID_3055407; gDNA_ID_1590866; Annot_ID_150180
cca

SEQ ID NO: 32424 - DNA, 1354 bp, Unknown; identical to SEQ ID NO: 410
  misc_feature (1)..( 1354): 2750-1469P.txt file - cDNA_ID_3055440; gDNA_ID_1590819; Annot_ID_150110

SEQ ID NO: 32425 - DNA, 3003 bp, Unknown
  misc_feature (1)..( 3003): 2750-1469P.txt file - cDNA_ID_3055475; gDNA_ID_1590789; Annot_ID_150074
tatttgttcattcgttttctgagattctatatcaaataatagtcagtcatcactagaaaatgctcaaacaactaatatgattcatacacatttcatatcatatgcttggcaatattggaccgaacttcatgatttttctgtccatgaatgcaaatgtgttgtgatctctgagttacatctcaaaatgtgaacttgacatcatattctcgttcaaaaaaggaagataagacaaaacatttaagaaacatttcacaatcatagggggcaaaagatcaaaatttaaaatttcggacgagagtggaaactatcgatctttaaggggatgatttggcaaaagtgttgtttttatttttccttttactgttttcgttttatcatctttcaacgtctttctctcccgacggccaaaaaccccaattttgccaaatccaattttacacccagaaaccctaattttccttactttgatttgattttgtgatggacgattatacaagagagatgatggatctcaagactttggtcactcgaaccctagagaagaaaggtgtcctcgctaagatccgggtaaattccctctacttctctaccatacattattcgcagagatttttgagtggaaatgagaacagagaagtgattcgtttgaaatacatacattactctttttctagggttcctgctattcagatcgaaatgctcgatattgttaattgcctatgcatctggaatcttgctgatagtttatttgtgtttgtaggctgagctccgtgcaagtgtgtttgaagcaattgaagaagaggatagagtgatagagaacaatgaaggaccgcctccagctctgttgggaagctgtaatgatcgtgcaaggaagcttcatgcttctccttcaggttttttcttcacaagtttttgcttttatccttttaaatctttcctctatgaatggtttggttctaaatggcatctcttggtttgaaaattttgttgaaatgcaggaaggttactatctgcgttgatttgtgaatacttggactgggcacaacttaatcacacgctcatagtttatcaacctgaaagcaatttggtaatcaatataatcccgttttcttttgctatgtttcattaagaagattgttgatgaatttttctcactaatctggtgaactcctgcaaaacctattcaaagccaaaagattcgtggaagtctgagttacgcgactttaatagcaacaatggttttgagctcaatagaaatggagatagtggaccactccttctcgatgttcttgaagggttcttgaagtttgaggtatttctttctttttttcccctgaagatgtttgcaggcaagtgtgaaactgaactttactatctataacttcttctcttagtttacaatctttacaaccatactctaaacaaattacaatagtccacctgtagtatgtgtgatttatgagttgtagtgttaacagttcctattatgtaagtgaagatgatcaatactttacacccaagctttacaaacaccaacttacataaaatcttggtactctgtcctcgcaaccaagagaagaagttatagatagtaaaattcagttttccaagaaaaataaagtctcttagtagagattagagttcttcagagatttgaaaaacacgtttagcaaatttcctagcctcaagttctcttcacatctaagaatcatgtttccatcctatcatagttaaaaccattatcatctgtttttgccgtatgctcctcagatgtagtgatcaacttttttttgtaatgaattttttcttcagagcatgacgcagggcatgggtagtagttcaaggagagattcagaaacagagtcgtcatcaagccttgagtccagaaatcctcctcgcagatcatctgcttctgatagcttacctcctcaacgaaggtacacatatcttcaacttcttattattatgccaaatcaaagatccttactcttcgacatgattgctttatttaccttcaaataaatgggcaggccggtttctgcatctcaagcatcgggtgagtcatcatttccctagtttcttgaagtattggttgaaatacgtatgcttcattattttttgataccaaataaatatgacaagatgttacagatagaagagtcgggttgtctacatctgggtacagaaaagatgaattcaactggagacaaggtaaccaagatacacatgaagaggtaacaagagcttcagcggcgctggaaaatctacagcttgataggaaaactcggaacttaacatcgtcttggaggtaagctttcaaggaagtctcattgaatcccacattgaaatgaaaacaaagcaagttgtggtaaatctgatccatcgggcttgcttgtgttgtaggaatgtgagggatggaacaaatgaagaagaagggagagattgatttaggctttggataaacatttcagcttctggattagtagagtaatggtttgtgtacgtgatatatgtatgtttctcctttatttgcaactgcgttttcaattagccttttttttaacgcacgaacctctgtctccttgagaacaaaaaacatgaaacagtaaaatgttttcttctgagatttgttatgggaagagaagagttcagaaagaagaatcaaagaaagcacaatgtggttgaatattttcattcacttgcttcttattttagtgtctccaaaattattatgtctctagtaataaacaaggtttttgaatgatgtgttcactgtttgttttactcgtactttttttttgttttccctttagtcttctctctctctctcgcttcttcgtttaaaactttaaacgaaagtatcgaagaagccaactctggatgacgcaaaagcttctctcagaacggcattgtagaattctccggtgaccaaataatccgattgcattagtaggggaatctgttattttgatctgatccgtcaaattggcggtaagaacaatg

SEQ ID NO: 32426 - DNA, 3000 bp, Unknown
  misc_feature (1)..( 3000): 2750-1469P.txt file - cDNA_ID_3055494; gDNA_ID_1590766; Annot_ID_150019
tagaacaaaaacatatcttacacattctctaacttgatctcctcctcttagattactcacccgtcatcataagccaataaaaagcaaaatgcataagaattaccaaaagatttgaatttgagaacaacctcggattgtggagaggacccactttgttgacgaacaaagggacatgatcgccggcattataatggttcgacgagcctgatccgattccgatccagaaggtcaatgcaagtaggacttgtagtacagtaagcagaaattgcgccatgaattggcactcttcttctgctgggttccaaaagaaacgaatcaatatgtgcaacaagaagagctccagaagcagtcatcttctaaaatcttaatctaacaacagctcaagaagaaaaaaattccatagctagagagaacacaaagtcacaagacgacgtcgtagaggcacaaagtcaaacctgaatggcttaagccgaactgaactgagtggttttgactagaccatcatcagaaaagtctccaagacggtagtcggatgttagatcgctcaagtaatttttggttttgttggtctcacgttttcagctgcccatttgatttcagtttgggcttttctttatctctaaaggcccaatttcatttaggtttagtttatttgatcattatccttactataaagccttcgcctttcgaggaatttagggtttcttctgtctgtctcgtcactcaggtttgtgcctcaacgactgcttcacttctagcttgattcttcttcttcgtttatatgtatactgtacattagattattcttgtttctcgagcttctgctatagattttgattcttttttttgttgtctttgtttcgtttccaggatcagatcttagctaaattgagacaagctcaaaatgaggtacttgacgcatctcttacattcactgtttaattagagaacaatacgtctctgaatcgtgattcagagacgtattgttcttctgtcatatgcaataagtttaattagagaacaatacgtctctgaatcgtgattgttttttggatgtgcgttattgatagctttatgatgttaatagtctaggattgacacgaagttgttctgcagttttgcataaatgctctttactaaggcctctaaatttggatgacaaatctaaatcttgcctcataaaaatttaggtgtattaagataagattattttgtatggtagtgtctataatgtgggttgttcatgttgaggttgtcaatgttgtgtatttttgtttgtttagttaatttgcttaactctgttcttgtgggttaatacagtaagcttcagagtgaggccgttcgtgaagccatcactactatcacagggaaatccgaggcaaagaaacgtaactttgtcgagactattgagctccagatcggtctgaagaactatgaccctcaaaaggacaagcgtttcagtggatctgtcaagttaccacatatcccccgtcctaaaatgaagatctgcatgctcggagatgcccagcatgttgaagaggtgatatatcttttcatggaaattgatcattttgtgctctgtttcttgtataatggttttgtgctcatttcatttggtggctctattagtttcatttgatgttgtatatgtcttctgaatgtagatgcatgatgttttcggaatttggtcattgtttatttaggcttcatttcttgtatcttttcgtaggctgagaagatggggttggaaaacatggatgttgagtctctaaaaaagcttaacaagaacaagaaactcgtcaagaagcttgcaaagaaataccatgctttcttggcctctgagtctgtcattaagcagattcctcgtcttcttggtcctggtcttaacaaggcaggcaagttctggctacagctaatactccattgttcttctttacatccgttttgattttggataggttttagtagtctatttcttttgtcaatgtctttttgatacaatgccaatcctttatcctgtgagattatgcttctttgatgattcttaagtaacattcctttgctttactttacacaggaaaattcccaactcttgtgagccaccaggaatccttggagtcaaaggtgaatgaaacaaaggcaacagtgaagttccagctgaagaaggttctgtgcatgggagttgcagttggtaacctttcaatggaagagaagcagatctttcagaatgtgcagatgagcgtcaacttcctcgtctcgctattgaagaagaactggcaaaatgtcaggtgtttgtacctcaagagcacaatgggaccaccacaaagaatcttctgagctttcacctacttaaaattggtggctataagacacttcttcttaccctttcgtttttgtttcagacatatctgttaaacagtgtaagagttgtgctgctactctcctctttagcttttggtttggataatttgaaataactgcagtgattttggttaatggattttgtagcttatattatctttgaattagatgtgcttatttcaaagacgaatcaatccacagatgtgaataaaaacagaaattttcgttttcaatttgaaaattgtcctcgtggactgttccataaccaaattctattgactatgcagtaattgatctttgaattaaaaggatcaacccactgattatactctaattgaataaatattcttctttaatgttgtttataatctcttaagcaagctctaatgatgtatttttgaagcaaactctaatgcttttatggtcagtatatttattctcttaagttttataactaaattaccatttttttttgccaaagcagacaacaaaatagcgaagtgcgttccaaaagttagcgttttcgtctccgtccccaaatctctcagctaccttaaatcagaattctagggttcttccgattagggtaaaatcgaatccagatttcccaaaattctgatctttgatttataaaagatg

SEQ ID NO: 32427 - DNA, 3003 bp, Unknown
  misc_feature (1)..( 3003): 2750-1469P.txt file - cDNA_ID_3055551; gDNA_ID_2926084; Annot_ID_196421
taataaggaattttcattattagaaaaagaacacaaaaaggatgtaacatgctcttccatatcgtctgaaataagcaatgaagatagaaaaaaatggtagttatttactctcattgtttcttcgaattcaaacacaacggaagacatttgattataatataagtatctctccaaaaatgtatagaaaaaaaacttaaaaacaaaatgaaatattacatttcaagcgacggacacaaagcttacattacacataactagatagatattcttcttcatcttataaagtataaacggaaacaaaataagaaaatgtaatattaccatgaaccgtgttcctcctccataaatcgaaccgtgatcggttaatactaccctgaaccagactataccaaccggttcaggtcaagcaccaggggccgcatctttagccctgccatggaagtaaccaccgtattctctagcgtaatctttgacgtgagatgccgtgtcatagatcctactacgtgcataatccatctgattcgatccaaccgggtgcattccccggaaatagcggtacgtccacgacactaaagccaccgttccgacaagaaatccggagaccgttaagaacccgccaacgacgacaaaaacgggaatccatatcggactcgagatgatgatcaatggaagaaagacaatgaagccgagcacggcagcggtgacgcttacaccaaggaggaagaggaggatgccagtggagataaagagagcgaggaaaccaaagagctgcgaggatgttggtgaatgggatcggagctgatggaaaaacgacgagatggggctgttgctaacggtggtggtggcggtgctaccataattgggccaatattgggcctcgccgctagagaacctttccgccattgtagagagcgattgttgttttgtgtgtgtgtgtgacagagaacagaatgaggaagggtaaaacaaatggaggacagattcagctttgaggtggcattcatgcaatgtttgtaaacacgtggagattggtcttggttttcactttgtctaaaatcgagattttggtttagattcggtttagtctaaatcgtattgattgggtttggtttgggtttatttgccgaaaaccatggaaaagggccaatgccaattgaagaacactaaaccaaaccttcaagttacaagaagagacaacagaagcgaaactagaaatactacaatagcaaattgtgtacctttatgacaacaattttttgtatgttaaaaatcagtagtagccaacgcctctaagctcagcagaactcggttgctgcatatcaccggcttttcccaaaaacacaactcggcctgtaaggagagaaaacagagatcaatatttaattgtttcccaatgaaatatgtaagaaatggagttttaggggttgagccattagtaccgtttctacgaattgctacttctcttatacgtcgaaccaaaccagtgacaggatcagtgaatatcttcgtctccagattaccctctaagtagataacagtactgttgaatgaacacgaaacaagttgttatgacacatacacaaaagcaagctaccattttgaatctagcaagcaagattcacctaaagtttcatcctttttcaccgattcttgatcgatatcagacatgatacatacatttgttccttattctatcatcacataaccttacaagctaaatatgatctcagaagagaactaacccgggttcaacattcttcaacacaagatctgccaagcgttcagggtaaacagagacacggtgccactgcaccgcagaccggctcgcatactctctcggatcttcgttaataagcggtctccggttgttcctgatcccaccagttcctacagagaagagagtgacagttctaccactcttaagcttcttctgcagaggaagctgacccacttgccccaccaatattgcctgtattaaaccagaaattagtctagaacacactaattattaacctatccagaacgagaatctaatgatgttcacaaaatgactcaacaaagatcatacaaaaggcaaaattgcaacgatcgatttaagaaaaacaacaaaaacagagtatgtatcaattggaattagaatctaagtttgataccttgaaaatgccagagtcaaggccattttcgagtggacgctcttccataacgcgttcttctccggaaaatcgagaaactggatctgaggcctttggttcaatgggcgattctaactcgtcaaagtcggagtcttctggggaagtgatgttgttggtacagaaagacatggaagcttgagaaattctagggttcgatagaagagatcgatagagtcttctagaaagtgtagccattgaattcgccattttcgatcttcactgagattttcgaatcgaatcgtcaaatgttggattctgggtttaacgtcataaaccctaaagggctaaagagcggagaaagtgattagaatattttggaataaagtgcctcaattatttcaaatctaatactttttaccaaaactctcttaaatgacaatttcaacccacatgctgaaatggtcaataagaagaagaaatttgcttttgtcgtcaccaaaaatacaactcatagtcctatgtatccgttaataagcatttaacaattcttttggaatacacatcgtctacataaattttgtaattcaaaataacaagcaaaaatatcccacaattctgatattcctttacaacttcaagtcatgttgttttcgacaaaatatctttttgattcaagaaattaaaataccaagtcaaagagatatccattaatatccctcaagaagtggtcaactctaacaaatctccaagtctcactctttttaaactcaaaacctcacaagtcacaagtcattacgaacactaaaaaaaaaacaatctctgtaactttggttagagcttccttcatatcaatccaaaaaaacaacaaatg

SEQ ID NO: 32428 - DNA, 2750 bp, Unknown; identical to SEQ ID NO: 400
  misc_feature (1)..( 2750): 2750-1469P.txt file - cDNA_ID_3055551; gDNA_ID_1590760; Annot_ID_150005
  misc_feature (1)..(1): n is a, c, g, or t
  misc_feature (2088)..(2088): n is a, c, g, or t
  misc_feature (2522)..(2522): n is a, c, g, or t
  misc_feature (2534)..(2534): n is a, c, g, or t
  misc_feature (2702)..(2702): n is a, c, g, or t

SEQ ID NO: 32429 - DNA, 3003 bp, Unknown; identical to SEQ ID NO: 28981
  misc_feature (1)..( 3003): 2750-1469P.txt file - cDNA_ID_3055700; gDNA_ID_1971712; Annot_ID_175116

SEQ ID NO: 32430 - DNA, 3003 bp, Unknown; identical to SEQ ID NO: 28981
  misc_feature (1)..( 3003): 2750-1469P.txt file - cDNA_ID_3055700; gDNA_ID_2926199; Annot_ID_201707

SEQ ID NO: 32431 - DNA, 3 bp, Unknown
  misc_feature (1)..( 3): 2750-1469P.txt file - cDNA_ID_3055727; gDNA_ID_1590989; Annot_ID_150367
tct

SEQ ID NO: 32432 - DNA, 1224 bp, Unknown; identical to SEQ ID NO: 437
  misc_feature (1)..( 1224): 2750-1469P.txt file - cDNA_ID_3055730; gDNA_ID_1590990; Annot_ID_150370
  misc_feature (177)..(177): n is a, c, g, or t
  misc_feature (1050)..(1050): n is a, c, g, or t

SEQ ID NO: 32433 - DNA, 1636 bp, Unknown; identical to SEQ ID NO: 436
  misc_feature (1)..( 1636): 2750-1469P.txt file - cDNA_ID_3055734; gDNA_ID_1590990; Annot_ID_150369
  misc_feature (1076)..(1076): n is a, c, g, or t

SEQ ID NO: 32434 - DNA, 2504 bp, Unknown; identical to SEQ ID NO: 438
  misc_feature (1)..( 2504): 2750-1469P.txt file - cDNA_ID_3055738; gDNA_ID_1590991; Annot_ID_150372
  misc_feature (18)..(18): n is a, c, g, or t
  misc_feature (61)..(61): n is a, c, g, or t
  misc_feature (65)..(65): n is a, c, g, or t
  misc_feature (109)..(109): n is a, c, g, or t
  misc_feature (121)..(121): n is a, c, g, or t

SEQ ID NO: 32435 - DNA, 2559 bp, Unknown; identical to SEQ ID NO: 440
  misc_feature (1)..( 2559): 2750-1469P.txt file - cDNA_ID_3055757; gDNA_ID_1590998; Annot_ID_150384
  misc_feature (62)..(62): n is a, c, g, or t
  misc_feature (66)..(66): n is a, c, g, or t
  misc_feature (205)..(205): n is a, c, g, or t
  misc_feature (371)..(371): n is a, c, g, or t

SEQ ID NO: 32436 - DNA, 449 bp, Unknown; identical to SEQ ID NO: 446
  misc_feature (1)..( 449): 2750-1469P.txt file - cDNA_ID_3055825; gDNA_ID_1591051; Annot_ID_150449

SEQ ID NO: 32437 - DNA, 3003 bp, Unknown
  misc_feature (1)..( 3003): 2750-1469P.txt file - cDNA_ID_3055835; gDNA_ID_2214613; Annot_ID_187440
aattcccattcaatgatacactttaatttagaggatttaaatgttgtttttataatgggatttgaatggatgctaattgatattggaacacatgtttactatgcaatcagatttcaaatgttagatgattaataaaaatgaaacaggataaaatatattttttaattgtttatgtgaaattttcttctagtgatgtatcatcatttgtttatgtgaaatttgatattccatatgttttagtatatccataagaaactcatatctaaaactgatgtatcattatccattaatattaatttgttgtacaagtgaatgatagttaatatcgcttatatacgtgatttcttgccgcatgtacgtgagatcacacttcatgtgcatccaaaaatttgcattttatttctagaaattaagcgacaaggaagacagagctagagagtactgtctttactctttagacgtgcatatgtctcctcgtactaattactcttttaaaatccttgcatttcattattttctgcgacaacatatttggtcggaacttgccaaatgatgtagctattgtccacgtgatgttttagtttgctataatatgttttaagtggatccttactcaacattaacaccaccctataataataaaaaaaatttaaccattcattattcaagtttgataaccaatatatatccgttgctcaaaaaaaaaaaaaaaaagataaccaatatatatcttattgctgtatttatctttatatagttttattttaatagtttttgaaaactgaaaccataacaagaaagcgtgaatccaaacgcattcctatgaattgtaaattgacaagtagcattttagaatagatggaatctaatctctaaatcgtaaccgaataaatggattggatccgttgcacagatggtttacaaagataatcatattataactaatccgaatttcaatcttgttttgatctatcttttaatagcaaagtccatgagtttagtgtttttgagattcctggaccaaagggtcatttttcgcatattaaaatgaatgagataattacgacaaaaaaatgaatgagataatttgggaaaattaaatatatacaaaaccattattatatgaatgtactaaattatttttaaatttttatatttcacctatacctaatacagaatacagtgtcattgctttgactccctccaccaacaagtgaaaaacctaataaaattttactaatagaaaacgaatagtggaagaaaccatgtaatgtccaatcaaccagtaaatcggtttaaaatatataaaaagtcagtattcttaagtagaaagataataaatttgtgcaatagtaatcaagatagtagatacgccgttggaatcaaatcttcttttcttgaatgtgttgttaacttaagccaaccatttgattctctttactgcagctatattaattattaaacaccaatgcaataaccatacatttcttcgttttatttagtctgtatattcgatcatgacatcattctcccacacttccaaaaaaaaaaaaacaattcgatgacgatatctatattagttgagacatgcatatctacaatacgaatattcgttattctcatttactgatgtggcgattatgatttatgactaaacgagtgattaactatatacaaaaagtaacaattaaaacaaaagtaatagaaaaatattgtgaaatgaaaattccagtgtatcactaatgaagcaattaagaatagaaaactaatactataatgtttatattcccatccgtgcgtttccattcactttaagaaatgatcatattcgcaaccaacaatttgaagcaaacggtcctctactttttattgttcgttttctctttaccgaattttaaaatcacgttaattatctgtataactacctttttgcgttgaagtatttacaacttgagtaaaatgtagattcgtatcaggatacaaacacacaataatactattcagagttcttagtaaattagtttccttttgcagcgatttatttccgtcaagtgtataatatagttaaccaacataacttaagttaaaatttcccaagtatagatataacagaagatcaaatatcgactcgaaactgagttataattaaattaacacgtgaaaataaatagaaaaacaagaaaatatctcgcacgctttccaaagccctagaacaataacgttcgatggattggaaaaatctctgctggtacattcacgagccaacacgtttgcctgccacgttccagacacaagctagaaagtaacggcatcgtcaaatctaacgagactcatcaaggaacaatttataaacatcaatttctttttggtttcacacgccttattatggtaagaaactatttttgcctattgaatgaaaaaaattgataagacatatgaaggatgagacctaactatagtcttaagtacataacatttactactactcaaaaccgttgtctttaattttaacggtccacattcgttctcacaataattgaccatacgtttgtttaaatacttcaaaggaaaggaaaaacagcaagacgtttgtgaggtaatggacaaacgacacgtagtttgaaagatgagaaggaagacaaaaaggcatagagaggaggaagagaaggagcggtttcgtaactgaaactgaaaaagctttaagagaaaacccggaaaaaaaaaaagagaaatattttaatcaattcttctttatcacaaagagtgcctttgtattaatgaattttgatgttgtgtaatgaatacagacataaccgtcgtgtctcgtcgttaaagaaacgagagtttttcagctctttacttaccttttcttcttacccttctttcatgactcttcttctttgatgggttaataatgctttgagcttgatgatttcgattttagtttcctgttagtgtttgttttcttctgtaaagcttggattttttttggtttcttcgatg

SEQ ID NO: 32438 - DNA, 974 bp, Unknown; identical to SEQ ID NO: 449
  misc_feature (1)..( 974): 2750-1469P.txt file - cDNA_ID_3055849; gDNA_ID_1591056; Annot_ID_150460
  misc_feature (13)..(13): n is a, c, g, or t
  misc_feature (25)..(25): n is a, c, g, or t

SEQ ID NO: 32439 - DNA, 3000 bp, Unknown; identical to SEQ ID NO: 10930
  misc_feature (1)..( 3000): 2750-1469P.txt file - cDNA_ID_3055875; gDNA_ID_2214466; Annot_ID_133020

SEQ ID NO: 32440 - DNA, 3000 bp, Unknown; identical to SEQ ID NO: 10930
  misc_feature (1)..( 3000): 2750-1469P.txt file - cDNA_ID_3055875; gDNA_ID_2214466; Annot_ID_182836

SEQ ID NO: 32441 - DNA, 947 bp, Unknown; identical to SEQ ID NO: 455
  misc_feature (1)..( 947): 2750-1469P.txt file - cDNA_ID_3055919; gDNA_ID_1591099; Annot_ID_150517

SEQ ID NO: 32442 - DNA, 1863 bp, Unknown
  misc_feature (1)..( 1863): 2750-1469P.txt file - cDNA_ID_3055955; gDNA_ID_1591112; Annot_ID_150539
tacaaagccaggaacagttttggttttgatcatacacaacgagaaacaagacttgtaagaattttccattgtacttaagaggctattactgtgtatcaagagctagatcacgccaagtttcagcatctgcttgctgagtttcctgatctgaaacaatcacaatgtgagggattatattagtcaagctgcttatatgaagattcataggtatcttggaagtgaaagttgttaaatctcagaaaccctctgaaacaaagctcaaatttgagctttactatgtttgaaacatacacaaaaagtgacgtatgtgtctccattactttccttatgacatttcaaggtctcaatatgggtgtttaacatcttggatcagaaatgcatcaccagtgtggattcacagctagcagttttaagaaaagactatattccaaagaatttagaccttaagaatcataaagctatgtaaactgtaaagcaaagcaaagaaaaaaacaaagagccatactggtttcttcagtatcatcagttttaacagcaagcactggaggcaatggaagatctgcaacaataatctcttatgaaatagaaaataggagaaacacaatgatcttgaggtataatgtaggaggaaaaagggttaccatcatcaggcaaagtgtccctcatccactcttcgtccacaatgtctataagcataccaagacttacttccgccatattcgaaaaactggagcttggaaatcccacaaattactgatgaaatcatccaataagtaaacatatatacaaatatcagacaaatggtgaagaaatttggattgttgaagtaaaaagtcaatttctttacaataggaaaacattgaacagaattgggacttctgatatccaaaattttgaattttgagaaagtgacagtatataacagacagaataaagctcaataacctatatatgaatatctaaaacaatctacaggtagtttcgccggagattatgaaaaagagagtagggattcattgagaaattacgtcgagcagttggtgaactatctagtaaagagaccaaatacgaaatcgtaccacaactcaaagccgactctttataaacagatatgattctctaaggaaaaaaacctaatttgaatcgaattagcaagagattcacctggtagaaacaatgcagccgtactccacacagagaactaaaaacctctagcttataaaaaaagctgattttttttctctttggttataaatatacagtaaccttctggtttacctagagtattcaaaaggctgatgaaatttaagttagggtatctctttatacggttcagagcttaagccggccactacagcgaccgacttctctcgccgtcgattaccggatcgtctccgttattgcgtgcttcatttaggtgctttcttcttcttcttctccagtttcagattttcctgttcttgcatttcacctttgagaaattgtgatataaaagttgtttactttacttcaatccagtaaagtaatttggtgattatcgtttcctctaccgcgatcactgtgtaattgatgatgagggttttatacgttcagtacaaatttgagagcttttatgttgacttcaatttgtaaccagtgtatcaattctgggattttaattttcatcattgcattatatattaggtgtatcaagtaagcaatgagttcttcaccgtcgttggagattttaggtacatatctctgaaactcaatttcattcttcgagttatgtttaaatgtctctctcttatctaaagtcgcttttctgtgtagttagagaagctgaaggcttcactgtgtggaatggtcctccatttactaatg

SEQ ID NO: 32443 - DNA, 46 bp, Unknown
  misc_feature (1)..( 46): 2750-1469P.txt file - cDNA_ID_3055963; gDNA_ID_1591114; Annot_ID_150544
agtccttctctgttcttgattctctagttaacattttcaacgaatg

SEQ ID NO: 32444 - DNA, 3 bp, Unknown
  misc_feature (1)..( 3): 2750-1469P.txt file - cDNA_ID_3055983; gDNA_ID_1591125; Annot_ID_150559
ctt

SEQ ID NO: 32445 - DNA, 257 bp, Unknown
  misc_feature (1)..( 257): 2750-1469P.txt file - cDNA_ID_3056008; gDNA_ID_1591159; Annot_ID_150604
gtttttgattgatgggttttcttgatttagcaatttttaagatttacttgaaagattccgtaattttgttctgattcggattctttgatctgtgctcactagctctaccaaagcagcttcctttctgaatccctagtgttcaattatgtgaacagattgtttactttagcttctcttccttttcattctagttttgcagagattttaggaggaacatgattgtttgaattgggagagacattggttcttgtaaaatg

SEQ ID NO: 32446 - DNA, 3003 bp, Unknown
  misc_feature (1)..( 3003): 2750-1469P.txt file - cDNA_ID_3056047; gDNA_ID_1971833; Annot_ID_176343
tcatttaaagattcgaactttataagggttcttgcagaagcaaacctggtgtttaaacccatcaaattggttgtttttgagagaatgtgctggagagtcatgaccagaggaagtgacccatttctcagcatcaatccatttagaagggaagtttcttcttctaccagagacattgctactgaaactgaagactcctctacctggagtacaaggagactccattaacatcaatcttctttgtccattgcttcttccttctccaatgctcttttgtgatgagaaacttggtcttctctcgtttaccatctcattgctgctactactgctttggtttgatgaaattggaagtgacttgatgaaatctgtagtttcctttagattgattctgcttgtaagtgagtcttctgcaaatgggttggcgctaacatttgagtttttctcctgtaaacaaacaaacaaagagagactcaattagaacaatgaaaagaagatactttctgagttatgtaatcaaaagacattgtgttcttttaccatattagggggaaacagaagctgagtttggggatggagcttggtgttgctgtttcttgtgaagtccatggagttttcttttgttttgtttctaccactgttggattattttggtttagttgttgtctgcatctaatgttgttgttatattggttttagaagagtgatgaaagagaagttgtaggaaaatggcatttgctttttagatgtctatagaaggaaaaaggcttgaccagtttttcagagtagaccattataaagggtactagttttatgaaatagcagtacacatttagattttcattattctttatttttttgttctatcattttcaacttgttgttttatactactctttagattctgatatgcatcactataaaatgacaaaattgtggataataaacaatgtttaaaaagaagaagatggtagaatggctaaacaaacaaacaaaaataacaaattctaaaacaacataaatttttctgatagtttactttaaacttaaacacatgtttgactctaagaaaaataaatgtatattgtaatcactttaatcgtgttctcatttcatatatacagaattatggacttatattgataaatgataatactagtagcaatataagtcctatttttttttataaaaatagatgtcgtgttttaaaaacaagaacttaaacttgttgagttaaaccatggttggcttaataaattgaaggatatatatcaaactgaactaaatagatttggatagtaatttagtaagcagaaagaattggaataggtaagccttttaacaaaaaagagaagaaagaattggaataggtgaagaagataacagtagagtaattagagtagtagtatatagagtggtcatggacgcttcactcttgggagaagtacgaatgcatcaaaagatgtggcccctgtctctatattcgtaaaatgattatcatcacaatatcatataaaggcccatgggttaataaagactataaagggcccgtagagtgatctcagaaacagcttttcttattatttgagaagtttttttttgttgtctgctaaacttgtaaataacattgaaaatgaagtggaagtattacaaaagcattacttaaactagagtaaccttggccaaaaagaaaataaaaaacaaggttacaatacttagaattgatgatagaaatttatctgatccaaagtaacattagagatctctaacgcttccgaaagcgccttcccgtaatggtgttgcgaatctcgatcaattatttgagaatatccacaccaaaatccatatatttatttcataaataaaaatgtagattgttttggtattcaagaccagatctgatttctccaaaaactttaaaacttcgggttcaactggttgagctattccatctcaggtaacaccgtaaaaaaacaagatatttttttgcacatgtttcaatcatattaaaaaaaaatgcaagatcttttttagttaaaattttgtatgtgaacaaatgaatattaattgctaagtttagttgacaaaaaagcgttgacgaaagaaaaatgctaagtttctgtgaatgaaaatgaaaaaataaaaatatctaaatttatttgcaaagatagattttagagagaaaaatctacaccacaattttcaaaatatgattaaacaacaacttataacatctaatattatgaattataacgtatggacctgatcctgaaatgatatggacgtaacttgaatctgtttctagctttagctagtttgtctgctactcgattattacacccatcaagtttgacatatttctgtcttttcttcaacataaatcacaagctgttgctagccaccttcaatgatgatcaaacggattccctgacatcaaagacattggtaatgcgtgaaggaaactgaaatctttagcttcaataggatttacgctctttgatatgtccaatagatgaacttcttgcaaacatgaagacatctaagtcgtctcgagctatccaacccaaacccattggagcattatttgcttctttaaaactgcaatcgtggttgcattttctccatccgttagatgggtggtgccaagttcaagttgtatttgcctgattcgttgtaagggaatgttatagatcgttttggtacttatctcctgggatattcacattcgtccactcttttacaccgtctcgtacctttctcacatccgctaggagatttttatatatcctgaaaaattcaagtaattttcttaatttccaaagtatctccaaataggccaaaatgtgaaagcaacgactcaacattgtcttctaggttgcaacaagtatagtttaattaattgatgatatagcgggacgttggaaatccttcaagcagccaaaatatgtgaccaattgaagaggacgtgatgaattgtctccctaacttggcaccatcgttagcaacatg

SEQ ID NO: 32447 - DNA, 22 bp, Unknown
  misc_feature (1)..( 22): 2750-1469P.txt file - cDNA_ID_3056128; gDNA_ID_1591256; Annot_ID_150728
agccaagttgttttcaagaatg

SEQ ID NO: 32448 - DNA, 2648 bp, Unknown
  misc_feature (1)..( 2648): 2750-1469P.txt file - cDNA_ID_3056131; gDNA_ID_1591256; Annot_ID_150727
agccaagttgttttcaagaatggttgatccggaaaggcataggaaagtggttaacatagatgatccaaacgcagcattctttgtccagcaagggaatcmwaatgttcctgttgtgacatttgccatggaaaacaccaaagssgatgttcacccgttaaagtttgagctttccttgtttgagacacaggttttggttaatacccctcaaggtatactggagatctcttcgggtttgttaggacggcataacatttataatattcttgctgctgtggctgttgggattgctgttggagctcctcttgaggatattgttagaggtgttgaggaagtcgatgcagtcccaggaaggtgtgagttgattgatgaggaacaagcttttggtgttattgtggatcatgcaaacacacctgatggcttgtcaaggctgctagattcaattcgagagcttaaaccgagaagaatcattaccggtatagatattttcttccatctaatagatactctttgcctgttcggccgttcctatggtctttatatgtgtggtcatctgattattttagttgttttatttatttattgaagttattggttgtgagggtgagaatgaaagagggaaaagacctcttatgacgaaaattgctactgaaaagagcgatgtgacgatgttgacatctgataatccgaggaatgaagatccatgtaagtaactctaagaattagattgagtctatctcccttgagtgtttctggaggtatattaacagttaattttccaatgtggttttagtggacatcttggatgacatgttgtctgggattggatggacgatgcaagagtatttgaaacatggcgaacacgattactatccgcctttggcaaatggtcatagactcttccttcacgatattagacgtgtagctgtacgttgtgctgttgctatgggtgaagaaggtgatatggttgtaagtattcaaataaacccacactctatacagtactttactgagtgtgttatcaaagttgctggatttacctttatgagcaatcaaagtaatatagttctcgggtaaatagctttgcttgacactgatttttgcaggttgtagctgggaaagggcatgaagcgtatcagcttgaaggtgaaaagaaagagttttatgatgacagagaggaatgtcgggaagcattacaatacgttgatgagcttcaccaagctggaatagacacaagcgagttcccatggcggtaagtagaaccgtaacagctaaaacaaccaacgataaccaaagtttctaatctgtgaagagttgctgaaacttgtcaagatgcttcacgatcactaatctgttcttccttgtattactgtgcttctgcaggttaccagagagtcattaatatctctgtggtgaaatcattagaagagaagttagcttagtccatgaaaccagattttcttccaccatggtccaattctcttgcgaagatcgatttgcacagaggtaatgaattctacacaagtgacataaaaatcatgctcaaggaaaagagattacaccactgggaggtacttaacgttccaatcaccattaccttaaagtttttccattgctcacttcacctgtttttttggacaagaggaaacccaagctatcgaaatgtaatattagactaaacttaattcagattttctgtcattgttaccgcaggaggaagattttaaaggtggaagaagatgcgtacaaattttgtaagggttaaaaacccaaaaatgtaagtggttctgttttgggtatgttttgatagcatgtgtttaatttagatgaaccaattcaaaccgaaccaacaaaaatagattccggtttaaattatttattttcttacatgtatccaaacttgaaaaaagtgaattcaaagaaaaaagaaaacgatgaaaatacggtttcaatttcttaatatgaaaaattgagaaagtaggaagacatgattgaacaataataagattaggccttgtgatatattgtgacaagaacataaattacgaatgtttggcaatggtgctagggaatatagtcttttgaaactattaagcatactttgaattttatattctggttataaattaaaagatttcccaatatccattcgtatttttgggaccactccaccaaaaccaatctaatcaaaatataaaaccaaataaataataatttgcttagagatagaaaacatgttatgtccgaggaaattgtcctaaatgtcgcaacaaacgtcaattcattaatcgttttgtttaatacaaatttcgacaagattgtgatagatccagaaccagtttagctaaaccggttgaatcagaagaaacgccaaaaaccggtccaatagctcaacctaacgccgtcgttttcaaagttccttcactctacttccttctcgcttacgtcactttccacagatccaacaatgatatcagataaaattaaaatattcccaatatattttctaagaatatctccctatttgtttttatttatttaaactattttaatctcttccgtgtttcactcttctctctctctctctcgcttctcttcattgtttctgtgtgattacagcgaagaagagagaatccttggagcattccatg

SEQ ID NO: 32449 - DNA, 2741 bp, Unknown
  misc_feature (1)..( 2741): 2750-1469P.txt file - cDNA_ID_3056141; gDNA_ID_1591259; Annot_ID_150737
aaaaaagtttggcgaaaaaaggtgataggtatcaataactagttgagatgggatagagataaattttaaaaaatggaccgacctattacaaacaatttaataaaagtaacacaagagtacagagactaaaacagtagctatggttttcttttggcgtctctgtaataaattggtttctggggatcttcgtcctatctcccatgccattcactatcaatacatttattgatgccttcattatcatctttcttttgtttttttgccgattcactttattttttttaactcgtaccatattctatagcattgatcctcttgtagtcgtaggtcgacttttgtttttatttgatagtaacacttatgtccttggtgatatgtatttttcagaaatgctttttcgatttatttaaatgtgtacccttttgtcgaccaaaaaaacaaatgtgtaccctatctttagtgtttactttgtagtttgtacaaaaatacgtttttctgttcgagcaagtttacttttgacaaagaaatgttattattataataataataatatattgaaatatcaaaattttgtgtgtaaatttattaaattatttgaaaatttcaaaaattttcaaaacaatacgagtatctttgcttaaatatatctaaaaatacacaaaataactaaaatatccaaaaaaatcctaatattttctatatataagtataaatataactaatatatacttatatttgagatatgttcgaattttttgggttttaaagtttagaaccgttcgggtattttaaaagtttgggttcgagtttggatcggatttttcggatcgggtttttcggatcgggttcgggtattatgcactggcctagataaaagaaagaaaccattcatcacctataacatttttactgcatccaccgttattatcagtatacgaacattacctcagtttcagcattatagcttagcaataaatagctgaagaaatgtagttggtattattgttatagcttagctagtggtggcaacatgtttattttctattcaccaggtgatgatggcttatcggatcaagtcttgattcgaacattaaatgatttacatggatcgatatataaacaagttaaaattggctcacatccatagatcgatcccataatctatgcgtttatacattcactgcactgtattaatttaacccaatcatatttgctcatctactacattaaattctgtcaaagtttcaatagtgtgttacacaataacggtcaaacaacaaatgattctccaataacaactatttagacagtcaaaaattttagcgtgagactagacggatcgatagggcataatagcatatatgtatagcccatagattaataaatagacattactacaaaaaatttggtgctaaacaagttttttcttaatggacccttttattagattaccttaaataaaccgatgttaaaaatcttgttttacaaaagtaataaaatgcggttggatatcaacatttcgtgctaaataatccgkttttaacattttaacttcaaaaaattaaaaataaataaaaaaatcaaacacatccttatcttcatgaatcgcctctaaatacgtagcaaagattggtcactttgttgaaaaagacaccacttttatcaagtctgaggagtctgtaaaagaacgttatttcttgtttgtcttcatacatcttattgttcatacgagtgaacgaatgcttccacttatgtaaatagacatgtgagacttcttcgtaggttggcatcacctatagttggatattttcttgttggtaagtttttagatagccaaaatactattaaacattcataagcaagtgaaaatatttatttgaacgatttaactaaaatgttgttatgtatttatacaaacatatatatttttttatacatatacatgttgttattttactaaataacgtttttgtccaaagttttttttactgaataacgtgtaatcaaataaaataataaaagaacaagggatctcttcttaataaaatattttgatttcatataaaagtaggtgatatctataaaataaatttacaaaatgttttagtttgtgaatgaacttcagagtaaaattgtaaagttaaaagttaattttacaaatttaaataattagtttagttatttagcagatacatatagtcagtctgctatcatagcatttaggttgaagcctttaagtttatcttgttcaattttttatataatatatatatttttttaatctaggtggtaaacaagctttatcacttaaaaggttaaaatgagtgggacaataatagatgtagctcataagttctatgttgaaaaagattaataccaaaaatcaatcatttacttataatcaaccatggagtagaaaagcaattacacaaatagagtaacttctaaaatatttacagctttttaggtagtgcaattactattagtactatttcttaattctctcaataaaataaaataataaaaaatcatatagataatcccaatatccccaatcttccactataattgaacaaaaaagactcctttttaaattcaacctctcccaccttctctctgcaactctctcattttcttaaaatctctttctcacagaaccaaaaaccaaaatctcagtctctaacaaacaacaacaacacacgagtcacgaggttgaagaagaagaagaagaagcaaatatg

SEQ ID NO: 32450 - DNA, 446 bp, Unknown; identical to SEQ ID NO: 469
  misc_feature (1)..( 446): 2750-1469P.txt file - cDNA_ID_3056202; gDNA_ID_1591291; Annot_ID_150790

SEQ ID NO: 32451 - DNA, 144 bp, Unknown; identical to SEQ ID NO: 478
  misc_feature (1)..( 144): 2750-1469P.txt file - cDNA_ID_3056264; gDNA_ID_1591352; Annot_ID_150864

SEQ ID NO: 32452 - DNA, 77 bp, Unknown; identical to SEQ ID NO: 485
  misc_feature (1)..( 77): 2750-1469P.txt file - cDNA_ID_3056319; gDNA_ID_1591391; Annot_ID_150918

SEQ ID NO: 32453 - DNA, 131 bp, Unknown; identical to SEQ ID NO: 486
  misc_feature (1)..( 131): 2750-1469P.txt file - cDNA_ID_3056323; gDNA_ID_1591392; Annot_ID_150919

SEQ ID NO: 32454 - DNA, 241 bp, Unknown; identical to SEQ ID NO: 487
  misc_feature (1)..( 241): 2750-1469P.txt file - cDNA_ID_3056342; gDNA_ID_1591402; Annot_ID_150935

SEQ ID NO: 32455 - DNA, 2813 bp, Unknown
  misc_feature (1)..( 2813): 2750-1469P.txt file - cDNA_ID_3056354; gDNA_ID_1591406; Annot_ID_150944
  misc_feature (9)..(9): n is a, c, g, or t
  misc_feature (31)..(31): n is a, c, g, or t
  misc_feature (71)..(71): n is a, c, g, or t
  misc_feature (100)..(100): n is a, c, g, or t
ctataactnttagaataccacaacgaatacnatcttcaaatactcactgatcatcaaaagggccaaaaagnagtttattgatagtttacacatttgttanaaccacgagaaaaggttacaactcaatcaccgcatggggaaaaattacgtagttggaacatggcatcgaaaaaaagaaaacctatgaagcatggcttgagtctgaaaaagttttatttgcttccaagagggatatggggagtgctgatcttattagattgagtttgtgattctctcaaacccaaatctttatcttcttcttctcctcgtcggctaactaaattctttctttcttcttctcttctgcgatcatccgacctattagtctctggtggcacaacttgtcggaaaaacctaagcatcatctcataggttgtaaatgtaataactgctgatggagttgtcctcagtagattagtggcacatccacggtacaacccaggaatcccttcgcttctgaacacctttgtgatgcaatcaatgactcctgaatacttagtctcagcatttctaatctgcccttgttcttgaagcttcgccctaattacctgtggatgtaacataaaacagtttatagttagttatgagcttaagagtgaggtaaagagagcacaaaagagaagaagaagagagacctcgtgtgggtaagtcaaaatagaggcgatcactttcgcgatggaggaggcaatagcaacattcccaggactcagattctccacggatgtattatctgagaacttttatagctctgatcagaaactagttgggaacagcacatgattatgtaacaatattttactggaggaatcatgttttacccatctttgccatgtattgcttaattttttcataagctggaaactggatcgcgacatggcttactcccgccaaagaaggcaatatgccactgttccaatacaggaaatataagcaatataactaaaacgtttaacataagcacgaaatatcacaagaaaaaggtgttcaaatttacggaactttcagtttcatatgagacactaacctgtacaaccctcgcactccttcttcatgacaaatcctactaaatgcagacattacacttttgtaaggtaccacaccaggcctaattccttgcgtctgaaaaaacggtaagaggttaggtcaagtatcttatgataaaacaaattcaacatgtctagtaaagctgaaaccaaagaaagaagacaaaagttaccattaatcttgtcttgacaacccaaagcggattagttgcaatagatgtggcagctccagcaccagctgcagctatcatgtttgacccaatactaagcttgccatctatcagtcaaacatgaacagttgataaaaaagacttggtatacgttatttgagcatatatatatgatactcttccggttaagcataagctacaacgcacaaaagatttgtaacaaaggaaaaccaaccacttgactgcagcacatcctttagcttcccataaactgagaagtagacctgagcgtgataccagaataacgattaaggaaggaactaaagttattcaaaaacagattaaaatcgattagaagacataaaatatctcctatagaagatccataggagaatgttgggcaagtaatatcttttatgacaagacaaattcacttgaagaaacaaagctctgtagagaacagtggtgcttacagcccaatttggaaggagagctatgatggttggtaaaagccctcgatacattcccctataaccttcttccttaattatattcttcagacttgtaatgattacaccacctgatatcacaaacagatgtagctagttaacacctatatccaataactcaaacaagagagagtcttgatcaaacatgcaacaacttaaacagaaacaaactacttgcattcacacaatctctcatacccatcacattagatctacaactacatacactagtcatactcttaagaaaattaagctcagtttgaagcaagtagtacctctttgaccagaggctggagcttcagggagaccaagaacctgtaaccttgttttgatcacatctaatggacaaacaaaagtcgccgcgatagcccctgaaaaaaaatccccaaatcaaccaaacaaaacaaaaattcagctacccgaatcaaaagacgaacttgaaaacagataattgaaactaacctgcggtggctccggcgccggcgtttgcagcgacttctctaatactccggtaatcaaaggtagagttcccatgttcaatcatcttaaaaccctagaatctctcaattggggggaatctgactcaaaattgaaaacgagatccagcagtaaatgataaacccggccacgtgaatcgacgattatatacaattctcgtcgttcttgacattgacccgacccggagaaaaaattcgaacgtgtagacgggtaaaggaagagactttgtttgcgtatgatttaggcggtccctagtcgaaaggatcgattttttttcttacagattccgaagaagcacagttggtttgagatgacgtcacacatttaacaacaacaacacacaacccaagaagaaagaaagttgaacactttttgcctctatctgattatcaaattataatctgactgaatccggtataattcgatcaaaccaagctaaaccgtaacccaacggtttaaccgatttggtttgggtccgcttaaactttgaaaaacaaggaaaactttcatcggcgagcttcttcacacttgtgaattccgattctgcagaaatg

SEQ ID NO: 32456 - DNA, 2191 bp, Unknown; identical to SEQ ID NO: 493
  misc_feature (1)..( 2191): 2750-1469P.txt file - cDNA_ID_3056425; gDNA_ID_1591443; Annot_ID_151000
  misc_feature (147)..(147): n is a, c, g, or t
  misc_feature (202)..(202): n is a, c, g, or t

SEQ ID NO: 32457 - DNA, 317 bp, Unknown
  misc_feature (1)..( 317): 2750-1469P.txt file - cDNA_ID_3056442; gDNA_ID_1591457; Annot_ID_151011
  misc_feature (1)..(1): n is a, c, g, or t
  misc_feature (170)..(170): n is a, c, g, or t
ntctacaggatttagactatggttagagtttacatttgatttagaattgtgtgactttgatataaaaataatgacatctacgaaattacgaaatacaaatatgggcttattcattattgggccatacaagcccatcgagtttagtattgatccgctaatcaaaaaacgtnaacaaataaaataaaataaattacctttacaggtttcgtaagataacagaaaaacaaaaacaaaaaatttctgctttgaagaagaagagtcgatccataatcaccactttcagatttccagattctggggaaatatcttcaacgatg

SEQ ID NO: 32458 - DNA, 1108 bp, Unknown; identical to SEQ ID NO: 508
  misc_feature (1)..( 1108): 2750-1469P.txt file - cDNA_ID_3056536; gDNA_ID_1591531; Annot_ID_151121

SEQ ID NO: 32459 - DNA, 556 bp, Unknown
  misc_feature (1)..( 556): 2750-1469P.txt file - cDNA_ID_3056600; gDNA_ID_1591571; Annot_ID_151187
gttttggtgtcttaatttttagtttggtttttcatatagagagggacatatctaccaattctaacttgttgatagccgtaaccaagattcaagaatagttacctgccaccacatcttcgcggcgtgtatctcaagcgtcatgatcgttgacgccgtctccaccagatgtttgtcgccgtaagctaaccctaataaagcggcggagtaataagcgtttacggcctcgcttgtgctctcttgattccggccgtcccagaactccgttaaccctccagcccatgagtgtagcttgaaaagatcaaaatttctcaaacgcggataactagaatttgaattattatcatcttttctcccaaacgtcatgaaatccgccaatagactgtacgcttgagctctgtatctctctccccacaaaggatcaaacttagcgagcacggcaatagcgtagagaaagtaaccaatatggtaatgatgattattatatataccgaacccgaaatcagcttgtttccacttcaggatcgaagtgaggaactaagcagcaatgtagaaaatg

SEQ ID NO: 32460 - DNA, 1041 bp, Unknown; identical to SEQ ID NO: 514
  misc_feature (1)..( 1041): 2750-1469P.txt file - cDNA_ID_3056611; gDNA_ID_1591574; Annot_ID_151193

SEQ ID NO: 32461 - DNA, 538 bp, Unknown; identical to SEQ ID NO: 515
  misc_feature (1)..( 538): 2750-1469P.txt file - cDNA_ID_3056625; gDNA_ID_1591576; Annot_ID_151198
  misc_feature (393)..(393): n is a, c, g, or t

SEQ ID NO: 32462 - DNA, 526 bp, Unknown
  misc_feature (1)..( 526): 2750-1469P.txt file - cDNA_ID_3056646; gDNA_ID_1591587; Annot_ID_151222
tttttttttttttgcttctgatattgcatctaaattgttgttgaactcttttccgccaatagaaacaatatttcaaatttgtagcatcgctaaataaaatacataataagttgaaacaatatagttgttgagtaaattatataatcatctttgctattgttaattctaaatttatttaacacaaaaagctaaccattaagcaaagaagaaagtgacctgatgatcgaaaggaacattagaaacgtcctcattgtccgccgggaaatattttggagaaggacatcgattaatctatagattagaggacacctcttagtttaaataattatatcgttatacacctaatgaaattaaataaatgctcaattcatcaataaataatttaatgttgtgtttcctaatactcggaacattataaccaccaatcaccacctccaaacttccctatataagacacgacacccattttaagcatccctagctctctccctctccatctctctgctcgcttgtgacagtaaacatg

SEQ ID NO: 32463 - DNA, 360 bp, Unknown; identical to SEQ ID NO: 520
  misc_feature (1)..( 360): 2750-1469P.txt file - cDNA_ID_3056654; gDNA_ID_1591590; Annot_ID_151230

SEQ ID NO: 32464 - DNA, 881 bp, Unknown; identical to SEQ ID NO: 523
  misc_feature (1)..( 881): 2750-1469P.txt file - cDNA_ID_3056693; gDNA_ID_1591624; Annot_ID_151282

SEQ ID NO: 32465 - DNA, 521 bp, Unknown; identical to SEQ ID NO: 527
  misc_feature (1)..( 521): 2750-1469P.txt file - cDNA_ID_3056750; gDNA_ID_1591660; Annot_ID_151347

SEQ ID NO: 32466 - DNA, 467 bp, Unknown; identical to SEQ ID NO: 528
  misc_feature (1)..( 467): 2750-1469P.txt file - cDNA_ID_3056765; gDNA_ID_1591662; Annot_ID_151354

SEQ ID NO: 32467 - DNA, 3003 bp, Unknown
  misc_feature (1)..( 3003): 2750-1469P.txt file - cDNA_ID_3056773; gDNA_ID_1591665; Annot_ID_151362
tggtcgaataaatcttcaggtaaaatcaatgcacagttccaatagaaagttgtattcttgcaaaactttcatggaagagagtagaatttttcatgttgtgtgacaacagtctcttaccattgagggacaaaaggagccatccatatgacatcaccagcctgaactggatacctaatttaaagacaagaagatcacataaaagttataatcatttcttctattctgtggaatatagctgtgtttgcagttttcttttggaacatgcttctgttcactttacatgaccgatgtagaaaactattgttcttggttgtgcatgtggtgtgttgctggaaagttatcaattatattcacaatttcgtttattaataatacagtgttgcgtaccagttatcacccaagcgataaatgccttgcccctccagaagcaacaaaccatgctggttataatgaacttcctgctcacattgcaaaatcattgagaagacgaaatggaaaaggaacagttaaaaaatctgcttatggtgtcaagtcaaactgttatgtaccttaacattcagaaactctccaggctgaaaatccataatctgcagatgacagacacatcagtaattaagctttagaggtctcaaaaagcgaawggattaattcaatcaagtgaagtgcttacatggatgttgaagtcataagcaacggacatcggaagaagtttccgcagttcaaaaacctgtaataataacaaaatatatcttcagagatgactaattttaggaactagaacttgcattacaaatgtaaactgaaatactttcagatgtattctgagaaaagtggagaacttttgcacacttacctcaccaggagtctcgagtagtggttgcttgtctgtggagccaacaataagctctgtggtgtgacttcctagatattcatacctagagatgtagcagtattgggtgactttttaagttaaaacagtagagagaactcaaaattttcttgtcatattaagggaaaggagaaaaacctccgctcgaagacaacaagtgttgcagactcaacacagtccaaggaatggtgaaagtttggaggtaggtacgcatatgaatcaacctacaggaaaaatggattatcagcagaaaatgataaaactaatggagaaatcttgcaaccatttcaccatcaaatctgggcagaacgtgatgtaaccagaagaatactgtggtaaattttcctttgtacaaatcataccgtcaatttttttgaagaactggatgtgttagtgagtgtcacagcaccctcgaccacgaatataagacttgaaaaagattcagaatattgaaaggagttaaaaagcagattatagatcataagtgcaagcatatgttaaagatagagctcatataagtaataataccgctctatgtcttgtggaggcaaacctgaacttgacatttctgcaagagacagtagaatcagctagatgatctccaaattctacgagtagatcatataaaacagcaaatctttaaacccttaatcactcgacttgttctgcgcaaagcaagaacaagtgaatgttctaataatgatgagattggtgtagcagcacactttaggacataaaggtagttcctaaaagattgactctattatcgaaagatagaagaaaataatcccaagaacttgacgttcattacttgtgagaagagattggtttcatacctttcattttcgccaagtacatgacaaaatgggaacccgttgccggtgtgatcaaatacgcccctaatgtgtttgtcctgtaaatttgagcaacagataagtgcaagagcttgccaagtttagacttcttttagctataaaatcaagaaaagtagggaaattataagagagtcatgtaccagtcaggtaaagggctgtatacatgactttccggtgttattaacgcatgatctcgtttgtatacacttcgtgtgaaaccaggcaagtctacaaaacaacagactcataaatatttctgcttaaacacttgatgaagatgcaaatacaaaacccccaattccaaatttgattagaaaactaatctaattatacacagagagagcgaactctcagaaagagactgtatatacagaactgaagttgaatgcttccatggttatgtctaaatctaattgatcaaaagttaagaaatttttgcaagacatgagccagaaaccctctcagattaaacactaattaaagtaatcttaacttttcaataacttaatctcaaaatcaatcatatacaacaagacctcgaacaattgataaaaacagcaatcaaacttaaccagcaaaagtatcaaacttttaataacacgaagctgtaagaaacacttgccttggaggtgtgaaggagagagtgttggattcgtggctttccaataaatgggtttcgtcttctcatccgattcaacaatcgaaggcgctgaacaaaacccatcatcgcttttcgaagctttaacaagacctttgataacaaataagaaagttctgattagtttcacagtatactcaaaagaacttgagaagaatctaaaagattcgtacttactaataacgatgaagacgattaagtaaagtgatcgcatttttgctgagagttagtggaacaattcaggtttcattcatgtttataaaaatctgagaagtgagaagtgagaacaaacagaacacgacagatgattctctgcagtggccagtagattatttatttggtagcctcatattaaattatacgttttcgaaaaatgagaaattcccggttttacttcggtttgatttggttactattatagtcgaaaccggaatattttcagagaaaaaaaactacaactattgggcctatttgttgagcccataaataatgttatgaagcccgatttgagacagatcgttatcgtttcggggtcacagggactttcactctttctctctctctgcaacaaagaagaaatg

SEQ ID NO: 32468 - DNA, 1969 bp, Unknown; identical to SEQ ID NO: 529
  misc_feature (1)..( 1969): 2750-1469P.txt file - cDNA_ID_3056776; gDNA_ID_1591665; Annot_ID_151361

SEQ ID NO: 32469 - DNA, 1666 bp, Unknown; identical to SEQ ID NO: 532
  misc_feature (1)..( 1666): 2750-1469P.txt file - cDNA_ID_3056812; gDNA_ID_1591696; Annot_ID_151407

SEQ ID NO: 32470 - DNA, 3000 bp, Unknown
  misc_feature (1)..( 3000): 2750-1469P.txt file - cDNA_ID_3056828; gDNA_ID_1620354; Annot_ID_154409
gaatattaatctaatttataacacataagatcatcggtgaaactgctacatgaatgaatcacaattcgaatcatgaggatctcttacataatattaacataaattgacaagttatttttgcatgattgaattccattactgttccccagtgattctaatttttttgactaaggaaaccatatcaataatcaaggattccgtaatctgtttattatgacatttctattacaggatccattatgattcatcccacacgaagattttcaaacttgtgattgtgagcgtaacataatcgaatcgattacaaagatataaactaactaaaatatgttaatttatattttgtttttttatatatatatatatttatgattttaataaaacaatcatattattttaatgcgttgttgtttttgttttcacaattctattattatttcgagcatctcttatttttgtatctccaccaattcttttatcattttttatcatttcttataaaaaagtgtaattcaatcattttacaatatagtatgtatgcattccaaaaaacattattgtatgaaacgaaacgaaacgaaacgaaacgaaggagtagacggtggatatcagccttaattaattagagtcaaagcattgtgattagtttgacttttacatccgtcactatgtcaacgttaatgtatttatccccaacttgctaatgatagaacaatatttattttgatttatcttgaatttcaacaggttaattagctaattatagttataacatttaaaaaaaactcagatgcgtgaacaagatcgcaaactaattccatgcataatgcatctcttgactttgaaatgcatttcttgacttcgaatcccaaatgaaccattttgttatatacttaatatataatatattatatatatatataacttaaagcgtgacattgttctcccaattatatagttaatcactataaactacaacttggtttgatagtcaaattcaaaaccaagactcaatatcactaagtcttctccattaacgctataaatagattgaaatcctaagctaattacaatcacaaacacaaacacaaacaaaacgcctctcaatactaaatcaagaacattgaataaaacaatgtcttcacgacaatcggtgaggcacccgagtcacaaccatccattgcgcggtcacaaatgcgaagccaaagacgaaatcatctgctccggttgtgatctcgatctggttggtgcagctttcaaatgcacaaagtcatcagattgtgattacttcttgcacaagtcatgttttgaacttccacgtgaaaccaaccacaaatctcaccaaccccacactttgactttaatctattccccaaagtcaacgtacacgtgtaatgcttgcggcgaatacggatcaagtttcacgtacaactgttcaatctgtcagtacgatgtacatgtcggatgtgtttcaatgcctgaaacagtgaagcgtgaagatcacccacatccacttactcttctttacggttctccttataaccaacccggtttagtttccaaatgcgatgtttgtgaagacattgtaccggataatctctggtcgtattattgcaaggaatgtgattacgctacgcatttacactcatgtaagaaagaggaagaggcaaagaaagaagatcaaaaaggagaaggaagtaaaaactcgatgaattcggagttagctgcaatgttagaggctcaaagagaagtggagaggatgcagattgagatgcatttggcgatgcaaagtgctttgatttcgaaaaaggcgaataaggcagctctcaattgcatctaattcgaagaagttgggattcttcaaattctctttacttgtgtctgtttttcttctttttgttgctttttcttgatttatgttgttgttgctcctgcaaacttttcatgttgttgttgttgttgtttttttctttgaaattgttatctgaaataaaagaattatcagtttttttttttgaacgattattgctgctttcgtttttgtaaccatgttacctttgcatactatgtttcaagttccataatccattttatattactataggaaaaatatataagtattggatcacccctacttatagattaaaaatattgggaataaagtattgaaattgtgagatttggggttatttaaagtagtttgtgttagtgttatcgatgtgttaataacggatggtaaaataaaatctaaagtttaagatttaattatatctatattatcaatatagtattaattacattttattttatatttctgtcaatgttatttgttcgtaaaatcaaattgatctcaaaactgaataaaaaacaaacaaatccagaccttgcaaatgcaaacacacaattagaagtgatgatgtcaagaaaaacacacacacaattagaagtcacataatcattagggagttaacaaatgggctcattttgacagaagttaagcccattaaagtaaagataggcccatttataatagagcctcaaaaatagtttaattgaggaagaagaaaactctctgctaaagttgcttgctttcttcttcttctccgattcgagcttccttcctctcagcaaaaccttcaagtaaaggtaacatcactcttctataagcttagatttttcacttttattcttcatactgtcgtctccctggattctatcttctcgattttggtgattcgaacacgattttacctatccttgagcgatctcgatcccaactttttgagttgattttatttcaggagttttcaaaaaatctgttgttagtatgtgattattagtttctacactctgttcttctggtttcgtatcatcagctagctagctttggttctcgaattttgcttctcaagattcaaatttcacttcgttactcgtttttttttgtttgggtgatgatttgatttttcctcattttgtagagtggtgaatcggaaaatg

SEQ ID NO: 32471 - DNA, 206 bp, Unknown; identical to SEQ ID NO: 535
  misc_feature (1)..( 206): 2750-1469P.txt file - cDNA_ID_3056855; gDNA_ID_1591722; Annot_ID_151441
  misc_feature (1)..(2): n is a, c, g, or t

SEQ ID NO: 32472 - DNA, 3000 bp, Unknown; identical to SEQ ID NO: 8391
  misc_feature (1)..( 3000): 2750-1469P.txt file - cDNA_ID_3056917; gDNA_ID_1971789; Annot_ID_175516

SEQ ID NO: 32473 - DNA, 360 bp, Unknown; identical to SEQ ID NO: 542
  misc_feature (1)..( 360): 2750-1469P.txt file - cDNA_ID_3056917; gDNA_ID_1591790; Annot_ID_151508

SEQ ID NO: 32474 - DNA, 1394 bp, Unknown
  misc_feature (1)..( 1394): 2750-1469P.txt file - cDNA_ID_3056955; gDNA_ID_1591821; Annot_ID_151549
  misc_feature (1215)..(1215): n is a, c, g, or t
  misc_feature (1306)..(1306): n is a, c, g, or t
acacatctagagatcttcgatgtttccggatgcaccgatctagataaaatcgagggatcattcgagaatatgtcttaccttcgcgaggttaatctctcagggactaatctgaaaacgtttcctgagttgccaaaacagagcatcctctgttcttcaaaacgtattgttctcgcggattcgagttgtatagagcgagaccagtggagccaaataaaagagtgtttaacaagtaagtcagagggctctagcttctctaatgtaggggaaaaaaaccgcgagaaacttctttatcacggcaatagatacagagttattgatcctgaagttcctttgaatatcgatattgttgacatcaaaagatccactgatcttaaaacagagtatatagccaaagcagagtatgtctctatagcagagaatgaatccaaaagcgtatcttctctcttcgacgagttgcagatggtatcggtaaaaggttgttgggttgagaggtgcaagaacgtggatgttatcttcgaatcagatgaacaacaagagaaagagaaatcatcattagaaagtctttggatctcaaatcttccattgctaacaagcttatacagtagtaaaggaggattcattttcaagagccttaagaagctaagcgtagattgttgtccaagcatcaaatcgctattcccggagattcctgataaccttgagattctacgtgtgaagttctgtgataagttggagagattgtttgaagcaaaagcaggagaattatcgaagcttcgtaagcttcaccttcttgatttgcctgttttatcggtgcttggagctaagttcccgaatctggagaaatgcacaattgagaaatgtccgaaattgaaaggtagagaagatgaaccgaggattacagatgaaatttcagaggatcaacctcacaagtaagtgaagataacaactaaacaaatcgaaactttattttgttttcacacactctgttctgttcttcttcatgtgcaggaatactattgggcctgaaacccaaactcctgcccagcccacaaaagctacagacacagtttaatctctctgttcttcgttcacacgacgaggatgaagaaacaaaatttccgctgattttatattatctcaccgttaataattatcgaagtcttgaactttgacagagcttgtaattcgaaacttttcaaaatggttactttgtgntgtgttgtgttgtgtaaactcttaaaataaagaataaatgaatgttattttatttttagtcttcttcaagttttggtctgcgatcgtgaantttacgcagagagagatcagaatcgaagaaaacattgcaatataaaagagtcaccttcgagttcgtgtctcactccgataaagcaatg

SEQ ID NO: 32475 - DNA, 302 bp, Unknown
  misc_feature (1)..( 302): 2750-1469P.txt file - cDNA_ID_3056980; gDNA_ID_1591843; Annot_ID_151582
agcaccatataaaaaaacaatgacgcaaattattattttgtttatgtgataaataaagaaatataaaacgagagaaaacaaaaagagtgagtgatagtgattacaaaggtaagccaaaatttgaatatttaatggataccaccagataagaagaactttgcttcaaagcggcaaagcttaagcttttttctcgcgcccgcctctctctctctctctcttctcctctaaccaaatttcccgatgtgaaaaaacaagtttccgatcaactcaaaccaccgtcaccacttcttctctccgacatg

SEQ ID NO: 32476 - DNA, 524 bp, Unknown; identical to SEQ ID NO: 549
  misc_feature (1)..( 524): 2750-1469P.txt file - cDNA_ID_3057010; gDNA_ID_1591860; Annot_ID_151618
  misc_feature (1)..(2): n is a, c, g, or t

SEQ ID NO: 32477 - DNA, 97 bp, Unknown; identical to SEQ ID NO: 551
  misc_feature (1)..( 97): 2750-1469P.txt file - cDNA_ID_3057058; gDNA_ID_1591893; Annot_ID_151662

SEQ ID NO: 32478 - DNA, 181 bp, Unknown
  misc_feature (1)..( 181): 2750-1469P.txt file - cDNA_ID_3057075; gDNA_ID_1591911; Annot_ID_151681
  misc_feature (20)..(20): n is a, c, g, or t
  misc_feature (22)..(22): n is a, c, g, or t
tgagaatgaatgcttccttnanatagtttaagaataagtttctcctctcatgctgcaattgtcagatgatactatctctgagtctgctaatatgattgaatctataaaagcccggcttatagggaatggtcagacagagaagaggtctagcgatgggaggggaaaagatgaatctaacatg

SEQ ID NO: 32479 - DNA, 3 bp, Unknown
  misc_feature (1)..( 3): 2750-1469P.txt file - cDNA_ID_3057113; gDNA_ID_1591927; Annot_ID_151709
ggg

SEQ ID NO: 32480 - DNA, 492 bp, Unknown; identical to SEQ ID NO: 559
  misc_feature (1)..( 492): 2750-1469P.txt file - cDNA_ID_3057138; gDNA_ID_1591950; Annot_ID_151744

SEQ ID NO: 32481 - DNA, 1721 bp, Unknown; identical to SEQ ID NO: 560
  misc_feature (1)..( 1721): 2750-1469P.txt file - cDNA_ID_3057149; gDNA_ID_1591956; Annot_ID_151750

SEQ ID NO: 32482 - DNA, 23 bp, Unknown
  misc_feature (1)..( 23): 2750-1469P.txt file - cDNA_ID_3057218; gDNA_ID_1592007; Annot_ID_151839
gtctggtcaaatgatcgaggatg

SEQ ID NO: 32483 - DNA, 250 bp, Unknown
  misc_feature (1)..( 250): 2750-1469P.txt file - cDNA_ID_3057296; gDNA_ID_2684240; Annot_ID_192541
gaattccccacgtcaacgtgactgtgcattccacgtggcggatgtgggccctatagttggaccatgactcggacggatgttgaaattcattgtcgttgccaattgcgtttgtctcactgaaactgtgaaaattttatctcttttatagataaagaatcttgcttttttcagttttcagtatgaagaagaattgaagagagtgtccgaggaaggagacctttggtttcagtttgtgagtcttgttgtaatg

SEQ ID NO: 32484 - DNA, 3003 bp, Unknown; identical to SEQ ID NO: 21455
  misc_feature (1)..( 3003): 2750-1469P.txt file - cDNA_ID_3057296; gDNA_ID_1971936; Annot_ID_177271

SEQ ID NO: 32485 - DNA, 250 bp, Unknown; identical to SEQ ID NO: 32483
  misc_feature (1)..( 250): 2750-1469P.txt file - cDNA_ID_3057296; gDNA_ID_2684240; Annot_ID_137743

SEQ ID NO: 32486 - DNA, 41 bp, Unknown; identical to SEQ ID NO: 576
  misc_feature (1)..( 41): 2750-1469P.txt file - cDNA_ID_3057310; gDNA_ID_1592082; Annot_ID_151932

SEQ ID NO: 32487 - DNA, 1320 bp, Unknown; identical to SEQ ID NO: 584
  misc_feature (1)..( 1320): 2750-1469P.txt file - cDNA_ID_3057383; gDNA_ID_1592123; Annot_ID_151997
  misc_feature (1)..(1): n is a, c, g, or t

SEQ ID NO: 32488 - DNA, 1836 bp, Unknown; identical to SEQ ID NO: 605
  misc_feature (1)..( 1836): 2750-1469P.txt file - cDNA_ID_3057552; gDNA_ID_1592275; Annot_ID_152195
  misc_feature (23)..(23): n is a, c, g, or t
  misc_feature (97)..(97): n is a, c, g, or t
  misc_feature (151)..(151): n is a, c, g, or t

SEQ ID NO: 32489 - DNA, 3000 bp, Unknown; identical to SEQ ID NO: 9477
  misc_feature (1)..( 3000): 2750-1469P.txt file - cDNA_ID_3057627; gDNA_ID_1972123; Annot_ID_179076

SEQ ID NO: 32490 - DNA, 838 bp, Unknown; identical to SEQ ID NO: 611
  misc_feature (1)..( 838): 2750-1469P.txt file - cDNA_ID_3057630; gDNA_ID_1592320; Annot_ID_152258

SEQ ID NO: 32491 - DNA, 588 bp, Unknown; identical to SEQ ID NO: 612
  misc_feature (1)..( 588): 2750-1469P.txt file - cDNA_ID_3057644; gDNA_ID_1592323; Annot_ID_152261

SEQ ID NO: 32492 - DNA, 616 bp, Unknown
  misc_feature (1)..( 616): 2750-1469P.txt file - cDNA_ID_3057680; gDNA_ID_1592352; Annot_ID_152323
ctatagtgacaggctgacagcaacagattgttgtcttaccttggacttggcccaatttccttttttggcccaccggtatgaataaaaagagtgcggttttcagttcggttcggtttataagcgtaacgatgacaaaccgatcggtttgttttaattcttgactttaataactaaaccctaaatcgttcttcttcttccgcatcttcctcactcgattagtaggttctctcttcttccaatctattcccaacttctcacttttccgtctaatcgttgtcttcatcaccatctctccgagttcccttcgagaccatcttatcttcaatggtttaggtattgcccgattttagatagttttgttctctcgtatagttatgacaatggcagatttttgtacgctctgcacatgcttaatcttgaggattgggctattattacgtactatgatttaatgaattttagatttgaattttggaacttttgatgatatgcatgttaatgaccaagaatgctccgaatttgtctgattcgttattcgaattctacttctttgattgtttgtttccaattttccatgcatctgacttgtgaattttgaacaaaattttcagaaatg

SEQ ID NO: 32493 - DNA, 2062 bp, Unknown
  misc_feature (1)..( 2062): 2750-1469P.txt file - cDNA_ID_3057732; gDNA_ID_1592371; Annot_ID_152361
aawawatttttttttttgttctaaatctagtagtagtacctcttaaagtggactgcgttccatggattttctacttcttccagcttcatggtcatcagcagatagactcccgggtgaagtatgataagtgtgtattttcaatgttttgagcatccatttgtcatcactttagcatcatatcatcactgttttataccatttctgatcatttgacatcactttgcatgtttaggatagttttgcatgcatgttgtatatttgtgttgttttcaggtgattcggagctggtgacgagctaattggaagaagcggacctgatcatgtcaaaccactcgacccctaggtcgagtagacgcttcaggacctcaacagaccactcgacccccttgtcttcacctccaccacctgaccatcactcgatcacgccactctacctggaagtcgagtatcaccatcaccaccacttgactacatattcgatggcgagcttcagagtcttctccattccacacttaaccagacactcgagcacaaggaagaaaagaagactccagcttatcactcgacctctcactcaaccacctgggtcgagtacagttcttaatctgtcccaatactgcgtcattttgagtattaggattttggaatattttgcaataagtagcatgtactttacattttccaaaacaagtttttatctaggttttattccgcaaacactctgttctagaccttttgtaatccggatttctctttatctattcagtattcagtatttgttcttgattttcgtttcctgttgttcatccggttatcatcttgctattacagtgttgttatcatgttttcattctgttcaacgtttatgttctctacaatgatgtctaagtagtgaataggtttctgaggatgggttagagtagtgtagaattctcaatatgctaggtggttgagtttgatttgatagatcctttctggattagttgttcttaatgcctattgctttctgatcaactagaatttgagcccagatattttcgcacccgaaaggtgtcttgatgaaatgtctgaaccactaattccagagattcgtggccctataccaaggtattggttgcagggagcgttttggctttaacttgttgattcgtaatgcctgttaggttggctctcgtcaatggtgattgagtctgggactaggttaacttgagggtctctgttgcggtggcacttagatttggttaatgaacttgttatctagggataatttgttgagcatgtcaatcacctataaactgaggaaacgaaactactcaattaccccatcctcaggaattctttatmctgattgaatttattgtttactctactgttgtttactacatcttgtcatctgttgcttagtttctgcaattctttcttgttactcgacgtgatactcaaccacccagttgtctggcaacagactgtgcagttgaatatctttgtttcattatactgtmctgttactcgaccagtcactcgacctcacccagtgctctgcaaagagctgtgttggtcgagtgtcttactttttctgcttgattttctgttttctgcatgttcactcaggactgctagaacacaccaaaacctgttattgctttgcttgacttagtgacttttgatcacatcttgattgttcgcatcacatccatttggattgacaacctaaaatactacaacgacatgattggtgttttaggataattgactaagaactattatcaatttggcgtcgttgccaattgggtgtttgtttgttacatttgagatttcagacttacttagatcaagttcgttttcaattttcaaaacggttgctaactgtgtgcttttcttgttgtcttcttgatccaggtacacctctgctgtatgcaaactcgatcaacaggcaaccagaacctccttttcaacgacaacatcgaccgcatagctcacaaactcagagaaaggagaaacacagtcaacctaataccacaacaaccactcgaaatggctgacgaacataatcaacaaaatg

SEQ ID NO: 32494 - DNA, 75 bp, Unknown
  misc_feature (1)..( 75): 2750-1469P.txt file - cDNA_ID_3057753; gDNA_ID_1592381; Annot_ID_152377
aaacccgaatgatccaacacaacagacacagggcacaaaagaagcaaagaagaagattcatggaaaagatttatg

SEQ ID NO: 32495 - DNA, 2916 bp, Unknown
  misc_feature (1)..( 2916): 2750-1469P.txt file - cDNA_ID_3057779; gDNA_ID_1592399; Annot_ID_152399
aatcgtctcactacatcagctgtttctgctgctgctttactggtaacacttatcaaatcttgtcttgtagtttatattcatacttatctcaatacacttaaagaagcttgatttgtgtaattcgtaggcaagcaagaaagttttggatcctgtagctccggtttataagtattgtcttatatcagtaactaacatcttaaccacaacatgccaatatgaggccctcaagtatgtgagtttcccagtccaaactttggctaaatgtgccaagatgatacctgtaatggtaagttatttagtttttatgtaaaggaggagacttttgtgtacatgtgagtttatcaacactcttctaatctatgtgatgttttttacaggtttggggaactctcattatgcagaaaaagtataggggatttgattatctagtggcctttctcgtgactcttggctgctctgtgtttattctttttccggtaaaaacacaatctttctaaagagatctctctattagtttgtagtaagcttatcttggctgctctgttgtttttgtatttgagttgtaggcgggagatgatattagtccgtacaacaagggaagagaaaatactgtgtggggtgtatcccttatggttggttatcttgggtacatatccgttttactcgtttcattgttgtttggttttgggataggaaccttaatactcgtttgttatgtccataactgggtgttggtaaaatggctaacaggtttgatggttttacaagcacattccaagacaaactctttaaaggttataatatggaaatacataaccagatattctacacaacaatttgttcctctattcttagttttactggtgagaacttctctttgtgcttcttttgtctcttttactctcattttgtttggactctggaccatgtcttaccttctgtgatgattagtttccattactgtttgatcaattttggatacatataaacttctgatttaagctttcaactgaggccatatgttagtagatattaggaaactttcttattccaactgtgattctattagtccatcactgcttttcgatatagaactcagctgccttgtataaacctcaatgtgtggacctaaaaatgctcgagaatcaggttgaccatgcttttttgctactcatatgtgaaatttcttggttgatataggccttatattgcaaggacatttactcccagcagtagactttgtttctcgacatagggattgcctatttgacatagctatgctttccactgtaagttttcagcttagtcattacatttattagactatgattgcattgcagcagtagtcacaactgaccagagatgaacacgttgttttgcaggtagcaacagccagccaatttttcatttcctacaccattaggacatttggtgctctaacgtttgctgccataatgactacaaggcaggtaagttagtctgatctcaactctttgattcataagcacaatataatcaaatctaattccttcttcgttgtctgaaaaataaaaagcttgccagcatcatgctctcctgcatttggttctcacacccgcttagctgggagcagtgtattggatccgtaagctcttccaatcctctctttactttgtcttccctctttttcatctctccttgttcccaaaactaaaaccacttttcactggcgcaggtaattgttttcggatctctatatgctaaaaccttcgtgaagaagaaatcagaaaagccgccggcagctcaagaacttccacgggatgaagaggcagcctctgaagggaaacccttaaagcacagagagagctttatcttctctgaggcttaaacagttaccagccaaatctaaagatccctctgtctttgaggcatctaactaacaaaactaaagcagttgagtcatacatgacgtaggacgggtacttatagagaccaatgagaccaaggatcaatttatttactgtttctgtagacttgttaaaatgattgtgaagtaaaattgttatggagttttgatattgtatcaagaaatatcataaatttgtgatacaatggctgattcatatcaactgaatttaatacagtaacaattttggtttaaaggatcaaacagaacttaaaagtttggttattacagagtttacgattgacacaatataagaaattacactaaagtcaacattagagttggtgagaaaatcctttgccttatttatcagacaagtaatcagggatatatgaaacaattccactttcaccaatgagagttctccaaccttaccaatcaagcttaccagactcgttmtcctgtcaacatctcaascacgktacacccaaaagcccacacatccgcaccataatccaaaacattgtcccttataagctccggtgacataaaccttgcagtgatagagaacgttgcaccataatttttttttagatactttccaataataaagaacagtttattgtggagtccaaactctgaatcataaacgaatcgatccgcgagaaactcgtggttataatataataaacttatatatattatatgcattattgttgcttgttgccaaaaccaagacagaaaaagatcattgcattttgaaaacgtcgtgttgaattgatagttgaccaaaaaaacaaatataatcaggataacaataaaatcaaacctaacgaataaacaaattgtcgatctgatgatgaaataattaagagtgtaagtataggaccgtcttttgttatggatgggacttgttcgagtctggtatatacagattaaatatcttctgacacttctatttttatatcactaagttttttcatgtgcttcttcttctccatcgaacataaacagagaaaacaatcaatatg

SEQ ID NO: 32496 - DNA, 1477 bp, Unknown
  misc_feature (1)..( 1477): 2750-1469P.txt file - cDNA_ID_3057786; gDNA_ID_1592403; Annot_ID_152406
tttctgttaattaaattarktgaattttaattttgatagcaactatttattaaatatcaattttgatagcatatattaatttcggtcaaaaacataattttctcgccataaacgtaaatccgtactttttccgccaaaaaacgtaaactcgtaattttctcgtcaaaaacgtaaatccctaaatttttgccaaaaacgtaaacccctaatttgttcgctaaaaaaatattccatccaaaatgtaaatccataattttctcttcgaaaattatgaattaaattttcaattttaataataataataatgaaaattattgattattgtttgatagtaattattaattaaattattacttaaatgagttattcatttaaccattcaatctatcgaataaataaaatgagtttataaattgactaactcaaccattcaatttattaaatagaatgagttcataaattgacttagatgaggtccgccacttttttaaaaactgggctcgaagcttcctcgttgtttcctcttttgcccctataaatacaaaaacttcgagatccgaagaaaaaaaacccaccaacaatatagatgtcttcctccggtagtccggtacacagtaccctaatttctaactccggcgatgaaaacactgatcattcctccgcagtacacaagcttatcgctgttatcaacggcggagccatcggtttgctgcagatcacagagaattcctcagcttcaaccaatactgcagatcgtcaagccactatcctctctttctgtgtctttattctgatctacgtcgtcctccgagtcactgaagtaaagctcaatagaaaccaagctccgatccatcacttcgttggacacatcagccatctttttggggctcttgcagctctcatgctcatctccattgtttctcccatcttcactctcatcgttgcccctctatggcttgtttggttctttgctgttatgtatgtctttttagtagaggtcatttgcatggtggagattaagcgtccaggggacgcaaatcttacggaccagatctctcaagtatagtagtttaaacgtagcttgagattccgagcatcaggttaatgtattagtagtaatttatactttatagcataaaatcatgtgttttttctttctaagttttcgaaccctaatcgtgtatataataaaagaatgagtcgggcctactttaaagcccgaaacaaataaccaaaacggcccatatacttcttagggttagtttcgtcaaaataccaatagttccaaattccgcgtttcgtgtgggagagaaaaagaagaaaaagagagtccaaccatatcagtttgctttcacagtggagtcggtgctctctttttttttcttctctctttcttttcacctctcgccggatcccggcgatcttataggaggcaaatctatcagtatcgttattctaggatctctaacaaacaatg

SEQ ID NO: 32497 - DNA, 312 bp, Unknown; identical to SEQ ID NO: 619
  misc_feature (1)..( 312): 2750-1469P.txt file - cDNA_ID_3057789; gDNA_ID_1592405; Annot_ID_152410

SEQ ID NO: 32498 - DNA, 709 bp, Unknown; identical to SEQ ID NO: 622
  misc_feature (1)..( 709): 2750-1469P.txt file - cDNA_ID_3057848; gDNA_ID_1592449; Annot_ID_152484
  misc_feature (3)..(3): n is a, c, g, or t
  misc_feature (6)..(6): n is a, c, g, or t

SEQ ID NO: 32499 - DNA, 2129 bp, Unknown; identical to SEQ ID NO: 625
  misc_feature (1)..( 2129): 2750-1469P.txt file - cDNA_ID_3057865; gDNA_ID_1592457; Annot_ID_152498

SEQ ID NO: 32500 - DNA, 3000 bp, Unknown; identical to SEQ ID NO: 10188
  misc_feature (1)..( 3000): 2750-1469P.txt file - cDNA_ID_3057870; gDNA_ID_2213635; Annot_ID_181005

SEQ ID NO: 32501 - DNA, 310 bp, Unknown; identical to SEQ ID NO: 626
  misc_feature (1)..( 310): 2750-1469P.txt file - cDNA_ID_3057878; gDNA_ID_1592462; Annot_ID_152504

SEQ ID NO: 32502 - DNA, 3000 bp, Unknown
  misc_feature (1)..( 3000): 2750-1469P.txt file - cDNA_ID_3057951; gDNA_ID_1620300; Annot_ID_152584
gagaaaatttaggggcacgagctttgcagtcacctatcaattaatccattaatctaactagtctatacacgttatccgatgaagaagtgtaaaatgttggaattgccgagttaaaataaaagataattaccttccaacacttgcaagggcactaatatgcaaatgctcaggttcttcttctctttagaccaacaaactcattttgcttaaacacttctacttcttttcctagtttatctgcagtttcctgcatcctcttctgagactcagccatttctccagccacttccctgcaacttgctccaaattttaatgtctcagcttcacaacaaaccatctccttctctgtttcaagtaaagttttcctgagatgactagttttctcatgaagtaaccttagtcgcctgtacgaagccataaattcactcaacatttgtacatgtttccctgaaatactctccaattgaagcttctctgagttgtactgatcaattaggttctgcaagcaagggaatgaccactcagctccatcaatttcaggttgctcatggtttgtccttccatgtatcacaacagaaccactagagaccgtatctctgatcaaatcactcatcgcttcatccacactcaacttagaaagagcactatttgttggctgatcaccattctgagtctttttccatggctcttcaggttcgctcgtaaccggatcaaacagagagatacctagtaaatagcataagagttcaaagaacaaaaaagtgtattccaagcataatactttaatagaatcaaaattgtccataagtgaagtaccttggttcagagcagtagagtgtacatcagaaacagacattgaaatggaatccaaattttctaatgtagaatcatcctctgcactaacagaatcttgacattctactacacaatcatcctctataccactaacagaagcttgacattctttctctgatgccatttggtttgcaatttccggtataacaccaccacgagcctgtaagctactctcaacatcactcaaaatttgatcagcttcaacccaaaaatcaatctcatccataacatcacaactaggaatcatctcaacatcttcccacttgaagaatccacaagctccaaatccctaacacaatttcttaaaacaatgttaaccagaattatcaactatgagctttaaacttgcgaacgagtcaaaacctttttgatgcagcatatcaggtaagctctaccggaaacgtctttaactctccggcaaggtccagcaccgcaggaacaaatcgggatggtgaaggcaggacggaatttgatatcttcgtcggttactttgtcacaccatttgaagaaacagcaattctgagcctgcgaatttcaaatgtcgtcagtaacaaattcaaatttcctcgcgaattttgcaggagatgaagaatcagtaaagaaagcgagtacgaaccgttggacacttgtagaacttccttccgggattttctcgagtattcgcgaccttgatttcacagaaacctccgccgcatgggcattggatcgccggtggaggatcatcggtgtaggatttgagaggacaatcgttgatccagtggccagcctgacggcatcggaagcaatctccggtctgcattgtgccgttaagcattcgtcgaacattctccttctcgggatgttaatatgggccaggtcatcttttttaagcccacataatttatttttagctatgactgaacaaaacatgctgaatatgggacgggcttaatgggcctgaagactttaagcagattaacgaaacaagtgtgttgtgtataatatgagaaccatgtcgttctgatcggttaaaaactacagctgaccaaataacatctataggcttctgcggatatgactctacggcgtctacgcctcgcatgcctatcatatttaaccgtcaataatggatttggcggttttggtaggccgggtcaaccggattaaaagaaaacggtttggagtccttccttgcaattgaattttcacacattcgggttttgtgatttctctgtcataatgggcccggcacatatggttcataacccatgtgggcctatggtataatttttccaattaaaactattgttaggtcgataaaacaaaaaacaataaaaacgagtggaatacacataccaaaaagaatgtgatgaacattagtaattttattttgatggttaatgaaaaacaaaataaatgcatcttggcatcttccgttggaaagcgcaaatagggcagattttcagacagatatcactatgatggggggtgagagaaagaaaacgaggcgtacctaatgtaacactacttaattagtcgttagttataggactttttttttgtttgggcctagttataggatcataaggtaaaaatgaagaatgaatattagattagtaggagctaatgatggagttaagtatgcacgtgtaagaactgggaagtgaaacctcctgtatggtgaagaaactatacaacaaagccctttgttggtgtatacgtattaatttttattcttttatcacaagcgatacgtatcttaagacataataaatatatatcttactcataataaatatcttaagatatatatacagtatacacctgtatatatataataaataggcatatagtagaaattaatatgagttgttgttgttgcaaatatataaatcaatcaaaagatttaaaacccaccattcaatcttggtaagtaacgaaaaaaaagggaagcaagaagaaccacagaaaagggggctaacaactagacacgtagatcttcatctgcccgtccatctaacctaccacactctcatcttctttttcccgtgtcagtttgttatataagctctcactctccggtatatttccaaatacacctaacttgtttagtacacaacagcaacatcaaactctaataaacccaagttggtgtatactataatg

SEQ ID NO: 32503 - DNA, 3000 bp, Unknown
  misc_feature (1)..( 3000): 2750-1469P.txt file - cDNA_ID_3057962; gDNA_ID_1620300; Annot_ID_152600
ttgattctacagacaacattatatagctagcatcggatgcaacatagattacaattaatttacactagacgactgttccatgcttcttctatgcagacttccctccaaacacccttataaaactggatctgaaagattctctaactcctctccagtacgtatagtttgacccatataaccacagattcactgcttttttccaaccatctctcgggaactcaatttctctaccaatcctggactcctcccaatcttcttcagtgtcctccaaaagcgggagcgcttcaaaaccaccagactccaggtgcttgatccacccgcgcatcagatagttcaccacctgctcgttttcatatcccaaatggtgggttcattatacctaattgcagagtttgaagaatttattgactagttcattatacctcagggacttcatcgtgtgggcagtgacccgctgggctgatctcgtagtatggagcgttggggatttccttctttatcttctttccccataacggtctcacccatggatcttctcttccatacatgagacatatctgaacattgttttccttacacctagcataaaccatcaaatagcagcattcctcataagcaataacaccaatcacgcagagtaaaaaacatataaaaacaagaaaccacactgtcttatacctagataaagcttcggagaaagatagctctccaccaggagcaagcatgattgaagcaaacgatgctgcagcagccggatgctgtgtgacctccacaatacgtgagaatactttatccacattgatagaatggtctgtgtagacctgtttaagtatctcagctatgctttcaggatcacttatcttttgccacctgcagtttcattgggaagtaaagatattagactgatagagatagaaatagaaaatgatacttttcaggtgaggagatgtgttaataaagtctcccttacaccaattctgtgatttttttcactctttccggcagagggaatgctccgggccatggaaagagacgtgctagctttggggatcttactggattagggaagaaaccccagaaaggtgttgcattaagcaaggtaacacccttaaccaggtgaggatgggttgctgcaaagtagagagctacataccctccaagtgagttccctgcaatgtacacaggctcaccgataacctgtacaacacaaataccacatactcttaccgactcagcagcttatttcagatgaaaaagatcgtgatctcaaactagaacacaaacggaatcaaagaacagagatgaattctaatatctagtgcatcctaaactttcccattcccaaagcaacaccagaagactccatacccacactttcaggttctgagctgaaaactattgaaatccatgagtatacgacacatagcaacaatctacactaaaaaaaaaaagctaacacactgcttttgaaattacgactaaaagaacaaaatcaacagcttaaagagtaatagaacaactgaactcagatattgctaacctcttctacaaaatactgaacttgatccctccagagatccagagagaatacaagttgatcagcccacggttcagttttgtcaccaaatccccaaaatggttccttatcttccgaggaactggtttcttcagtcatggtagtaggatcttcagtagggagagataaaccctgtccaagaaaatcaatagcccatactcgataatcccttcccaaatcggtaagctgcttctcatagtgaaatgaaccaacgccaaagccaggaagaaacaacaccgcaggagcatcgagattgtcacaaccggctttctcataatgtactctaagcttgggcttccactcgcagtgagaatgactgattcgagcagcaatttcaccatttgattcatcaggcaaaccaggaatcaaaacctttgacgttgattctcctcttctggctatacgacccaagtcatcattctcaccaacaacataaccatcggaatttccacttcgaatcacaagtctggattttttgacccctgagaataacaaacttgaccgatttgggaccaatcttttcgttgctaatttactactccaagtaaccacagagcactggggcacaacgttcagtgagattatctccataacaagttcctgcaaatgaacaaccaaaaggcatatcctttaatacgaattttccactcatatatctcaacttcatagcaaagctaagaataacaaggaaaatcacatatgaagctggaatctttgtatagttatcagaattttgcttcaaaagctgaaaccacatacaaaaagttgatgaacttgcggtaatcttctatgaactcgtcttatcaaatcctaatcaaaacaaagcaaatcaaggtcaagccaatcttctatcaaattgaaaccaaacaacaacaacaccacccgattcatcgacaaagaactccagctatataataaacccaggaagaaaagaaagaaaagagagagttgcaacttgtaccttttcaaattccagaagcgagaagcttcatcaaatggtctctctgagagcgttattgagaaattaagcgaggaaaaatctaaaggtgaagaagaaatagaagaattgggttgcttgctggcttggttaacttcaatcgttcggtgcaaaccgacagcaacgtttttatcgagtttttattttttcttaaaggatccaaaattcatactgtattattaagtgtagggttatttttttcacaatatgacattttgttttggatctgacattgctaatttgacaccgatgtaacattgcaaaaacacatgtttgttgcaaaaatatgacagaataatattttttttaaaaacaattgatttttgatcttcttttccattgtgtaacaatcggaaaacaaaaaaaacaatcgaaaaacctgcagttttcatatcaaacaatataaaacccgtttaatttttgaatg

SEQ ID NO: 32504 - DNA, 3000 bp, Unknown
  misc_feature (1)..( 3000): 2750-1469P.txt file - cDNA_ID_3057966; gDNA_ID_1620300; Annot_ID_152598
actttgaaattaactctagaaatcttatgtaatgaaaacaaaacgaaagtatatagaatcacgatgagattaactggctaaaaagtaatcatctttcatacaaatttgctatacatttttttaataaggacttctcttttaatgtgtaggaaagatgaaatcaaaacacacctatagatctattttccataacacacaagatctgaacacgaaaaacaattgttataccagatatatacaatagtgtttttttttttggtttgaatgatatatacatttacatatatataaacacatatattaacgtataaaatattacaggaaatttgattggaaatgaagtccaagttgagtaagttttatttcaaccacctcaaggaatatatacggccttgaagcatacgtaaccatctcaaaggcagtttcaaatcaaacgtagatgttagggtataatgtaagatattgagattcttgttggctaacggaatattatatcaatatcgaaatgttgccaggatatgagaaccatgtgatgatgatatatacgtgattgcttttcttcaacttggtgacagagaaaaaaaaaagtttaaaggagaaataaaagaacaaaagctgttcaacccaaccgaattagcttgcaaacgagtaaagagcagatctatgcctcatccgctgaagcataatgcatgaaatgctagaatccaactctcttcggtttttgtgctattatttaggatatttctgcctgctacacattcgttgtcgatatttgaaaaacattgggatcaaaagacatcttatatgaataaaaatatatttgttaattgttatacataatttgatgttattttgacatactatgacaatacatatgttatcgtcaccgcaatattaattaactgttttcgtcaacagtgtataaatgattcccataacattattaaacgttgaatggtaggaagaacaacttggtatgttatatatataacagagatctcatattataaaagtatgaaaatcatgtgtgcacatagactatatcacatctacatgaaacacaaacacaaacacatggatttcttctaaacacaacgacatggatataaatccagtgttatcggcgtattaaaaaaataagacaatgtatgagtgtgacaatcaaccatgtgaaatcttgtctttctataaatatactagtttagaactttttgttttattttatttatttgttattttactatatcttaagataagcttatgccaactgactttcaaattaaaatggaatattctcgttttgttaggtggttggatctcgttttatttaaattttcctatatccgtcttaccgagtaatttaacattttttacaactaagaatatgctcttttccgtccaattgggaatatgcttaacaacactatcatggatgattatcctaaatgtacaataaatttactacttaatcttcattcatgttatcatgttaatatactattgaaggattccattgtaaactatttcatggatgataatcctaaagtgtctttggcttccccagtcaatattaaacaaattcaacgcaaactttttaataacagtaaataaacttacccaacattaatatttgaccaataaaaagtcataaataaagctttgaaaatattaatggggaagaattcaatagttttcgaaacatcttaaaccttactctacctaataactagacttaaaagcaaagaatcgaattaaacgaaccaccccactcttctgctaataggcaaaaacaaattccaggtgtaaaagcacgtcagcaagagaaaacacgtggaccaatgatgtaaaaacgtgcacggaacagtaaaagaagggataccacgcggtatcacagcctcataatattcccttcaaaatgggaatattataattattatccaatcccgaaattaactctcttttttttggttctgacaatgacaaacaaaataggtttcgtgtagtaagagtatcctccacgtgtcattaaaaacaaaaaaaatggttcgaagagtgactggctctacccggtaaatccactatccttgaactgccacatccggtcgcgtggttattatttattttatttcctctacttacaaaaaaaaaatggtgtatttattttcttcaaatgggggtttaagctttttttcagttgtttggttttttctttttcaaagggtttaatgtcttcttcttcttcttcttcgttatttctattctagaagagagagagagagaaagacaaggacgatcgttaaatctttttctcttaaatcttagaatttcaaagtctctgtaatttttttctcttttcatttgtatagcacaattgttcttaatcagagattcgtgagaggtaaaggtagcgtaattattcagtttgcgtgatctataatttaactggcgccagattgtgatccaggaatcgttggcttgttaggtgagtttttttgttcatcacaattcatgttctcaattctgtttttctgatccacaaactcaattcatgttctgtttttggtgacaaaaaagtattgaatctgaagtcgaataaattatttggcggtttgtcagaagttggcaatcgagatctgattatgttttattgtttgtttctacgtaaattgtgagcatttaagttacatttgtttcattgatctaagtttttgcgtttcatctatacgttgcttgtttcgctgcatttttgcatgttttttaaaaaacaaacaaagtgatcaagggtttggtgttcattgttgatctgaatctgtatagggcttagttttatcttcctgattttttttttttttttgcatttgacctcggatctgttgatcattagtttaagaatgtgttcaaattatactgattagcttaattttgttggagatgatcatgacattaaaagtctttgatttttttgcaggttgttgttttgttatgcataattgagagatg

SEQ ID NO: 32505 - DNA, 3003 bp, Unknown
  misc_feature (1)..( 3003): 2750-1469P.txt file - cDNA_ID_3057977; gDNA_ID_1620300; Annot_ID_152591
cttctttcatttcgtcgcaaccactttatccttatcatcttctttgtctttcaccgcagtctgagttagctttaacgaaaaaacaaagatatgttgaaatgaattcaaacattggttgcaatttaagatgttacagactttggtactcttgttaattacttgaaaagatacatgttataatgctaacaataggtttgatttgtttgttgaggtagatgttgattgattattaactcaaaactaaactaacagtgagatttgcatttggaagcctaacgacatgaagctgtcttgaagattggatcttcttattatgggcccaagcactggcccagatatgtcttgtactatttgtatgctttgatagcttgaaatttggagtagtgcgcgtggggagagggaatggtgaaaccttagtggttaagttatgaggaaaatgataaaaggataaaacaatcaaatgcagcttgaaacggccataacataaagtaccttatggtggtgcgaatatttttgtgtttctttcactcttttattgctgaaagctacgacacttgtcttaatatattgtttccgcaagtcacatgatctactttttatttaacgtctagaaacgccgagatatatgatgattagtatatcacgtctatgcaaattgttagttcgtgtttggccaaaagatatcgagacatgtctgaagaaccgagtctggttttgagatatttcttcaagcattactatacaatagaaaaaggagacacgcgaatatgataatagcaaaaggcataaaaaggcgaaaattaaagaaaaacgtaaagtgatttggcctcaatcaacgggaacgtatcttaattttagaggttcttcttttacttttgagacgagagagtttgcgtctttgcgagctgctttggttgactaaacattatcatattgaaaaccaaaatacaacggaggaatatttgtcacagtttcactttcacattgtttccttaacgtttaatcaaccttgttcaaaatttctatagttgtaatcatcattgtttacaaaattttcgttcaaagatgattttaaataaaattgtgaaagaaaaccttttctgaaataaggattggatgatagtgttaaaagaaaaatatgaactgaggcaaaaagaggagtggtccccggaagattgtgaaatgtgtcatctaaaccagccagacgtagtcacgtgttctctctagctttatgaacttccttagccagcaccatcattgtgattgtagtatatatgtaaccctaccttcatctctcccattttccattctccatatagactcctttacaatatacaaaacctatccaaaagcgaagaagccaagcaaacatattataaaaatgaagaaggcgtcagatttcgtgaagcagataataaacatgttgacttgtctagcaaaggacaagacgaaggagcttaagaggaagacaagagccttcaagacacgtctcgtaatattttcgctgctccacaacagacacatggtggtgggttctttgtctcacaagctcaagagcaatcaaacatcaaaaaagatagatcatgataacaaggatgttcaagattatcatgataaaaacatggtggttgtgtatagccaaaacgttaacgccatgtctagcactcctgtctctccgcatgtacaatatcaatatacagaggaggaagatgatgaagaaggggaagaagaaaagtatccagacttgagacactcgttgtttgaggcagaaggttcggtgatagagatggtgaagcactccaaggaggacaatggagaagagtttcggttggaagacgagatcgacaaagtggctgatctttttattacccgcttccatagacagatgtggttacagaagcaactgtctctcgagagtccagatacaccctccccaattcattcttaatatacatgtatttgacgctcctccttgttttttgtttcggggtgaaggactcaatgatccatacagatttttgttttacgtagtgaaaaatatgaaaacaggacatatttattaatttcttctatcaatctgtacctaacaacgtccgttcttccttcaagctccttgacgaaataaaatacagttttttttcttcatgttattgttgtttgtgtgattaattgagcacttggcgaccattaattcttcgtttccatggaacagcatacacggactcatatctttacgaattgtgcaggcctgttttcaagttcattaaagcctattaaggcccatttactgatataataattaattcagggtccgtcgaaaatagatatttaattcaggggccgttcttttgttccgtttaacgacatcgtttcgtctttcccctccttctcccgttctccggtcctcatgcctgccggaatcagctggttagtagaactctctctctcgctgggatggacttgctagttgctaaggatttttttcttctttttgatgatgattggttgataattctagctggtttctctgaataatctagttttatatgtacatctttatattcagtttaaaatttttgcggattaatttagagttatctgtttagttgaggggacaagggtttatctttaaattttgttattgatgtttttgtatgcttataaacttgtaatggttttggttctcgataatgtgcttgaacagtattgctctctgtgtttctgtccatggtgaatcgcacatgcttcttcaagtcatgtgatgatgtctctgttgtagccatcctcttgaaacttgaacctttttggtttgttttttgccaaatctatctttactgagttattattccaattatcaggtcggtttggactctcaatggagagtgtggaagcttccaagcaaatatggtggtatctggtgtcaaatagtgtttctttattatcttctgcccatagatcttaaacgtaaaagcatccaaagatgcattaattaacgataacatg

SEQ ID NO: 32506 - DNA, 3003 bp, Unknown
  misc_feature (1)..( 3003): 2750-1469P.txt file - cDNA_ID_3057985; gDNA_ID_1620300; Annot_ID_152583
aagtgtatactcgtttggtatagctacttttgcaattgtgaccacgagttactctgacaggcacattatattcgcagcagtgctgtaaaagatgcaagtaaaacataattatatgtcaagaacgatgaggtgtatgaactaaaagactagcttaatgagcacaacaagaagagtagggagagctagaaaaaaaaattacattcttaataagcataaagaaataaaacatacctttagcgccaaattccctcgttctaaaagttgatcctttatctgacgtttattaccagttaagttatgccctccctgtccagtgtaagtcactgtatctgcattgtctagatcatcctcgtactggcccgacataacaatagaaacagcaagcggtaatttgtagttactatactcctatagtgggaagaaaaaagtcagatttatgagtaaataaatgaaaaatgaaacgaaatatcttatattttgggatcaaatacaataacaaaaagacaagttgtattactttttcgtattccattgacatataatcaatgccatttagccaatggttatggaatcctacagcacacatttcagctcttgaaaaaaaacggtgtccaacgtctatacctgcaagccaatgtgatcagaagtcagaacataataatgaaaacttttctgtaaaaatcttaagaccaaagcttatgctggcttggaattaaaatttagggaaagaaacaaagttgtaaaagcacaactaccaaccaacctggaaggtcaccgattatttttcttgggtacaatatcgccttagcttttatcatctggaaattttcttaaaggcttaagtcaacttgcattgaagattacagaatagacaaaccatcatatttacaagaacacaaagtataatgatacatgttgcttaacaaaacattgtgacatcttccatttcttgatagacaaaacaatgttgcatgaggcaactaaggccagaggtaagaaaaatcatgacttgcctcagttacacccttcaaatcaggcctgctcaacttagcctacaataaaaaagaggatcaaaacaggtcaacaacacagcaaaaacgaaatttattatcagcattgctagagcctagagacaaaaaaaggaaaaaccacaaacctggacacagaggagatattgcttgttaaataacctcagacactttgtcactttgagatgaggttccaagttcacgtccttaccattcagagaaacactcaatttctgctttcctttctgcattgcggttagctttggagggcttcttcgtttagggctcccatcgacattttcctcttctttctcatgtaactcagtgtcatcgacacaaatttcactctttctgtcactgaggagcttaaccctctcctgtactaaacgcgccttctcatctaacgctttctgtctcactttctgaacccgaacactcgatcttcgctctgtttggtcaggagcattagctcgtttcctttttccagccatcgatcactctttttcccctgaaaacaaaaccctcgaaattccaacaaaagggttccacaaatcgagacacgaacggaacagtattacgaggaaatgggcaaatattgagaggttagagagacagacgtacctggaaaagctagcggagaagaagagacggaaggagactaagcagcgcgagattgaaactgtgaagacgacgaagatgagagttttttttttctcctcttttttttggtataattaattctttttttatttcaaggaggaaagtagacacgaaataaatgtttgtcctctttctttcccggcgatttcaacttttcggtttccctcctaaataattctgtcggatcaatggatgggctttctaaggcccaatttatttaaagaaatattaaccatgttgaaatcaaatcagagatttttccctgagaaatcagatcacttatctgtgaaagatctgcggtatttccggaaattcaaaaggaaacagattttaactacaaaagttgcctattccatggtttttcaaaactaaaatgatacacaaatttaaggaggattagtgagagtttgagttttttaaagacttaacagattctaatcaaagatttttatagattctaatcaaagatttttctatggaatctcggttgaaattttttttgttcaagaattatgtaccactcactgccagtgtgtgaagagaaagaagagatttgaccagctgctgtctgtacgttgaccttgaaatcgttatcgcaaagcccatctttctcccaaaggcccatccttttactcttttattttccttttatttttggatattcaaggaaatctcaaaagaaaaaaagaaaaaaacaaatcggttaagttcggttcggtacggtgggaggaacaaataagggtaggaaaatcgaaaccgaggcagtggtccatggggagcgaagcagcagggtgtttgacggctacttaacggagcccaacaaaaaaatcctcttttgccttatcttcctcctcccaaacaaaatctctcctcttctcttctcttctcttctctgcggtcgtcttgtctccaggtatactctcccttgcttctctactttaggttttctccaatcgccaccaatttcatcatccctctcttcttcaatcattaaattggacttgggtttcttactttatcgcattgcttactccccctgattgtatctcctcctcctcgatctctctctcgggttttggtttgtcagatagaaacaaaagattggatatttcagacacaatcgatcaaagaataaactattcgtcgctctcttctcaatcagccgtaaaagtaagtactttgattcctgaatcagatgttgttacttcatttttttcaatttggacccttatgcataaatttcaattctttgcatcgcttgttacaatttttcacattggtttttctttttcttctctgtggacgactcagaatg

SEQ ID NO: 32507 - DNA, 3000 bp, Unknown
  misc_feature (1)..( 3000): 2750-1469P.txt file - cDNA_ID_3058036; gDNA_ID_1620301; Annot_ID_152622
gacacgaggtgattggctcatatcatggctattaaggttttgaagtagtgtgggaggacacactgagtttcaaagatgattaaagtgttcaagattagacttcaagcaaatgcacatgcttagtttggatatagaatatgggcttacgtatctatagatgggcttaagttgggtttcatgtgacggtctcatgtatggatatatatatatgaggcatgtttgccctaatgtgaatcagagagttttccctatcgttttcctcgtttataattgcatttttcatcgttactattcgttaaatattttaatttttttaattaaaatatctttgcagttatgtcttcttacaaagtgtcttttctccatatttatttgtattttccttatcacaattatttctttctaaaaattaaatattttacaaatatttgtgtcaatttaattgtttatatcttctgaactctatatactttgtttaccaaatattcaatcttctgacaattgtttttttaaagatgattgatggtccaagattaaacccgacccggacagtgaacccgactaccttctcgattattgggtcatcgggttaaccaggttggaccataagtcaattaattaaaatttatttaataaatttaatattaataagattttagagttcttataaattaaaaaataaaaataatcatgtttataaaatataaaatcagattatgtttaataaaatataaaatcatttataccaaaaaataataataaaaaaaataaataatatatatatatataatcaaacaataataataaagtgattaaattttttaaatccaactaaacgtctaataccataacaaatatagtagtagatcaccaatgacggaaataaactagtaaaacatcgtgaatttacacaactaatatcgggtgtctcactcaccattcgtttcatttttaaggcggcattgtaaagtcttcgtcaaaatgtaaaccataaaatgagtttacgaactgaaaagatttctaaaaatgattgaataaagtctaaaatctcatattatattccaaaataaagagaatattttaaaacccacacccgaccggttcaccggatcataggttaatagtgagtttttgtgggtttttttgattttgaacttgtcgggttttagcactaaacctaaatcagaaaaatgtttgggtcacggttcaaccggtcggaccgagtgtgaaaacactgaccactgggtttttctatttaaaaataagttgagagttttaaaatggataagtctaaacttgagggttttttcattaaaatttatttttctaaaataacaacaacaatttataatattcatcattttgagtttgatttattgtttgagaaatattgtataaacaaatttaaaatatttttcttcatgaaatcgcgagaaaagatatgtttgagttttattaataataaaaataatcagatcatgtttaacaaaatataaagtctaacaataataagaaagtgattaaaatttataaatctaactaaaacacggtaaaaaaatactaagatagtaggatagtgaatacgaagaacttaaaaaagttttgaaataattcaataatgaacagtgaatacactaaaactctatctttttgtccaaaatcaaatatatatatttttaaacgaatacccgaccagtttaccagatcacaagttagtgccaaatttttgtggatttttgcgctttttaaattgtcggatattaacagtaaactcaaacccgataaatatctgtaacactggttaaccagtaggattggacgtgcagattttttttttctttttttgaatgaatgaccaatgctgaagctttacggtttggttgcaaaccagagttgcagtccatctctcatggaggttgaacccatttgaagatatatatagaagccgattccgaactgtccggtcaatcacttgaattattaccgatgcagagatgggaagctcaccatgtcttcttcgatttctttccgtccaaattgaatggactgtcgctttaaatatacgtagcgtaaaatgaattgatgcgtcttcgagaactgagaagtggagacaatacttagcaaagcagagtaatccaaagtaaaatcttgcatgagaattcgcttggcaagatgttcccagatttgagccgagaatgtgcagctgaaaaacaaatgatcccttgtctcaaatggaacttgacaaaacacacatgttggattgagattcgatgaccaagagcacatttgatcacatgtcacgttgaagttggttttatgtttctaaaaataatgccaaacaataaatgctcgaaactgaagtccacctacaagttttacgagtaggtttgtcatatcataaaaaacaaaatctacgctgtcgatgagatgcaatcatgcaaggtcgttttaaaataatcgtttgtttgtggaagacgtactttaggtagtctttgaataattatttcacaactagtttatattttcacaaatttaatatttaatcttgcaaccagcagcctcatatataacaatataaatatacattttagaaaaatggccaaaacttgtatatatgaaaaaagccaagtccatcgctaaacttactgatcagcatagcagtctgttcatcttcagaggtcagctcttttctctttccctcataagcatgcttacttcttattcgcaccaatgttttaaccttaaataagatcttatcgaaatctattatttatgtgaacgtaatgagcatagttttagatatcctcttacagtagttccgtttctgcaattggtgatcttaaatattgtgttggttcttcgcttgacaatatgttttgtttttttaatattcccaatttaattaaggaacacatgtggatattgatgcagattattgtactaggaaacacaagaaccacttcatatccagctgaatattgataacatcagttcaagatg

SEQ ID NO: 32508 - DNA, 3000 bp, Unknown
  misc_feature (1)..( 3000): 2750-1469P.txt file - cDNA_ID_3058040; gDNA_ID_1620301; Annot_ID_152621
actaggcaaaaacgttgtaggctttgtcaagtttttgtactacaaaaacgctcgtgttgtcatcggagatgatcatggcaacaagaccctttcatctgatctcctagaggtcactgattcaatttccataatttaaagttctagatttctatcgtacttggtcaacttattatcattctcgatgtattttttttttcttgttttgcagttcttgttggatccgtttgaacatatcatatcagtggagggtacttatgatgatacatctggaggtataaccatgcttaggttcgagaccaacttacaaaaatctccatactttggatttggtacaacatcaaacttcttgcttcacaaggataatcaccagatcgttggattccatggaaaatccagtaacatgcttcatcaacttggggtccacgttatacccaacggttttaaatttatttaataacgttctcttactttttcttttaataagtcatgttttaatgacatcacatcttcaactatcacaatataattttcttctcctaacatttaagctctgatacttctcagcaagtgttgattttcttacccaaaatgcaaaaacacattgtcccaaattcgtcttacggtttggttccataatttacatttatgagctaaatctatatacacacatacatgtagaaattttggcaatgcgtgttatacatagagctgtcaattgggcaggacgtccatgggcttgcccagtccaaatgcatatgggcggcctatattccggactaaaaaaaaatggtctaattgggcatattaccagttttgtccatggacaatatgggcttgaccgtatgaacaatgggctgcccatgggcatgaattgagtcaatagacatgtcttcattttaatcatatttttataattttaattacaattacaactaaataattttcaaattatatattttacattataagtttctatttttatgaaaattttaaattttaataaattatttcttattaaattatttacggttttgaaggaaaaatagtattccacaattttttggaatacgcaaattttcgattacggttttgacgggaaaaatacaattctccgattttataattttgacggaaaaacgcaattctctaattttacggttttcacggaaaaacgcaattctctaattttacggttttggcgggaaaacgcaattccataatttttccgccaaaatcgtgattttattgtattggtaagaaaaacacaattttaccgttttgtcggaaaaatgcaagtctccgatttttacaatttttgcggaaaaatacaatttttgaatttttctttaaaatcatgatttttgatttatcaataataacaataataaaatgggctgatcattatggacatggtctttattgggcatggacattttcagaccattgtccattatggaccgtccaacttggcccataaaaaaaactgtctgtacggacacgcccaatgatctttggacggaccatttgacagctctatttatacagtaaaaagtaattttcgtacgtttctacttagaaaatttagtgttactgttttaatataattccaaacattgtttttttccatatttggaagcatcttctactttttagaccacatcaaccaactgcatttcagaatactgataacaagtggttagattgatagaaaaaaacaaaaataaaaaaaaacaattgcaagattgctcatttaatttttcaatcttggcgatggcaatttctcacataataataaacaaataaagtaataaactataaagagttggaaaaaaaaagcaatgtataatccatttctattttattaatccggcaggcgtaaattattgtctcgccccatgacataaccgatcaacaaagactaggaggtaatggtccatgagatatactttataaaatatgagtatatgactctgatttggtctaaaattgcatgataaaaaataattatatttttgttggcaaaaatcaaaattgttattgcgtatatttaaaaaagctatagaagttttaatatactttttagtcttattttttttaaacttttattgtgtaatatattgttaatgtttctaattaaaattattaagaaaaattctcgcaataaagcgtaaaaaacaaaaaaaatcgcaatgttttttttatatatatacaagatagaatatataacttttttgattttagtaaaaaaaatttgtaaaataaaaagttaaatgttttttaatatagaaacgacccctgttttaattggagtctaggtctaaaaaatctattctattatgtcgatagaaaaatgttcgggttgaaatattacttttgtttgttaagttttacgagtaggtttgtcatcataaaaaacaaagtctacgctgtcgatgagatgcaatcatgcaaggtcgtcttaaataatcgtttgtttgtggaagacgtacttttggtcgtctttgaataattatttaacaattagtttatattttcacaaatttaatatttaatcttgcaaccagcagcctcatatataataatatcaatatccatttttgaaaaatgaccaaaacttgtatatatgaaaaacacaagtccatcgctaaacttacggaagtctgttcatcttcagaggtcagcccttttctctctctcccataagcatgcttactctttattcgcactaatgttttaactttaaccttaagtgagatcttatcaaatctatcactgtaaacgtaatgagctatatatttaaagttgtagaaatttaaatatccctttatgttaactaatccatggtagtataatcaattggtttttcttccttctagtttagatattgtgttggttcttcccaacttaaggaacacatgcatgtggtactgatgcagattactgaataggaaaaacaatacaccttcatacccagctgaagattgatattagttcaagatg

SEQ ID NO: 32509 - DNA, 3003 bp, Unknown
  misc_feature (1)..( 3003): 2750-1469P.txt file - cDNA_ID_3058044; gDNA_ID_1620301; Annot_ID_152619
ccacccatatacacgaagacgattgagaacagaatgtatggtgcagtttggtaatatcacatgggaaagattagtgaaacttacagttcctccaactgtaggatctgctgtatgcagaaagctcatgaaatttccagagactcctccgagaatgtaaatgagacaaaacgtgaataatccatagtcacggcagacttttggtccaaaagtaagcagagcccaggagctaagggctacatgaggaattccagagtgctgcagatgtaaaatggaagtgtttcattgacgaaaaggggatattacatgaaaccaagtcatcaagagtgctaaatgtgacatgcaaaaagatgcaacggaatgaggaactaaagcaatatatacttatgatattaacaatgttgttgtcaggtatttaaaatctctagctgttttggtcaagtgtgtttttaaaacagtaaagaatgggaacacagacccaatttgttggtcttgtaccagaaacatgggtgtgaccagcctccaccattctccagcaaggattagatcatttatctttgctccatataacaaagggagtgataagagtcccatattgttgttcctaactggcgctgccgcctcaaacaagcagacaccaacattgatggatgctaatatgctcctgcaattttaatggagagaaatatatttctaagcatcaataagaagaacatgtgtggcattgcatctaaaacgaacaagaagtgattaagagtttttacacagcatagaagttcaatgtatcttctgcttgatcttcatcatcaaactgctggaaaggactattattgttttcaataccagtctttctcaatttgcttgctactgaaccgccttctgattttaccacgtccaaggtggacgagactaaacctttagattttgcatctgacaaacagcaaaataagtgaacattaacaagaggaaaaagccagaaaaatcaagcaacaagacaccaaaaacaagaatacctttttggagtttgtcaagataagcactcaaagaatccaactcttcattcacattgagttcagctttgcgatcaatatcatctcctgttgagatagaaggcttctcatcatcgttttgaagtttcccaaagtaagaatccaacagtttaagtctctgtttggtaatcttgttctctgatgacgctctaactaaacataaccttcttcttggtgaacgacaatacgggattgatttcatataactcttcatcctacaatccctgccaagcgtggttgcttcagccattgttctatgtttcagaccagacgaaaaacgtcttaaaccatttgaatcaaacaatacttctcctttacaagggacttcatggtgaagaggaaacagtgccatcttcaggtcctgtccatttcagagaaacatgtcatcatcaaatctcatcattcaccaccaaaccccaaagaagattatacaaaaacatgtgaatgattttgataaaaacacaaactttagagacgcacttaacaagttagtcctaagataatcaaagaagctatttgggattaaacccatttcacaaccgaaaagaacaaacagagatacgattcacgaaaagctttaaattaagtaatctcattgaggcatttaaccaaacaacaaaagggcataacgttttcaagaatccaataacgaaacgagtatcaaaatcacttctttgaagtgagacatttgtcttcttcctcaccgtttgcgtgagacttttcaatttacgaagtacagagacgagtatcaacacaattgggaagaagaattagaatttgagaaagtgataagattttacctttgaacgaagaaacctgatcctaatcttgaagattgaagatttgtggttgcgaggattaggaaaaattggagttcgaataacgaagcagtgacttgtgaaaattacgtttaggaacagaacataaagcgactaaggaaacaatattttttatttaatggttcaaatttcgtcgtgttggatattttattgttgacaaaacaaaagaagagatattttattcttgaacattactgactcacaagtacaactcaagaattgaccattttatttgctttttcttttctgtttttgatcaaattggtttgctttttctaatttaatgttctgatgaatatgaatagcataaatatttttttttgactaagggcttgactcgtttaaacgcagcggatacggttgttgttgcgagagtttgctttatccctgtgatttaatttataaacttcaaatctaccaatattttagtatgcaaaatgttattgtgcaacatacaataatatgatggtacgaaccttttgggaagtggatggaaaaaatacagactaacaataaatttaggatggtacgaagttgtatgctcaattacatattactagtgaaattttttaatctatattaatgcatattagtccgcaatagtgaatgatgaattaaatacggactgattcgatttcagtcagatttgcatcatactacacaactatttatattttagatttggttaaccaacttataaaaactttaaatactacacaaccatttgttttttagatttggttaaccaacttataaaaacttaatttatataatcttgttggtttttgttaattttcacatagttgtccaattgttcccacacatctcagtattgatatccatcttcttatcttcgttaaccacctaccaaatgtcacgtggacgctccatttcggtttctatccggattcgcggtggattctcctcccaccccaatcatcggttcatttcagcatttggttatatccaaattattttaaccggtttataccgaaactactcgaaccagacaatctttgattggtagaaagagagccacgtaggattatctcttctaatggcaaattaaccaaaaacgtaactgaagatcaaaagagaaagagagaaaaaagacgatg

SEQ ID NO: 32510 - DNA, 3003 bp, Unknown
  misc_feature (1)..( 3003): 2750-1469P.txt file - cDNA_ID_3058048; gDNA_ID_1620318; Annot_ID_153248
gggagactaatctccctcattctaccaaaaaattaagggaaatattttttcttaaatttgttgatatgataattatggtctacataatatcgtgttttaaatcaatatataataaatgttggttaaaacaagagcaataacataattttggtgaaatttcttgggaaggtaagaggaaaacttccttgatagcatggaagtatgtaaattaggaaatttcaacaaagccttacttgtgaaacaattcggccggatcgtacatttatcgaagctagttacttccttgtaaaaagttttttatgtagtgatggtggttgtagacctttgtatacttggaatagtgttctctattgatgagatctcttgaaaagtggcataataagcaatattggacaaatctactagggtttggcttgataaatggcttatggatgaacaaccaaggagacccactaagaaataaattttatttattattaaacttaaggttgctaatttgttgaatgagagaggtgttaatttctcccaaatgatgttaatcaagtcttattgatttatcttaattcaaacaagaaagatttttcgttttggcgattcaataaaactggagctgaaatcaaaattctttctagggatataaagagtttgttggattcatctcttgaaaaattctttaaaagcaaatcagggaactagacgaagattttagcggaagtagctcaaaaagcaaaagcatccatgaaaattgctatggtagatgaatcacgaaaagctgaaaaagctctgatcgctagtaaatagtaataatagattgagtctagttgatcagaagaaacttgcacaagttatcaaggtggtggtcgaaatggaggatgaactcgaggagaaggttcaaaaagtcgagaagataaacagaaaggtagatgagaagatgaagaagaaggcaaagaagagacatttttcgtttttggtttgttgaatgttgattcgtcttcagctatcatatcatgtcggtgttagacttaaaataagtgtttaccaataacttatacaagagaggttctacaccgtttaccaagagaatcaaagaatgcaaagtttgtaacttttgtttgtggtttaaaagaacaccacaatcattgttgaatgcataacatatttcaaccagataaggagttaaagaacttttatatggatctaatacttaaccactaatactaaaaattgatcttgaagcaacataggagatttgagtagttagaacatatctagcaaattctgatctattgtgaaaagaataactagagacggatgacttaatttctatatagcatttggagggtcataatgacttgtttttatttacgtgttttacgttattttgtttttgtcaaaaggctttcataaattagtaatactctataaataaataaacacaataaaatactctttcttatcgatttaggtatggccaatgtaaaaaactaaaaattaacaaaattttgaaacttctatacatttttatggttctagtaatattataaatttatacatatatagctaagataatattctaaatatgactataatattgtttgtaatttgaattattgttagcgttattctctaatgttacttattattcaaaaactcttcggtgttttcgatttgtatccaaattttatgataaattctaaacacgataattaatttacaaaaataaagtacttatttgagtacccttaaatttatgtttacttgacttcccagttcccagccagtataaatctttttcttatatttaaattaattaattaactttggatatagaattgaattattaggaaaatatatacatatcaatcaaaaatataatatttataagcttaatacaaacatagaaatatctatatctatatatatctagcttaattaattggatagtaaaagcttatctttgcatttttattattttaattaattacttgtatatatatattattttaaatacttattagcatattgacatttaagatacaaggtttaaatttcttttgttattttgaacagaagttttgttaatcagtaaaataaaattattgtaaataaaagaaaagattttgtgcaaaacaaactccaaagtcgtttatttttgtaactttatctttcacgtttaaaaatacaaaacaaaattatgaagtaaaaataatacgtaatgtagtcgattttacaactttacatctattgtaaacgttttcacgatcacatatatttgtttttaaaagttttaaagatatagttgaactcctcatctcaagggctttgatttgataaattatctatctaaattttaaaattatttatcaaaattttaaaatttgacaatagcaaaaaatttgacatatgtataatttttgatttagtattattattctgcattgttaagatgtaaaatgtaaagttgtaaaaagtaaatgattccgaggattttgtgtaaaaaaccttaaaatgttttagagtttcttgcactaaaaggataacttttactttttttccaaaccccaaagtctgatttacctgtgagttaacaacaattactactctctttgagtaaaaatcgcatgccaaaaagattatagaaaatataataccgaagaaaattccaaatatacaagcagtaaattaagttgattttgggaatagtctacaatcccatgtacacatctccactacattccatacaccttttttaatctaacggctcacaaacaataaaactctccgaataagtaatcaccacgtgatttatcttgacacaccaaagtttgtatagacgtgcatgtatgtaattaattaaccttttatgtactatgaattaactgtgttgatatataaagggtgactcaataccccaaaagcggtctctctctatactttgcttctctctctaaacttctctctttctttttttctcaaagcttttttccttctccctaaacgatg

SEQ ID NO: 32511 - DNA, 3003 bp, Unknown
  misc_feature (1)..( 3003): 2750-1469P.txt file - cDNA_ID_3058083; gDNA_ID_1620302; Annot_ID_152682
ccttcaaagttttatttaactctcttcattgtcaaatccttcatctttactactttttcaatatctccccattatgtataaatttaatgcatcaagtactacaactattccacatgtgcattgataaatcaacctcaaaatagaggtaaaagagagagagaaccacttttttgaaaggagtggaattgttctcgtatcacgagattacataaacgtgagtcgtccaaactactagattcgaataaaccaaccaaatcacaaattgtttcttttaaaataatgaaacatgatgtgaaaacacaactcgtagcctatttgatattgttttcgttcatgttttgtcgacgtagacccatatatcttagtaggttttgaaataaaccaaactgagccccaactaaagctactaaaccacggtcgatagaaccaaaccgacgtaaattcaaagctataaactcaaaccgaattataaaatatgaagttatgtttgattttgatatttttctcactgaatcaaacctaaacttaaaccaaaatggcgaaatctgaaaacccaatgtaaatgcagactccctatggtcgattaattttgttgttgcagaattctttagaagtatgatgtgacatcaccttgactaatgctaatgtcatcacttaatgtaaagaacgtactaatatttagcaacgattttaaaaataataagcatctcaatacttaagattatctcaagtaaaactaataatccaaagccatgatgattcatatgaagcccactgcccaccaaggcaagccaaatgtcgatctctctcgctaccagcaaccaccgcacttgcctcgtccatgtcacttccacaaccataaatttttttggtgccactcgaaataaaataaaaatataaaatttatcaaaatcattaacgatttaaagcaaaattctaactttaataagataaagctacaatccggagatggtgaaaaaactttaatccatattcacattgtaagtttttctatggaaaatcacttcttctttttttccacgcggtttcaaaggttaatcataaaaagagtagaagttaaaggaacttttttgtatctattatagtttgtttttatatgtattgtgaccacaaacacatatatctacatatttattttatatataaagagatagataatctaactgagaaatccacttgaagctattcaacaatttttatagctttcttcctctccaaaaccacaccaaaaaaaaaaaaaaaaaatttgattttcagatccaatcaaccagagatgagagataacaacaataacaacacaagagaagaagagagaagcagttcttcaaagcagcaacaaccacaagctcctatgtctttgaagatcatagattcatgtctcagactaagtgtggttcctctcagtgttgcaaccatctggttaactgtcactaaccacgaatccaacccggactacggcaatttagagtacaactccatcatgggtctcaagtaaacatatactctttactttctttcaactttttagtaagtattttataattattaattaattagttataatttgtaggtatatggttggtgtgagtgccatatctgctatttatgctctgctctctactgtttcttcatgggtcacatgtttagtctccaaagcttggctcttctttattcctgaccaggttttttaaaattatcttctcaatcatttatcaaatatctagtatgcaatttcttatgttagttaataatgtttttatatttttttgggtgtatgaaggttttagcttatgtgatgacaacatcagtagcaggagcaacagagatagtgtatctacttaacaaaggagacaaaatagtgacatggagtgaaatgtgttcttcttatccacattattgttcaaaactcacaattgctttgggacttcatgtctttgttcttttctttttcttatttctctctgtcatttctgcttatagagcttttagtccctttgatcctccttgtgattctcaaaccaataatgatgcttaaattagtcagttttggattcaactttatcaaaatgttgcagcagtttatggtgttttaactttcttctcaaaatattacaaaatatttttttttatgccgccaactgttgttgtaggcaccatactcctacaaagaacaagcgggttaggcagccgtttagaaataccaatttattttatgttttttaaggctaccaaattattattttactttttaatgttaatatataggtgtatcttaaaatttttgtttaataaattttttaacacaaattttgcatgattttaaactaattttgaataagggatagaaagagcgctacaaaaaaaatcttgactcggaccatcatttttgttggaccggcacatcctgtagatgtataaataacttattttgcggaaaaaaatagatgtttacatgattttacctaaatactaccatttatgtaaatctataaatatcagtttatagcaagttataaatccttacatggattaacaggtgtacaaaattttacaaaataataaatacaaaagcattgaaatagtgtttttaaccaaaagaaaaaaaagatactgtaatctatagaaagaatcaaagtgaagttgcagaaataaagaccaaatcaaatgaataatttattaaattgataaggtggcaaccaacaaatatattgcacttaatatagtaaaaaatcatacattgctgtcagtgagtagtaaaccaagtagtcacccatatataaatttcttgaaaatatgaaactcctaatcctacatgacttaaaccttttttagataatttcattatcaaatggctattctttcaattcacccttatatctttgcacaacaatagagagagaaaaagaagttcaaaaaaaacataagatctaattaagagaggtttttggtctagttcctctggttcataccacaccaaccatg

SEQ ID NO: 32512 - DNA, 3000 bp, Unknown
  misc_feature (1)..( 3000): 2750-1469P.txt file - cDNA_ID_3058091; gDNA_ID_1620302; Annot_ID_152675
aatgggcctacacggatatgagagttgcgcgtccattatacgcaaagaaaatagataattattctctgcgtctcacaccagttattctaaacgtgaaaccttccccacttggtcactaattcgaacttatccatccacgtgtctagaaaataatagatctacggctaagatttagccgccataaaaagaagatctatggtaaaaaaaaaaggtctataaatacaaaaccttccttaagctttcttcttcatcaattgaattaacaaaaactccaaagactccatcgaacaaaaccttcaggtacgatttgttctttcttttgtagatttgatcgtttcgttgtttgttgttctctgtttgattgattgctctctagttttaattcgatttagggttttgaagctttctctttgttcgttgtttcgttttcgaatcggattggtatgattttgcgttctgtttttcttatcttatggttttgatgtgtgatttggatataatctctgcataaactatcgaatctcatattaaagcgaattgatttacttgattgttatggttttgagaagtttgatctaaattttggattgtctcctctcaaatcattttattggtcagctttagggtttggattgagattgaattcgaatatatccatgatccagtaattgatctatatagggacttttcgtatgttataatctagttatatgttgaacatcatgatgacatgatctatttggttaagtcatgctctgttcttgattaattgttgttgataaagactagatttgtttattgttgattggagtctaaaacttgggttttctcaatttgttttgcagagagaatcaaacagcttaagggcagtttcttagttaaaagtaaccaagtttacatggttgagctagacattcagattccatcagcatacgatccatttgcagaagctaaagattcagatgcaccaggagctaaagagaacattcacattcgaatccagcagaggaatgggaaaaagagcttgacgactgttcaagggcttaagaaagagtacagctacgagaggattctcaaggatttgaagaaagatttctgctgcaacggtaacgttgtgcaggacaaagaactaggcaagatcatccagcttcaaggtgatcaaaggaagaaagtgtctcagttcttggtccaaactgggattgctaagaaggatcagatcaagatccacggtttctaaactgaacccgaattggatcgtttgatatatctatactatttatgcgaataattggtgtggtgtggtgtgtttgtgaccattacaagtttttaaagctttggttttgttattgacttttgcaatgataagaaatatttcgattgttctaatttctgaagctcttcctttgattacttgcaaaagaaggaaataagattcctgaaacgaaatagaatggttagaaaaagctgataatttgatggatcaagggatgagataagaagctagagcattcaatcaaatgtactttgagaaattgaatgtcgtccactatatttggaataaatctgaaatatgattttgtttattgtatggttggaaatgtatgaaagtaacgaacgtatcagagaacagataaacaataattttgcaattagactcagaatatttatcaaccaatctcaagttaaaccgaaatttgtatatataccaatactaagttagtacatttttctagttacccaactttttttctttgcaaaaattaagtccaaggttgaatgggctttaaagtagtatctttgggctaatccaaaagaagaaggattacattacttcgctaatggcctgataaatcaaagatctttgcatagcagacacgtggttttcacgtgacctctaaaaaagaagaagtaactgatcacagaagcataataaaaaagcaagaaggaaatatctttaagcaaagatattatctaaaagcccaaacaaaaacaaaccattaatttaacaaaacagagaaagtgttataaccaaacaaatccacaattttttttgctgtaattaaaatatttttggccctctcaaatgtttttgtcttttttcgcattagccctttattgactcgttgttaaatgccacaagaagaaagctgaagaaagggagacgaaaaattcgcaggtctgtgttttttctctctgtcttctatgtctctgtgttttacaccgaaattgacggaaaaagtttaaagcttttgtttcctgtgtcgtgctttgttttggttattttgggtaataatactgtgtgtttcttcactcgattttttttttgaaatccgagattttttgttttttctggggttgtctatgtgatttgattctagggctactgagagattgctaattttgtttcttgtgtgtgttgattagtggtttgattttgagttaatttgtaattaggagtcttgattttaagggtttagaaatggttgcatgttcttttggattactggatcttatctgctttaatcccaggtttttagtagaaatgtgaataaaattacagtttcattattcagtttttttcttggattgtgaaagttatttgtaaaaaaaaaaagtttacatttttgaaacttgttttggttttggttaaagattttgtttatagaacatctgagatttttaacttctcgttactgtgatgatctttggtgttgtactgtcaattgtgtgtattgacgattttcacctgtgttttatatttactgtctcagaggaactatagccaacactagtcactgcaatatcgagcttggagaaatggagaaggaaagccatgaggagaacaaccacactatctcaggtgatttaacggcaaaacggaaacgaggtcgtccgaggaaacaattgaagctggaatcgaatgagcactctcttggtcattctccaagttttagcaggagtcagcagcagtctcgccagaggaatgacgatgaagctatg

SEQ ID NO: 32513 - DNA, 3003 bp, Unknown
  misc_feature (1)..( 3003): 2750-1469P.txt file - cDNA_ID_3058099; gDNA_ID_1620302; Annot_ID_152672
aatgtggtgcttgttgatcatggaagcttggaaattgctgaaagtttgaatctttctcaacatttgagtgaaatttcttatcgggattcgcgggttagggataagataggttcttatgaagaagatttgataaaaatctgtatgaagaaacatggtgtcatcagcaatgtctcacactctttgatgcttgaaaccaatgtgaaggttcttagttttgatcatatattggcttctcctgcagccatggatgtcttggcaaaaggttttatggtaacaaagttttcagaaggaaagcaagagtttgagctcgaggttcctcctggatcagctttgttgttcccgagcgaagaatcggtaaagatcaattatcttaaagagaaagaagagttaaaagtaaggaatctgattgttcttgatgggacttggtcgaaggctagaagaatataccttgagaatccatggctaaagcttttacgttgccatgtgaagctagaaatagaaggtacaagtttatacaaagaagtacgacggcagccaagagcgggatgtttatccacgatagagagtattgtatacgcgatgaaggagatcggtgaagatcctgaaggtttagataatatgttgaatgtttttgaatccatggttgaagatcaacgaagatgtaaagatgagaactttaacaagattatctgaaagacaaaattactctgctgttgtaacttgtaagctgaatgaattagattcttcaattttgataattatgccgaaagttggagtcgtttttggcaatttattaaaacaattgaagatataaatgttggggtgtgaacaagaaaaattcatagttctgggccaatatgtaaattaggaaatataagttttgttgagtaagacttttgttaattttgaactcagagtgtgttttcgtttccgaatgctttcaattcgcagaagcttaactctagcaaaagagccaaaagatttgtttttgtttttgtgtaatctccgagctcgatgtgtatctacagatgactatgatccaccattttcgcctctctctaaacccactaaacctccaaaagagaagaagaagcagaagacgaagaagcaagaccagtcgtcggagctggtaaatgacctgaagattccagtgatttcagacctccctttcgattttaggtattcgtattcagaaactaacccggaaattgaaccgattggattccgtgaaccgaaacggttctctccatttggaccgggtcgattggaccggaaatggactgggactaccgcactggcgtcgccggagattgatcagagtcaatgggtggaggagagagcaagagttctcggcgagactttgacagaggatgaagttacagagcttattgaacggtatcggcatagtgactgtacacgacagattaatctcggtacaattttgaatcttttgcctaagttttttagctttgaaattagtttgcttgatcaaatcgaatcgtcttcaaagttaagagctttcgtcatcgttgatgttgcagattcactagtggtagaaacttctttgtgttgacatcacttgtagatttgtggtcttgatgatgatcatgttgtgatataatcaaattatgtgattggtctcttcttataaactttgtgatgttatcagggaaaggtggtgtgactcacaatatgatagatgatattcataaccattggaagaaagctgaggcagtgaggatcaaatgcttgggagtaccaactcttgacatggacaacatatgtttccacctcgaggtgtctattattagatctccagaacacggctctgtttttctttcggttgatcttactatagttgtgttcttgataggaaaaatccggtggaaagattgtatacagaaacataaacattctagttttgtaccggggaaggaattatgatccgaagagtcgtcccatcattccactcatgttatggaagcctcatccgccaatatacccaagacttgtaaagaatgtggctgatgggttagaatttgaagagaccaaggagatgagaaatcgtgggcttcattctcctgccttaatgaaacttagtaagtagtatatacatcgtcaagttctttgtcatttttctagtatttcctcgtttttgattggcggattgtattgtgattcagctaggaatggtgtttatgttaatgtcgttggaagagtgagggaagagtttgaaacagaagagattgtgagactagattgcactcatgttgggatgagtgactgcaaacgaattggtgtgaaactaaaggtataataaactgtaaatggtttgcttgtcttatattgtctgtcagattctctagaattgatctatcttgatgctgtgatcaaaattgcaggagatggttccatgtgttcccatattgttcaaagatgagcagatcatactctggagagggaagaggactggtgaagaagagcttgttactctatgaatctttgatctagaatcatgatcatgtgagtgatgtgacctgaacaaatccaactgtagaccaaaacttcttcatcgatacaacagatactaaagtttcacatgtctcagaagtagtcatagatacaacaatcttggttgatttgtatattcgattatgtacttcggtttgatttattgaactaaaattggatcagtccaaaattgttctttatgaaattgactaattttattttatttttttgattaagttcataatttgatttttagagtaatccaatttactgttctgttgtcatcattcttaccttagaacactaaccatgttcaattactcaatatcatggcccggttcaaaaccaaaccggtcaatggtagaacaactaatgggctgatataaaaattgggcctataaaaaagcctacaactgtatatcataactataaaaatgctttattttcgaagcgaaagtttaggttttggtttttttgtccgtcgtagtgatg

SEQ ID NO: 32514 - DNA, 3003 bp, Unknown
  misc_feature (1)..( 3003): 2750-1469P.txt file - cDNA_ID_3058107; gDNA_ID_1620302; Annot_ID_152667
atcaaatctaaatgaataagtaacttttttataccaaaaagtagaaaaccaaacaaatgcaccactggcttccaaattggggtatatgcgaaacgatttagtagcttaagtttctaacttagcaaatttgaagcagaaaagaggaactgagagttccatgataaaaccaattgtgaaatgagtcatttcaaatgagagctgagaattagatgttgcaaagctcttcacaagcacaatctagaggaacaaaccaattgtgtactgcatcatcataactaaagtctttggcgttcactttcaagccatatccagcgtataaatgtaaaagaaaagaaaaaatcaaatcaaagcaccaagatcaaactctaaccatacttataagctgagaaagaaaaacatcaaagctagttatagatactagacatgacacatttgaataagtgcttaaagcacatcattatcataccactggttctcttaactaatatcaaatgtttggtattacgtgtatctatcagattgattgaaatagaaggttgaaacataaagcaaggtaatgtctctcagaaacgattccacgttattatcaaaatcaatctctatcaatcaaaagcaagaggcaatcacaacaaaaggaggaaaagaaaacctacgcactagtgatttgaagtaaaacaaacatgagaacgacatttttgtgattctaatccttgaccagtcacattcaacagcgaagaaacaagtcccagaaaaaataggccaaattcacataaagaacaaacacaaattcccttaattaaaaagcaacctagctaataatctcgatagatcaccaaaccatggattcgcacaaagaaagcttaccgatttataatggatcaagtgatcagaagaaagctaaacccttttcaaatttcaaaacttttagaactccaccatgtaattgatctaattggattaaggaacagcattgaacatttaggtctacaagaggggaaaataaaaatcaaaactttggtcttttgattggttttgaaatctgagtttccttgttggggcgtgatgaattaagcagcgactagtcaacgttccttgtttacagtgtagagtagattgctccaatcatttttattggactcggaggtaataatgtttcactttttttacgaacaggaagaaaaatatgcaaattatactgaaagccctaaacttttgagtttatcacatttttaacctaaagttatcagttgtatcaaaatgatgtagttatattgaaactctcttcaccagttagaggctttaaagacttgccgacaaaatgtagaagtaggtgtatatctccggccatttcagtaactagttctgttcttggatgtcgtgtgttttgtctaagggagaagcgagaagagattaaaagattagaccttttcgcattcatggattcgaagttgagaaattttgtgatgggtctgtttgtgatgactgcgatcttgaataattctggtgttggcgcgtggactggagagattcgtggtagagttgtgtgtgatgtctgtgctgattcttcaattggaccagaagatcatgttcttgaaggttagtatctctgtccctcttctttatgtcttctctttagtcagttttagatgttcgattgctgggaagaagaacaattgtctgattttgagaaattctttggatttaactgtgtagaactctggattcacttttaagtagtgcttcttcagaaagagtgttgctttgctaatgttctgatggatttcttcagagtgattactgttcaattcagtagtagttgtttctcactcatcaaattggtgtgaatttcttcagagtagtttattagcccgaagcttgttggtactgtttgttcttatttcttgagcaaatggtgcatatcttggtgagtgtgtgtctacagtttttgcagattcttatttttcttttttaataacataaatcaaagttagaggggattttgtttagtatcatctctggtctctctgcgacataaaaatctgttatgttcattttccttatgtttttagctgcgcttttgtatatatcctatagtgtcaaatgttttttgcagattatgttatacttctatgcgaaatcttttcaagttttctgattcatatttggttctctgaattccatgaatcaaatttaggagagcttatggcttggatcatctcttgtctctccggaacttagtaattagtttgttcatccttgtgtttccagctagttttatgtattatccgatagtgttaatgatttttccacactgcttcatattccaaatagtcttgttgataactcaaaaccgggattgcttagaagccactcggttttatgtgtttaccattctgctagtgaaatgatctctttggcacttttaaccgtgttatgtgatccagtcacttcatatcattgacgtatcaatcacatttgcgagctgttattgttcaatctttacaggagctgaggttgcggttctgtgcataaccaaatctggagaagttgtgaactaccaagctttcacaaactcaaaaggtgtctacacagttgcagagacaatgccagagagcgaacgttgggacgcttgccttgcaagacccatcagcagcttccacacaccttgcaatcgcctacaccaaaccaataccggaatcaaattcacttataaccgcccttccggtttctttcatgccgtgaaaccatttgtgtatcgacctcaatatgcaccttcttattgctgattcaaagacaccttgtaaaagtccttgtaagttgtaatactaactagtttggatttgtgaaatgctaatatggatcaagcttaaagtgttttgatgtaaggataagagaagtttgtttatataaaagtctttagtcaaaagtcaaagggagactagtctcacaaggcggtgacgggggaggtaaagaacaattaattttgaatgggtcctacagatg

SEQ ID NO: 32515 - DNA, 3003 bp, Unknown
  misc_feature (1)..( 3003): 2750-1469P.txt file - cDNA_ID_3058122; gDNA_ID_1620302; Annot_ID_152657
ttaaaataatcaaatacaggtcaatgctttgtatatttacaattattattttttattttttttggggtcacatatcatttttctttttttaacaactggggtctacatatcatacggttagaggtattaacgtagctcaccggtctcgtgaaaaaagaaaatagctttcactatcactctttccgcgattagtaatcgtaaatttttttgttttaagtacccaaacttacaaaattacctccttttctcttaagacactgagttcttgaggatatactttgtacataatgtaaatctcatatgtttttattttctctaagtcttctgaattaggccaaaaaaaaaagagaaacttagaaattccaaatcgacacgtatagcaatataccgccccgggaaaatgaaatgcacatgctgatgctatgacatattgacatgcgcatgtgagtcaccaaagattctcaagttgttaagctaaatatgattatgagagcggttaaggccaatgattaggaattaggatgctaagccgtatccaacagaaacaaatctttaatatttagctgtttcctaataattgtctatcttttgtccttttactcttgaaaatggttaattatgatactacttcatacgtattttagatataatattgttaatttacgattacaaaagtgttgaaaaaggactagtttaatggttttttctcataatattcttgttagtgatatataaaagttgttgtattagaacaatttgtatcaagaaattattaaatttataagttaaattctctcttatatgaagcaattatttccgacaagacatgcatatgatgctccaacctagaacgaaagctcataattaactgcggttaaatcataacacgtactctagtatattaaacaagaattgacatgtagcttttaggaagtataattacaatcatgtacacagtactaatgtatattgaattttctacagtgttttttttcgggttaagagaatcaaactgtattagactctgaaatggttgatgcagaacaaaaaacaaatttgtgggcttaatgggcttcgaccgggcaagttatatataacatgtaccgacaattgagttgagttcaattgtagcatgtacactaaacacattcgaaacttgattctgcccatatttaaataaaatgtatatacaataataagtagcatgtaatatatagataaaatctactctatataaaaaataaagtttttttggaagagatttttttatatacttaattacatgccatgaaattaaaatattttggtaaagagaaaattatttaaaattatttacatcaaaatttacatttattaatttcatactacaagccttaagatagctcataacttcatatcataaacctacagtaattcaacaaaataaacttttcatagtaacaaactaggtaaaaattaactttatggtaacaaatgatttcataatccattgatatcaattgtcttaattacattccaagataatcaaaaataaattatttacgaatcagttgatcaatgataaaaacatctaataatatgatatatgttttaaaaacgcttaaaaatcatgttatttattatataacacataaaatcaaaacttactcaattcagaatttgtacacaaaaccacattatttttacaaataaacctctagaagttgacaatttagcacaaatactaaatcaatagtgttggtctctcccaatatatacgcgcatatatacacttatatactccttagttcttatataattctctttctctctataaagtataaacaattgcgaaacctaaattacttaaaatctctctctcatttgaattcttcttagtgtttagattccaggtcaaactgtgatccatcatctttgctgctagactaaatttttttctctgatcgagttaaaaagttttggactttctaattttttaattcgacgaaaaaacctctccaacaatggttttatcggcgaagcaaaccccctctttgaagatatacatacagtaataagtagcatgtaatatatagataaaaccacactatatatcaaaaataaatatatttttggaagttttttttatatacttaattacatgccatgaaagtaaaatattcacgctaaagagaaaattgtttaaaattatttacgtcaaattacatttattaattccctactataagccttaatatagttcataacttcatatcataacctatattaattcagcaaaacaaaccttttatagtaacaaactaggtaaaaattaaatttatggtaacaaatgatttcatagtcaattgatatcaattgtcttaattacatttcaagataatcaaaaataatttatttatgaatcagttgatcaatgataaaaacatttactaattaatatgatatatcatatatgttttaaaaacactacaaaatcaaaactgactcaattcataatttgtacacaaaaccacattacttttacaaataaacctctaaaagttggcaatttagtacatatactttttgttttttctaataacattttcttttctaaaacataaaaccaaaaataccaactgaaagtaaaccaaaacctatttgcaagtacataattctttaacaaaaagtaccgaatttgttttattttgtcaacaagcttaacgaattaaaaaataaattaatagtgttgttctctcccagtatatacgcgcatatatacacacttatatactcaaaagtttttatataaatttttttctctctataaaatataaaccattgtaaaacctaaattacttaaaaagatctctctcatttgaattcttcttattgtttagattccaggtcaaactgtgatccattatctttgctactaaactaagttcttttctctgatcgaatcaaaaagttttcaactttctaaatttttttagttctaaggaaaaaacctctccgagaatg

SEQ ID NO: 32516 - DNA, 3000 bp, Unknown; identical to SEQ ID NO: 640
  misc_feature (1)..( 3000): 2750-1469P.txt file - cDNA_ID_3058128; gDNA_ID_1620302; Annot_ID_152654

SEQ ID NO: 32517 - DNA, 2846 bp, Unknown; identical to SEQ ID NO: 642
  misc_feature (1)..( 2846): 2750-1469P.txt file - cDNA_ID_3058132; gDNA_ID_1620302; Annot_ID_152652

SEQ ID NO: 32518 - DNA, 1085 bp, Unknown; identical to SEQ ID NO: 630
  misc_feature (1)..( 1085): 2750-1469P.txt file - cDNA_ID_3058135; gDNA_ID_1620302; Annot_ID_152651

SEQ ID NO: 32519 - DNA, 3003 bp, Unknown
  misc_feature (1)..( 3003): 2750-1469P.txt file - cDNA_ID_3058173; gDNA_ID_1620303; Annot_ID_152712
agagtgatccgtaaggacgacgaaaacttctttcaatttttaaagtatttctatatcattttggtaaattccaccaaaaattcacaactcttataaatcattttgttgttgctccatttattgttttgtatcaatcaagtatttggatgttttataactacaacctagaactaatatctacacaactaatttacaactacaacgctaacaaaacagattcataagtacaactgtgagacagatttagtagaggtttgattcttaataatctaaaataaatgtgatattgtaattttgaaggatgatgtgtacaatgaatataatgatccatattctaaaacatattcaaataagtttattctaaatactttgtacatatatttaccttggtacgatgcatgaggaggagggagtttccatctttatccatgaggatgagttcctcgggtcgggttcgggcataattatcgacccggtaaatcaaatctccattcgaatctatcaccgtgaatccttcacaactcaccagaagcgattttctccacaccgtgagtgtcgtacacgctcctccaatatctgcggcagcgacggagactgtggactctgtagatgacggtgcatcttcaccgtggaccgacctcgaccgttgcttcaagaaagggaacatttttgtagttttggtgttcttggttaactattttaagagagttttacagatctaattaatctcaattctcaatacaaatatggtaaggttaggtatacatatgagatatatatatatagatctaatatatatgtgtgtggatgaaagatattagctttgttatattatatcattgtcttattatattataatttttttcttctttatatcaacttgcaaagtttttaaatatcgctacttgatatttaaatgcgaccacaaataatacttagtgacaaaactgtactattctacaaaatataaaaataagaatttcacctaaaaagctttaaacgttttattaattatgagtcaaaatttttagtgttatttgaaaaataatacaatatgataagatattataccattctataagttaattagaattttttttaagttaatgaatacaggtcattagatttttttttatcacattacaaatacaaatttaacgtacgtaacatttacatttagtggactagaactcaaatcaccctattacagcttgcatatatagtaaattgtttttgttttataagtccaaaaggattagtctaaattacattgtttggttatcaaagaaattaaaataaaaaattagataaaattaatcgaaaatgaaaacttaacatgaaggttgaaatctccaaattatttactcatcctttttaccaaactcaaatatgatatttttttctatacgtaaaactcaaaattgtatatacaagaaatttagctatctaaaaataactatataataagccattatagtaagccacaattttgaccatctacgatcttttcttttgtacgtagtaaggtttggtgcaaacttttgcaagtaattagtatatagctcttatggatatggtatattcctgatatgaactctgattgggtaatgattagcacttagcaaggtagtcagatttttggctttggcacgcatgggtttcactgtttcaggattgaattggaatttttttttgattaattaatgtataatattttatacaatataaaaatatattactgtattaggtaagaactttacgacaaaaaaaaaaaaataggtaagaactttaagattatgcaagggtcttaaaacgagccacgtaatcttcttagacccacgatagtagatttttgaggtctccaagaatctcttatcctttttgtcatcgaatctctctctctttctgaagatatattaagaaacaaatctctctttttcttcgaaaaggttggttaggtgaaggacaattctcatccacacgattagatgcataaaattatatatataagaagaaaatctaattatatgaaatggtggaatttcatgtcacactagacgacgaatcttccatattaaactcacttctaacactgcatgtgtatgtaattatgtatatgaatgaatatccaaatagaataatatatttggactaatcaaattattggaaaagtacataaataaataagtgagctttcattgtcaaacctgattttgttgatctctgggtttgccattactccaaaaaatcttaccttcaagagtgatgtcgacacagtggagcacacgtgttgtaacacgtgtcatgactcagctcaaaattggatcccacggaagaagttagatctcgaggccaagagaccagagtcatcaattcaaaccccacgtgcgtgagagtcactgactattctcctcttatcttccgggtcttcgaaatccaatatctccaaaacgcagcgtcttggttaatttttgagatgtcaatatatataatctgtgaccttgtaatgtttaatcaacaggtgtatgatcatctttcatctaggagcattttcattctatcaacatattctcataacaattttactatgcctaacaattttttatttttactatgaaatggatcagtaataaatgggccttaatactgtaccaacaatcccataaatgggcccaatgctggatcctatccgccgacatctaacgttccactaacggagacgttatcgggaatattcacattaattaacgaccgttagttccacgccaaatatgttacatctgctacaaaataaatagtttgattttccaccgtggacggttacctactcgaggcccagacccgaatcaaacggactggattaaatgttttaaatcaaggggtgggattaaatctgaagcacacgcttttattcgtcacagtctcctcccacactcttcaatcagtaaagagttttaggtttttttttcttcttctcggaggtttgtagaatcaacaaaaatg

SEQ ID NO: 32520 - DNA, 3000 bp, Unknown; identical to SEQ ID NO: 643
  misc_feature (1)..( 3000): 2750-1469P.txt file - cDNA_ID_3058193; gDNA_ID_1620303; Annot_ID_152701

SEQ ID NO: 32521 - DNA, 3003 bp, Unknown
  misc_feature (1)..( 3003): 2750-1469P.txt file - cDNA_ID_3058227; gDNA_ID_1620304; Annot_ID_152767
agcacatcttacaggccctctggaaccaagagtttccatatgtgcagcgatcgcacaaccagtaaggaccaccatagttgtcgtacgactccgcctgtacctcgggcaaaccttctcgtaaagtcttgatgaaatgataaaagaagttcccaatgttggttgtctcgctcaatagcttaccgcaagtaagctctttggcttctgtttcctcctttatactctgtgagaaactatggacaatgccagacgcgttttgttggaggaatcgcaggtactctctcttcgccatatcatactctgtgtggatatagtcgtacgcacagctccatttgaggaactgtctgcactgaacaatgagcatcagtccttcccttagtaccttaacgtcttgctccttcaagtcactaggtttcttgattatggattcctcgaaagcttctagctcgtatttagcgttcaccagattcacttgactcgcattccagagatccaaacacgaaatccccggttttgctctgttccaatgattgaaaccaacattgctcgaacgcgccggtgccaaacaggatcctgaggttccgtgagtttccggtgaccgaaaacacttccaacagaaacgaccgctgaatcaagaaaacacacaaattagtatgatcaaataattaagatagagaaatctaataatctgcgaatagcaaaaaacagtgttattttcataagagtgaaacctgcagacacaagtcaagaactgggcccatggtcgttcaccatcaatctccacaggaataaagcaatgagggcaaggcttggtattggcatcaatccaggagacggtcgatggcttgtctacttcttctatcaatttctccaagtctctagacaaccaatcagaagcgttgttgcaggtcactggtctgtgtgactcaagcatgcatctccaacagaagatatgaccacagagacacacaatgtttaagctatgctcttcatcttcacttgccagatgaaactcaatcacgtaattgcaaccccgtgcaggacacagtttgagcttccatcccaggtatttctcacggtaagatttcagaatatacaactcgtacatcgcttgatcacgtacggttagcttctcaaccgtctccggtccaacagcagctcgacaatctcgatcaggacaagagattgcagtgtggtttttctccacagagaagaaatttttcttaagatacttgctccaacaagctttgcagaacttgtgagaacaaaaaggcgtggagatcaaatcaccatcaacaacaacagcatcaccatcataatcgtcatcaccaatattagagcagatcccacaatatacacgagataaatcttgattcgaatcaataacaactggtttcaaacctgattcagtcattagtttctccatgtcttcacccaaacgctccaaaacccgattcgagtcccatcggaatcaagattgactccgaaggtaaacagaggaaagctttaacagacgagagttttcttgtatctactgttctagggttttccttttttttttgctttggagatatcgattgcttctctacaaattgtttttttaatcattattaattggaccctaatcattctaaatatttgtgatttatataagattacaacagccaattatggtttacattgattttttttttaaaaagcctataaatagtttttttttattaactcaacattatgattctttattatttatcaatttaataacaaaagttgacaaacaaaaataaatctaaaaaaaaagatctgtactaaatgtgattaaacttgttaagaaatgttactgaaagcaaaaggcaaaccaaatctaaagtcaataaagaaaatatccacctccatgattcaataagccccctaaatggctaaatcaatcaaaaataggaaacaaacatagacccaaaagtatatttaagtaatatatttgactttcagctaattttattatctttggtcaaaaaaaaataaaaaaaaattttgtttatgttttgacttggtgaacactaaatctagtgcatgtggttaccaactcacaaactaataagcaatgcgattggttctttatcatgcaagtgacgtcacaagagttgagtgaagggtataatagtaaaatcagtaagaagaggcaacgccgacgaacccgtggcccgcacgtcgtgagaagagaagagagtctgtgtgagcagaacagagcgaggaaaggcgcgtttgttgcgttttggccccaaaggccaaagcccgccttttgcttttcacctttcgttataaaaagcgtttcctctccttctctttccatttctctctctctcctctctcgctcgctggcttcgaggagaaaaaagaaaaattggagaaataatttaactggttctcggagaatctagggttctttttagccacgccttgctgatctccttcgtgaattcgattccgattctcacctggtacggttttttatatttactcttggttagaattcgcgtcagatctggaatttttgtcatactttttttttctttcgatatcgattcctatgatgacctcttctgtgtcatatttttgtgcattaggcttgatttgtgtgttgttgtttcgccgaattgcttgatctcgtttagttttggtggtcttagacgatttgtggcttagactgtccaatgtggaattgaacagagtttgatgtctagctttagaaatacagtaatctcctaattgttcaggatttggtttaggaattatgagattgtgctatctctggcacgatagaaagggaaaaaactaggtcactagctttgttgaagcggaattgttgagccattattgaatctgtgattattgaggttatctcttcttacggagacttatctggcaggtcttttgtggcctaaagctcataagtttatgctagtgcaagaagttatataggaatgacatattagatttacaatgatg

SEQ ID NO: 32522 - DNA, 3000 bp, Unknown; identical to SEQ ID NO: 659
  misc_feature (1)..( 3000): 2750-1469P.txt file - cDNA_ID_3058231; gDNA_ID_1620304; Annot_ID_152766

SEQ ID NO: 32523 - DNA, 3000 bp, Unknown; identical to SEQ ID NO: 656
  misc_feature (1)..( 3000): 2750-1469P.txt file - cDNA_ID_3058245; gDNA_ID_1620304; Annot_ID_152758

SEQ ID NO: 32524 - DNA, 3003 bp, Unknown
  misc_feature (1)..( 3003): 2750-1469P.txt file - cDNA_ID_3058252; gDNA_ID_1620304; Annot_ID_152756
ataaatgagcttctcttacgagaatatatatatgtaagaatatacatttttagttaattcaaaatttcattcgattatttgtttgaacccaaggtgcacatatgttcccgtaagccgatagtcataacatttgaagcattaacacatttctatgggggaaaaacgttcaatcaaccacataattgtaaacaactaacatttatacaaacgatcgtctgaaaaaaattgattcatataaaatctgataactttagtttatagtatacacactgttttgaaatttgcggatttagattgattcaagttcaaaaaatttgaaaatgtccaaagtcaacatttgaccaagaagtcgagtgttgtttttaatattgatggctaatatgattttaaagcccatacataaaagcccaaatacggcccaataaaggaaaagactcctctgggaagaagaactaaaaaagaaactgggattttggaagaagtggtcgagagaaaacaaacgataatgggaagcgcaccagctcagattccgactagcttcggccatgagcttagggcttgtcttcgttgccgactcgtcaagacctatgaccaggtttttctttactcttctttcactgtttcttccttcttttagggttttggtgtttgatttgcctttctataagctgggtttttttttttttttggttcaaacagtttagagacgctggttgcgagaattgtcctttcttcaagatggaagaggatcatgagcgtatcgtggaggtcactacccctaatttcaatgggtatgtatttcatcaattctaaacctttactttaggcttctttggtaggaaagtctttgcgttgatgggtactgtttcaaattacttcttttagggtttcataagatttacttagctgtatagtaatggaaagttctcaactttagagtgattttgcgtcaggatgcttcgtggtttctaagatctctttgaacttggattctttgttggattagtgatttagcttttaagagtaatttttagaaagttcagtgttagagcttattagtgggtttgtgttctttttgttagttgatatcttgatattcctagctactgatatcaagattgttttgcagtataatctctgtgatggatccaagtagaagctgggcggctaggtggttaagaatcggtatgttgatcgcttcccttaactatcgacttgcttattccatcaatgtgttcttattatcccatcattatactctatttactaaggagattactgttacatttattaacacatctctgtattaaagaacgaccatgagatctccaatgaaagattacattacaagatttgtgtgattctctgtttctagaggcctaaaatctgatataaattggaatgtggctttagatctgaagattttcaagatactttgcctccttgtttggtttattgattgcataatgttgctaaatttgtgcagggaagtttgctcctggttgctacacacttgctgtctcagagccactccctgaggaaatgcaggtaaacgattagcaggacaatattttatcttcgtggtttgaaattgtactcagtaacacattagccttcttcttcaaaattagatcatattttgttcacttgtctgattttgtgtgtttcattcggtggtgatttaatgtagcacttatgccaagaggagcgtgtacaatatgttctgccgaaacgcatgtgaagaaatctatcacgatgaaggctagtagggaagaccaagtattccactttttcattaaaagcttcttgaaacattattaggtgctttatttgaatcttcaatcttgtggaatggtcgatgttaatgaagtcagagactccttaacactcttctatgtaaggcgttagtccgaaaagaaaaaaaaaagaaaaaaaaaatctgtgtctgaacaaaaaagtcttctcttatctaaggtttagactttagttaaccaatcggaccctaactaaaaatattaatgagagtaggaagaataaatttgtgtggactctaaagatcaagacaagacaattataattcttcataaagtcatgcaattaataataataataaaaaaataataattttcttgattaattgctcaaagtgaaagtcaatctaaaatttgttcggtttttcaattctacaatttttatttgaaaatatataaaataaaaaaaaatggttaataaagaattgcttagagtttcctctttttctagaacaaacaaaaatgcttagaccttctcgaaagaatagcacatcacgttatatccaaaagcatattcttttgttagattaatcgtagtcatatggtcataagtcatacataacatgtaacatgttagttcgatcattattaactttcaattaagtattttcgtaagacgtaattttcaacaataaacaacaaatccgcgatatacggtttttgaaagggcaggcaattgtttttttaaattattaatactataaaacaattttcttattggctataaactaatatttaattccacgtggaagttactgttcgtcgatataaaactttcttcgttaccattttgagtctccggcggctttcacactccagaaaaaaaacacagaagctacgtttttcaggtaatatgaaattctctccgatcacctcttcttcgtctggcagtatctctgtctcaaattttgttagatccattcgaaaatccgtttatcgaatcactcttagtctcttaccattcgtcgaatctaaaaatcccgtctttttcgctagtttggtggactgataagctgtgatttgtatgaagaatcgatataaagtctctgcttttttgtgtgggttttgtcgcttctttggtaaaatggatctctctgtgagaaagtgacgatcatgatcttaggtttttgattcttatatcgattgttcatttgcaggactttgattaggtttttggagatttacaaaaatg

SEQ ID NO: 32525 - DNA, 3000 bp, Unknown; identical to SEQ ID NO: 665
  misc_feature (1)..( 3000): 2750-1469P.txt file - cDNA_ID_3058256; gDNA_ID_1620304; Annot_ID_152751

SEQ ID NO: 32526 - DNA, 3003 bp, Unknown
  misc_feature (1)..( 3003): 2750-1469P.txt file - cDNA_ID_3058265; gDNA_ID_1620304; Annot_ID_152747
gagccatagcaccatatgctgtaaaaacagcacatcccagaatggcagattcagagtagggcaaagactctggtagaggagctaaaccatgagctggtgtaacacagtactcagccatccctcccatactatacatatacactggtgaatctgccagaaattaagaaatgtaattaggtaaaacaatcacagttctcctaatatgccacctgatgtttaaaaagtcttcaaatttaccatcatgtcgcaaaaagagacgagtttcgccatcgtaaagagttcccttggctctgttgtaagcaaagaagtcttcacatagatcatcatggccctgtatccaaattaaaatatcagctaaaaagctacagttctcagattagagaatccgatgaaagcaatacaatttcgttctcaccttagcacaataagaacaggttccacaaggcataatgaaagctccaactacacgagacccgattggaaatctgaagaaaagttgagacatttaggatttcttcaaaacatatgattccattagtgtggaggtgaagtaaagttgacaaacctattaatgatcttgtgatcagtaagtggaccatgttcaacaacttcaccagtaatctcatgaccaataacacaaggactagcgaacggtatctctcctttcatcacatgaagatcagagtggcaaactccacaagctgcccacaaacgaaaatgaatactaactttcaaaactcgaatcctacaaattgattcaatcaaatcccagaaaatgaagaagaacctttggttttgatgagaatttcattggatttggggcggggaatatgaaattcttcgatggttagaggcttattgggctcgcgatacacggctccacgcatgaatccgccggggctcacgtgatacccacccatcgattgagaatcatcgccggaggctccggtttggagagacctagtggagagggcagagccaacggcgagtcttgttaaagagaagaggttcttaacggcggaggcgcggcggagaatcggagcaaacgccatgcaaacacgacggacgaatttgatcggagatttgggcaacgaaagagacaggcacttgacacgatagactgaatctgttggacactttgattgaattacacgacgcgcttaatctgaatttacgaaatgagtctgcgcaggtggtattcacgcgccgatattgcgtgcggggatgatttgtatcactttaaggatgtattccttgggtcaacatccacgtgtatatcttatctacgaaattaagatattatatagacaattaggacggaatgctaattgttagttttttatataaaaaattttaaattaaaataaacaaaatttactataaacattctttagtttcaaatttaaaatacgtgaaaaatattaaatttatgacaccataaaatttacagaccaaataaacgtaatgttaagttcggttcgttttctatgtttttaaaactaatgtttacaaaataatagtaaaatcaacatagttttatttatgaattttttaaataaataataataattgttttttaaaattaagtttaagagttattttgtacaaatcatgccgaactttgtatgtcgaaaacttacagattaacgaagacataatgcataaacgcagttatttttcgacgctttttaaattaaacacaaataacatttaaaaataatattaaaattaacataaatggttttgcttaaaaagttaactattttgttaacactaaattgttgattttataaaaacttttaaggtaaatcactattatttttaaaaacgatttaaaatgttaaatcaaatatatattacgtgaaacccatgttgaacttcaaataccaaaacttacagaccaatctttaaagggtaggataaaacattttaaaaaaaaatccaagtgcctaagtatttaattatgtgtaaaccatattaaacctaaaacacttcttaggggtttgaatgttgtatctaattagtttacacaaaaactaaaaatttaacacttaaaaaaaaaaaaaatccggtttgttctcaatgcattgaaatttaacacttaaaattttttaaaaccaaaataatttctatactgaaaacagttagttaaaattttaaaaaacatattttgtataagtaaaaagatagtttacctaataaaaatatttttaaaaaatcataaaaactaatcttagtgttaaatttacttgcgtgaaagcggttgaactaataacacggcttaaggacccgtaggatgggacggcatgcttaatccggtttgttctcaatgtattgaaatttaacacttaaatttttttaaaactaaaataatttatatactaaaaacatttagttaaaaaaaaaacataagtaaaaagctaataaaaaatattttttttaaaatcataaaaactaatcaaatttacttgcgtgaaaagcggttgaactaataacacggcttaaggacccgtaggataggacggcatgcttaatccggtttgttctctatgcattgaaatttaacacttagggggtgttattggtttgggatttaaaaagagttttaatgactttaaaagttatgtagaatatgttgttattcaatcaagactttttaaaactctgttacaatttggtgttattggttgtggatttataaaaagtaatctaaaatttttataaatctagtgttattggattaagagttttatagagtcattaaaagttttgtgttattcaattaaaacaaaagaatcttggattgttgataacttaaaatattatgttattggtttaggattgattgtacataattttcttcataacaaaagtcatgaaaactcccacataaaatagagagattgtggaaagaatgtatcatcaaaaaaaaactctcatcatcattagctcttcgacttttgtgagactctgttacggcgagaattgagaatgaaaacaatg

SEQ ID NO: 32527 - DNA, 3000 bp, Unknown
  misc_feature (1)..( 3000): 2750-1469P.txt file - cDNA_ID_3058267; gDNA_ID_1620304; Annot_ID_152746
gatacaatatctaaatccctaaaatattttggtttttaaaaaatctaagtgttaaatttcaatgcattgagaacaaaccggattaagcatgccgtcccatcctacgggtccgtaagccgtgttattagttcaaccgcttttcacgcaagtaaatttaacactaagattagtttttatgattttttacaaatatttttattaggtaaactatcattttacttatacaaaatatttcttttttaattttaactaaatgtttttagtatataaattattttagttttagaaaaatgtaagtgttaaatttcaatgcattgagaacaaaccgggttaagcatgctgtcccatcctacgggtccttaagccgtgttattagttcaacggctttttacgcaagtaaatttaacactagattattttttatgattttttaaaaatatttttattaggtaaactaccttttttacttatacaaaatgtttttttttttaattttaactaattgtttttagtataaaaattattttggtttaaaaaaaatctaagggggtgttattggtttgtgatttagaatgagttttagtgacttgataaaatctttaaatcaaggattttaaaagattgctaaaaagtttgatattatcttgatgactttttttccaaaatcttgtaaagtcttttaaaacttttttccataatcttgtatacttttaatgactttttcaaaactttccctgcaaaatattttcaaaatattgtccaatttttttttaacgtctagtgaccatcttctatcttttatataacatgttctatgtacgggtgttcaatctagttcaaatatcattttttcaaaaccaatagtggagtttttcatgtttaacagcttttgttcatattcggttttattagtaaagaagatttttcatgttcaagcagaggctccaagcaatctttgttacggaacattacagaagacaagtgacgattcaaaaactgaactccattaccaatcgaagacgaacgagaaggacgtagcacgtttgcattgttttcattctcaattctcgccgtaacagagtctcacaaaagtcgaagagctaatgatgatgagagtttttttttgatgatacattctttccacaatctctctattttatgtgggagttttcatgacttttgttatgaagaaaattatgtacaatcaatcctaaaccaataacataatattttaagttatcaacaatccaagattcttttgttttaattgaataacacaaaacttttaatgactctataaaactcttaatccaataacactagatttataaaaattttagattactttttataaatccacaaccaataacaccaaattgtaacagagttttaaaaagtcttgattgaataacaacatattctacataacttttaaagtcattaaaactctttttaaatcccaaaccaataacaccccctaagtgttaaatttcaatgcatagagaacaaaccggattaagcatgccgtcctatcctacgggtccttaagccgtgttattagttcaaccgcttttcacgcaagtaaatttgattagtttttatgattttaaaaaaaatattttttattagctttttacttatgttttttttttaactaaatgtttttagtatataaattattttagttttaaaaaaatttaagtgttaaatttcaatacattgagaacaaaccggattaagcatgccgtcccatcctacgggtccttaagccgtgttattagttcaaccgctttcacgcaagtaaatttaacactaagattagtttttatgattttttaaaaatatttttattaggtaaactatctttttacttatacaaaatatgttttttaaaattttaactaactgttttcagtatagaaattattttggttttaaaaaattttaagtgttaaatttcaatgcattgagaacaaaccggattttttttttttttaagtgttaaatttttagtttttgtgtaaactaattagatacaacattcaaacccctaagaagtgttttaggtttaatatggtttacacataattaaatacttaggcacttggatttttttttaaaatgttttatcctaccctttaaagattggtctgtaagttttggtatttgaagttcaacatgggtttcacgtaatatatatttgatttaacattttaaatcgtttttaaaaataatagtgatttaccttaaaagtttttataaaatcaacaatttagtgttaacaaaatagttaactttttaagcaaaaccatttatgttaattttaatattatttttaaatgttatttgtgtttaatttaaaaagcgtcgaaaaataactgcgtttatgcattatgtcttcgttaatctgtaagttttcgacatacaaagttcggcatgatttgtacaaaataactcttaaacttaattttaaaaaacaattattattatttatttaaaaaattcataaataaaactatgttgattttactattattttgtaaacattagttttaaaaacatagaaaacgaaccgaacttaacattacgtttatttggtctgtaaattttatggtgtcataaatttaatatttttcacgtattttaaatttgaaactaaagaatgtttatagtaaattttgtttattttaatttaaaattttttatataaaaaactaacaattagcattccgtcctaattgtctatataatatcttaatttcgtagataagatatacacgtggatgttgacccaaggaatacatccttaaagtgatacaaatcatccccgcacgcaatatcggcgcgtgaataccacctgcgcagactcatttcgtaaattcagattaagcgcgtcgtgtaattcaatcaaagtgtccaacagattcagtctatcgtgtcaagtgcctgtctctttcgttgcccaaatctccgatcaaattcgtccgtcgtgtttgcatg

SEQ ID NO: 32528 - DNA, 3000 bp, Unknown
  misc_feature (1)..( 3000): 2750-1469P.txt file - cDNA_ID_3058271; gDNA_ID_1620304; Annot_ID_152744
gcttgtaagttttctggatcacttgattgagtctagaatctagatagattacatgtacggtttgattcctttggctgattttccaaagttttgttcaaatttcaggagaactacaaagaggaaaccaagattgttttgttttgttagactctaccccttttccgattcacatggtaaggacattgaggtagagaataatactaaaaagcaatgggagatgggagttccagtagatccaacagctcaaacagcactagtgagaaaccagagtggctgcaacagtacaatctcgttggtaagattggtgaaggcacttatggtcttgttttcttggctagaaccaagactccgcctaaaagacctattgctatcaagaagtttaagcagtccaaagatggagatggagtttccccgactgctatccgcgagatcatgttgcttagagagatttcccatgagaacgtcgtgaagcttgtgaatgtccacatcaattttgcagacatgtctctgtatcttgcctttgattatgccgagtacgatctctatgaaatcatcaggcaccacagagacaaagtcggccattcgttaaacacatacacagttaagtctttgctctggcagcttctcaacggattgaactatcttcacagtaattggattatacacagagatttgaaaccgtcgaatatcttggttatgggtgatgcagaagagcacggaatagtgaaaatagctgatttcgggctcgcaaggatatatcaagctccgttgaaaccactatcggataacggagttgtggtcacaatctggtaccgagcaccagagctgcttcttggttcgaagcactacacgagcgctgttgatatgtgggcagttgggtgtatattcgcggagttactaactcttaaaccgttgtttcaaggagcagaagcgaaatcgtctcaaaaccctttccagttagatcaacttgacaagatattcaagatcttaggccacccgacgatggataaatggccaacactagttaaccttccacactggcaaaatgatgttcaacacattcaagctcacaaatacgacagtgtgggtctccacaacgtggttcacctgaatcagaaaagtcctgcgtatgatctgttatccaaaatgctggaatatgatcctctaaagcggatcacggcttcacaagcactagaacacgagtatttccgaatggatcctctcccaggacggaacgcatttgtagccagccaaccgatggagaagaatgtgaattacccaactcgtccagtagatacaaacaccgatttcgaaggcacgacaagcatcaatccgcctcaagcagtagcagcaggaaacgtagcagggaacatggcaggagctcatggaatgggcagtagatcgatgccaagaccaatggttgcacataacatgcagaggatgcagcaatctcaaggcatgatggcttataatttcccggcacaggcagggcttaacccgagtgttccgctgcagcagcagcgcgggatggctcaaccgcaccagcagcaacagctaagaaggaaagatcccggaatgggtatgtcaggttacgcacctcctaacaaatccagacgcctctaaaggtaaaatcgagatcatcagtctcgggttagaatctgtgtgtttgccgcagaagaaagcgttgcgatttgctttatagagtagagttagattgtaatgcagcatgtggaatgttgctattcatatggatggattggattctctgtagtttttgtataaacatcctctcaagtatttgttaattatattagatcatcatttctcttaacatcatttctcaaaacgtagtaaataggagatttgccaagtgaaaaatatatataatgagacagttattatgaacacaatttacagttattatgaacacaattttggtgatgtttctactgtttatgaaatttgttttttttttacctgccagtcttatctatttaccaccaacatacattagaatctaatgtaattacatcatcaatcatagacctaatgaatatttaataccacacagtttaaacattgctattaaagtttgaaaagattatactttagtaaaataatgttttcaaacttgtattcaattatactacgtaagcagtgatccaattattacgaacataatacttttccaaatcaaaattttgtttttgttcaccttaccatcagtttcataatagaaatattatatatatacaacacaaacaaatgaatgagaaatgtttttctattattatgacttttatttaagattcaaaagaacgaagaagagttatatatatgcttgtttgtttcaggacaaatacaataaataagtggataagaaaaccacaaaccttgaactagcctgaaatgtgtgaaccaagctatacaaactgtacgtgattctgcatcgtggaagtcacaaacagacttctgacttctgctaaagataaaactcactgtttgcaagcaatttagtataaatatgaagcattgacctaccaagatcgacacaatcacacagtttcttcttaattaaacctagctatttttgtctttagcagaagtcagaaagctagttttgtatttttcttatttcttaaatatatggcggccaatgttatgagacggtttatgatttaaagatacacaatggacccacgacgttgccataatacaattattaggctgttaattaacgtgatcgttacgtttgctacaaactagctagttgtgtcttctttattttagtagataagtataagagtctaaaaatattacaacccaataatggttacattcatggtcgacttagaagatgaaagttgatttcttaaaaaaaaaacacgcacaataaataaaccaccaattcacaaatacaagaaatttaataacctcgagcagttaccctatttaaatcccctctagccttgttttccttctcacacctatgaagcaatg

SEQ ID NO: 32529 - DNA, 3000 bp, Unknown; identical to SEQ ID NO: 668
  misc_feature (1)..( 3000): 2750-1469P.txt file - cDNA_ID_3058275; gDNA_ID_1620304; Annot_ID_152742

SEQ ID NO: 32530 - DNA, 3003 bp, Unknown
  misc_feature (1)..( 3003): 2750-1469P.txt file - cDNA_ID_3058279; gDNA_ID_1620304; Annot_ID_152740
ctactaaatctcaatctccaaggatctttatatattaataagaaaagctactatccaaatgcgaccttgttcgtgaagtgtttggtttataatttggtggcttaagactatagcccaccattgacccaaaaaaagaaaggaaaattaatagtagactatatagctaccaactccctataatttaccttgaaattaaaccagctttgtatttttttaatagaagtcagggctctacagtttcattttaaacttttttttttgttatattacatcctgcaggttagttgtaatttgtaaacgtaatcaacataataaaaccatttacatagactgattaaagttgattccatttgataatatttagctatttatatatcaatcaaccaccagctcttaaatatatgtattcaaattgttttgttgactctttttgctacactttaaatttgaatctagaatgttgtcctgaaacaaaaatctgtggattgaacaaaattatacaccaggtaaaattttgaagtttttaaaagcaggatcacatactcctaattttagattggatagatctagtataaaaatatgaagtttttttcccaaaaaataataataccatttagctcttaattaaatgcatgcaaactaaagataaaaagaggaattattttaaccattctaactcgtcacaacatgcctaatcattccaggttaattttagagttttcaaatcgtcatattaacatgtgatcctgaagactcttctcttctttcttctaccattagctgaaatctttacttgtaccacaattaacctcaaaccctagcccctaaatccccctagaaatcaatccatcctcagttctccaaaaagatatctttggtttttcttcactgacaaaacccctaaaaatggccgactcattcgagctaattgtaacccgaaaagaacctgttctcgtctctccagcctccgaaactccaaaaggtctccattatctctcaaatctcgatcaaaacatcgccatcattgtcaaaacattctactacttcaaatcaaactcaagatccaacgaagaatcctatgaagtcatcaagaagtcactctccgaggttctcgttcactactatcctgccgcagggagactcacgatcagtcctgaaggaaagatcgctgtggattgcaccggagaaggagttgtagtggtggaagctgaggccaattgtgggatagagaagataaagaaggctatatcggagattgatcaaccagagactcttgaaaagttggtttacgacgttcccggtgctcggaatattctcgagattcctccagtggttgttcaggtgaggggttgatcgattgatattatgttttgcttgctgttttgtgtgagtgaacgaacatgacctatactggatttggtccgatattggtttcaaataactatattatatagtagaattagattaatattgattttttaattatgcatgtacgtataaatacgctaattagtaagaaagaaaaagatccatactattattcactacaaaatacataaatttcataacttttaattcaaaagtatttatattggaacatatcctaattgacgtttttccaagattgttgtgtgattgtcgacaaaataaattttggacatactcgtttttttttgggcagtacattcgagtaaatacgattgaagaaatcatgcatttttagttgatcgaatacattgtatacgatgcttccatacaaattttggtttgtttgttaggtgacaaatttcaagtgtggagggttcgtgctaggactaggcatgaaccacaatatgttcgatggtatcgcagccatggagttcctcaactcttgggccgagacggctcgtggccttcctctctccgttccacctttcttggaccgcacacttctccgaccacgaaccccaccaaagatcgaattcccacacaacgagttcgaggacctcgaagacatctccggcaccggaaaactctactccgacgagaaactcgtctacaaatccttcctcttcggacccgaaaaactcgagaggcttaagatcatggcagagacgagatccacgacttttcaaaccctaaccgggtttctgtggagagctcgttgtcaagccttagggcttaaacctgatcaacggatcaagcttctctttgctgcagatggaaggtcgagattcgttccggaacttcctaaaggatattccggtaacgggattgtgttcacttattgcgttacaacggcaggtgaagtgactttaaaccctctttctcattcagtgtgtttggtcaaaagagccgttgaaatggtcaacgacggtttcatgaggtcagcgattgattactttgaggtgactcgagctaggccgagcctaacggcaacacttctgatcacgtcgtgggcaaaactgtcgtttcatactaaggatttcggttggggtgaaccggttgtatctggaccggtcggtttacctgagaaggaagtgattctgtttctgccatgtggtagtgacacgaagagtatcaatgtgctgcttggacttcctggctcggctatgaaagtgttccaagggattatggatatatgaatcattaaaattatttatggtttaatgtttgaatttaaattaactatgatttaaaaagcaaataatgatgatatatcaattacgtgtttgtggtcgtatgaaatattgttcgtcggtggagcaaaaatgtaactaagatgttaaagtatcaagtttaataaagaaagctattgtgtttactaaaatgttgtttggtaagagctcaaatctttgattttcttcttacaatactttttctgacatagagatcaattacaacctacaagtcacaccttacaaaataaacttatcacacatagcaaaaatattatcacgaaaattaaatcgttagaattgtctttttttgatcaacgatttgtctaaattctgaaattttatg

SEQ ID NO: 32531 - DNA, 3003 bp, Unknown
  misc_feature (1)..( 3003): 2750-1469P.txt file - cDNA_ID_3058295; gDNA_ID_1620305; Annot_ID_152805
gctcttaatcttttgttgttgtttctcctaattttcgtatgtcaatcttgttcttggatataaaaaattagtttcaattttaaagaataagaaaaactgttctcgctataacataacttcctaggttagacatactgatgacatgcatatgattttttttttctaccattaaatttggagtttgtcgaatatttttaattcgaaaattcctacaatattctcaattaagccagagtaatcaaccaatgtgcttagtttcatctgaactagtcaacctcttcggtttcatagaaacctaactcccctcgccaattcgatttgcagtcgatttgattgattttataaaatttggttattttaaaagtgtatccccacaaaatctagtggacctttggacatgggacaagcatggtgagttgccactagtaaggttttttatatataatatctcagtgtaaagaataaacatatatatctaaatgtacaatgaccacatacaaattatgtaaatgtaatttaactattgcaaaacgtctttagaaattagattaaagaagagtatgtgaataatctatctaaaaaccaattgtctgaatcattaacgaatacttaggacttggtcaaagttttccaaaacaaattccaccgattgagaaatgtaaacaatttttctgccaccaccactataagagagctaggaaacgcattcaatgccctacgttagtaaggaaaattcaatgtcatgcactgtatcacaaagtcataaacatttaattgaaaccctatacctagctagatagttcttatatacccacccattaccagtttttatttattaatttattatttaatagattgtgatgaccatacctatacctttcatcttttagttttaacttttacctctatgttcgttgtcacactcatcttttaaagtcacattcactttctcgtctcgagttattagtaaattaaatcgaattacgtttcttgagatcatggatattaataaaattgattttgtctcatacaaatttatttgtgaaatcatatgaaaatatagaacgaaaaaataatatagactgcattatacgttcgtctttaaaattaaaaattaagagggcataacgcgttacgcgtgcatacgtagtatttgtatatgtaagattttaatgtataataagctcatgttgcatcttagtatgggcatgcaattgcaagtgtatccataatgtttttaatttgtccgtggagtattgaacatgatctctaatttaaagggatacgttttttatttttgacgaatgaatatcaatttatatagtaaattacacatgacatgaatttttttggatttgatttcgaaccaaataatttcttcaagtatatgtatactaggaataataaatatcttgcatgggatcattatatcaaaggcgacacaacttggaatcgtgatgatactaagctcacacagtcgtaaatcgtaatattaaatacgatcatcatgtacacttgcaccgccaactcatgatcatgtaaaggatacattgagtaatgaacaaaatgcaccaccccgaccacaccaccccacccactataatatattgaaggaaaaggagagaaaaatcaaagcaggtcccacttgataaaatggcactaacgaaatcccaaaaaactcttataaatatacaatttgtataatacaaacacaaatctccaagcaaagaacaatagataaacgaaaaagaaaaaagtaagaaaagaagaggaagaagaggaagaagaggaagaagaggaagaggaacgaatatggggaactgtttagtaatggagaagaaagtgataaagatagtgagagatgatggtaaggtacttgaatatagagaaccaattagtgttcatcacatccttactcaattctctggtcactccatctctcacaacaacactcatctcctgcctgatgctaagcttctctctggccgtctctattatctcctgcctacaacaatgaccaagaagaaggtcaacaagaaagtgacctttgcgaatccggaggtggaaggcgacgaaagattacttagagaagaagaagattctagtgaaagcaacagcaatatcgatggtgatgacaccaagaacgtaactgttgtaagaatgaagatcgttgtgcataagcaagagttggagaagctacttcaaggagggtcggtccatgagatgatgtaccagactcttgagaaacaacttttacttacttcgtctgatgatgatgatcttgaatgtaatagcggctggagacctgcgttagatagcatacccgaatctgaaagtctcagaagaacataacagatagctcatatatactcaaaaaacagtttgagctttgttcaaggaaaaacttgtttttaggttttgtttgtaaataaagctttaagctgttataggaaaagactgtgtgatattgatgataacactaagactttttgagtcaagctttttgttttccaagtaaatttaaatgaaaatttcatccatgtttttccatggattgagaagaactcaataggaaaagtaacaaccatgtattagatttaatataacatgaacaaacatttatatgcacttattatttatcatatgtttcagaaccagccttagtttcttgctcatgtctcttcaaatctcttcatcagtataagattaagttaattttgttcatagtcaacaaagaaactaatgtgttttggtaaagtaacgaccactctatgttgaaccgtttccggtttaagatattctaaccggatgattgagagtcgtaccgattggtttgaatcggttttggattttgctgctctatcgtcgtgggagagagataatcatcaatttttccaggcaaaaagcttcgattttgaaccatataaatcatctcccatggcggaaatcgaagtctttaactaaagaagaagaagaagataaagctttgtaatttatagaatg

SEQ ID NO: 32532 - DNA, 3003 bp, Unknown; identical to SEQ ID NO: 32531
  misc_feature (1)..( 3003): 2750-1469P.txt file - cDNA_ID_3058295; gDNA_ID_2926241; Annot_ID_204082

SEQ ID NO: 32533 - DNA, 3000 bp, Unknown; identical to SEQ ID NO: 671
  misc_feature (1)..( 3000): 2750-1469P.txt file - cDNA_ID_3058301; gDNA_ID_1620305; Annot_ID_152798

SEQ ID NO: 32534 - DNA, 3000 bp, Unknown
  misc_feature (1)..( 3000): 2750-1469P.txt file - cDNA_ID_3058337; gDNA_ID_1620306; Annot_ID_152816
ggttaggatcttgagccgaggcaaacactagcactccgccatatccgttcttcaaatgtgttgcatccacaattaaaactttcctcatcactctaaaaccttcaatgctagctcccaaagctacgaatatgtactgaaatttatcattctcatccaatttcagataagtaactgtaccatcatttaccttcttcaacatgtataaataacaattgatatccttgtagcttttttccgggctaccttttaaatcataaatcgcatgatatttcccccttagcgctgtcgagtatgatactttcacacctaatttcgtctgaactagctccatgataattcttggaaccggagtttccaactgtcccgaaaaatgatcatgaaggagagctgcgactaattgtgggttgcctttttttttcctgagcctactactacctttacttagccgagtgcaactatgcatcttattataccttctaatcgagaatatatcaatattactgatattggacgctcgtaaacgccaagaacagctctctttggcacactttaggacatagcgctccttatccgacttcttaatcacataaccaaaaatggtagcaaatacagctctatccaccacctcgtgcaatgccgccttgtttggaaattcttgacgtaaggtcaacccaattccgtcttcccattctttcttaaacatacccggttctacaacaggtggcgactcaacatactgttcccccctatcagaatcatccatagactcatcatagcgtgtttcatcttcttgagtctcgtgatcctccactattgcctcaagttgatgttgagttccgtgatcctccactattgcctcaagttgatgttgagtcccgtgatcctccactattgcctcaagttgatgttgagttccttgttcctcttctaataagacgatgagtgcaccatcatccactctcatttcatcctcctctgtatagttcttaccaacagaacttttaccaactctagacaattgctcgggcaattgctccggctcgggcggtttagagatctcctccacaaccaaaacacttcttcagttattttttgcggatgttacataaacaaagacatcctcatcatcacaaacgttcatttcttcctctactccgaacaaccgtggattgtacctcatatgcaattttaccttatttgcatctaatccaagcttcgtcattatcctatcttctaacattgagagagtaatcttctcccctaatgtcttcatcatcacattatacatgcgaccttggaatttaaaatatatgatcacgttctctttcattgtaacctgccaaaacaatacacatactcagtcaatattactagtattatcgattctagtacattttcagtaatactattactaattctgaaatattacatgtgtgagtaatactattacatatatgaaatactacgtgtctaagtaatattggtgctattaaaacatactatctatataaattacggtactactatagttagtgcgaccagtattattttcgcgacaagaacaaatattcgatttgagttcaatttagtatgaatcagcatgtgaaatcaattgcttacccattaacagaccaaatgaagcctaaatctatacttaaacttctaatgtaggtgctaaaacacaataatccaaatctaatttgattgaatttcaaaatcctcaaaatatgtaattcaaagcttttgaagctctctccatacctggacttagtagattgatgcagcttgcaggaggagaaaaacgacaatgcggctcgccggaggaagaagcccgaagaagaacgagctcgagctttttttttttttccgtttttttttttttcaaaatgttttctagaaatattaattattcattcaaaataaaatacaggggtaaattcgtcttaacacaattcattaactcaaaggagataggaagactctaaagtggttttgcagattagttgtcccacaaaagggacacaagagatgatcattctaaataatgactaggattcaacctgtgttttattattttgggtgattgttgtatatttagtaggagaatatattttaatgtcgtcaagcatgtgtactatttaataagtttgtatgtaattttaagatagttaaagtagttaaataaatgtgaaaaagtttaagtattcataagttttaggcattaaaatttttcttatactttgttttttttagattaaaaatattttgaacttttttgatatgatttataaaaatcaataatactcaaaaagtaaatgacagaaagattaatgataaaattttaattaagtaaaatattttaaacaaaatgaataggttttttaaatttttattgtaagtaattctacaaaatgtggttaaattaggtgaaaatagaatcttagaaataatatttgtataaatgatgctcattattcatcatgctaaattggagtctttgttaatcagagaagtcagcttatgcagtatatttagaaaaagccaaaaaggctagaaagagataacataaaacaactttcctttgttgttgttataagtaaaacatttacgaaaaatcccggatattcacctagtaaattaataaagtgtgcataagagagtactaaaatgaataaagtatgaaatttactgctaaaccaaaatcacctttccagcgaattgtggtcgttcgaatggaataatccggttaagctataccagagatggatgttaatacggtttactttcttgagaaaaaaagaatttatgcaaagaaaaataaaacttttttgacaaataagatatgtggataatgtgagagataagaaatatcgaaaactatataataaaactactgttgtggataatgtaagagacgatacaaatagcctcataaggcaaaaaacaatggcatcatcatcatcatcacatttgttttgacgctccaagaaaatttgcatg

SEQ ID NO: 32535 - DNA, 2503 bp, Unknown; identical to SEQ ID NO: 686
  misc_feature (1)..( 2503): 2750-1469P.txt file - cDNA_ID_3058356; gDNA_ID_1620307; Annot_ID_152867

SEQ ID NO: 32536 - DNA, 3003 bp, Unknown
  misc_feature (1)..( 3003): 2750-1469P.txt file - cDNA_ID_3058371; gDNA_ID_1620307; Annot_ID_152857
caaagtttttgatttattattttaaaatcacaaaaccatataaagtttaaaaatcttgttaaacttcataaaatccgtctttaaaatttttaatataaaagtttgattcatattattgttctttcttaaaccaacatttcgttgatgaaagatggtcaaatgaattttttgttgtcaagctagagaacacctaaattttttccaattgatattatgtatgttaacacaaaaagagttatctaatacgattagttaatttatggatgattccaagtagaaacgccaacataaactttgactttgaggccgaattgatctgcttcttttatttctcttacaaatttgaaattaaattagtcaagtgtgatgataaaatacataacgtttgtacgcattagtatgttgtgtagcggagagactcttgtttataaaaacaatgtttggtttattctaattgtcattttattctttggatctttagttctcgcttagcgtctcgtgcatatttttcctcaaaatcatcaccattaaatgactcacgtacacaataatcacaacaacatacatatatatcaccatgccaaaatacatctgaaaaaaataaattcctagtcgctacactgtcatattttgattgatatttagactatttagtcattcagataacattgttacgaggaagtatatatacatacgtagcgttgtactactgtaactggttttaaatttatagtattaattttgttgatgttccgattgaaaaagtcattttaggaaagaacgaaaaaatagtttgaaagtgatttttttttaaaaagatataatcctacactgtcatgttttgattgatatttagtcattttgtgtgttaattaacactttattatagacagggttagttattaatttaaatctaaatgttcttgtaaaggcttccacttaattttctaatcaccatctgccgaccaaactactttatcaagtcacagcttttgtggaaaaatttccgttaattcatgagcttttctatttgttcacacttcacacaatcattaaattaaattttgcggctaatgttagaattatcgtacgacaactgatcacacgctacatgttctctagcttaaatttgcaacatatataattgaaacatcactcaaccccacaggctacaacatcccacatttaatcaagaaatcaatcagttcacaattactgatgaaattacgcagcaagtaaccctagctaactaggataaaagaaaacgatcaattctcgggaaaattcagtctctcccgaatcccaaaaacaaaagcatgcatttcgtaataaacaacgcactgattctgtttgattttttctacctttatcctacacaacactagttaaacgacacaaaactcaaaacacgaacacagttacttaatctattccccttattctttctttttgattataatagcatatcggaaaaaaatctacaaacattcaaaaaaacatcatctactcatctatatattcaaaccttggtccattcacatcacgaagtccatcgcctataatcatataacatatccaaaaccctaaaacgcaaacactaagataactatttcttgaaattaataatgtcgtcgagaggattcaacattaaagctagaggattatgtaataacaacaacggaggaggaggaacgggggcgaagtgtggacggtggaatccaacggtggagcaagtgaagcttctgacagatctgttcaaggcgggactgcgaacaccgagcacggaccagattcagaagatctctatggagctgagtttctacggtaagattgagagcaagaacgtgttctattggttccaaaaccataaagctagagagagacaaaagtgccggaaaatctccaccgtcaagtttgatcatcgtcaagatacagatctttctaagcctcgccgagacaacgtacgtcgtcatcaactaccagcgaaaggttaatcaagatctctttctagattgttttataatcacattttacagtatatattatcagtttatcactaagacgctaataatgtgtcttggtttcttataaatatttttgaagtttgtaaagtagaagagaaaatgatagagacgttgcaactcttcccattatcgaaagttgagagagtgagagcaaacgttactgctgcgagccacaacgaatacacacgagagcaagcatatacgacggcgttttctacattctcaacatgtggggctgagatggaacattcgccgttggatctccgattaagctttctatgaacggatttgatattaacgtacaactctagtggtgacgttgctaagaaataaagacatgatgatcacatttatttagatctagctagattttgacaaatttcccttgtaacaatatcaacctaataatatcgttgctacattttttttcattagcttcttctcttcacttattgcctgttctgttctgtggcctacccgtgaaatgagtacttacgatttagggttataacattaccatagtggaagggatgatatttctttttgtatcacatttatgatttacacttttgaaagtctccacaacttaatttgtcattattttattttattttctcctctacaattcatattttcagcactcgtttgaaaaattacttcaaaatatttgataaaataagaaataaaatcctatttaattatccaccgtcttaataaattttcgagaaatgtatattggaaaattgcccaataaatgacgtgatcaggcccatcatattgggcttaacaaaagaaaagcccattatagggaaataaaataaaacgaccatattagaagcaatttagtgcaaagtggtttttcctggagaagaagcaaactctcaagctccgtcgggaaaaaaaggaaaaccagatcggaaagttcacgtttttcaaatcttctccggagaaatcagattacttgattcttcaaacaatg

SEQ ID NO: 32537 - DNA, 3000 bp, Unknown; identical to SEQ ID NO: 681
  misc_feature (1)..( 3000): 2750-1469P.txt file - cDNA_ID_3058377; gDNA_ID_1620307; Annot_ID_152852

SEQ ID NO: 32538 - DNA, 3000 bp, Unknown
  misc_feature (1)..( 3000): 2750-1469P.txt file - cDNA_ID_3058390; gDNA_ID_1620307; Annot_ID_152847
aatggatctttaggtacgcatagacgccatacgttttaaagcgataatgagataacatgtgtacaacagtacaagtatatcttaaggtctccgaagatacttctaaagtatgttataacatacactccgaattttttaaaacttcgaactaatataagttattagtggtttcagaaataattaattaaattggtttcccaccaagattaaaggtgataaactgataatggaatcattagagaatgtgatcgagttaacattttgaccaagtcattttagtttctcccctatattatagctacatataagtaaatgcattaaagctaaaaaaaaaaaaatgcattaaagctaactaggattattgcataatggtgtggtaaacgaaaagcgtgaacgagattgtttcatataacattcaacgttctctaggttttgtgcacttttgaaaattatttatacgatattaaatgatgtcatttttgtaaataggttttacttagatcttagtgtcgtaattttaatactaagtgcatgtgttataaatgattgaagatttgatcttaggtgggggactcactgagattccatagcatataagaagtagaagataaaaaggcaaatcaaacttagagctaagagaggcaagtgttgctaatcactacttctatagctactcctttgcttttttactcctctatgctcttttttccattgaccgattttcctcttcgccttgggtgtataaactaattcatacatttttgttttcaacatatataaattaaatcattcttttctgagtggatgagaaaggtaaatatggtaatagtgataaataaattgaaactataaagcaacagtatttgatactatcgtccaaaggtgtgattaatcaaataaaccccaaatccaaccaaatttgattaagactaagtccaaaaacatatacaatccttcaattcaaatgtatgtatcgacccacctttctatatcatgtccttaaaaagtataccgcgtaaaagtcacatgtaagtacatcaaaactcatcatgaagtactgaacataattggtattatcactaataaattatgaagaggcctaactttattagagaaaagaaatatatcttttaaagaaaagagatgatgggaaactcatgaaatggggactttgggtgagggaaagagagagacatgtgaagtgttcataggcaatttgtggaccaacaaggcacatgctactcttctttcatcaactttttttcttagttttgtgcgaaagataatgttttgtgattatctattttctcataaccatgtttgatcttggtgaaaactaatgatgcaaatgtatatccagtatatgtttttgaatctaacactgactacattcatcgaactatagtttgcaaaatttctataccaatttaaaattttcgtttcactttcatacgacttattttttgtaaggaatcggcaagccaatccgaaatgaagccactggccaagtggtacttccacagtgatcccatcccccatgtactggtttcgagccatgttggtatagggatacttgttgattgatattttttaaaaatataaccattagccgtcgctagacactagtaagaaaaacattagtttcttttaaaatgtttttacaaaatttattctaaatcagtatgataaaataattatgaaacttccaaaaataataattagattcctacactaagtaaagtctcaatttgggcaaatgcaaatgcaatactagaaaaacaattcgaaacgcaaatcagtagagaagaacagctcacaactcctatcctccactgtaactcatgtagagttttgtttgttaatttgaatccatgtccatcaaaactaataagttttctcatttatatataatcaaatcaaaaagaccgaaatcagaaactatttttttttatagagaggtgcttggatgtgtaagatctacaaccaaacaaaaacatgggccaatatacatagattgaaaaatcaacaaggatccaaacaaaatgtaattatggaaccaaaattcttgacctatgattcatcagttcctccatttctctacaataattaatattcaataagaatttcacattaacatccttttaatatattttaattatctgttgatgtcactagtttgttgatgtcatcaacaaaccgatcgataatcaatggattaaaattggttcgatttcttttcacttaagtgtcttttgaagttagctaagtccagttacaatcaaattatcatgacgaaatcagaagttaaaaaaaaaaaaaaatcagaagttaaaagttgaataaataatatttagcatatgcatgtgtgagttctctgcaaccaaatacgaaaacacactaaaccataaacattctggttccaaaaataaacggaataaagctaccggaattacttttttaccagcaaatgatatacaatcccaaattatataaatgattctacatatagtaagaaaatcatgattccattaccatgtgcataaaagttaataatatacatagacaacccacaaattcatctatatttactataattaatttcgtacatgccaaatatgttttagttataatacagaaaaaatataactctttaaggcactaaatcttttaaattatagaattttgctctctgataaatttgaaaatctgtgtgttagagatgtttgaaacaaaatttagaatagtatcgaaaatattttatccttatttaaaaaattcatattttatgaagaagttattattcactgcttactgtattttagaaaattacttataatttagaagaaaaagaaaagaaaagaagaagaatgcaaaagagtataatgatgaaaggtcctactttatgcagaaaccccccgtgtgcccactctccccttctccattaatactctctctccctcatcctctcttcttctctcatcatcatcttcttcttcaatg

SEQ ID NO: 32539 - DNA, 3003 bp, Unknown
  misc_feature (1)..( 3003): 2750-1469P.txt file - cDNA_ID_3058401; gDNA_ID_1620308; Annot_ID_152887
tcactattttatggattacctttcaaaatgtataacgttttttgtaataacgtggattttgctacgaacatgatgaatcaagagtgacgcattttgttgtggaagaaaaagtgagacatgtcactatggagatgggatcaatagttatttaattacataattaaaatataattagaatattatataagtcattaagtaattgttggtagaaaggacaataggggtttaggggtggggtcatgccagtttgggtaaaaaaggattagcagaagagagatcagagagatgccacgtggagcctacggccaatgggagagcgataagcttatcaaagatttcaaagtgcggagggtaaagtgggcgacgttgcttttccacgtgtcaatgtttcattggtaggaaaagttaaaagttagatttccgcttagtcggtatttgggtcccatactgtcttcgcaacttggccctctctcttgcgctcagaaggttttgtcttttaagtttcttcttgattttggttttatcctttgttatttttagtctggtccgtattttctccgtatcttgtttcaaatacattctctcgtaaagaaaccgctttttttggtttagtactgaatgataaaagtattgttttcgtacgaaatttatgtcaaccgccctagttctagaggatcacctagaccatatgcatgggacttggtcgagcttcgatgtggattagcccgagttatcaatagaatactgaaaattggcataattaactttgatttaatggaaatgcgtttttataatatactgaaaatttaacagacatgatgattgatgagtagtaaatttcaaatggtataacaagtttaattgtttttttagtaagttatatatactgaccaagacgtttttgtttgagtcagtgactatcactctttgtttttactcaacttaattccatagatcctggtacttataacgtgtacaatctagaatcacaagcgtttagagatagtgataattagcttggctactttctcagctgtgttgttgcttgatcgaaggtggaaaatgagagtggtcatattgaagttcttgcttagtgctattgttaatagaacggttggagagccggccaagcttatggataatatatttatatatggagaatgagaataacataaagatgagacatggttgaacctaattaatcaaaaaaacaatttacatgaattttttttctttaaaagatttcaatctgtaacatgcatagaaacttgtctcataaccctcgtagtcgtatagcaagcattagttttatgatagagatgtttcggttacgaaagaaaatttaaaccaacttaagtggttgtaaatcacgttgtaatttttatgtttatgtacaatttcaaattacaaatcttcatttttaattataatctttgccactgaaattcacgataatatcactaaggttcgatgcaattcgtcaaacatttcacgtactaaaatttgttcggcgagtgatggagacatagatgtaaatggaaacgtgtactcgtaaattgtgtcatctttcgtggcccataaaattgagatggagttttatcgttttctatatcaaataatgtaaataactgaataaaaaaggttttattataaaaagtaccaaagaaatggaccgtagtcaccatttacatggttacatggttacatggcgcgacacgtagtgtcacttaatgctgcaagtgttttttcctctttgttttttgcctccctgaatattttaaatttggtatataaaatatttctgctgacgagttttagttactctagtttctaaaatggtctagaaaaagttgtgatatataaatataataactcggtaatggctacgtacagagtcagccacgtaacactaaatggatgtgtcatggacccgtattacactccccattatacacggatagcgcatacatgtagtagagaatgataatgtagttttaacctctcaacagggagataaataattatgtatttcgttttctaaagtcatagttaatataagtgataataaataagttttgacttgtttccaaaccacttaacaaaatgatagttatttttctgtccccgaatcattatgaataattttctagtgggaattagctatttcagatttgataaacaaaatttctttctttaatcaatattatgtttaattgtaaaatgtacacacaatccacaactagaaagacgaatccaaaaactaaagaaaataggaaatactcgacctttattttctaacgtcaatccaccacatgatatttgtggtttttagcgtaataattcagttctaacacaccacatgatttgctaagctaccagtactactttctttgttaggccgtgagaaattgaatattccttcctcttattctgcatattctttgtatttgttttgttacctacctcttctagtgtgtagcctacgtaaatatacactcaagttgttttgatgtaaccggttttctccaccgaaaatcgtattgtgaacataagtgttttttagtttttttgtctagttgattacactacatatcaattcatacttattataattacactgattatatataaatgcatgaatgaaaactcgaattcgatatattacgattcgtcaaaaaatgtatatctagtgaattctggtatcaattagaggtctgaatttgttcaatatcgtccacaattccctacctaaaaaattagagctttttggaccaaatccaaaaatggatctaaaaagtgaaaaccaaaatattcctttaagaatctacacagattcgaaccaaaccggattaaaccgaatagtctacggcacgtgtggaaacgcgctgcgtttcaaaaacatttggggtatttttgtaatttttgtaatttttaggatcagggttttaggagaaacccaggaagaagaagaagatcgacatggacttagaacaccaaaccatg

SEQ ID NO: 32540 - DNA, 3000 bp, Unknown; identical to SEQ ID NO: 699
  misc_feature (1)..( 3000): 2750-1469P.txt file - cDNA_ID_3058405; gDNA_ID_1620308; Annot_ID_152896

SEQ ID NO: 32541 - DNA, 3000 bp, Unknown; identical to SEQ ID NO: 703
  misc_feature (1)..( 3000): 2750-1469P.txt file - cDNA_ID_3058409; gDNA_ID_1620308; Annot_ID_152888

SEQ ID NO: 32542 - DNA, 352 bp, Unknown
  misc_feature (1)..( 352): 2750-1469P.txt file - cDNA_ID_3058439; gDNA_ID_1620309; Annot_ID_152932
cctggacatgatattatgtttaagaaaatggccaagactactagcgtgaagccggtttttcgatgaacacatcatcatgtaactctaaatagtaacacaaatattcatgccgagcagttaataacaattatgtagttttaatttcctaattaaaatcttaataaatataataattattaattaagacaaaagataacgaacgatagtgatctgttctatcttcttcctctacgtctctctgctcgaagcttgtgccctttcattattatgtcaacaaccctcctctattgaagatttcttcaatcatcttctccacaacaaaaaaataaccctaatttacacagaaaatatg

SEQ ID NO: 32543 - DNA, 3003 bp, Unknown
  misc_feature (1)..( 3003): 2750-1469P.txt file - cDNA_ID_3058443; gDNA_ID_1620309; Annot_ID_152931
gtgttccaatggatccatacgctcgccgtgtaatcgagcctgttcaattccggaacccgtttctatggaccgcagtgattcgtgggtatgcgatagaaggtaaatttgatgaagctattgctatgtatggatgtatgaggaaagaagagattacgcctgtttctttcactttctctgctcttttgaaagcttgtggaacaatgaaagatttgaatttgggtcgtcagtttcatgcacagacgtttagacttagagggttttgttttgtatacgttgggaatacaatgattgatatgtatgtgaaatgtgaatctattgattgtgcgcgtaaggtgtttgatgaaatgcctgaacgagatgtgatatcgtggactgagcttattgctgcgtatgcgagagttggaaatatggaatgtgcagcggaactgtttgaaagtttgcctacgaaggatatggtggcttggactgctatggttacgggatttgcgcagaatgctaaacctcaggaagctttagagtattttgataggatggagaaatcgggaattcgagctgatgaggttactgtcgccggatatatatcggcttgtgcgcagcttggagcaagtaaatacgctgatcgggctgttcaaattgctcagaaatctgggtattctcctagtgatcacgttgttatcgggtctgctttgatagatatgtactcgaaatgtggaaacgtagaagaggcagttaatgtgtttatgtcgatgaacaacaaaaacgttttcacttatagttcgatgatcctaggtcttgctacgcacgggcgtgctcaagaggctttacatctttttcattacatggtaacacagacagagataaaaccaaatacggttacatttgttggtgcgcttatggcttgcagccactcgggacttgttgaccaaggacgtcaagtatttgattctatgtatcaaacatttggtgttcaaccaacgcgggatcactatacttgtatggtcgatcttcttggccgtacagggcggttacaagaagcccttgagctgattaaaactatgtctgttgagccacacggaggtgtatggggtgcattgctcggtgcctgcaggattcacaacaatccagagatagcagagattgctgcagaacatttgtttgaattggaaccggacattatcggaaactatatattgctctccaatgtctacgcgtcagctggagactggggcggagttttaagagtgcggaaactgattaaagaaaagggtttgaagaagacacccgcggttagttgggttgtagataagaatggtcagatgcataagtttttccctggaaacctgaaccatccaatgtcaaataagattcaagacaagttagaagagcttgtagaaagattaacggtattaggatatcaaccggatttgagctctgtgccatacgacgtgagtgacaatgcgaagaggttgatactgatacagcataccgagaagctagctttagcgttctctttactcactacgaacagagattctacgataacaataatgaagaatttgaggatgtgcctagattgtcacaagtttatgcgtttggcatcagaggtcacagggaaggtaattataatgagggataatatgagattccaccattttaggagtggagattgttcttgtggtgatttttggtgagaatcgaggttgtacacagaccaaatgcaatcttcgaggagacttttcttgtgaatcaagaaaatggctatggagaattgagaaactgggatagttttggtcgaagaattttgaacacatctcgtgaagacttgagagttttaacagaaacgccacggatctgaatcagatcatagctagtgtatttttatgcgacttcgatcttgcttggtcctcatgggcttgggctgtctctataggcccaattatatacgtccttttgtgttagagctaattcgttcttttttgtgttacagctaattcgttcgttttttacgcatagcatatacctaccaaaacgaacgcatgtcttcgctgtagcctgtaattcattttttcactttaacaacttcgaatatgatcaataatacaaacactttcgtgttaatttttttcttcttaaataaacttttctattagtctctttgtattgctatcataagagtataatgtttggtatatattaagactttttggaaatatgatggtccacacaaagaggtatattcgactattcgtagatttgcgagaggatcaaacttttcgtcgtaaaatgtttaccaccgttttatttgtctgaaactgaaaacaacgaacagtgtctatttaattaaccaaaacggcagacacaaatctctgggtggagccgatttctacggaagtcaacaaaacgcaccgtcgctgcagatcactacctcctctttcttccttaacgaaaacgaaaacattgaacagagagcaagaacaaaaaggcacgaaagcaaaagaattctcaaactcctgagaaaaattcgagctccgtgtgattaattaggtaacgtattgctcgatcttcagatgaatttggagttttgctttcttcaagcttattctattttgcgagattttcggagaaatgataaattaattgatgtttttgagtttcttcctgatctcgatgtgttcgaatgtaattagatttgagttgcgatattgagagatctctgttgtttgaattttgaatttggatcttcctgatgtggttttgcttcttcaacgatggggtttatcgttgctttcccaatattttactgagttcttaagcttactcgtaaagtgattatctgctaggtgttcttctgcaattgcttttgattcaatgtcctctttgatgtgaagtaatgcttaatcaattcatattttgcagtttgtgttggtaaacttcaatcagatgagtttgatgatgaaagtttagaagagtgtttttgcttccaaagcaaaataaaaacaaatg

SEQ ID NO: 32544 - DNA, 3003 bp, Unknown
  misc_feature (1)..( 3003): 2750-1469P.txt file - cDNA_ID_3058470; gDNA_ID_1620310; Annot_ID_152961
aatatggataatgttgagtatgttaaatatatagtgacaagttacataaaaaaagcctaaagaaatcaaattggaaaaaatagtaaggtacaatgtatggttatcgaaagcccaagctgtacttccattgatgtaggagatgattaggaacacgtggattatatttgaccaaaaatagtagaaattctatttatatttgttttcttcttttggttttgggtttgattttgtgatttggatagttcggttaaggatggtttgatcaatcaatataaccatactaaaatatgattcagttaactaactatagtaactgtttcttcgttagtaaaatgatacatttattggaatctattgacaaatcttaatgacttattataactggtgataacaaaatctagctattattttgtatccaactacatattttgtataaaatggaaattcgtatatgatatttgtttagtttaaaagtagagtgtatttgttttttcaatgatgatttaatgaaatcaagctcttagttgagatcaaaagacaaataaaacaaaatgtttttttttgttttgtttcttttctatttgagggaaggccatgaattcttatttttgacaaatagttgttctatgcaattaatattgatgtctaatacatatacagcagaataaataaaaacttgctatataaagacgtattatttatagcattctgtggagtataatgtcgaatcctgttctcatttccgattttacatatttatggtactaacgccttcatttatttttccattttcgttagtcaacaacttcagcttttgataacgcctaattgtatcatcaactttagttagttttctcaaataacgtcattttcaaataaagtttttgatttctcttttattatatttatgcaaaaggaaaattataatttcagtattttgcagaacgctgaaatgtataatagaacctattcatgtatttttgtaaaattttaaagattgttttaatactaaaataagtaaatcattaaaaaaattcctagacattggtctctaatataagataaatagatctaaattatgtttggattttaattctaataaaaaggtagccaaaagttatatatacaatatttaaacaattttatttgtttaagatttgaattttatagtatgcgagaatcgcgtaaacttttctcgaatgtaacaaaaaatttcaaatcttctcgacacatgtaatcttttgcgagttagaagatttgattccttattttttgttcgtattcttaaagttagtcacgtttatattatttttcgctttgtaaccgtccctttaaatttttaataaaaattaaaaaaattgctagaaaacaacatttttgtattactcaaatcaaaagtacaaaaataaatttagctagcgtttcacaaaatcaagtaaaataatctccatttgaaactccataatcaagctgtttgatgtattattattacatgtaatgaggagaaagaggggtcgagaaatttaaagtaataataattctcttcttcgtccatggaataaactacgattagtttaaaaagattaataaagatggattaaagaaactatatgttaaacctggaaaatttatttaaaaagacgtttttttagctataagaaaaaaaagaataatacctttatttttacatgttatttacaagtaataattttttttttctctctctctctttgaaggtggcacgagcacccataaccttcagacctatagatacaaatatgtatgtatacgttttttatatataaatattttatataattgatttttcgatcttcttttatctctctctttcgatggaactgagctctttctctctttcctcttcttttctctctctatctctatctctcgtagcttgataagagtttctctcttttgaagatccgtttctctctctctcactgagactattgttgttaggtcaacttgcgatcatggcgatttcgaaggtgacttctttcaaaaaccctaatcctctgtttttttttttattttgctggggggctttgtacggactttcatgggtttttgtagcttttccctcggcttttgcgcaaatgagactttctgggttttttttccagctttttataatttcatcaggtggatcgaattcgtagtttcagcttagatctctctccctcttcattatctggactttccagacttggagttcttcgggattgttttcggtttctgggttttgttttaattgcgagatttaagcttttttcttttttactactgtacttggtttgtggttgaccttttttttccttgaagatctgaatgcgtagatcatacgggatctttgcatttttgttgcttttcgtcagcgttacgattcttttagcttcagtttagttgaaatttgtattttttttgagcttatcttctttttgttgctgcttcatactaagatcaattattgatttgtaatactactgtatctgaagattttcaccataaaaaaaaaattcaggtctgaagctgatttcgaatggtttggagatatccgtagtggttaagcatatggaagtctatgttctgctcttggttgctctgttagggcttcctccatttggaccaacttagctgaatgttgtatgatctctctccttgaagcagcaaataagaagaaggtctggtccttaacttaacatctggttactagaggaaacttcagctattattaggtaaagaaagactgtacagagttgtataacaagtaagcgttagagtggctttgtttgcctcggtgatagaagaaccgactgattcgttgttgtgtgttagctttggagggaatcagatttcgcgagggaaggtgttttagatcaaatctgtgaattttactcaactgaggcttttagtgaaccacgactgtagagttgaccttgaatcctactctgagtaattatattatcagatagatttaggatg

SEQ ID NO: 32545 - DNA, 2402 bp, Unknown
  misc_feature (1)..( 2402): 2750-1469P.txt file - cDNA_ID_3058470; gDNA_ID_2926221; Annot_ID_142406
cttatttttgacaaatagttgttctatgcaattaatattgatgtctaatacatatacagcagaataaataaaaacttgctatataaagacgtattatttatagcattctgtggagtataatgtcgaatcctgttctcatttccgattttacatatttatggtactaacgccttcatttatttttccattttcgttagtcaacaacttcagcttttgataacgcctaattgtatcatcaactttagttagttttctcaaataacgtcattttcaaataaagtttttgatttctcttttattatatttatgcaaaaggaaaattataatttcagtattttgcagaacgctgaaatgtataatagaacctattcatgtatttttgtaaaattttaaagattgttttaatactaaaataagtaaatcattaaaaaaattcctagacattggtctctaatataagataaatagatctaaattatgtttggattttaattctaataaaaaggtagccaaaagttatatatacaatatttaaacaattttatttgtttaagatttgaattttatagtatgcgagaatcgcgtaaacttttctcgaatgtaacaaaaaatttcaaatcttctcgacacatgtaatcttttgcgagttagaagatttgattccttattttttgttcgtattcttaaagttagtcacgtttatattatttttcgctttgtaaccgtccctttaaatttttaataaaaattaaaaaaattgctagaaaacaacatttttgtattactcaaatcaaaagtacaaaaataaatttagctagcgtttcacaaaatcaagtaaaataatctccatttgaaactccataatcaagctgtttgatgtattattattacatgtaatgaggagaaagaggggtcgagaaatttaaagtaataataattctcttcttcgtccatggaataaactacgattagtttaaaaagattaataaagatggattaaagaaactatatgttaaacctggaaaatttatttaaaaagacgtttttttagctataagaaaaaaaagaataatacctttatttttacatgttatttacaagtaataattttttttttctctctctctctttgaaggtggcacgagcacccataaccttcagacctatagatacaaatatgtatgtatacgttttttatatataaatattttatataattgatttttcgatcttcttttatctctctctttcgatggaactgagctctttctctctttcctcttcttttctctctctatctctatctctcgtagcttgataagagtttctctcttttgaagatccgtttctctctctctcactgagactattgttgttaggtcaacttgcgatcatggcgatttcgaaggtgacttctttcaaaaaccctaatcctctgtttttttttttattttgctggggggctttgtacggactttcatgggtttttgtagcttttccctcggcttttgcgcaaatgagactttctgggttttttttccagctttttataatttcatcaggtggatcgaattcgtagtttcagcttagatctctctccctcttcattatctggactttccagacttggagttcttcgggattgttttcggtttctgggttttgttttaattgcgagatttaagcttttttcttttttactactgtacttggtttgtggttgaccttttttttccttgaagatctgaatgcgtagatcatacgggatctttgcatttttgttgcttttcgtcagcgttacgattcttttagcttcagtttagttgaaatttgtattttttttgagcttatcttctttttgttgctgcttcatactaagatcaattattgatttgtaatactactgtatctgaagattttcaccataaaaaaaaaattcaggtctgaagctgatttcgaatggtttggagatatccgtagtggttaagcatatggaagtctatgttctgctcttggttgctctgttagggcttcctccatttggaccaacttagctgaatgttgtatgatctctctccttgaagcagcaaataagaagaaggtctggtccttaacttaacatctggttactagaggaaacttcagctattattaggtaaagaaagactgtacagagttgtataacaagtaagcgttagagtggctttgtttgcctcggtgatagaagaaccgactgattcgttgttgtgtgttagctttggagggaatcagatttcgcgagggaaggtgttttagatcaaatctgtgaattttactcaactgaggcttttagtgaaccacgactgtagagttgaccttgaatcctactctgagtaattatattatcagatagatttaggatg

SEQ ID NO: 32546 - DNA, 2402 bp, Unknown; identical to SEQ ID NO: 32545
  misc_feature (1)..( 2402): 2750-1469P.txt file - cDNA_ID_3058470; gDNA_ID_2926221; Annot_ID_203288

SEQ ID NO: 32547 - DNA, 3003 bp, Unknown; identical to SEQ ID NO: 32544
  misc_feature (1)..( 3003): 2750-1469P.txt file - cDNA_ID_3058470; gDNA_ID_2926224; Annot_ID_203443

SEQ ID NO: 32548 - DNA, 3003 bp, Unknown
  misc_feature (1)..( 3003): 2750-1469P.txt file - cDNA_ID_3058491; gDNA_ID_1620311; Annot_ID_152995
ttgtctaccaatagtaaggcccgcatgatgagtgtggaggcttttacgagcgaggcggctagaatgattggaattacagtagagtgcagaaatatgtggtgtactactgtcagaattatttgatctaagttccatatacacagacaatcgatttaaaaaatcatgttcggaaaagacttacgaatcttttaaagaaaaacagcttggaaaagcaaataataaacattttaaattgtttattcgcaagaattatataaaaaaaaaaggttttaacttatagaaggcaaactccaaaaagaatatttcaggaaagactagaaaacattatcacattggcttttagatcctgttgaatcattcaatatgtattattggcagataacatttgacctaaacaaaagaattagttttctcgattatattttattagatctccgaaatctgtctttgggtaaaagtattcttgagaagttttgaaagctttacgtcattaatgacgccatcttatatgtattgattaccagttgattattatcccacgtggtatcgatattcaattgaagcaaaacaaaaaaaattgtttagttttctttgcgtctcgattcattttatccaaagctagcgttgactaattttatgagtacgattcaaaaaaataaaaaacatgcataagctctggtatgtcgacggaacctgttattgttgacttgatcgtattcccttttaagggatttcgtttactctttctaagattcatgtgtttatacaatattatcatatgatccgatttctagaaactttcacttataacctgcaagtagttttgtataaactttctatgaaacaattctacagtcaagaaaaaaaacagttctatatgtttgatgtgcaacaataacagaataactgacctatttaagtactctactcgtcattaatcaatattaatagatgttatgaagaaaaagggataactgagtaactgacctattacaaataaccttatatgtacgagtgaataaaaatataaattaaaatatggtaacggtctcattatattgcacaccgtaactgtctgcataagtttttaagtttaaaagaaaaccattatagaaagaagaaaaaaaaagccttacaagggttatatagatgaaacgagaaatacacactggtttgctttgaaatgtttcaccagatataatgaattggaagactcgagcaggatataaaaagtttcatcaaattctaatgaaaagaaaactcacttgatctctgttaaaataattttaccattcacattttagttttactaaaattattaaagtatattttagaaaactcacttgatctctgttaaagtatattttgaaaaccaattattgtggacagtaaaaactcatttgtgaagtgaaatccatgaagtctaagtcgaataatatttagaaacaagagttaaaatctttatgtatttcattttctaatttggttgaacataagctaaactctatatatatattgtattgtttttcttaaaatcaatcatacatacagaaatagttttctcaaatcatttgctaatttatctgtttctatttttcttagcatcaccaaatagatatgtcaatttcccatctctttatatataacaaaatatgatttatttctataaaataacaatcatctcatacacattaatctcgttgtgtgtcatctattgtgcaaaactgtttaattagtatcttaaaatattaatatatttactcttagtctttgtcgacacttagtcattgaaatagttaaaactattacaaccaaagattgcctcaaactcaaagtaatgcatagtttcacatgtcgatacaaattttgttttgtccttttatcccaagaaaataaaaattaaatcaatacttattcacacgtttcattaaataacaaagacgttgctttcatcgtctctagccgatttctagattctcctccaccaccattttacccttcttttaaattccttccttcaatcaaaattagaattatttctcaaacctcttctttatatactaaaacgtctcacatgaacaagaagaataaatagaaacaaagaagatgaacaagaacaagattgatgttaagatcgagacgaagaaaggatcgatggatgagtggcctgagccaatcgtccgagtccagtccttagccgagagcaacctctcctctctccccgaccgttacatcaaaccagcgtctctacgccccaccacgaccgaagacgctcctaccgcgaccaacatcccaatcatagaccttgaaggactcttctcggaagaagggttgtctgatgacgtcatcatggctcggatatcggaggcttgccgtgggtgggggttcttccaggtggtgaaccacggggtcaaaccggagctgatggacgcggctagggagaattggagagagtttttccatatgccggttaatgccaaagagacttactcaaactcaccaagaacctacgaaggctatggaagtagactaggtgttgagaaaggagcaagtcttgattggagtgattattactttctccatcttcttcctcatcatttgaaagacttcaacaagtggccttcttttcctcccaccataaggttcctcttctttaatcattttctcttctttttaagaatttttttagtgaattttcatgagtactgagtagaaaataataaatacggtatttttctattctttaaaatgtacggacatgtggtacaatcttgggaaattatcctctttttattagttttgatatactattaagttcttggggaatgtgagaaggctgattttttgcttttcacgaggagaattatgtgagttttaacgttgggataaagtccaatatagggaaatggataaattattgattatatttatatttattcaaaaaatagagaagtgatcgatgaatacggcgaagagctagtgaagctaagtgggagaattatg

SEQ ID NO: 32549 - DNA, 3000 bp, Unknown; identical to SEQ ID NO: 720
  misc_feature (1)..( 3000): 2750-1469P.txt file - cDNA_ID_3058498; gDNA_ID_1620311; Annot_ID_152990

SEQ ID NO: 32550 - DNA, 3003 bp, Unknown
  misc_feature (1)..( 3003): 2750-1469P.txt file - cDNA_ID_3058502; gDNA_ID_1620311; Annot_ID_152985
atcatatctttggttatttcacagatggtggtgatataacaagtttctatgtatttctcttacaggattcgagggggttgtcacaaaaacagatctttctagagccgagttcatcagaacctagattatatgttctcgttcgtaaaatggtcgaagatgatttggttggggaagtcatagcagaggagaataatgcgagttctaagaaacggaagagagaaaatcattctaaagggaccagagatagacgcaggtgtaaaccattgtccagacgaaaacagagaagcaatgtcaaacgaagaagataatatcaaggaaaatcaagaactcaaagcaaaatgataagatgataattggtccggattcttgaaaattgctttcactgtgactctagtttgtgtttggtcatcgttgatgcccttaatgaaccttggatagtattttgccaatttaaaggttaaagaactcagagactattgatttaagatactcggatgcaactgcatacttgtggatgtattatatatatcttatgataagtggttatgataaaaatttagacatgaaaaagcccaagaagaagcataaacatgtaactgttaagcatcagaagctgtagtttggatacacaagccatcattatacgtggacactaacacaaatgtagatcatacttgtcagctactaaagagttaaggaagatttgctccagtacaccaatgtacactaacacgctagaaagtagaagaaaacaaacaaagacatcctaaagagttctctaacttccatcctacagattaaaacaagtaacaggatcctccaatttcaatgagcttcagattcaagtaactcctctttgcttcaccatggtatttcctccaccaatctaattctacaattgcttacctgtacaataaaggcagatcaaacttcagtgaactcattaccatatgaagaatgttcgactactatgaacattgatcttttttctcaatttcaaacctggaagtctactcctcctaatccagttcaacattccacgaagctggagaagctaaagaagtaagagaatgctatctagacttttccttgccagaccactggaagcacagaagctcaactgaattgtatattgacaaaattggtattcttcaaaagcagagaggcacatgactttcacatatcaacaataagtcaattactaaccagcctcatccatgcttacaacaactaacagcataggtataacattgttgttgaaatctaaggtccttccacggatacattatgcggtttaaagagaaagagtaacaaccatgtaaagtctaagccaccactagtaacttgaaaacctaatgtgagttcttcttacctgaagcacttgcgcgtttccggtgctttgatttctcaatctctaactgcatctccatcaacatgttcattcgttttaactctacctcctttgtcacttccattctctgcttctccaactcaatcatcatctgttgcttcttcccttcaattctctcgtaaacttctccaaacttgagaatcgccgtagctagttccctacacgttgatccttcactcagatctacctcttccacacgaggatgcttcctagcaacgaattcccaatcaccaacctcatcatcatcctcatcatcatcttcaagagagcttccagtagagttcgatccagttggattcagatgattcttaaaaggcgctgatttgacaactccgccagccgatttcttcacaacgggaccgattagaacatcgaggcggttatagaaacgccaagtcgacggcgagagtttagctttctctgttttgtacttcttcttcaaagtatcgacccggttcttacactgtaagtcggtcttcttacggctgttatcaccgtgtctagagttaacggcgtcggcgacgtctttccagtcattctgccggagatttccgtggttcagcttgacgtaacgattgccccaggcttctaccagcgtcgccgtcgcttcctcactccaccagtcttctcttcccaacggcggtcggtgggacacacttgattttgactgcggcgtcgtcgtctccattcgtcgggagtagtgttgctaatgtgcgcaccgggaggagagtgacggcgtaggataagatcggaatagaaacaaacaaaacataaaaagaagttttttttttttggtgggaggaaaccggaatgggagagaagaggataagtgtggcctgacattgatgaccggcggtgacgtcactgaccgtattggagcgttttggtcccaacggcgattatccgttaagaccgaaccaatctctttggtctcgttagtacttatgattaaactgttaaaaaaaacctcataatttttcatttatcccaaaacaaacctcaaactaaaaagattacataaataaacctctaaaagtgacagattgggtcaatagcaaatagttggaaatattttagttttatttcattttaagccttcaagttttacttctttccaatgtttaaattttgtctttcataagctcagacttcgtcccagatttcattgcatctagcacagaaagtgtttgattaaattcctctgagaacatctctctttcactaagcgaaatcttccgactttcgatacttttttgaacctcactttcttcattccgttcagtttagagcctcgacaatcatcggaactcgtttgaaacctctctatccggtttctaatgtaagtgacaattcttcctactcacttcttcttcttcttcttcttcttcttcttcaatgttatcttcctctgtctcgcttacttttcataaaacgatttcgacccgcaggtttaaagagaaatgagaatctcaaataaaattttgaaaatagaaaagactagggtttaagcgctaagacaacttggaaagagcgggagagtgtaaattaaacttcaccaatctccattgcctgttggcttcggagaaaaaatg

SEQ ID NO: 32551 - DNA, 3003 bp, Unknown
  misc_feature (1)..( 3003): 2750-1469P.txt file - cDNA_ID_3058508; gDNA_ID_1620311; Annot_ID_152983
tcttttccagagtatgatttgatgtcgacgatcaatgaagccagcaaattctcgtagccgttctcgttcttcgccatttttacttcgccgaattgaagaaagcaaaaagggacaaggctagtgggagatagagagagagagggattatatgaatttgaaaaaagagtgcaccttttgattttgaaacgttctgatacagcaagaggctccacgatccctgcgtaaagctaaccggctaatcggtcaaccggttaaccagataatcagataaccagctaatcactcagccggttagccagataatcagataaccggttcagtaaggtattgacaggaattgtaaaacgctttttggaggagccgtcaaattgatttcgccgatttgctcatctctgactctcagttgctttgctccttctcatggagaatccggcggagaaacccgacccgaatccatcaaaacccaaaatcgaatctgaagatgaaagagaagaactaggagatattaacggcgacgaagaagaagaggaagagtatgaggaagaagacgatgggaaacctcgaacgcgagaggatgcaatcgcggataggatcaaagctgagtctctgttccgtcgtatgcgagcaactccggtcgctgtgcgtgttcacgacgtgatcgtcaagggaaacgagaagactaaggatcatgtcatcgaggctgaggtggatgttgtgaggcaagccactacgttgcaggagcttctcaaagcctctaaggttgccaatttcaatctacaagcgcttgatatcttcgattcagtcaaaattacgcttgattctggtcctcctgagcttcctggtaccaccaatgttgttatcgatgttgttgagagcaaaagccctatcaccggtcaaatcggaaccttcactaaagcagaggtatcactttcgttttcttatttcagtggattaggatacttaggtcttggcaggaagaattagatacatccattgattgatgcatagagttggatttgttgctttatgaggataattctggatttggatttcatatatagacttttgtatgtcatgtgttttagtgatttccagattaagtgttcttgtgagaatttgaaatgttgaatgttgttcataagtctaatgttcttgtaggctcggtcatcaagccttgaaggctctttgaagtacaagaacatatttgggtatggagatatctgggacgggtctcttgcttatggctgtgatcactctgcagaggtcggcttggggatgtatttgccaaggttcagagggcgtcctactccatttacgtcgcgggtttacctttctacccaagattggcttaagttttcgtcttataaagaacgagctcttggtctttccctcgggcttatcgctagcaagtatcatgagctggcctataatattgcatggcgtaacctgatagacccatcgcaaatggcatcaagatcaataaggagacagctgggtcataatttggtttctgctctgaagtacactttcaaatttgaccagagaaactcatctttgaggccaacacgaggttactctttcatctcgacttctcaaataggtggtcttgcacctgatagtcgaactctccgctttttgcgccaggtttgggattcttcattcttatgtcagaatttacataaacctatatattacagtgtggaaagttgtagcacaaatatattactcagaaaacttccatggcacctagttcctcgtttatgcttttgcaccatttatccataacttccgaagtacatctgacactctttacttattgtagcagtgaatgaaaagattggttagcccttttataacatatgtggttcttttatgtttgccatacatcatgttgagggtttcttgtccttttgcaggaaatcgaccttcgatatgctgttccactcgggttttatcgtgctgctctgaactttggtatagctgggggaatcacatttccatggggaagcggatacaagagcagagcttcttgtgtacctgagaggttcttcttaggtggaaacatatcgcctgtgtgttctttgggaggaccatctgcattatggggattcaagactaggggattgggtcctaacgaaccaaggagggaagtacaggacgatgagagtggtgacacatatgaacgggattttgtgggaggagatgttgcggttactgcatttgcagacctttcttttgatttcccattgaaatggttcagagacagaggaatccacggacatgtgtttgcatgtgccgggaatatggcggaattatcagagaacaagtataggaacttcacagctccaaagttgttggagacattcagaagctcagttggtgcaggaatcgtggtaccaactagtctatttcgcatggaggttagttagttctcttgtttctcttttcttatcaaggatcataaaaaaattgcaatccttttaacagatattgattgttcttcttttgttatgtgatctcttatgccagctcaactactgccacatactgaagaaacaagaacacgatcgagcaaaatctggatttttcatgacattttcaacatcatcttaatgctacttttgatgatatcttaattttggctttgcactcacagtgtcatggcggagtcttttgttttgtttccaggagctttcattgtttaggttgttgtttggaattgaaaactgtgcaaattttagagagagagattacctgatgtgcggattgttcttgggaaggagatagatcaagaaataaaaattaactaaagttgatttgttttgaattaaattttaaattagtaataaactttttgttttccttccttttcaatgaagataaagatgacacggtagaataaatttttgtttcctttttcatgaatatgttttggatcgagtactgtcatctctataaatataagtccaattacaagtagattgttgggtggacaaagtcatg

SEQ ID NO: 32552 - DNA, 3003 bp, Unknown
  misc_feature (1)..( 3003): 2750-1469P.txt file - cDNA_ID_3058512; gDNA_ID_1620311; Annot_ID_152982
aagctatagccggagctaaaatcagcattatctgcaagaatcataggcaacaagtgagtttctacaaagtctttcgaactgattcctacggccatttctatggtgagctcaaaggtttcaagatgactccacatttcttggaccatcctcttcattcttgccgagccaagctcgtctcttctcctcgtgaagactgcaatctcttctccaacattaacaatgctctagatggagctccactccgatatgaagagaagaggctcaagtggactaactatgaggccgtgatttacgccgctggtccattggctttccgtcctgaccactgccctgcgactgcaccacccacttactgatttgggttttgaagatcatcatatactaattacataagacaatgttattgatttttctctattttgtatctttttggttttatggtttgtcaattgtttgtaagatgctgagtaatattgtaatggcctaatgggactcttgtgactcaattttgctcagtttaaatcggttaaatcattggtcacagaaacattataaccagaataattctaaatctcaaaccttacgacacaaatatgtcttcaagttacaacaagaacaaagatttctcataatttaacacaacagagaggtacaaagcaggaacatcgaccacaaacattgtctgcttctaggcatacgttatgagagtagaacaaagtggaaccaaataccttgttccttagaagtccattggcattgcaaacaatttgttgatttcatccaaggctacttttgtgcataccgttggttcaaatagttcgcgctcatctgattttgaaggcaatctctgagtcggctggctcttcccttgatgttcttgctcagcttcttcttcatcatcatcctcgagtattgagaaacctgcagcaggatttggttttgtctctactactgcttttcctttgtttttagagcggttgggtctaacaaaattgattggttcgccaaacatgttgtttatgtcctccatagcttcctttaggtttactgtagggtcaacaaggccatggtggcaggcgttttcaactgcttcaggctcatcggagattgttgaaccaacaaatctacgaacaactgtatcttctctaaatctagcccgaggaggagtgtttctgtctgcttcttcagagctttcaggtgaatggtctcttggcaggagaaagacaaaagcttttccagcctcatcattttcatccgcagtttcatcagtgttttcatcatcaatgaatatctcaaaggactcttgattaggctgggatccacactgagtagtactagtctttgcttttccacttgtccctgtttcacattcgagattctcgtccagaaaaacctcaaagctattgttgcatccttgattttctttgttctgacttctctgtcgtgatcttctctgaagtggagcagtttctataggctctttgaacatgttgttgattgtattcatggcttccttcatgtttattgtgggatccaccaaaccgtgatggcaagcattttctgcttcaggcttccctacaatggctttatcaacaaaattcaacacaggctcatgttgttgcctctcatcaaccttgtggtgctttccagacagtttttgttcttgacgctgcaagaggaaacataaattcagacatctgcagaaattgtaacccttatacaaacggagcaatcaaattatggaaacagtacctgtgtcttcttctttttgtgcctctccatgcgagtaacgaactgcaagtatgatttctgtaactcatccatgggttctgcaaggctgggaacaagaggaaatagtcactcaatttaaatcatgtcttccacatatcacatatgctagctcaaactggcattatagcattcctcatatccacaaaaccaagaatagatttgattgatatatgttgcatatgcatactcactcgaatacatttttctagagtttccaagaatacttacttttgaaccccaagacggtacattttctcagcatcctcaaatctcttcatcttctcataatggagagcatatgcctggtagaagagtgacctcttggtccctatactttttgcttccatggttcttaaaagagctcttggatcgtctacaaagtccatctacccaaacaattcatcatcacccattaagacccacatgctaacgaatcaacatctgctatcaaaatcaagtgcaaaatcaaggggtgaatgtacattaccagctgcaaccaaacacgaatataccgcgaatcgttcttatatctcttatcagattcaaatgactctgcacatttctgcaaaaaccgcggcagcttctcgttcaatatctgagacggcaaactctctttcatcttcttaacacctctgtttcagattgacccaagattcaacgacacataaatcaacacaaacatctattcaattaggtttctatgaacttaaagatacagacccgcccacaaaaatggtgacacaaagagtaagacatagacaaaattaccggatccacggaagaagatggtcttttccagagtatgatttgatgtcgacgatcaatgaagccagcaaattctcgtagccgttctcgttcttcgccatttttacttcgccgaattgaagaaagcaaaaagggacaaggctagtgggagatagagagagagagggattatatgaatttgaaaaaagagtgcaccttttgattttgaaacgttctgatacagcaagaggctccacgatccctgcgtaaagctaaccggctaatcggtcaaccggttaaccagataatcagataaccagctaatcactcagccggttagccagataatcagataaccggttcagtaaggtattgacaggaattgtaaaacgctttttggaggagccgtcaaattgatttcgccgatttgctcatctctgactctcagttgctttgctccttctcatg

SEQ ID NO: 32553 - DNA, 3000 bp, Unknown; identical to SEQ ID NO: 719
  misc_feature (1)..( 3000): 2750-1469P.txt file - cDNA_ID_3058520; gDNA_ID_1620311; Annot_ID_152978

SEQ ID NO: 32554 - DNA, 3003 bp, Unknown
  misc_feature (1)..( 3003): 2750-1469P.txt file - cDNA_ID_3058532; gDNA_ID_1620312; Annot_ID_153034
aattaaattaaaattttgataaatgtagggtgatatttgggatgttggtctctctacctgtgctcgtcgcctactacgcagctctggagtttattcattgattaaactaataaattcgattatatcatcaatattaccctttgttcatctttcacaagtttttttttttgttatctcttttacactttcctcctaaaggagattttgaagtatattcgagatatgaaaaccattaactgaatgaattaacctagtttatgcttaattttatactttcttaagctctctttattttcgtagtatgcataatttagtattttgttcacatatacgtatcaagaaaagataaaaactctataaatgaaaatacatcatgttcggatctaaaattgttttaatacgtacactaaatattataagccctttttttgttaacaaaaaaaaaaaaagaataaatgaaacgaaattcaggttagagatcaaataaaatcttgttattatttgattcatgatcatacatactaaccaaatcaggatttatgaaataaattattctttctcctcaaccgaatcaatatgaagataaaaggggtaatttagtcttttcgaattcgtttttcttaccgaatctctttagttttttttctttcttttgtgtggaggagagaagagaacgcaacactttcttcccaatctctctctgctttctctctctagacgtgatctctaattctctaatgtcttcctgcattgccatttcctctaacccctccacaatcggaggaagacgattcctgggagcaagagaaacgatgggacttcccatcggaaaatctcttagagtgagagaattatggtgtgttcttaatgcttaataatcaccgacacagccattgttcttcatcatctccatggattttgattccatttctcgggaaagcacttttctttccccattgcttaaccaaagtaccatcctttattccctctctgatgttctgattcaatcttaaaaacctcagcttgaatttttgttgtggggttttggttgggtttgtgaattttagatgcaatgtggcaaatgaacttgggatcagatgatacaatgggtgttgatgggtcttatccggaacgtcacggagagccagattgtgcttattatataaggactggactttgtaggtttggttcaacttgccgattcaatcatcctcacgaccggaaactggtactgactctgtttctgtgtttgttctttcctctgtatcttgttgactcaaagtttgtagctttgagggtctgtgtgtgtgtgtgattacaagctgatgaatagtctcgtatccaatttctaggttatagcaactgcaaggattaaaggagaataccctgaaagaattggtcagcctgaatgtgaggtagctctgtttcgaattactatcatagtaatgtcttctagttatcacattgtctcaaagcttctatttttgttgttgtgtctgtgcagttttatctgaagacagggacctgcaaattcggagtgacttgcaagtttcatcatcctaggaacaaagctggtattgatggaagtgtatcagttaatgtcttaagctatcctctacgtccggtatgtatacatttcaactttctaatctcaccactgctttgtaaaattttgcctctctcatgagttctgtttgcagaacgaagatgattgctcttactttttgagaattggacaatgtaaatttgggggaacttgtaaattcaatcaccctcagactcaatcaaccaacttgatggtttctgttcgtggctctccggtttactctgctcttcaatctctaactggtcaaccgtcttattcttggtcgagaacatcttttgttgcaaaccctcctcgtttgcaagatccttctggtttcgcttcaggatctcaaggaggtctcttctcatccgggtttcattcgggaaattctgttccgctcgggttctatgcattacctagagagaatgtattcccggaaagaccaggccaacctgaatgccaattctacatgaagacaggagattgcaaatttggaacagtctgcaaatttcatcatcctagagacaggcaaacccctcctcctgattgtgtcttaagctcggttggccttcctttacgcccggtaagctaataaaagacttcagattctttcctttatagtctcattatgtggtttggtaaattcttgttgctggtttgaaacagggagaaccactgtgcgtgttctattctcggtatgggatctgcaagtttggtccaagctgtaaatttgatcacccgatgcgagtcttcacttacaacaacaatactgcatctccttctccttcatcatctctgcatcaagagactgcaatcaccacagagctcaggaatctcctagtctcttcttctgtggaagcaaaacccacatcactccctgaaacaacctctgctaaagacaccattgttgatgcacagcactgaaaaccctgtgttttgtctatcttgaaacaatatgtaacatttgttttgctttatcttgtaagcatttatgtacagagatgatatctgatctaatctgattcgccttttgttgtaattttctattggcaacagtttgtgcattaaaaaaaaaaacagtttggtcttaaacgggccttcaaaaaacgtctaacaagcccaataataaaaccataatgaaaagaagaagaaaaaagaattaaccactcgcatgtgtaacgcgttgaatacacacgctcgttgtatctatctatctactcctccggttaacgggggtttaaagccacgtcggtgctacacatgtccctgatttctcctttaacataaaactaaacagctgttttgtccgcaatcattatctattactaataaaaaatctcaacttttgttccttactcttattacttcctaaatccgatcgaaacaactgttgggttagtttctaatttccaagaatg

SEQ ID NO: 32555 - DNA, 3000 bp, Unknown; identical to SEQ ID NO: 731
  misc_feature (1)..( 3000): 2750-1469P.txt file - cDNA_ID_3058553; gDNA_ID_1620312; Annot_ID_153035

SEQ ID NO: 32556 - DNA, 3003 bp, Unknown
  misc_feature (1)..( 3003): 2750-1469P.txt file - cDNA_ID_3058556; gDNA_ID_1620312; Annot_ID_153033
actacactcactatttacaggaaacaattggaatagaatcatatgccacggcacggtctggtcaattatattgataacgataactctcttgtttctcaattaaactaatggctaaaaatatgaggttgattttaatttttttatctaaatatttagactcaaatttcaattgtatctattctataggaatttagccaaattatttataaatattcgtaatcatattccgaagaaaaaaatattattgtttaatttatatctaaactttacttttgtttgaatattactcatggatatctcattacctatcttttttctacaacaaataaaacaattaaaaatttatctataaatatgaacatgttggtttctctatcgtaacacatttactatctacgaacgaatttagaagctttgttttctttcctttcgtttgctactactgcaacatttctatttttctgataaaaccatgataaattgtggagatgtttacaaggtaatcgaagcaatggttccactctatgtagccttaatcttaggctatggctctgtgaaatggtggcacatcttcacgcgtgatcaatgtgatgctataaaccgtctcgtttgctatttcaccctgccgctcttcaccattgagttcacggcccatgtcgacccgttcaacatgaattaccggttcatcgcggccgatgtcctctctaaggtcatcatagtcacggtcttagcgttgtgggccaaatatagcaacaaaggaagctattgttggtccattactagtttctctctatgcactcttactaactctcttgtcgttggtgtgccattggctaaggcaatgtacggacaacaggctgttgatctggtggttcaatcctcggtatttcaagccatcgtgtggctcacactcttgttgtttgtcttagagtttagaaaagccggatttagtagtaataatatcagcgacgtacaagtagacaacatcaatatcgaaagtggaaaaagagaaactgtggttgtgggagagaagtcgttccttgaggtcatgtccctcgtttggttgaagcttgcaacgaatccaaattgctattcttgcatccttgggatcgcatgggcttttatttctaacaggtaaaaatgaatctttaattaaactttatattggtacctataagatgtttaacaaagtgttaattagtatgtgtgatcagggactcaggagactacattaattccaccccttactccgaggcaaccgttaaaattgcctaaaaatatctatagtttgacgtttaaaccatctaaattattacttttctgtgtagcgcctgatgatctatagttaaaattttgacagaaatataggtcacgattgtttctttgcatttgcgtttatatttccatgtgacaaatgactaggacatttttaacatggtaacataatttgcaaacgtgacatgtacatgcaaataaactaatcatgattttaatctgaatattagagtctttgaccaaatttctattttatttgttttagtgtgaattttgggtttagggttttgattagtgttttgtatactcttggctaacaaataaagacttaagtctaataattgatggaaattaattggaaatatagatggcatctggagctgccgggcatattagagggttcgattcttataatgtcaaaagcaggaacaggaacggccatgttcaatatgggtacgtttatttatgtccatgcaagtatctttctatacgtaaagattacgtatcagtattgagataacagtgaatacatgcatatatacgcaggaatattcatggcacttcaagaaaagttgatagtatgtggaacaagcttgactgtgatgggaatggtattgaagtttattgccggaccggcggccatggccatcggctctattgtccttggcctccacggtgatgtcctccgcgtagccatcattcaggtcataaattctactttatccttttgtaccctaattctactgaagtttgtatataaaaaaaaaagtagatcattttccattcattcatccactaagatactaactttatatttttcagtttaatatatcattaatatttatatgaaatttacaggctgctttgccacaatcgattacttcgttcatttttgctaaggaatatggattacatgcagatgttctaagcacagcgtaagtccaaattttaaaaattcagtctatttaagaagaaaatggtaatatgaaattaaattaaaattttgataaatgtagggtgatatttgggatgttggtctctctacctgtgctcgtcgcctactacgcagctctggagtttattcattgattaaactaataaattcgattatatcatcaatattaccctttgttcatctttcacaagtttttttttttgttatctcttttacactttcctcctaaaggagattttgaagtatattcgagatatgaaaaccattaactgaatgaattaacctagtttatgcttaattttatactttcttaagctctctttattttcgtagtatgcataatttagtattttgttcacatatacgtatcaagaaaagataaaaactctataaatgaaaatacatcatgttcggatctaaaattgttttaatacgtacactaaatattataagccctttttttgttaacaaaaaaaaaaaaagaataaatgaaacgaaattcaggttagagatcaaataaaatcttgttattatttgattcatgatcatacatactaaccaaatcaggatttatgaaataaattattctttctcctcaaccgaatcaatatgaagataaaaggggtaatttagtcttttcgaattcgtttttcttaccgaatctctttagttttttttctttcttttgtgtggaggagagaagagaacgcaacactttcttcccaatctctctctgctttctctctctagacgtgatctctaattctctaatg

SEQ ID NO: 32557 - DNA, 3000 bp, Unknown
  misc_feature (1)..( 3000): 2750-1469P.txt file - cDNA_ID_3058577; gDNA_ID_1620312; Annot_ID_153016
atcgattgggttgagactagccgtccgataccagttatatcaaggatctacagtacaggatccaacgatggacccgctttcgttgtttcgtctggaaagagttttccagtggcccggattgatttcgggtggggctcgcctgtttttggatcgtaccatctcccacccgggagcagagctggttacgtaatgacaatgccgagtccggtggaaaacggtggctccggagattggacggtttacttgcatcttacgaaaggacagttgaggtttattgaacaagaggcttctcatgtgtttaatcctgttgacaacgactatctcaagatttaaagcattatcaaactttggttatattattatgcaaataaaggcttatataaatttggcttttatagttgtaaatttcagtttaagatcaatattttgatttaagtttaaaccaaaagaaaatgagtgtgcagattgctaatggtaatcgactaatcgtcaattcttggccttacattgtgggggtatgatcgtcattttacactccgataattctgaacctcgcgtccatcgaacccgaaaatacgtaaacatccccaaatgtcttctttcttcgttatccatttgagggtattattgacctcacggtaagaaaatctacaatatttcacggataacgaaaacaacactcgaattaaaatttggaaatcaaaagtctcccaggttcctttgaaagatcacactactgttttttggactcgagcttcttcttcaacaatgcctctctctctccgacttgctccatctccgacgtctttccgttattctccgattacatctaccggcgccggaggattttcccccgtgaagcagcactgccggatcccgaattcgggcgtcgcgacgaaaattggattctgttctggtggtggtggtgttttagattccggtagaaggattggttcctgtgtggtgaggtgtagcttagaaacagtgaatgtcactgttggccaggtgacggaggttgataaggacacgttctggccaattgttaaagccgccggtgataagattgttgtcctcgacatgtacactcagtggtaacgtttcgatcacttcttcttcttcttggtgcgaattttggaattacttgattgcaatctcttgtttggaactacttgattccgtcgcatgttcagagaattggaaaattcatgtacttagatttttgataggttttggataagtcgttggaaattagggttgattagggatttctcagttgatataacattgctaagttgtttaccagagaactttgctttagcagatcctcatgtctttaattctcaattgccaattcttgctacaacataatcatatcatggtctctaaccatatcctttgcttctcttggcctatttttagctctatgaacctcacattgtgtagcttccatagtttagggttagtatatgatcaccttgttactttcaattgtattcaaaagttacagcattgtaagtatcatatataatcttcacagtatcaggctgctgcttctctgtacacattcttttgaattcattttttggttaggaatgatatatacaaaaggatatgaagttatgaatagtgagactttcaggagaattagagcatgtacatttaataaataagcataaaaggtgttccaatttccatcatcatgaatgcttgagatgagtttactattaaatgttctgttttggtgttgagaaaaatcagtttgcctctcttttttttcaatcctcgtttggctctttgcaggtgtggtccttgcaaagtgattgctcccaaatacaaagagctatcggagaagtaccaggacatggtgtttcttaagcttgattgtaaccaagacaacaaggtttgttcttctttttccgctgaatgtgtctttatatttatgttacttatttcataactcaaaaactcttgcttgcagccattggcgaaagagctaggaattagagtggttccaacttttaaaatcttgaaagacaacaaggtagtaaaggaagtgaccggggcaaaatatgaagacttacttgcagccattgaagcagcaaggtcaggctgagtctctctctatatcactcattatgtaaagtattaggatcattctccatccatgtaattcgtttggttctatgtatgtaactctttgctgttcccttaaccggaatcggttgttcactatctatgtataaatgctggaaagttatggaatgatgagctgaatgtgtatctgtatgcatcacaagttcataaccaagtaaatatgcatgtaaactataagaaatttaaaaattaagattgattttaattttgggggacccgattgttgaaatagatgcattttgtttatagttttggcttacatgtacgatgcttgtgctttgttttcaatggatgttccaacttccagctagattgttaacaagtcatatcttcatttagttgttcaccaaatccagtctcgcctaattttaaaaatttaatacatttggcgtatgtatattaggctaatgtatttggatctattcatgtatttttttataaaaattggagacaccgacagcattttcatctttagatgcagtcggatttttttcttgctgaaaaaatgtgtttcctctaaagagtttagagaaattgtaatttcctaaacaggattttaaccctaacattttttatatttatttaaaagtaataattcatttaaattcttcaaggtaaaaaatacgatagtccacaaggattgggagtaatcgcgaatacagaacaacagatcagagtatgacacgtggcgaaatctgaaagagagttataatcaaagagaaacgcgttccgaatccgacatcttctctctctctttctgaagtgaactgttgttgttgtgctctttggtttcatcgagagagaacctaaacccgatctgaaccaataacaataagaagacgaatg

SEQ ID NO: 32558 - DNA, 3000 bp, Unknown; identical to SEQ ID NO: 727
  misc_feature (1)..( 3000): 2750-1469P.txt file - cDNA_ID_3058583; gDNA_ID_1620312; Annot_ID_153013

SEQ ID NO: 32559 - DNA, 3003 bp, Unknown
  misc_feature (1)..( 3003): 2750-1469P.txt file - cDNA_ID_3058585; gDNA_ID_1620312; Annot_ID_153007
tgagtcacagtacagagtcttttttatctttctatgattagtcaagtcgcattaaaatctcaaggatatagatgaatatagatgaaaagaggttttcttccttgttattaatggagtcacagcaaatgttttttacttcttacgattgatcagttcacattaaaatctcaaggatatagattagatgaagctatgttttaaaaaaactgtttttttatgaagtttccatgtactgcagatcatgtggttggtggatatctttagagcaaaaatcgtggatacctcagagcaatctctaacgattgaggtcagaccttttcttcagtttatatgtgctcagatcatatggtcaaaatggttccactaagtctcattttttattgtgtaggtaactggagaccctggaaaaatggttgcactaacgacaaacttagagaagtttggaataaaagaaattgcgagaacagggaaggtaatttttcactttcaaccactttttgctccaatccttcttaactgtcaacaacgtctggctctaaatgtcttcaaattacatcttctgtcttgaaaaagcttgtttgaacggttggactcacatgtatcattacttgtagccacttggagcctcttttttttttttttttttttttggtctattatgtcacacatacagacccgagttcctttggtgaatctcaggacactctaaatggcagagcacatgaaattcccagtttagctttaaatacatgttcacatcttacatgaaaactgattaaattacttaatctctaatgcggattttatcttcttttccatgtagttaatttctgcgtttcactgactataatgagtaattttaagaatcagcttttttaatcctaactgttgttgtatactactactctagattgctctgagacgggaaaagatgggagaaaccgctccgttttggagattttcagcggcatcatatccacatcttgtaaaggaatcatctcatgagactgttgcagagaaaacaaaactagcattgactggaaatggcaatgcatcatccggggtatagaaatattagctaatttattttctccctgtgtatatctaagcactagtagattgaacgagattaactgatactttattttagggtgacgtttatccagtggaaccctataacgatttcaaaccggtccttgacgctcattggggaatggtctacgatgaagatgtaagacacgtttctcggatactgcattcgttttataattttctttttgatccagtaaatccttcgaaattagaggtcaaagtgaactaaaactgtttacctttttgcagtcgagcggacttcggtcccacacattatctttacttgtggccaacgttcccggagttctcaatctaataactggagctatctctagaagaggttataacatccaggttattatgcacacacttttgcttttagcttcaccgatgtgatgcatactactcatttctctcaagagtatgtgaaagttgttgcttttattgctctagagtctagctgttggtcctgctgagaaagagggcttatctcggattacaacagttattcccggaactgatgaaaatatagataaattggttaggcagctccagaagttgattgatcttcaggaggtgagctaatgattcgaaaccgtagtgtactttggttttaattttaattttatatgtctaataacgtttccctttcattggcttttctagatccaaaatataacgcacatgccatttgcggagcgagaactgatgctcatcaaagtagctgctgatacttctgcaaggagagatgttttagatattgctcaagttttccgtgctaaagccattgatgtctctgatcatactatcacccttgaggtgctgatatcatatctccctgaactttacaacaaaaagctctcgtagctttctgatatttcaagcttgagatgagatctagtagctgatgaaatccgtcgatttgcaggttacaggggatctcagaaaaatgtctgcattacaaacgcagttagaggcctatggaatctgcgaggttaaaaaaaagtttcttgatttatctctaatctcttcacagacacggtcactgttgtgtctggcgattcttatggtttgtgttttatgaaaattgaaggtggctcggacaggaagagtggcattggtaagagaatctggagtggattcgacttatcttcgtggatactctcttcctttgtagttctagaggttagtaatctcttttataatcacagatgcatcatgcattgttgtcgttttacatcatcatcatctgtgttatatatcaaaggaaattcttgtgcagaggacttgccgcaagcttcagtgtcgttcctggaaactagtcaaaaggactgcacgttgtttcagcatctgtgattgattgcttcctcacgagtcatggcgcttcgagttgttgttataggaggagctattttatgaactaaaaataaataattatctttgttccgttaaattagttttgcatactaatcaaatgtagaacactgttactagtttgtcacttatttagtatcaaagacgtgtattagtatatactccaatcgatcttaacttaacaattaagctctaaccggaccggacttggttagatcttaacttaacaattaagctttaaccggaccggacttggttagaatccttccttgcgaaccaaattagggcaaacttgtaatattgaggaaacgtttaattcttttcgtgtttcttcttcgcagcaattgcagaaacttaaaaaaaaaaactcaaaaattagatcttaattcgaggattctacttctgaatctgaggaaaagctatcccagatccgatcagatctgttttgttgattctcttcttcttcagtcagtggaagctatgatggattgctaaaagagaatacaatacgcacgaagccacgcttgagaaaccatg

SEQ ID NO: 32560 - DNA, 588 bp, Unknown; identical to SEQ ID NO: 725
  misc_feature (1)..( 588): 2750-1469P.txt file - cDNA_ID_3058589; gDNA_ID_1620312; Annot_ID_153006

SEQ ID NO: 32561 - DNA, 3000 bp, Unknown
  misc_feature (1)..( 3000): 2750-1469P.txt file - cDNA_ID_3058606; gDNA_ID_1620313; Annot_ID_153062
tttcccgtggacggaacttttgatcctttcgttgttgggtaatttaaagttttcatctttatgttcttttttggtgattgatcgatttttggcaatgcctgtaaggtgttagatacaatatctgagtaaatctcagtcattgtctgttaaagttttgttttgttgcaagtctcaatcaaaagttctttttttggttttgttgttttctgcttagttttggtgtttgactttgtaacagactgtactacacgaaactacgattaggaactcctccaagagatttttatgtacaggttgatacaggaagtgatgttttgtgggttagttgtgcttcttgtaatggctgtcctcaaaccagtggactccaagtaaagcttttgaattctttgtcataatcttggtctagttatgatttctgtggttttggattgttaatatgatgcttctttcttttgcagattcagttgaatttctttgatccagggagctctgtaacagcatcaccgatttcatgttctgatcaaagatgcagttggggtattcagtcttctgattcaggctgttctgttcagaacaacctttgtgcttacacgtttcagtatggggatggaagtggcacttcagggttctacgtatctgatgtcttgcaatttgatatgattgtgggaagctctctggtcccaaactcaacggctccggttgtgtttgggtgagtttatttcagcgaatcctttgtttcatagtcatcaatatgggccattactcttgactttgttggttgctatgtgggattgtttttctggaaccagttgcagcacctctcagacgggagatttagtgaagtctgatagagcggttgatggaatcttcgggtttgggcagcaaggaatgtctgtcatttctcagcttgcttcacagggaatagctccaagagtgttctctcactgcttgaaaggagagaatggaggcggaggcatattggttcttggagagattgtggagccaaacatggtctttactccacttgttccctcacagtgagtgttcatttatccctcgaaaccgtttcattttaaatagttgttcaaatgttcattagagagtgactgataagcatgatcttatttaaatagttgctcaaatgttcattagagattgactgataagcatgatcttatggcgtgttaaaatgtcaggcctcattacaatgtgaatctgctgagcatctcagtaaatggccaagctttacctatcaatccatcggtcttctctacatcaaacggccagggaacaatcattgacactggtacaacattggcatacctttctgaagcagcctatgttcctttcgttgaagctgtaagtcatcagagctcacgttgctatatgcttttgatatcaccgaaccatctgtgaaatggagttactataactgtactccattgacttgatactctgcaatcttcgttcaatacttaaatgttatctgtcttatggaatttttcagattacaaatgctgtttcgcagtctgtcagacccgttgtttcgaaagggaaccaatgttacgtaataaccacaaggtctatcctctgaccacatcttcttatcccaagcatgtcttcttaattggtaaacatttgaacttttttattgtactgtgatgatcagtgtcggagacatatttcctccagttagcttgaactttgctggtggagcatctatgttcttgaatcctcaggattacctcatacagcagaacaatgtcgtaagcactttaactcgcaaccttttcataggaacctggtttcagaatctgaacctaccttgacctgaaacagtgagtttttttttttctgttcctggtataacattggcctctgcactctgctttctagggaggtactgcagtgtggtgcatcggttttcaaaggatacagaatcaagggataacgatccttggaggtaacccgaatcgaaagctgaagcctttgttatttgaaatctacatttggtaacacaaaacatctgtttttgtcatctttttttcttctgcagatttggttcttaaagacaagatctttgtctatgatctggtcggtcagagaatcggatgggcaaactacgactgtaaatctcatctctttaactcaaatgacaccctaaagcaatgaaatcttaccacacttaaaaaattcttaaccttttttatctttcttcaggttcgacgtcggtaaatgtctcagcgactagcagcagcggaagaagcgaatatgtgaacgcaggacagtttagtgagaatgctgcagcaccgcagaagttatctttggacattgttggaaacactctaatgttgttactaatggtaatcaacatgttcttatagcacacagcttttcacaactttgcctaaattgtagtttcttcgatacccttttgatgtggtcgtcggcgtgttaatttgtggtcaccggcgagtaagtttctcccaaccggcgaatcccagcaaaagaaaaattaacttgtttgttgtttgtttgtatgtttttttattcctatttcattgttatagtttttgatgtacataattccttttatacatagttgtgtctatgtgtgtgtattgttctcctgatcaagttttttagtggaaattctgcaaagttaaaaacgaaatcatactatctcacaattctattttgttcatcatacttccgtacactcttactcagacagagtcaacgaaagccctaatctttcttatctgacacaaacactaactcgtgtttcataatttatctgttattaatgttatgctcaaattaggtaatttatcaattaatctctttttttatttggtcgtcttctaaaaatctccaactttcttctcttccatagaacctcaaatttctagggttttaggggtttttcctgaattgaatttcccagatcgagattcgctgtttctcgattgggggtacttttcaactattccggcgatg

SEQ ID NO: 32562 - DNA, 3000 bp, Unknown; identical to SEQ ID NO: 738
  misc_feature (1)..( 3000): 2750-1469P.txt file - cDNA_ID_3058629; gDNA_ID_1620313; Annot_ID_153058

SEQ ID NO: 32563 - DNA, 3003 bp, Unknown
  misc_feature (1)..( 3003): 2750-1469P.txt file - cDNA_ID_3058657; gDNA_ID_1620314; Annot_ID_153113
agaaatgttacaagttataaaagagtttcttttaggttagggctatctctgtataattaagtaacgtaacgtaagtatcctatctttattttctcagtatttctctaaccctttttattaacctcatgtatatgtaatatgacgtcctttaacaacaacaaaatatgacgagctggtgattcatcattggtcgcctaaaaaagaaaataacaatttataaaattcataatttgaggttcccatttatccggtttattagatgctatttttgaaattctacacagaacacgacccggtttgatggcacttgtgctgagtagcgaaccggttctactccttagtcctaaatatggttccgtgtaagtgtttctaaactttaaacaacattcgaaggaacccactcctataagacttatggattttgcagttgaatccttgtacttaaaacattttaatttgaataccaaaacttataagaaattatgtagaacccttttaaatgatttcgtaacgatagctacatgttacatattaatttaagttgacaaaaaatatgacaattagtggttgaattgtaaatatatataacatgtagtttttttataaattatctaaagattaatggtcattgaatcattgatcgtgcatcaaagatactacaaaaagaagaaaatcaaatatataaagaaagaaggcgagtcattttatgacaacgagaaacagaacatcactaccaaacatctccagctcagtttcttcaaataaaaacagttaatctctctaaaacaattttttgttttctctctctcttaaataaccagagagttcagaatcattttgattctctttgtaatctttagttgttgtacctaacatcatggctgaagaggaaccgaagaaggtgacagagaccgtgtcggaaccaactccaacaccggaagttccggtggagaaacctgctgctgctgcagatgttgctcctcaggagaagcctgtggctccacctcccgttcttccatctccggcaccggcagaggagaagcaagaagactctaaggctattgttcccgtcgtccctagtaatttgcttactatcttgtttttcaacagaaagattattactaactcaagtttggttcaatgattattaaaaacttctgccaaaatatgtttctattaatcaactgattagcgtcgtcaaatatacctgattttcttaaagattattactgattacatttccgattaaaaacagaattttataccttttctttaatatagaaaaataaacaagtttcaaaattctgtaattatgtaagttttaaggttaaaaaagaagaactcaaagatttttgttcttctctaatgtgttgttattaatttttctttattaatacttaataaaaaatttattttgtggcagaagaagtagaggaagagaagaaagaaggatcagttaatcgaggtaattaacgtaatagattcatgactaatactaatattatctgaaagtaaaggatcatgggtgtaatataaataattagtatttttgtcataccggggaacaattaattaggtggtttgtgtgtcgtgttatcatgggatgtgtctaaaactgaaagatggtttaataatattcactaattttgggtgaaggttgttatatggacatgtgtgtttatcattgtctcttatttttcccacaaactctgattagtgattgtatttgcttaataattttgggagtgaagatgctgttctggctagagttgagacagagaagaggatgtcacttatcaaagcttgggaagaggctgagaaatgcaaagtggagaacaagtaacgtttttcatgttaacatttatccataaatgtctattaacccgatttagtaatattttgcaatgaaaccaagatattatcattaaggtcttgaagaatatattttgaaacagagctgagaagaagctttcttcaattggatcatgggagaacaacaagaaagcagctgtggaagctgagctcaagaaaatggaggtatgtttgaagttaatatttagttagagattttgaagcatttctgatttagctccgagctttttcaaaattgtggaatttttttttaacaacaggagcaattggagaagaagaaggcagagtatgtggagcagatgaagaacaaaatagctcaaattcacaaggaagcagaagagaagagagcgatgattgaagctaagcgtggagaagaaattctcaaagcagaggaattagcagccaagtaccgtgccactggaaccgctcccaaaaagcttttcggatgcatgtgatctctaatcatctcgatggggaaacaaatgaaatatggtatttgatgtaatgacgttctttagtttgcttaatgtgggtttaatatggcaacatagaaagttataaggtcaacatcttatattgattgggctgcgtttgttaatttgatttgtatttgtacatcttttcattgaaaggctttctcttagctttatgaattggtaagtacaataatacatatttgttctttatgtcgtaatttatgatcgcatcccccggcccctatcataaatgtagtagtacgtaagtggtccgatatgtaaaacgagaacaaggtcccataatttgaaatgtttgcatcataaaatgttatgctcaaccaaatcaatgtagcataagataaaatcaaatcaatgttttagctacgaacgagtcacaatagtatagcgaacaatttatccgtggatcaaagttggcccaaaagggcccaacatttcagtagccggttaataaaatgtaaatcacggcccataaaacaaaggcccaaacccaaataaagagagagatcttcgaaactagggtttcttccggagcttcactacttgagattactctcattcgctttcttttgcctctcgcattttcttcatcctttttgcctcagagctccgtggagagcagcaatcagtagccatg

SEQ ID NO: 32564 - DNA, 3003 bp, Unknown
  misc_feature (1)..( 3003): 2750-1469P.txt file - cDNA_ID_3058660; gDNA_ID_1620314; Annot_ID_153112
aacttgaaaaaacaagaaccaaccacttgtgtctgagtacttttaagtgaagagataaaaacaaaacaactttagaaaaagtaggcgaagtataagagtatagcagagctgtccattacattgaaacatacgtcacatgttctcatcctctaccaaaagccaccacaaacactaacttttgtcaattgtcaatcaatatattcaatacccttttttttgtttattcccactaaattataatttttgctttataaaaaaaaatatcaaactctatattttctcgatctcttctcttcctcttatttctccaagatcccagacgaaatggctcaggtttgtttttttctcatttgattttaaagtttgaatatgattgatctcttcctcctaaattggttttacttttatagaaagtggtgctgaaggttttaaccatgactgatgataagacgaagcagaaagccatagaagctgcagctgatatcttcggtgattatttcttcctactacttcttcttttctttaactactttttgattgaatttcaattcttgtttctgtttattattgtacttttcagatttttaggatttgaaaaaacaaaaagaaaggattaatcaagtttgctgctggtgttttcactcactaaattaccatttttagctaaagttatgtgaaacaatcggtatgaaatctagctcgattgtagtataattgcgtcagaatcttgagagcttggattatttgacctttttgacacatatagtcaacgaaatgatattctgaacattttgaaagcccgtattttatgggccggaaaaagcaggtttagtttgggcttagttaaggctgactcggtaaattcgaaaacgtattatggaatgtgttatagcaagtgttccatttgctttagatttaaaacgacgaatgtatgaccaaagatgatacaatgtagtagttcatatgctaagaggattttgttaagcaggagttgattccatagcagcggatatgaaggatcaaaaattgacggtgatcggtttgatggatgcggttgcggtggtgaagaagttgaagaaggttggtaaagtcgatttgatatcggttggaccggcaaaagaagagaagaaagaagagaagaaggaagagaagaaagaggaaaagaaagaggagaagaaggaagagcagaaagaagaagaacctaagaaataagtgactcgaattgctattaaaaccctaaatttttgtcatattgatttcacaattagaacgctgaatcattgaataatttaagatgtaaaattaattgttcaatacagattgtaataaaagcgaagtatttgaaacttttattcttgtgggaacacaaccaaactagtacaagtttactatattaagcacaaaacagcaaaacctattaagaacaacaactgcaataagtactataaagtataaacgcaaatctatatatactaaacgaaaaaacaaaaacgtgatgactattacataacgtactaccgtttgacatatgtaaaacagtaaaagagatgttccatattaaatgtgaaacttttaacaaattcatcgcaattgatgtatacataagttcgtattcacaatactcgaatctcgatcaagatttaattaaacattggattaatttcttactcataaatacatactgtgaatttctttgaagacatctccttctactgtttcgtgaaatgttaacaagattgattatatggagatgtaacttaaattataaatggatgaataatatcggagataataaaatgcaaagttatcagcatatcactcatggacggaaaaaatccaagttttaattagtaaccaaatcgtttaaatgatttttgaggaaaatggaacaacaatgacttctcaaccacaaataatagcaacaatgacattaacgattatttgtaaccttctttttttagcagtaattagtaactattagctacctttcagttatagaatatacattatattccggattgagcatatactaatatatttttgattactgtctatggattaattcactagactttgaaaatatacaaactttacggtttcgataagaaacaagattcgcgtaaagaaatgttacaagttataaaagagtttcttttaggttagggctatctctgtataattaagtaacgtaacgtaagtatcctatctttattttctcagtatttctctaaccctttttattaacctcatgtatatgtaatatgacgtcctttaacaacaacaaaatatgacgagctggtgattcatcattggtcgcctaaaaaagaaaataacaatttataaaattcataatttgaggttcccatttatccggtttattagatgctatttttgaaattctacacagaacacgacccggtttgatggcacttgtgctgagtagcgaaccggttctactccttagtcctaaatatggttccgtgtaagtgtttctaaactttaaacaacattcgaaggaacccactcctataagacttatggattttgcagttgaatccttgtacttaaaacattttaatttgaataccaaaacttataagaaattatgtagaacccttttaaatgatttcgtaacgatagctacatgttacatattaatttaagttgacaaaaaatatgacaattagtggttgaattgtaaatatatataacatgtagtttttttataaattatctaaagattaatggtcattgaatcattgatcgtgcatcaaagatactacaaaaagaagaaaatcaaatatataaagaaagaaggcgagtcattttatgacaacgagaaacagaacatcactaccaaacatctccagctcagtttcttcaaataaaaacagttaatctctctaaaacaattttttgttttctctctctcttaaataaccagagagttcagaatcattttgattctctttgtaatctttagttgttgtacctaacatcatg

SEQ ID NO: 32565 - DNA, 3000 bp, Unknown
  misc_feature (1)..( 3000): 2750-1469P.txt file - cDNA_ID_3058668; gDNA_ID_1620314; Annot_ID_153102
cttttccttttccctttttgtgttgtccaacaaataaattaaaatcttggaccgatatcgatagcgatatgaacaagcaatcgagcatgtcttttcttcgatttactggttgatattaatcaaaaataaagttttttacataggaaatgttttactagtagcccatgagcataataaaagcagagagaacagagaaatatgaggagactttcaaataattacaacaaagttggatgattatcctattttatatgattttaccaatcataaagctctacaaattaacaattaatctaggtgactaaaacaaaatgaatgctatcattctgcatggttatttcacttagccgttttttttttcatttttggtgagaacagagaaatatctcattttgttgcttccgaaactatcataaagtatacactgcaaggtataaagaaccggtccacaaatacagtgaaattgaaggtgtgctaaacattagataactggttatgcacccttacgctaacactttttcttgctaagatacaacatcaagagtcaagacatttccttgagatatataggccgactttgctagccgttaaaatgttaactttacgttcttttcaaatctgcagattttataataatacagttcttctagacggatcggtctctcccagataaaatccacgtgattgtgaatgagaaaaattggtaggtaaggtaataaaaaattgatgatgatcatactaatattttaagattctcgcttattatgtgggagattaaaatatatggatataatttttgcacttacgatcccatctacttattatgtagattataaaatagcaggcttgcataaaagcataacatgatgtaccaaacttgttagtcaaacaaaaaaaaaaaatatccaagaagctttgaagaaccatggcgatgtctcatgtccagcctgtgcttttcttcctcgcatcactcttcttcttactggctttgtgcagcgccaacgattttgaatattgcaccagtaagtatcgatttgttaagtcttcaatgttctatattttttttcgtgtgtttaattatagaaaacccctataaaaccaattagtttgacatatgaattcaaataaataagtggatttttttctttcttagaaagatgtatagatctaagtgttttttacctgcagaaaatggacatgattatggtgtcgtctcttggatcgaggtctttcgggttgggcctcaggaaaacccaaccctcactataaatgtatttggtactgcgagtaagtaatagttttgaatcttttgatgatttttccaaatttcaactctctttttattttctttatatagtttctaatatattttttgataaaattcttcgtgtgtatatacagcgaaagaaatatccgcgggaacccttgtatatgtagcctatagatctggggattttacaggccttttaaaaacttacgacctatgtgatgtgagtttggcatgtaacattgattctgagattgaagctggcgacgtgtttgacttcagtcttaaagacgttctttatgttggttttgatgaggtaactatttttaatactctttgtatatgaatttgaagtttccttaagaagtcctaggaccaatgttttctcaagtaatgcttttgggttcatgatgttctttgtttctcattaattcttctttttaacttggcagggaatcaagtattccgtatctttgcgtcaaaaaaccgcagaggaggaggatccaataataaaaatgtgtatcgacttcaaagtacctgcctcagcttctgcatttgtctctatttagtcacgttggctgatgaaaagatgtttccaactctttcattatatgactctttctcgcttgcatttttccttttttatgtgttgtccaacaaataaatcaaatccttgaaccgatatcgctatagatattgctttgttgtaattttggcctgattaatatgaaccaacatgcctttccttgaattttctggttgatattgatcaaaaataaagttttttacagaggaaatgttttacgagtagcggatacgcataataaaacgcagaatagaacggaaatatgaggagactttcaaataattacaacaaagttggatgattatgcgatttgttttggtaaccagttggatgattttactaattatatgatagctctataaattcacaacttacactttgcaattccccaatcttggtgactaagctaaaactaaatgaatgctatcattctccatggtttttcacttgatcaatttttatttttcatttttggtgatgaaatcatatttcttagcttccgaaactaatcataaactctgcaaggtataaagaaccggtggtgtgctaaacattagacaactggttaagcaaccttacgctaatactttttcttgctaagatacaacatcaagagtcaagacatctccttgagatatataggctgactttgctagccgttaaatgttaactttacgttcttttcaaatctgcagattttaaattataaaaaaaagaaaaaaaatgtgtttacaataattatcttcgagacggacgtgattgtgaatgagaaaacttggtagttaagatataataaataatcaattatgatcatactaatatttaagattctcgcttataatgtgggataaagaattgacaattgatcatacattcatactaatattttaagattctcgctcttataatgtgggataaagaattgacattgatcatgtactaatatcttaagattctcgctgataatgtgggagattaaaataatggatataatgtatacaggctatagcatcctgcactaacgatcccatctacttattctgaagattataaaatagcaggcttgcatatatagaagaataacatgtacctaactttttagtcaaacaatcaaaacaaaaaatccaagaagctttgaagaaccatg

SEQ ID NO: 32566 - DNA, 3000 bp, Unknown
  misc_feature (1)..( 3000): 2750-1469P.txt file - cDNA_ID_3058672; gDNA_ID_1620314; Annot_ID_153101
gactaagctaaaactaaatgaatgctatcattctccatggtttttcacttgatcaatttttatttttcatttttggtgatgaaatcatatttcttagcttccgaaactaatcataaactctgcaaggtataaagaaccggtggtgtgctaaacattagacaactggttaagcaaccttacgctaatactttttcttgctaagatacaacatcaagagtcaagacatctccttgagatatataggctgactttgctagccgttaaatgttaactttacgttcttttcaaatctgcagattttaaattataaaaaaaagaaaaaaaatgtgtttacaataattatcttcgagacggacgtgattgtgaatgagaaaacttggtagttaagatataataaataatcaattatgatcatactaatatttaagattctcgcttataatgtgggataaagaattgacaattgatcatacattcatactaatattttaagattctcgctcttataatgtgggataaagaattgacattgatcatgtactaatatcttaagattctcgctgataatgtgggagattaaaataatggatataatgtatacaggctatagcatcctgcactaacgatcccatctacttattctgaagattataaaatagcaggcttgcatatatagaagaataacatgtacctaactttttagtcaaacaatcaaaacaaaaaatccaagaagctttgaagaaccatggcgatgtctcatatccagcctgtgcttttcttccttgcatctctcttcttcttaccggctttgtgcagcgccatcgattttgaatattgcactagtaagtatcggtttgttaattgttaagtcttcagtgttgtatattattttcgtgtgtttaattatagaaaacacctataaatcaattcaatcattcatataggccttgatttcttagtttgacatatgaactctatatccaagggttttgtacctagtggaactcatcataagttctaactttcacgatcaatcgctacggctgctgcagaaaatggacacgattacggtagcatctctcagatctgggtctctccctctgatgggcctcaggaaaacccaaccatcactatacatttattcggttctgcaagtaagtaacagttttgatgatcttcccaaagtttcaagtctctttttttctttatatagtttctaatattttcttgataaaatctttcttatatatataggcaaagacatatccgcaggaacccttgtgtatgttacctatagatctggggattttacaggccttttaaaaacttacgacctatgtgatgtgagtgcatgtaaccctgaatatgtgattgaagctggcaccgactttgagttgactctttccgacgttctttatgttggttttgatgaggtaacatgcttttataataaatataaagaaccaaaccggatctgactttaattcacatttccatgtacgtcttttttgttaacttggcaggaaatcaagtattcggtatctttgcgcgaaaagacctcagaggagaagaatccaataataaaaatgtgtgtcgacttcaaagtacctcacccagcttttcctcctcctgcattggtctctatgtagtcaagttgacagatgaaaagatgtttccaagtctttgattatatgagtctcaacttgcatttccttttgtccctttttatatgttctccgacaaataaattaaaaccttggcttggttgatatgaaccaccatgtcttttctttgatttacttgttgatattaatcaaaaataaagttttctgtacagaggaatgttttacgagtagcagagatgcataataagagcatagtggaacagagaaatacagtatgaggagactttcaagtaattaagctttatagattgtaggatcgataactctaaaaccaacacgtctttgctttacccttattgaatgcaagcttatctattatggaaatttactttgtgttatatgcctatttcgatccagtacaagtaaggttttgatcttctaaaaatatctaaattacaaatctaaaaagttaaaaatcaaactggagccctgttttgttgcaaaccaaatatatacttgcttaaaaattaaaaattaaagttgaagtcggaccaaaataagaaaaactccaatatcaaaaacgaataataaataaataaaatccttatatttgacgagttatttacgagattggcattttttagaagagtattgtggaataaagtatttctgtctggactacaaatttaaatatttcttggtcatgtgaatagacgaatttatccttaaaaatttggagagcaaaattcaagttatttaattattattttttttaccaaaaaatcgtgttggtttacaatttagggtttagagtttagtgtttagaatttaggatttaggagagtgaaagaagggtaagatcgtcattttactgaaacaaaaaatgcttaaaactaagggactgggaagaaatacctaaactgaaagttttggattgacaaatgctatggacaagaacccctatatttcacctttggtgtgtaatatgggctagttggctagttccctactttgggctaaggccttgaataggcgtgtaactcttttttttctcccgcatgtcattcgaaagcctttattaaaagtatcaatgttgaaggtatattggtattgcaagaagtttttttggtttctaaattttcgtttagccaaggttttgtttctcttttgtgactatttgaaattaaaaccctcaagcattaccaaaaagatgaggccttaaagcaaatatgccttaactcacaagattctctgtctctctcttccctctttttcttattctttctctttctttttttgtcctctttctcctaaactctttcgaatctctttttttctttttctttctggcttctccatcaggaagattccgatg

SEQ ID NO: 32567 - DNA, 3000 bp, Unknown
  misc_feature (1)..( 3000): 2750-1469P.txt file - cDNA_ID_3058679; gDNA_ID_1620314; Annot_ID_153098
attccaaatgtatatcaaaagaaagtgtgacatatatatatatatatatatataattatatatatgtaaaatcttatttttcaacgtgagaaaacgatagctaataaagagtggtttatgttagatgatgttgcgtgacatgaggttaaaacagtgaaactcaccgcaaaaataataaatcaatatcaatctaactgaattattcagtctcatttatcaagaaaatgttttatcagaaaaaagtatgtcaagaaaataatataattctatgaaccaagaaaaaaaaggagtgtgagacatacaagcaccgagagcagcggcgtctcgaaccagtgtcatgctaacacgccgccctggttcgccggaaacaagcggaggagagaaagacacgtagacaactagaaccatagccgctgttagatcgaggagccgagtcgtcgtcttcattgttacagttttggacgcttcaatggtgaaagaaggagactgggaatgaaaacggcgtcgttgagttctatgcctgttgtatcaaaggaaaataattgatttggggatttaagagggaaatggaaaggtttatagtatttatagataataaagattttgtggaaagtaattcatttggagaagaaagggaaaggagaggtcaagttggcaaagaggtaagagaaagagagagatttatgatattgataggcacaaagaagtttttgccatcttacaatttgttttcctttctatgaaaaagattgattgttgttaccaattgttagaaatctcttatcatctttaaaaaaaaaactcatatcatatctatgcataaatatgtatgtataattcaccacatggagagactcacttatttttcatgtgtatgtgtgtaaagagagacatatctgacccaaaaaaataatctttgatttgttattgtttacattaatttatttattagaaatataaagtccacatgatattttcttccttaagaactttagctttaaaaatagatgaaatttttctgttgagctaaaagattcatttccctctatacattcagatttctattttcgtttagtaaatatttccttgtaattctactgtggtccaccattgtaaattcattgtttatgtttttgtaagaattttcaatctgtaaatgtattgaaatccaatttctgtattggtattaaaaacaaatttcagtgacagccacaggctcacaaaaacagttctacactactacttatcagtttcacacgagagctaagtttagttatgtgcagtagacagcatagggcgtagataaggccaaaaaacaaaaaacaaatgattaaaaaaaagtttttttttttgcaagaataaccatattttgatactttctttttatttatttataaaaaatgtattgtatttttagatatttttctaagtatggagatgggtcttgatgggtgggtcaccagctgatgaattagaatcgaaaatcacattcttaggtgtcttttggtttaggttcaccgaatcttcttaatctatctttaaagaaccaaaaaaaaacacacacaaacaattgtcttcaatctctctggtcatttttcttatgaaaacaagtataataattacatttatttacactctttaactaatcaacctattattacctaactacaactttcatattcatatcaagaaagaaaggtttgatagttagttatggttgttatccttagccattatgattttggtttggtcctcacgggtcctccttcaccaaatgcatatgttttttttttttttttttttttttttgtgttgcctttgaagtgaagctatcacaattttgaatcaaaatgttgtttggctttctaacgtgcatcaataaaatcaggaagaacttatcattcgtcacaatcaacataccagctacttgtttcttattgtccatcatattcctaacaaatgatatatatagttcatctcgaactattgaattattaagtattacgcaacacacctatgtcaaatgatctgaacttcgatactatatcagaattcaaatacgtttaattcaaaattaactgaaagtgaattcattcattaatatctcttatttcatagaagagatttccaacatttttttaccattgtagtgatcttttagttgcaacatttactaattagtgataagagagcacacatgtgggagaattaggcacgtgtgaagagctaaagagaagcatgagaagaataaaagagtataaatagggatattagagaggaattatagagattatcctgcgtgatcattgatgttgtgaggagaattagggcttgtgtgctatgttcttgatgataagagatgagcattgtaactccgatcttatcaatatagggttttgattcattgtaattgggatttacggataataaatacaaaggtttatgcgtaagttcttatcaacttgtaatggtcttctggttgcaccatatgctcatagatctagtgtatttggtacaactgcttaaaagtttttgatttactctagtatatttaacggagatttgcctatttttccttaagggtgtgtttaatgttttcatgttgaaacaatgaatgaagtttcatgtaattttaaatgaatgagcaatcataatgaaaccgatctactttgaagtttgaacatacaatagaattgactcatatgcttataatggactcaccatctatgtttcactgctaccacaacattttttggtaaaagattcactaatccctctttgtgttggttaaaaaatcaaggtaaagagagaaaaaatttcaaagattatatgtaccaaatgaacaatttgaaaagaaaagggttattttagaagtaaaaggaaatatatggaccggggaggttattattacagaattaaaaaaccctctttcacggtggcttcttcttctttagttcatcggagaaattttagggtttatatcggcgaacggaaaagatg

SEQ ID NO: 32568 - DNA, 2053 bp, Unknown
  misc_feature (1)..( 2053): 2750-1469P.txt file - cDNA_ID_3058701; gDNA_ID_1620315; Annot_ID_153162
cctttccttctacctcaagacaaaaaagacgtaagtataaggactcatggacgaacatttatttttatcatgatgtacggtgattggttgattaattggcaaataaatgtttttaaaacttactttttggtcttttgaattttattgaagagtgggtttttataggcggttttaagccaatagatagatggatatataactttttatgaagtatgttgtggtttaatctctcaaactgagagatgatttccttgttttattttagttagctttatcagccaagttgagattctcagccaaagactacagtgaccatatggcactcgttcgtgcctttgaagggtggaaagatgctgaaagagaaggatcggcttatgagttttgttggaggaatttcctgtcagctcagacgcttcaggcgatacattctctgaggaagcagttcaactatattttgaaagaagctggcttagttcatgatgatttagctctcaacaacaagctaagtcacaaccagtctctggttcgtgctgtcatttgctctggcctattccctggaatagcatctgttgtggtaagtctaagacccatgtctctggctaagtctcctttctcgtgtcagagatttcggtgaaataaccttgttgtcctttttctttgcacagcacagagagacttccatgtcattcaagacaatggatgatggccaagtatcactatacgcggtgagcctcttcattcgtatttcccaacatcattacttgagtctctcgatatggccatcttttttatttaaatggtttttacggtttctatgtttcagaattctgttaattcgcggttcccaacaattccatacccttggctagtctttggagagaaagtaaaggtcaatgcggtactcatacgggactccactggtgtccctgattccagtttgatcctttttggtggttcattgagcacgggagtacaggtgatttctctcattttcctctttttaacccttacactagtcagattatggaatactccggaatcgaatggattgaatgttgtgttgtttccaggtgggacatctaaaaatgcttgacgggtacattgatttcttcatggatccaaatttggctgagtcctatgtaaagctgaaggaagaactcgataagcttcttcaaaaaaaggcgagtttttttcaattttaaaaggaaaaagtgttcgtagtgcagcactttaacacctttagtatctttacgatttgcagcttgaagatccaagcatggacatccacaaagaaggcaagtacctcatgcttgcagttcaagaacttgtggctggagaccaatgcgaaggcagatttgtctttggccgtgacacaaagaggccaagccaaccgcaaataggagagaacaaacactccaaagacgggacaaacccgaagagtctccttcagacacttttgatgagagctggacactcacctccaaagtacaagacaaaacatctcaagacaaacgaattcagagcacttgtggagtttaaaggaatgcagttcgttgggaagcctcagaggaataaaacgctcgctgagaaagatgctgctgttgaggccttagcttggttgactcatacctctgataatagtactggccaacacaatgaggatgcagattctccacctgatgttactgataacatgcttaaactccttggaggacggcgcaggcgatccaagggcaagtaattgaatctctgtaggttttttcgcagacagatttggtttgtgtaactgtgctttggacgatctcaaataccaaccaaagcagatagagaaattatacttcagtagtcactatgtaactatagtgtcgtttttggggcagaacaatagtgtagggttataaacataaaatctagaaactttaggggctatgatgtattttgaacaataattggggttattatcatcttatatgccgccacgtggcatttaactctctctgagcttgctcgcttacgcaactctctctctctctctctttgagcttctgtaatg

SEQ ID NO: 32569 - DNA, 3003 bp, Unknown
  misc_feature (1)..( 3003): 2750-1469P.txt file - cDNA_ID_3058710; gDNA_ID_1620315; Annot_ID_153149
gaagctcttggaaatagttaagaaagaacgttggagtacctggacttggacaaatccatcttcttggttaagaatttgaagtgacagggttccctgcatatcaaagctactaagtccaccatctcgtctcaatgcaacattgagcttctcttcaacagttaatgtgaaaggatcagttggaggtggggcagctgctttggattggccagtaggcttaacatcttcaatgacgtcttcaccttctgctttaagggactccattaactggttctttcccgacttgccaagtttcatgccagaactcttaggaggagcagtaacagaagaccgtgatcgatctgtgaagttaagcacggtggataagaatttcaaaacaaagagattatctaatcgaaatcaagtatatatatatagaggcgcttaagaaacccgagatggaagggcattttgatttgaatacttgggattgaacggtcatttgtgaatgatccactagttaaagcacactaaccttttggtttggtattgatagggtcgacatctgaaatcatgccaaacccagaaccacttccataaccaccgccgccaccactggatatgctcaattcattgaaaccactttcaagtcttccagatcccattgaacccatggacgaaaatcctcctggcttattcttttcaatctaggaattacataagaaatattaataggagttacagaaatagaatacaacagcagggtgcgctcctgtcatgtaccttgcttttgtcaatctcattagccttacgcttcatcacgtccttagtgtcattgatcttgctctgcataaccagtttatgcaacttctcctcatgactttccatttcacaatactgcttcacctgggcaactgtcacactttccttgtgcccaagagatatgacttcatcaaatgcaaatatgagctcaaaagatgccctggaaatcccttcttcatctaaagacatggaatactcaggtacctagaaacaatcaaatgatcaaacagcacttggaacactcacttttcaaaagaactaagaaccagtacacatccagagtcaaggcaataatctcctcaaataaagtagcagaagtaaaaaaaaaagaaagaaagaaagaaagaagcatacaagtttggagagcaaagtaagggtggccaggtcttctagaatgttactctgcttagttgtaacaagaagcaggaacagagcttcaataggctgataaacatatcgcacattctccgtctcgatataggtatgctgctttcccattccaaccagcttaggaaaagctgcaagtagaccttcgattctgatacgggacatatccacatagtgtctggaaacaatcactacataaaaaagaagaaagttagaaaaaacgcaaaaatattgaaaaacgagaattcgaagacaaagtcaaagatagatgaaaataacctttcccagacttgaccacaatggcagcagcaagcacaacctataaagcacaggttccaactttagaaaacgcgccagacactcatcaaacactaaagttaacaccaaattgcgaagatgcactaaaaaggaaaaagaaaaaaaccaatcatagaacaaaagtcaataccattttgattattcaggctcgaacaatctcggcgattataagaaaggtaatgcgaatctgaaatacaaagaaccaatgttagagtaaatccagttagagcgagatcagaagaaacaaacgggatttgatcttcaggatcataaatcacgtaatagaggaagagatctcgaatacacgaatccaaacgaaactagactagcgaatcgaaaatataaaaagaattcatcgcagatccagcggatctacgagcatcagaggctcataatcgaaaaacataactgtagaatcaaaatcaacacaagcggatcaaattcatgaaacaggatcgcgaaatttagaaggaggagaaaattcttaataatggagatccacagaaatgtagccagagagaacattcattcaaaggaaaacgaaaatcatcaccatcagtgaaggcgaagagcgagagaacaagacgataccttgggagtgatcgaaggagatgaaatcaccagtttcttcttcacaagctcgccgagtaaaaaagatgaaacgagtctcagattaaatcctggtgtgtgtgttagagaaaagacgatccacaaaacaaggacaagtaatctgggccgtttcagttccttattgggctttccaacccagtaaatggaagaaaaaatgccaaaagggcaaattcgtcattggtgcagaccgacgacattcggtttagtccggttgaattttgaaaggaatgtactttcatgtattgagatttgtagcaatcaatcatcttcaaaagtcaatttcagttctagggttttaatttgatacgaggtcagcgaatccggcgacgaatatccgccactagtaactctagctcaggtaggttactctctctctcgttttctttctttatctggttttcacttcgtccacttagaagtatgctcatttgataaattggcatttgaccccagttcaggatttaggattctgattatctctcaatacttgattagtttagtgcttaagttattagtttttggtatgcccacttgcgccatgttcgtttctaaagcaatgagattattttcatttaaagatctggaaaaaagaaactaatggagacaacggcaaatgaagatggattttaagggtttttgttcttagtaaaaaaaagttatcttctttttaattttctgagactttaattgctagaaagttataggattgattcagatagtggaatcagacaactttttcttttatgggcgattactcatttttgttctttggtcttctgattgtttagtttcttagcagatgatttagtcttctcttttgtgatccttttttgctttccttggaagtgtaggtaaggatttgtgtccatg

SEQ ID NO: 32570 - DNA, 3000 bp, Unknown
  misc_feature (1)..( 3000): 2750-1469P.txt file - cDNA_ID_3058714; gDNA_ID_1620315; Annot_ID_153148
gatgagagaactttgcgacagtaattatctgtgaaccacatttctcgagttgtatcacaatttcaactacagaacaatctctcagatagacaaacaaaccaaacaaaactcgtgtccacaactcaagaccttcgacttgctaaaccggagtctcgcagctcccacgccggtttactctctctcgaaacatcggacttgattgctcgaaccaatggcttcatcaccagcaagtactgcattttcaaaccatcaaaagatgaataaatgatgcatgatgttttgatcaagccttattctgtattgttactgaatggttcagaggggcttacttggaatgcaaacattaaaggaatcagtttttttcctctttcgtttgggtttggcccttcgaccagtttcttgtcaacatgaatcgccttgttgccattaaaagagatctctgtgattttgttgaacagattgggaatccaactagtcccgcatggaagaatctgtcacaaatttggaaaatccgacttcaagattggtccaactactacaagacgcgagaaaaagagaacgtggacaaaaccaatcaactgaccttttcatcgctttcgttcttatggcatcttccgctgttctcaacaagaatgacaggaatagaaaaaccctacaataaaagatcagaggtaagtgagtctattaacttgactactatcaaggtcgttacagacatttatgtaaggaggaaaaaactatacctgcaaatcctgtttcttcagttgagcgcctgtctggataacttttagaagagcattagatcttttggagacaaagtggttataatttaacccgtctggtggagagaactgagcatgggtgagaacaagagcagacttcttccatatctctttaccaaatgcatcagttatagcaccgacaacttgcctatcaaggtcatccacccggtacacatccaaacggtctacgtatagtagcacatctatagtcatgttgaggagaaatctgttcaaattcaacatccacgaatccaaattaatacaaatgccacaaatgagccccaaattaggagagtaactccttagacctggaaacagttcatcataccgttttataatgttgatggcttgatcattcacatatcctccctcaataagaccaggagtgtcgatgatattcaatgtaaatcccgatcttgtgcgagagaccaaggtaggcctcagtccttcagactataaagagggaaaatcacacactttctatgagaaaaattaaaagaaagatagccaatagtcataaagacaagccatgagaagagcattaaacttggcacctggaaagtactaactgcagcagctttctcgcctataactgaattcacagttgatgactttccaacaccacctttccccattacaaggaccgttagcgagctcacatcctacaccagttttttttctttcttaaatctctctaagacaagaagaaacaaacagaaagcagatgaagctagaaacaagaaaggaacctcttctttatacttcccaaggatctcgagcaatttagattgagtagcaggtgggaactgctggataccgatccattcacgaagcgtttgcaaagctgccatggacacaaatccttacctacacttccaaggaaagcaaaaaaggatcacaaaagagaagactaaatcatctgctaagaaactaaacaatcagaagaccaaagaacaaaaatgagtaatcgcccataaaagaaaaagttgtctgattccactatctgaatcaatcctataactttctagcaattaaagtctcagaaaattaaaaagaagataacttttttttactaagaacaaaaacccttaaaatccatcttcatttgccgttgtctccattagtttcttttttccagatctttaaatgaaaataatctcattgctttagaaacgaacatggcgcaagtgggcataccaaaaactaataacttaagcactaaactaatcaagtattgagagataatcagaatcctaaatcctgaactggggtcaaatgccaatttatcaaatgagcatacttctaagtggacgaagtgaaaaccagataaagaaagaaaacgagagagagagtaacctacctgagctagagttactagtggcggatattcgtcgccggattcgctgacctcgtatcaaattaaaaccctagaactgaaattgacttttgaagatgattgattgctacaaatctcaatacatgaaagtacattcctttcaaaattcaaccggactaaaccgaatgtcgtcggtctgcaccaatgacgaatttgcccttttggcattttttcttccatttactgggttggaaagcccaataaggaactgaaacggcccagattacttgtccttgttttgtggatcgtcttttctctaacacacacaccaggatttaatctgagactcgtttcatcttttttactcggcgagcttgtgaagaagaaactggtgatttcatctccttcgatcactcccaaggtatcgtcttgttctctcgctcttcgccttcactgatggtgatgattttcgttttcctttgaatgaatgttctctctggctacatttctgtggatctccattattaagaattttctcctccttctaaatttcgcgatcctgtttcatgaatttgatccgcttgtgttgattttgattctacagttatgtttttcgattatgagcctctgatgctcgtagatccgctggatctgcgatgaattctttttatattttcgattcgctagtctagtttcgtttggattcgtgtattcgagatctcttcctctattacgtgatttatgatcctgaagatcaaatcccgtttgtttcttctgatctcgctctaactggatttactctaacattggttctttgtatttcagattcgcattacctttcttataatcgccgagattgttcgagcctgaataatcaaaatg

SEQ ID NO: 32571 - DNA, 3003 bp, Unknown
  misc_feature (1)..( 3003): 2750-1469P.txt file - cDNA_ID_3058741; gDNA_ID_1620316; Annot_ID_153186
gtctggatttaaggaaccatttttttatttatttcttttccattctctcattttaaaaaaaacaaaaatcttttgggcaatttttcgtaaatttgttttcgttgcgaattggtgatccaacaaaaggaaaccaaatttctgaaaattcaaatgggaacacttaaagtatagtgcaattgtattcaaactgacaaattaatcattaattgtattagaaaatgatatattgtcatcgtgactaatttgtcttttgaattcaattgtaactactaactactggttttcatttttcagattatttctcggttcttaaaaagaagaaaacacatacctaatatcgtgtgtatcaaaaagccatgtgcgagcaaccatcttcctttgtaaatttgacccttttgtgtatcatttatatcgagtgtttgtaattgttggttgattttgtgttatttgagaggctagtcatttacgcaatttctaaatttatcttttagtacgtatcaagatgttggagcaactgtgtccaacatacatgacatgtgaaattataattgttaaaacaaaaggacatgtgaaattactatctacttaaagaaaaaaaccagaaagaaaaaaaggtattaaatttggaactaaaagaaggttaaaaagttttttacagaaagtaattacacttgcagatgaaagaaaaaaggcagcatcatgatatgtaaaaaattgtcgaagaggtttagtcgtatcactttgtttgactgatcactgtcttctgattcatttttcagtttttctttttcaaattgtagctcacaacattaaagttattcactgctttaatcagatagtttaatactagtaactagctcatttaggctttaaacacctctttctgattactagcccactctttggtggttcttacatatcacacctaactatactgtgtatccttgaagtgaaaatcaaatttaccattcgtatcttacttacatacactattatttttccttttttttttcactcaaggtcctactctttgataccatagctataatttggaaataactatttacagtgtattaattatacctaaacagtttaatctggactaaatatttagatagatgttacaaatttggttcgtctaataaatgaagacaagacatgctaacaaataaaacactaccacaaagggatagtgagagaatgtgttttgcaacaagacataactttgattgcttgatgtgttaaaatgattatgtcagagacagagagcgatcataggctttctttatttctaataacgtcgattttcttcttcttttctggcgttcaataatgtcgaattttaattcttgatttttgcaactctaaatatccttaacgacattgaagcatggtgcatgtcgatcgttaataataaagttgaacaaaaatcttgttgaattaattacaagcacagcttcaatagcataactttacgagacgaccagatcttatagacgagtttcgcttttacttttttaatgattaaaactttcatcggagaacataagtcttcctcttaattaaaattactacccgtgcataacttcattttttaaaacatcaataattaatatacgattacaaccctaaaaattagtcaccctatagtacataacaatgatgatagttttttctttttggtgtaatgttaaaataaaatgttagccatattaaacgatagttcttttaacttagccattgtaagatatttcttactttagtttttccgtagaagatattcattatggtatggatagtatataccttaactgagtttaaatattggatcaataccatctaataacacatatctgatgttcaatacttaataattttgcataaatgttaagcgtgacaacttaaaaaaaaacacatcaacagagtaaaaacatatctgttaaataagaaaaatgtcatttttataacacttaaaaaaaaatgcatgaagcgtttcatagtttttttttttttcaaagtaatgtaggcgttagatatttcttacaattttttgaaaaatattttttatgttgtgattggctgatatcaggtaactaaaacttctttaaagaattgaagaaaatttgaaaagtaaatagatggattcctatattgtcatttcagaaaaacagtagggacaacttcgtaaatgatagccgtattattaaacaaataaatttaaattagaaaaaaggaaaaaaacgcaccacttttctttttcgctgatgcacagcttgtcggtttgcgtgcaaatcctctgtttcacaattttttcttcttctctttctctctcttcctcttttattcctctgttccaaagttcagcagaagcaaacacacacatcacttactatctctctctccttcttcactttctcacataaccaaactctctctttctctcttttttttgaagtctcctttgaaactataattgccctttagtgttgttcgttcagagtcttcaaaacttttgcagcttcaattgtacctgggtttcttcttcattgttcctaaggtttctgtgtccttcaattcttctgatataatgcttctttaagagagttgacatcatcactttcttggggtactcttctctgtttctccccagaaaatccaactctgtaattttgggtctttattctgtttttctctttgaagaatctttaaaattctcagatcttctgaatctctcttctttaaaactttttttaactttattttttgtactcgcttctttgccttcatttttctcgtatccacatgtcgttggtctttcgctacaagccacgaccgtagaatcttcttttgtctgaaaagaattacaatttacgtttctcttacgatacgacggactttccgaagaaattaatttaaagagaaaagaagaagaagccaaagaagaagaagaagctagaagaaacagtaaagtttgagactttttttgagggtcgagctaaaatg

SEQ ID NO: 32572 - DNA, 3000 bp, Unknown
  misc_feature (1)..( 3000): 2750-1469P.txt file - cDNA_ID_3058747; gDNA_ID_1620316; Annot_ID_153177
tatacaaatctgaacaaacattaaaactcatctctctcatcatctttggccatggcaaaagacttggatgtgaacgagagtggaccaccggcggcgagagactacaaggatccgcctcccgcaccatttttcgacatggaggagcttaggaaatggccgctttatagagcggtcatagctgagtttgtagcaacacttctgttcctctacgtctcaatcctgactgtaatcggctacaaagctcaaaccgatgcaaccgccggaggagtggattgtggcggcgtaggaatattgggtattgcgtgggctttcggtggaatgatctttgttctcgtttactgtaccgccggtatctccggtaagtatgtttatatacaaacgttcgagtcacgttacatagatttccacaaataaaaacaaacaaatattatttacgaattttaatttgagatggtgataccatactattgttgtttctttacggttcagtttgaattagtttggtccgttttatcaaaatttaaatacttctttacaatttatttttgtttatgaaggtggtcatataaatccggctgtgacggtgggactattcctggctcgtaaagtgtcattggtgcggacagtgttatacattgtggctcagtgccttggtgccatctgcggttgcggtttcgtcaaagcattccaaagttcttactacaccaggtttcatcacgtctcaaaactcctatttttttggtttcatagatatatatatatgatcatattacactgttttactaatattggtaatgatatttagatatggaggtggagccaacgagctagccgatggctacaacaaaggtaccggactcggtgccgagatcattggaacttttgtccttgtatacaccgtcttctcggcaaccgatcccaagcgaaatgctcgtgactctcacgtgccagttttggctccacttcccattggctttgccgtcttcatggttcatttagccaccattcccatcaccggaaccggtatcaacccggctcgtagctttggagctgccgttatttacaacaacgaaaaggcctgggacgaccaagtacgtcattaacctttatataaacatattttttcaaaagttatatgaattgattagtgtttaattataacattttgtttttataattgaaacagtggattttttgggttggaccgatgatcggagcagcagcagcagcgttttaccatcagtttattttaagagcggctgcgattaaagctcttggctcatttggctcctttggctcctttaggagctttgcttaatatacatttattttaaattaaaccacaagttataaatctttgatcaaaattaaaaggatgattacaaatgaattaagtggaagttacatgtgatcttctttatatgtttctgtttttttgttctctctttcatttcatggaatttcccattcgtgtaattgtaaatgtggttttaattaatgttgctttaagataaaatctcaagttcgctttatcttttcgtagagttgacgttaattttgtcttttgattgtatttctctcgggaatcaacatatgtcacgcatgttttaaatctcaactttgtatttccttccaagcatttttttaggtttatgtggattaattagggattccaatataacccaaattgtggacccgattaataaaatttccgtatccttgttttctttttccattgcggttccttcaagctaacaaactcttcatgcattctttgtcaccaatcttaccaaaaatacgaaagaagagaacaaatcgtatgaccttaatttaaaatcatttgttccacatacctatatcaaatatataataaacgagtaaattacaaagggtcataagatttttgaaaaaagagagagggtaaaaccactatatatattacgaactatttgttctgttaaggataaagtgtatcattcattaacacttgttctagaaaaggtaaattctatatagatgattgaaaacaacaaaaaatgcatgacttctcttcagtcttcactcattcaaaaacacactttattatttttcttgatattatgcaatcatacaattttgaactttaagcaacaactatctcctctatagccaatatcccatataaaacccaaaaacacacactcacactaaacaaaataagaaaacatttacaaaactggttagcgaaaaaaacaacaacatcatgacatacctaactcactctttgctcttcttcttctcttgcttatctatgcttctttgcgtctccattgcaggaagcagacctgttcacggtccagcttatacaaacccatctgctttctctccacaagcttacgatttctttcacccaaaatcatcactctctgatcacaataatccaccaaaatcctcgccttctccgctttcactttcaccttcaccttcaaaaacatctattgtagaaccagattcacaaggaagtaaagtttcatcagacgaacacacaacaagtgagagtcgacgagaagaagaaggacgtggagaaaccatcggagtagtgttaggactttctttcatcgcatttctctcattaggaatctactttgtgatcaagaaacaacgtgctaatatcatccgcactattgtcactcactctgacgcttaaatataccaaaaacatacttctttcattactcttttcaagattttgtcaaatttctattgttttgattatgtagaacgttacaatgtgtcaaagaaaacatttcggttcggtttagtttaatttgttcggtttatatatttttctggttaagacttaattatagatttatagtccctaataatttaatttgatcctaaaacgacgacgtttgatttggtaacaacgaacaatgtactagaaaagaaacaagcttgtattgtactcgtagttgttacttgttagatctcaacaaccaggtcgcacacactaaaatg

SEQ ID NO: 32573 - DNA, 3003 bp, Unknown
  misc_feature (1)..( 3003): 2750-1469P.txt file - cDNA_ID_3058751; gDNA_ID_1620316; Annot_ID_153173
tgtgataatgattgtttgtaattacaggacgggctcggtgacacaataagagtttcactgacggagccaccagaagaggagatagatccctgcaggcgattggctaacctcgggacaaaagctgccaaacttcaacaaggcgttgtatgaataattcttgttctgatccttctctggtttccaatttatgggactaatgcaacccttttttatgtattaggcaccgtttgaagaaaagcataggcattactttgattttcagcgtcggacgggtgatctacctgtacaaaaagaggtaagactgtacatttttttttaaagtttcatgatgtcgtttccaagtattaaggaaaatgaagtctttcgtcctgaaaactatagggagaagaggttgattacagaaatgtccttcaccgtgatggttctgttctgatgtcgatttctctggatcaactaaaggtgagtcttgataaatattcttcagtcttctctccttcttcttctatttctttaacccaaaatgtaaagggatcattgtctttctgctcactactttggtttcctgtctaggcacctgaactcctctacagatcactcgctacaaagcttgtcgtgggtatgccattcaaggtgagatatggttcaatatattttcatgagagacgcagtctcactgtaataaattgatattggttctcaatctgactttcctgagtgatgcttgtataggatctggcaactgttgattcaatcttattaagagagctaccgcctgtagatgatcaagtggctgtaagaatcaccctttcttctccatatcatttacatttaagatttgacatggctgagtataaatattgagttctgtttacagcgtttggctctaaaacggttgattgatgtcagtatgggagttatagcacctttatcagagcaactaacaaagccattgcccaatgccatggttcttgtcaacctcaaggaactatctggtggcgcttacaagcttctccctgaaggtgtcccaattgtttacctgaaagaattcataatatagagaacagttttctttcgttatttcttagcttcggttatttcaggtacacgcttggttgtctctctacgaggcgatgagccttacgaggagcttgaaatactcaaaaacattgatgctactatgattctccatgatgtacctttcactgaagacaaagttagcagagtacatgcagctcggaggtaataattgaatattctcaatagctaatcttttactgagttcaaaattgtcacttttaagcgctaagtggtttttttttcctggacttgtaggctattcgagttcttatccgagaattcagttaactttcctgttattcatcacataaacttcccaaccggaatccacaggtagataacgacttcaagctttatgcagtgaatggaaaatccagttttgaccatgtgatgttttctttcttcttgcgcacaatgcagagacgaattggtgattcatgcagggacatatgctggaggccttcttgtggatggactaggtgatggcgtaatgctcgaagcacctgaccaagattttgattttcttaggaatacttccttcaacttattacaaggatgcagaatgcgtaacactaagacggtaaaagcacaaagaatcagtatttctgcattttctttctaaaaagagagaagcaataacttgcaaaatcatcgcaggaatatgtatcgtgcccgtcttgtggaagaacgcttttcgacttgcaagaaatcagcgccgagatccgagaaaagacttcccatttacctggcgtttcggttaaaactcaagactttcatacatgtttttcaagaaaaagttttcttctgtttttgaatgtaaacaaattgaataatggcgcagatcgcaatcatgggatgcattgtgaatggaccaggagaaatggcagatgctgatttcggatatgtaggtggttctcccggaaaaatcgacctttatgtcggaaaggtaacacctttattcttgagcttcgttgtgaatgtgtttatatacaactcggagcttccgggtgacaaaagaatctgattttgatatgttgtggacagacggtggtgaagcgtgggatagctatgacggaggcaacagatgctctgatcggtctgatcaaagaacatggtcgttgggtcgacccgcccgtggctgatgagtagatttcaaaacggagaaagatgggtgggccattctttgaaaactgtgagagaagatatatatatttgtgtgtgtatatcatctgtttgttgtgtattgcatcatcattttgaacaaatgtccaaatctcttaagttgataaaagttcttaggccaaataaaatttaatatgaaacttgaacaagaaatttgacattaattaatcaacttatgaactcctcctaatataaaatagaatattattacaaatacgtaaaacgtcgtcgttcatttatctgaatattatatatatatatatatatatatatatatatatatatatatatatttaccctttaagaaagaaaaaaaatcgaacttcagagaaaacctaatgtccaaaacaatccagcgattcattgtcttcacttttacgtttctgtaagcaaattcgtcctgtgtttcttggtttcttacacttttttgttgttgatttcttttgtaatggatcttgtttaggtttcatttcgtgttccatcatcgtcactctcctagggtttcggttttgcttactgttttttttaaaaaaattcttagcctttcctggaaattattcttattattctaggttattaatagttgggttgtgatttgtattctgatttggttctctgaaattgatggaattctgttgagtttatgatcttgtttgattggcttcagacaaattctgagagtcttgacgagttttcttgtttctttttcaggcaatagaatcttgggtttggttaagagagatg

SEQ ID NO: 32574 - DNA, 2651 bp, Unknown; identical to SEQ ID NO: 746
  misc_feature (1)..( 2651): 2750-1469P.txt file - cDNA_ID_3058753; gDNA_ID_1620316; Annot_ID_153172

SEQ ID NO: 32575 - DNA, 1369 bp, Unknown
  misc_feature (1)..( 1369): 2750-1469P.txt file - cDNA_ID_3058761; gDNA_ID_1620317; Annot_ID_153225
caatctcattacgcatataacattttatttatgtgaaagttgcagatatagatataaaatgaaaaagtcatatataaatgacatgacaatgcaaacaaattatttattagaaaaagaaaagagaaaaaataaattttatagtgccgacagttttctttttccccttgaatggttgtaggctaatatatctatttatgtcaaactattagatcttcttttttcttttctacacgtccatgacaaaatgttagatcattgccaaatttaagacatatctatttagcgaaagctaaaatttggatagtacgtacactacacctaatttgttaacaccatttacggatagaagaagcctacacctaagtcggtggattcttggatttgtacaagtaggtctttaacacgaaaatatagttaaactggaactacacttagattatactaggtcttgccatcttcatatatatgctaatatgcccacatttggtgcttactaggttttaacccgcggtttaccgcgggcaatcggtttatttggttcttatactaaatatttgaataaatttgatatcctaaacatataaatataaatttctagtgattagtgaagaatattgatattattgattattgatttcatgattgaatagagtgtttttagggatggaatgtgatcatcttttgatttcaaaaacgacatagattccttatttttgttgaacggtttagattgaaggaaaataatattattaaacggtttagattgaactgaatcatataaagtttaggagattgttaagaccaaattacccttaatgattttgaatagcaaagaacaaaatccaaaattgaaatcaaaattgaggttaaattagacaaaatttcaatttgtacttcccttttaataataaagggataatctttcggtatatagtttttttttgcatttactaaatttgtttaaattgcttgatattctacattataaattaaattacatacattacaaaaaaaaacaaaaatcagaaacaaacaaacactactcactgaaatacaaatcttaattacacattttaaactttcactgaaatcatttaaaaatgtttcactaaatattcactaaaatacaaatattcgtaaaaagttaattgtccaatgaaacttttattgtttgtttaattcgattcgacagtccactttttacgaatatttgtattatagtgaatatttatagtaaataagtagtgaaagatatttagatagtttcagtgaacgtttaacatatgccttattaagatgctgatatttccataaggtaagtacaactatatgagagcttgcatcaatctaatccaaccaaagaataatg

SEQ ID NO: 32576 - DNA, 3003 bp, Unknown
  misc_feature (1)..( 3003): 2750-1469P.txt file - cDNA_ID_3058792; gDNA_ID_1620317; Annot_ID_153216
aactgaagaatatttcatgagcataaagaggtgatgattgtgaatcatgatattcgataaagccaatattagcttaatcattttcatttgtttacaagttaatagcggtacgaaataactagtctatttttgtttttctccttttggcactatgaatctatatttcagtttttgtcttttccaacttgtacaaatagcattacatttgttttgctttcctacttaaactcatcatataaatatgaataagacatagaaaacagtaataaaagtgtgttcttttgattggaaccaataaacccacaatcgttttattggaaccagtctcaaaaaattaacaccacaatttttaagcttcaaagatgacattgaaaactcccaacaaccatcatcatcactgaactgttgttatataagattaggatttattattactaataatgttttacatatttattgagctttaacaactaggataaggaatattacaaacttctaaaactttgcgagcaactggagagctaacaaacgtactgtataagggattgttaatgtaaccacataaacattccttttgctcaatcagtttgtcgcaacaatctttagttggttgtcctcctgtggtcattgccggtaagcatggcatgagttctgttggaatacatgacgatgacacttctgatttgatcaaaataggagatgacatgacgactatcacaactgtgatgaccattagtttcatgaacttcatgtcttgaaactttgatgatttctttttgctttcaattgtttttaaaacttataaatttgagattttggtttgtaggttcttagttcttacgatggcaaaactctatataaatataacagacaagtcagattgatctatccttgttaagaaaaactcatccatttggcaatcatgcaaaataaagtgaaaaccatgactaatgtacatgttccacaagtgcttaagcatgtgttgagttgtgagaattttttgtccatttggccatatgtaaaataaagtgaaggttataactcatattccaccacaagtgttcaaacatgtgtcgagtgtataagttgcatagtaatatatccgttaaagtatatagataattttctatatgaaaaccattgtgactcataaaagaaaaactaccatataaaccaaaataatgttgataagattttatttgtaaactaccgaaattatctctattaacatttatattgtgagataaaaagattctcttccttttctcctttattcattattgttttttcaaatgtcatttgtcttttggtttgactatatttttcttaaaatatgacctcatctcattatctaaagttttccccccctcatttgttaaatttatatggtttgtttaaatgattgtaaagtttatttaactagaaagccttatgtacattaaatgcaacatttttcttaagttatttgaattttttttataaattttttttttcaaaaaatagagaagagaattggacttttcttgatctaaaccaaataatcacaaccattgccggtcctaagaaagatgtggtccaatacaaaacaaatattttttgatgggttttatagataaaaatttaaaaaggtcatcacatttgggatacaatgacatataatattatattattttgtaagtttgtttagtgttatgaaaaatattagtatgtaaatagggtggccgtttggttttgtttcagttcggtctttcagattttacgtttttttggttttgtaaacattgaaaactatatagaaaccctatgtaatttagtttggttacggttttccgattttacataaaatggaaaggatataaaagtataaaactatatgtattttggttctctttggtttcggtttggttccggactttttaagttatgctatgtttttacaaaacaaaatataaatttgaataagaataaaatatcaataattatatatcactaagagatcaataattataagcccaataaacaaaaaaattagatagtaattctactaattacaatataaactggacaatattattatatatagttatccttaagtttaatcaaaaaccaaaaaactattccgttgtacggttttaaacaaaccaaacctatccaaaaacttaataaaaataacaactaaatgaatttttattctaaaccataatcaaaccaaaccatttattttggtttgctttggttcgttttttttttgcccacccttatgtaatattgtatgagatattattttttacgaactaatcttgttaggatattatttatttgatatgacatttaaatgaatatttttttacgagtaaagaattttattaaattgttttagttgcaaacgtatatatatgttaacttaaatgaaaacattttattatttcgatttttgtctttggcacgagctaagacgctctgtaaaagtgaatgttggacatgggcttcgccccaccaacacgtttaaaagcccaacacattaaaattagtaaaaaagaaggaaggaaggaagaccggcccgttaaaagaaaaagagctcagcatcagacgaggcccgcctcaaggaagctgttggtcaagagaaagtcccacatcgagaagaaacctgaacgatagactgtcctttcagtactataaatactgacaaaggaatgtcagaaaaaggaagaggaaaaagtgggagagaaaagcaatagaaacttctaattaaacttctaattaatattaagtctagttttgacttgtgaagtctgtattaaataagtttaagctcggctgtggaaacattttgtaaacagccgaacttcaaggatattaataaagatcttccttaaggctcggcatttcattcttcggtttggaagtttggttttatactccaacaattggcgcgccaagtaggggtctaccacaagaaaaggagaagagaaagccgaggaagatctacgagaaggaaggatg

SEQ ID NO: 32577 - DNA, 3000 bp, Unknown
  misc_feature (1)..( 3000): 2750-1469P.txt file - cDNA_ID_3058800; gDNA_ID_1620317; Annot_ID_153213
aaaactgtcacactacgggtgattcaaaagttaaggaaagagttcatcaactcgacttctctcatatctttccttaaaaaatttatgatttcgatttcaattatttttacgttttgctaattttagctcacacttctcaaccgctccaccaccatactgagctacaccgaactcatatattgtgtttttttttctcttctaaatgagaaaatcaacatgaatcataagaatcacgtttataacatagatatagacaataatacatgtagaacaatgaagagtttttggaatccagaactgtgtatggaactacatatgcgatttaaaataggaaccctatgttccacactagaaacctaaagaaacttaaaagtgatgcaattgtggactcatgtgaaacaatgggtttaggttaaatcttaaaaggagtatgcatgcggatacgttacttctggcaacgtttttttcaaagaatttgttttaatttgttttatacttttttacaattaggtacgaagctggcatgaggtatgaagaaagtctataaaaatagcttatgtggatgttttgagaagcctgtaaggctacatttaggtatggagttgatatgtattgggcaaagatcattcaaataaacaaaacttattactccaagtctcaacaaaaggaaaatgaatgactttggacttcctcaacattgggctgcccaatttgggcatttattttatttggacttctactagaacatacatcatttttggttcaatttaactttttaagtgtatgggtcttgttcgaataatgggggtctaagagcatcttgtatggtctgtcataaatttcaatacaattatacaaaagtgggttgcatgactagtaatctgggtaccaaaattcgattttgaaacatctgaccctcttgttaataataataatacttaataaacgcagacaagaaaaaaattagaaaaaaagaggagacttgagagtttgagaccttcttgttgaacgatcattaatttgaccagtccagaaaaataataatataatcttaaattcaattttgacggaaacgcagacacaatattgcatgggtccttcacatgccttgtttattattttttaaggaaatcaagagtatatggtcaatatggagagaaaatcctttgtatggtccaagatcaatgctttatgtattttatatttgataaatattatatcttaaggcctactattaaacaaatctaaatttttttatttttaattaaaaaaaaaaaaaaaaaggaaaattgtatttgatcaatactaagaaacaacgaaatcttacatatactacataaaaaaaaattatatgtaaaatttattgatcaatgctaaagaaaacattaaaattcgtaataatttttcaaatcctacataaacataaatagttattcaaacttttctcgttgatatttattgattgaaaacaaaatttctgtaaaacttattttgattttatatcaatgaaacaaactagtactgtatgttgctagtcaaagaatgaaaacaagttagagattttacgaatcaatgtaattttcctccaaatcagtttagtttttttttttttttttgtcgaaatcagtttagttttaattttgaatagtgatgtattatgtatttaatatcaatgagatggttgttaaataatagacatagatgtatcgttttgataggccattcaatcatgctactttcatttttgtacaaaactaattatatgatagtgaacttcatgagagtgaattcgagatacaaagacagaggtcaattagagtcaagaatttcttgtttggccatgaatttttctattggtgagtttatgattatgagtatagacttgatagtaaataaatcttacgcaaatagtgctacgtcagctatgacgaggaccatagaacgagccttcccaccacacgtgtcctaaagcttatgttgactcaaaatattgatacactgtacaaatttatagctgtattttcttgaaaagaaattatactttcgttaacaataaaattagcaaaattcttctatataaatttaaaatctatatacaattatttgtaatcagttacagttttcttttataatttttataggtctaaatatatcttattttaagttgtatgaacaataatttttatttttggtaccacctagaaagctattttcattatatttttttaagagtatatatttttgttttaaaataatttgggacttataattctctttaatggcataagcattattcagaaacacacatgaatatgtggcaaccttatcaagaattcactcgtattcgtttctatcaaatgcatataaagtaaataatttttaatttccttttccaaatgattatatcaaattaacaaaaaagttacatatttatatccaaaaaaaaaattaagcagaaaataattaactactaaagtgggccagagaaaattaattacataccactcaaaaaatttagatttgatctgaggaagttgttaaccagacacaacgtatatgaattcgattcatttcctcatttaactcttttcattttaaaattcaccaaaaatctttacccaaaaacaaaaatagttttattaattataatatatatctttatccattctaattccagtatagtcagcaacttaataagacctgtccccttctgtattccttcaaagcaacaactaaaaaaaaaaaaaccgtaatttataattttaaattaggaaaaatagtcagaaaataaaataaaataaacaacgaaaatccaagtcggctttagcctctctttggtcactataaattcgccttttgcttctctctatctctatcacgagaactctctctgttaacgtttcacgtcaccatcaaatctaacaaacacacataaactattttttttgttatttgctttttcattttctaggtacaaatcaaatgggaacaatagatatg

SEQ ID NO: 32578 - DNA, 3000 bp, Unknown
  misc_feature (1)..( 3000): 2750-1469P.txt file - cDNA_ID_3058804; gDNA_ID_1620317; Annot_ID_153212
acatgcatggtgggttttgattacttgaaaacggatatcgttaggcccggctcacgggattttggcccaccaggccaccacaacaaccttagtgatgtcctactattttgacccacaatgtttttatcaaagatgaattattattgtatcttttgctaactttgttcttttgtgtgtagtcgaacacggcgctaagcgcagagcaagagatgaggctgaaggagatgggagcgacggtgaggaacggaggatcatatatgaaaaagttgaaagtggacgaggataagcagaggatggcgaggaacatgatgaaaaagatgaacatagagcaactctcagagcttatggcgttttatcatttgatgggtaatatatgtggagaggttttggaccgaaagcttcaaggcaatgtcaatgaatgcttgagggacctatgagtttcatgtgaatgaatcgcatgcagaggatgctttaaggaaaagcgactttgtaaatttgctttttatattttttggtcagaggatggaaaaaatggtaacgtgtgtgtggtcagtttaacagtcataggttatatgatgattttaccaacaagtttttttattacaaatattttcatgatttgctttagccaatattgctgatgtagatccaacaatgatttcaatgttttgtgaaactagcacatttgttataaattatggaataaatactatctggtataataatggtgtacaaaattaaaatgaataaatttaattttatataataataaaaaaatagataaattggcacgaaatatttgtatccaacaacatagtatcacttatctaaacattactcaatcaaataaagttgttgacaaagcaaaaatcttatgaaaaaatgaaggattctctccattttaatcgtctcttcgtcttgcatgtttaatcgataagacgataacgattagagtgacgttaatttcacttatacatgagtctccaagagaaagagatgctatattaaatcaagcagctcttgttctgatggggcaaagaggcctcgaccggcatattccagtttaagctaggagccttgattattctataggcaggtgataggaaaaaagattgttaggtatatatcaagtataatattgtatttctaggtacatatcgtacatggcaggccctgaaattttgggggcctaaaatttttaagaagtttgttgtagtttctaaaattgggggccaatttataggaaaaatcaattgggggcctttttgtaaagaaaaaataactaaaattttggggactacagtcaattgtttcttcttgctctgcttagttacgacactatatgtatgactatatgtattaactatacgatgtaatgtgttttataccatagacatacaattccggtacgctatttgactagcttcgacgttaaccaacattgaccaacaaaaatatttaagaaattattttatttactttttaatattaaaaagaaaatatatttttttgttgggtgttgtataataaaaaacacattctatattcaatatcaatatattttgtatatatatttttaatgcattagaacctataatagttaaaaaaaattaatttcaaaactaaactaaaagtgtaataaaaacattattaaaatttcaaaatattaaaatttaaattaaaaacaaaaaatcttattagaatcaatcaatatattctatatacttcacataactttcgtgaagaatgtgattatcgaagtcattgttgttcatgtgtgtattgcgattcaccatgcattactaaaatcatggatcccacttattttgtttgcgggtagtgcccttagcaccgttgttttgactttcatagattgtgtcttcaagaaaatataaactggaaatacgcattattattaaaaaatttattacaatttccttacataattgattctaagaagattatgaaatcattaataaagttattttttgtataatatcttgtttactttgtaaaaaaaattattaaaaacattctcgtaataacacataaataaccaaaaaatttgcagtgtttccttttaatatagaaaagatagaatcattagctttaatttgacttttaatattttaaaattttaaaaatatttttatttcgcttttagtttagttttgaaatgaaaaaaaaaactaactattgtaagagttaatgatttaaatgtatacatataaaatatatttatgttacagaaagaatgtatttttattatacaataccaaataaaactattttttctaatattaatataaataataaaaatttgttggtcaatgtcggtcagcgttagaatcaatcaatcggtgtaccaaaattgtatttctatagtattaaccatatgatgttggataatttatatatatgatcatgcaatatatttactttgtgtagttgaaaacacaatattatacttatatgtgtgaacatgcattcttatatatttatttcgtctagctatcaatttttttctttaattttatataattagctgcaatttttttttttaactccaattttatacttcaatgacgtataatattttatagttgttggcctatctttgtataacctaacgtaaaatgctatttcaatataacaaaccttacaaattacaattacgaaccctattttatcacttttcttcctaagaaagatttttctgaactctgaaatagtttttcttatacgttaacaagattttccacagtgaatgacttacaaataaaacgagaaaagtcttccaaagtcaactaaccaaagacgtgtcatttagttctccaagtctatgagtatctgtccttctcaatattgacttagtcgtggttcgaccattccactagctcttttctgtctccacttggtttttttttgtttaatcatttatcatctactctactttaaacacaaaccaaaaaagaaactactttccagatatcaatcatg

SEQ ID NO: 32579 - DNA, 3000 bp, Unknown
  misc_feature (1)..( 3000): 2750-1469P.txt file - cDNA_ID_3058808; gDNA_ID_1620317; Annot_ID_153210
gcataaaattatgacgtgtggttttgtttttttctttctcaggtttgtgtatgtattttctaatagaaacagatcaaactcaaaagtcttgatttcatatttggttgtaactttgtcatggtacaaaacttgtaatcactgacaagtttgattttagtttggacttgcttttctcgaaactaaaaacgcatatacagtaaaacctctataaattaataatgttgggagcgagaaaatttattaatttaaagaggtattaatttatcgataaattaataattattaatttatagagagattttacaaattttgtattttttttttttacaaaacttcgatagaaaagtagtttttctttataattaataattttttctaaaactaattacaaggaaaaaacaatgattaagtttaaaaaataatacaaaattttttcgacgtaataaaaatattagaattaaactctacaaataattaatagaaattgaagaaaaaataatattagagtcatatttcaataaatattttacatataatattgatatatatatatatgtgtatatatttgtaaatttatataattattaatttataatattgatgggaccatatatttatataagattttcgaaaaagttattatcttattaatttatcgatttatatcaatttttacattggtcataactcgggacgggaataatttattaatttatagaggttattaatttatcgagtattaatttatggaggttatactgtagtttatgactatttaagaaattaattatgtaattagcatatagttttccattaaaaagcgcatacaataaatctccaaatcaactaaaaaatattaacaaaaaataaatcagctgccggactttgaaccgggaatgagcaaggatcaaacagatcattggagcttaaatagcttttgtgctacagcggattctttgatactacatgaatttatattgtacatatatattaatgtgtggttttcattataaacttaatattttgttaacaaattttagggcaactttacatatatattttttattttttaagaactcaattatgtaattagtatatagttttccattaaaaagcggatacaataaatctccaaataaactaaaaaacattaacaaaaaataaatctgttgctgggctttgaacacggaatgagcaaggatcaaacagatcattggagcttaaatagcctttgtgctacagcggattctttaacactacatgaatttatattgtacaatagattaatgtgtggttttcattatagacctaatattttgtttgataaattttagggcaacttcgcatatatatatatttaattttttaagaaatcaatatgaaattagcatatagttttccattaaaaagcgcatacaagaaatctccaaataaactaaaaaataatcccgctgccggtatttaaactcggaatgagcaaggataaaacagatcattagagcttaaatagcctttgtgctacagcgaattctttgatactacgtgaatttatattatacatatggattaatgtgtggtttttattataaacttgatattttgtttaacaaattttagggcacctttacatatatatttttgattttttaagaaatcaaatatgttattagcatatagttttccattaaaaggcgcatacaataaatctacaaataaactaaaaaacattaacaaaaaataatttcgctgccaggctttgaacccataatgagcaaggatcaaacatatcattggagcttaaataacctttgtgctacagcagattctttgatattacatgaatttatattttacatatagactaatgtgtggtttttattatagacttgatattttgtttaacaaattttagggcaactttgcatatatattttttattttttaagaattcaattatgtaattggcatatagtttttcattaaaaagcgaatacaaataatctccaaataaattacaaaaatattaacaaaaaataattccattgctaggttttgaatctggaatgagcaaagatcaaacagatcattagagcttttagattcagatttgaaaagtttacattacgttgtgttatcactatgttaatattaattattctatatatatatatatatagatgttagcatcttgtatcaaacacagcaatattatagaacaactcaaattatattctataatatttattaccatttagtgcccacaagcgaaacagtaaggtttattgtcgtcaactcattgtgatattttgacccgtttcaaatttttcgcttattcattggtaattctagggtttatcgctaggtctatgtattttttttgctagtctaggttttggctttcatgaatctgaaaccggataaagtcgttagtacaccccaagtcaagaacccaccgcaggctcaggaaatgagtaaaccacaaggcaaaagatgatcaaagaaagaagggatcacctcaggtcaaacgggtttaatggacaaggatggaggcgacagcgtaaatgagagagagacagagatagattaggaaagtattcatttcattaggttttccgaaatggcaaagtgccttacaaatacttagctaaaccggcagtaaaccgattaaatgtttcagtaccacaaaccggtacaataaaccataaagacataattaaaccaggatgaattacaatcatgctgtagcagaatctatgtttagtttggtctgcgtagaagtaattttttaatctgctccgatagaataatgtgctatagactccggatggtcttgccgtgttgggggttatgtagcttctttgtttctatatgtatcttgggtttagattttggaacccttgtttatggagaaactaaagtttcatagttttaattttgatcttttggattcggtgatcgaagtttgatttcagcatggttatatgtcttaacatatttatg

SEQ ID NO: 32580 - DNA, 3003 bp, Unknown
  misc_feature (1)..( 3003): 2750-1469P.txt file - cDNA_ID_3058812; gDNA_ID_1620317; Annot_ID_153209
tatgtgtgaccctcgtcgccatttctttgggaatttcacatgtccagtgaaaggtcttggctctgtggttcagaactctacgtatcgtaaactttgtgataaaagttttagcgtcacagttcctacgagttatgttccagaggaagaagctctgaatttgacacatttggaaagtgttttgaggaaagggttagaggtgaagctgaagataagtgagatgtctggtcaagaatgtgtaaccactgatggaaactctggcttcacacggttttgctgcacgaacgtatcaggaccagaaatcagttgccttacttcaataactactatgaataatggttatcacttgatcttgaatttcatctaatccatagatcataagcatcactaattttacattctcaatgttagaatccatcattttttggatgcaatcttgctcaaaaagacattaaattttgcaggaacttacagcgataatcgccctttcctggtaacaattggaacaggttagagttactgcttcaacttcagcttgtattgaacttttgcgggactgaaactaaggttgttttcaatttttttagttctagggtcaatactatgtgtatgtgtggtgctgtttctagcattttatcttaacgagagaagaatagcaaaggctgcgagaattcagcacctcgaggcgcttggaaccctgagagggtacaattataaacaaatcaagaaaattacaaaatcatttacagaagtagttggacgaggaggatttggaactgtatatagagggagattacgcgatggtcgaaaggttgccgtgaaggtcttgaaagattcaaagggaaactgtgaagatttcatcaacgaagtcgcaagcatgagccaaacatctcatgttaacattgtaactctgcttggtttctgctatgaaggatccaaaagggcgatcatatatgaatttctagagaatggatctctggatcagtcgttgaatcttgatgtgagtacactttatggaatcgcgctaggcgtggcacggggacttgagtacctgcactatggctgcaaaaccaggattgtgcattttgacattaaacctcagaatgtactgttagatgaaaatctcagacccaaagttgctgattttggactcgctaagctctgtgagaagcaagaaagcatcttatcattgcttgataccagaggaacaataggatacattgctccagagttgttttcaagaatgtacggaagcgtgtctcacaagtcagatgtgtacagctatgggatgttggttcttgagatgatcggagcaaggaacaaagaaagagtccaaaatgctgatccgaacaatagctcggcttactttccggattggatctacaaggatcttgaaaattttgataacacaaggcttcttggcgatggactaacccgagaggaagaaaaaaatgcgaaaaagatgatcttggtgggtctatggtgtattcagttccgtccatcagaccgtccatcaatgaacaaagttgtagagatgatggaaggaagtttggattctcttgatccccctcctaagcctcttttgcatatgccaatgcaaaacaataatgcagaatcatctcagctatcagtggaaagctcaatttactccgaagtatgattccatgacttgggaatatatgtaaaaccaatcatatttcacatttataggtcaattttgcattggaaaatatattaaacagtaacgtgtgtctcaaactgcgtttatcaagaaagatcatgtaaaaatgctagggaatcgtaataaatcaagaaatatataatgtaaaattgttgtgcttatgaattggcaatctctgttttcatacaagatatttgtttgtgatttaagattataacttgagatcgtttgtgttgttggcaaattaggtatgattggaacttgaactgagattgtttgtgtcgttggcgaattaggcatttaggtgtagaaaggagatgatgattgattgaatttaataatttgtctcttacaaaaccaaatattaaacaaatttacttttcaaatttgtaaactgaaacttaaaattaaagtcattacaagataactaaaaaagtttgcagagatggaacctgctagtttttttcctttcttttatcttttctgcttacactgttggtactagttggcatttaaaattcgagtttaaacgagcatgcttaattcgggtttggtcgggataaagttttaactgacgactacagctctacttgtgacttgtaagtggccggccctgaaattttgggggcctaaaaattttctaagggtaaatattaaacaaatttacttttcaaaatttataaactgaaacttaaatgaaagtcattactaaaaaagtttgggtacccacatgccacatgcagatctagacttccctttttgattttcctttagttcgatttttttctctcgaaagcttctgtgatttagttaataacaaaaaaaaaagactcttgataataacttcttcttacttgctcttaagaacttataatgagatattgtgtgtcggtcgttttgacttcaagagacttgtggattttggtatatgtgttccatttctaacctatagagaaatcagatcagaggatgtttatgcaattaggatctttccaagcaccatgtgtataaccttttgtttgtggattaccaaattactttatgaatagggatgtactcttggatgaattaaaatcatttttaattaaagatggtagaaacgacaagaaggtaaagaaacaggagttccaaatatcataatgattgagagacaaagtgtgaacagaagaaacaaagatatggtcaagatccatacacctgttgtaagaaaagtctctcccccttataaagtctcccatttctctgtagccttatcaaacaagtgttctaaatatttgttcacagaaaacttattctcacacgtcatggattatttgtcctccatg

SEQ ID NO: 32581 - DNA, 3003 bp, Unknown
  misc_feature (1)..( 3003): 2750-1469P.txt file - cDNA_ID_3058815; gDNA_ID_1620317; Annot_ID_153208
ctattatcccttttggtcacctgaccgagaagagtgcggtcacccggttttcaaggtcaactgcagcggagatttcgcagagtttactatatccacggttaagttccacgtcctcgagatgaactatgagtctcgtataataagacttgtaagaacagagtatctcaacaatctttgtccttggcatccagagaacagatcaatcaaccaagaagtccttccatttcttcaagacaccgagctaggaaccttttattacaactgctctggtccaacggtagacgaacttgccaatggttacatcagacagcttgggtgtgatgaagaagttggtgggaaaagttactttgtctcgtccccttcacatcctgggaatagagctatcttagatgggttaagtgcatcgtgtgaaagaaacgtcgatatccctgtttctcgatctgccatggagacaacagcgacaaatcagagtctcgaggctataaagaaggttcttgatgtgggtttcgaacttggctttaacagtgattgttccctatgcgtagcatcaaaaggtgcttgtggctttaatcagagctcaaaagcattcgtctgttattgtaaagatgagcctcacgagcatacatgtggaaagatgggtataggtttgtgagtttcaagtgttttttttaagtacgcttctaagttctgtcttgcgtttgaactgaaatgtttctcatggtatttattcatgcaggggtctccaaaaaagcaaaaataggtatatgtttaatccttttccttccaagattcaatgaaaataatctttgtggaacagacctaattattaacagcataaacttatgaaggtcttgtcttattgtttgtttctaggcattggacttggctgtggatttttgggtgccactcttattaccgtatgtttgctctgtttctttttccaaaagagacgaacttcacatcatctaagaccaagagacaataacctaaaggggctagtacaactgaaacagtacagttatgccgaagtgaggaaaattacaaaattattttctcacacgcttgggaaaggaggatttggaactgtctatgggggaaacctttgcgatggtcgtaaggttgcagtgaaaatattgaaagattttaagagtaatggtgaagacttcatcaatgaagtcgcaagcatgagccaaacatctcatgttaacattgtttctttgcttggtttttgctatgaagggtccaaaagagctattgtgtatgagtttctagagaatgggtcgctggatcaattcctctctgaaaagaagtcactgaatctagatgtaagtacgctatacagaatcgctctaggtgttgcccggggacttgattacttgcaccatggctgcaaaacaaggattgttcatttcgacatcaaacctcagaatatactattagatgacacattctgccctaaagtctcagactttggccttgctaagctctgcgaaaaaagagaaagcattttgtccttgctagacgcaagaggaacaataggttacattgcacctgaggtgttttcaggaatgtatggaagagtctctcacaagtcagatgtttacagctatggaatgttagtcctcgagatgatcggagcaaagaacaaagaaatagaggaaactgctgcttctaactctagttcagcttattttccagattggatctataaaaatcttgaaaatggagaggatacatggaaatttggtgatgagataagtagagaggataaagaggttgcaaagaagatgaccttggtgggtctctggtgtatacaaccatctccattaaatcgtccaccgatgaacagaattgttgagatgatggaaggaagtttggatgttcttgaagtccctcctaagccttctatacattattctgcagagcctcttccgcaactgtcttctttctcagaagagaattcaatctacactgaggtatttataggatccacaagttgaaaacttatttggacactccatatctgtaaacatcttaggtatttataggttcacagactccatcatataccttgtggcttatgtaatcgtgcaacaaaatattattgaagaagaattttgcctgacaagtgtaaagagtgttgagtttattgtctatttggtgaacatcatatgagacgttggggaatgttaaagaggttttgtttgaaactctgtcacagctaagcttcagatatggatgaccacaaggataaccacgatctgctcccagaaacggaagtttgctgtgatgtttccacactcgaaaacagagtcatgtgagaagagggatgggcaggttacttagagtacaaggaaggaacatggacaatatcaacaaaaaaaaaacctaagagtgttgcaggatccatcaatttttgaaacgtaagaatttttttgtgtagcacgaagagatattaaaagaagaaaagaatcagaaatttaagtcagtaagcaggaaactgctccatacgccaagtcctctgtttctgttctgttagttgactgggtctaacagtgggattgcatatccacttactcacgttgcgttactttgtttcttttattttggtgtatttaaacatcagctaagacttgaaaaattgacaaaacatagtttatctctttaggtacttagtcttgtgttacacataaacacatctcttagctatgaggagggatcacctatcacacaacttggtcagaccgacgatgagttaaacaagcgttctaaatagaccgaacagaagaaacaaaatatggaaaaatcactgaaggaatcaatttagatccatgcacttgtcgtaagaaaagtcacttaagtcgagtctttatggctctccatcatttgtcaaagtcaactaagtctcccctttctctatagctttaatcactctctctcttttttcggtttctaatcagagcagtagtattcacacacctcatggattctttatcatccatg

SEQ ID NO: 32582 - DNA, 3000 bp, Unknown; identical to SEQ ID NO: 759
  misc_feature (1)..( 3000): 2750-1469P.txt file - cDNA_ID_3058843; gDNA_ID_1620318; Annot_ID_153238

SEQ ID NO: 32583 - DNA, 3000 bp, Unknown; identical to SEQ ID NO: 14905
  misc_feature (1)..( 3000): 2750-1469P.txt file - cDNA_ID_3058863; gDNA_ID_1620319; Annot_ID_153276

SEQ ID NO: 32584 - DNA, 3003 bp, Unknown
  misc_feature (1)..( 3003): 2750-1469P.txt file - cDNA_ID_3058891; gDNA_ID_1620320; Annot_ID_153307
gccaggaaatgaacgacctgagtgaacatgtactcgatcttgaagtcagagtaactaaatcagggaaattggaagaagaagttaactatttgagggaggagttgtgttcgtcgaaatctgagcagctattgttgttgcaagaactggagagcacagaaactgagctacagttttctttgttttctgttgagaagctggaggagtcggtctcatccttaacattggagtctcagtgtgagatagaaagcataaaacttgatatagtagcgttggagcaggcgctctttgatgctcagaaatttcaaggtgaaagcatccaagaaaacgataagttaagagaaatagtcaaggagctacggttgaactctcgagaggcagaagagaatgctgagtgtttagagaagcaaaacaaggagctgatggagagatgtgtagcctctgaaaggaatatcaaagacttacgtcaaagctttagaggaaggttggaaagtgaaagtgaagcgcctgtaaatccagattgtttccatgacatcatcaagaaattagaggttttccaggatgggaaactgagagacaaaatggaagatatggcaagacagatacttcaatacaaagatcttgtaaagcagctcaaggtattagttaccaaacaaaacagtagaatcaaaaatttggtgcctttttgcagcgtcacacatattctaactagttaaaccattattttgttatgcctaaggatgagttgaaagaagagaaactaaaggccaaggaagaagcagaggacttaacacaagaaatggctgaattaagatatgaaatgacatgtttattggaggaagaatgcaagcggcgtgcatgcatcgaacaagcatcattacaaagaatagccaatctagaagcacaggtacttgcttctttatatcttccaatttttttattttttttgagccatcagatattgttgaaggaacctaacaaatatccattttcttgttaagatcaagagagagaagaacaagtcctcaacttgcttagttcctcttcctgctgtataaaccagctaaggttcgagttaaacttgaaatcacagttaatgcctcaaataagcctttaagctataaggtttgaattcttatgtatttaaagtgtacataatccaatttgattggaaattggaatatagatttcatccctgtgattatgtttatatatggaaattgagttttacaagagtgaaactgcttcttcatgtgcctaccaaaaaaaaaaactgcttcttcatgtggcttctaagtgtttaattacgccttcagcaacatgtagagatcttgagaaattgacatgagtctctagagaatgttgaaagctgtggtcgttgaccaagaagattcttactatttgactctatttgataggcctgtaatgagcctaggtcaataaggctgagtttatttgatggcccgtttttctctcttttattgttcttctttttcttgtgaaaataaagaaatctggaagcgttgttgtatcatcatgtatgtgcagagtctagtaaccttgttgttgatgcaaagggataaatgaatgggtcaaggaaaagaacctgttgtctttattgttaatcaagacacttgtagatttgttgtctaacctaatccaacttgactttaagcaaaaacatattccaacttgttcttcaccaaaatgatatgttgaaatatcgtatctactaggacatcaagattttgttgtagtcgttatcaatgtaaccggtaacaaataaaaattaatgagataaattaggcatgatcatatccatagatattgtcaaacaattttctatcttcaagtagtttttggttttgggcgaaaatatgttctctttgacaaattcaacaaagaccattctttttggatgacaaaattgacaacttacccattctttttgggctcatacaatttatcaactaaaccatcagtacaaaaaaagaagcagaaattagaaaaatataagaaaatgactctttctctgtaagaaaaaatccaactacgtttattatatccacaattacgtcctatatacaattaaaaagatctaaattgctctattttcgttagaaagtagttactttttacttttttagaagtttgatctagaaaaaaaaagaattatatatatgaccgttttagatttgaattaaatgattttgttttatttattaattgatccacgttcctttctacaatttgttttttttttaatctccttgataaattttcgtcaacacatacccaaagacctccttgttgtactctcaaattcttgggtcgttctgagtcgtctccgcgttaaatcttttccctttttgatcctttcttcctttcttcttcttcttcgcattgatttggtcctccttcctcttctattctattcattaagaacctaatcttcatcttctccatcttcttcttcacggactccacttcgctcatccaggtaaccacaatctgctctctatcttttgcttcaaaattctcagttcctttcttctcaatttccgtctgctagatcctgggctttcgatttgttccgttcctcttctgcgattgtttcgttccagagagaattatcgaaataattaagcgaattttgtgtgtggttttcatagtcttgggttctttagccgctacatatactcaattatgcccaaaattaggtttaaaattgattaactaaaacttatactttttggtctcgtcttatgttatcgtttaaattgttcttagaagtgaaatcattcgatgctacgtttttgacttgttgctttactttatctatacctttgatttgatcaacttttctcttagcttacaagttagaatcaaagcatcaatcctgattactgttttggtttctgcaggaaggtttattagtagtaaccaatccaagtgttccttttgtttgaagcaacaagctttgtgatattatcctgagagacaatg

SEQ ID NO: 32585 - DNA, 3003 bp, Unknown
  misc_feature (1)..( 3003): 2750-1469P.txt file - cDNA_ID_3058895; gDNA_ID_1620320; Annot_ID_153305
cttcaaaatcaaagtgtagaaacagagattaccaataactaattgtgaacgtttcaaagtttttaaaatttcttgtaaacggaggtaaccattaaaaaacgaattacatttattattttgtaatattcaaaacaaaatcaaaatcttgagaatcgaaaccgttacgtatactacaatttatatgatcacattttaaatttcgaaaattgagggacatttcaaattcaagaaaacatatactccactaatttagggtgtctccgttagtttctaaaactcgttgccccttttaattccagttcaaaagctcacgcctcatacacaatctctaaaccctgacctcccatttcagtttctctgtttgagaacacttgatttcttttaaaaatggcggctacagtagcagagtacgcaactgctaaatcattggcgttgctggacacagagaaccgcgaggttctcaatagttttgatgccatttttactcatggcaacaccgatcaagtcgctcctcttgatgagcctctggtctttaaccgctttggactcagtcacatctcggccaaagacacccatcaaccaaaaacggacgtagatgaatcagcgaaggcggatttcgctggtgcaaaaacgtcagtttggtgggacattgagaactgcgaggttccaaagggttgtgaccctcatggggttgctcagagcattagatcagttctgtcgaaaagtaacttctgtggtccgctcactatttatgcctatggtgacacaaatcaaatcccttcctctgtacaacaagctctctcttccaccggcgtatctctcaatcacgtccctgccggttaatctctcttcttgaaacacctgattagctataaattaaagtatgaatattttggagttagtgagaccagtctttgctttgtagtctctaatggcttaattattctctatgttcttgatgatggtgagcatttaacaggagtaaaagacgggagtgacaagaagctccttgtagatatcatgttgtgggcaatggacaaccaagctcctgctaacataatgctcatctctggtgataaagacttctcttatcttcttcacaaactaggtatgaagaggtataacattcttttggctcgacctgagaaagcttcaacgccactcatcgctgctgcaaagaccgtatggttatggacaagcatttttaatggcgattgtcctaacatacctattgatctcactactagacgtcatcatcatgattctgcctatgaggtatcaagacatttgggtcctaaacaagctcaagggaccaagaggggccggagtttttgtgaattatgcaatgtttcttgctcaaaccatgatttaaccgctcacctctctggtagaaggcacagagctaacgtaagctatacatttctttttcttaatgtgtgcttgaatattgtcctctctttaagcctaatcttgagttcactctacgggcattagatgtgaggcacatatatatatatgttttatgttgatatagtcttgacaattgttgttgtacattttctcaacttgtgtaggttgagctagtagcccgtggacgccctcttgtcagtaattcaaccgaaccaaagtatgcatggtgccgagtttgccgtttgcgtttccgcagccaagcaagttatgaaacacacatcttagggaaaagccaccaagaaaaacttgaagaccaaaacgagcattccaaaaagcgcatctgcaggaccccctaatcgtttcatataagattttggagggaagacataatgcgattagagtttgttaattcccaaacttgtcttttgagtctcatctttagttgttggttgaacaacttttggtttcggttttcatttagtctcgtctgtgtttttggataaaagccgagagctgagcccacgttgataacttttttttttttcaaaaattgggaacctagtagatgatgatgtgaagtgataattacttaaacgtgattatatatatatatatatatgtgggaaataatgttttactggaatgttgatataatagttttgacagttttttgtactctttagctgaaaccattttcttaattgatttttgttgtcagtgtgctaatgtcattggtgtaatcaaacccgaagcaaaatcgaaaaccttccgctgtaagctttgccaggtcgattgctcgaacgaagctatgtataatgcaagtcatatttcagggcggaaacacaaaaacaaacttaaaagtcaagctaatctgtttctttaattaaatttagagtaatagatataatgatctttgaggtctatggatttttggtaaggaataatttgagccaaatttgagcaattttgattatcgatcgtacaagttgtagttttgttgctccggaagatttcagattttgatgtaaatttaatcccacaagttataatcatttttgtagtttatggaattgaaattctaaacataattgttctgacaaaacttgtatttttaatacaattttgaaactctgcacatccaattattttctttaacgtgcatgcaccgatttatttagtagccttaattttttcttattaagaaaagatcctttactaattatgacacttattttcgctaattaccgatggggagatacagcccccaaaagttacaacggctattttcaaatgctgattggtgccttttcaaatgctgacgtggcttaaataataattgtcgaaaaagtagaatactgtatttaacttgatcgtactacagaggacaaaataaaaaagcagactttgcgaaaagcgaaaggtttcttcgtcaacatggaaagaacttagtggaaacttcttaaaacttagattgtcagattagcataactcaccttagcaagctccgatcttcgacgagatagtgagaggagtaaagagtaacttttggttcagaaacaagtgtctcttctctctctagtatctccggtgatg

SEQ ID NO: 32586 - DNA, 3003 bp, Unknown
  misc_feature (1)..( 3003): 2750-1469P.txt file - cDNA_ID_3058903; gDNA_ID_1620320; Annot_ID_153300
atatactaacattaaaaaataaattgtttccgcggtgtaccgcgggttaaaatctagtatatatgtataaatgtaacgaataaaatgagtatataattttatatgattagtgttgaatgttttgacttaacataaagttgcatcaaaatgtataactaatgctatatacttctctttttgaaaaaaaaaattgagtcttggtatattaaccggagacgagataatgtaattatatattaagattttttttcactggcatcaaatctaccagaacagtcaaagaggtaattaagagtaactgcaagagctgaaatcttcttacaaacaaaaacataacatagacccataacacagagacagagattaccactaaactagaccaaaatgtcctcgaaacgataactaagtgcacccacagaaccagagaccattaacatccttagagcatcaggaaagagcagaatccactcgaagcgatcaagagaaggcagatgaacaatttgcttgagttcttgagagcaaacgcgctgctgtctgtcgtgtaatccgggttaatccctgtcccagtggtgcctcctgtgctatttcccccaaaaactccattggttgggttccctgaataaggactgttggtaccactaccaggaagtgtggtggtcgttgggctgccttttggattggttgtgccaggtgtcacagttgtgctgccgctagagccactggaagaaaataagagttatatcagacaatgaagttccaaaaccagaccaagtcttgatgaaagagattgatctaaaggaaagtcttcaaagcaaattcatattctatactcaaaaaacgctaacaaaaagaagagtctcagtttctattaactaaaagggtctttgatgggtccaaaagattaaagatttagagtactattgcttaatacggccatatcagtcaagaacatgatcatgcgttcaaactgtaatccaataaagcatttgattttgattatagatatgaccaaaagtttggttaaagaaataaagaaaattgagtacttttaggttcacgttgaacacttacaattaacagtgtcttaaaataagactgttcacaacagagtcaaaaaatttcattacttactctatttcctttagtctatttaagtaatactaatgatgctgttttctattttaatttaagctgaatgatgatatctctttcacaacaaaagtaaacaagaacaaaaaaagttgtaatttgggacccaaaccaaactttaatctactttttctctttgccacaaacatagaaaacaaattcttggttttggttccataaaatgcaaaacgtttctttcaatttcttgataaggccatttgaatcagaagcatacctggcactagtaggaaaggcacaacctgtataacctgtaaaaaacaaacacagaaaatgttaagccattggttattgtccacaaatttgaaaactagaaatatagtctttattatgcatttggcgtatccattttgtctcagaatcttgaataccaaagtcattcactagtgacaaaaataaaaaccttcaactttctgtaactatcaataattagacaccacatgaatcctaacaagcactccaaaaagagcaagtttctttagcattggcctaatgtaatatcaaagagcagaacaaatgagaatagtttagagagactaactgggatcggagttagtgggagtggcagttccatcgaaattacaagagccaggagattgacccttcttttggaagaagctattgactgcatagttgcaatgagacctaacattgtcagggttgaagcaagattgttttggtttagtaggattacaatctgctccatttccacaagcatagtctagggttgcctgtagcactgtatcactcagccctgtcttacacacacaccatgaggcacctacaaagaccacaagaaagccaaaattagaaaatagatagctgcatcttccttgttctataatgtgagaagccaacaagatttgggtaaatcttggaatcacctttaaaaggcaagatttacaaatattagggtaaaaaaagtaagtaggaagttgagagacaacaagcaaatcagaagaagaaaaaaatcagtaaagttttctagaaatttgtgaactatgccaagaaaaaacactttaagaacagaaaacaattttttattttttcattcttcaaaggaacagaacctttttcagacaagagctaactaagagtgaaagagataagaagactaagctaagaaatctgaagaagagtgaaagttcttactagaatgtccagccaaggatagaaggagaagtgaaagcaccagagcagccatagatgcgttcagacaaaatgtcactgttgtctttctagaaacagagagagaaaagaatggagatagagagatctctagagcaagaagaagaagaagaagaagaagaagagaaagtggagagacacagagagagatagagagcaagtagagagaaagaggggtggtgagatgagagagtggctacttgttctgtgtcttcttgtctcttctcaaaacccttttgaatgcttttttacatcattaaagaacttagctcgtgtagactttttttgtacgtatatttttagatttaaattaaagacacatcgtattattggtacttcaaaataatttaaaatgacttattgtaaaaggcaatttttttattttttgtgttgcaggatgagatgtgaaaaagctgattcagaaaatcttgttcatgcttgggtcagatttgaataatttgttttgcaaaaaaaagaaataacaataatttgtttactgtgtattggccattctaaattttataaaatcgacataattacagtaaaaaaaaaagtataatattttgtgtattttatttttaattgtcttgttattaattcaaaaaaattctctaccaataataataaaaaaagaataatttagtcatg

SEQ ID NO: 32587 - DNA, 3000 bp, Unknown
  misc_feature (1)..( 3000): 2750-1469P.txt file - cDNA_ID_3058907; gDNA_ID_1620320; Annot_ID_153299
atttgtgcagtaggggttggcgggataaacacttcctcatatccttttaagtgcttccttacagtaccttggggaagggcaagtgcaagagaattcgcttctccagacccaatcagatcctcaaatgcagtcttcttttcacttgcctcaagtaaagaagaaaaattggcctctgatatttcactctctaaaccaagatcagcatttcgtttatttttcttttcctccttacgccgaagtttttcaatttgctttgcagactctgtttgaacagtaacctgaaaggtggctgagtgcaatcattactgtggctatagaaaaggaatggtgcccaaaatcagaagggaaggcctcaggcaaatagatgtacctgtgttccataggtaggcatccgagattgggtgtttgaagctgctttgtcagacttgagaatcatttggccatgatggatagcatcaacaatttctttccgatgctgaaaaaggaatatacaagacaccattcacatttctaagagactagaaagaagaatataattttaatatagaccttagtaacaactcttttactatatataggcacacccatacaccataaagtcggcttaaaagatggtgatttcatccaaaaacataaaaacacagttgtgcatgccacttaaacgtaatggtaactaatgagaaaggcatactatactgtagaatctaacggaaatcaggtaccaagtatcaccacaggtccgtagacttcagaaaaaagagcaatatcaaatttaggccttaccataataaggtcttgaacagtctcaaatgcaccatccccaacaagatccagcagatccccagctatctgcagaacaaatatttaaaatctcatctactttcacttgcaaatatgatgctctaggaacaggtatagtaggttcgaaaataacatacctcctcaccgggtttatccgaatccagaaatctgcatatagccatagccaattcttcacgggaaagttgtgaattggtttctctaaccatccgaccacatgcatctcttagccaacttaaattgaattttcctgcactgagattatttttcgtgtcgctaacaccactccatccttcagaaaacgatgtatgagcatcattgctttctacatccacaaacccagtttcgtcaagagatgcttccaccaaaaaacgagctggtagattgaaaacaaggtcggcaccaaactcagctcccccattaacttcatcagcatatgtctcagactgatgagtaggctgtattgagtaaagtgcctgagcaaaggaggccacgttttttacattagcatctgagacagcatgcccgacaagattttgcaactctaacctgttgaatataagaaagcctcaattatctctgaacaccataaagaagtgcaaaaatctcggccactttcataatcttcaacaatcttgcatcagcatggttgataaataaacgaatatacataaaatgaaaaaacagaattaacagtacttacttcttcccggaaatgcttatattatcattgatatcactatcatcttcctccactggattgttaaacagacgataagcggaaaaagcaacctcgcgaaactcatctgatggaacttcccgatcaatcaattccactacagctccaataaactgcttgtatgcttgtcgcacttcgagagaagctgtcacaccaattccaatcaatatacacacaacaccatcttttatagagaaattgggaaaaaatagatatcatcataaaatcacctccttcccattgatgaactatcctcttagcaaggtcagattcatcaaggcgattaccggagctgaaatggcaaacacaagtaacacaatagtccaattcaattcaagtatttccaaatgctttccaaattctacttagacattgtgatcaccagactatacaactatcaaattcgatatagcaccaaacagatgctatagaactcgctgaaaacttagtaaacgagtggaatcagttcggaaagaaaaaaacggacctgcgaggcttattaagagtttggagtatagttttgcggcgaaggtaagcctgatcgatgtcgaaaggctctctaagagagcttgtcaagcgaggaagctgaactaacatgacaaaatccctgtacttgtgtcgtttaggattcttctcctctgtggtgttttcacctctggtcggctctccgaggaagaaggcgatcgcttgcgttctaaaacggcgtcggttagatacttgaacaaataggcccgtacaccgacccgctaagatacgggtccacgaaatcgacgtcgttttatgtttattacatggggagttgtggaccatgactaaattattctttttttattattattggtagagaatttttttgaattaataacaagacaattaaaaataaaatacacaaaatattatacttttttttttactgtaattatgtcgattttataaaatttagaatggccaatacacagtaaacaaattattgttatttcttttttttgcaaaacaaattattcaaatctgacccaagcatgaacaagattttctgaatcagctttttcacatctcatcctgcaacacaaaaaataaaaaaattgccttttacaataagtcattttaaattattttgaagtaccaataatacgatgtgtctttaatttaaatctaaaaatatacgtacaaaaaaagtctacacgagctaagttctttaatgatgtaaaaaagcattcaaaagggttttgagaagagacaagaagacacagaacaagtagccactctctcatctcaccacccctctttctctctacttgctctctatctctctctgtgtctctccactttctcttcttcttcttcttcttcttcttcttgctctagagatctctctatctccattcttttctctctctgtttctagaaagacaacagtgacattttgtctgaacgcatctatg

SEQ ID NO: 32588 - DNA, 3000 bp, Unknown; identical to SEQ ID NO: 778
  misc_feature (1)..( 3000): 2750-1469P.txt file - cDNA_ID_3058919; gDNA_ID_1620320; Annot_ID_153288

SEQ ID NO: 32589 - DNA, 3000 bp, Unknown; identical to SEQ ID NO: 792
  misc_feature (1)..( 3000): 2750-1469P.txt file - cDNA_ID_3058947; gDNA_ID_1620321; Annot_ID_153334

SEQ ID NO: 32590 - DNA, 3000 bp, Unknown; identical to SEQ ID NO: 796
  misc_feature (1)..( 3000): 2750-1469P.txt file - cDNA_ID_3058958; gDNA_ID_1620321; Annot_ID_153326

SEQ ID NO: 32591 - DNA, 3003 bp, Unknown
  misc_feature (1)..( 3003): 2750-1469P.txt file - cDNA_ID_3058962; gDNA_ID_1620321; Annot_ID_153323
aaatactgtctctacgagggtgagaacaatctccagacacaaagacattcctttgcccatccacttctagccagctacatcccgctggctttttcatttcctttttcttcattaggtttctcaactccatcacgccttcccatttagcatctgcagcatacatattcgatattagaacgtggtttccggtgtcgtcagattcagcttgcaagagatgatttgcaactgagtgccccagatccatcctattataggttgtacacgcccttaacagtgttccccatatatttgcattaggttcaactggcatctgtgtgacaaaagaatatgcatcatcaagtcgaccccctcgagcaattagatctacagcacaagcatattgttccattgtaggtttcataccgtgaactgtccttattgagtcatatatttgcaatccatcctgtattaaccctgcatgacagcatgcagtcaacatagtagttatgaaaacatgatcgggctttatgtttgattcagtcatatgagagtagatcataagtgcttccttgcccctaccatgtacagcatacccagctaccatagcagtgaacataaccagatctctacgagcatctgactggaagacagaatatgcatgcttcaagctgccacatttagcatatacatctagtagagtccccttcaggcggatatcaccaagtccgcctctaataatatatccatgacattgtcttactagatgcagagaggctagctgcgcacaaacaggaaggagattcatgatagtcacagtgttaggcctcattcctcgagcttgaatctcacggaaaacaccaatggcttcattagggcaacaactttcagcatagatacgaaccatcaaactccaagtggtgagatcagtagtagacatctcagtgaagagcatctgagcatcatcatgacttccactattaacatatcctgataacaatgagttataggaaaccaaagttctcctctctgataaacccagaaaaatcttatgagcgtattcaacattaccacatttggcatatgcatcaagcaatgcattgccaagcttgggttcctcttcatcgtgtaaaagaccagccttaactgagtacccatgaacttcttttactttaccaattccctgtacatttatgcaaaactttagtaggcttaaaatagtaacagagtcaagagtgattgcttcattaagtaagtggtgcaagagattcaaaaattgaaactgctttggactgtctgcaaaggcatcaagtatagcattccaagatattatatccttcgtggacatcagtgaaaaggcccaatatgctgcacttgtgtcaccaaatcttgcatagaaactaatgagagcattcccaactgatgtatcctccaaaaggtaagaatggcgcaatatataactgtggatctctttcccagaggccaagtcagttaattgcgcacagacaggaaggatactgataatagttaccgaatcaggagaaacatcccccttatgcaccaagttgtgaaataactgaaatgctttaaaccactcacaatttgatgcataaccagctatgacaacattccatgaaactagatctttagaacccatcctggtaaacaatgaggctgcttcttctatccttccgactctcaaatagaaactaacaagtgaattacatacaaaaacatgggtttgcagccaagacctctgcacaacataactgtgaatctgtctaccacttcgacatgcaatgttcttgtccatagaagcgcaaacaggcaaaacatttgcaattgttgcataatttggctctgtaggttccttcagcattagacaaaacgatctaaatgcatcagccatcatattattctcagaaaacccagcaataatcgcattccaagagacaacatctttatcagctataccatcaaatgcagtataagcatcgggaaaaataaaaccaaatttggcatacatggaaaccaaagcattccccacaagtgtatctttctccaaaccggctttaataatataagaatgcatactcttcccattgtatgaatccccaaggcgaacacacaaaggaagaacaatcgcaaaggtaacagagctcggcttaggttcatctgcaaagtgcattgctttgaaaaacctcatcgtttcacgaccgcaagaaacagaaagtccagtcagaacaatattccaaacaacaggatcaagactgtccatttgcctaaacatcttctggcaatcatccattctcctgcatttcgcatacatgttaagaactgacttcgaaacctcagagcaggctatatgaccaagcttgaacacgcaaccgtgcagagccctccctgatgtgagatcagacactgaagcacaagctttgacaacatccagaaaaaccctgtgatcagttccaaaaccagacaaaagtctgaaattctgaacaaattgccgtaaagggcccatctttcccctgaatatcccaacaacggccctttattagcaaaaaatctacgttacattgggtcagacattttcacaaacacctgatatgcaagaacagtttctctagatataagcgttgtcgagatgtaacagacatagagaaactgaaaaagcaatatctttatcaagctcctcaatttatcaagcaatgaaggtgtctctcagtctccatctcctccacatacaagcgacagtttttgtcttgagtgaattgaaaattatgaatatatatggactattccgatttaattaaaactgaagggctaaaaaagaatatattaatttacttaggtccttacatgaaaatttactatttctattcttattcgaataattagaagaaaaaaaacaaattccataaatatatatatctttcgtcgactctgcttttacacatctctcacacggtaaagttacaataatctcagcttgaatcacactgacgaaggcatcttcctgcgattatg

SEQ ID NO: 32592 - DNA, 3003 bp, Unknown
  misc_feature (1)..( 3003): 2750-1469P.txt file - cDNA_ID_3058970; gDNA_ID_1620321; Annot_ID_153320
tatttgcttcttgtcacagaccgtcgtgctcttacaagtctccacaatttaggttttatttattgccgttatgccctcatacttattcaatctctcactttttccataaaactttctattaattgaattgttcataggatatagattttgtcgtttttaattttttttatacagtacaataaaaagtcaacggaaaacagagctcattaaattcactgagacgaaataaaataataaataaataaatcgaaggaaggagtcatatcaccttggtatttatatatctcaagcgaccatgcatgatagtgaaatattcaagtttaaagacatgatgatgatgtcttgcacagttcaaacattagtacttgttccatggtttctagtagtatttgtactcgccggtggagaagactcatccgagacgacggcaatgtttccggcgatgtttgtgttcggagactctttggtggataacggaaacaataaccacttgaactcactggctaggtccaactatctcccttacggcatcgatttcgctggaaatcaaccaaccggtcgcttctctaacggcaaaactatcgtcgatttcattggtacatattttacatatcggtctctacatgcatttggttttgaaatcagtgcatgcataaatttaatttgcacaagagattcacccttttactttttttttttgttttgttaattttttagtttgttttgggttagcaattaattaattaacatgatcatggggatggatgtggatggttgcaggagagttgctagggctgccggagataccggcgtttatggacacggttgacggaggagtggatattctccatggtgtgaactatgcctcagctgccggaggaatcttagaggaaaccggtcgccatctggtacttcttcttttttttctttctaaatgtctatttttattgttcaaaacattttttggttatataggatatgtttctttttttttaccatgttagttcatatcaaaaactttgtttaacgaaattggtctaatcgattgcttatgttcatataaagaatccaagttcgaaatatccaaaactgaaaccgaaaattgaattgtactatgcttttttgttaataagcatacggttttcgatattgaaaattgaaagttatctttcgctaagtaaaaaaaataaaaaaataaaaaagtgaatttggggtgcataaagtccgccggaacagtcgtcctttaaccaatagaagtagccacatttgaatcacgggaggttatttaatgtcgagtgactttgatagggtgcatgaaaaacttttgcctacgagacatgagtatttaataaccccaaaaaaaagactataataaatggggttgcattcttgcatgcatgcatggatgaagggagagagatttagcatgggaagacaagtggagaacttcgagaagacattaatggagataagtaggagcatgaggaaagagtcagtgaaggaatatatggcaaagtcattggtggtggtgtcattgggtaacaatgactacattaacaattatctgaaaccaaggctattcctctcaagctctatttacgaccctacttctttcgccgacctccttctctccaacttcaccactcatctccttgtaagtcttatttacgaatcactatcagtaatatcattaaccatatatgtgtgtgtgtgtgaagtcatcgagtgcctaaaatccgtatagataattacgaatttttattttataacaataatactcatgtcaaactaaaattcgagtgttgtacaaaattttgttaggaattgtatggaaaggggtttaggaaatttgtaatagccggtgtgggtccattgggttgcataccagaccaactagccgcccaagcggctctgccaggtgaatgtgtcgaggctgtaaacgagatggctgaacttttcaacaaccgtcttgtatcgctggtggatcgtctcaattccgataacaaaaccgctagtgaagccatctttgtttacggtaatacctatggagccgccgtggatattctcaccaacccatttaattacggttaagtatctaacttatcccttgttttacattttttttaatcaaatgtttcgttttagcttagttgagagcatttttaacttgaaatggtttgattttgttttcttttattgtttgtaggattcgaagtgacggatagagggtgttgtggagtagggagaaatagaggagaaataacgtgtctgccattagcggtaccatgcgctttcagagaccgacatgtgttctgggatgcatttcatccaacacaagcttttaatctcataattgctctcagagcctttaatggttccaaatccgattgttaccccattaatctttctcaactttctcgtctctaaaccctcaacaaatccttctctttttgtttatgtatttttgttactttaattttgtagacttgtagtagtactattgcatatttcttcgcattatctttttggttgtgatttggttccaatttgaatgtggacctctaatgattacattatcgttaactgcaaacatatacgtagaaaatgagtcgatcgagaaattgtagaatctttttctattattcttggtttcacaaattaatggtagagactttcatgcatagtgatgacataagatgttgcatattgatatggcggattgttcatagtttttttttgtttttttttatgacataaaatgttgcatgttggcatgttgcggactaattcatagattattattagtccatagatgtattatgtactgtatatacatcatttctcttttttgttacatgtttgaacttaaacaaaaataagtaactaactataggtttaaaaggcccaattaggaaattagacaggcccaaatataattattgaagcccaaaatgaggctagcaattcgaacaaaaaagataagcttaggaaattgtaccaatg

SEQ ID NO: 32593 - DNA, 1000 bp, Unknown
  misc_feature (1)..( 1000): 2750-1469P.txt file - cDNA_ID_3058989; gDNA_ID_1620322; Annot_ID_153383
cttttcgagaatcgttgtttcggcttcgtttttaaattaagattttgagagcaatcgaagatttaaggagaacaaatggattttaagaattttaggagtaaaagtgactaaaaggacgtcgttttagtctcaacgaaataaaaaaaatttgtaaatacccataacccaatcactgttatgtgatatgttgtttacgcgattaaaatttaaactaatttttttttggtggaaaaaaaattaaattagttttattacatagttattttacttattatagtatgaaaccggtacacgaagacaagtttaaagtatacgagataagtataaagtattaatttatacgaaataacatgtgaaacgaagtacttttttttgcagaatcaaaatctaaacgtaattaatcaataaatatttaaacaagtttaaccgtttaagccttaaaacttaaaagtagattttaggtttaacaatattgtttctgagaaaatgggctaaacaccaaatctaaacaaaagttagggactttcttcatattatattattgttaactatatataaccgaaagagatcaatcaaagtaaaaatctcttttaacacatcgccgtcatctctctctctctctctactctgcatcagacaatcacaaatctttctctttctctttctctctctaacacaatttagaacaaaagtttcttctttcttctctcccgagaggcctctcgctgttcattgaagttctcttagaattttctatcaccttgtatgtatgttcatcgcttgaattgataatccaattaacgaattttcaaattgaatcataaaaatcgtttctttcagttttttcttatccacccaattctcaaatttctctcttttttttttagggttcctctcagatttctctatcgatagaatacattgcttctgcttttgatcaattgtacttcttttgtctctctgttttagggttgtgtaatttgcaaaacagacaacaatg

SEQ ID NO: 32594 - DNA, 3000 bp, Unknown
  misc_feature (1)..( 3000): 2750-1469P.txt file - cDNA_ID_3058995; gDNA_ID_1620322; Annot_ID_153377
gaatcttcttctcttctttagtttctagattcttttggtttatagtttgagaaccaaaatgtcattagtcaatactagtagactagtaccattctataacaagggagatataagtcaccagtcaccaccaatgaccggttctgattttttttttttaataacatatagtcatatgtgttatatattttcatttattttagatgatttatgcattattttctgttataaatagctcatatagttttaattatacatatttcccttaaaaaaaattgttaatcaccaacgatccaatttgtttttttacaactattattatctatacttgtgtttatttccagttaatactttaattgacgtacgtatatgaaggttagtaaacacacattaaataatgggttttcaacaaaacaaatcttccaaatagttgtttttattttattctaccttctatcttcaaaaaattcagattaattatacgaaatagaaaataaaaggtaatataagttaactcttataagtatcttctaaacgtttttacagatacatacattatatttttaagaattaaaatgttgatcacgaatgcttttatttgatatacaccattttttcgttactaatctattttttacgaaaaaatttgtttcaaaaagatgtttttaaaaaaagttatctatgaattacacaataacacaaatttcaacaatcactattggtttattgtccgttctcttttcctgttttgtttcttaaaataacatacaacgacttgaagcccaacattcatttgtttgggccaaaagtagaaattaaattactattgtacccctaactaaacattgtaatttacatttgttgccacgcttaaaccttcccttgtttcatcctcctccgcctcgatccctcactctctctcgcgtcagtcgttactgctgcaacaaatctgtatttgatttctccattaacaacgaatctgtaagtttgaatttttattcaatctatctctctcaatataagcccttttctcctcttttatgtaattatttgcattaagatggaaaattttcaattgcagaaatggccgctgcttttgcttccagattaacccgaggtaagagactaccttattcctcttccttcgatctcatcttgtgtattgaatccataaatcctatgttttagactgtgatgggttttggttattgatgggtttgtttaaaaatcacatctttgtgaagttaaagattcccatttttcaacatattatcagcttcaaaattgttgaactttgtaattgatttagcaaagttagagccaaaattttaaaatctgttgtctttgttgtttatggttatagtatctgatttgattcatacacaaatcatgagcaggaggacgttcattgcttggaggtcttaacaatggtggttcgatgaattcttctaatggaatgatgaatgaaagtatcctctctcaggtcagaaaccaaccaatgaaagtattcttctaatggttttagtgtcttaagcttattcttttttgttgatgttggttgaagcagcagcagcagagaaggacatttattcagatggggactgttctcaaagtcgtggacaattcaggtgcgaagaaagtgatgtgtattcaagctctaaaggggaaaaaaggagctagacttggagatactatagttgcttcagtgaaagaagcgatgccaaacggtaaagtgaagaaaggagcggttgtgtatggtgtggttgttcgtgctgcgatgcagagaggtcgtgttgatggaagtgaagttaggtttgatgataacgcggttgttcttgttgatagtaaagataagaatactaaaactgatcgccagccgattggtactagagtgtttggtcctgttcctcatgagcttcgcaagaagaaacatctcaagattcttgctttggctcaacacgttgcgtgagatgcaacaaaaccgtaaacctcgtactgtctttttttatgtaaactctagttacccgcatgttttttttttgtgtgttcttaacggaatttagaggcttcaaactttaaaaagtccccacacttttaaagtctctctctattactctcttccctacatttctatctcctttattatacaagtggtatacagactcagatgaagaaccacaaaagagggaggagtgaggcggcacattaaagtccccaatttcgaagacgatctcttctcgagagcctgtctcggagtattacccagagaccagagtataataaaggcatgctttggaatgcgctgcgagaaccaaaccactttgtgccaagagttaggtgttgaagaagggtttagcatacactgatttgaagaacagaactgagagggtatagttcagtgatggagttacgccataagaagaagtctggatcataaggttaatctgaagtgggctgcgttgcttcttgttttttctgatatcgacatatataaattagtatatgtaaatatgtatttttaaaacttttaaatcatactttgtataataaaattattattcattattagaagaatcaatagtttatctagtttattgactattcattattatatttaattacaacattatctatgtttttgtttatttgtgactgaccttaaactttagtttattacatatataccctataagtagttaggtaaagctttcaattttagtcctcagtttctgacatttttggttattttctcctttttttatagttcaaactttttttttcctttcaactttttcatgttcatatacttttaattttactgaagagagattaatttacaaattcaaaaaaaaatcttagatcaggtggaatctaccagagagcacgcgattctagatcgatccaccggtgagagacgccggagtttttatccccgcggcggagtaaaccatttcttcttcccgatgtatcagtgaagttaagtagtcgagagaggggataatg

SEQ ID NO: 32595 - DNA, 3000 bp, Unknown; identical to SEQ ID NO: 804
  misc_feature (1)..( 3000): 2750-1469P.txt file - cDNA_ID_3059016; gDNA_ID_1620322; Annot_ID_153364

SEQ ID NO: 32596 - DNA, 3003 bp, Unknown
  misc_feature (1)..( 3003): 2750-1469P.txt file - cDNA_ID_3059039; gDNA_ID_1620323; Annot_ID_153417
ctttgacggataaccaaactatagtgtgcacgtgcattaagcatggaataccttccactgtcctaaaagtgtcatcggacatacaatcaggttaccaccattttgaagtacacttttttgttcaagaagcctcttatcaaagcctagaaatttggttgccttcaccgggggactagtgagatcatctacagaactgctgatcactttgtctccttcatagttggggcatagaaacccagttgatgcagctttccaagaatgggcaagcaaaagggatatggtcattacagtctttccaagacccattgcgtctgctaatatctacaaaagttttaggatataatattattacaaaacagctatataataaagtgacaaaatctaaacaataaatgaaagaaatttttataggtggggtattgagatcatactcctcctcttgccatttgaagtgtgctagggaagtgtattgtagcatcaccagtaaaagaattcaggtagacaaccagttccctcctattgacataaaacagatagtaaatatcttatctgactcgcactaaagttcgaaggcaatagaaatatcactcacttgtctgctaaacagtatgcttcccaacacgggtgaagcattgttgctgcctcatcagtgcaatttcctttctccagttgggtcatccaatgaagtgcctgcttttggtatggacgaagctcacacagaagtgtatgtggagtttccatttcctgttgcaaaaattttcatgcaattttccaaaggaaatttccagtgttggatataagtaagcaagaagtcttgaaaatgagaatacctttaatccagaactgtccccaacaccaacaatgttatcaagatcaccatcgctgatacactgctcattttcatctccgtttgcatcttgattcatattcttgaccttgtttaattgaagcaacgaagtaggaatagcagaaccatcctatttccatagggcagagagcaaatgacaaattttacaggcaagaagtcaaattttaagatgctaatataataagtaatatttaccttggaactcaaaggtcgcttcttagagtaaaaatcctctggagtaaactctgcctaaatatgatgaagaatggaaaaatttcttcgtcatctcaagattattcagtcacatcatatgagaagtatatgggaactacaaactgcaatctataaaagaatccgcatatcaagttataggcaaggaataaccattaccttcttaaaggggatcaaaccgagtaaccgaaagagatttgggagaggatggaacattgattcctctgccgtattactagctgtcttaaatgaagtcgcactatgcttttgaaacatggaactattaatgtacacgctgtttcaaaaacaaactcacaccacttcaaacactaatgcatctatcctgaaattgtaaacgggaacacaaaagttttgtatgcataccttacagacagaagaattgtatccatgatgctcaaagcttcaggcgccgacttgcaactgccttctatcctaattttcttgtctctcacaagtggtagaagacaccgagcccactcgtttggtattctaccaatctaccacaagagcccatcatagttagttaacaattcccatctaacaaacttaacatagcaaataaaaaagatgtgaaacacacctctcctgaatcctttgtagagaacctaacgatatcagaagcaccacgcaaagctggccttccccgcccaaaaccgcgcttcccaggcgtagtctcaggctttaatcctttactatgcggaaacgtgaacaccaattcatcaccagacttcaatttccttcctttacatgtcgataacccagccaattcagaacaaccaacaaaccaccactcattccctgaaacactctcttctcctccaccattaacactctcattttcttcctccacgcgatgattcgctccaacacttccgctgtcaccaaaagtacagccctttaatccactatcaactcgcttccctccattagagccgctcggggtaggagtggctacatcaggtttggcgaaacttggagtgtcgaagattatattgatagcagccgttggatcatgattcgccatgtgtaaagccctgattatatccatatctgagtaatcggaacccacgactgatctgacggtggaaacaagatcgtctgagactttcgttcccatttccaaaaccctaatcctacaattttccagggaaattttgaaactttactgaaaattcagtgagcttgtggctaaagaacgccggaaaaagaaaaccccaatgtagtacagtggcgaattatagaaattgaagtagatcgacgacgacggcgtacgaaatctgccggacccgagaaacgcgcgtaaattagcgacgagtctctcaaattcccgccattatattgttttttttattcaagtgatgaaaatagaaaggtaaattcaaaaacggtgacgttttaaaatccctaacgggtctagatccgggtaacccgcatcccgagttgaactcagtttaacaattagaccacaaaaatctgccattaactcagaagtgagaagtgtagtagaaccattcgacacgattgaaaaagctcatcttttttatttctatgtctctctcttttggttacgtaagctctctgtccatatgcttcattgatggtggtggttatcaaaatctagcaaggttttagcttcaattctgtccatatgtttatccatttccaagctcagacgtgaaaagatttcagatttatcgctggatcacggctttgatttcttttgcttcagctttgaatttgatttcttttgcttcagatttatcggtggatcttagattttgatgtgggtatatggttcgattttataaaaagaagttagatttttggaatcatagaaagggataaacgagaattgaaatctggggattgatttggatctgatg

SEQ ID NO: 32597 - DNA, 3000 bp, Unknown; identical to SEQ ID NO: 808
  misc_feature (1)..( 3000): 2750-1469P.txt file - cDNA_ID_3059043; gDNA_ID_1620323; Annot_ID_153416

SEQ ID NO: 32598 - DNA, 3000 bp, Unknown; identical to SEQ ID NO: 812
  misc_feature (1)..( 3000): 2750-1469P.txt file - cDNA_ID_3059047; gDNA_ID_1620323; Annot_ID_153413

SEQ ID NO: 32599 - DNA, 3000 bp, Unknown; identical to SEQ ID NO: 811
  misc_feature (1)..( 3000): 2750-1469P.txt file - cDNA_ID_3059051; gDNA_ID_1620323; Annot_ID_153412

SEQ ID NO: 32600 - DNA, 3000 bp, Unknown; identical to SEQ ID NO: 810
  misc_feature (1)..( 3000): 2750-1469P.txt file - cDNA_ID_3059055; gDNA_ID_1620323; Annot_ID_153411

SEQ ID NO: 32601 - DNA, 3000 bp, Unknown; identical to SEQ ID NO: 809
  misc_feature (1)..( 3000): 2750-1469P.txt file - cDNA_ID_3059061; gDNA_ID_1620323; Annot_ID_153401

SEQ ID NO: 32602 - DNA, 3003 bp, Unknown
  misc_feature (1)..( 3003): 2750-1469P.txt file - cDNA_ID_3059084; gDNA_ID_1620324; Annot_ID_153431
aattgcatgggattcaacgcatagcaaaatccatggagaattgtcttatcacagctccatttcatgtgtatgacaattgaaactaaacaaatctgtatttataaaaagagataaaagaggaaataaaagaagagtcaataaatatggagaggaaagtaatggttgtggtaggaactctgtgaaatcaatgtaaagggaaaaacaaatcaaaaggtcccccacataaaatcaaaaggtaaagaaagaaaaggacagtttacacgaagagtcacactgtactctggcctcacatgaaaccctaattacttaactttattcactttttttcactcaatgtcctttattattttaccacctgacctgactctctctctctctctctctctctctctctctctctctcaagccctagactgtcacacctattatagatagcttataccagctatattccatatcccacgcttcttccgaatctatttactggatcctgctctttatatgatcccaactaaagcacgtcttaatcaatacattttcaaatgttatagacttattatagtacaaaactagctaatctcaatacattataatggtatacggtatcaaaccactgtttttcttcacagtgattgatcctacttagactgttcaatatggcatgtatgccacgttcaaactcaaacaaatgtctttttcttttttttcagttcaatattatcatacatgtgatgtgaattcatagattattgtgtaacctagatatgcacataagattacgtacgttaccataagttttgatccaatacagttaacttagtccatgaatctatatgattcatgcacatgatttatatgccttataaatcatattcactttaaatgttaatcatactcactttaaatttgcttttgagtattatttgacttgtaaaatgatttgttttcgtatctccgaaaaagtggtgtacaagtgttgttggagtagagatcttcacctagtggacgtctacttgtacggctaaacataactacctagttcaaggaaacgattcctccaacaaagttggtttctgagcttctcaatctcaatcatcatcccaatagattccaaatgcttgcttagcttattcgactaagagaatacatagtctctagtttttagctatcatcaattctttactgtttatgtcacattgtatagtcacaattcaaaagatttgattgaaagccacagaaaaatcgaaaggtcacacttgaccattgcacaaaacacacattttatcaacattgatctccaattcacattggttttacattacacattgaatcaaatctacacttaaaaaaaaatcatcgcctaattgtttttgggagacgacgccgtttcagcttgagaaaggcttcgccagaaaccaccactgtaaaatctgctccacatctccttctccaacgcaatcacagcctcatcttcttcttcttcttcttcttcctcatctctgctctctaacgggtgaacagcgaattgagaactccctcctctaccaaactctcttccactctctacaaactcctttttcgctaatcgtttccgtcgtatacggcggattgcgcggcggcagagtccacgagggagcttgtatacagcgagtacgacgagattcacgacgctacaaggagcgcatagacataaggctgcacaactcgccgtcgtaccaccgcaacactcagccgtcgtagatcctccgccacatagagacggcgttgatagacttcgacggagactcggttgtttattcatattcagattttttttattaaccgaatctgagaatttcgagtcaaaaaaaacaaatgcagatagatttcacaaatcaatcaatcaaaaccataaaatctatcgatcctcctcgtctttgatcgccaagaaaatctcagaagaatctccgatgaaaaaatgaaagaaattgagaatccgaaaggatttgtttgaaatggagagtgagctattattaatgtttgtggtgtttaggcttttagtcttcttcttcactgtttgaggttaaaaagtcatagaaacgatttttgggtatctgttacggttacgttggctagtgtatagatgccgacgaccaccatggatcatatttatacatacaatttacctatgtggataaataaactattaagcattatttagtttctttgtgttacttctttaaaaaagatgataatattacacgtacaattgttcttgtttattcatttgtgtttgttgatatctagaactcaatcttgaataatattatcttatctttatgttttgactaatcattaactttcgtataaagataatatcaataccactagataattatcacaccagcattcttactagcactttatatctactactacttttggataatgcaaatacattttataaaaaaaataaaggctgtgtgatttggttaaccagttactaatcttataaaattatgtagatcctatggtaaattattggaaattttcataaattagacaaatttattaccaaatctcatacaacactatttaaaacattgataaaatataaaaaaaactttgaatattgactattgaccaataaactttattatttgactattaaatttgtgcaataaattaaatttaactttttacccacatcaaaacataacagtaaaagagaatgtggatttagacctttataagtcccatgaaaaagggcccattttataggtatccaaaacaggcccaattttctggaaaaaaaaaagaagaaacgatgccacgcgtttcacacctgtccctgtctctttctctcgcttttaatttttacttaacgacaaaggaaagaaagcatggagattgaaaacggaagccatttctagcaaaacaattctctcttttgtcttgaagataagtttcacaaaaaggtctgcttcgcctcttctacgacgttgcagaaactaagaagagatg

SEQ ID NO: 32603 - DNA, 3003 bp, Unknown
  misc_feature (1)..( 3003): 2750-1469P.txt file - cDNA_ID_3059090; gDNA_ID_1620324; Annot_ID_153447
tagagtgaaaccttttaacttcaagcaaatatgtacttcccttcattatatctctggccagcttataaaagttctcaactacctcttaaatctcttctaatatattgaaatctctaaagtaaaaggtcgagagtcgagacagcaagcaaaacactcgtgaaacatgatgaatgtagtagctgataaactaacaatgaaattcatatggaaaattcattttaataagcctggcccatataataatttagaaaccatgcgcgtattgtgtcttaatcatatccagtatctcctagtgcatcatattagttggaaacttaattctagccatccaccatatctaaagcctaaatgaataggtaattccaagattcatcaatcgaaactgttaagtcgatgaatgcttctaatcatgcatctttactaggggaaaaacaatgtacctgtaaaaatggactaaacacctgttaccagcagctgatcaagctcggtttctagctccgttaactcaacctgattttcatttctgcattgtagcaactgcctccttagatctcggaccagctcgtttaacttctgaattttcttttcttgaaatagaattttctgccacaaatagacattcatatcatcattagatcatacaatgaagcgtatccttaggcaatcaaattgcttagtaaagttaactaatagggcaagatttcagattaggtatgctttttgtttctgcgaatgcatcacttggaagaatcaaagtgatgggatgaaattagaaactagcttcttttgctttcctaagactatactcaacaatacacaaaactgaacacgttttcagcaacaatcatttcacaaaggttttgacaagaaacatgaagaagcaatcagatttagagtgctaagtgagggactttgttttaacatctaaagaaactaagcaagtcactaaaaacggaatgcgtcacagaaaaagcattggacaagtaagtgtcagtttaagaacccaactccttccttaggttcatatacacaacaattttaattccaccaaaatcaataaaaaacaaacctttacttgtacagattctttgccttgagggatatgttgttgctctttatctgaaagaatcagaggacgactactagtctcactttcattctcaacttgttcattccactcaaactgagaagtcaacacaatgaacataagaacaaacaaaagcacccacgatctcgtcattttgcaggtaaagtggtcttttatttgatctgctacataacaaaacaccaaataccacaactcaaaatcacaaactaacaagtgtagaaaaggatccaaatcacaaagtaatctttgaacattctatttacaagaagtgtaggaaaggattaaactttcacattccaaaaccttattttttatttatgagtcaagccaagaagattcctgaagatttctgcttccatggttccaaattaataacaaatccagaagaacaattcagtgctccaaattaaacatgacaaacgagcttagcaacaaagtcataaaacagagcaggacaaataaaaatcaccaaaaaaattcagaccagaactatagattcgataagaacaaagacgattagcaaaaattaaggtttatacatattttagcactcaccagtcgaaatctgaaagcatgaatctagtttttgcctagaaggagacgaaaagtaaataataacatagctagcaacatgtatactatttcacatttttttgagtttctaagccaatcagaaggctctatttcgtacccactcgcacaaagagcgctttgagcgagtgagagcgattctgtgggtaaacccctttccaattcatgcctttttttatcaacgcacttctctccaaaatctccatcgcgtgacttttttttttccacaaaacaaatgaaaccgaaccgaaaccagtttttatttcaaaaccaatgcaaaccgaaccgaatcagcaaatagggtgaagcaacaattctgggcagtaattttctgcactttccatgacttttcaacatcctaccaacgagaaaaagagaaaacaccacaactcaaaatcacaaactatggagtatagaaaaatatccaaaaatcatagtaatctttgaccattacaagaagtataggaaaggattaaacttttaaattccaaaaatctcagaatcaaagctaagaagaatcctgaagatttctacttccatggcatccaatagaggaagaaggacaatttactgcttcaattaaacatgaaaaacgactgaaagagcttaagctttactagttttagtaaaatttctcggcaacaaagtcaaaacagacatagacacataaaaaatgataccaaaaaagaactgtatattcgacaagaacaaggacgatttgcaataagtaaggtttatacagattagactcactagttgaaatctgaaagcatgaatcttgaatcttgaatcttgttgtgagctcttcgtgtttgcctccttttattatctttcttattttctgttctttgtgtggattcaactcgcaacttttatatttcactctgctgcttcgagatccacccattaaaaagtatttaaaccgaaatgaagattagtgagccttcatgggccttcgtgggctttgacctgggtttagtgtttaaagcccatttcctctttatggtcgtgtacttgagaagaaatcttttcttcttctctgtaaacaatccatcgaaagatcatcaaaaaaatcatcttcttcctcaatttcttctgattcctcctctctttcttctacttctcaccaaatttctgttagttctctgataagtacatttcgtgcttatcaaatacttatattttaaggggttgaagttgtaattttgaagaagttgaagatcaatcaaaaataatagaagaacagagacgacgaaacgaaaccagccggagaactgagcagagaaaaacccccggcgagaatg

SEQ ID NO: 32604 - DNA, 3000 bp, Unknown
  misc_feature (1)..( 3000): 2750-1469P.txt file - cDNA_ID_3059096; gDNA_ID_1620324; Annot_ID_153438
tacagtcttaaacttattgttcgcataaagaagtagacattgttagaattaatattacattgttacagatatgagttctaacctggaattgatgagataatcagtctcacaataagcgacaacagttctccaactaatgttcaatatattttcaactaacatcagtattcagtgcacatatttagttcttgtaatctgttaaatgtagtttgtttgactgctttaatcaaatcaggattcagtttattttagtttctaagcaatgataagcagaacattcgttttgggcttttaattgggcctttatcttgtctttattttttcgtctgaaaacatcgggcctatatcttcacgtctaaattttaaatacagggaaactgtagcttacaatgatgataaatttttagtttggtgatccatttttctcacctatatataattgaagaaaaaaagtatatgcatatacaataattcaggtagagtttgacccgaaacggttacaacggtttggcataataaacaaaaaacaaattcggcatcccaaggaatgcaacgttcactgaggctttctctaaaagatagtactaaattataaaagaagcgtctttttgaagcaatctcaaactaaaccttttgcttctcttctctcccatttcctgtaatcatttctccgatttaactatctctctttctctcatttgcagttttcctgaaacttttcagaaacctaatttggtttctcttatatatgctcttaatgaaccagtttatccggatttcgggtttgattcaagactctaaccctaaagtctgttagttgatgcaaagatgctcggagatttcatcacaagaatcataatgttagaccctctttctctctcgtctttccttcatctggttttatatttaggcattttcgttcttctttctcttagattttctggaaaatttgcagattgcttgtgggttacgcgtaccctgcatatggatgctacaaaagcgtggaaaagaaaaagcttgagattcacgaacttagatactggtgccaatattggtaaagcttactaattgttaataaagaagattccttttttggataagggtatcttattctcataaccatcttatcaaaaatccgaatttgatttgtaggatcttggtggctcttcttactgttttcgaaaggataggagacatcattgtatcatggttagtacttatatgtcaaacttcaaatctccatcatatgcttctttattgtatgaaaccttctgattcatctcatctatccgcaggttaccactctacggagagatcaaaatcgctcttctcatctacttatgttacccgaaatcacaggtactaactacagtacaatgcaataaaaatctaatgagaattcattctcattcttagattcacaaaacgaccaatcttcttctcttggtttctaacagggacttagctatgtctacgagaagctactatgtccatacatgtcaaaacatgaatctgacatcgatcaaggaatctctgtcttaaagataagaggacatttagtaattgctcaactactgcaatgtatcttccactggagcctccaaatcttcaagcaattgcaacaacaattcaccatctataaggtattcaaaacaaacatatacatcctcaagctttactgcatcagagcactctcaccaaatccatcacttcctttgtctacagaataaaaaccaatcaaagtcaaaagatcaacaacaaacaagaacttctttaatgtttctccgttagaaggtgcctgctatactactctaagccacaatctcaataaccgggtttttaaaccgccggttaaccggagtttcacatgacttcaaattgaccacagacgaacaaaaaaaaaaagatttttcctttgatatgttttgaatattgtaacactttattgtatacaattcaattcatgaaaaatccaattttctcaccaaatcaaagtttatttgacaatcaaaggaacacgaaacgattgaaaaatccaatcaaacacacgtcgcaagaactgaaacccggcggataagtgaagccaaacgcggcggaagaattgagaaccagcagaatcatctgacgaagtaagcaccgttggttgaagataagacaaagcagcttgcttaacgagacggttacgaatcgagatatctccggcggcggtggatataacaggagagcagctaccgttgatcgacggtaaattgagtgaagagttaatcggagaagagatgatatctctgagagaagtgtaagctacgaaagaggatggttttacggagatgagctcgtaatcgaacgaagacggcggcgttgaagctatgtcgaaaggaacttctggaggagttagagtcgtcatgttggatatggattttgtacggcggagttgagtcgccggagattgtgacggcggaatctccatagtctttcttcttctttttttttgtttggtttgtttgtgagtttgtggctgattgggttttgcgagtgtttaaagtaaggaaggaggtccaattattgatctctatgatatgtacatttgtcactatcttgtgttgtattaattagtaaagagatacgtttactttatttgtattttcttaattattatgattggaatggaagatagtaggcaaattacaaaatttaaggattgattactatttttgatgtgaagattagatggaaatatattcggaaatccaaccagcctaaaaatagattttgatttaattatcaaagtatgatcatcaacacggtgtcgttccggttcatcgaacattccacttctttcttcttgtctgaaaaatctagaagagcagctatttggtttctctatccgattcgtctctctcacgccctcacgtttatccacctcatcctcaaaccaaaccacaagacctcttttttaagtaaccaatcacagagagatagagagagagaacagagtcaatg

SEQ ID NO: 32605 - DNA, 3000 bp, Unknown
  misc_feature (1)..( 3000): 2750-1469P.txt file - cDNA_ID_3059103; gDNA_ID_1620324; Annot_ID_153432
ggtactgtaagtataatgttttggtaatgaattattacgaatacttatgggtgtgattggtaaagatattagagtaatatggagtaattaatgttggagtaactatttttttttttggtaactaatatcataagatcaaaaatgatataatttgtgataatggttgtatttgatttgtttctgtattaagtattaactcgttgtgatattatatatattgatttgccgttaaattttatgttgcattatcatgaaaaagtgactttttaagtattgcgaagatcagaacatttataaatttaagcattttttagtaatgtatgagttcattttatttccttaagttacttttggaatatattatttgcaagtgtcaatcatttaaattctacgttttcttgttataattaattgggcttttatttgggacaatagctcaatggccttttgggttacgagttaagggagaaatgggcccaatacaagcattcacgttgacttctcttttttttatcgtagttttgaccctagggatctgaaacgatatcgtttaatgtctaagcgggtaagggtagtgtcgtaataatatattttatcactagtgagaaaattgaaaccaatcaccgattgttctgagccggacgaaggagaggcagccgcctaagaagttgccgtcgtgcgccatggccgtgaaggcttctggattcattgggaaatcagcaatctctgttcatctagatttctcttcgtttcctgtgaaattttcatgcttgaaacagttttctgtatcttcaccaaagccactggtcgttttatccgttgccttatcgtcgccggcaagaacagttgagtctccgcctgttggttaccggaagaatgttgggatttgtctcgttagcccatgtagaaaggtaacttctttcttcttctccttcctctctcatcgctttatgtgatttggaagaatttgtccacttgatttggatttgaaatggttttggttttgcagatttttacggcgtcaaagattcacattccggatacatggcagatgcctcaggtgaatctctcataagctctattttattacaaaatgggtttattatataggctttcggtgtctaagtagttttgattgctttggagagcttagttctcacttctcaccaaaacaacagctcctttgtagtgtattgagtgatatcgtttttacctttgttgctaaagaggtgttgaattgcatagtttagggaattgttcatttgaaattacaaagtaaaaaccaaatgcattgacaatcctgagaagtagcttaggctgtagattcaccagtttatgatcctttagggtatcaattttggccataggtttttattaaatctgcttttacagggtggtgctgatgagggagaagatttgaggaacgctgcctttagagaactgagagaagaaacaggggttacttcggcagaattcattgcggaggcacgcttttgacatctctctctcatagtaaattatatttcaataagattcctttcatcatttccatggtttttggattagagtttgaattgctctgtgtatcaccaaactgagcttttgactattttaaacgtctctagataccaaactggctgacctatgattttccccgagaagtaaaggacaaactaaaccggaaatggcgaacaagttacaaaggccaagctcagaagtggtaacaactaagcatacagtctcatatatctgtgaaaagtatcttaaagctgcaaatttaaggatctaaataattcttcatgatgattatctaatacaggtttctctttaagttcacgggcaaggaagaagagataaatctccttggagacggtactgcaaaaccagagtttaaggtgtggtcgtggatgctaccggaacaagttattgaacatgtgagtgataggttttggctttaaattattattgtgtttgtgtgtgcttgaaatttgttggccttctcattcattcattctttttctgacaggctgtatatttcaagagacctgtttatgagcatgtcataaagcaattcaacccttattttgtggatgaagaaaaggattccatgaactcgtctaaggattgaatgtgcacaaagattcaccaagtgaatactgattagaagcaaatcaatcaattcattatactggtttctcttgaatctcatcaaaaataaaaattcatgaatctcagacattgatcttgtagtttgatgctatatataaatcctcacgaattaaattcacgaactaaattaccacattaataaataattaatttacccataaattacaacattatgctgatactgatagttcgagaggactcctttgaaataagcgttcggaaaaaaattaattatcacctagttctaaatcatcaatctgaaaattttagatgcaattttttggataaatcaaaaactttgcacaccatctgtttattcaaatgaccttaaatcctatgtggctttacacatttagcaaaaaattcttccaatggttaagagtccactgattcttagaaaaaaaaagagcatttttaagagagtattttttttcttctttttgttcattttggaccaatgagcattcaagacgtagtggtatcttagcttaaatcctatgtggttttgctttttcctctcttaaaaattaaaatctgttgccggttcctttttttcctcagcaccaccacaaaatggcgtcgttttgccgatttgatttaaagcatctaaaccggtttaatccaactccgtattgattgagtttatacttcagcgagattgtttccgttcttccgccacctcctgtgtctccgttattaggtatttgtgagaatcttcttgattgagtttatacttcagcgagattgtttatctctaagctccaggagaagctaatttgaattgcttctgggtttttagtacgtagctctctataagatatataacaaatg

SEQ ID NO: 32606 - DNA, 3000 bp, Unknown
  misc_feature (1)..( 3000): 2750-1469P.txt file - cDNA_ID_3059111; gDNA_ID_1620324; Annot_ID_153424
caggtgggaagatctatctctctgcgcctcttgatcacataacttcactcttctttgtttctttctttttataaattacagacagaacaaatatagtcataaataggaaggtgatgctattacagttgaaacctgaatatctttgggggtcctcttgtcttaaatttggcatctctccttcattattaaattagtgtctctcttacactttggtgagcttaaacaggagtataatttgtaagtgttggaatgagtggaatattcaatttattccattcaacttaaatggttatatttgattccaccaaattttatctttctaattacacacatccatttgcactcttgttcttagcaaaacaaaattgttctaatctttagccaaaaccagacctaaatcaaaccagcacaaaatctcagttatatcagaaaaagcagaaccaacatatagtttgtttcatacacaatgtcgaacgttaaagaatctgaaactgttcactttttgtttagtgattgttgattgtcacatcaaacaacttacaaaggatcactttgattcaggtacaaagtcatttccatcaaaagaaccaaaaaaaaaaagaagcaatcacagagataagtagtaaatcactcatcggacaattgatcccaaacattgacgatgagccacccttcaatggctgcagcctcaagttgttcttcaggacctgccttctcccatttggcctcaatcgaatccagctggcccaaatcagaccacaatactctgtgcgctaattctcttgtcccaagaaactcaagcaccagagttccacgagcttccgcagccaatttcccaacgttaatcgcgtttcttatcacgagaccgtggttttctctaagcaagtccaggtcttcctcgatctgcactccaacaaaagtgacaaacttggaagcaaagaaacggtacagatccttgagattgtcatgaaaaggtttaggaagtcgaaggaagagacataagtttctagtgctcagcttcaccgatgacagactccaccctgacgttttggttttggtttcagtttcaggaaaccccacatcccagtacacatcgaagatcaccgctcggtttccattcaagatagaatcttctcttataagtgaaaggtatggagagatatctgttgatgatccaacatcaatggtcttagtctgaacataggagccatcagtcatcttgaactttggcccatcaaaggaggccatgtgatgaaaaaacactaaagaatattcacaaatcaaattagattcaacgataactgacaaagttgtagctaaacttatctcaatactaatagaagtggaaagtaagatagtgaatccaatcatcactcatataacttgagcaccaataaggtttcctcttttttataaaaaactacaagtattcatgagttggaaacttggagaaattgggtgaagaaaggaccacacattgaataaacaatgatctagcatcgaattgatcaaagtagaggtaaacaaactttttttttagttttggctacaaataccattgatcactccccctagttctaggtttcatgacctttctgtgcatcaaaagataacaagaaagaagcgaaactttttgttctatatctcttagactaattaactaatggagaaacaaaaacatttgattctatcttagttcttgtaacccaaaacgatcgatccgagagataaaatcccctaactatcatctgaaattggaatcatactagtcaaattcaacttaaaagagacattaactgatgagaagttaagaggaggacgaaccttgaaatttcgcgtccggttagggatcgtagtaagcgaggaacagttcttctggtttctgctggaagagagaagactaaatccccgcgagggaagaagaaatcacgaaatggagacacatttcctcagcttgcttaaccaaccatacgttagtaatttaagctgaccaatccggttcaaccgaaattctatgtcttttgaatgtttttcttgacttttttttttaaggggtccttgtcaatctttgttaccaacgccaattcacacaagaaatataatgtgagacatttttcatcgttatcatacaaccgtgaatatacttgtcaagcaatgttggtcaaattctcaagatacaagagttttttttcacgctaatgtagtcacactacaaatccattaatattatttttttcgtttagaaatcacacataaaacatagattgtgtttgttggtataagtgatagagagagcatccccatatcattttccaaacacaaatgctcacaccaaaatggttgagttcataaggtacatttccacacattatgcttaagtttcactcttattacacttctttgaaatgtctattaatctttaggaattagcaagtacgacacacattcaaatatccaacaactactctctctttatcaatcaacaaataaaaaacaaaacttgattgattaacaatttcaaagtttaaattcaatcacacctaacctgaattaaaatttggtctattgcatactcaaatccggttcaatgttacaagaccaaaaccagatatttatcttaaactggtccacttgaaaaaacgaaaaaacttaccacacaacacaggctgattctgaattcagcacaaatagtttcaaagcccaacaatcatcgcccaatttttgttatataccgccgcttctttctacacaacctacaaagccaaaagcttagtatactctctctttctactttaacaacaaattcgccgcttatcgcctccgatcttctctcaaaggtacggtttcgttttcatttcctccgattctcgtttcttcttcagattccttcatcgattagctctaggaaccttctcatcggaattcatttattgtctttgtttgttattcgaagcttcttctgtttatttgatacatattctctttcagttactctatatg

SEQ ID NO: 32607 - DNA, 3003 bp, Unknown
  misc_feature (1)..( 3003): 2750-1469P.txt file - cDNA_ID_3059127; gDNA_ID_1620325; Annot_ID_153463
tattcacatctcttgatgatataataaatgttcatttttctttttctttctttgggaatttggtgaataaacaaaattggtaaagcaattacgaatatagctatgtaatgtagaaaacaaaagcaaataatgatttgcatttttctttgtcagtcgtcacgtcgatggcgtcatacactgatacaagagtacgtgaccatagaaaagatagaactccatacaaggaagaaagttatatccacttagccatgtttctttcatcatttatcattttcattcagacgatccacttacataattcatttgaatgatgtttctttcattatttgcaatttaatctaaataatgcatttaaataaatctttatttgtttgattattttgtaattcatctacattctcatttagataaaaatgattaaaatacccatgctttcattttgacaaatgacaaatattcaaaatcattacctatcatcaatacaaaacatattggcaggaaacatgattttacggttttgacggaaaagcgtttttggcgggaaaaacatgattttgcggttttgacgtaaaaataagatttttgcggttttggcgggaaaatatgatttttgcggttttagtggaaaatataatttttggcgaaaaatataattttatagttttggcgggaaaacatgattttgcggttatagtgggaaaatatgattttgcaattttggcgggaaaacataattttgcagttttggcgggaaacataatattgccaatggcgagaaaatataatttagtggtttcggcgtaaaaatatagttttatgattttaggtggaatagcggtttttggcaaaaaaaacgcaattccatgattttacgattttgacagaaaataataatccatgatttcatgattttagaatttttttttgtttcaatatgtaatttgaaaaatataaaataagaaatctataaaaaataatattatttaaaatatgattataaatgaggatatatttgtcttttgactgaaccatatccatctaaatggttcaatcaaattcatccaaataagttttataaatttgtctaaatttaaaaaatcattcagatgtattatccagatgaaccatccaaatatttgttaaatttaacaaacatcatttttcatttccatttggatggatcatttggatgaagaaacaaacagaactacttcctaaaaatctctcgctatcatacagacccttctagaaaacatgcatgcaccggactttgtgttgcaacttgcaatgataatacatattatttttgaatagatttctaatgataatttatatatccttctacaaaaagcaaaaccatatattttttcctctccttttgtaagtcgaattcattgtccacttggaaaaaattattaaaatcatattatgcaaaccaacccttgtggtcccataatgagacgtgcacatctctcgtatttactatgaataacaaaaaacaaaaatagaagaaaatcaaatcagtaatggagtttattgatttatattggttcagtaatttaaagcaaaattatgttttattagatcattgatttaaaaattttgtcaaaataatgtattatccattaattgatttctaaataccagttcaaatcatgatttaatgctggatttcaaaatctacattagatattaaaaggagaaaatagagtgatttaatttatggataaaccatgttatcttaaaatcaatatgtctaatttcaaaattaataaaaattcacaaatcaataggatttttttattattattaataggaattttaaaaactcagtattttggataaggataagagaaagttgtgttcctgggttatctacgaccgggggactttcattggttgtaaaatattatcatttatcaaacataattatcatatgaaatcttaacttgaattttatttatagccaaaattatttttactctttgttcataaaattttaatactaacttatactattgaatattataaaaggacaaacgttcatttgaaatgtgctatcgtaaatgtttcgaagaattggttaggagtgcactgaaacttgaaagtaagatatttttacagttttatattttaatttatcataacgtacggacactcatgtcaaatacgaaacaagatatttgaataatcctttctactaatacggttaataaatttacgtaaaacaaaattaattttaataattttatttacaaaccaaaccaatatcatcaatattatgtcttttattgagttgttgactacttgacatataaggtcttctaagaaaattccacaatttgaaacttcctcacaccttcctcaaaccaaaactagtattacctatttatgacatcacttttatgcttacacgatagctactcagatatataagtgtgtactctatttcttgtttgatggaaatacctttctagagtactcatcagacccagttacatgcgattatgatcgaacttcaagaatccagaccatgaaaaaggtacgtatgatcccattaaattcaattttactttaaatttttgggtactattttaaaacttcatctactctacatattctattattttaaaatatgttgttttaaagttttttcttttcttttcccagctatgtttgaagttagagaacattaaaagtaatgtcattcacggtagcaaaactaccaaaaatgctacaaaacataaatctttccaaatgtgtcataatggtggacaacaattttgtctaccaaaatttttttatgtcgtttcgaatttttgtccaccaaaaatctgttgtttcaaaagtggacaagtttttttcatcccattttttcgtttcaaaagtaatctttattaattacatcccaattttttcgtatgtaatgcggcaggtgattacaattcttacatataagcgataagaagaattgaagacgaaaattggaaggaggagctgatg

SEQ ID NO: 32608 - DNA, 3000 bp, Unknown; identical to SEQ ID NO: 816
  misc_feature (1)..( 3000): 2750-1469P.txt file - cDNA_ID_3059133; gDNA_ID_1620325; Annot_ID_153476

SEQ ID NO: 32609 - DNA, 3000 bp, Unknown; identical to SEQ ID NO: 821
  misc_feature (1)..( 3000): 2750-1469P.txt file - cDNA_ID_3059137; gDNA_ID_1620325; Annot_ID_153470

SEQ ID NO: 32610 - DNA, 3003 bp, Unknown
  misc_feature (1)..( 3003): 2750-1469P.txt file - cDNA_ID_3059167; gDNA_ID_1620326; Annot_ID_153505
aatttaaacaattaaataattttttttattgaaaatttaattattttttaattaccctttaattaggtaggtgcagctactttttttcttttccttctttttctctgtgaagctactcgttgattgtactaaaaagtgtaaaataatactctgtttagtcggtgcaagaaatagaaatgtaactgcttcagacgaccgttggatttctttattcatcagttttttgattaagcgttggcttatttttaacaactccacgtgcaattctcttataaacaaatggttatccaaacgcaaattccttgaccaaatctttttggtcggtttgtttattacaaaaaaagaaatagacaagatcaagggaattagatagtacgtggcataatcccccgttggtcctttgaatgttcttacttagctctggagtgacaattcaaatcctttgcataagtcacctcactaacatctctggtcacatgaacgaactcttatttacaaagcagggtctctctcatcatttttttttaaatgacaatgcatatgtggtctctgttcggtcgattacatttgaccaagtgagtgttcatctttgtaatcatgttggcattcaatcccgagtctcttccatcatcataaactatatcaaacaaactaacaatgatcaagcattattttttctctcttttttctgggtttatattgatattgaaacacaattactaaaagtattatatattaaaaagattttttgtatttatcagttaaactaaaaacctaaaatgctcatttctttagttgaaatagtgtttaccagttgcaataaaaatataaaattaaaccaaagtttcaaggttttattttttaatgagttaatctttcgagattctataaattaatatttattagtttgtagatatatttacgcaaaatacagtactatgttatttttagattttttttttattaaaacttttttaggttttgttctttgcatatttagttatgttttttttacttctttaatttctttttctccaacatattatgttaacgtagatacgaggcttaattcaatttttctttacataaatctaagcaatgacttttcatctacaaagttttttaaaatcaactataactgatcaaatacgtaaagagttatgtgaatacaaaagaaatcatatcaattgtactcaaaaggagttataattgttgattgaacagaagttatatacaaaatttagtcacacaatctgaaacagactcaagcgatcagctgaatatctatcataaatgatgaaataaaaaaaattagagattaacttcaaaaaaattcaaacttaaaaaaaaaacaaataacattataatactaaatttttttaaaaatatatgtttaagatttatgattattaatttatgatattattaggagcatatttttatatagagatttcaaaaaaaaaattatcttattatctgatcgattttggttaatttttatatttacacagaaccgataaaatttattaatttatagaatattaatttagagtttctattgtataatactaaatattggaaaatctaaacctaaatctaaggcatttccttaaattaaatataacatgaaaatagccctagtagcatttataaatccaccgagaatcggcataatttttttgtacaatgaagttagttgagttaatgaacaaatttattatgaccaaaaaatggaaataaaatatcataattggttcaatttttttaattggttcaaaattcaatatataaaaattaaaatcttaattaaatcccagaatctcataaataattttgggtccgactagtgacctataaaggaatacaaggaatgaaaagaaacataactaaaaaggaacaaacaagaaaataaaaaaatgataaaataagaatgaagaggaatgggtgtggaagaaaaatagaacaaatgttactgtaaatgataaccaaaacatagaacaaatagtaacaaaaattaataaataaataatttattttctaaattaaatattaaatataagacgaaaataatttaatttttaattaataaatgtttaatttgtttttttgtctgtttctcatcaaatttgggaaggaataattttcttgtacgattcctcaaaaaataaggaatgattaggaatagtgtggggtacacatattacaatttagaaaaaaattattgctgaatggtgaaaaaagaaaaaaaacaataaggaacgtgttgttcctacccattcttttcttaaaaaatgttcaccaattggaccctttattttctctgaagaggaatctgacgatataagccaatcatcatctaatgcctaaaacgtttcaaaacattaaccatccgaatcaattaaattttcagacaataaagttatcttttccaaatatattatggatatatatacccatcgtcacatttcttttctctaatttccatatcaaaactaaaatgaatataacaagttgagtgaggatatttttaaattaataaggaatgattttcattggtcaatccgtggaaattacattgtcggtaggtcaattaaaggcgcaattatgatgcaatatataaaaatttagaaatattaagagccatgtgactagaaccatgtatacaatattttatttcccttcgtattaaatcaccaacgaccaaatctaaaggtagcaaatcaaacagccccacaaatatatcaaaatatataaagaagtaattaaattaacaaaaacgaagaaagtataggtttcactctcttactcattccttacatgtcgaccaataattctataagtatctaatgacatttcctatctttctttcaatccataatcttatcatataatcaaattcgggaaagtttttaagtttcataaactctataaattactctctaccatcttaacctaaaaaacattctcaatcctttgtccaaaatcttgcatatcggcaaaatg

SEQ ID NO: 32611 - DNA, 3003 bp, Unknown
  misc_feature (1)..( 3003): 2750-1469P.txt file - cDNA_ID_3059173; gDNA_ID_1620326; Annot_ID_153500
ttttgtaattgtacgtttgtcccatatctccaaactgcatagctgattttctggcaaaaactattctctaaacattgtttaaatgatataagatatggattgacaaaaaataagtataaaaaaaaaaaaaaaaaaaaaaaaaaaaaagatataagtatcaaattaattaggctgtgatagaaatcaatctttcagattatatgtttcgtcatgtaagcatttttgaactttttatgtttctaaatttccacatatatatagtaatattttgagagattgacacgaataacaccaaaacaattttacttacaagatatcatatgatcatgtgttaataaaaaaacttatcatatgattttttccaatgtaaacttaaaactaaaatgaatctacgtgaacaaactttaaatcaaatatcaaatatagcaaacgtagcccggaattgaccttagtaaaaatattaatttcgatcagtctttagtcttagttgttggttttgttcattgttttttttttgtaaggccttagttatgacccaaacattgtttccatttagttcttagttaatgaaaccattttataaacatttaccacatactattaaaaaaattgaaacgaagttacaacttacaaatagtttaagacgtccatgcaaacactaaaaatcaatttgatcaattagtttttccttagtagatttatatccttaacgtgtggtgtagagttcttaagctaaatgttcgttcaagaaaaactatttgtggttgggtccattgatttgttgtactagaaaaacgaagtaatttgtgatggaatttaatgttgcaacgagacttatcagtactttggtgtggcctaaagccgtaggtctaaagaattaataaattcttggccctaattaactttttaaaacagatttaaatactattctatgttgattatgaaactgtaggatattttatattatgaaactttaatagatacacattataagtcataaataacactagaacaacaaaaaaaagaaaaagaaacaaaaaacaacttaggttgattaagtcttattgttttcaatatttgtgtctcaaacctctagacaacatttatatatttgactccaaaaatcatatgtaacgttgtattccgatcatccgatgagtacgaatcgagtcagtaattgaggcgatgattattgaatttagctgcacccaacctaaccttaccccaccttcttaacgagttagccaccgacgcataaattaggaccgcccatttattgatttctgatcaggacacttttgtatttgaaatattatgctatggtttattgattaatagttcatacacaactcgtaacaatgtttttttaaaaatagaatcttaataacaactttaagaaaaaaacaaaaaataataatctgtaaatggattttttccctgaaattttccatgatccaaaaaaaccattacaaatttcgttctcaatacaattaaatcagtatgaatgtctgaagtatgatctcacactaattttgtagtcaatactattactcttacaactgtacacgttttcacatcgccttaactccaggattctctatcatgatccatcatccatgtctctatcgtttatctgtatccattcgtttagatcacatcatcaattaattcattcaaatagatgtttttttttacttaaaagagtgattatatgcattcaaattgtgaagctctatatattacgctatagcaagaaacgaaacgtactgttttcccctattggtgaccgctctgtttttttctggatcaacgtaatctcttctttctttttatccgttggaacttaattagttaaatatttgatgctgggtcataattcgtccaatctatttcgccacaacgatgaaaactttacaaatgaaaaaaaaaaaaaaattaaccaaggtaaaattttgatattcatttcataatccacttttttttttagttaatatcttagaatgaatagtagttttgtaattaattaatcaagaattaaaaaaagttctatcaaaatctaaatatatagtcttttgtttgtaatatgttctgctttttacaaatatggacttttggtatcaatcatattcacttgttcagtattattcgaatttcttgaatcatataaaaacgaattatgtaataaaacgatataacaaatactgtggccggtcctaatgtcaattgtcatataactatatagtatatatatataaacctttctgcaaatacaatcctatatttaaataccaacatccacaagataagtaaaaacagaaaaaaaaactttaaaaaatgcgttgcctcacaaaaacaagatcgtttcattatgtcatcattttttattccttcttctttttaccgttcttgtcgtcctcctccgacgatcaaagaaccaccgtctccggtcttttctgtggcggacgtagcaaatcctccgcagatccaaactacatcccaactttcgtcgaagatatgcattcactatctctaaaactaactacacgccgtttcgcaactgaatcattaaactccactacatctatctacgctctgatccaatgccacgacgatctctcaccgtccgattgtcagctctgttacgcgattgcacgcacccgcatccctcgttgtctcccttcttcctccgcaagaatcttcctcgacggttgtttcctccgttacgaaacttacgagttttacgatgaatcagtctccgatgcgtcggatagtttttcttgtagcaacgacaccgttttggatcctcggttcgggtttcaagtttcggaaactgcggcgagagtcgcggttagaaaaggagggtttggagtcgccggagagaatggagtacacgctcttgctcagtgttgggagagtttggggaaagaagattgtagggtttgtttggagaaagctgttaaagaagtgaaacgctgcgtttcgaggagagaaggaagagctatg

SEQ ID NO: 32612 - DNA, 3000 bp, Unknown; identical to SEQ ID NO: 828
  misc_feature (1)..( 3000): 2750-1469P.txt file - cDNA_ID_3059181; gDNA_ID_1620326; Annot_ID_153498

SEQ ID NO: 32613 - DNA, 3000 bp, Unknown; identical to SEQ ID NO: 832
  misc_feature (1)..( 3000): 2750-1469P.txt file - cDNA_ID_3059186; gDNA_ID_1620326; Annot_ID_153493

SEQ ID NO: 32614 - DNA, 3003 bp, Unknown
  misc_feature (1)..( 3003): 2750-1469P.txt file - cDNA_ID_3059207; gDNA_ID_1620327; Annot_ID_153533
tagccattctaaaaataagatgttcaggctcagagtctgtgaaccgaaccggaccggaaccgtccataaagaatttgacaacaacaaaaaaaaaaagagagacgaaaatacggataatttttttttaattacaacaacaactttcttattatatttttgacatcacatgtgacgaaaatggcttgtttgtttaaattttttaataagaccaaacataattggacaaccaattataaaagtgacaaaacacgattaatttttaaattttttatttacaaaaacaactattttcttattaaattttatttttgacatcatatgtgacgaaatggcttatctgtttgtttttcaattaaatccaaaattggtaacactttggttttatttgttttgtcaactgaatttatgaatttgattaatcgtatgttttcggacttcggagtagttaacatgacatctatctaataaatccattgttaatcaaatgatttctaattaatatataatgaaaatctttgaagcaaataagatcatgtatttatattcatccctacactaaccagaaagccaatcccgtcgctcacacatggataaaggacagacaaagtcaagagacccgtcaattattatgaacgaaagttaatatttattctaaatttgtcaagaagagttgtaattaacgaaatggtcctaaatatgtataaatgacaaataattttcagtacttacattaaaaaaaaaaattggaattgaagtattgaaaaagcaattcatggttgccgattgtgtggatccagactgatcaagaactgtatgagttgtgaatgcaatcacttggatttggtacaagatacatatatcttaaagtcgcaccatatatgtaatgttaaacaaatcaaaatatattagaacgtgggaaatgttcttaaggatgtaatgtaaacgaatgaggactaggttaacaatacacatgagttcagccattcacatataaaataatgttaatgtttacaaacaaaattcggtcaataatttaagaacttgcaagacatatctatatatacatgattaatatttgttcaaatctgtaatctcttcgtcttaatctgttaccaacaaaaaaaatgatttctgttagacaaattctaataattattatttcgatccgagatactcatatatattacaatttgaaataaagtatatacaaaatggaacatagatcaaagattgtaaactttgattttgcataccatatattatttatttattttttccaaatatttattattattatctcacaagagcgaatgtgtaagtattaactgtagatagctctaccaagttttaaaagtttcaaaagataattactaattgattcatgataaatcttacgatttttagtcttttgagactaattattcttatatcgagaatcgaagaatatgaatgatatcaaaagctgaaaattgtgttttagagaagaaaatatatttaaacatgtagagaaagttggctagtccaaatgtgtatccattatttttagaaggtctatgcaatctaaaagattttgatttctgaaaaaaatgatgatttatgtggaaacacataatataattgatttccttatctatgtcattaaaatatatttattttcctctaatgtatccaaaaaaaaatctacagttgaacacgttttagctgaaacgaagtatgaccaaccaaaatcgccaagagagagcagtcattcatcgcgacctccaaaccctctttatacatgttgaagcgatggaatccatacatactgatcttccagaaagtcgaatagtttcataggtcttctcaaaagagatgattttaacaaaataattgtaatagttgtgtgaaaatgacttctaacaatcattattcaaatgacattaggaattagttgtgttaaccctagaaattctacaagttttttaggcccaaagactaatcatacgaagctttgtatttgtgtatacactcgaaaatattctaaatttaaagtgcggctaagtggataagaagacgactcgaatccaagactctgtactggagaattaccacaggaccaaggtaattaacttgattaatcgatttacactaatccatcaaccttttaacatctttttggttgtacatacacatacatatacatagatatgtatatagttatacttatttatatctttttttaatagaattgatcatatccggagtataaattagctaagaatacatttattcagacagccaacacagctgattatattaaatagcatgagctggaatggatgtttctcaacttatttctccaagttgcctatttcacatcaagacatggtgcccactttcctccaactctagatttattgtatatctatgtgaaaatgtgctgtcgttcacattcatccccaaagtattttaatgtatattgtatttgatcacatgaacatgacaaaatttatctgtaaatgtcttataataattgaactaaaaatgttatatttttaatctttttgtttgtttctattggataaaatgcaaataattatttggtagctatagacaaaactaacgtcgtgcaacaaaagttaaaaccatctttaacaaaagaaaaaaattgatgacaagatatgtataacaatatcaatgtctaatgacattctatctttaaatgtaagaaacaaaactagtattttggagaaaatattttaaaccttactttgtgtttttgttgacatttcacaaattatttaaggtgatttgttaattaacaatatcaaaaaaatcttcctaaaaaaaattaacccatacatgtgatgctatagttagtagtactagaactaaacccatccagtagtaaatctaataaacttcatttttttttgtattttgttgacttgcacttcgacatactctatataaacacaaccatattagagatcagatcccaacaccactaataaactcaacatg

SEQ ID NO: 32615 - DNA, 3003 bp, Unknown
  misc_feature (1)..( 3003): 2750-1469P.txt file - cDNA_ID_3059226; gDNA_ID_1620327; Annot_ID_153540
ttgaccaaattgaacccagattcaaccatttttttgttatgttattattacttattttgaagatgaacaaaaatgattaatgcgtaatgattttagattacttaacctgttgaatcaatcttagatccgtgttaattcaacaatatgaatctcctgatctgggaagcaaatagagtgaagatcagtccctttgtatactttgattcttgcaagaacttattaatatgatctctgttttgagtttgtaaaaattttacctttattttgagatgattatcagaagttactggaaatgctaattataccgatcatttttgaagacactaatttacttgaattcttaaacaggaattaagagcctgagtttttagatgtagtatatcatctgatgatgatgatgccctttacttgactaatttttttttttttttctatttttagaattgaattcgtgtgttttgctggttctataaagtttcttaatcacaggaaaagttcaaaggacaatacttgaatacttgggtaattcagaacatggttctatgatctcattgtggtttgttcgttggattttgtagttagcagtggacaaaaaaaatggtgattatgttttcgattcttcagttcaatttaaataagaatctatctatatcaacatttgtgaagctctttgttgtttcttggtgatacagaatctttgactcccaagcatcacggcattgaggttaactgcattaaccagtcaggtcgaatatttgttatccattgaccatttgtttgattatgggtcaatggagtttcaatgactcttcagcttcaattgttgcttataacttacattagttttctaatagtattatcttttgatctgtttccttatcactcttatgacttatcttatgctcttacttttccatttcgaactcaagcttctcatgtttattgaacgtttttgttggtgattactgtgtacatatgtagggaatctgagaacctcttgaatttaagtacatttctcatgggttggtgagttctttaattcttcatattttatttttgctcatctttaattttttgaaattttgatcgaagcagaacagctgcaaatttgaaaatctcagacatatctaaagcaatgtgacccacattggttggaatagagggtctctcagtacaaccaactgggtatccatatatgtaatgtctatacacaatctagttttacttcatattggtagtatattaaatatatatactataagaattattaaagttagttgtaaattgtaatgaattagagcatcgtaagtaaataatctttttttttcttttaccacaataattgttatgcctttacagaaatcaaagaatacatgaagggagcgaaacaagaaaacactaatacaaagggaaaacatgaacaaggccttgaaatcaaagagcagaacaataaagctcaaaaccatatcagtctaaaaccaacaaagtcttgtaggggaagaaatatcaccttcacgattaatcaaattcctcttgcttttgagttttgataattatcttgtcctataaccaacaagaccctttcactagcgatataagatctttcgtgatgcttttggaaatctcaattgtagtcccattgcaaggttctagtgtacattctactttccattcgatgaatttcaagaatcaactatcaattgacaaaacaggggaaaccaacgtggatgctcaatcgcctctaccagttggtgagaagaaagttcaaaatgatctgttttgtcttaggttactacggcgttcagtagcccacaagaaactcatcaaatccgtttgaaaagattatgtactttgaggatgatcatcttcaaaatgatggttgaaagtgtattgttccaataatataccctcaatttctagaagaatttgtattttggataataacaaatggcgtaaaaaacaacaaacatactcattgaatatatacttacaatgtcatgtacgaaccacataaaactaacttttcacttaacttttcaaattcctaacaacataaaacttatatttatcatattatgtagtataacttttttgcttctcctttttcaactctcaatgttttggtcatagtattttttttttctatttccataattttctcagaacaaggctactgttatttaggccttgtaatatttttgatgaataacattgcaataacagtgaaaataacaaattacagtcaatttggattgtaatattgtcaattaggctaaaacatataattcaaaagttggatagctcgtaacacttgcaaaatctctaaaaaaaatccgaaacttccaataaatagtactacataattccaagttggattgtaatttgggaaccaaatggttattctacataattgatgattgattgagacgtttacgctacaaataaaccaaagtcctctgaccataccggttcaagaagtcttccctctctcgcgccaactttgaccaaagactaacggtgaccacacgtcgtcaatcctttagtcatccaaactccaaaaccaaacaaaaccgaatattttgttaacctactagttcataaaattctacaacaaaaaccaaatttcaataaccgaaattaaaataatccccttaaaatttcgtaataatggtctcattttcagaaattgtattaattcacattaaatgtagtgtacaagtaataccaaccaaaccgaagcaacccaaaccggatgattttgacgaggtcaacactaacggcttttcacattagagttgaccaagagagagcattgacctgagagagttcaaataattgagtgagtctgtatattaaatacgcaaatcatcatcttcccaatttcgaatctcacacaccgaaagttattttcgaatccactaacgaatcttccacagcaaacacttttgtgttcctctgtaatttctcagtatatatagataccaaaacaagcagtgaaaaatg

SEQ ID NO: 32616 - DNA, 3000 bp, Unknown
  misc_feature (1)..( 3000): 2750-1469P.txt file - cDNA_ID_3059233; gDNA_ID_1620327; Annot_ID_153528
tacgtcatgtaacaagaaagcaattacgcgtggggtcttccttttaggcataatcttgtcattttggtatatgctttgtatcaatccatgtcatgatctatcctaaaacgtcgtcgtttatgccatggacggtgtagactggtagacactcatatctcactttaaccgaatgtttccgaagaatttcagacaaaaaaaactgatgaaaaaaatgagtttgcatcagataatgctttttgataaaggggtttcaaaagtggaattcttattattttttcgccaatagtgggattaatttagtcgttgagatttttgcttcaccgttggtttattggttctaataaaagttgtatttgattctccacccaaagttgggacgggtttatgacccataaattaggcttgtgatgtggagctgacactaactaaattttcaaacatatcttgaaaatttatattcattcattagaaatttatattcattcattataaagactaaatctcaataaatgggagtgttaatttgacatatgaactatgaaacgtatcattttactatattttgtattaaccatttggtaatgtattgatgtcctatcttaagtcatgtcatagtgtagctcttttaaaaccttttgtaggtcgtttataaacttgctagatgtacgccatgattttgcctatagatgatttcatttagccactacaacatagagttaatgtgcaaatatgtcacgaggtagtttatttaagtggtaatagatgatgaaatagattgaattgttttttataatattaactttttcatactagtgtattagacaaacaaaaaagaagtggatatatggtgatgaatgacgcactttggataattctttggcatatgaatcatgaatcactctactatatttctttttgtattgaaatatgttaatctactgatgatttatctactaactcatgtcattatgttggtcgtttaaacccatcttttttttttgttaaaagggtcgtttaaaatcttgctaaaacaccatgatttgcctattaatgatttcatttagccactaaaacatagaagtttatgtgcaaatacgtcacgaggtagttcactaaagtggtaatagatgaaatagattgaattacttttataatgtttaattacttagctttttcatatttgtatattaggcaaacaaaaaaaatggatatatggtggtgagtgatgctctttcgactattctttgactatacacttttagtccacgaatgataaatccacacgttgcaaatcccatagcctccctctctatctctcactttctatcaaatttagctctttaaatgttcctcacattctttgcttctttgttacttcttacacattttctcactctcacaaatctcacacacacagagtaaactaactctaaaagctatgaacaaacaaagtttgaagagacttcagttccggagatggggaaagcgaatcggaagctcgacgacggcttcagcaacgctaggaaacaccgaggaaagaacgattgtggcgtttgcgttctcatgttgtggaaaaccacgtgttctcgtgaagcagtttgtttggaggcttaaatcgcgcttaaggtggtctcggaagagtgatcataataatattcagtgtagttatgatctccggagctatcatctgaatttcgacgacggttggtctcgccgacggtgattttaattacatagacgttgctattattgtctatatatggagccttttcttttcatattttgtagtaaattaaattctcaatctgaaaagatgattttttttgtttcgtgttttcttgcatacaaaattgcaagatcttgatatttctattcataggctttaacttttgatccaaatacaaatacttgtcatagaaaacaacatttgtatgagcctaatttatcttagctttgtagtcttcattttttcttgcaacactattaactcgttgtgtttttcgttgatgatatatatgatgttgatgaattggtaaacccatagatgacataataaatataattgatgtggaagaaaaagatatcggaccagttaagattttctgaaaattgaaaaatgagaatgtattcataaaaagtatttttaaaatttttatgttttgcagatgaaatgttaaaatcaaagtaaaataattgctgtcattttattattaatgaagcaatcaattcagtcatctaacattaacatatgtccccacagtgtttctaattaccactcaatacacaatttttggatagggaaacctcataattgtttttttttttgttttggggtgggcacaaaacaagtcttaaattcaacaatctgaatctaaaccaaatttcatataaacaaatttgggcaaacaagttattttgataaaagtaaccattacactccaaaagaggatgaatttaaagaagacaatgcactatttgctaaaagatatcgagaaacataattaaaagatagcaagataaaccggagccggagaagagtaatgtcgtagaaaattctcctaagctcaacagtagattcttcatcattaaaagaggccagtgaacaagagtctgagaattagagaacacatgtaaactaagagcattttcaatggtaagagcccctcagctgctttcaccattttttaataataaatttttgaattttgtgagatgagaatttatgttatttttaaaatttattttatttcacagaactgaaaaactattataattcataacattgatttataaattagtgaaacactctatatactctatatccactctattttataattttataattaaaatgtttggaaacattttaattagtgaaacacttatatccacttgggcctagaataaacgtagttgggcctgctttcaaatggatacaaaacatatcgttttacgtctttcgtctctcttctctcgccgaaggaaaaaaattcagccatg

SEQ ID NO: 32617 - DNA, 3003 bp, Unknown
  misc_feature (1)..( 3003): 2750-1469P.txt file - cDNA_ID_3059237; gDNA_ID_1620327; Annot_ID_153525
gcaaattcctaacgtacactgatttgaactcaactgaaacaaggcacaccagaaagaaatgaatatatgacaaataactccaaatagcatatcctagtgcgagtttgagcatatgagaaatttcaaaacttttaatggtccaagaaacttacagtcttcaaaaccggagccatcttctgcctctgctccatagtcggaaacatatgtggatgagtttgattgctgaataggggcaagaggcgcagccagctgaggggaaggagtccgcattggttgatcccactcattaatatcttgagagctcttgttatatgatggttgtgtagcagctacaggtacagttgctgcttcctttgcaacttttaactgagaaaaagagaatcagcacatctccaattaaaaagataattttctatatctcaaatgagacaatactaaagttaggtacaaatgacaagaccagatcatggttattcgtcatggtacgagatagtaatccccaattcacagcattatcttttcaaaggaagtatacagtcaactattgactgactaccatgacacacatatatatgaagtatgaactatgaacactgtaagatatgtgcttccaggtcgtttttttcaatagatatgttgttttgttactatgctgaacaactaaacaagaccaaagagagtgtgcacttacaatggaagcataactcatctttgatttttcaccaactggttcctctactggtgcagcccgatgttcatgtaccacatcaactgcaacttcttccctaggtgtttcctcaatcgcaacttcatcttcatagtcttcatgctgaggttgatgttggtcctcttgcagactgtacttatcaacaagatcatctttgatttggactgcgttcacataatcgcttgcctcttcctccagcacatagtcagaaactgaaaagtcaaaaccagtgatatcaattttaagttttaacaaattcatcacactgaatcagtcgaaacaaaacatgacaaagttgacaaacaaaccttggggatctggatgacgggtaggaggattaagctgagcctcatgcttgatttcagataaataagaaggctgatgatagtaaacagtaccctcatcaacaaacagaaatacatcactgagaacaaaataacccttttcctgaggagcgagaaaaaaggtctgcacaaaactccttctgttgctaaattccttggttttcacagatcctgaaaccaccacaagaacaccaccttcccacgactcgactgaattaatcgtcttcacttcaatcgcagtgaaattcagtgacataaccatgttatgaatatgctgcaatcacatagaaattgaaaaatcaaaaactttcactaattaagtaaagcacaaacctttatcaacttaagttccactaatccactagaacctaatgaattctagaaaaatactggatcttgagaaatgggattagtagaaacagaaggagagagtcgtgtaccagcaaagaattagcagtctcggtggaatcaccatcgatacgaatagctctactaggctcagaataaaactgatgaataagatctggctgctgctgcaacacttgataatactgccccacaaagtacgaacccacctgcaacacatagtatgacaccgattcaatcacttagccaataataatagcttaagaatccataaatcaatttacgaaatgaaaactcgcctgcgtcgctccaggataaggagtcgccattatttaacaaaacccaagatctggatttaaacaaaaccctaagatccgatgaagatcgagtaaaagcttccaagaaactcaaattaatcagaagaacttcgcacagaaggaactggatagagaaaaagaagaagaagagagtatctctcaattgaatttgaataagaagagatctgaggaaggattgatgaagaagaaggaagtgagatttataaagggtttacagagaagaagggaaatggagagtgatagatctacacgagagagagattaaaagggtttttgtgaacactatagatagggtatggcaattaagaggaggcgctctttattccctttttatctacaaatgtatcttttctttccttttccctttgatttgccccataagttttgaatgcgtagaaaataaccctgaattcttataataacaatatgggtcctttatcttctttttattcatgattttaaccccaaaggttttgacattaccaaaataaaccataataacaaactgaatatttatattctcatgattttaaaccccaaaggttttaagattatcaaaccctttatattgccattacttactttttgttttctcgttttttttcaacatctagctttgattaatatgaaaagtagtcctgatgtttacaatggaacttgaaatgtaaaagtatgatacaaagtttgtttgatcaatgagagtttcttttaccaaacgatctgcagctttgttgttgtgccttcttgtccaaacaaagtcaacactggagaatttttgcctccaatatttgatctctctgatccaattgtggactttaaagttttgtgtttctcccttgactagcttcaagactatacgattatccccttcaaataacactttcttgtgtccttgtatccatgtgtgttgtattgccattaccaagctttgaattcctcgcttatagtattgcctccggagacatcttttgcatattgcattggttattaagttctgattctgatctagagcccttgatataagtattatgcagtgattataattgggcttttatggcccaatcattgagctgattaatatattggactttaatggcccaaatcatggtaaacaaaactcatcctactgatagaagaaaccctcgttactatcctctcactctccgaagcgattcagaaagttttaacccaaaaaagcaaaaaaaaaaaaacttttgttcactcgatg

SEQ ID NO: 32618 - DNA, 3003 bp, Unknown
  misc_feature (1)..( 3003): 2750-1469P.txt file - cDNA_ID_3059242; gDNA_ID_1620327; Annot_ID_153519
atcaccaatattatatatcaagttgagatcaaaattcatttatacgtttcatgagcacctttttctttgtccattagttgagaaagtaagatatgggttcaatattttataagaccaagacccaaaaccatttttctaatacttttttttctttgttaaaagttcattactgaagtaccatatttcaaatacttatgctttttcgtttccaattatttaatatgaaatttatttattttcatctaacatttttgctttttttctgaatcttctaataatattttcgtttaaatagaatctaaaaaataatatttgaaatcctctatatattaaaagagggatggttaatatttcattctatattattaggctactatttggactcttttgtattgtttctttttttattggtgccaacttaattctaccactaaaagtcgattttctatttatttatttttcgtcattcttgttactctagccatggaaatggaaacaaacggaaactagacagagaaaattattattgttactaataataaatgaattcgtcgccgtcgaatatcaactcaatgtttgttttttgggatgtgtaatcctcaaatatgcctcacggctacatcaaagaagagatactgtgtagccttagtgtattttaagcaccaatggatttcacagagttgtagcaattatttggtggtctgaactcgacattacacaaggcttccaatacatatacagaattccctttccacgatagattttttaaatactacttatatgcttttttcgttttcagttattaaattagctcaaggtgtttgagtattttggttggttccattaaggaaccaaaatacattttttattcaaatttcattcggttcaggtaggtttaagaaactgactcaataactaagtaggatttgaaagttttctaagtatttttcggtttagctttaagatatctgaaaaaccaaactattttgggatatatgtattaggattttctgttttttatttgagtaatttttgtaaattctgttcaattactcgaatatctttcgattatccaggtatctggaatattcaactcgaaaattttggttcacatattttaccaaaagctagagctaatttaaatcagctttactatatatatgttttttttgttttttctttgattagtatgagagttaatgttaataagaagtattcttagtttttccctctcttttctttgtttaaagtgagagttatagttacagtaaaactttttttttaaaatggtcccatcaaatactataaattaatgattgtataaatatatcaaaatatatttttacaaaaatccattgtagtttttgttagaattcattgctaatattttcaccatatcaatttattttttatcatctgttagacatgataaatgattgattatttttagttgattttagaagtatattgattataacgaaaaactctctttcaaaattacaaaataaggcaaatctctatatagattaataattaatatctttgttaattaataaaatattttagtctcaacattattaatctatagaggttttactaatatgcttataaaatcagaccgaaaacatactaagatacatacaggacatttataatgatagagcttctcagtgcaataactgttcttcgtggacagataaaaaatatctactatttgacaaaaaataatattgacaaaaaaatatatgtatatatatttatctagaaaaatatcgagtcattgatgtataacctgtttcgattttccaagttattatgtttaaagttttggagattttttagtttttatataacatgaaaaatattaagctataatctttataatcagttaaattttagtataaaattcaataaaccatcttttatttataaaaaaagaatgcataataataattaatatttatttcgactttagtttatgttttcattttttctccaaattcgaattaaatgatttattaacttttaatttaaatcaggaaaatttttcatattacaaatataaaaatgtagtttttaattaaaagagaaaaatgatatttttcaaacaaaactcataaataggatcgttttcaaagttgcccaatataatttcgtattcttaaatatagaaaatcacagatatcaaatataggactaacaatttaatgaattttatccaaagacgaaaaaaaaaattctaatatatgactaaccgtataaccttaacgatagggattagcgataggacttaacgatataaacacatatgtatatggttttcgacctctcttctccaaaaccatcacagagagagtcgccgaaataaattgaaatccggtgagaagattttggattcactccttccttctttcttcttctttatcatcatttgagctggttttggtatctctcctgacgaatttgaatctctcagccattttctcttctcgcatctgtgttttcgtgcttggagctgtacacgtttctttaatttgaatagtgattttgcgttcgttaattagccttctcgtacgagtgggctattttgggaatgatttaggtggttttaagttactgggtagtagtcactgctgagcgatttctgtttctcctgttgaatgattgattcagaaatttgaaattcacatcgaaaccaaatcttaaatcatattggtagctttttttttgttttgtgattagatactgtttttttatagtattaaattcgttttggtgtgagtgatttagtgtttgggaaattatttaatttagtggttattttctgatttagtgatgatttgagaattttgtgttgtttatattcttggtagcgggaaatttgtactttcctttgtggacctttcaactattgaatgtggaagatttgctgagaatcttagaaagtcatcatcatccatacgtaagagaacttttttttagcttgagagtgattttcagatg

SEQ ID NO: 32619 - DNA, 3000 bp, Unknown; identical to SEQ ID NO: 854
  misc_feature (1)..( 3000): 2750-1469P.txt file - cDNA_ID_3059258; gDNA_ID_1620328; Annot_ID_153572

SEQ ID NO: 32620 - DNA, 3003 bp, Unknown
  misc_feature (1)..( 3003): 2750-1469P.txt file - cDNA_ID_3059262; gDNA_ID_1620328; Annot_ID_153571
aattctgtaacatggttcaaattgtttacttgctcaacaaatgctacggctgactgtagaaatgcctgccacccatatagatccacgataacattaaagtcgattctatgacgccttaccaagttaaatgcatctttgaaccgttgctgagctaacgcattcgtaatggaagagaggaccagctttctgggatatatgcattcgagattcccccgcatagtttgtaatatcacagcagcttcatctccattgaggactcctatcacttttgcacctctttcccaaatattaacatagctcatattttcctcgtctcgccttctaccatcaataacaaagaacacatttccaagtgccacatctccattcagtacatccttggtatcgacaataaagagaaaatcctgtttggtcaaaataatcagatgggtaactacttcattggccaactctgaataaaatgagaaactgctacagttattacataggttcttcccgttgatggacagtctacccatatcatcaagcccacatatcaagggtttatgcaccccactagcatcaacctgtgccaccctcacccaaggacaagtcgatggaaaacatacactatcatcactactacgagtttccataatttctgaccttgacgcatatccaagcactttcccaccctcaaactccacaaaggctgaatcacgcttactaggattccaggcaagagccaggaccggtgattcgagaagtgtctggaaagtaatgctagccttaaagccagagcaagtcacttgatcaggaacatgatcctcatgacagactacttcaacttcttgtaaataagaaccatgaagctctgtgtcataccctcccgaagagagacacttgttgtggctagaaccataagcggagacacacagaagtgagtggacatccaaccatagaagatgtacaaaagagcccagtgctgttttacagtctgaaatttccacactgaagtctttgccttcgagatcttcccaagtattaggtgcagggaactcaacaaaagacaggtttccatctgacaaaaacacagccagacaattcttagaattccttgagtaatatgctatatctctgacagcagaagaaaaactaaggctgaacaaatacataggaggtggcatcaaggacaaagatagtggtgtcacgagtatcttggagttatctatgacaaaggctgttgagtcctccatgaccgctgttacccacataaagtggcgaacagacacctgccctgacagagtccaacatattaactgcagtggctttgttggatcccacatgactgttaccccagcttcccttggatacctaatctcctgtttcaggtaccagtggttgttgctaaagaaccacaccctaatggcatcatatgttttacaactaacaacccctgcaagaagatctgatgcagaattccatttcagattttcacatgattccgtagcatcttctggttcaccaattctaaacgagcttctctcaagtccattcctctcaaagaaagcaatcgatggactgctatcatctgacttcctcttataaacagctgcgattttagcaccactcggcatccattcaagaatcccctgcgtaaattcttttgtttctgaagaagactgcaaagcaccggaatcactttcccatatcttaatcttcttagacatacaaccagactcataaacctcacccatagtcgcaaaatactttccatcacccctccaggaaatggaaatacccccacaatttacagacaaatcattcgtttcacctaaaacagtatttaattcagatggttagcaaataaacaaaagctgttcacgataagtttcaactcaaacccataaatttaacccttatgcagtcaatatgacaagaaggtaaggggtccttacgtacgtaaccaccttcaggaacctctccaagcgccttctcgtacatcaaagcccaatcataagtcattacaagcaactgcccaagaccagtaatcaatccaagtagatctccagtcggattaggcgagatacacttgacacctccttctatatttccaactagctcagtcacatcactctccacattatgcactagcaaaagcccatgagaagtcccaattaatagagactccttctccgcgagataatcgaaagccgtgatgaaatccccaggctcaatatcaatactgcagacctccacaggcatagcactctttgccccagcgctttcattctgccacaagaaatacataaacataaagagaaagactttcgatttaaacagaccctactcgctaagttcacttgcaagttcatccacaagaaacttgaatcaaaagcaaaataaaaagaaaaatccatctttagaccaaagtccccaacttttttctcactcgtttccttattaagcagaaacaggattaaccaaggaggaaacgaattctctcacagaaagcaattcacttacttggaaggaagagagctgaagggcgtaaacgaaattagcagaagatgcgaaaaataagcgactttggtcgatgtcataagctgcgaactgtacaacttcttcagtcgaatgcaattggatgttctgaggaacctccgagaaaagcttcaaatttttcattttcgaagaagtaagaatcagtacaacatcaacgaactttgcagctacagatccaggaagcagatttaaaccccagaaatcactgatataataatatttagggtttaacctaaaacacgccttcttctctgtttttcttttcttctctgtttcctctctttcgttttgctataaacttgaaaaactgacccggtttattttaccacaccggttatcttggtttataccggtttagtttgtaagaaatataatattattatccggccactttcttcagagatcagttttctatgcctttccttgctgattctctcactagtgaggaaaagcatcatcatg

SEQ ID NO: 32621 - DNA, 3000 bp, Unknown
  misc_feature (1)..( 3000): 2750-1469P.txt file - cDNA_ID_3059287; gDNA_ID_1620329; Annot_ID_153593
taggttgatcttcttctgagagttcaccatacaaatttggtgagcctcactgggtattgctatgaaggagataattaggcccttatctatgagtttcttcccaatggagacctaaaacaacatttgtcaggtatattgttctagtaatctcatcgcatttggtcatgaaactcagaaatagccttgaatgggtctaaaagatctaatatacaggaaaaggaggtaaatccatcatcaactggagtattcgtctacaaatagccttgaacgcagcactaggtttgtactaacttaaataccgtagaataagatgtatatcgactcattttcaggtttgcggtaaatcatttgatatagctggctccattgcaggattggagtacttacatattggatgcataccgccaatggttcatagagatgtcaaaactgccaacatattgctagatgagaatttcaaggccaaactcgctgattttggtctctcaagatctttccaagttagaggtgagtcctatgattcgacattcgttgctggtactcctggataccttgatcccgagtaagtatctctttgttttgaaacttcctattcattcttcaatggttaaagagtatataccctgttcttgtcttgcagatattaccctacaagtcggttagctgcgaagagtgatgtctacagttatgggatcgtgttattggagatgatcacaaaccagcccgtgatctctgaaaagtaccacataacagaatgggttggctctaagcttaaccgaggtgatattattgagatcatggatccaaaccttggcggggtttatgactctaattctgcgtggagagcacttgagctggcaatgtcatgcgcagacccttcttcctcgaaacgaccaaccatgtctcaggtaatcaacgagctaaaagagtgtcttgtgtgtgaaaactcgaggatgagcaagactcgaggcatggaatatcaagaaatgaatattagcttggatacttcggtggttcctggagcaagatagttttgacttttgagtagttgtctacttgttgtaccaatattgaatcaacatatcaatttgtaaaacatctataataaaatgtgatttcttctccatggttttgcttttgtgacattctccaacaacaacaaaaaaaaaacactttttcgttataaaaagaaaaaaaaaatggtgaagacgcctaaaccctagtaagagtggggcttaagcccaatgggccaaacaagcgtctgtgaatggcggcaatttcttaacgcgaatcaatcgtcgatcgctggagaaaaggtctcaccgccgggaactgctgatgatgaagaagcgctctttttctcgctcgacgggatctttcgccgtcgtaaaccaccggagattatcattctcagtcgccgactcgccgaagcctgctgagatagatgaaaaacctagatttctcttggactcgctgctctgtggattatccaaacaggtgtttgctttgacattacactataatttctacttacgcatcatgaactcaaatcttctggtgtgattaagattgtgacatttgtgctaaatcaacttgttaaacatggttgtgatttcttattgaaggaaataattaggctaatcaactttagctgaatttaagagaaaatgatgtcttcttacctctgtgaagctgcactagaatcacacacatttactctttttcgccactgacttgtcaaaagtctttcttttgtgaatgatatgtttttttttttcccttatttatttgatgtttatctctcagaccaagatttctctcagactcgctgccctgtggttatccgaacatgtttttctttggattttgatagtgtcttcttaaacaaaataatcagaggctaataacctaagctaaacttaagagactcacaaattattgaattgagagcatccaaacaacaacaaaaaagacattcaagaaaacaaaaacccaaaaagaccgtcttgtactctaggttgttggactcgtcttatattattgattgtcctataatgtgccaatttattgcttaacgtacttcttggcccgctcccaaattcatgacggggatattgggacattgtcgtcctcttaaccctcatctttcccttggcgaagggctagctgcactagaaaacacatttactcaatttttcaccattgacttatcaaaagtctttctttttgtgaatgatttgggtttgcttatttattgaagtttatcttcagcagcattaccgattatcgatttcatttttctaacaaaaacccttttccaaaactacagggaaattggtaagacgcctaaacttaaaaacccaaacaggtttctcttttgagattgcactaaaatgtcttcgtgcatcatcacttcatggtggattaagatcttttggtacgattgatatgatagtttctttggaactaagattcatgctgattgtctgattaattaagaaactactgttgcatcaaaagtgacacttctctagtaaaactaaagaaaaagaatattgtttgtgatttcttaaacaaaataattagagactaataacctacgcgataaaagagaactcacaaattagtgagagcaaaaaaactacggaaaggacagtctttaaagaaaaacacaataaacaatcaacgaaaaagggcagtcttgtttggactgtgatatatcaatgtgtgcttcttggtccgctccttagtttcccagaaaaaaacttcatgacggtgatgttgggacattgttgtcctcttaaccctcatcttcttccattggtgaagctgcctgcactagaaaacatatatactcattttcaccattgacttgagtcctgactaagtctttcttttagtgtatgatatttgggtttgcttatttatttaaagttttatcttcaacagcatagccacccgttggtttcttgatttttccttgggagttaagaaaagatg

SEQ ID NO: 32622 - DNA, 3000 bp, Unknown
  misc_feature (1)..( 3000): 2750-1469P.txt file - cDNA_ID_3059302; gDNA_ID_1620330; Annot_ID_153613
aaaaatattgattttcttttacaataaataattaatattagaaaaagataattggaggaaaaagcaacttgagattatattttaaaaaacttaagtaaaaatataattaattaaaggaatcatttattattttcttagtcgttgtgtaaaactcagaaaattattctttcttataggagtaattaaacgaggttatatgtgagtttgagtttataaaagaagtttaaagtgtataattaaacaagatttatgtcggttttggtttataaataatagttaaagtttaaatttataattaaatgtagttaaatgattgtttgggttttataaaaagtgattagggattttattttacaataaaaatgtttaattttaatttttattagatgagagattttgatcactggcggatgcctaacgtatatttttttaacacaggcactatattataaataatttaatcaaaaatataatattaacataaaagtaattcttataagaaacaaaatcctacaaaattattctacgtttttcccaattttggacaaatgaaaaacaggaattgatttaatttatttagagaagtttttgcatcaaaagttttagtataaattaagtacagattatagatacaattacctactgtggacattttgataatttaggaattaggactcataataagccaaaaaaattaacaatggaaacaaattaagaaaagaaaaacagagatcagtttgcgttgatttgtttaatattttggaggccgtaagggttgggggtaaataggttttaaggcgtatattttcgtttaatacaaacttttggtcaaagtattgtttttatttttagtactaggacacttttttattttccatattggctttggcttaatgtatttgaaaatattaaattatatgaaaaaagagtgtggggcgcgtgtcctagtaactctgatcttgtagtatccgcccccgatcataattcttttaaaatattatcttaattaatcgtatttaaattggttgatagtgtttataaaaatttatgagatttgtatccagtttaaatttctgaattggtcaacaatctaatttcaatcgaagccatctcagcgttatcgcgtctcattgttaacagagttatacttgcccatttttggatatttttacaaagtgaaaattcatccgaaaatgttgacaattgaaaatgttagactgttttattttctaaggaatgcataaatttgttaacttatcgtcgcattatgtgtatgattgataccacagtagaactcgttcgtttgaatatttttttaagtttgtgtaatctttctttgtaagcgaagagttttggacgaataatttgagacaaacttgactacgagaaaactagctgagggtaggatttgaacccaaaacttggtcataatcctttttgagttcccaaaattcactgatagtgttaagcggaatcgttcattcaaaatatatactatatgtaggctatttgggaatatcttatacacttttttgtaagaaaattagacatatttatctattgtttttaaaaaaaaattgtaaaaaaacgagatctaagtttattgtcaagttaaacaaatagagaattacgggacgataaaaagaaggaaactaaatgattagagactttatttttatttttctcaatcgacgtgatgaccaatttgatacagactcataatctatatgatatacccaggtggaagacccatgcgttgcatgcgttagaattaatataataaaatacaacctgttgtttagctgtttctaattaatattgaaatatgtttagctgttgaaaacatatagaggttaccttttatttttctctaacttattcatctcatctagtttatccaactcttttttattattcagcttatctttattcaacttatcagtactcattttattcagctagttcaatttgttaatcaccattggaaactttttaggtgtttatttttagaaaatactcttcattaaatctcaaaagttcataaagtttttggtgtaaactactaattggagattcgatctaatgttttataaagtattttatatggtttaataagattttagaaggtatttaaaaatgttttacaaggtattgttttacaaggtatttataagttatttttatactgtatttataaaatatttataagtttttacacacatataaaagtagtttgtatactttaataaagttacacacatatttgaataaacctcatattcttaggagtacttttaataaacaattagaaatataatatttttgaaaagtggtattcgaaaagatgcttttgaaattcttcctttatttagcttccaattctaaacatttgaactaaactatttgatattcaattttaaaagcttatatggattgtcacctccaaacatatgctagatatttacttgagaatttttgataaacatctacttacaaaattttaactaaaataatatattgagaaattggaaaatgaaaaagtaaaatggtcgaagaagaatatcttttatgatatgttagcctcaacaacgggtgatatttaataattagtttaaaactttagtcactttgtagttaatacttctgatttaggattaaggtccgttgcacccactacttctgacaaaactaagtgtgcggacttagaaaatagattaaacatggatggtctcctatctctttgttgtcaacccaaaccggcaaaccctgatattctcttattacttttcatctataacatattgagtactagtacttgaccaaaacaaacatttaactatatagtacatctctttgggcttaaggaaacccttttgtaaataaagcctaagcccaaattgtagaactagttatagtcaataacacaaaattgcttctaaaaatttcccaaatctcaagtcttattatgttattttcaacaacgatatgcatgagatcatg

SEQ ID NO: 32623 - DNA, 3000 bp, Unknown
  misc_feature (1)..( 3000): 2750-1469P.txt file - cDNA_ID_3059311; gDNA_ID_1620330; Annot_ID_153631
tgatgcaacattcacgattggttttctctgcagtgaaagagagaatggcattacaataaacagtcaagttttatttctgtattatttaagtttttccattgctaaatttagatgaaaatggcactatagtaaatataaaattttaacaagggttaattgtcttcattatacatgtgtgaacgttattcaagttttctcactttaggaggtgtttagtttcgtagttagattaaataattatctttaatcttttatctcagtatttcattaggagatattgtccacatgagttcctcttctttcctaataaaactaacccctcttctttttgatagataaaatcttttttgtttttttaatgcaaagagattacatgaaaggtcacagaaaatgcaaaataaatttgagagataagcataagcatacaagttgctagcttttaaaaacatcaaaagctcaagaaactagggaggagctaaagaagaaatagcctccatatatactcactagagatccttaattgaatggtccacgattgcctcagcctccaggccctccacgaccatggtttctgcgtccaccgacatgagtatattacatctcttgaaccttttgagctgcctttattggtcatccttctcaagatctctaactctctaagctacatcacaaacagattctagacctgaattaattctagatttgaaggcagcaaatggattattgttaaggacactataagccacatcattttgtgaggatcttgattgagaggaaggagttgtgaaactttttctgtagcatggtaaagaccaatttaaatgtttgaaattgcttcaaaatgttaagaaattaaaatgtaagacttaaattcgactagaaaaaaaatgttaaaaattcgttttatgcgtgtttaaatatagattgtggtacgacgaggatactataacaaaaactattgtgttatatatgtcttaattttctaaaataatatgcataaacggtacgtgatattctaatataatcaatgcaagtataatgtaagggaagaaaatgtcacattattacaacttacaagcaaatcaaccaaatcattagtgttgtgccagcttctttacacaactcgccacgaaaccgacttagacgtaatttttaaaatgatataatgaaagcgtcaaaataatattcccaaacctcatcctcgctttcctcaagtaacaaactttccttcgtccgcttttgattttttgaacttttgactttttggatatcattcccaaatgtttttcaaacatctcttgtgaacgttccaaaaaaattgaaaatgatttattaattgtagagtactcataataatatatcaaatcatttttcgggtattagtgttacatattcttttggagttcaattacgatttttttttttttttttaatgttaagaatttttgaacttccgtaataatgatggttcaaacaaatttgaaggtgaggaaatcacgtaaatttcgaaacttcaaagttcgtttgggttcccgcttgtattttttactgtttgtgttaggttataagttgattttcttgttatttttagtctttttctcctatttatatctctacgtaaattttgtcgaaattttgaaaaatgataaagatgataaagatatgtaacataaaaaaaaaagtgttaagaaatttggaatctaagtgtagataaatttcaagtttatatttggaaaaataactgtacttgtaaatatgaggattgcaaaatctgtctactgttcatgcatgcttacttttttaattaactgaaaattatcgctacacatatcttgttcaaatgttttcgctttacttttacgatgaacaacactaaattttattaactgatcttacaaaacttcgataataaaaatgtagttacggcgactagtcatcacacaataattttagcactactttcaattcatccaaaataaaaatcgtaactaaattgtgtcttaaaatttacgattaagaaatcaggaccctagctagagtcaagactatagtatatatgtaccaacttcttttattttttgtcgatcatcattaggcatgacggattaacaaattaaatcagtagttttaagtcttcactattcatggatagataatttgacgactaaagtaatcagttatcgaacctctggagtctggatagatgactacataaggagtaatggagcaattgttgcaatgtccacatattgaggtatacttaattggttatttgtcttaatgaaaaacaaattcagaataatagtttatactagtaaaattaaaatattgcctcaactaataagttgttatgtgcaattatatgtggttgttgtacatgtgaccttaactaatattaagtgaaacatatacatttaaagataacgcctaaaatttaaatccttttttttttcttaagtccttcaaaacattctcaatcatatgaaagtcttgtcaatcaataaaagtccaaaatatatattttagacccaagtggttttagagaaaccccgttttaaatcattactatttcattaaatttacttttacatttctttcagaatcgaagttgccaagaatatgaaatcgaaatagattacgatgaacattaattacaattctactattatcgacttagctggatcaaattttcagcatatcatatacattgtaatataaattattaaatttacaacatggcaaggaatgttacaaagtcgctcgcacgcctttgcaaacgtttctaagcttaattatctaaacaaataatataacctttgactttcgcatgtattcggcatgtatatgaggtgtattaatcttttaggctctaaattatatttcgaaggttggctttatatatatatatataccttatggttgatcttaaatgactcacaaccctttccacaagaagttataaaccaatacatagaagaaaacttccaaccccaaaaaatg

SEQ ID NO: 32624 - DNA, 3000 bp, Unknown; identical to SEQ ID NO: 873
  misc_feature (1)..( 3000): 2750-1469P.txt file - cDNA_ID_3059344; gDNA_ID_1620331; Annot_ID_153660

SEQ ID NO: 32625 - DNA, 3003 bp, Unknown
  misc_feature (1)..( 3003): 2750-1469P.txt file - cDNA_ID_3059358; gDNA_ID_1620331; Annot_ID_153649
ccttagggctaaggtgtgattttaagtattataactcatcacattttgcgtctctcctagagttcctcttggttgttggatccaacacgttttatttctccgtgatcaaaaacagggtaaacttgaagatagaatggctggtggaaaagaagagtacaatgcattcttctactcgcttgtttctaccgatacacaggtaaatcactttattgttgaagtagccataaaaactgaaattcatcagaccaaatcagaaccaaaatataattcagttctagtccgcactcgtttccaaaacacagaaaaaattttgctttccagaacccgtgacttgaattcctgaaccgataaaaatcgaatgactgattgaatggagaatgactgatgtaaggatcgtgaatgttgaaatgcaggaaatgtattattcaacgaaaagacagcagtttttgatcgaccaaggttatagcttcaaggtaataacaagcctcccacctccggacgcgggttcaagcttgggctaccacagtcaagaagaacagttgtctcttctcggaaaggtgttgaatgctggagacgatatggttggtttagaacaacttgaagaagacacagatggaaaggctctaaagacgcgacgaagcatgggatcgatgagtgcaatgtccggtgcaaatggaagggtctacatggaatacaactcaggtcgtcaaaaatctggtaaccaatccaagaaacctaaagacccaaccaaacgacacaatatcttcaaaaaacgttatgtttgagacaagagaactcatattcggctatatgttttgagttgtaactttggtgcaaatttgtttcaggcacaaaatcaagaaaacctaaacgaagacaccctaccttaaaagaccgttaacatttgatatttgttttattatgtgaattgattaattgatattagaaagttctttccttttttttgatatttgttttctagcatatcatgatatcgcctcgagaatacctttgaaaattattttgttattgtcaactgtcatgatatctcgctgaaccaacatataaaacacgattataatttggttgacagatcctgaacaacagtaaaacgtacttagttttcgaggttaaaaaataattacttgtcatgatttcgaattaaaaataataatgggctcaatttgagattaaagaaagcccacgctaaaagaggcctactaaatgcccatattggatccgttattgtagcctttctatatatgaatcgagtttgcatttctgctataacgttctctgcattcacatgatcacatcaactcagtaacggactcgacatacccggacctggacccgacaccgaatccgaatcataatgcgacggagacgcagctcgcttctcggtctagcttacaacggaaaatatttacggtaccgtttgttttccctctgtcgtagaatttctgtcttcgacaccggattgatataatcgattgaaaagacaagagataatgtctaaaattgattcgatgaagagaaaaagatcaatatggggaacgataaaagtctcgatcttactgattttggttaattttcatattaccctgcaaaaaaaagtattgtcaattctggggaattttgttgttcaggtgaaagatgaagaagacccgactctgtgtgttttttcttttaagtgtcgtactgatgaagaagatctgggtcaattagtcatccgttatggcccagttgttaagatgttatccaaatcgtaagaagaaggcccgacatgtttttgagacgttggtaagaagaaggtcttgcttcttttgtgcatccagataatgtctatatgaccaaggtaagagcatcctcattgcacatcctccaatgaatgtctttcatattaaataatattaaatttaaagaccctctctcttttgacaggtaaaatgtctactattaagacacatccatttattattttccacttttttaagtagtttaaaagtttaaagacacccataaaagatatgcaatgaggatgctctaagggaccgagattatatactgctgcagatggggtaatgtaatgctatttgtcttgtgcaggagcgttggatgtacattggtctcctcttggttcatactttgtgtcacttgagaaggagaagaacgtggcaactctttgggcattgaatcgtctcccattctcagaccatgtacattgcacaatttttatgagtatcataagcccaaaaatattaaattaatgaataaaataactgatttgggtttaagtagtatcactggagtgatttctttgataccagtctctgataacgtggcgggttatgattagttgggaaaacatgtttttgtgtgaaaagagagaaattttttttttcgattagtcgggaaaacgcatcttttcgattttgcaattttttttttttaatgatactaatacgatttcaccggtggaaacagatttattatcaatattataaaaagtttcaaacaataaataaacattaaaattaatagtaaaatattattaatggtactctatgagtaccaactatgtgcatgctctcatgcgctttccttcctcatcctatggtttgtctttcatctcccattttgcatatgtaagaataatcttagaggctaaaagaaaaaagaatgggctcaacgtgagaataagaaagcccacattaaaagaggtctattaaagcccatatttgatccgttatttatttgtagccttttgaatcttctactttacatttcccttccttgacattaatgattaaaccagtgatacccgaacccgacaccgaatccgattcaaaatccgccggggacgcagctactccctccgccaaatagctttcaacggtaaattttcacggcgccggttgtcttccttctttgttcttctcaggaatcgctaattgataacttcaattggaagatacaagacaaaaaaagaagatcaatatg

SEQ ID NO: 32626 - DNA, 3003 bp, Unknown
  misc_feature (1)..( 3003): 2750-1469P.txt file - cDNA_ID_3059365; gDNA_ID_1620331; Annot_ID_153647
ataacctataaacaagaattaccaaaattaaaacatctagaagaaaaattatcagttttgtctcgttttttattcacagaagtgaatctaaagcacaaactctaattcttaatctccgtttttttgtagacgatttgaaacgtctgtacacaaacatatgtatatcaacactgacatgtttcgtaaatccaactttgtgatcagctattagtgtattcttacccattttttctttttaagtttttctcttgttctccaatttctttcttctgatacagagagaattgagccttctaagatgcggcatttgcgggttgctagtcaagagtagagtcaaataccatttcctgcagaacaaacggatcctctcagacatatcccgggaattaaaatgaatttgtaaacaagctaaattggaactactcattatttacggtttacttagagattagagtttttcgacatacaccaaagagaagtgaataaaagaatgtaccttgttgcagacggggcaggtttcacttctctccatccattctagaatgcatgcaaggtgaaaatggtgatcacatttggctacaagtttcgggttctcgatatcatattctgaatcaaaagcacagacaatataataaataacccattctcgcagtcatgtaaggtacgattatgtttatatgtttttgagatgtgggaaaggcaaacaagcttttaccttccaaacatatgggacaatcctcctcttcctctattggtataaaaacagcttttgatagcttcgggtctatttcttcagtagattcaagatcaatctctgtttggattttgctatctgtctctttatgtgagcatgtagttggaaccccgagagtaataccatcaactgtttcttgagcagactcggtattagcagagtccaccgaaacctctcttatatcaacacaagtagcctcttcaccactagctggtgtttgaggaatccctataggcacatcgaaaggggtaggcagtggcggtggtatataagcatcaggagatgatgtctctaagtttgtgtctactactacaacaccagtagagattgcagaggaagtcctgttatgagcggaagataaaggcacacgctcttctgttgcccttgggtactgcaaaatacaagtcataaaacaagttatattcccatatgaatctcgaagcccgttggggcttttaactcatttagtgtcctgaagcacatcaagattgatttatttgcagcctatcaaagcaaggacacccaaaaaaaacgaggaagtgggagaagtatcagactaacgtagtagtacgcaggtccattatctacatcagctcttcgtgaagaagaacaacaacagcaacctcccatctcttcttctctttttttttttttctgttttacaaaaactacaaaacccgaagactcttcatctatgctaacctacaagatatgtgaagaaacaaattacattctgagatcagtaggagaatatttatcatctatatgcaagaaactcaaacaagctttatcgttttcgatatcagtttgagctgtctactaaagtctgatcagactcatcatgctagtagcaacaataaaacaattcagctactaacagttcaaattcactctcaataatcaaagatacaataaacatcaaccattaaaatcgagacaacagtgttgcgactacaagcctatgtgaatctcctacaattctcattctctttagcaccatctacacacaattgcaataaattcaaatcagttttacactaaaccccaaaaacttaaaacaattctactcagaatttaactccaacacaaacaatgaatccacaaaaagaaccaaagctccattaagagcaagctaatccgtaaaaccctaaaccgaaacttataaaagcaacaataaacatcagaattctcagaatctagcataaacacataggagaaatacggatcaaaacagtaaaaaaaaaacccacagaatttcacacaaaaatcaagctcaaaacctaaagaaaagcgatcactagcaagaacaaacaccaaagaagaaccgatcatcttctcgagattgaatcagagaagaggaattaaaaatctcaaaatcatagagagaattttactttttgttcttgggggaagctttttttgttttgtcttcgtctttctctgcttctgtgctttttgcggtgctgtgtttatcgtgcgctctatcaaaatgactttcctaagaaattacaaagactctttttgggctcaatattatatttacttacctgatttattaaattcattaatacaattattaattagctgattaattattttattttttccgttacaatgtatttttcaaaatttcaataatgaaattacataactgaaaatcggctgaaaagtgtcgaccaaaaaattataaattgggaagtaccattttcagtaaaattattactattttttttccggcaaataatttatcgatgtttaaaaaagaaacatgggctcaaacttaagaataaagcccatttaaagaatcctattaaaagcccatatttgatctgttactgcagcctttatatatgaatcgtgttcttacgtttctgcttaacaatttccttcctccgcttcaaacgagtcaccgactcgacacaggaatccgaattcgccggagacgcagcttgcttcgttgaatagcttacaacgggaaattaccacgaagacggttgtatattccctccgtcgtacaatttaggttatgtgcgaattcacaaattgaaaatacaagagaaacaatccctaaaatcgatttgattaagaggagcgaaaagaagaaaatcaatatgggaaacggtaatggtctcgaatctcgatcgtactgagttttgattcgtttattgaattatccggtgaaaagagtatgctaatactggggaaaatgttgatgtttagatgaaagaaaacgacctacaaagaagatg

SEQ ID NO: 32627 - DNA, 3003 bp, Unknown
  misc_feature (1)..( 3003): 2750-1469P.txt file - cDNA_ID_3059382; gDNA_ID_1620332; Annot_ID_153682
caattacactttgaaagggcattaatgtcatttgatggacagaatcagttggacgtacaatgtttttactggtgagctcgtatgtcttttccctagttttaaggctttaccttttctagctatcaaataccaaactctatttttagtatttaaatcccggggagcctctgctttatttacattttcattaagttttaatggaaaaactgtaacaacaattcataactcggctctacttgtcgggttatgaagtcttagttacttgatgtcgagaaatcatctctcattgtgatgggaggaagcagttgttactattggttggctatgcgcagctttggtaaatcgcattcacagtttcttcaaaaaaaaaggtcttctttggtgcttgggtcaagtgttttcttcggattttagtttgtatgtttctatgcttaggttttggtttcgatctctttcgatttcggcttttaaatttctgtttatgtttctctttcatacgattttagacttcgggaaattcacgtttttctccagctttagtttccgaaaacttttctctcgtccgtcggctttagtttccgaagatttttctttcgtccgtcagcttaacttccgttatttgggatttgtatttcaccttagtttcaaaacaagtttcataaataaaatatttcagatgataaaaaaacaattcataattcggaaataaaaagttacaaacaatgtttaaaatagtacttaactgtttccatattttaaacattgtttttcccccacaaaaagcaggttcttgtacattcacaaagcacacacagatccgattaagatttagactgcacaatactcaaggaacgtgtcttcttcttctttttctttaaagaacatgtttactaaacaagaaagtgaaatttcttcatgagaatttgcaaaagagacaaaagctgatgcctacaacaactaagattataataacaaaattatgaactgaaaaaagagacatgttcagtcttttattgctttatatctttctgcagttaataaacgaatttgactacaatgagaagctttttctttcctattttttttattgtgatcttgtaagaaaaaatagtgtttaacactgttatttactattatagtttgaattatgttcttgatcaccaataacaagtaaagttggagatgtggtgcagtgataatgaaaatatactaaactaacaaaattaatttaaaaggctcaatggtttaagcatttaagtgtaaccccaatgtaaactcatttttctgcaattgggccaattaaatatagacaaccacaaataaatatcaatgacatcatcactgtatatcctaatgcttctcaaagaggcatataatactgtaatctccaatttttttgtttgtcaatttcttttaatcccaccctaccattgacggctgtggaggaaaaaagagagacaactaatgaagtaatgagtaattatacttttgctttagttaaagagccggctttagccgttttttactttcttttgtttagtttttgttttctactttattcttcttaagtagaaagtttacccaaaaaaaaaacccatcttaagtggaaagtaatagagcataaataaaaaataaataaaagagggttacaaaatatgcatatttattaaaggatcacatgtattctaaaatctgatatacgttagccatacgacagaacctcgtatagccttcaaatgtattaaaatgtaaatgcttcgtcgaattatgcgatatcacagattatatcttgtgcactaaaagtatggactatttcaaagaaatattcaataaccaaatgtacttcaaataatcattattagatgtaaaacccattacatggataatgtggatttcttctagatcgctctccttgtagaaagaataattgacatagtataatagcaaattgattatggaatagttaaggatgttcaaaagggttttaacttttaaggccaactcgacctgattctaaattagctcagttctgaattaactctaacctgtttttggtccgctaaattttgcataaataatatggttaagcctttttgtaacatggttttagtctgccagtttttttatttaattcttttttacaatatttttgtatgtataaataaatagctcagattttcttctcttaactaacatttaaaagttattatgcattcatagatcaggtatttgtttcatattttagaccctaatgcctaaaccccatgtagcgagctacaagagcaacttaatgtctgtacaattaaattaattatcgtttatagggtttttagaaaggcggttaaaaaaattatttatatataaatctaataaatgcttatattgttcaccaaaaagtaaataaattttaataagttcaaatttaaaaatttatttttaaaaaataacaaaaatatgttaaattttattgtaattataagttttactctaaatgaaatgattaatatgatatatgtctaactttatctctaattaattaatttttaatatgtgatttaacattatcaaaatatatttatatttacattagctcggtaaattttctgtgttttggattaactacaactttagtatagtgtaattagaagtggacaaatatgtataaattttaataaatacatcatctgaacttatctctttattttcaatattcttaataggccttgaattagaggcccaagtaaaaatgtcgaatattgtttttttttcacatttgtaacaatcggctttaataaaagttttaattctgccatttcctttcaaagtaaaaactaaaaagcttcccttgaggcaccacttcttctagagtcgatcttcttcaaccttgactcgtgagtcggtgcgacccagattcttcatgatcgtaatctcatcttctttatatattcatgggggtttgatcatctttctgcagcaacagagataacgtttaattcgaagatg

SEQ ID NO: 32628 - DNA, 3000 bp, Unknown; identical to SEQ ID NO: 882
  misc_feature (1)..( 3000): 2750-1469P.txt file - cDNA_ID_3059391; gDNA_ID_1620332; Annot_ID_153675

SEQ ID NO: 32629 - DNA, 3000 bp, Unknown; identical to SEQ ID NO: 881
  misc_feature (1)..( 3000): 2750-1469P.txt file - cDNA_ID_3059396; gDNA_ID_1620332; Annot_ID_153673

SEQ ID NO: 32630 - DNA, 3000 bp, Unknown
  misc_feature (1)..( 3000): 2750-1469P.txt file - cDNA_ID_3059400; gDNA_ID_1620332; Annot_ID_153672
aggtgaagttctagtaatccgacagggctggtttgatctcaagatgcaggctgtaacaatggtctcacattatatgttccattctgcagaagagtcgttgatgcagaagcacctctggcaattgttgtcccagctagaggctctagctgcagaatgaagctgcgcgagaaggatttgtcttggaacaactttttgggaaacgcaagaaatttgaggtacacccagtgaattcaatactgttgtatcaaacagagttatgaaatgtaattacaacgattttgtttgagaaacacttagagcttgctattccaaattcccggagaatgatatatgctatacttgtttcttcagaggcgtggaatatgttgctgcagagaaaccagcaggagcttacacgaacatccttttctcatcaggaaccactggtattccaatgaaaagaaaaaggcatcatggtatgtagatgaggatgtcgtgttgaattaccaagttttggttttctggtgtaggtgagccaaaggctattccatggacgaacatttctcctctgaaatctgctgctgatgcttggtgccatttggatgttcagcggggggatgttgttgcttggccgaccaaccttgggtggatgatgggaccgtggcttgtttatgcttccttgatcaatggggcttgcatgggattatacaatggatcacctcttggtcctacctttgccaagtttgtgcaggtatgccattaaactatgcattctcatctcatggtttaagcagagagaaaaaccttaaaagagacaaaagcaaaacatattttgtgcaaatatttgcacatatcaaaataaaacatcaaaatgggatctatgattgactggatttcattgcatggttgagtctgggatttgggcagcctttaatttaccatatgtttatattctggggttaggatgccgaggtatcagtgctaggcgtgataccaagcattgtccggacatggcaaaactcaaactccacttcaggctatgattggtcacggatccggtaataccgaaagtgcatctttagaatgttgttaagcctgaattttgttgtggcgtggaccttattagatgttttgagaaaaagaaagttaattagttttaatgtatcatgccaccacttatttttttccagaaataaatctatctaagtattgttgctagttctttaaaaactgttcaacaaacatcttatgtagttgttgaagtcaagaagatttttctatgcagtagtaacattgatgttttatatttgatactttttcaatagttgttttggttccactggtgaagcttcaaacatagacgagtatctatggttaatgggcagagcacattacaaacccgtaatcgagtattgtggcggaactgagattggaggcagttttatctcaggttctttgcttcaacctcagtcgctggctgcttttagcacagctgccatgggttgcaagcttttcattctcgatgaagatagcaatcctattgtaagaaactttatggtctcatagatgatacagtatttcttctgaaagatcttacagtatgaaggttgtgtgatatttcctttccttcctcgttttagcctccatatgctgcaggagtaggcgaattggctctttgtcctcacatgtttggagcttcaagcactcttctgaacggtaatcacttcaaagtttacttccaaggaatgcccaccttccaaggacaggtaatccaacctttgtcatatttatacagaggttttcatctgttttaagtctgtgccttgcctgcttttcgatagatcttacgaagacatggggatttatttgaacggacttcaaaaggatactaccgtgctcatggacgtgctgatgacacaatgaatcttggtggtataaaggtagccttactgtacatcttcgtatatagtattgaaatgcacaagcctaacgcattgtcatcataatcatattctgtgttgattgttattgtgcaggtcggttctattgagatcgaacgagtctgtaattccgttgatgacagtgttctggagacagcagccattggtgttccacctcctagtgggggtcctgagcagctagtaatcgctgttgtgttcaagagcccagaattttcaaatcccgacttgaacctgttgaagaagtccttcaactccgagatacaaaagaaactgaatcctttgttcaaggtttataccaaaaacaaaacacaagagagttgaagttgttgtgtggctaatgtgaatgttttttttcatctggcaggtatcatctgttgtgactcttccttctctaccgaggacggccacaaataaggttatgagaagagttctaaggcaacagcttactcagactggtctaaactcgaagctatgaggcaatttctctctaataccaaatgttgggttttgccattcacaggaaacaatatttggtctttgttgtaagaatccacatccatgtctgtatcaagaaatgattctcaattcacataaataagagtggagctagtgtacatacatctagtgagatccttgtccctcaatttgaatctcaactttggttatgattttatttcgtaacaaaaaccatattaaataaaacttgctatccaaaacgcaacagaaaacaagaattatcaaattcgtttatcacctaatagtaacaagcttttgaccatgtaaaaaaagaaaattgatgattggggtgaccaattaagaggtgtactatttacttatttacgaattaggggtgaaattcgaatattttactagatacatggacataaacgcgaaaagacgaaagatgaggggggaagtaaattatctaatgtacgccaggcggcgcaagatagaacgattcgcttatctttcccttatttcttttctcaggggatacagagagaagccaaagctaatagaagcacgaacggcgtcgggttagtccgacggaggaaccatg

SEQ ID NO: 32631 - DNA, 3000 bp, Unknown
  misc_feature (1)..( 3000): 2750-1469P.txt file - cDNA_ID_3059439; gDNA_ID_1620333; Annot_ID_153701
gagtgtcgcaggcggagaaagcacagtcccgcgattcgtgcgtttcgctttccctcacgactagtgacgcaccgactcactgctcatgacacgtgctcacgtgaccccctcctatattctccttatcttttctgaataatctgattaaattagtacattcttctaattaattatttttagacagatctcagtgattaggtggtctattattcaagttgataaaaactttatctctatattgtctaatgtctatagcaatattctccttttttaaaagagttggactgtgtaactttttatgatactccatcagtatagtatttgttctttgtttacatagtcaaatggtcagtattgaccatatcttttcttaagttaaaactaatatccacatattctttttaataatgtatcaattatgcggatttaaatgttggtacaattaatattagattacacctccactttttttttttttattgcatcaagtaaatatccatattattgtatttgttttttcaatggaaacttgtttatattttcttagcgcttattgatactacattactagttttatacatcgttttgttacactcttttcttttcaaaacgatgtaactatgctaaagctaaatcatatttttgagatatgaagtttttaaaagttaaaaactacgaagctaagctagtacatagtgttgtgttttaaattttaatacatgcgtcgtcttgtagaaaaatgttgttgagagtaaaaattcaatatctttatatttttttacgaaaattatattgtagttaccatttgcgaaaattataatatagatttttaaaaggataatgatgggtcattgttaaaaacatatcaaatgactagacataaaaaagacttggaaacgttgaaaaaaacaagctacgaaaagattcgagcaagacattaaacacgacacagtaacttcctaacttcctttaatcacctaatttgaaaacaatttactaatttacctgagttcgaaattatttggtaaattatgaataaatatcaaatatgcaatctgacatctggttccaccatcgaccgtgacattcgcgtgcctttctagctctcgcttaaagtcttttatgctttctcaatttctggttttatctagttctaaagctccactagattttcttattttcttcaaaacttttaatttttctattaatatttttttacatgatcttcaaaatacaatacagtacatatatacacttaatctgccatattttacttatatctaacttcatgttccatggagcaaacaaaaaaaaaactgtgccatgagtttttaaatacttatttttaactgcttaattatacaaagataacgggaaatccttataaatttgtcaaacaagattaatagttaaaatgttttacgatgtttcacttacttatctttattcatgcggagtttacccaattttgaaaatttggagatgtttcatatgttttctcttgaataacacaaagcatgttttaagtaagtgtgaggtgaccacattccatctaggttggatatacctcctctcaacaggaggccaacctggacttccatgcatgtcccaataaaatgtacgtaatctactaaaagaacatataatcaagagttctttagaatgtcatcttcatgtcatctcgaatatccttctaaagtttaagttataactaaaacaacgtaacatgattgatcggaaaatcgtaaatggaactagttttgggccggattttaataatgtgtaccgtaatgtgttcattaagctacgaagcatacacaaaaccaaatttagatttttctatcttttttgctcttttaaacttaaacttaaactttggcatgaaccgttgtgagatggagatgaaatggtccacacttaggagatgaaatggtccattaaaaacaaaaacaaactattctcgggtatgtaattatgtgggagatgaagggtaaaataataatctaaaagagagatggtagtgagtgatgagaggggaaaacaaaaacagaaccacttttgtcatccctcaacacctacatttgtcttgctagccagaaagaagataatacttgtccccactgtctcaaattttctattttctatttttatttttcaattgacaaatatgcaattgtgacaaagtttattcatgttttaaatggaacatatttttcttttaacaaaacccgaaatttcaaactagttaaatctttttttttgtaaaatgaacaattttgaaaatcaaaatactttttaaaatcctaatatatcatataataattttaatagtgaattactatatcaaatttaaattatgatttaaactcgcataaccaacgataattaaaataatcaaaaaatatccaacgaccaaaaatttattaaaaaaaaaaataataatagtcatacaaatattttcggataaataatttcttcattaagtataaatattgaaaaataggaaaacgtgataaaagaagattaaaatttaagacaaaatatttcagtactaataggtggaccaaatatttatgaattgcaaatcgataagtggagatgacattatgacaatcgtgataaaccttaaaagaaataatatttacggatattccaaacaaataaataatattatatataaatatatatatccctaaacggctaaaccctaacttgtcgccgggatttcgattaacataattctgtttcactaaaaaagactcagaagaaaaaagaaaaagaacagtagtgagagaaagtaagagcgagtctgtggttgacaaaactcttttgctctcgcagagaaaagataacttatttttttttctttaaaatatttggaaacaaaagagactctgtctgaagaaagctaaagacttgtgatgattcttgacaaaagaaactgtgtctttggagaactctgaagtaagagagacagagaaagacaaagagagagacatg

SEQ ID NO: 32632 - DNA, 3003 bp, Unknown
  misc_feature (1)..( 3003): 2750-1469P.txt file - cDNA_ID_3059447; gDNA_ID_1620333; Annot_ID_153695
tcactttttacccgaggccattctctttcgtattgtgaatccttgatctgtgaatgtatggttctccggataggcccgtggtctggggtagcagcatccagacccagttgatgaagcttaatggcagcatcgaacagataatggtaacattcagcctggaagtgatagttaaagtttataaatagaaacaaacaaatatatgaacataacataagaaaatggcgtagaacttattgttggtttctcaactttcaaccaaatattgaagtaacttgcacaaacctgtgtcttagcatggatccaagaatcaccccaaatgtaaactccgtgattgcgtaccaacactgctgttgcttttggataggcttctatctgcaaatgagagtgaaatatgtcaaaactaattaaaaccattattttgttgcatatattcaattcaagcttcctcagaacaattagacttacagctttggtaagtgaatctgttagttcattctcatatgctgtgttctctatgattgggacaacaagttcatcatagtatccgtgaccttgaatcccttttatcatctccatgtgagttatctatgaaatgtcggacaggaagaaacattaaaatgcaaagtcctaactctactggggaacctggaattgtctaccaaataagcattacagcttacacggaattctttggcttgcggattcagcatcgtcacaagacaagattccatgccatgactgtgaataacagctccagcatttcgcatctcatatgcctgcaccacaacaaggttttgctatgaaacttattgataacgtcactatctcaatgttattagagattggacatctataaaatgagaagggaaatcatacaaacaaagcaagtcaatttggcattaaaacaacccacatacaacttgtcgaaacacaactcactgaaggaaaaagagattgtcttaacatacatgcaaatcatatataagtttacacattacaagcaatgatcatgcaacctcactgatcaactgaacccaggaaagatatatttgatagtctaaggtggttctttaataagtaaagagaagttacaaccaaaactccattttcaagagtgtttgtgtaaacatcaatacgctctaaatatcaattcatttttctgagcccattgtgtttagttctaacacttcactactgaatccatctcaaccagtgcaacctagtgggtattctatgggtcgaagaaacccacttgacacatccaacgaggggattattgctcaaattggacaagttttaccttgtaaccgagttttcgcaagcgtttccccaaagaaagtcgcctgttctgcacttttttttggattgtaatccaacagtcattagcaaacaacgtatttgccattccagtaaaagatcactagctaaatgggaggaaggacaaaataccactagaaaagagcgacgagctcttaacatatttcgttcataaccatgtgctctaagaaaaatccttcttaacagaaaacattataacttgaaatccgtaactgctgctcaacactttgacgaaatccaacattgctcaacaatttgagaaaacaaaaaatgcacaatcatcaaagaaaataccataagataaagaaggccaatagcaaagtgataatcaagctacgtatacagaaatccctaacgcagaatcaagtattactaccttgaaagcgacaaaaccataccttcatgaaaagtggagcacaatcggtacacttgggaggcttatttgggtatggctttggagagggtgtagatatgatggatccattagcagataagatgtacatatcctcaggttgcatcctctccttttgaacaccttcaaacacaacaagaatcagtaaaccgtgaagcaaataaaataacacatagaatcagcattgcaagattttcctttccattcaacatcttgcattgttaagtcgctaatgattcaaatacacaaagagaacgcttctaagcattgaaagaccaaaccaattctccacaaaaagagtgttaccagtgattttaaatacacaaagatgatctctagaaacagaaactttaactgataaacgcattacgcatagctcatatagcaaattaaaggtccacgagaacaaacacatcaactcaacagagcaacgacacatacatcagttcaaagatgcatcaaaatgagaatcaaggagaaagaaagtgactttaagatgtagagaacctgaaggagacatgacgataagttgctccggtttaggaatcgaagcatcatgaactttcatcgttatgctaccgccagtgccagacacccaaccttgagtataaaagtgacggcagagttcagtaaccaacgaactcgtctccttcacctccttcccttccagatacgcctgtggcaacccgatcatcgccgctgcagccaccgccatagattctcagagatagagaaagaggtatagagattgaaagattagagctttgtaggggaatgaaacgcaggtttatctggcgagctttcctttggctgctttcagaatatgattcctttttacaatttcccttaatttttatttaatctaaaggtccaaagtttcgtaaagtttgcatttttaagtacagcatgtttcttgctttagagttagaacaaacataaaaaaaaaaaaaaactttcatagcaaatttcaatattttttttctataccacggcgcttcctccgccgtatcttcgccgtcatcgccgcaaatatagaaaagacgctcgatttggggatttctcaaattaaactccttgtcgtttttcttacaaagaaacgacacgtagtctaattagaaggtacatgtttggtaacaaagaataagtctaatccaaaaccgagataagaatagtgtaaaaaccactcttgaaacctcctcttcaaaaataccagagagcgagaaaagctcttatcttcttcatcttctccaatg

SEQ ID NO: 32633 - DNA, 3000 bp, Unknown; identical to SEQ ID NO: 883
  misc_feature (1)..( 3000): 2750-1469P.txt file - cDNA_ID_3059451; gDNA_ID_1620333; Annot_ID_153694

SEQ ID NO: 32634 - DNA, 3003 bp, Unknown
  misc_feature (1)..( 3003): 2750-1469P.txt file - cDNA_ID_3059469; gDNA_ID_1620334; Annot_ID_153732
ccgcaagttgagcatcggccgttttcggctgaggaagacgagacgatcgcacgtgctcacgctcagttcggtaataaatgggcgacgattgctcgtcttctcaacggtcgtacggacaacgccgtgaagaatcactggaactcgacgctcaagaggaaatgcggcggttacgaccatcggggttacgatggttcggaggatcatcggccggttaagagatcggtgagtgcgggatctccacctgttgttactgggctttacatgagcccaggaagcccaactggatctgatgtcagtgattcaagtactatcccgatattaccttccgttgagcttttcaagcctgtgcctagacctggtgctgttgtgctaccgcttcctatcgaaacgtcgtcttcttccgatgatccaccgacttcgttaagcttgtcacttcctggtgccgacgtaagcgaggagtcaaaccgtagccacgagtcaacgaatatcaacaacaccacttcgagccgccacaaccacaacaatacggtgtcgtttatgccgtttagtggtgggtttagaggtgcgattgaggaaatggggaagtcttttcccggtaacggaggcgagtttatggcggtggtgcaagagatgattaaggcggaagtgaggagttacatgacggagatgcaacggaacaatggtggcggattcgtcggaggattcattgataatggcatgattccgatgagtcaaattggagttgggagaatcgagtagacaaagtgagattattaggaaactgtttaaattggagaagaagaaaaatgctctgtttttttctcctttggattaggcttaagaattttgggttttaaggaaatgtatagaggaaatcgagtgaacaaagctcgagagctggggacgtagtgacgaagacgaagatcaaatttctcttaagctattcaggaaaataaaataaatttttatttataactacgcttaatgatgataatagatcaaattaatacacaaagtatcacaaagtgaaagataaatgatccagttaaagaacaagtttgtcgaggattggtaaagacttgcatttggcaactaaaggcacagatttgggcatggtaagaccctttccttccgacatgtcaacggcaacgtcattgtctctctcccaatcgaaacactggatcaatgagcctaaagctaagctcagtactagttgggccaggcccataccaggacatgctctcctaccgattccgaaaggcagaaacttaccacgatgggtctctgattcaaacctctctggtttgaaagtttctgggtcatcccatacatttgggtctctctgaatagcccacgcattgataaatagccaggtgcgacgtggaatgtcaaatccagcgacttcacagtcagtggatgaagcgtgtgggacaagtaagggcgccgccggaaacaaacgaagagtctcagagatcacattgttgagatagggacacttgccagtatctgattcctcaaacacacgcccttctttcgaaacctcgtttagttccgttttgagtttccttaaaacttccggatgatttagaaggttagccatagcccactccaacgtcactgcggttgtgtccgttccagcaagcaacatcacctgcaatgaatcctttgaatctttgatgaatcaatcttgatcactcctattaacgattcaaaattataggaattaaaaactcatgtacctgtacgagccctttgatgatatcatcagtgtaacattcaggttctgattcttgaagagacagcaaacgagtgatcatcgttttctcaagctctgcttttcctctgtttttccgatgctcgtcgactaatttctgcataaacttgtccaatttcgaagcgagtttctttgctctctttctgtatccatcaagatcaaagagcttcagagtcgggagaaaatctccgacataattaacaccagcgaaatcgaacacctccctaatcagcttccgaacttccttagtttcctcgtcttcctctcgttttccagcgaccatgctcattaggatgttatacgtaagcccataaagaaacggctggagtttcaatctgacactgcctcctgatgttaccagttccacgttgatcttccgaatcatagctctcacttcgtctctccgtatatccgaaaagtctctgagacgagcggtggacaagatatctacggcgcagaaacggcggagtctgcgccaatgctccccgtacggagctgtgctaaccagcgtgttgttgtaacccatgtattcagttaaagtagcgagaggcctgttggcgaaaacaacatcgttttgctgagataagaactcctccgcagctgaagctgacgttacaaccaccgctcgacgagagcctagccggagaataaacacgtcgatgccgaggtttcgagagaggtcacgaagggaacggtgaacaggttctttgagaaggtggaggtgtccgatcaccggaaaacctacaggatttggcggtaaattcttcttctgctttgatcggaaaacatacgccactgcaatgaatccggccatgagagcgagtagaaacaaatcaatcatctcacccattcgtgaacacataattctggagactagtcgcatgattctggagagtagtcaaaaaaataccagaggtctcactattataatatacgagggagcgaaaaaaagaaaagaaagtgtacatagttctggagagactagtcaaaaatatacgatgggttgggccgaaaaatatgaagttattggttattgataggcccattacgataatctagtgatttggttacccagtaaaggtttactttttgtcggagattgcaaatatcatgtgagaagagtttataatctcgagaaatctttttgggcgacgttgtttgctcggagctctttctccgatttgtctccattttcggtgatttaaagttaggatttggctgtggagatg

SEQ ID NO: 32635 - DNA, 3000 bp, Unknown; identical to SEQ ID NO: 889
  misc_feature (1)..( 3000): 2750-1469P.txt file - cDNA_ID_3059473; gDNA_ID_1620334; Annot_ID_153731

SEQ ID NO: 32636 - DNA, 3000 bp, Unknown
  misc_feature (1)..( 3000): 2750-1469P.txt file - cDNA_ID_3059477; gDNA_ID_1620334; Annot_ID_153728
taataattcaagtttttacgtaaccccaccaaacatttgaatttataccttttgagttatatatctacatttttgtcgatttgttgataatctattagacatcaggagtttaatactttgagtgaatttgataattaataatgccaagaggttattgtgatgggaacaataagctctagatgtaaccttgcgtagttattatattgggtttacgtgttcgtttgtgagactcaactatactactataaccttgctcgttgtttctattatcaatggtccgagtgtcggttttggtctccttgttttaaatattttattgaagtcgttttacaattaccaacttttccttaaaccaaaaaatagatcaataatggttttgattgatgatattgatggttgattgacggtgtcttactcactcgaagattagacaattaccaaaacgattttattcgtagtccaccaaaaaaacaaatcaactgtgatcatttttcatatctattataaatgactactatagtatgacattttgaaaacatttgtaacgaataatcatcacaacatatagtaaactgaaaatataacatgcaacaatctaaagaaaaaacctaaaatacacaacgtacagcctcaattattgaaaatattttgttttctggtatgataaattttgtgattgaaacgaccaccgagaagttcatatgaacatagaaaacattaaagaaaacaccgtccatatattattttatttaagacacaccgtccaagattacaactgtatatttttggaccaaaaaatcattgcccctcttgtggaaaagagatagtggtgcagaaaaaaaggcacgtggaacatgacctaattcggctaaatacagttttaaaattcaaaaacttacgataaccggacaaagatttaacagctgttttccagtatgtccacgtgtccatgaattatccttccacgtgtaagtttgagtgacgtgtcatgctaattattcttaacaaaggcaaaactactcttgtcttgttcctcctgtcgtgtaagctagcaactgtaattttgctattggtctactaacgtgtttagatattcttccacttgcattaccttttctttttattcgacattatagaatgtattaattgttaacggtttagggaaactacttaattatatggtttacaaacaaaaaaaaaacataatggtgtcaacaaaaaaaatcacaaaggcaataaattaaagaaaacaggtgcatgtggttcgtttacttagttgcatagaatagaaagatgctgctacaaaatatccttccgtgttctcgcttatccttaagccgtatgcacattttgtaccttcaccttccacacgtgtgcatgtatatatccacacgcactacaaatctgcattaatggtacggtcatcgttgaaacgactacgttcggtgaccttcgtgcttaagataaattttgttggtcttctgatgtatatgcttaagccacacacacctaacaccttcactaaagcttgattgaaaagcgattctttgttggacgacaaataaaaagttactcttttcttcttctttttgtatgtgtggaatcaaaacgtttaatttttgtacctaccaagtactatttcatcttatatgttagaacttaccgatttgttggattttttagaattctgatatcatatgatatttccaaaaaaacttatttaaagatttgctttatttcgtcttcaaatctgaaatttatcgtcaactttgtaaatcaaatgttaaaaaatttcaaatgtagaattgggatattaaaaacttgatcattttgataatatctatatactataactctataagataatgcatggaatcacgttttacgaccaagcatcataagagtcatgaacgggcaaaagcgagggcaatataaagctagaaacaaaaggacagattactacatgaaagtgtgtgaagctttttccccacattggccgccggctttttttgacttaattaatattaacaatactctctacactgttttttctgtcaataatagtagtatatgataaatattcttttcaaaacaatacttctcatgtggagaaaatatcgaccacatcatcaactttcatgaacaatgatcaatggatcgaccatcacacttgctaaataagaaaggcataagaagattatgttgcaaattattaattgaaactcttggatcgataaatattccatcggatttgaacatgaagataatgtgtgaacgattacattttaggttttcacctttttagagtgcagtaaatgtgtgattaaatagaaatttgcttcactaaaaccaaaaaagtaagtacaattctataaacagttcattattttatatatatttttatagaattgcagaaactttccgtatagtaaacaagttcaatgaacacaaagaatgaaagaagcttctgtttaagtagaggaataaaatgattataaacagagcgaaattatatgtaatattataagaaaaagtttcggcgggtctatctaactgaaagttaacaacatcacagtacctactaaaaatatattgaataataatcattaggagtgtatgtgtggttgatgaaaggccgaagtagagccgccctataaatgggcttttgtcgtcaaagtggtggagcccaattttggaatggcctatctgattgttagttggtcatttgtccttttcccccataatttatttcaacaagtccttttcaacttcttaaaacatctagaatcagaaaactattcattgaaattcatacagagaatatcagttatcacttatcagctactaaatatcataggaaacacagtaacacacaatagcgtagagattatacaataaatgggcttcaaaagatcagcccaaaaagaaactaagcccaataaataatttctaactaacgtgtggactcggtgagtcatcatctatctcatctcggtgatg

SEQ ID NO: 32637 - DNA, 3003 bp, Unknown
  misc_feature (1)..( 3003): 2750-1469P.txt file - cDNA_ID_3059492; gDNA_ID_1620335; Annot_ID_153764
cacacaattttttgttggataagattctagtaatgtgtcaatatttcaaaggaaaactataatgccgacagacacataacttgatccacaaacttccattggactaatctactactcgatttatcattcagttaaaagcaattctatacaatgaaagttactgcaagtttgacctctcaagatttaggctaacctgacaaaacagagcaaaatcttacaagatttaggtttaaataagacgtgtaggaaccaagaaactaagaactacatgagatttaagatggttcttatttcttcatcttccatacataacttaaatgtgaattctacaaatgattttcttcatctcttttctttacatttgattccattttatgtttgcaaataatgagcaatcacaacaactgtaaaaaacatcaattcaagatactccttttcagcttcggtcagctatttggttgttcgttattggtgtccattgctgacttatccatctcatcatcagaatcaatgacattttcaaagtcataatatggatgcgcctgcacatttaaaaaccgatgtcgctatgtatgtgtatcaaagaagtaaaacaactcgttggttcattatcagcatcgtaagttagttacctttggtcgcggtttaacagcttcgaaactatgaaattgaggatccgagaaatcaggcgcctgcaaaataatatatgctcctttgtttttgtacctctcttctgttgcctacaccacacacaaaaatgattgttaacgcatatctttagaaaatgcaaataccaaaggcgtaaaaatacatacttggaattgcggatagtcaggtgcactgaaaatagtgataagctttccggattcgacattgtggtctattgtatatccattgtccattccaccaagaccagttctcttctctctagcatctggaccttcatgtgatctgatgatcaactgcaccaataagtgtaaaacatttgatccaatcatccatatcagtatttgggaagcaaacaagcatcaatatctactttggtgtcaccttcagttcatatttcttcaaaaaatcctctgtacaatcgggaccccaaagaagaccaatgcctctctgttcatttggtgaaaggcccggagtcattgaaggatcagaccataaaacgtctcctggtatcaagtttgaaccttcccaaggaggatcaagaactgatcttcgagcttgcatcaactcatctaaggtaccgagtttcattgagctcggctcaggttccagaagaactacccgacggttctttttcccccttgttgttcgcttaggcaagactgggctgcggaaaagccctccatgtgctgtataaacacgtccagaaattatggaagccaaaggaagaccttcaaagcaacccaaacatttccggtacacatgttttcccttgtctccgtattttgtaagcacttccttctcgaaaccatacatagatgtacaatactttgactcatgattaccacggagtaggtagactctgtccggcatcaaaacctaaacaaccaaaaagatatgtgctttaagaatactaagacttgagccaatagtaaaacagcttagtaaagagtttaccttccaggacaagagaacaaggaaggtttcaagtccccaagcaccgcgatccacatagtctccgttgaaaacataacaccggttttgacaaggaaagccagtatctttcaataggaaaagaaggtcatgaagctgaccatgaatgtcaccaaccacaacaacgttggatacagagtcaagatcatcgatatgaacgcagttacgttctttgtggaggattttatgagcggtgaggacgagggaatcaaagacgttgacaggcaatagtgaaggtaactgggaaggaggtagattccatgaagaccattcgaaacacgacataagcccatgtacccagtcgttagtgagagctcccccatctggccatgtaatgggagatggtggaacagtttccattaaaactgtaaaaacactaatctataatcaattccagagtatgaacatgtgaaacaagagtatcaagcaatcgaaacatagacaaagttttcaaatttcagcgatcaaagccaccagaacataaaatcgaatctgtatatattcattcgtacatctttaaactcaagagaagagcaaaaagtacaaaatcgaatcatgggaaatcgaaatccatatcacaaagaataattcggaacagagtgagactcaccggctaagagtggagacaatttacaaaattccaaagcttggatcttggacctagctaagctagcttactttgctttctctctgctttcagtcccgacaccgtcgtcgacgagatttaggatctgtctggctttggatccatttactcaaacgacgtcggttaaccagctaaaaggattcaaatcaaattcatgattccaaaccggccggtttaataaacgaacaaaccttttttgtcgtgacgctgcaatagcgttttgcaatcacgcgctatcgaaaacgcgagttcgagattttgttaaaggtggccaaccggtttgttctggttttgatataaacttgaacaaaattgggagaccgaattatacattggtctattcggttacttatcgatttcagcttgattttgtttacggtactatccaaggaatttttgtttggtttcgatttttttatttttcagtgtggatgaaatcaaaccgactaaaatcggttcgatatcgatttttacattttttcggtccggttcatgcttttcctctattttgagatatttgtactgaaaagcagaaagagagaagaaacacaaaaattggactttggtttgaaattggcgacatttttgggaaatctagagactaataatcaatttcgtcaaaagatcaaatcttgctaaattttcttctgctcgtttgattttccgaatcgttggtttcgataagtgaagaaaagatg

SEQ ID NO: 32638 - DNA, 3003 bp, Unknown
  misc_feature (1)..( 3003): 2750-1469P.txt file - cDNA_ID_3059492; gDNA_ID_1620851; Annot_ID_170330
cacacaattttttcttggataagattctagtaatgtgtcaatatttcaaaggaaaactataatgccgacagacacataacttgatccacaaacttccattggactaatctactactcgatttatcattcagttaaaagcaattctatacaatgaaagttactgcaagtttgacctctcaagatttaggctaacctgacaaaacagagcaaaatcttacaagatttaggtttaaataagatgtgtaggaaccaagaaactaagaactacatgagatttaagatggttcttatttcttcatcttccatacataacttaaatgtgaattctacaaatgattttcttcatctcttttctttacatttgattccattttatgtttgcaaataatgagcaatcacaacaactgtaaaaaacatcaattcaagatactccttttcagcttcggtcagctatttggttgttcgttattggtgtccattgctgacttatccatctcatcatcagaatcaatgacattttcaaagtcataatatggatgcgcctgcacatttaaaaaccgatgtcgctatgtatgtgtatcaaagaagtaaaacaactcgttggttcattatcagcatcgtaagttagttacctttggtcgcggtttaacagcttcgaaactatgaaattgaggatccgagaaatcaggcgcctgcaaaataatatatgctcctttgtttttgtacctctcttctgttgcctacaccacacacaaaaatgattgttaacgcatatctttagaaaatgcaaataccaaaggcgtaaaaatacatacttggaattgcggatagtcaggtgcactgaaaatagtgataagctttccggattcgacattgtggtctattgtatatccattgtccattccaccaagaccagttctcttctctctagcatctggaccttcatgtgatctgatgatcaactgcaccaataagtgtaaaacatttgatccaatcatccatatcagtatttgggaagcaaacaagcatcaatatctactttggtgtcaccttcagttcatatttcttcaaaaaatcctctgtacaatcgggaccccaaagaagaccaatgcctctctgttcatttggtgaaaggcccggagtcattgaaggatcagaccataaaacgtctcctggtatcaagtttgaaccttcccaaggaggatcaagaactgatcttcgagcttgcatcaactcatctaaggtaccgagtttcattgagctcggctcaggttccagaagaactacccgacggttctttttcccccttgttgttcgcttaggcaagactgggctgcggaaaagccctccatgtgctgtataaacacgtccagaaattatggaagccaaaggaagaccttcaaagcaacccaaacatttccggtacacatgttttcccttgtctccgtattttgtaagcacttccttctcgaaaccatacatagatgtacaatactttgactcatgattaccacggagtaggtagactctgtccggcatcaaaacctaaacaaccaaaaagatatgtgctttaagaatactaagacttgagccaatagtaaaacagcttagtaaagagtttaccttccaggacaagagaacaaggaaggtttcaagtccccaagcaccgcgatccacatagtctccgttgaaaacataacaccggttttgacaaggaaagccagtatctttcaataggaaaagaaggtcatgaagctgaccatgaatgtcaccaaccacaacaacgttggatacagagtcaagatcatcgatgtgaacgcagttacgttctttgtggaggattttatgagcggtgaggacgagggaatcaaagacgttgacaggcaatagtgaaggtaactgggaaggaggtagattccatgaagaccattcgaaacacgacataagcccatgtacccagtcgttagtgagagctcccccatctggccatgtaatgggagatggtggaacagtttccattaaaactgtaaaaacactaatctataatcaattccagagtatgaacatgtgaaacaagagtatcaagcaatcgaaacatagacaaagttttcaaatttcagcgatcaaagccaccagaacataaaatcgaatctgtatatattcattcgtacatctttaaactcaagagaagagcaaaaagtacaaaatcgaatcatgggaaatcgaaatccatatcacaaagaataattcggaacagagtgagactcaccggctaagagtggagacaatttacaaaattccaaagcttggatcttggacctagctaagctagcttactttgctttctctctgctttcagtcccgacaccgtcgtcgacgagatttaggatctgtctggctttggatccatttactcaaacgacgtcggttaaccagctaaaaggattcaaatcaaattcatgattccaaaccggccggtttaataaacgaacaaaccttttttgtcgtgacgctgcaatagcgttttgcaatcacgcgctatcgaaaacgcgagttcgagattttgttaaaggtggccaaccggtttgttctggttttgatataaacttgaacaaaattgggagaccgaattatacattggtctattcggttacttatcgatttcagcttgattttgtttacggtactatccaaggaatttttgtttggtttcgatttttttatttttcagtgtggatgaaatcaaaccgactaaaatcggttcgatatcgatttttacattttttcggtccggttcatgcttttcctctattttgagatatttgtactgaaaagcagaaagagagaagaaacacaaaaattggactttggtttgaaattggcgacatttttgggaaatctagagactaataatcaatttcgtcaaaagatcaaatcttgctaaattttcttctgctcgtttgattttccgaatcgttggtttcgataagtgaagaaaagatg

SEQ ID NO: 32639 - DNA, 3000 bp, Unknown; identical to SEQ ID NO: 907
  misc_feature (1)..( 3000): 2750-1469P.txt file - cDNA_ID_3059506; gDNA_ID_1620336; Annot_ID_153800

SEQ ID NO: 32640 - DNA, 3003 bp, Unknown
  misc_feature (1)..( 3003): 2750-1469P.txt file - cDNA_ID_3059514; gDNA_ID_1620336; Annot_ID_153797
agctttgtggaaacatgttattcatgatccgcttgctcatttgtttgctggagagacacatttgagaaacctacacacaaagattcagactgaccgtctcaacaatgctcgagaggtttctggtgtgatcctagccgttcgaactctctggtttgacacaaggattcaagctgctctggagtctttccacggcgatgcagcacaggttgttctacttggtgcaggtttgttttcccctgtttagacattttaacttatgtgtgtatatatatatgtggagcatgagtttaagataagtagccaacatagaatgatgtaattgaatttcaggaatggatgcaagatcatacagactaaactgcttgaacaaaagtgacgtattcgaagtggattttcaagatgttttggaaaccaaagcgagcctagttcaagctgcagtaaactctagagatgagcttaggatgacagcgaaatcactagtcagagtagcaattgatatcagagacaacgattggtttgaacagcttaaaaaatcaggttttttgccagagattaacacggtatgggttctcgaaggtattctctattacctgtctcacacagaggcaatgcaagtactaaacctcatagctgagaagtgtggactaaccagcacagttctcttggcggatttcatgaacaaaccatcagctacacttccaaactctgtgttccacttttacagtgactggcctgatcagctcttaccaactttgggattctctcatgtcaagctttcacaaataggtgatccagatgcgaatttcggtctgctccacgatccacggaatctcttcaacaaacttctccgcctgccaaggactgcacaaatccatccagatgatggaaaaccatgctgccgtttgtatttggtcgaagcttccggttcaccgcctcaagataaccaagcgagcttgtaagctccttccggacgtgcatttggcactgcacgcttttgcagaacagatatatatgtgagtctttcacactagagaaattgtgtaggaggttaatgtaatttgatgtataaacgattgatatgaacaattcattatattctaaactctaaagttctatatttctatctgcttgaaaattacaacgaagaaagaacgcttgtcatgcctttcgataactagcatgatcgtccttccttactgtaactcaaacgatgaatgaagctcagcatcaagcataagagtatattcatatagaacgagatatcgtctctcacttagacagttgtaaaaaaagttggtacacctattcagccataatgatttcacaagaagaaaaggaagagagaactagacttcatctcaaatctcaagacagtctttgacacccttctcaaatttgtcaagataagagatagtctctgtaaccccatctgcaactttttttctgcaaaacaagttaaaacattgtactgctttagtgacatgagagataccaaatcatcatacaaatatagtttcgagtaacagagaacacatagaagaaacggatccctttaatcatttcaatcactaacctatcagaaggaagattcatatcaaccccattcgtcaacacgataagggaaccgaaagacctgcgatataaagtaagtgcaaaatcaacaaacaagaaccataaatcacagcatttgcatcacatttctataattcaacaaccaatttcattacacatttcaatagagagtcacactagcacatacctaacaagatcatcaagtatattctctgcttctaatttaactggatccttatcatcaagtaatgaagcagcattcttcacaacaagcttaaatgtacaaacctaatcaacaacatcatcatcatcatcataaaaatcaaaactttaatgtcattcataactaaaacccaaaactttaagatcaatttaagattctagaaacctcaactccggatttagattgaaaatcaacaagagagcttctttctttaggaacacaatctcttgcagaagacttaaacagattctgcagattctccaaatctttctctgtataatcagattcactagttaacgaaagataagcagattgaagagcttgacgagttgcatcaatgggagcaagtaagaatcttgaagacttcttcttctgatctttaagccactctttaggtcctgctgtgtgagaaaattagtttttttttcaaaattcacaaatttggagataagatcaataaaatgaagagtgagtgagaagtgtgttgtgtacagattcctaaggagaaggcgaaagcgggattggtgggggagagagtgaggagaagagaagtggcggaggagagaagaacggtggcgtctcggcgagagataatctgtggcaggtggtcggagatttgtgcggcggcgattggtggtggtggtggaggtttagtgtttgaagagaagaaaggttgagaaattgggataagacgagccatggcttaacattaacgagctaagttatgtgtacccgctcatgtggtatttaccaatggtttcctttttgaacagatttttgtcttgtttttaaacacaaaacgacgtcggtttgtgaacataataaaaatgtaaatgttgacttatctttgctaaattggtccgtcagctaaggatgtaccttatttagcaaaattaacgaaaattaacgatttaattgaaaatcaactaaagtttaaaattaaagtcatcctactcaaaattggtgctttgtttcaccacttttgataaactggtgatggtttttatgacattttttccagtaataaaaggggtagttatgcaatttagtagaagttaaagggtttctaaacaaacttaaaaaccaaatttttctttattgctttgctcgagagtgcctgcaactgcaacagttgagattttgagcgtgtcaaggattctgattgataacgatattcaagttcagcaatctcattgcagtagaaaatg

SEQ ID NO: 32641 - DNA, 3003 bp, Unknown
  misc_feature (1)..( 3003): 2750-1469P.txt file - cDNA_ID_3059522; gDNA_ID_1620336; Annot_ID_153795
tctcattacatgactatataagaacctagttacatgaaacatttcatgggcttttttagacttatcatgagattcgattttgggtttcatatggatccactaataggatatatatatatatatatatatatatatatatatatatatatatatataaatcctcaattttaactatcgggtaatctttacgcaaatatttctatttactcaatagttataacctctacgatgagattaggtggcttaagacatgtttcacgaagtgtcacctaaactaacacttagctaatccacaaaggacaaatacattaagatctatctcattcaaattctcatttttgacttgcctctgctctctataacttttaatccctccaaactcaaaccaaatcaagtctagaatcgtgggggccaatctcataggctaggtactgtttacaatcttctagagagatatttcggatttcgacagagaataattgattaaaaaaaatatttgttttaatgttaagcttaatggtgaatgtgtggtactttagtttgtgcattaatggtatttgtaacgtctgtatcccggaaaattagaagatttgagtttatgtcggaaattggaggggaatctgtttaattccagttggtttagtaagcttattattaaaccaaagaggaaattgtttaattttggtaatcctaattcctgtttaatttaagttgactgaaaagaaacttaagcctatttataccctataaatcaaagaagccctagtgatttctcataatggccaccttcaaggagagaaagagagaggctgatttttggttaaaagaaggaaaatagcttcctcaaaaagggatttctagacagattagacacgccattctagagcagatgtttggtctatataatcgccttgtttggtaagaaaatttattgacttgtagcttagactcatacctatatattgatatgagtcaatattctaagagttatctgtggtttagtgagctattctgttttactcgtgatgtggaccagcgtgtatttaaaggaagaacgcgagtgaacttacggttggatcgtcatgaaactttggggacaacttcaggaaatctaggaaaacaatttcaacggtgcgatttgaaagtggacttttaaatctcgttgcgtgatctcatctttcaggctgaggattctgttagttttctagaatattctagtttatgttaaatgttgtttttgtggttggctatatggtgagttgatctactgttggtgagtgggaagttactgctgattgtggaattgttgtttttggtacaaaaaacatcctcatttcaaggtgtgtgcgcgatcatgtgtgacttatttgttgttaagattgtgtgacttgtttgttgttatatataggctggattttttatggatccataatggatccctgcgattgttttgtcaatagatgttttggtttgtttaatgatttatgtgtttattgtgatcttggttttgcttgtgtgtatagatcgtagatgagagaatcgtctcaataagtatttatgcatctctttttttatggtgcatgtaaagataaagtgtgaatcacaaacaaataaagagatgcataaatttgatcaaaaatacttaggcgatcatcccatctacgtgttatacacacaaacaaaccaatattacaatcaacacaaaaatcatgaaacaaaccaaactaatgaacaattatctattgacacaaccatctcagggattcaattttggatgcatcaaaaatccatcctacacatcaaaacaaacaagtcaaacaatcttaacagtttagataatcttatggtcacacacaccttgaaccaaatatgatttttgaacaaaaacagcaatcccacaactagcagtgactttccacttgcctaggtggactggtttgttttataattatccaatttaagatgtacttttctcaattcttatacaaaaatattttgtttgaccacaaacatgcgtattgcttgggtttattttcctaaagaacttgataaattgaacatcatgatgttgaatcctgaaatgaaatagcaaacaaatttaaaacttctcaccaatgtcttaagacaaaataatcgtacgattgataatgaaacgttttaaaagaactaaacttgtggactgaaagtagaattggttgtttttcagttaatcttagtgtcatcatgaccgtgagacatatttgttattaataaacaataattgtggtagcagaaaatttgaccaaaattttggttgcaacttgcaaccatcgttactagtctaatgcttactggcaaaaaaattcatagtaaagaaatgtaaactagtttttttcaggtgattgtcaaaaaaaaataaaaaaaaaaaggtttttcaggcagaaaattaaagcatgtgaataagtttattgtcggaattatgaactataaacctatctacttcattcttgaaaatttaattgtattttaattaacttttgtcatacattaatattttgtaacgtataaatatttaaaaaaatggtttctttttccaaaaatttaaacaaattgatatcatttttttgtgtgaatgaaataaaaagcaaacaacaataaaacttctcaccaatttcctactttggacaaaataatcgtacgagtgataaagaaacgttttaaaagaactagaaaaactagtggacactcgagctctagatttagttggtcaaaatcattaagtaattggaatagtggaaggggttaaaagaagcaactagagagtggagccactcgttgctctcttaagaggaaagaaaaaagccagtggttacgcaatgaagaacgtatgcttttgcttctaagcctttggttttttatgtgtggttctcttttcttatctctatgaaccaacaccaaacattttccaacattccttcattatatatcagaacaaaacattattcgttcatgagagaaacaatg

SEQ ID NO: 32642 - DNA, 3003 bp, Unknown
  misc_feature (1)..( 3003): 2750-1469P.txt file - cDNA_ID_3059527; gDNA_ID_1620336; Annot_ID_153785
caaaccaatagcaaattaaagtaacactctttttccacataagccaattcgtacataatcatctcaaaattcagatcctttttgtacaacttcacaaattaatcaagcttacgttgtctaacaccaccaataactttggtagtaggatccaatcgattcaaatttccttcatttttcttactaggactctctttcccattcaaatctggtttcttcaagtcactagatttgaatccgatcctcgttgattcaaatacaagcaacccaacagcgagaagaaaaactaagacgacccagtatctcacaaaaagccttagaacatgacgaggaagctcgtagctggttctgtgactcactttcttccgctttcgtcgggtacgagctcggatccgattcaaatcgttagattcgtcgtcagatactgagatcgagacactgttgttgttgaacattgttgtggtttcgaattgtttaggatgatctttggaattggtttctcgaaaacgaaagagttgagcttgtcgtagtagagagagatcttcttcccttagaatcgaatcatcggtgtttatcaaattgaacgaacccgattaaaccggtttatgtctcaataggatgttttagagattttattttgtttcattatatatgatgttatacaactttctatgcaatttataaatgatttggtatcttatgacttatgagttatgattatttctatcatgcaatcttgcatatcattagttgagtttgctaaatcaagtattaaaagatatttttaacgaaataaataattgtcttaaattgttagcttttaagtaaaacatcatataatttaaaatagaggtactaaaagttaactgttataactattttaagtttgttaaactttataaacgtcttaaatatttataatattaaaacctgaatgacattcaaataatataaatagtttaactttataagaatttataagaagtttaaacattataaatatttaaaatatttaaagtattcataatatttacattctataaaaagtttataataataatatttaaactctataacaattaaaaataaattttatgaaacttttttggttcctttgtgaaaaatgcaaccggtcaaaacagaaaagatacgactgtagttgaacaaatataactgtccaaaaaacccgtaaataacgaaaatatacgacaaaaaaacactaccgtaaaacaatgaccgtaaataattgagcgaaagttgcgataaaaaacgtaaccgttgagaagttcaaaagatacttgagattgttttgttattagattccaaaaaattttagttagactaagaattagagaaatttctttcatattaaaatgatgtatatttaaaataacttcgaaagtaaagaatttagatccattttacaaaaaaaaaaatttggattcatcataaataatcggtgtgaaggaacaaaaatatgagaactatttaggaagaaggacaaatatatagagttcaaaactcacgaacatttaaataaactactttattcatacgaaaagttgtgaaaaaagcagaaaatatataataaagagacgttactttaaatgaatagatgcaactataaagaaacaaccgcaaactaaaaaaattataattgtagttgaacaaatataactcaatgataaaaagataaaccgtaaactgaaaagatatgactgtatttaaattaatataactgtcagaaaaaaataatcgtatataatttaatgtaaagatgcgataaaaatatacaactctaaatacttgaaagaaatattgtgataaaaaaaggcagctattcagaatttgagatgcaaaatgatacgaacttagttgaacaaaataactgttcaaaacataacaataaatattataaaaagatacaaccacaaaaatataactgaaaatattttaataaaaactaccaaaaaaaaagcgaaagacatttattcagattatttttattattaaattataacaataagtttacttattctcaaactcttatctataatactgatgcaacctggaaggatgatcatcgtgcaggttttggatagatcctcaaaaaccaacatggatcaagattttatggtggaaccggctatgcggagtatgtcaattctcctctacaagcggaagccttggcgcttctctttgccataaaacaagttcgccaactcggtttcaaccatcttacctttgctactaactcttcacaactcgtcaaaaccatcaattcggagactcaattcaaggagctccatggaattcactttgatatctttgatctatcctcttcttttaccgtttttagatgtgtttttattcctcgtttgcaaaacaatttagtagattcccatgccaagaaggtcttatcatcttctgtaatgggcctagcccaatcttagagcagaaacgaattttttttttttttttttttttttttgtctaaatgcagaaatgaaatctatgttgcaaaaacaaaagtttccttatccccaaatcgagctgaaatcttcaagagtgtgtcttcatttatctactgttcatcattctcgtttaggacaagcaacgaatgttaaaacgggtagcctgattaattagttttgtttcactaaacgaaaactacgtcgtttcagcttagggtttatcaattaccagaatctaccaaattcacaacacgagagactctctcgatgtcgagaccctaaatccaatcttcatctcgaccacacgacgaacctttggaagagttcttcgagttctccacaaactaatttgagctgatttgatatatttcttcgagttctcgatatgctgatttgaggtcattctcgacaagtttctgggtttagactagtgtaatcgatgagatattgacattatatgaagctgagattacaattctgttttgctttgaaccgaatacatgctgcagttcacagttttgacaaaaaaatg

SEQ ID NO: 32643 - DNA, 3003 bp, Unknown
  misc_feature (1)..( 3003): 2750-1469P.txt file - cDNA_ID_3059576; gDNA_ID_1620337; Annot_ID_153828
tgcacttatttgtacttctctctgtgaaacatcccaacaaaactacttaatatcttacatgtaagtgtataacttgactatagataactcacctgggaggtctcttttgtggttctgctcatagctttagcgtatctttcttggaacttcttgacatcaacaaatacattggagacacgctcaccaaccgtgtttccaaccccgatcctcacgttgcctcgtggttgctttgacataaggaactccaatggagcaaggtcagatctctccaccattctgcacatctcataaagtatcatacttttatgtatttctctagttgtcttgtctctattgacttcacatatagagagggaaatgaaacaaaaccattactacatctactagttaagtgcttacgaaatgcagtctacagggcaagcttcgatggcttctttgattttggattcaggatcagcccattgagcaacaaccctcgctctcccgtaagcagtttcaatagcaaatgttttctctgcacacaaagcacacttcaaacacccaacacacttaacctcgtccacaaacgcagctcgttgctctgtttctggtccacaccaaaccgagtatatcggtttccctgtatagcctctgagttcttctagttttgcttgctcctacaacaagaaagtttcattcatatttacttagtgtgaccttgacagagactacaagatcaaagaagcaatataagaattataaccttgtcataggcttggcgcgagatcggatcagagagaagctggtaagcctcgttaagaatgatggccatatcatgaccgggatctcctgcgatatctggatgacatcgtttctgcaacgcacgataggctgatttgatctgagacttatcagaacttcgatcaatacccaagaggtcataaagatcaaagtcagtgatagacgatgatgatgaagttgctctacacttgaacttgagtggtgatctaacggtgatgagcttctgagatgttgaacatggccatgtagcagttgatggaggaagagtcgtcggagaaaaaatagccggtgtcatattttccccttctctgttttggaaggtggatgagtttagagagggacaagttgttgaaaatatctctatatgaagctatttttccatctctcttggaaagatattttatttgggacgaataaaagttccaaattgagttatagctaaaatgaataatattttataaaaaataaaatttttgaaagcagacaataaagttgattggtggcaattaaaagagttgtactattatgatattatccttctatacgaatgaaagtttaaggctgaggatcatagcgtaaaaaatatcataatgaattatcgaaatgttgttttaataagaaaaaccaaaaaataaagtcttacatatttaggttacctaatttttggcttttggtttggactttaaaagatccagtctacacttgttgtatctttcttacaatcttttctttcattttcaggtaaaccaaaaaaattataaagaatcttcccaccctaatcagaaaaataaattataatatcaattttcaagaaatcaaacttgtaaaatttttctacttaggagagtataattttgagaaatttgagtttttaatctacaaaaaaattataattaagtaactaaccatcccacaaaaagatactgatattatttgtattttctgtaataatgacaatgctaccctttgcctgagatacaggctctttttcttcttcttcttctctctttccaaaaaacactttctcatcagctgttaacattccaacagctttttgggtcccaaaaattactatctcctttttgtaaagcttcggattctgaaaacgttcaatggagatgtattggcgacggaatcaatacatttaatttttggaattgacgtctagggtttgtgattaaattgaattgggggttttgatttacaaaggtaaaattttggatttttttggagttacatcaatttctagttaagtgtggcgagttcgtgtctccttgtgccctcgattgtggaacccaaatggtgtacccggtgttctctactaccacttctttcctctaccaagagactatcttgtgctgtgctactcgttatgttggtagtgatgacaaacatatattattctatttttctatggttaaagaatattaaattttagattgaaatctttgggttcccaatatattatccacttagggtttagtatccttccaacaaaaacatttaattgattataatgctatattaacgtaacataaactactatctcatcaccactaccaacactattactttatatttaaaacattttgctctatactaaaattaaaattgatttacaaatcagttatgaaaatagtatagaacaatattttatttctatacatcttaaatagtacaatatattttttacttacaaacactatttctatttttaaaattcaaatccgattttaaaaattcaaactattctgtatgtagaaaaaaacatatatttttctctactaaatttcagaattgaaatctattttttggaaaagatatatagcaaacatatataaatggataaaaactaaaataaaggttagtaaatcatctcacctatgagtcaacattaaaattgtcttttccctacccttacatgttactttcttaatttctatatatatgatgctatattcttaattacattatcaaaagtagctagttttgcaattcaccctataattttgtgtgcacaagaaaaaaaaaaaaaaagagtataattttgtttggactcaaatcaatgggccttaatatggatccattaaattaagcccaaaagctttcgttaattcttcaacgaagatcgctgaaaatttcctttcccatttcgctgaatagggttcagtacaaaattcggaatcgtaggtttaagaattttagatcattgaaacagccatg

SEQ ID NO: 32644 - DNA, 3000 bp, Unknown
  misc_feature (1)..( 3000): 2750-1469P.txt file - cDNA_ID_3059583; gDNA_ID_1620337; Annot_ID_153826
gagtagaggttcttaagtaagacaactactcatgctaaaggctatggagtcaataagttgagaaagacagagacaaacatgaaggcaacacaaagaaccttacagcttcatatgtcaatgttccagatcgagaaacaatccctatcttccccggcttgtgtatgtatcctggcatgatcccaatcttgcattcaccaggtttgataataccaggacaattagggccaatcagcctagtttttgattgactgttaagagcagcctttacacgaacctacattacaaaagccagagaaatcagtagagccaccttatattactgtgcaaacctatcatataaagaagatatcacaaaaaaaaaaaaaaaggaaactggtaacaacgactattaccatgtcatgttgaggaattccttcagtgatacaaacaataagatctaactcagcagctaaaccttccatgatagcagcagcagcgaaaggcgcaggtacgtagatcacagaggcattggctttagtctcagccttagcttcagcaacagtgttgaaaacaggtagccccaaatgttctgttccacccttctttggtgtcactcctgctacctattaaccaaacaaccacaaacctaaaataagatcatcacaagctttaaagcaaacacaaaacaaacaccatttcatcaacataaacgaaccaattccaagtgaacttgagagatgaaatagtaaagaatcggctcttatgatcgtacttaagaactccatacatagaatctgaattgctcaaaaacaccaagaagtacatttgaatctatgtgaattctcgaatacaataccattttggtgccgtattcaatggcttgttcagtgtggaaggtcccgttctttccggtaataccttggcagatgacacgtgtatttttgtcgacaaagaccgccgcaggaggcggaggagttgtcccgaaggagcgagactgtaccaatgaagtgagagagcagacctttgagctgccgctgcagccgccgccggaatggcgaagagatccgagaagtctcgtgacctgcctagacatggctgtttcaatgatctaaaattcttaaacctacgattccgaattttgtactgaaccctattcagcgaaatgggaaaggaaattttcagcgatcttcgttgaagaattaacgaaagcttttgggcttaatttaatggatccatattaaggcccattgatttgagtccaaacaaaattatactctttttttttttttttcttgtgcacacaaaattatagggtgaattgcaaaactagctacttttgataatgtaattaagaatatagcatcatatatatagaaattaagaaagtaacatgtaagggtagggaaaagacaattttaatgttgactcataggtgagatgatttactaacctttattttagtttttatccatttatatatgtttgctatatatcttttccaaaaaatagatttcaattctgaaatttagtagagaaaaatatatgtttttttctacatacagaatagtttgaatttttaaaatcggatttgaattttaaaaatagaaatagtgtttgtaagtaaaaaatatattgtactatttaagatgtatagaaataaaatattgttctatactattttcataactgatttgtaaatcaattttaattttagtatagagcaaaatgttttaaatataaagtaatagtgttggtagtggtgatgagatagtagtttatgttacgttaatatagcattataatcaattaaatgtttttgttggaaggatactaaaccctaagtggataatatattgggaacccaaagatttcaatctaaaatttaatattctttaaccatagaaaaatagaataatatatgtttgtcatcactaccaacataacgagtagcacagcacaagatagtctcttggtagaggaaagaagtggtagtagagaacaccgggtacaccatttgggttccacaatcgagggcacaaggagacacgaactcgccacacttaactagaaattgatgtaactccaaaaaaatccaaaattttacctttgtaaatcaaaacccccaattcaatttaatcacaaaccctagacgtcaattccaaaaattaaatgtattgattccgtcgccaatacatctccattgaacgttttcagaatccgaagctttacaaaaaggagatagtaatttttgggacccaaaaagctgttggaatgttaacagctgatgagaaagtgttttttggaaagagagaagaagaagaagaaaaagagcctgtatctcaggcaaagggtagcattgtcattattacagaaaatacaaataatatcagtatctttttgtgggatggttagttacttaattataatttttttgtagattaaaaactcaaatttctcaaaattatactctcctaagtagaaaaattttacaagtttgatttcttgaaaattgatattataatttatttttctgattagggtgggaagattctttataatttttttggtttacctgaaaatgaaagaaaagattgtaagaaagatacaacaagtgtagactggatcttttaaagtccaaaccaaaagccaaaaattaggtaacctaaatatgtaagactttattttttggtttttcttattaaaacaacatttcgataattcattatgatattttttacgctatgatcctcagccttaaactttcattcgtatagaaggataatatcataatagtacaactcttttaattgccaccaatcaactttattgtctgctttcaaaaattttattttttataaaatattattcattttagctataactcaatttggaacttttattcgtcccaaataaaatatctttccaagagagatggaaaaatagcttcatatagagatattttcaacaacttgtccctctctaaactcatccaccttccaaaacagagaaggggaaaatatg

SEQ ID NO: 32645 - DNA, 3003 bp, Unknown
  misc_feature (1)..( 3003): 2750-1469P.txt file - cDNA_ID_3059587; gDNA_ID_1620337; Annot_ID_153821
tctgagcagcagaagcaagttcaagagaacattcactaccaagttgaaaaattctgctctttgatggatggaatccttcttcctgatgttaggaggaacgagtcggggtcacaatcaacaagccctcgtcctcctcgtagaagtggtcttactttcgccattggtagtaataatgcttttccacatgcagatcagccccgtaagtgttttactttacttgaatcgatttgtgaacttattactcagtatttttctttcagcttaattagtattctcactgattcttcttcagcacagttgttcccgagacaaagcctttgaaactcaatgacgtctcacagagattaatggatcaaatgggttacaccctcgagaccaaaccgtctgtaatacctcacaaagacgctggtcaaggttgttttatcaaaggcgaggcagatgttggaaccgtcttagccttttaccctggagttatttactctcctgctttctacaagtacatacccgggtacccgaaggttgattcacagaactcatatctcatcaccaggtatgatgggactgtaataaatgctcaaccttggggtcttgggggagaatcaagggaagcatggaacgggtcctacacacctgcggtcaaagcaaacaccaaaaccgcagaaaacgggtcagacaggttatggaaagcgttgagcaagcctctcgaaggttcgggtaaaggaaaagaggttcttgagaggagaaatccgttggcttttggtcacttagctaaccacccagcgaaagagatgactccaaacgttatgatatgtccttatgacttccctttgatggcgaaagatctgcggccttacattccgaatatatcttttggggattctggagaaataaagatgaaaagatttggaagtttctggtttaagacagggagtaaaaacgggttagaagctccggttctgaagacactggtcttggtggcaacgaggtcgttgtgtaatgaggaacttttgctgaattacaggctgagcaactctaagagacgaccagattggtatactccggttaacgaggaggaagataggagaagatggagctaaatttctcttttatgttttaatgaaacttgaaaggctctgtttcaaaacatgctcctcggttttctttagactattagcgggacgtcgtttcgctgattgtgtcactatttttgtttttcgattatttttggaagacattttattctaatattttatgttgttctgttgttacatactatggacgaagagcaacacacgactctgtgatgaaaccagtgctgcaactgtaatagggaaattacgtaatgccaatgcaattatagagttctcaatggatggttggaatggaacaatggtgatgatctgtgttgttgaatgtgataaatgacttaatgatggatttggttttgtagtcaaaattattgaattgaagacgttcaaaagttatcggaaaatatgactaccgaataattaccacaaaaggaatagcgaattcaataaagtagacataaaatgcacaacttcaacataaacgattatatgaaaactataattgtataatcttataactctattatctataatcattgtgagtatatcaaatgttgtttaaactcactcttgaactatttgataacttaaacatgtaataattatctacgcaaaaaaaagacatagtaattgaaaaaaaagagagtaaatgtttacatgtttatgatcttcgtagagaatcttagctagtttcttttaaaacacgttagtcatataataatgcaaacaaaaaaatttataaattttttgtttgtaaacatttcatattgatcacactgtaacataaatgcctcgtgacttcttaatgtatataggtataataggagagtacatgtagatgtagatatacacttctatgacgtatataaacagaaactgaatctttttattacgcaatcaaagccgtaacattctgttttgttatatgacaggtataatttactttgcacatacatcacaattcacacattatattatataaaaatatttatgtagatcggtcgttgctaatttcaagggggaggaacatgaaagattgagagagagagaagtaaaacagtgtttggtcaaatctctcttaagaaataatcttatgaaatgaaccgtcactttctttgctctgctctgctttttatttggatccttctattccaattcattgaccaatcacttcattatctctaattctctaacattttttttatattatccttttgatttatatatcaaattatttcaatcatgatacaaaaacgatattggagacatagcacaagttgcgtctgtctgtacgtattttctatttatctagtatagtctaacaaaaagagaaattgcccataaaaagggaaactcaatttctaacaaacctttctatttttataaagagaatttgctactattattactgatataaaaagaaataaaatttcttgctttctatcatatttgatattttttgatgtcttcgtcttaaggaaatggttacaaagacaagtataatcatataattcaaatagaaaacgatattaaagacagatcacaaattgcgtgtgtagatatttcaccaagtgttaacaaaaagagaaattcatataaaaaaaaatatttataaaactgcaactattaatttattcaaactaattaaaaagaaagagaaaaatcttcctataaaaagaaatgaatctttctttgtaatcagaaagaaataaaattctttttacttttccagaatttgatttttctcatgtgtcttatcttatgaatatggttaccacccagtgagactacagagtgttcttatctgtctctgaatcccattctctctctcacacaacattatataagcttacacagtcacttcacaatttccacaaattcgatatattaaactataataaactaaaaagaaatg

SEQ ID NO: 32646 - DNA, 3003 bp, Unknown
  misc_feature (1)..( 3003): 2750-1469P.txt file - cDNA_ID_3059624; gDNA_ID_1620338; Annot_ID_153871
tggggtttgactatttaatcagctttaagtatcatcatttgaccttttcactgttttactgctaccaataagattttagcaatttgtaccatatgagagaatcatatgagcacttacttttttattcttttcttttttggtttaaatattagtactcacttacaacagtttctaatttttttagctattgataaatttccataattggattagcaattgttattctctttataatttcatgtgttttagtaatatggagtattatgtgatatgtgagggaaaaaaatcaaaagagggagaggaaaagaaaagaaaagatagatactcttttaatacaaatgtaagtcgagagaaagagaagaatccaagtcggcagttccatgtgtaagcctcgggaacacaaatatttgtcccacagtgcgatcccaaagttcatgccccacacgtgtgaagtcctacttggcgccacgtcagtatttaatgcatgggaaaattgaggtggtaactgatgatgttaatatcctctcgattattgcttgaagatgtctcactcgatagtgaaacttgttgatgtaatatcacagttttttatcttaccagttacgactagccagtgtttcgctcacttgttttggagatgaccaaatttttagaataaaacttacaacaaactcgcttttcttagactagactcaattatatatcttatagtttatccaaaaatgagtttatacatgctgtcaattgtaattaatggtcatattgactaaaacgaaaatacgtttgattaacttttcaagataaccaatcaactatcgtcacttactttcatgtaacggaatttacctaacgtcatttgatttctcatcgttttcaaccaataacacaacctggtccagctaataaactcatttgtttttttttgttgtaactttttctctttagaaactcatcggtctatactcttgatctaagtggtattgttattctaggcaagaaatcaattatattgaacaaacatcttatcacgcacaatccggtcgcgatgaaagaagtttctacttctagttgaggccgtcctaaatcaattcgaatacgtattttagatcaatatttggaatgcaaaaaaaaaaatgacggagggagtataaagaacccatatttaatttgtagactagtctatatatcttcctcatatcttagtgatttgctatgaatctttcaattgtaagaccaaatgtgttcaaaatagtgtttaatctgtatagtatatgtatacattagaaagaaatatacgtacatgtatatatatatatatgcattaaaagatgtgctttatgaattaaggtaaaatatgtgaaattatgtcaacattattcttcccttttagggtgtattttaaaacagaagctcattggtactttaggtttagcataggctataggttttagttgttatcgagaatgccgtgtttacttcatcatgaacatctcatgttaacaacatgcattttaagttcttcaaaaaaaaaaaaaaaaaaaacatatgcattttaagtctttgtaaagagatgtaacattgtttatgttatctttaatcaattaaatacgaagttataatttacatatgaaaggtaaaaataaagaaaggtaaaaatagtaatcaataaaatagagttattttgatcaattatgctgaaatttcatgaaatatgtgagaaatacatctattggacaatccactaactgtcaatctcgagaattagaatcgtgctttgacagttttaactatatatagagaaacacaaatggcgtgagttttaggtttatattttgactgatacattactaaacaaaaatattaaattaagtactaaaataataaatgagtgaagtaatattagattcacgtataagtcatgtctaaaagggaataaaacaaaataatttacatttcttttcagatcttgaggtccacagttccaccttcgtaccaacacccaagtggttctttagagagagagagatttataagcttctctttgggcattacaattttttttgtgaacatagaaacactcaaaacttcaaaccaaaaaaaataaatgggagaggttcaagaaaatcctaaactcttatatcagcttttcaaatctccatgaataatattaacaaatttgttctgatctattttattttatttttggtatcaggaagagaagaaaccagaagcagcagaggaaaagaaaatggaagagaagaaaccagaagagaaaaaagaaggagaagacaagaaagtggatgctgagaaaaaaggagaagattctgacaagaagcctcaagaaggagaatctaacaaagattccaaagaagattctgctccggcggcgcctgaggctccagcaccgcctcctccgccgcaagaggttgttcttaaggtttacatgcactgtgaaggatgtgctagaaaagtccgccgttgtctcaaaggcttcgaaggtatgtattaaaaacagatatgtgtagagaaaaaaaaaagaattaattgatttatataattttgcaattccacacaaatcttttggtttacatttttaaaaatataaaaaattcagttttccatagaatagtttcggaaacaattttttaaagatgattaattatattgtggctttattttaaaaatatacaataaacacaattatcttgtattctttccagcatcctatgtcaattgctgtaactggatatatcttgtttctgtcaactatagtttttttggttaatctcgtatctaagtatagttaatattcgtcatataatttgtgtgtagggccacataaagttttggttatgctttagtattatagcttttgttttttaaaaacactcaaactagaaattctgtttttgggtaaaaatggtaaagctaatggtttataaaaaaaatatataactttggaattttggttgaattaatcaattaggagtggaagatgtgatg

SEQ ID NO: 32647 - DNA, 3000 bp, Unknown; identical to SEQ ID NO: 919
  misc_feature (1)..( 3000): 2750-1469P.txt file - cDNA_ID_3059635; gDNA_ID_1620338; Annot_ID_153862

SEQ ID NO: 32648 - DNA, 3003 bp, Unknown
  misc_feature (1)..( 3003): 2750-1469P.txt file - cDNA_ID_3059641; gDNA_ID_1620338; Annot_ID_153859
gaaggaagacataattctttactctgccaaggtgtatatatgaaaatctacatacataggcttaagagcatctaataagttagtggctgtgatcgctgatatctatttcggtctaatgttttaatccaggtaatcccaggcaatgaatcacgagtaatgaaaatgatgaatcggatagcagatatcgggccaaatattatcatgggtaagaatgaaatgctccacacatctggtcatgcctaccgtggagaattggtaagctgctgcttctcttaagactgttgataccttcagaagttttgttgccagctttcctttctgtttcttttcacttcatcaatcttaggcttttagcgcatatgtaaaggtgtaaaggcaatagttccctgtttgcaaactgatgaatatctaagggaaaattttgtttctaatgattgtaactattccctattttgaaggaagaggtccttaaaatagtgaagccgcaacattttcttcccatacatggagaacttttgtttcttaaggagcatgagttgctcgggaagtctactgggattagacacactactgtaagtctctcaccaaagacatatgaactcatggtagataaatagcatacaacataggaaaataccgattgtgaagattttttctaaaagttctgcaacatgtttatgagtttgatgaaatagatgcaaatttcatctggtcacaaagtgcctcaaccgtgaaaacagaatttctgagacatgttcaatttaatacaaaaatttcatggaaggatccctttattatctctcggagatataaaataaagaaacccttgtttgtctggtattaaaacctaggtcaactagctgaatgtttcactttttttttttttcattttctccaacttcaggttataaagaacggagaaatgctaggagtttctcacctgagaaatagaagggttttgtctaatggatttagctctcttggcagggagaatttgcaggttgatttgattgtcactgttgtgttctgtttatcttgtgtaaatgactagattaggatattgaataatcctagcgttgctgcagttaatgtatagtgatggtgataaagcatttggcacatcaagcgaactatgcattgacgaacgacttagaatttcttctgatggcattatagttctgaggtaaatctgaattgtaacattcctgtgccagtgcattttgttagtcgtatttaataatttgttggcttccttgtatgattttctataatccagcatggagatcatgcgtccaggggtctcagaaaacactttgaaaggaaaaataagaatcacaacgcggtgcatgtggcttgacaaaggaagacttttagatgcacttcacaaagcagctcatgctgctctatcaagttgtcctgtgacatgtcccttgtctcacatggaaagaacagtctccgaagtcctgaggaagattgtaaggaagtacagtggtaaaaggcctgaagtcatcgctatagccactgagaatccaatggctgtccgagctgatgaggtcagtgcgagactgtctggtgatccaagtgttggttctggagttgcagctttaaggaaagttgttgaaggaaatgacaaaagaagtcgggcgaagaaagcaccttcacaagaagcttcccccaaagaagtagatcgcactttggaaggtctggtcttactttcacatttgtaggtctatattcgggatgtaatctaacatgtttcagtcatgcagatgatatcattgatagtgcaagactactggctgaagaagaaactgcggcatcaacatacacggaagaagttgatacgcccgttgggagttcttcagaagagtcagacgatttttggaaatcattcatcaatccatcatcgtcaccttcaccgagtgaaacagaaaatatgaataaggtagctgatacggagcctaaagcagagggtaaggaaaacagcagagacgacgatgaattagctgatgcttcagattctgaaaccaagtcatcaccaaaacgtgtgaggaagaacaaatggaaaccggaggagataaagaaggtaatcagaatgcgaggagagctgcacagtagatttcaagtggtgaaaggtagaatggcattgtgggaagagatctcttcaaatctatcagctgaaggaatcaatcgaagcccgggacaatgcaaatctctctgggcatcacttattcagaaatacgaggttcgtctctgaacatatgaatctgtagccgtagatttgaagttcatgattacaagatcaaaagctcttaagttagcaaccaagatttgatgtaatacatttttgtgcaggagagcaaggctgatgagagaagcaagacgagttggccacattttgaggatatgaacaacattttgtcagagctaggcacacctgcgtcttaagtaatgtgatttagatgacattatcttcccaaaagaatcatctccagattttcttaaattgaacaaaaacagaaaagcattaattatattatgtatgtaaccagctgtaagatgatttttgtctgtagaactagaagctatcaacgcagaatccaaatcccaagggacaagaaagccatgactagttttttcggtttggtttaagattcgctttggcttcaaacacatgactaaccggaattattcaattttgatgttcatgtggttttcttattggttttcgttgattttatataccaccaatcactaatttttttaattaaatccggtttagatgctgttgtacattgaaccaacagttaaagtgagaaatgacggtttcacccttaaagcagcgtagcccgtctggtattccaccgtcgatcgccgccgtggcaattttggtaatttattattattttaaaaacaatgtgaaagagattaatgcaaagttgagagctgagtttccgacaaatttattggattgacgaactttgaagaagaagaagagagatg

SEQ ID NO: 32649 - DNA, 3003 bp, Unknown
  misc_feature (1)..( 3003): 2750-1469P.txt file - cDNA_ID_3059645; gDNA_ID_1620338; Annot_ID_153858
aggcatataatcttgtcatttactaataattctttagtaacaaccataaagcttattgagaggttgaaagtggtggaccggtgggtgaagttataaatgcaaatggttgaggcctagggaattgagttactaactgtgtacccaacattaagtcacagcctgtcctttctatatcgagtgtgaaaggtcaaagatgcgtacctttgtttactcttcaattcacactttatatacgactactactagtactacttgaactcaaataataacaagaaattggagtgagattatatgattttcaattatttgtacgtagttcagatgtggtgtgtgtgtgataagtctttgatttgtagtgtataagaaaatagcgattacagcagtgtggtttgaaaatgttcgatactatgcgttgtcattgaattaatttgacaatggagttatggagcagagagactctctcctttaaaaattaatttcccaaacaatgaattctgatagaataaatttatgcacatttattttatactatagtactatgtgggggacaaaaaaatactatataatcaacgttattttcatactatttaataaaatacgtatataaatatcgaataagatggtttttgtttgcgtatgaattaggtagatgtgataactcgctgtctttgatttttcataataagccgtcaatatccatttatcactagttggaacttggaagtgtatatatatatatatgatttctttttaagttctgataaagcaaaaaagaatatgttgacttggtcaagtggtccaatgaatccaatcttccagcgggccatttataaagagactatcaaactaaaaagtggtttacgagtataaactaagttgataaaaggttttttgttttgttaaaaggaaaattatgttttgcagaatgatttatcttacgagtataatgatcaatgatgtattcttaaaagcatgggaagattgacttcggtttaaaaatatatccagtttcaagtctctcacgttaagtgtaatagtaatataagatttgacaatctttatcatcgttgactttgaccaacaaaaatagtcaaatattggatatttggatattttctaatttattcagacaatgcaaaattgcaggttcagtatcaatgtatcatattcatgggatttcagattttgtgatgactattttagaacactactttgtgattatctgaaatgttatatttaggaataaaaatcttagctaaacttttttttttttttacattcgtgctatttgaaagaaaaaaaaaacttatagttgctatgaatgagaaaccatcttcctatgtatgttgacctgataatcacttgctatgaatgagacatttttatataaaaaaaccgctatgaacgagacatttaaaaccatcacgttgacagcaaactgcatataaattaagttaccgaatggtttaatgggcctagtaatgggccaaacagtctttctcctttatttcagattgatatagtggccactacaaatgcaggacctgtcccgttgaggaataaccggttttcaattcaattgagagaaggtttattgtattcgtcgtctcccatccgataagagagaaagatagtttacagtcacagagatacttttctcactcatctctctctctctttcccgcttccctccttaaaccccaattcttctcctgctcacaaaaaccctatcttttgggttttgttatacagtgatgatgaaacctgcttctttgcaaggtttctcctcacatgcgtcctcctctatctactccgatgttcgcaggccagctactactccttcgaaaatggcagcttttagtgccctctcgctttgtccctatactttcaccttccgccaaagctctcgaattaagtctaccgtttcctgttccgtcacttctgctcctgcttctggtctgttgtttttctttctctcctcgtcttttcctattgggttcctcggaaattaagttattgattgagtaaatgtgctccactactgtaatgggtttggagtattttgaattagcatagaaaaaaattgaaactttataagatttttggttgatagtggccgatagtttggacagagtttctatggagattctcactctgattctgttgatacttgatagtatgagtagaatctttgaaatttggttgttttatgtgtcgtgaatggaccataggagactgactagtcgagtgtttttatttgtgtgtgtattgactctatttgttgattctggtgttatgtatcaggtacatcttcatcctctaagacgccacgtagaagatcaggtcgactagaaggagttggaaaaagcatggaggattcggtgaaacgtaaaatggaacagttttatgaaggaaccgatggaccacctctccgtattcttcccataggaggccttggtgaaattggaatgaactgtatgcttgttggaaactatgatcgttacattctaatcgacgctggtataatgttccctgagtaagtccggagatacattcatcttgttaatattggcgagaagtcattatctttgtgtgcgtggtgctaactctccgtggaaaacattgctgtataatgttacagttatgatgagcctgggatccagaaaataatgccagacacaggatttatcagacgatggaaacacaaaattgaagctgttgttataacgcatggtcatgaagatcacattggtgcgttgccttgggtaaggtcttcttctactccttgaaaaatccataatgagccatagacttttggagatttctagatagagtctagcttttatttttcaattaacagctgcggctcgtgtgtataatgcagttcttttcctcagtccattgctggtttctgttctttttttgaccgatacccttttacatgagcaggttatcccagcattggaccctaatacaccaatattcgcatcatccttcaccatg

SEQ ID NO: 32650 - DNA, 3000 bp, Unknown; identical to SEQ ID NO: 926
  misc_feature (1)..( 3000): 2750-1469P.txt file - cDNA_ID_3059651; gDNA_ID_1620338; Annot_ID_153856

SEQ ID NO: 32651 - DNA, 2237 bp, Unknown; identical to SEQ ID NO: 931
  misc_feature (1)..( 2237): 2750-1469P.txt file - cDNA_ID_3059681; gDNA_ID_1620339; Annot_ID_153909

SEQ ID NO: 32652 - DNA, 3003 bp, Unknown
  misc_feature (1)..( 3003): 2750-1469P.txt file - cDNA_ID_3059685; gDNA_ID_1620339; Annot_ID_153906
ggtacaatcattcttccataccagaaaagttgtttatcacttgagtttattttaattacctttctagtaacgctccaattatcactttatttgttggacacacatgtttaacactcatgctgtctctttatttaatgttttaattttaccaccactaagataacacatatgcacattctttatcaaaaaaagatacagacattaatctaattaatcttacttgtaagtttcaaactcgcacgcacatacgatataaggatatatgtacatatatatatatatatatatatatatatatatatatatatatgtatgtacatacttgttgatgaggcatccactggaagtatacacgtttggttttggcccacgtgtatatgtctatttatagatgtaaatcatcttgaaataatatatgcacatattctccatttgtataacttctgaaaacgggtataaaatgttctcctaataatgtttttctcactatcccttgacgtcactttccactttttcttactttcaaaaatttatgtaatggaaaacagcttcaatgtagtaatcagatattccgagtgcgatgcagtggtttaattacagctatatatgtttttaataatagactttgtagtttggatgtatttcatgcatgttggaacaaagtttgatattatcacaataattatctgcacataaaagtagcatgcgtgtgtatacacaagttaattgacggttaaggcgatgcaaaaaggtaaggaagagtaaaacttacgacaagaattccatgttgtattaggacaggttgtctctttcccccatctccggcgacggctccggctcgtccttccggtatcctttgcatattcaatatgtacccatcttgagtcaccaccttcataatttaacaattaaaatagcagctttatcagttaatatatcgatgagtaatcatcatcaatagctatatagaaaaaaaaagaatgtcgtacgtacatcatgttcttcgcacttgtaaccaaatatgtgaacagaagaagcgcatatgccgccggcagcagtcctctgcggtggctgtccggcaagcctgccgaaggttccacgagcttcaagggtcttgagggaaagagcgaagaagattaagacagataaggctaaaccgattgaaacggacggaaccataaccgaaccggccattgagatatatataggggttatcacgtacgtttataggaaagtgaaaatggttttatatagagagaaggggtgacggataagataatagaaaatggaattattagctatttataaaaatgcaaaaccacgttagcaactatggatagacaaaaacttatttagaaaaaaaaacaatttatggtgtgtaaacataaattaagaattgaatcatgcacaaaaaataagacaagcatttatgaatagtttctagaagtggtgaatcatccactgctatcgtcgatacaacatttactaaagtttctatatataagtggagggatgatcagtgtgaccatgccatgatttctaacttttttgagagagcgaggttattatgataaacatttaaaataatacgtggaactgagatgaatggaaaataatctttataaaagagaaaaaaaaaaatagaagatctcatgataataaaagtacttccatatgttttcaatgtgaagaaaagaatagtaaaggagatacatccaatagcttagtctagaaaagagctgactaattttttttaaaaacaagatctctggtttgtatatttgtatcgattacacagcctagatatataaaacacaaaacttgatggagacaatttcatatcctatatatacacattaatttaatgagtgaatagtaatagcaactagcaaggcaatctaaacaaaattaagaaaagaaaaatgttaaattcctgagatctataataactcataagcaaaaaatatatttaaaaaaatcatacaaatgttgtaataatatcattttgttttaatgtggagtgataaaaagaagataggacgaaagaagaaactgttaaaggcgattgtagatgctgtagggacggataaatggactatgacatcagtttccgttacttgtttcttctcgaactcaaagaagaaagaaaaaaaaaaaaaaaattctacatcggtacgctttcgtttcacaccctgcatgcacacagtgtccggtagtcaaaaatacaaaaaaaagaaaaaaaacctcgagacatgctaaatttggataatgattaataatttgggggtacacaatgttccaaataatttatatacaaagtcttgctttcatattatttgtgtgtccacacttcaacaatatagtattatactattatccctatcccctatgaagtatgaacacactttttatgatacgtatcatattcagaaaacatcaaaaattggtcataactctcacgtggtgtggtggatttgcctcgcctttcgtttctgttttttgcaaatatttaagaatctttggtcatttaggctttaatttagttactttaaatttatttttgttatagaagtattatgttaaaaacagttcgtgttcatccttggactaaccagacgatttgacaaaatccgaatatccgatcataaaattaaataatcagccgttattgttcctctactactacgttttaacttttaagaacttctcctggtactttgatgggctataagagcggcccaatatttcgactttaaaatgggccaatctttggtaaaggcccaattatagtggcgcttcttcttcttcttttcctaaacaagcaatggcatggtttagctggtgagccagtttataggtaaaaaggataatttaagccatttaaaaaaacaaatctttaatggcgtaattcaaaaaacgtgcacacctatctaagtaccaaactctttatgttatataactattgtgacacaatttcaaatttgctaactcccaaaaaaaatg

SEQ ID NO: 32653 - DNA, 3000 bp, Unknown; identical to SEQ ID NO: 937
  misc_feature (1)..( 3000): 2750-1469P.txt file - cDNA_ID_3059699; gDNA_ID_1620339; Annot_ID_153891

SEQ ID NO: 32654 - DNA, 2739 bp, Unknown
  misc_feature (1)..( 2739): 2750-1469P.txt file - cDNA_ID_3059706; gDNA_ID_1620339; Annot_ID_153885
tctgcagctgcaaggaaacaacacacagcgctcaagtgacaagccggctcacttcccttgtctgttaccagtccatggtagtagtatgctgcagcctgttaagaaaaaagcagaacataatagagagatatattttatgaaagaacaatagagatgaatatatatcggatcactctcaacaatagcttacatacacatacaatacctttgcttccagaaacttccagtagataaaccggagaagtttcttggcgcatccatggctaactgcttcacaactagacaagcagtgatatgcctgaaatgataatgagatcattttatagcaaattaataattaaaacagagaaaagacatatgattgccccgaaagcatgccacagttataagaagctgaagattgttaaactatgaggaggacctgagtgaagtagatgacttgctcacatgcaattctcctcttcacagacaatgttgctttctgactatcaactgctaatccaagttgaatctcagttccctgcagtgagattcaaccaaacttacaaattgaaaacatatatacaagattcaggtttaggagtcacagtttcaaagtaagcatgtgtgtaacctggcctagtgcttgtatagagagagtttgtaatacactttcctgcatatcatctggcaacttactcctgcatacatatagcaaattttcagatatgtaagtattaatgtgatcctagaatttatgtatttgtgcttcatactttatatcatgaggaagttgagtcagaatctctcggacgcagaactccaagtatccagatgccttgagcagcaagtcaaccgcatctctcctgcaatctgtttgaaagtgacaggttaattagttttttgtaaacacaataaattaaaataaaagtgtgaaagtcaacgaggccacaccagtggagaccacacggacgccattgccagaaccagaagcatagcaatcctttggaatcatgagagagttagcttcagtcaatgccaaagcagccatcatgtggatcactatcaacatctccatccaaaggtttgtgcaacatatctctgcctgtatacacccttcacattgttaagattttaatgatactagaacaaacaaaatgaatatccttaggatcagcttaatttaagcaaaaaccgaacttactcgtcgaccatcgccaagggtcctccatttgagctctacgcagccctccattccatctttacctgtagagttaaatattctaatatcaccatttgaatatactaaactgtttaagttaatcaaaacttgcaaacacgaacttttcttgataagaccggatagaagtgacaagtactcctccaaagctgtacgcaactcagagatggctgaaccccctgcagtagaaaagatggaaccttatgtcttgacacgcaagaaaagaggaagaagttggtctaatttctctatacctgtgtcctcagctaccaactcaatctgatttcttaaacatgtcaaccgattgatggttgtcttgggagaaacacctttgagttggcgctgaagatcagactgaacaggaacacggaactgtagaacaaacactacagattcttgaatgatcctcttcttgttcttccttcccacaacagcaatagtagattgagcacaccccatgctctctttctctctctctctctctctgctatgatcttttgctcacaaaatcatcctacacaacattgacatatatatatgtcaaaataaggatgttttggaacaacctgaagcagatagatccggattaattttgaagctctaagtaaaatataaaaagaacaatctggaagagagaatctcagagagctaaccagaagagataagtaagcatgtgatgatgggaagagaagatttactcaggtttcagagttcgatgcaaatccctccacatgctcttatattcaacgatagatatacgtgatttagttaaccaacaaaggaaaatcacatgcctttcggtttaatccaagttttaattatgtttcttacgggtagctgtgaattcttattctatgtccccacccacttgcctactttttattggctctcctgttttagttttagtacttccttcctcgttgacttctttccttaactttcccgccaccttgattaattgaatcaaatcaactttatcagtttttaccctcttttcttactccaaccaaaagattgttagaaatgaaaatgagattatggtaacaaaacctccattgattcgagtcaatatgtcttttgaatgatatgaatcgttggctattacatcttaagtagactttataattagacgagataattaatagacaaagtcatctatgattataaaagtattagagaatatttggatccaatcgaaatgtggtgtgggaaaagaaacatgttagattgtggcaggagacaggctgtgttatcttcattgttctactgcaagtgcaaacacacttcccttctttaatttggacggtatattaatacactttattattagaatgggcttttataagtaggcccattatcaggtgaaaaacaattgggcccatcattgactttttttgttaatgggtggtggtggtggtgattaatatcgtcgtcggaggtttcttgagctgaagaaaacattcgtagatctatttccgcatctgcttaaacacctacatcgtcgtagatcgcaaaccatg

SEQ ID NO: 32655 - DNA, 1222 bp, Unknown
  misc_feature (1)..( 1222): 2750-1469P.txt file - cDNA_ID_3059715; gDNA_ID_1620340; Annot_ID_153947
ctttcgtgtgattgtgatttattcgatacagattgtttaagcctatacaaaatgacgtgattagaaattttaagagatattcacattcttctagattggttagttaaattaaatgtgagtaccaatttatacaaaagcataggttgtttatatcattgtcattcctagctatgaacaaaacaaaattttatatttcttctatgtgacgacagctaaacatttcttgtttttagttggtgtcaatttaagaataattagaaaaataccaaaagaaaaaaaagtagaaagtatagaacaaaatagaaaagtgagaataatggatacacacacactaatatacaactgcaagcacataaaattttcagacacaccacacaacattcactttcattataattttggtatgtgttgtattattcaatttccagttttttttatctattcttttcttagatgtcaattttgtagctgaaaatttatatagttgtcataatattactgcaaatcctattgactattgttagttttctatttggagattttataacattttttcacgattttatgctcctttagatcgacttcatataagcctccattcaatattacgtcaacaacaaagccatacatgaagattcatgagaaaagaacaaattagaatttctttttggctttctgttaacaagatacattgtatgaaatgaatctgacccgtgatgacaatgcaacaataatactagtacggctctaagagtcatagtcaaaagagatggtgattataagacagcaattacgcatgtcaacgtcacaataatgcgtgctactactaccatcctcctactgtctgctacgtcaacaagtggattgcaatcagacggtgattgtgtctcttttcattctctctcttttactaatttctctgataattaaactgagaatgtatattaagaaaaaaaaacaaaaacaagagaggaattttcatacacactaacttaagactctttgtaagttttcccaaatatggattttctagtataaatatgagttcattagtttcaccaagcctacaagcatctctccatctcaaatcatattcacctaaaaatcaggtcccctctctttatatctctaacattcttatatcagatcatattttttggatttcttgttaagtaacaccaatcttttaaaagtgttttcaggttaatataaaagaataatg

SEQ ID NO: 32656 - DNA, 3000 bp, Unknown; identical to SEQ ID NO: 942
  misc_feature (1)..( 3000): 2750-1469P.txt file - cDNA_ID_3059719; gDNA_ID_1620340; Annot_ID_153946

SEQ ID NO: 32657 - DNA, 3003 bp, Unknown
  misc_feature (1)..( 3003): 2750-1469P.txt file - cDNA_ID_3059723; gDNA_ID_1620340; Annot_ID_153944
aatattatataatttgcatagaaacttgaaaacaacttatattgtgaaacaaaaaattttatctaaaacaacttatattatgaaacggagggagtatttatctacattcgttataattattttttactttataaatatacttgttttctgttctagtttatgtttgtggggaaagaccgggacacatagtagagaaacattttgcaatgggagagagccttaacggtaaaaacaaagtagacattaataccgaaaggcgattggcagatcagaaatcaaaacaattcaaagaacaaggttgttccgaggaagaaactgaacaagccatgaaagatttcggattaaaaaggttgttatacaatatcaaatactgaaattagaaaatagatactatgaagtaactcgaagcattttcattattcatatatataatgttaattagggcaagactttatgggtggccaaacacatatgtcttcaccaaagcaatgggagaaatgcttcttggacactatagagaaactatgccaattgtaatcatacgtcccacaataatcacaagcactttctcggacccatttcctggttggattgaaggtttaaagtaagctatccatttatcattcctcattatagtagttactttagattattcatccacgtacttgatttgtttctgactcaacttctaatgtgtttattgtatgtatgaagaactgtagacagtgtgattatattctacgggaagggaattcttaagtgttttctcgtcgatcaaaagacagtatgtgatattgtaagtttcactagcacattaccaactttgaaaaatgtaaactaaaattctatttttactagcttgattgctaacaaagaaatatctctatataacaagataccggttgatatggtcgtaaacgcaatgattgcaatcgcagctgaccattgccatgattctggaagtcatacagtttaccatgtcggctcatctaaccaaaatccggtgatatataaacaaatttatgagatgatgagtcgttatttcatgaaaagccctcttgtcggacgtaatggtatgcttatagttccaaaagttacaagaatatccacactggctaggttccgtgtatacacaaatcttcgctataaattacctatacaggtaacagcttgcataaattgcacacgatttttttttttttctgtttgagtgttattctttttattattttaatagcaacctctcattttggctttgtgttttttcttctttagatattgggattacttagtgttatttccctatcccaaagagataaatttgcacttcacaaccgtaaattcaagatggccatgagattggtgaaactttacaagccttatgtactcttcaagggcatgtatgtatcactctcatatttcctccaacattccttttttacaagtattttcttccacttttaatgtatctagtagatatttttcatgccttagttcacgttttaactatagtttgaaattctattgtgtattcaatgcagatttgatgataaaaacatggaaactttacgtatcaagaatgaagccaaagatatggagaaattgtttggcaccaaccccaaatgcattgattgggaagactattttatgatacgcatatccctggcctcatgacacacgtattcaagaaatgaacttcaaatacaagttaatatacgaagtcaagtccaaagatattgttttgcatgggatgaagcctactatatataattactaagtatataaataataaatcgatggaaaatcgacgacaagtaatgttgtctttgtttgcttcttaatgtataatccatatttggaatttgcctatctaaaatccctcggcttgtctttggttatatataaaattggactactcattttgacaagtaaacatatactactttttaagtcaagaacatatactacttttccgacagaatcccacatttctttagttcttttactttgataagcaacgtcatcacttttaatgatattttaagtgaatgaaaaagagatgttgagtgaaggaaaaaaaagaagaaaaacaactagacgtaagtaaaattggactactcattttgacaagtaaaggtgggcttcggtgaagcaagaggttacaaagcaaatggacatcaaccttaaacactagtatataaaaagattttacaagtgacctgcgcttgtagttacctagttcagctaaaagtaaaaaaatgacacaaatgtaatggacaagtactgaaagataattttattggatataaatgatgtaaccactgacactgttgagcaaaccttcacggctcattaaagatttataaaggacagtaagaaaaaaaatatgtttccccactaggctttctatttttagtatcactctaaactctagcgagtgaagatggctaaagtatagctagttaatgcttaatgcgtaatataaatatagttggtatatgattaaatactagtaagtctggttttcaagtaatgcagtttaaatggttcactgatgaattaaaattgacacacaataaattgtttaaacataatataaatgaggaaattaatgttttgaaggaacttcaatacagtataagaatatatgtgtttctcaaaatggtgatttatgtatagttttctagggtctctccttaactccgttgctagacataattggtgttcgtgtataaatgatttgaatctaacaaattgttaggttgaataaaattttgcagcaaatttgaaggtggatgaatttaagagccgttaatatagaagaactgcaaaagtacgttatctatttgtgtaaagccaaccaccaaaaaacaacgcattttggttcctttaataatcatttctttcttttatataaacctaagatacgttccccatatttcactcactcaagaagacatctaaagccatcaaaaatatatccatagaagcttcatcgaaatg

SEQ ID NO: 32658 - DNA, 3000 bp, Unknown; identical to SEQ ID NO: 947
  misc_feature (1)..( 3000): 2750-1469P.txt file - cDNA_ID_3059725; gDNA_ID_1620340; Annot_ID_153941

SEQ ID NO: 32659 - DNA, 3000 bp, Unknown
  misc_feature (1)..( 3000): 2750-1469P.txt file - cDNA_ID_3059730; gDNA_ID_1620340; Annot_ID_153936
tcgtttttgagctttgatttttagtaaaagatttgattttggttttggaaatagagaaataaaaacgatggagaaacgctgagaagatatgaaaaagaaaatgagtttgcagttaaaaagggtaaattggacaatttggtttgacaaagtgccttatcttttcaaagtgtctaaattcgtacatacttttctaaaagtgccatagaatgtaatattctcttaaaagaatccttgaacacaaaaaaaagagtaacccatagcggaatagtgtttatttgttaaaagggcaaactatttgtgtgtttaattagtcccgaatccgaaaaagataagaaccttgttgtctttcgttgaagaagtcttatcggattgtctctggtttttacgttttttttttttttggtgatattggaactgaagataaagattgatatcaaaacttaaccatattgtgaaacgatgaacatgtaagaggatgataagctctggctctcttataaaaatagtttatacgtgatccctttagaaaatgatgataatcacaatattaccagtgacataaaaggaatatatcggacttcagctgcacgcatgcaacaaaagaataacatatgatcgaaaagaataatcacagaaaacttgattaaaattaacaaacatcacacgtaagttgacaaaaaaaaagaaatacaaataataatcacacgttataaatggccatgggacataactaaatgctctaaaaagagtaaaacgttacgtaattcatttgtattagtattagcccactgagtactgatgagagcggaccaagtctcaaatctatgcaaaccacaagaaaagacacctaagtattagtatgatgacaattctgtcgtaaataagatttagttgttcgattatattctggctccatggatttgtttttttgctcttcttgacttgccttaaaaaaatttaaagaagtctacggattgtcgggttgtcaaaacttgtttttggtttcgagatttttattttggtgatttgatagagaaaccaaataaaattaaatatcaatccagcttctaaagtttcaatctaataaaaacaatattaaataatatataagaaattataaggaatgataatttaataggttcgtcttctatgtcgattaagttttattccggtaatgtttttcaactaaaattaaaacggccatacacctttttagttttgcttttcacgatttttttgtcacaattttgatacagtaccaattgtgttaaatatttttttgccaaaattatcactctataacactttaagttttaactggagaaataacaattttagctagatctttaatttatctgtgaacgcatttgagttttggatcattcatttctttaaagcaaatgtttgtacttcctgaaaacacttgaaaaagaatttggtagtttggccaaaaaagaaaaacttgttttactttcgttggttgggctgttacataacttgttttaagtgaatttgacatttctgtaatgaatttcatattaatagaagaaagagtctcgggttgacctattttttaagtaaaggtacggttgagattaattaaggtcgcaacatacttaaaacgaattattgatgttgaccacttttacctaacaatccataacggtgcgtgattagttttcgtattggttggtttatctatctgttttctgtttagtgatttaaattagagaggacccccaaactatataaattatgtgcccagttaagtttaatattagtgatgcatgcaaatactctactagtcatggagacgaacctaaccaaagtggcatttattctccgaactggtacatgagtaccataattatctagaataccgtacacaaaaatcgttatctagtgtctcgaaatcggtatcacaaaactagtcgatataggaagcattttaacctagattgagaaaatacacaaatttaccattttctaacttgcacatatatgatgtggagattttcaaaatacactatggggcatatatagtcttcttcttttttgttaaagtgtatcaacttttgttatttagaggaaggaattgaagtgttttttttcaatggtcaatatatagttgtgaacaattagaatttacattcaaatatcttcaaaatttataattttcagatctatgtggtacattacaaagtatcttggtatttaaaaagtcatctagtgtaattatactcaatgattaaattttggaaagtaatttgcatctataaaagataatgtaccatgataacgttaatgtacttgcaaatggccgaatttatgtaacgaattaacgaaaataccccaaggcaaagtcttcttcatctttttttttattttcaacttgttatatacttacacagttttttttttgttatgtaaataaataaagttaactaaaattatgacgagaattgttacacatacattatttcagttttactatactttcactagaaattacatgttccttaatgaacctcattacaaagattattgtcctctgacaatttgattaggcattagaaaactaacctatgactaatctgagtttgcttcaaaaaaactatttactaaaactggcaagccaaattaaaagataggaaaactaaaggaaaagagactgaaacttgacggcaaagacgaatgcttgactcattcaatggacgtacgtggctcgtaaaaagtttactaaacagtaaacacataacaacgaaagtaatcaaacacacacacacaaaacatccttgtctttaccaatatccgtacaaaaagggaataaaataaaaaaaaaaaacgaaaaacgcgtagagaacttttctcctttcactcggagaaaccaatctctacttcttatttaatgacaatgaatccatggcatctaagttaataatataggtagctacaactaattagagtgtttcttgttgttaaaaatatcgtacaaaaatg

SEQ ID NO: 32660 - DNA, 3003 bp, Unknown
  misc_feature (1)..( 3003): 2750-1469P.txt file - cDNA_ID_3059734; gDNA_ID_1620340; Annot_ID_153935
actacaataatgttagagttgaagtggttcttaacagctatagttctcgccccttctgtgcaaaatgtcactccagatgcagagctcctatcattctaaagctttgtgatccatatactggatacatttgttccgatgcatgtgtagtgcccgactatcaatacagctaagacaactatgtagctgtttatttcactctattgtttctcgtaattttttggatgtaagagtttatttccaactacaagtgctaagcattctggttatattcatactgtgttcatcagtacaggcaggattaaactgtatcgatgacatatataaagtcgtaacaagttatgacaaacttgctaaaaaggtagtagcaactaatatgatttagttaatgaaaacatagacagaaatgatggaaacagatatttgtgaatcagaaatgttattaaacaaagatgaaaactgaagtaattttaacaacaaaaataacgaatatgtgatgtacattgcaaatgcaaaaattataaagacacagcggataaagttttggaaatacagagaacaaactcactcacgtgactaaatctaaaagacaaggcaagagttcaatgaacctctgtatcattttgattttgacatttacaagagttacataagcaaggaggaccatgacatgtaacttcaaactcacagtcattttcatgacaaaaccaaggcttcaaatcgaaatgatgcgactgagttgatttacaaaaacagtggtccgtttcagtataccttagataaggccgccagattttaagatctgcatgatggtaaagtgattcctccgcagaaagatgcgattattatgtacagcaagaaaactatcaagcatgtcaacaagaccctgccgaacacaaacaagaaaagcagttttgttgattaataaaagtgatctggaactcaagcatcaaaacaaaacaataatgaaatttctttaagcagaggtggaatcaaggcagtgtagttcctatcagccaaaaattagatattttgtcgaggagaatttcccaaaatcgaaaataatgttgaatcttagaactactgtatctctagtttaagaaacatatcaataaactatgctgcaaaggcgagttgaaacacctagaatgtagaagagcgtatctcttagttagcaaagaaaaggaatgaagagaatctagaagtgagagagatccttacaggagcttagcatttttcatccaaagagctcggcgaaggcgcttagattgcttcctgaagtgaaacgagctatcttgcattgttgctgttttatcaacaagaagctcaatcctatcacctctttccattatcttctcaatgttctctaccatgaccgatcgaatctgtaaacacgataacacaacaatgagataacaaacttcatctttcacccaagacagatttaaagaagcctgtgtgagccaagaaggcgtaataactcataaaaattcaaccttttcaatggatatagctgagtaatatctagagatcatacgaagaaacaattatacctcactgacttctcctctaacacgattgagagtatcaacactaggattactagagaagaactccatctgctgatgcaaaacccttgagaattcatcattcattgcataagctggagcattatgagccactttgccatagtttttcatgaatctcatatgaatctcttccaaatacgaaaatggaaccctccctgaaaatccaatcaccaacacatcaaaacataaaactcagaatcaattacaaagactaaatcttcttaagagagattacgattcggagaaagtgaaaaatacttacttccaaaggtatcattggccatacagagaaaggtaagaccatcagatctaagaatatggaagatataacgatcttgagagaaacaaagtctttcatcggagatttccggtgaaagcttctcgaggatccgtcgcaccacggcgcctgtgtttcccgtaacggcgctgaattcagctaataccacggtacctctcgctacaacagcatagacaatcgccatcggagaatcttcaattagagtgattcgatgacagagagtggagatcacgcgctccggcggcgagaaagttcaacgtcggctttgctgcgatcagaacagagtataaaaatgcgaagttataaggttaggtgcaaacgtttcgaatataaccccttgttttattgttacgtttttaattgtcacctaaaatattattttgttacattttaaaccctgatgcatcggtttacggtttaccaatttattaggccttggtaacttatccgaaaacaaaccgacccgaaattcacttttcggtttgggttcggatactccaataataacttgatcgtttccttctttttaatttcgattatccggttcggttcgagtatagcacgaataaaccgaattaaaattaaagccctaatttaaatataccgatcgagtcttcggcgagcttacttcgccttgaatcgagtcttcgacgagtctccggctgcgagtttctcttgctccggcaaacagacctgtcattgcttctctctccggctaactacacaggcgagcttctctatttattttcttctgtgtctccagttgcttctgatataatgaatatgctcttgaagcaaattgtttctctgcttctctttctccagtgaattgtttgttgtattataaacgaggtttaggaattgggttaataatattggaggattgtgtttgtattctgtgtccgacgaacaaatgacatttccgatttctattgtgctacgagctcagtgtttagaagggttttgatgttctctattgaatattcatgttatgttagtttgatgattagatgattttgctttgcaattactgtgtttttttgtctgactggctctgatattatacaacgtgtttgactccgattggtatcaatcttcttcttcgtcttcagaagcatg

SEQ ID NO: 32661 - DNA, 3000 bp, Unknown; identical to SEQ ID NO: 945
  misc_feature (1)..( 3000): 2750-1469P.txt file - cDNA_ID_3059738; gDNA_ID_1620340; Annot_ID_153932

SEQ ID NO: 32662 - DNA, 3003 bp, Unknown
  misc_feature (1)..( 3003): 2750-1469P.txt file - cDNA_ID_3059742; gDNA_ID_1620340; Annot_ID_153931
taaatgacaattgagtaacctggatcatttcagagggatcatagatttgagtccggatgataaccaatcgatctaatagatcaatagggactccatgggggctgggcatatcagtccctctgcaaataaagtaaatcacagtaccaagttaacaaaaactcacaagatttccaaaggaaaatgtctatcaaggtctagcgctcttctcaccttacgttgcaaacacctctatttgttgcaaatatcactatcggagataatgagctctcaagagcacggttcaagtatgagaagcactccatatcaagcatatgaacctgaggttttataattaaacaaaggtattcttactgctcctgagtcctgagcaagatcaatagtggaatgaaaaaaaactttatttgggaaaatacctcatcaataaatagaactcctggaacaagctctgccacaccttcatctatatatcggttcacaacctacaatggcatataaaaatattagaccttgcaaaagagaaagtaagatgcttaaaaaaatcacccatgtactagcgaaaatcaccttgttaatttcttgccgaagcttatcagtgatctcagtcttccgcggtttcatcatttggcccatcaaagaaagtatatcctggccaccttgaggtcgagcatttgctgcatccagatcttggagtgtgacatcctatcagtcaaaagtatatggtctagttgagtaacaagtagtcttaataaacttaggaactaaggttaatacacatacaaactaatacataacagataataaatcaacaaagaaaataattactctacacagaagggagaggtcaaagaaggtaaacctgcactatctctttctttttgtggacctctcctttgggaagtggaacatattcttctgcttccagatcaaattcagtggcaaaagcatcacttctacctacccgtttgacagctccactgtttgcttcgatatagattacatctcctacagctacctgagaggcaaacagcaaaaatataaaaagaaaccaatcagaatgacaaagtaatcagcaaattcatacacaattgtccccacagaatgacatcgttagaaaaccaaaaaggtgaaaagaaaagcaggttttggaacaaactgaaaagcaaaaacttaggggaaaataccacatccaaagcatagcatcgcatgccaagaactgaccttttccttaatcaaggcatcatagatagtgggatccaatttcagatgtttggttcctttgactgtcttgagtgtaattacaacatggctgatgcttttaccataacctccagtgaggctttcagtttcttctggtgacagctcggtgacctagaacacaaggacaacatgtcaaaaaccaattagcgagacatgctattgcataagaacacagcaaaagaaaccgcaaatagcaacacacctccccttcatagacttctttggtttccttgatacgtagaccaatggcacgtctaaaattctccatgagaacctctgttttcttaacctctgatgagtaaacctcagatccaaccattggacagaatggaacctgcaagaaagaaacaatccagataaaataagctaaaagtaaaagaaaaaagcttcatacaatgaagccatgtggaaacaatgtaacaaagaagatacaaaatgagacatccaaaattaccttgcttcccagctcttgagagattccaagagccaaagctgttttcccagttccaggaggtccagcaagcaaaagagccttgcccgccattttcttctgcttaatcatgtcaactacaagaccagctgcctctctagcctcaagttgaccaacaaatccagctgccaattttatagggataccagttggctagaaaaagagacgcaacattagcaacagaaatgatgtactggttatagaacgagatcacacagatgcttgagaaactacagtcagtaaaagaagcaaagatagttaattaaaatcaaagtgccgtgccaaagtggaagagcaaaggtcttcaaacatcggtcaagtactatatatttcataaaatacatgtattaaaattgaatatttgcaaatcaaaactagagtataattgtgctagagccgaaaaaagagtctcggagaataccaaacgaagcaatgagcttgaaacccctaaaaatcattaaactttaaacacaaaaccttaaagaactttgagcaatacgagaatactgcaatgcatcttatccccagaaaagtcgaaactttacaaatgaaaactagggtttgtttgtgctagaacagagaaaagaaactctaagcgtagtaccaaacgaagcaaatagctttaaaaccctaaaaaagcttagaacataaaaccttaactaaaccctaaactcgagcaaactactggaatccactagagtcaaagagagagaggagaaggagcacctcgaggccaaggcctttgatatgggtgtgagtagcaatccgttgtttcttagcggtggactgaatttcttcaatctttactttctccatctccgtcaactacaattactttgatctgctttaggtcttttgttgtattctccgacgacgaaaacgacggcggaaagttttgagctttattgagtttgcaacgcctccctctgactccaaattgccaaaacctcttcctaacaaagtttatatgttaaacatgttgttgcaacaatgggcctttatattatcctttatttacaaaatcaccccacacttcctaaactcagaaatagaaagaaaacgaaaacaattagagaaaagggcgaaacaaaaagacaggactcaatagtcataaatgtaaattaaggggtgaaattataatatatgaataataaaagggtcttctttttggaaactttctttctcttcatcaacaatagtgataagcttcttcttctggaaaaaaaccagaggccgtctcactctctcgctacatg

SEQ ID NO: 32663 - DNA, 3000 bp, Unknown; identical to SEQ ID NO: 949
  misc_feature (1)..( 3000): 2750-1469P.txt file - cDNA_ID_3059746; gDNA_ID_1620340; Annot_ID_153925

SEQ ID NO: 32664 - DNA, 3003 bp, Unknown
  misc_feature (1)..( 3003): 2750-1469P.txt file - cDNA_ID_3059811; gDNA_ID_1620341; Annot_ID_153984
caaacttgttcttgaaagttactgtgttaagaactagatgttataagtggacggagctttcagtgttacttcaaacaaatcaaggagacaaagctcgacggaaactgatatctgatcattattacaaggttcaaagacagacctgagtagtggattctgacgcggatggtgacggaaacagaagaaatagagagacgatgaagaagaatgcatccagagccattgatgattcagcttctcgcgagtcttgcttgattcagcttcctatcattgtttccattctctttttgttattggccgatcaattggaaagtcaacggaaaatcaaatcatttaataaaaccggttaaaccggatttgaatttcaattggtttttgccaaattgcagcagagctggccggttcgcggtttcaatagaacccttaaggtaaggtaagggattttactttgcccttttagttgaatcaatttttgaaaaaccctcacttattcttactaccccatctccttcttaacctatttgaaatacaattttacccttctcctttatcctttttaattttctatttaagttttgctaccaaacaatctattaaaatcaaccaatcatttacattttatttcctatctcattaatcagttaaacctacaaaaaaacgctggacaacagaaaccaataggtacaactatgttgatgaacttctacgaaaaacatataattacatatcgttttatttttctctttcattttcaagttataatcaaaaagacttcagtcatacgcgtttcttataatggatactattaattttcttgtcgtatttatacaaattaatatgttttgtattggtacaactaagtacaacccgcacaactaaggtcttttcacttggctagttttcagaatattataaaatatgaaaatttaaatccaaactaagaaaacttaaataatgcatacacaatggtaatgaaattacataattagtttttgacaaaaatcatattttctaaattaatgaaactcttatcacaaaatctaacattcatacactaacaaccttaaactttcatggttactttgtatattttaacaaaacaaattaaaaattttaaatacttgtaattagataaatataaatacaccgatacaaagtaattgtattttgatgggggaataccatatgttctacccataaaaattaattttgagttgataacaactagatttattatattctcgatattgtacaactatgagcaaaaatgtgcaaccgagtacaactgtacaactatgggcaatatatttttcagatatttatagatattttttagatatttgtagatattttataataaaaattagctttattcttttgtgataaaaatatttagttttttttgtcatcaaaaatacttaattttatagttaaataaactatatttttccctttcaaacttttttttcattttcaaaacactgttatttaataaaataaaatactaacattcataaaaaattttgtgttttgttttggatcaaaatacattgacgtgtagattcatatttattttggagttttttttgacaagaaatcttagattcatacctaaacccagatacataattgtacatgagcgtaccagttgtacctaaacgcttagatctattatcttaaaaaccaaaagacagccgaacaattgtatctaaacccaaaaacccaacataattatatctaaaaatttagccacaattatacctaaacacaacactatctaaagactcaaacacgaagtcttcttcttctctttgtcattctccttctcaatttctttctccacagctttctccttcttcccttttcttctagtttttatcattcaaaagcaatctcataatattttgttttaatgcatttcacaaactgtctctaaggaacaaaattcaaattcattcgaatcccaattgtaatcctaaaaactaagtcgtaatggctattacaagaggcttttaagggacaatttcgattttaaatagataattaattcaaatttgaattgtactcataaaaatctaaattataatcgaaatttcatccaaaatccatcattttcaaacaaaatcaaagaggaaaagagatcaaactatcaaatctaataagaaataaaactctaattaaacacaacaccatcaatcatcatatatggaatagagatagatctttggattgatagaaacaaatgaaaaggtaaaaaagatggatctttggattgatagaaagaatgaaaaggcaaaaagaagacgaaagattatatatggaatagagagaagagagtaaagagaagaagaagaagaagaaacaaatcaaaagttttgtttttgttgaattgagagaaaaataaattgagatgaaaaaaatttgatctgagaaattaaatttttttttgttgagaataaaagatccaaaattgttatggatctagatccaacatagaggttgggttgtaaataagtaaaaaactctagttttacttgtcttttattattattctgatttaaaataaataaataaacatatgtttttttataaggggctaactagagaatgtttgaagctgagggggtggactagattaaaatcctaagctaaggaagaagaaggttttgatgttagtgaaaggttagattttttattccgatcttggtcagtctcctccaatcgtgatttctcttctggatccaagctgatgagctctacgtcttcctcccaggtcatcactcttctctttttatgattgtgaacttgttttcgatggttttgatcgatttctggttcagttttttttttatccttcttaaaggattttatactatagatgggtcgatcaagtgttattgatatgccattgaagtgaactaagcttgaaatgagccaagttaagtcttttatggggattcttacgaagttactgaatctgatgtgaatattttgtggcagatg

SEQ ID NO: 32665 - DNA, 3000 bp, Unknown; identical to SEQ ID NO: 957
  misc_feature (1)..( 3000): 2750-1469P.txt file - cDNA_ID_3059815; gDNA_ID_1620341; Annot_ID_153983

SEQ ID NO: 32666 - DNA, 3003 bp, Unknown
  misc_feature (1)..( 3003): 2750-1469P.txt file - cDNA_ID_3059821; gDNA_ID_1620341; Annot_ID_153980
tctctctttcttgcttcaaggagcaggtacagtattgaaggtccgttactcacctatttacaaacctttgaattttggtgacattattctccttaatctcaaattcctttttcttataggaagtcatctttatagatagccaaagacgattaaaggtacattacaatccccaacaccacattatcagaagtttttatatgtttgtttgaaagactcaaaaatcatctactttttactaccacagggtgcttcactcgatctatttatagtaaattcatatggttcagctttccaagtaagtgtttcaccctaaaaatttctctgtaaactatgacttgcattccaagccaagtaatcttgtctctggtggttttgtttccttaccaattaggccatctgcattgcgttgcttcttccatttctttcaaaactttggggcataccgtttaaccaactcggtacctacctaaaagatggtgcggtttgttttctcaacaatgggacaataacaaaaggatgtgatggggctccgtttttgcctctgttgtttgtgataatgaacattggctataacattgctcttttaagactcctcaagatttcatccgcggtggtttcatgtcttgcatcaacagtctcagtgccaattgcagtgtttctgttcacaatgccattaccgtaccttggagttgcatcatcactaccaaaagggttcatgggaggaacaatcatacttgtattgggaatgattctttatagttggacaccacacggagctaactcttctcatactgattcagtcattccttcacctcctccaacatagagagggcttaactaaggggttttgcttttatataaagatttgagagatttatgcaaattcggtttgtgtttaaataaacttatatttgatcatatgatgttaatggaaaagttgacattttgtgtgtgttgcgttcacattagtattctagttcattagtcaacggctaacataatcttgtcttcaagagttgttaccctttaaacatatcactacaaatcgtgtgctaaaccatttaaaagacaaatcaaaacaaaataagaagaaaatagcctgcaacaatcaaagttacttcatcaaaattgttaaatagtaaaagactaagcaaatcctacaaaccactgagttttcttaaaccatttgattctacttgtggcaaggtctcgaagacaccacaagttgaaggaagactaataatatttagctaataaaggtcatctttaactaaacagattgaatcactattgattccgttaccaaattcttctaccggtgcttttagtgtaacccccagaccaaatatcatcatctccaatagaatctactctttcccatttgttactctcaactctcaagattcatcttaaagatgtaaaacaaatgtttctcttcaactagcttttctaataaactcaagatgatcaaaacctcttctgttttctgaatcactattctcctcttccaaatgtactcccactcttttgaaacgtactcaaacggatgatcccaatatggggtttcttcgacttcttctttgggaaaatctccagagaaatcgacaatcttgatgtgatcatcagaagtatacagataaagcttgctgttcttataagccagatcccaaaaacccaaatttgcgcctcttgtataccaattcaaccaacaatcatctcctttcttgtgtgtgaacaactcaagcttattgaaaattcaagcaacgacataatctcctgttctttcgtttatccacagaacagctgctctttcgcttccgaagatatctttcgacacacgttccttatgataagactcaacgaaataacctcactcatcaccaccgcttcgtttgaatctcacttgtccaccgcgtattgacgtctccattgatggaagattgattctttcgcccggtaacatgttaaagatagaaaagtcgagataagaatctaccatcaatagacagtttccgaagctagccatatatataatagctcttgtcagagattccaaagagtttcgcgttgtaaatcttgtcttctccgggatcgaacaacatcgaagattcattatggtaatatgaattgccatggatacagaggccgcttcacgcatgttttccaaacggagaaccactctaagcaaacgttttttatacggtgaaaatctatagtgctcaagctttcgattatcggacgtaaaagattggaccaatcttgattttcagacattttattcactcatcaaatgtctgcgcttacatcacactaatgggagctatagggttagggttttagggtttacaaccaaccctgtacatttccctttttgatgttctgcttttcactttgataattaactgtattttatattttactttcttcctaaatacaataaatttcttaacacattcaaaatcccatgaattagaaaattggttttcacatgtttcagattgatgaatgaaaattctcatacacctgattacgtagtttcttatgagatacatttataatcatatttatataagatttaggcaaaggttctaatcttgatttttatgagtagttgtggaatatagaagataagaagagacagttatgtaacaaaaattaaaatcccagaaattcctctcaacctttgtcttaaatccctaaatgttgtttttactttaaataccaaaattacagacacgttttggtcctaaactttctccctatcaacaaaccctataatcctttgaaccgaataccaacgaagaaaaaaaaacattctattcatagccattcacaaccaaaacacctaacgttttcttgctaaagaagaaacaaaaaccagaggaagaaaagcaaaaaaagtaagagaagaaaaacacaaaaaaaaataaaacctttctatttctcttcctcctttgagctttgacctctcctccatctcccccacccttttatgcaacaatg

SEQ ID NO: 32667 - DNA, 3003 bp, Unknown
  misc_feature (1)..( 3003): 2750-1469P.txt file - cDNA_ID_3059825; gDNA_ID_1620341; Annot_ID_153978
aagaaattgaagtgctttctcaagaaaagatggacttccatcgatttcttctaaagctagcaaaattggtcttccaacaaccgaagacttcaacgggcgctgatccctccctgcatgtcagggtgttactgatatacatcagaaatatgaaaggagccatagcagaggagctgataataataaaataagtgagaactaacatgaattgaaagatgcttcaatagtattgtttgcttctgttcggaatattccattttgaccaattacaagtgctgcattgggagcttgtgcaagggcttgctcaagggcagccttccattcatacaagtcgtccaatgtctcagcctatgagagccaaataattagcattcgatagaagcataacatagcacatatcgaaaaagggggaagaaaaattaagttagccaagcaaatatataaatcaccttaagggtgaaggctcgtccatcacgcccatctgggaatagtacagtcagcaacttcttatcttctctcaccacgacactgcaaacaaggatgttaacgcaggctagaaagttggagctattcttataaacaaaaaccacatgaaatttctacctccccgaactgttcaagtcaatgcctccaagggtcaaatttacttcacctcccttttgtggtaatgcactctgtcaaacagttgaaacaatgagtttaagttataaaatagttctagaaagtttggagttgataatgtaaatcaacatcctcctaaagcttttagcaaattaatacaaccatctaagatttctattgatcaactatcctaagttccaaaagctcaacagtaaaagtattatatgaattggagaaaaaatcacatcaaaggatcacaaacacttactggatcatttttgaaaaagaccaaagaagttcgggtaaggataaaccaacgcttcttccaggatgtccaacctagtcctgccaatcagaatgccataaagaatttagtaaacaacaagatgcttgtaaccaaaaaaaagataattttgaaagaaggggaaaataaaagagttcaccttttgatgatatgaagagagggccactcttataaacctgtcaaaattattatggagtacaatgaagattagcatcagtttgctttaactgtggaattttcatacaaagcaaaacactcagagctacatatataagaacgaacatattttagaacccagaaaacccccaaaagatgcatatattcactggcactaactcggtcttaaacaaaaatcgtacatacacagtgtcacatatgctttgaatacgaaacaaacacactaatcttatttatctcatccagtattcaactttcctaacaaagcaagcaggaaccaaaccagagactgtaattaccgtattcgaagctccagcttgaggcctctgtataacagctagagaagcctccattgcagaagtacacacttaatcaaaatgacgcatcagaaaaagatcattcgtaagcggaaaactaaattgctatctctcaaaagctccccagacgaatcaaactatacacattagcccgaatcgatggcttgttcaactcccatttccaagccaagctttcccttactttgcagtgaattcactacaagagtctgacctactgcacagctacaagagaagatgagtgaaggaggggaaggcagggaagggaaagttcaggcacagcaacgtgtagtctagttctatgcattgggccaatcaaaagacgccacgacaaagacatgtcttttcccctttttttgtcatactttcacattattattatacttttcgcatctagcggtgatggtactaatttcggtcccgtgttggtttggtttccatttagggttattcggtctggtatgattttgattttggattgaaatcgtatttgaaaagaaacaaaacaaaaaaagggaaataagttttgaactttttggttcaattcggttcaaattgtatcgatattagagctcacttcggttttcgtatatgttttttctttaaaagaatttgttccaaaagttcatcaaaattggtttaattcgaaaagctagatgttaagttcaaatattcatataagaatgcagtatgtatataatgttgtattatgtgatcctatatatataaacacatataataagtatttcagatattttatcataacttgtcaacacacaactttgagccattcctcatcaatcaccataaaacatcacatgaacatgaacttagcaagccaaaatcctaaattctgcgcatggctaactacttaacttggtcactatcgtatcgtccaacagttttttagtataaatgtttacgtttttttcaaccatgcatcacaagttagatgtagtgtacataagagttcacataacaaaagagcctaaaaacatcactacaccctacaccttgtattaacgtaaatatacactagatatggttgatcaaatataccatttcaaagattaataataaattctaaaattatagttgaagtatcttcccctcataaaaaaaacgaatatattcaataaaggaactactaccacattacatagagattaatctacttatatatctatttttatttacattttcaacaacataattgtagaaagtgatgtgtaaacaacactagcacaaattaaatcattacttattggttatgttttctattaaaagtaggaatgtctaaaataccgataacgggctaatttaaggtataatcactttttctgaaatttcctgataagggttaaaattgtcttttcgatgatttaccaaaagaaaaaaaaacatttgtcgtattttgcaaaacaagttgggcagcgtgtgttaatgcaaattgtttttaaaaacaaaagagagagataaaaaggcaaagtccaagtcagcaactcacttccgtctctctccccctcaaaaccagcagaaccagtctcactcgatccttaatccaccatg

SEQ ID NO: 32668 - DNA, 3000 bp, Unknown
  misc_feature (1)..( 3000): 2750-1469P.txt file - cDNA_ID_3059837; gDNA_ID_1620342; Annot_ID_154003
cacaggttacgatgtatgcccagttatatacttgtatatatatattaaaaaaatgttggacactgttcattaaaacatttcgaaatttaagagaatcataatcatagatggacacatataagttaattgttgttccgatcccaattgcaacacataaaatgttgcaagcgaatatttgagcgcagaatctccagacaagccggtggttggtaagtttgtagtaatggtttgcttttggcgacgaaaaccaagtaacttgtctcactcagaagtcagaaatagattagataattatcacaagagattttaattttccatgtctttttccctcaacaagcatatgagttcaaacacacaatgcaatacataaaactagaaatacaatgcacaaaaagaaaaaaaacgatcatgatgtcaaaacaatttattagtagagaacacaaacaaaaaaaaagtcaaaaagttactacaaatatctttttgcctatttcaacaactatatactaggtgacttaaattttgattaccaatcgtattaaaaaaaaaaaaaaaaaagcgatcatgatgctataatgcgttacggtaatatacaaagcaatgggcaaatggccctcaaatccactcattgactaaataattcaatacataaatacaaacatcacataacctctcatcttctacttgttcatcttccattccaatctcaagatgcacgcgaagaccgactccgaggtgacaagcctctcagcttcatcgccgactagatctccccgtcgaccagcctacttcgtccaatctccatcacgtgactcccacgatggggagaaaacagcaacatcattccactcaacaccggtactcaccagcccgatgggatctccaccacattctcactcttcctcaagccgcttctccaagatcaacggctcaaaacgtaagggccacgctggagaaaaacagttcgctatgattgaagaagaaggtcttcttgatgatggagatagagaacaagaagctttgcctcgtcgatgttatgttttagctttcattgttggattctctctactctttgctttcttctctttgattctttatgcagctgctaaacctcagaaacctaagatctctgttaaggtttgtgagagttgacttagtagatcgagatcagatttcagatctagagtcgtgcttacgtttgtagaattgaattttgcagagtataacgtttgagcaacttaaggttcaagctggacaagatgctggaggtataggaactgatatgatcactatgaacgcgacactgagaatgttgtaccgtaacactggtactttctttggtgttcatgtcacttcttctccgattgatcttagcttctcgcagatcactattggctctggctctgtaagttctaaaatctgaaacttctttaaaatgtgtctaattcatcttcatcaatgttgttgtcatgttgctatcaccagattctctttgtttctttttttttttatgaaaaatgtataaccgaacctttttcggtttagtttggaaaaaagttcggttcggtttagtttttggttagtctttgatcaatgttgtcggtggctattatcacatggggttgatcaggagtgcacattttggtgtttagttttaaaattttgtgtttaaaatatgtgtaaccgacaaaaaaatagaattttattggaagtggtatataatggatatatatttttaaaagtttgatctagtgtggttgttactaaattcaattttgctttatttgacatagacattttcttaacatttggttttacaatatagttttgatgacccacttccaatttaatttgatcgttattctttttacttttgtagattaagaagttttatcagtcaaggaaaagccaaagaacagtggtggtgaatgtacttggagacaagattccactctatggaagtggctcaacattagtcccaccaccacctcctgcaccaattccaaaacccaagaagaagaaaggacctatcgttatcgtcgaaccaccagcgcctcctgctccagtaccgatgaggctaaacttcaccgttagatctcgagcttacgtgttggggaagttagttcaacctaagttttacaagagaatcgtgtgcttgattaatttcgaacacaagaaactcagtaaacatattcccatcacgaataactgcactgtcacatctatttaaaagaagaaaaaaatacacatgagagtgcggacggtctcgtattgggtagtgcgcctatggccctatacatgttacaaggtattgcgtgtggcctaccccaaagcagaagaatcatcatcagtgggtttcataaatttaatttacgtaattggtttgagagattttgttaatgatacacagtaaacgagaagattcacattttgttttctttttttaatatgttttttcacgcaaagtatcaaattcttatttaatggagaaataccttatagtagcacacattttgcaaatttttaaaattaatattaattagtaaatttatacaataactagtttacacttattcattatttataaaaaattaatagtaactacaattttcttaaatcaaaataaaaatttcgaaatatctaatcaccatttcgatgagaattctttatgatttttgattgaaaagttttcggttattctgatctccaaaattatgttcataattccgacctcagagctcttatttgctaattatgctatttgtgataattgtcctaaaaagggattacaatttttaaaataagttaaaatattaaaacaaccatttgtttttaacttttaaagggaaagaatacaatttatttcaaaataaattgggccttaatctgagtagctcggtccaataagaaaaggccttgattagagcaggtctggtctaatcagaaaaaggtaaactcggtaacgaaatcagaattcgtcggagaagaagaagaagaaagatg

SEQ ID NO: 32669 - DNA, 3003 bp, Unknown
  misc_feature (1)..( 3003): 2750-1469P.txt file - cDNA_ID_3059853; gDNA_ID_1620342; Annot_ID_154001
aaatatatttacccgatcattccataagtttttatcgaacccttaaattcaataatgtaactagtgacacataccaaaaaacggtcacacaagatcttataaatttaagagatattattagaataagtaaaatttatacgaaaagtgaaaatagatatttaaaaattaaatcatatgagaactaatacgcaattgcaccattaaaccattcttcttaattttgaaagtcattttcctcgatgtatacttaactaagtgttttattttctccctcttagtatgtgtatatatatagtacggtgttgtcatcttcatcgatcaacttcaataataaattttagtacatccttagctaaaccagtactataccaaaattcaagagtcaatttttttgcttttttaaatagaagaaaattttatatatttctttgtttacatgaataatttctaacaatcccattaactttgactagtaagaattaatttgaataataatagtatatatacatatatatataaatatatatttgtttgtttacgtgaataatttctaacaatcccattaactttgactagtaagaattaatttgaaaaacaataatatatatatattaaaagttatactaaaacttttaatatttgtaggaatgccctacagatataaaacatttatgccctttatttgttttttgcataatcaaaaaattaatagtatataaaagttatactaaaactttatagatttttttttttgaactttataagcattttgtaagcaaaaaaataggaaaaaaaaacaaaattatattttttaaatatacctctatttagatttttacctccaaaaccattcatcaaattcacgtaatcgagtttttcaaacataattgtcttaatggatagcaaagccaactcatttatttgattaataaaaacaaagtttttattttgtaatcaaagttcaagcaccttacattagaaagtctttgactttttttttgtaatcaaaattttagagtttaaggttttatttttcttaaatctaaaattttactaaactaaattcattaataagacattttattaatttaaaaagatgaaaaaaagatagtaaatgaaaagtttaacaaatataaatatatagaaaaatgcttataattgattttttttataacataaaagtcttaaaacttttttataaaaatatgctcctctactataatgtcctaagccgtggcttcacttgattgtgtagaatgtcgaacctggctacgaagcacctaataatgttagacattttgacgtggtaggagttgtgaaacgtctgactttttcttcaggcattggtattcctaaaaattatacatgtggccgcaaaactgcacttgttccgcccagagtatacaacacttgctaaagatgtaagtgagtttagtttaaattaattttatatcgtgtgaactaagatatcttaaaaataattatttcagtgaattccatccttttttttaagaaatttatcgtgggtcaaaatatatgagctctttttacaagggagtaatagatgtgatggtttgtaagactagaatagcgaaaggggagtttgttgcgttcgtgaagttgccttgctcaaaagtggaatctctatatgtctcattagacattttgctaatccaagcgaaacgaaaggtgcgtggtggtcgtcgtcttactgatcccgacacaaagttagctacgcatacgcgtttgttaatagattttgtagcttttgctcctcctaaatagtcttttgctcaaatgttacccacgttgaggaaaattgtagggtttaacagaaaattctaacggaacgttaactctgtttacgaaaatttcacggcatgtccgaattggcccagtcaataaaacttgaccattttatcaaagaataaaaaaaatatgatttaaataacatttcgaaagttcatgtttttttcgtcccaaatttaaaaattagcgattttttcaatatttttcccgtaaatcaaattatccgaaaagttttgattttgactttgctaaaagagaaaatctattttattttacaaattgatcgtgtaggaaactaattcaagttcaaagaatttggaaatctccaaattcgaagtgctgagagacattcaaagagcacatgaataatttatcctttttcaactttttcaaagctacaaattctgatctcactacaccaaccagattcggaaaaacatattatatcctaactattgagcatctacgttgcttatgtttagttcaaattttgacatcatcctagttgttcatttgatttaaatttttgatacctaatacagtaatactaatgccgattataatagagaaatatattactttggcatgttttaacgtgttgaaatgtgaaagtattttatatttttaccttttagacatgatcaaatgtttatttctcgaaagtggtaaacgacgaatattaaaaaaaattgtattaaaataaaatcgtaaaaaaatcagaaatttactaagtttaatctctgagtatatatgtgtgattatttgtggaaacgtattcagctattgtgttccgtctattcaatcattttactattccattcatagtcaaatcccagtgtttcaatcctaatcaaatttggatctcgaaccaaccttccaatacgttattagtacttacaagaaaggtgtagtagaaatttgccagtcggataagatcatgtcattcattcgacaaattcattgaccaagaccaagaccataagaaaaaaataattccaccaactcttgtttttttttgtcaaaacgtgaaccaccaactctttacttggtcaaaaggttatttggactttttaaaaactccaaagtagtataggataaacgaaaatttccaggttcaccaacctagacgtttgtctcctctcctgtctatatattcactcatgcaaggccaccagacctcattcttccacaatg

SEQ ID NO: 32670 - DNA, 3003 bp, Unknown
  misc_feature (1)..( 3003): 2750-1469P.txt file - cDNA_ID_3059857; gDNA_ID_1620342; Annot_ID_154025
taaagaattccgcaaatccaaaataagcaacacaaaagaacatagagaggaaactaaaacaaaattctgctcaatgccacacacctcattccagaatccagatcaattccactcaacatctgtgctgcttttgaccattcctgctctgattcatacaaacccgcaagtttttctctgataacaagtgcctgcaaatacaccacaaacagtttcatctcttagaataaagagattgaaaaacaacacaacgtacattgtctcagttatcccaaaatacagcatccttagtaaacaaatatctcaaattagctttcagtgtagatttcacataccaaagcggtacaatagcaaagcgactctacatacctctcaacttatgttaagtaggtaaactaattagggtttaaaaagtacacgattgctgctaaacagtaaggtatcacgaagagaaaacaaacctgttcctcaaaggaaacaactctaggctgaatctgggtaagagtaaattgagcaatctccttctgcgtctccggttctaatctcccaagctcttgtgcgaaagactgcaaaagctgcctcgaaaccaccaacgggacatcatcggaaagaactggaaaaattgtgaggaagcaaaaatcaaaatcaaaccagaaattctgatataaaccgaattccataagaacaaaaagcagttgtcgaatctcttatgaagttgaaaccatgagaaagaagggagatgcgaaattactgtgatcgatgaatctctgagcttggagaagatcgttggaagagagaacagaggagaggatgagtttgtactgttcgattttctggcgttggtcaccgattgcagaagcgttcgtcaaagcttcatccatggcttctcttctgagattttctctcccgcttcgattgaaaccctaagaaaccttacaaggttttgatttctctctcgctttttttttttttttttttggagtttgctctctttttatattaaaaaaataaacggggactagattctgtgccggtgatcggagaggcgctttacaaaatttacttaatatggtcacaactcatatgagattagtacccaaaataaattaaaatatatatatatatatattaagcataaatactatatttttttttgttagttcataaattttataattaatttgtgatggtaagtttaccaaattgattgtagattaaaaaaaaaaatcaacaaataatatattgtttagaaatatttttatatgtgagcctaaattactacagtaaatcttttacacaaataaaaaaacacgtcgtgatttggaaaacacgatgatgaggtattttatgatgacaataccacgtttaatattatgataccagatcggaaaaagatgatatgttatgtgttttagagcttagggagcaatttaagatggaaacgtaaataattatttgttgagaaagaatcgactagaagcaatcgaaaaattgatcgaatggtcaagatatgaccgagaagtcatcggaaaagttgtgagcccaaatcttgagagcaatgacatgcaaaatgttttgaaagtgctctcatgaattaaaagtgaaaaaagaaccactctctcgttacatagagggtagtatataaagaaatttacctatctcagactaggaaaccaagtctcgcattggaatacgactttggtttaaacatgtgagctgactgacaaatcgattttatgtgctttacaacttagatataactgaacatattggtattggatgaggttggacgatagactcatagacacaatcgttgtctcgaaaaatcacgagtttctctcgcttaaaggattttttttgatgaagtttatggtgatcccgttcgagaacatcacaattgtttttgaatcaactttacagatccatattgtaactaatgattatagactacatagtttaccaaaattacatttactcaaaagaacagatgcggttgttgatggcaaaacttttttggaatggtagacatcccattgaaagaaaacaaattgccatggtatggaattcatgataatgatttaactcgttatagtctggacaaattgtcatggtagggtttcattgctctttctttgggtagttacctcaagatatctctttgttcttccttgtgatagttccaccttgatatgtacaaccccacattaatctgctcatttcaacattaattttctctattgtttttaaattgtgtgtataagattatttcactaactaggaaaacaatccatttctttgacacatgggctttacttaaacaaaagcccaataacttgtgtttagaagtcacatgatcaaatctcaagacctattataaattaacaaatttcatattgataaattttaaaagatttcctattacaatatttaaagttgctacaaattatagattcttttgatcttttctgatattgtttctcaaataaaatataggaataccaaattacaatatgaaagttgcttcaaattatagattcttttctgattttgtttctcaaataaaatataggactgaactaccaaaggcaataatattcaatgtgaccaacaaaaaaaaaataaaaaataaaaagaaatactcaaatctcataacctttttgactaaatatatcaatttcttctattttcaatgagcataaattacacgcgtcctcagaagctgaatccgatttgcaattcttcaatctcaaccgttagatcaacaaatccggcatcgaattcctccgcgtggtttggtccatttttttaatttgagtattaattcttttcctatttgacaacatgttttattaattattattattattccatttgcattaaaatataataaaaagatgtaagattctctccgcctccttctctctataagaaccgacacagagacgaagaagaataatcactcgaaaactcatcaaatcaaaaatcaaacacagagaagagaaaatg

SEQ ID NO: 32671 - DNA, 3000 bp, Unknown
  misc_feature (1)..( 3000): 2750-1469P.txt file - cDNA_ID_3059859; gDNA_ID_1620342; Annot_ID_154024
agtctccttgatctctccttctttcatgaagataaacgttggcattgcctgaactttaaactcctcagcaacagtctgcacaacaacataacaagcaagataaaggctcagagaagtcaaaaatccctaagtttggatattgggatagtgtaagattgatgaaggaaactcacgttcaattcgtcaacatcgaccttgaagaagactacgtcgaggtgcttcttggctaagtcagcaaagacgggtgcaatgaaacggcaaggtgggcaccatgttgcagtgaagtctatcacaatctgtgtcatttccacacaaccatatttaagaaaacaagctacaccgatcgataattcaaacaatagatacgacatcggttcatcattaagataacaaatgtatgcatttcatgtgcttcacagaacatggataataatacaaacatagatacaaaatgggttcactaaagacaattttcatgtgatctctagcagatgattcataaaattgaatatgcatagttgagagattcacataacatgtttttatccaatgatgcttctatcaagttcttagggtttcaatttctgagattctgggttcctaaacaatcaattaaactattagggttcataaatttgacattaaggagctcaaaaattcgattggggacaattcaaacctaattctgaatccgtcatattctaatcaaaaggaccaagatcagaaacgataaagcagcgaaatcaatcagaaagaaacatttaaaaccttagatcgagagtttttaccagtttcttggattcgttggcggctttgagcttctcggtccaatcttcaacggtgtggcaagcgataacttctccttctgcggccattttctcttctctgtgtttgatttttgatttgatgagttttcgagtgattattcttcttcgtctctgtgtcggttcttatagagagaaggaggcggagagaatcttacatctttttattatattttaatgcaaatggaataataataataattaataaaacatgttgtcaaataggaaaagaattaatactcaaattaaaaaaatggaccaaaccacgcggaggaattcgatgccggatttgttgatctaacggttgagattgaagaattgcaaatcggattcagcttctgaggacgcgtgtaatttatgctcattgaaaatagaagaaattgatatatttagtcaaaaaggttatgagatttgagtatttctttttattttttattttttttttgttggtcacattgaatattattgcctttggtagttcagtcctatattttatttgagaaacaaaatcagaaaagaatctataatttgaagcaactttcatattgtaatttggtattcctatattttatttgagaaacaatatcagaaaagatcaaaagaatctataatttgtagcaactttaaatattgtaataggaaatcttttaaaatttatcaatatgaaatttgttaatttataataggtcttgagatttgatcatgtgacttctaaacacaagttattgggcttttgtttaagtaaagcccatgtgtcaaagaaatggattgttttcctagttagtgaaataatcttatacacacaatttaaaaacaatagagaaaattaatgttgaaatgagcagattaatgtggggttgtacatatcaaggtggaactatcacaaggaagaacaaagagatatcttgaggtaactacccaaagaaagagcaatgaaaccctaccatgacaatttgtccagactataacgagttaaatcattatcatgaattccataccatggcaatttgttttctttcaatgggatgtctaccattccaaaaaagttttgccatcaacaaccgcatctgttcttttgagtaaatgtaattttggtaaactatgtagtctataatcattagttacaatatggatctgtaaagttgattcaaaaacaattgtgatgttctcgaacgggatcaccataaacttcatcaaaaaaaatcctttaagcgagagaaactcgtgatttttcgagacaacgattgtgtctatgagtctatcgtccaacctcatccaataccaatatgttcagttatatctaagttgtaaagcacataaaatcgatttgtcagtcagctcacatgtttaaaccaaagtcgtattccaatgcgagacttggtttcctagtctgagataggtaaatttctttatatactaccctctatgtaacgagagagtggttcttttttcacttttaattcatgagagcactttcaaaacattttgcatgtcattgctctcaagatttgggctcacaacttttccgatgacttctcggtcatatcttgaccattcgatcaatttttcgattgcttctagtcgattctttctcaacaaataattatttacgtttccatcttaaattgctccctaagctctaaaacacataacatatcatctttttccgatctggtatcataatattaaacgtggtattgtcatcataaaatacctcatcatcgtgttttccaaatcacgacgtgtttttttatttgtgtaaaagatttactgtagtaatttaggctcacatataaaaatatttctaaacaatatattatttgttgatttttttttttaatctacaatcaatttggtaaacttaccatcacaaattaattataaaatttatgaactaacaaaaaaaaatatagtatttatgcttaatatatatatatatatattttaatttattttgggtactaatctcatatgagttgtgaccatattaagtaaattttgtaaagcgcctctccgatcaccggcacagaatctagtccccgtttatttttttaatataaaaagagagcaaactccaaaaaaaaaaaaaaaaaaagcgagagagaaatcaaaaccttgtaaggtttcttagggtttcaatcgaagcgggagagaaaatctcagaagagaagccatg

SEQ ID NO: 32672 - DNA, 3003 bp, Unknown
  misc_feature (1)..( 3003): 2750-1469P.txt file - cDNA_ID_3059863; gDNA_ID_1620342; Annot_ID_154022
aattgaaattccaaactatttttaagtatgaaataaatttattttttaaaatataagaagcctaactcacattgtatctaaaacatattatttatttttaaaaaatctttttttttctaacaataatcttaattaaaaagactaataaatgttagtaaaaatgtattggacatacaactaattgaaaggatttcaaagtttctctagactaatatgaggttcacaagagcaaatagataaatttagaatatcaagtatagttttgctataagatttatgttaaagatacaactatcacacctagacaaaatttaaaagcatatcatttgaaattgcatatgagctaaaacttatagtaaatatataccgatcaatagaattaaagaaaaaatgctttaaatttatatattaacgaaggattcaagttgtttacgtaaaaaaagaagaaggattcaagttaaatggtaaagacacatatagatatctaactagttttatcactaatcattagatatgatttgatactaactaagatacgtgtgaactaactgatccataagaaaatacaatttttgctaaatttttaaaattagaggatttaatagatattatctttaaatttgtctcacccttcaatttttcaattttgcattgaaattcgaattaaaattttgtaaatatgcttgcttatttgtgtgagctattggtctaaggtcattaaattatagtataatgataaagattgtaaattaatctttcctgaatttttaaaatgaagatctataaatgctttgaaaaaaagttaaactttgttgaattatgaacaacatactactctaattagaaagcaaatacaaaaaataaattccctaaaaataatatttagagctcctcttaataattaagtattgaaatattctttcactattcataagaaactatgttttaagttcaaatagaaaatcacaaatttatgttatattttttgagaacaaaattcgttttggatgaaattgtagtaaagtgaaaatatataagtttgtgtgaagaaatcagtaataacagaaaatatcaatttattggctcaaaatagtaaaagcattccatatttgaagcacttttggaaattgagacacaatgtttccacaagtcatcactcttcttcaagtattctctttcgtgggcaattaacatgggtttatctgcaatatatttaataagcgtatcgtgacacatttttccttctttgacgagatccttgcaacaagggtcaggcatggttccattttcaaacacagcagcgattatatccaaagcacacttaggagtgattttaacaaaacaagtattccataataatgttgcttcagcttcttcgactgagaaagccggaacaaacgcacacaccaaagctaaaacaatgaacaatgtagtaatctgagtgttaaatttagacatatctacttatggttgaaatatacaagaaatattcttattttactaaagaaatcgtaagaaagaatgattagtatttgttatttaaaaaatggggtaatctaacttttatataggaaatcaaaatcacaacgtaacttctaaaaaaaccaaaaaagattaacgttatatttaatggcaattaaaattttgacaaataaatatactaccaaacttaaatttaatagtttctattaacgttgcaaaattaaacaaaaaaaaaccctaaatacatgtaacaatatccaattcaatagatagaagaaagcaatggttaacttttttatattttgatatctaacaccaaatagttaatgggtataaggttcaaattgacatattttatggtattcagccaaataaattttaatttcaaactattttaagtataaaataaatttatttttaaaaatataagaaacataactcacattgtatctaaaacgtattatttatttttaaaaactttttttctaataataattttaatcgaaagactaataaatgttagtaaaaatgtattcgagatttaacttattgaaaggatttcaaagtttctctagactaaatttaaaaatattaagtataaggttcacaagagcaaataaataaatttaaaatattaaatatagttttgctataaatctgttgagaatataactatcaaataacatattatttgaacttgcacatgagctcaaacttatagcaaatatataccgatcaatagaattaagatcaaatctttgatgaaaagatcgaacttttgatgattccatcaggactccaattcgcaaaagtgctacttcgcacacgtgccaactcgcacaagtgccacttcacacacgtgccaactcgcacatgcgaacgaagaacacgcaacggagaataataaacaccgtcagcttttatcgtcatttttcgccgctctcaccgaacctctgctttctctctctctctctctctctctctctctctctctctctctctctctctctatctctactgtgcgaaaatggcgatgaaggcttctatcaaaggcaagtacgatactgacaaaaccagtggaatcggttcacttgctttcaacgccggcgatattaagctacgcgccaccatgaccgatgctactctcgtcgccggtcctactttgaccggtctcgctctcgctgtagagaagcctggttccttcatcgtcgagtacaacgtccctaaaaaggtcagaacaactcttttgatttgagtcaaagcaaacaaatcttagaaatttttcaattcccatggaaatgagattgattgcttacgattaaacctaggattcaagtcaaagcaaacaaacctagaaattacgcagctaatgcttgaattgaagtaggatttaggattctggagtttagggtttttagattctccacaagtttaaagagatttgcaggcagacatttaagaatctatgtgcttaactatgttggtgattttggtttacaggatgttaggtttcagttcatg

SEQ ID NO: 32673 - DNA, 3000 bp, Unknown; identical to SEQ ID NO: 963
  misc_feature (1)..( 3000): 2750-1469P.txt file - cDNA_ID_3059866; gDNA_ID_1620342; Annot_ID_154021

SEQ ID NO: 32674 - DNA, 3000 bp, Unknown; identical to SEQ ID NO: 962
  misc_feature (1)..( 3000): 2750-1469P.txt file - cDNA_ID_3059879; gDNA_ID_1620342; Annot_ID_154015

SEQ ID NO: 32675 - DNA, 3000 bp, Unknown; identical to SEQ ID NO: 969
  misc_feature (1)..( 3000): 2750-1469P.txt file - cDNA_ID_3059887; gDNA_ID_1620342; Annot_ID_154013

SEQ ID NO: 32676 - DNA, 3000 bp, Unknown; identical to SEQ ID NO: 972
  misc_feature (1)..( 3000): 2750-1469P.txt file - cDNA_ID_3059894; gDNA_ID_1620342; Annot_ID_154004

SEQ ID NO: 32677 - DNA, 3003 bp, Unknown
  misc_feature (1)..( 3003): 2750-1469P.txt file - cDNA_ID_3059928; gDNA_ID_1620343; Annot_ID_154079
agggcttgcccctaagacctgtgagtttttttcccatgctgttcttttgtgctagcattaggaagccactgagaaattttgtttgtagtgctacagaacttgatatttctggtgaatttgattcaggacaaaaattatgatcaatcacacacttctccgattcacacttaaaactcattttcctttattttgttatactttcaggatcagagcatgtgcacacactacagccgatatggcatctgcaaatttggtccagcttgtagatttgatcattccataccgcccacattctcgcccagcagctcccaaaccgtagaagctcgtcaagttggcgctaacggaaatgaagatgacagctggcattgacatcacatgttgagaagcctgcgtaagggatactttttttctttaccatgataggcttttcagttcttaggaccaaactcttcttttggctttggaatttatgaaaacacatttaggtaaattatagtctccaaactacatctatctggcaagtcaatgcttgtttacaggattctcacctaataactactgttatgccgctttaactgtaactatctactctttcactaaggttcactctaatggaagcatgtcctgtttatgctttgttcttcttccgttggtgactctcctctgataaaaatttccttgatttctgcctagttttgttcatatctgaatctcaaaagaattgctagaacggagaaccaaacaacgacactatatgtacatagattgttttgcatacttctatgtcaggactcaggacacatgtttctgctatgattgtctggtgctgtgtggttaccctcttacaaggagttcacttttctgaaatcgaagccctaaacatggcctcgggttctttcagatagatggtgggatcaaatcttgtgatcccagtttcagcagactctgtttcaacatctttttgcccgacagattcttcttcaggtgtcagcaatctagccttatagagttaaagctcgcgacttcctcccagtaaaatcgaatgttaatttggttagggtttagagaggttgaagctattggaacgatgtacagaaagccatgtcgatatgaataatagctaatagcattatgtctgcgaaggacaattactcaaaatcttatttccatagttcttagatggagagtcaaaagatacaaattatatccattgtgcgcaaaatgttggcaaacaaaaagaaaggaacaaaaagtatactgaacaagtataatatcagcagaagagagaagaagaagaaagctgagatatatgggtctttaagcgttaacccttttgtttcactttgtttgagacctctctgcaaaactgcttcagcttccctacccctcggattcttcagaagatggcaggatttaacggaagcaaaaccatttgttctgcgcagaaagcataaatcaggtgagcaaatctatgttcttggataaagagctaagaagttgaatgtaatgagaaaaagaaaacaaccttagctttagggttttgggaactatggttattgttttgatcggagttttggtttctctgaggtgaaaccagactattagggccagcgccggatgctttcttggtcttcttctcgtcactagctttgctgaaaatgactgtgaatccttcggctgatgccggattgttcacatcccattccccaaactttggcaatggtttccctttgttttcctgcaccaaagaaacagagattcatcaaacatcaagaaagctatagagactttttctgaaactgatcatcgtggtgatgatgaaaggagagagacttgatgaagacgttgtttgttcttaccgccattgttgttgagatcaaagcaaaatgaaatatcaaagatctattgagagagagagagggaggtgggaggagagagaagggaaatgcagttgtaatatagagagaggaaggagaaacataagagggaaacacgtcgtcgtcgtcgttgacaacagcattaaccaaatcaaacaacattattacacctcttcttctttcccgcgtaaatccctaaccgtactacctaacaaataattttaaaacaaaacatgattaaaaaaagtgtcaagcatcccttaatacattttcctctagaacgtgcgttataaacgtgctattgagaaagtcttttaaagcagatttgcttattaatatgcttaggtcaattgatttttcaaaagacagaactgttttttttttaagatttgcaagaagtgtttgttaaaaatagtaaaaaatttatgttttaaaaagataaaacacaatcgtttaacttaaacatgttaattgttaagagtataaaaaacaatcaatcgctaacggttaattaagacaaatatatcacaaaagttccaataatatcaaaaagaaattccaacttatcagttttatttatttagcaatcattttcaaatatataacgtagaattactataattttattttatcgtttataactcgcacatgcacagtaccgaatttaaatctagattaccgtactatatcactagtacaaatcattgtattatataacctcaatcacatatacccagtcatttatcaatcattcaatcccaaaacaatgaaaaaacaaatttgatacagcttagttacttactactagtagccaaaagtagtagctcgagcacaataatttatgagaaaaggaaaagtatttcatcactaaatatgcatgtagtttatttactctggaaagttgtgagagcccagcccaagatagttttgtaagtagagtgattgggcctagcccagcccaataaagttttgtaactatattaggcagagagagttggacctagaataatgtctcaaaatccatctgtttggatgcagtgatatctccattcccaattgcctaaacccaaattagaaattttgcagaaatcaaattttgtcgctaaaatccccacacagttcgatg

SEQ ID NO: 32678 - DNA, 3000 bp, Unknown
  misc_feature (1)..( 3000): 2750-1469P.txt file - cDNA_ID_3059930; gDNA_ID_1620343; Annot_ID_154073
ccagaatatttactcttgaacaatatcaatcaaacaacaaatcatatacaagcaattatggtcacaaaaacaaaaacaatgtctctatcattgacactcctcctcttcatccttgtttctaccgtctccgtgacctcaacactagaaaacctttcaccggcagctgaaaacaaaggatattggtgtgtagcgaataaaaaagcaacagatgagcagctacaagcgaatatagattggtgttgcagctacgaaggaggattccgtgattgtacacagatcaatcccggtggagtttgctatgaaccaaatactctacgagaccacgcgtcgtacgtaatgaacttatattaccagaaccttggtagaaccaaagaccaatgcactttcaacggttctggctctgaagttactaaagacccaagccatgacgcgtgtattttcatatcttatgattaatgtatgtgtggtagatttttaagccgaatctccaaataagttgaaaatgctatatattgatcaaatatctctaatctctgtataagtttatatgtaactatatattggagtatattctcaacttatagaacatcttcatatttctcaaatgttgttgatgaattaatcatttttagtacatgatcagatcaatacttgtattgatggctaaagacttcataaacgcaagatccaactcataaaatgactttatgtatcttgaaagagcatttcaagttttttgaggtgataatatacattaaacctgatgctaataggaaaggtttttcttgctggactcgtaacaaaaaaaaaaataggctaaaatttcgattaatcctatgaaaaagaaggtatggaatctttagcacgagagtattacattggaaaggagcacatgctgtggcttatcgattagagacaagtggactgaaagttggattacattgcagttacgtggatgtgacaaaaaaagagtcaagaaagttgaaaatttcagttacgttgctagaaaatgtgattttcttaaatgatgcattaaactatattgaattttcctttataccttttaaattttacttataatataacaaaagaaataaattttaataatatatatatatatgacgaggaaaaacaaacaagtgagaagttacacatttttgcataaattatgaccaaaccttcttttcttcttatcaccttttgatttagcgtataaattgacacaaacacataaaatgtttagtctgtgaacaaatatcaatctataagcaataatataatggtcacaaaactgatgtctctatcattgacgctcatcttcgtcctcctcgtatctaccgtatccgtgaactcgacaccaagaaacctctcgcaggctgctgaaaacaaaggagtatggtgcatagcgggtgacaaagcgacagataagcaactgcaagcgaatatagattgggtttgcagcgacgaaggaggattccgtgactgtggagcgctcaattccggtggaccttgctttgaaccaaacacggtaagagatcacgcgtcgttcgcaatgaacttgtattaccagaaccttggtgccaccaaggaacaatgcaatttccataacactggcattgaagtttctaccgacccaagccatggctcgtgtattttcgtatcttattagaattctaattccgcttttatgtgggaacttgttaagcctaaactccagttaaataagttgaaaaaaaaactatataccaaaagtttctctaacctcagattatatcagttcatttcatcttacaaatgtctaattttgccggccaaaagaccaaaccggcaaaagcaaggcttgcggccgctaatagtagtatatggttttctttggccaatgttacaaaaaaaagttcttgcagtctagtgcttaaaacctcaggggttttgtcacctttacatgaatttgaaccttgaaaatagcttaaacatattctctttaacaacaaaataattaaataggtaaaaattatgtggccagtttttaattttctctcacttgtaacattgtgaaactctcggccggctctgtttgtcgttatgtcaatctgaacatagatgttacaaacgtccattaaaagagattatatagtgacgaaaacaattaatgtcttaatgttctcgtgaaattgcaattttctatgtggcaggtagactagagatatgagatggtaacaactctaattaaaagacaaaaacatcgctcaagagtatattcacttttacatcgctaaatatatactgaagttattagctcaagagtatttaatcatcgccaaacctccttatctctctcgcttacttagggttcttagtatttcatcaagaattcagcatcaaatatcatacacctttatacactttggtctttgtgtaagcaccaaagcgtctttcgtcaccatcattcactaaatgttactcacttaatacattcataggtgtcttttttctccaaaaaaattataggtttcatataagcatttattacatttttaatcttgttcaaatcaataactaaaacttttaaaagtagctaataactctttacttttttaattaataataaatatttgagttagttgtatatagttattaactcattaatttttttaaaaaaatatagccataaatgaaagatatctaagttaattatttttttggtagatatctaagttaattatgatatatcaaaaaatctaccaaatattataagaagaaatatatcataatttttttaatggaatacctttagagtatttttatttatttattacttcctctaactatctctccctagctagtatatatatacatgtacttgcacaaaaagataacacatcaaaactattgaatccttcaccacttccaatgtcgtcgttgcaacttttaacacttcttcttctcatatcaactgtctctatccccgtcgtgacttgcagacaatggtgtacgccaatg

SEQ ID NO: 32679 - DNA, 3003 bp, Unknown
  misc_feature (1)..( 3003): 2750-1469P.txt file - cDNA_ID_3059934; gDNA_ID_1620343; Annot_ID_154072
aggagtttggggaaaaaggaagagtttttttggttggttcgagtgattatgaggttatttctgtatttgatttatgagttaatggtcgttttaatgttgtagatggcatcgggtgagggaattttgacggatggacagtggaaaaagcttgaaatagcaactcataattctggaagtttgtcatcatcgcctaaatctcatactctctttgctgatctgaacattaagtctcccactggtggcaaaggaccagttgctgggattcctaataggcatgtgcgacgtactcactcagggaagcatattcgtgttaagaagggtattaaactttcttcaaccttttgtgcttgttatttggctaatagatccttttagggagtgatatgactctttattagttcctttcaaatttgctttagtgaaaagacttaagttttcagtagaagagttcaagtgtgtaggtgatatatggtttacttatgtggcaatgatatctgcagagggtgctggtggcaaaggaacttggggaaagcttcttgacactgatgatggtgactcctgtattgataagaatgatcccaattacgatagtggagaggtactttcatatttgcgccttttgttttgtgttggatacttttccttgtttctttagtgtatctaacatcccttgattttatcttttattagtagtttgcttttttcattcatatactcaatttaacaggacgcatatgatggacttgttgattcaccggtatcagacccgttgaatgattacaaaaagtcagtagtttccatcattgacgaatactttagcaccggggatgtgaaagtggcggcatctgacctcagggaacttggttcaagcgaatatcatccttacttcaccaagcgacttgtttctatggccatggacagacacgataaggagaaggaaatggcttcagtgctactctctgcattgtatgctgatgttattttacctgatcaaattagggatggatttataagacttctcagatctgttgatgaccttgcggtggacatccttgatgctgttaatgtccttgcattgtttattgcacgggccatcgttgacgaaattctccctccggtttttctggttagatctaagaagattcttccagaatcttgcaaagggtttcaggttattgtaactgcagaaaagagctatctctcagctcctcaccatgcagaactagtggagaagaaatggggaggtagtactcacactacagtagaagaaacgaagaaaaagatatctgaaatcttgaaggaatacgtggaaaacggagacacttacgaagcttgtagatgcatcagggaattaggtgtctcgtttttccatcatgaggttgtgaagagggctttggttctggcgatggattctccaaccgctgagtcacttgtactaaagctgttgaaggaaactgctgaagaaggactgatcagttcgagtcaaatggtgaagggattcttccgagtagcagagagtctcgatgaccttgctctagatatcccatctgccaaaaagctgtttgattcgatagttccaaaggctatttctggaggctggctcgatgattcatttaagataacctctgatcaagatggagaaaaatcgagtcaagacggaaagctaagacagtacaagaaggatacagtgaacataattcaggaatatttcttatcagatgacattcctgagctaatccgcagtcttcaagatttaggggcacctgaatataacccggtgtttctgaagaggctcataactcttgctctagacaggaaaaacagagaaaaggaaatggcttcggttcttctttctgctcttcacatggagctattctcaactgaagatttcataaacggtttcattatgctcctggaatcggcagaagacacagctttagatatcatggacgcatcaaacgaacttgctctgtttttagctagagctgtgattgacgacgtcttagctccacttaaccttgaagatatctcaaccaagctgcctccaaaatcaaccggaaccgaaacagtccgctcagccaggtctcttatctccgccagacacgcaggagagagactcctaagaagctggggaggtggaaccggctggatagtggaagatgcaaaggacaaaatctcgaaactcctagaagaatacgaaacaggaggagtaacatcagaagcttgtcaatgtatccgcgatctagggatgccttttttcaaccacgaagtagtgaagaaagctttggtgatggcaatggagaagcagaatgatcggttactgaatctgcttgaggagtgttttggtgaaggattgattacaactaaccaaatgacgaaagggtttggtcgtgttaacgacagcctcgatgacttgtcgcttgatataccgaacgcgaaagagaagtttgagctgtatgctagtcatgccatggacaatggttggatccttcccgagtttgggatttctgcaactcagtgattagtggttctcttatcagtttcttgtgtttgtgcttacgatactttcctcactatctacatatatgtatggattcagttagtagataaacatgagatgtttatatgttcatgtgtttctgtctggttgttgtgttttgtctttgtactgatatcttttagtgtgttctaatttctgatggatttttgttacattgaaaataagttattagcatggttaatttgtgttaacttattactcttgtgatattttatgaaaattatttataaatatagaaaatatggtaattaaattataaaaagataaataaaaatatatttgttcggtcggtgagataattatgactccggttccgggatagagcaaacaaaaggatagaccaatactcgttgccaaacagctttatcctcgtttttatatttgttttgattctttcttcttctgctcaactttactgtccggcgtactcagcaccatcaatg

SEQ ID NO: 32680 - DNA, 3003 bp, Unknown
  misc_feature (1)..( 3003): 2750-1469P.txt file - cDNA_ID_3059938; gDNA_ID_1620343; Annot_ID_154071
atagactatatagcatatgaacacttcgggtgatttattgcgcatgcaacttgacgttaattggacccaccttgcttaacctttttcctcttcttgtgaaattattttggtgtgtgagaatggaatcaacccaagtcattttagagaagaagaaataatgcaaaatgtttcctaagattcaaatttcatgatacctgataaaaagtgtttggctgaactaaaaagtgttgttcagaaatgtaattctgatcaagctaaacggagctggttatgatttaaaaacggaaggagtaatatcagccatcattacaaatataattggctcaacagttctaataattaagattatcaaaccgatagcacttaatactgtattcaacattcaggtaacgctaggaatgagtcacgtggcttaaagaaaaaaaacacagaactcgtaattaaaatctcaacgaacttaaagctgaatgttggtgaaacactaagtacggtgcaccaaaagtcaacactgtgttagtaatgtactttagtactaatatttaatattacggtttaatttttgtacctttatcattacttttacgttttaacggttgaatattatcaatagcatagcagttagctcaatttaactgattttttttttttcctttttttttttttttgttaaagctcatatagtaaagtattacatttcgagatactttagtgtttctgctatctactaaaccatattttgataactaaacgtatatggattgtaattgtaagaatacgatatttgatacactttgaattgtttgataagttggttttagagtgtttgttattattattatctttatacaaaatgaatttcttttggtgtctcaaagagatattgcttgcaggaaaagagaaaagaatagacccaccaaaagcaatagaataggagaactgagccgacactggcccatagaggtttgattttgggaccaccgaaccatgtgctcgagtccaatctttcaataaattctacacatataattttcttaaattcatataacgtttttagaatagtagtgtattcattcatatctaacaatcagaccctatgttgaaattttggctggtacaaaatgtgttgacaatcaatgcacatgggaagtatttgcatcatcactctatatcctcctcctcctccacactttaaaaagaacaatgtctttaaaaacttaatcaactattcgattacaagtctcgccgacatttttctttttgctagagccattcatgttgatgaattttcacttcgggcaaaaatatggatcatgagtttaagtctagttttttttttttaaattactgttagtagcaaattattttatacattaagcaaattgtgtattctggtacataaactgcagaaaacaattaaatgacatttctcactacattttagacagttttggacattcattcgattagtaaatgatttcgttctcgtacgtgatgaaacacgagaaccgatcgacattaatgttcctttttcagaatattctcaacgctcaaaagctaatctatatacatttttcactactttttacatgattcatagaatacaaaaataattgaacgcatttgaataagtaactaaatatagagtatgataatatctaattcaaccattttaattattgactacattggcttatcaaactgaaacttgatcatttggataagcaaacttaacaaattaatgttttgaacaaatgctcaactttacaagttttttttgtcttctatacgaaatcaattcaagtttcatgacattgtcttgtgaaaaaaaaacaagaaaaaatgtagagaattgacctttctataaagaaatagagtcgttagattggatttaaggtggtagatataaagaaaaccgtcggatcagaaaatagagacaaaagggcatgtgaccggtttttgcttgaaaactacttgctaacttcttctctactcatttatcagtgttataatttttttgttttttttatacacatagtacgttcactaaaataacaatttaaaatgaatattgatataatttagtcataataatttgaaaaatataaaatacaatatccatatctgttttaaaactataaacatgatggccatgatctaataatatgattccatgaagcataaaacttttattaacgtagtcaaccattggatattgtccagcccaaaatatctaattcaatgggccgaacctacccaatacagcccattgttttggattaaaatctttaaaaaaattggaggctaaattaaaaaaagaaggaaatattctaagccctccacgtattacgttgatgacgtgtaccatcgtatataaacaaatgcacaaaactttattatattgttgtaaagtagtacttttattggcgatcctcatccatttcctctctcgtcgttgtctgggaatcggtgacttttgaatctttgcgactctcttgtagtgataaattgatcgttatctactttgatactctccggtcgtttttctccggtgctggagatccgattccttatcttttctgtcttggctcgagatccgagccaagcagtaaagaagacgactttgtttcacgatttggaatttgattcctgcgatcacaggtatgacaggttagattttgttttgtatagttgtatacatacttctttgtgatgttttgtttacttaatcgaatttttggagtgttttaaggtctctcgtttagaaatcgtggaaaatatcactgtgtgtgtgttcttatgattcacagtgtttatgggtttcatgttctttgttttatcattgaatgggaagaaatttcgttgggatacaaatttctcatgttcttactgatcgttattaggagtttggggaaaaaggaagagtttttttggttggttcgagtgattatgaggttatttctgtatttgatttatgagttaatggtcgttttaatgttgtagatg

SEQ ID NO: 32681 - DNA, 3000 bp, Unknown; identical to SEQ ID NO: 979
  misc_feature (1)..( 3000): 2750-1469P.txt file - cDNA_ID_3059942; gDNA_ID_1620343; Annot_ID_154067

SEQ ID NO: 32682 - DNA, 3000 bp, Unknown
  misc_feature (1)..( 3000): 2750-1469P.txt file - cDNA_ID_3059953; gDNA_ID_1620343; Annot_ID_154063
caaatttgtttatagtttgaccaagttcaaagattattttaaaaggctagactagcaccaaacaaaactacccgccacgccacattgagaatttgtgagccgcacaaagatctgttttattttgttctactttaatttatttactttgttgtgttccaaatagaaaatacaaacttatttccaattaggcaattagcataaatgtttagaaggaaaaaaaatgaagaagataagtttctaaatattccgagtcagcgcctcgtcaacgtgtggttagggttggctccgaagaccatgggaagctggtcaggtcaacggtcatcccgatttttgagttagtcaaccatttattgtaaaaattaaaattttaatcttggtaacatatttgatgaacaataataataataaaaaaactagatatttaaactgaatgtgttgagcatgttattttttcgtgttagacttttatgtcaaaccataaaaattatttattggagaatgtatatggaaatatacactaatatacatctttctccaactagactatacacacaattaaaaacattaaaaatctactgttttcagtttttataagtacatcgctgattcatgatacttcatacttggctacttgcattatataaatgggcaatatatatccaaagtccaaactcaaaggataagatcggagtataaacatgcacatcaatctccagtgcttcagagttcaagtggaatacaaacaattttagaatagaaagtgttcagtaatattttaatttctaaacccttaaatgtgttgggaagaatcttacatgaaatcatcaaatccattagtttattaacacttttcacttttctcttccgtcgaaacttatccacaagttttggattttgatgtttcgttttcttaaagagccatttgtgaatacttaaagttataacaacaacatgattaatatatcgaatatacatatacttgtagagttaatgaaaggaaaacacccccgacatcttataataaaatgttataaaactaaaaagtgtacataaactactactctgaaaccttaacacattaattttccaatagttagaaacttagaatagttatatggccttatgagatgtctacactagttgttaaatgtcaacacggatattgaaatttcttggaactgattctgaattcgtttaagtacttcgtttaagagcttgatgcgcaacataaagctcttatttgacacgtgtcatgatgttaatggttaagcttgactgccatattggcctagactaccagatttgccacgtgtaatatatgcggcgaaatttatttcattcttcgataagttcttcaacatcctatgatgttcaggcattcttaaaccacaattaacaaaggccagtggcagaaatggataaatgagagaatgacaagtggatagacaagagggcttgagagtggatgaggatcaacaagccacgtagacgaggaggtgggctcttgggaagaggcaagggtcggtttacttcaataaccaccctttctcaaacttagaataatactactatcagcactttttctacatcacaaaggcaaatttcttgaccggttttatcacttttcccacgtaggatcaataaaaaaagataaacattcgtgacttcatgaatcatggggacaaacatcctacatggtaccaaaagtaaaatacattacttgttttattgtcatcccaaacattacaaagggccaaaggcaatattatttctagatactttcagtggaaagtattaatatatgtgtgtaatgttgggaataaaatatagtcgacattggtgtatcgaaaggtccatttaaaaacataatatattgtaatgatctataggttagatcctgttggtatatcaggttgggaataagaaaatacttttgttatacaatgtattatagaatatgttgtgttagggggcactgcggctatttgacaatgtttgaggcatattagtcctagggaagtttataataagctgcatcaccaaatcctttatacatatctaagcgtagtaagatgaatgtaactgatcatagattttaacatatgatatgagctctgaatggagaaaatatatttatctaattaaataaaatatgtcattcgggtccaaaaatgatatgcagacttaaattttcaaactattcaaactaggaaaataaaattgaacttatcttctggagatttttttttttttaaattgtgctttgtatatttattagtccaatataaacataaatgagataagtacacataggctttttgttgttgggtttgttcacatttgttagttctttttttctgtcaaacagtagtatattttcagtttttctgcttcaaattttgtaagcaagaagttctgtttcattttagtttataaaaatttataacaacatgtaactatatgcttttaaagtagactcaaatactgggtgttatctgtgtatagattaagatacaactaattgtatctgtgtcttagtgtctatatatacgattatctatttatcaaaacggaaaaaccatagccaattacttgcatttgggttggtgttaaagacaaccgcaaattatttatcaatgaatcataacttatctcagagaaatacagatctgagaccccaaaactcctgaatatacagttcactacttttatttccaattattctggttaccaaaaaaacagagattaattgacatacacgcatctacaaaggcgcgtagggtaaaacagaaacaaaaacaagatatttatcataaaaaaatgccacgtgttattaacaagtaatcaaaaaggaccagacttcgttgagctgtgtctataaaatccagagaagcaatgccctcaagcttctccatcatcaaattaaaaccctccagcctccaacaacaaaatttaccaacactctctctttctctttctctctgaaaacttaaaacgatg

SEQ ID NO: 32683 - DNA, 3003 bp, Unknown
  misc_feature (1)..( 3003): 2750-1469P.txt file - cDNA_ID_3059957; gDNA_ID_1620343; Annot_ID_154061
tcggcctcaagattatttatccggtttcttgctcaaactcttcaccatctgattcctctgcattatctgcatcatcatcctctgcttcattatcatcctcttcttgttcgttgttgacgactggttttccaattaccggtaaagcaggactcatctttctgatctcgttgcactgcaccaaacccaagacaacaagaatttacttagaacttgtcttaaaacattcataacaacaacactgaaactgacaattagctctactgatctctctcacttttgagctcccacgtctatataatcacacaatctaatatatttaagaagaacatataattagaggtaacaccaacacatcacacgacaaggagacatgttgtctaaagttcacaatggctaaattccaaatctgcaaattttgtctttgcttctttcctttcacttgctagtgattcaggaaacggaactagttttcaaacattggaaaacatgtaacaataaactcaaatccttttccatactaaatctagaaaccaaaaatctctccaatttaaactcgaagatcacccttggatctttatacattattacgggtctaaagctataagatgatagtccaatgaacacaaatgcatatatccatagagtctacactggaaaaaccactacactagaatcacaactcgacattggtatccactaaaattctcacttttgtactaacttaaaactcaaacataggacccaaaagaatatgttccaaagcagaaagattcagaaactcatattcatcttatcaatatgaagtagagaagaaagtgatctgcctaaaaccaaaatcatcaccacggatcgaaaaagattgatcatttacaaagtagaaaccacttataatctcgaacacaatcaataaatttcactcataatcagctcaacttacatgaaactaaagatctaagattgaccttttatgctgcctgtagtgacagtcgaaaactgaaaatttcctattcagcagattccgaaggagaacgaatacataaataaaaaagaaggaagctaccttttcttcgaactcagcttcttccatggcgagaagaatctcctcgttctgcggctgaggccattgtaacggaagcaaatacgatgccggaatcgtcttcgtcgacgacggaaattgggtcatcaacgtcggaaactgtaacattcttcttctcttcctttttctctcttaacgaaaattgatggaaaagtaaataaagaccaaaaacacagtgcatttattattgggcttttatctgtttagcccattgttattgggtaaagataaatataattttgactatgagtagggactaaatgttaaatttgggcttgtaaaattacaaaagcataatttgaaacccattgggccactccctaccttccgcgcgtgacttaaatttgaaactaactaacaacgtcttaaaaattaaaactctaataacaaaaacgtaaataggcatctgatcttttgattggtgatggaatagtaacattccaaatattttgattacccataaaacatcgaatcttgcgaattcatagtactttttgtattattttttgaaagctatattaacattttcgtttatcatttatggtagtatttatgtatcttgttttaggttttcgaaataaacttgttcatgtcaaaagaaattgaagaaattcaaacgaataaaattaatcaactctaataattttcttatatttcaccagtctactatcataatgaacatacttaattgtaatgtttgttagtatgttttctaaaatccactatttaacttgcatgccattgctgtttatatacggtctctaacccccaaaggagccaattatagataaaatactgactatcaattttgcaaatttggtggtgtgaatagttgtaaaggctgtacattgcgtaaaaaaacttagggtaaaataaaaaagcatcacatagttattttaaaaaggccaaacacacctttaaaaaggataactctttacacctttatcccacaccccatttccttgtgagaaagaaactatgcatgcgggaatataacaatacggctttgcttctcaatacaacgacataaaaactctctttataagactctcacacacacatatgttgatatgtataatacacgtctctaaatttgtgtatctatctacattacaatatatatagtttgatatcaatctacaattgaaagcatatatatataagtatgtttcttgcttcagttcttcaccaaaaacttgtgttcttaatcttggtttatcacgatgaaattgttgtcgatgatgatgatgatggaagctattgtcctggctaactcaccttgaggtcctcgattccattgatgacgctaaatggggaataagcattcctggtccgatccatttcatgtcacttaaatcttattatttcgtataataatcaaattcaatgttgttcaagtttgtattcgatgttttaatcacttacgtatgtattttctcatggaatgtatcgtcgaactaattattcaaaacgacctttattttgaaaggaatgcttttttattaattggaaattacaaacgaaaacaaacaatttgtgtccccaactatattttttggaccaattaactaatcactaaaggtctcatgtggagacttaataaaccttaaatgtaattgtcattatgagtttgaatgacgttatgctgagttcaatgagaaaatatggttggtaattggtagttgtgtgtcataactcgtaattaaatcacgccacaaataattaactcgatgctaattaagaataaaacctcttttcaaaataaacaaaattaaaagctttccatgtcaaagttgcttcctttggcttcttcctacacacttgcttcacatgtctactacactgactgactgacacaacgataaagtacacttatcgtgtttcttggtctcatcataagttcaatg

SEQ ID NO: 32684 - DNA, 3000 bp, Unknown
  misc_feature (1)..( 3000): 2750-1469P.txt file - cDNA_ID_3059961; gDNA_ID_1620343; Annot_ID_154057
gtgcacaacctcgattaggtgagtattacagcactatgtgatattctgatttaagctgcattcatttttccggcaacttttttatttgcattgttggggtgtaatataggtcaggatgatggccccattgtgttaatattagctcccacaagagaactagctgttcagattcaagaggaatcaaggaaattcgggttgaggtctggtgttagaagtacttgtatctatggtggtgctcctaaaggacctcagattcgtgatcttagaagaggtattttattttttaatagtgtagttttcatgtctggttcttggatggaacatcaaagtttatgaatcatgattggcttgtcaggtgttgagattgtaattgctacacctggtcgtttgattgatatgttggaatgtcaacacactaatttgaagagagtgacttaccttgtactggatgaggctgacagaatgttagacatgggatttgaaccccaaattagaaagattgtatctcaggtatgtttgtactttctccaaagctatcatgtagtgtctttaaggaaagggtggttgaccaacattattagtcgatagattttatcttcccagtttattgttctgttgctaaataagaaccatcacggcttttgttcagaacttgagattgttccttatttttcacagatccgacctgatagacaaacacttctttggagtgcaacatggccacgagaggttgaaactcttgccaggcagtttctacgagatccatataaggtttacttgctatttagtttaacttattaggattgagtatactgttgttgaataaagtaggggatgttttatgttgtgcactgaaaacagttgttattttgtaggccattattggatcaacagatctaaaagctaaccagtctattaaccaagtaatcgagattgtaccgacgccagagaaatacaacaggttcttaatttttctgtcattagataagaaacgatttatatatatatttatttgccttcttatatgatatgatacttatgccttttttctcgtttgataggctccttacactacttaaacagttaatggatgggagtaaaatcctaatttttgtggagacaaagagagggtgtgatcaagtgactagacaattgagaatggacggatggccagctcttgccatacatggtgacaagacccaatcggaaagagaccgagtcttggcagaatttaagagtggacgaagcccgataatgactgccactgatgtagcagcaaggggacttggtaggattaactgtgatacacaataggagagattatacttagagcatttcgttttcttggggttttaaagataataaaaaaagtcgcctggctgccgctttccacagtttcctctggtattagggaaaaaagcacatagaaagaaaaaaggagcttctttgaagaatttgtttcctgcatccatctcccgggcatggagctgattggtttttgagcagcctgggcgactgacacctgcatgcattaatagtgttataacgccgtcccaaacactccttatccctgcaagttaaggtgggcacatttacttgggaaaaatgtgttgctcttagtttcttgatctttccagatctgcagttgtagggataaggggttcttgttctctatcctctccttagctaggctttaaacaccaaactcatttacacaaagaaatttctgttcttcttcctgcatttcatctcagtctatgatttacttctcaactgtgttccttctttcttcttttgttttgttttacagatgtgaaggacattaaatgtgtggttaattatgatttcccaaatacattggaggattacatccataggattggtcgaaccgggcgtgcaggagctaaaggaatggcctttacattcttcacacatgacaatgctaagtttgcgagagagcttgtcaagatccttcaagaagctggtcaagttgtacctcctactctctccgcactagtccgatcatctggttctggttatggaggtgaaacctcatttctcttctctcatttgatgagttcaatcaatcttgctaaattttggtacgaggatctgattcaattttgttgatttgttcaggttcaggtggtggaagaaacttcaggccaagaggaggaggacgtggtggtgggtttggagataaacggtcaagatcgacttcaaactttgtacctcacggtggaaagaggacttggtaaagagaatcccatcattttgattctatgagaaaacctttaattatgatgatgatgatcagcgtttggtttcgactagaagttctttgtcgtagagaacaaacatttactatataactatttagctgatttcgctgcttcttcttcttcttcttcatgatatttctaaacattttgcctttttcttaattctatcaactaaatacactttactactttactctcaagtcaaccgtaacactgtaatgaaacttgtttttaaaaatcggatgtggattattaggttgggagattcaagtattgcgaatagaatttagacaaatgtaagcatctataacatctagaacatgtatatcttctcttttttcccaacaacatctagttacgaatccttaaggtgaaatgtgtaaatagatcatacttagctaaaaaaccctttacatttatttgtctaacattgtctaccattaggaaaacaagttaaaaataattcgctatgtttgaatcgaatttggaattatataatcgatcgttagtttaacattcagtaattattaaaattaaatttttaacgcaaagataataatgtaagtaatcattaatgtgcgtgtatatataagctgtgcccacaactcctagtaatgactttctcaggcattgttgacacaaattttgctctgagtaaaacttgggaatagagagagactctgagtgagagagagattctgagtgagagacggagatg

SEQ ID NO: 32685 - DNA, 3000 bp, Unknown; identical to SEQ ID NO: 984
  misc_feature (1)..( 3000): 2750-1469P.txt file - cDNA_ID_3059994; gDNA_ID_1620344; Annot_ID_154098

SEQ ID NO: 32686 - DNA, 3000 bp, Unknown
  misc_feature (1)..( 3000): 2750-1469P.txt file - cDNA_ID_3060002; gDNA_ID_1620344; Annot_ID_154095
ccagtaacactatagaaaaaatagactgaactatcgaattatatactttacaaatcattaacttatggtaaaaacgtttataatttttttgttttatggtatatggtaatagcttttggaacccgcacaactagaagtaaaagaaaaaaaacacactaaaaaagttaacttttatacattttggtttttggccgattacatttatgatttatcattgaattgcaaaataatttatttctgtaataataaacgcgtaattagatctatataaaccctaaaccccatcactcacttactctacccctggcttctccttcaagctatactctcattctctctcctccgaccaaagttttctgttcctccgcttctccttcccctaccggtgcgacttctcctctcttttatcttctctctttgtttattttaacgccggaaatgtttctcacttgtacgttttggtttccgatgtaatctctcgtcttctctgtttcttgaaaatggggttttgatttctgggtttgatcttagctccatcaactttgatgcttccccttgatcaaaggattaaattctacagtggagattatctatctgcttaccaaattttgatcagttacaacaaaattacaaaatcagaattagccctagaatttgttttttgttgttacagtcccattcattgaaaagtgtcttcttctatgtgtaggtgcttcgttttgtgttgtacagcagatgtctgttgatatctgcaagaagaatccatcgtttctttggtgtgactgtggatatatgagcagaggaaggttgtggtgctttcagaccatcatgttttcttcttcttcttagctttttgtctctgctagatcttgttattgtgagttttttgctttactggtgagggaagttacttagtgtagtgaaagttttccccttgtcttccaatggggaaaactaacttggcacctggttttcggtttcatccgactgatgttgaacttgtgagatactacttgaagaggaaagttatgggaaaaaagttccaagttgatgccattgctgaggtcgacatttacaagttcgaacctcctgatttacccggtaactaactcattctttcagaaatctttgttctgtttcatgctttcttatttatttcctgattactaacagaggtttctttacattgtacagacaaatcatgtctagggactggagatcttaagtggtacttcttctgtccaagagaaaagaagtatcccaaaggcggtaaggcaaaccgctctactgaatgtggttactggaagaccacagggagagacagagatgtttcttataatgacgaagtcactgggaagataagaactctgatttatcactacgggaaaatacctcgcggtgatcggactgattgggtcatacatgaatatagacttgaagacaaagtactggctcaaaagaatgttcctcaggtaatgacgattcgttcttgtctttttttaacgttttgattccttgcaagtttactaaacatgcttgttgtgccctgcaggatacttatgtgctttgcgttctctttaagaaaaatggacttggaccaagacatggatctcaatatggtgctccatttaaggaagaggattggagtgataaggaagaagaatatactcagaatcatcttgtagctggtcctagtaaagaaaccagtctagctgctaaggcctcacactcgtacgctcctaaggatggtttgacaggagtgatctcagaatcttgcgtctctgatgtgccgccactaactgccacagtgcttccacctctaacaagtgatgttatagcttacaatcccttttcttcttcacctcttcttgaggttcctcaagtatctctcgatggtggcgagttaaattcgatgcttgatctcttttctgttgacaatgacgactgtttacttttcgacgatttcgactaccataatgaggtaagtctgtctctgcatcatcatgcttttgatgaatcagatttcagtgttcctgaaaagaaacttgttttgattgcttctgaaactacaggtaagacatcctgatggttttgtaaacaaggaagctccggtgttcttaggagatggcaatttcagtggaatgtttgacctgagcaatgaccaagtcgtagagctacaggatctgatacagtcacccactcctcatcctccttctcctccagctcaagctagtattcctgatgactcaagaagcaacggtcagactaaggacgattaagtattttgtgctgacttatgctctttcttgctttggtctgatgctccatggaaacagagaccaaacatgtgaagctttagccagaacgtttctattgttgccatctctgtctgcacgaaagaagagacaaaaccatgaatcagtaacttgaaaccgtccagtagtggagccagctttctatgttatgtttctgcaactgcgttgtctgtagtcttagattttcatcatcatttatgtatgtggcaaagaccttcgctttaactagtgtaataccatggattcttagcttagcttcaatgataatgccattaaaattcagtcacaggctataaggatgaatgtgaacgaacgtcgtcgtttggggaaatacaatgccacaattactttgactttgcttcgcaaacatagtacgaggatgtaagtagaaattaacaaaggttatggggtcttttagaacaatgttactttccagaccagacgacaagacgacgtcgttcctcaaatagtccacgtgtctttcctaataagtgaattttagcattacaattgtcaattggggagtaaataggttgaaaatataatatggggatgtaattttacaattaaaacagttatgaggctttaatcgaatttgttgctttgctttgcgactttcatctttccgattaatcaaatccttttatcctctgaaaaatctcaactttcgaagaaaacgaaaatg

SEQ ID NO: 32687 - DNA, 3003 bp, Unknown
  misc_feature (1)..( 3003): 2750-1469P.txt file - cDNA_ID_3060026; gDNA_ID_1620345; Annot_ID_154144
atttcatgaccttaactattgctttaatacaggactgaaacttccaaacatgtcactagattagcaaggtttacaatatagcctaaccaaggcatcttcttaagttatccatgttccaagagtaataacctatctgagaaaactgtatatattaaaaacaagcacaactttgctaacatgtcaaagcttcccaaagcagccaatccaagataaaaccaaaagatactatctttatattaactaatagtaccacaaaaattaaaatctcagacataaaatttaagagcgaatttgtagagaaaccaaacctgggtttgtcacgtggggtattgaagttgtcatagaaccttcaatatcacgattcagagcagcttggaacgcgtctacgtcagctcctgaatgcatcgattcatcctaaaataatacaattcgaccggaatcaaaaaccacgaagacgattccagatacatcacacaaaattggattttgaaacgagtgagattagaaacctaacctcatcttcttcaaggagcttgaaaattgaaggatccattgaaatagctggggaaggcaaagagagaaagagagctctcggcgtagatgaattaataggaaacagatgttataagattagtcctaaactaacctcatgtcgtttattagctttgttttagcactgtatgtcgtttttaattttgatcgaaaaaaaacgataccgtttgttatggatgagtaacctcatgttgtttattggtgttcttttaaaaactgcatgacgtttaatggaatacgaaaaacgctgtcgtttgctttattgcgtggagagatatatcaaactttatgtcgtttattggttttggttaagcactgtttgttgtttgcgtgtattgagactaaaagttctggtacagagagagagatacatcaaaagtacagtgtaagctgccgccattaacgaagcatcggcgaaaaaagaagatgaatatcgttggattgagcaaacgtttcttctccgatcgtcgctctcttcacgggatcaacaatgctctcttgaaaacagtgttcaccggtcggaaaccgattctcggattctccggccgatcgattcacgagctacgcaaaactgggaatttcgtaatccctcgtgttttctccgtgtcgcgaaatctaacgacgaaggcttcgtcttcttcttcgaaacaacctgcgtttctacgatggtatttgagaaagctcgaatcacatccttttatgactaagagtatcactacttctgtcatctatatggctgcagatctcacttctcaggtttttttttgaatctttgtagtttttggaatttagggttctttctcatttcattactaattagagaattttgttaaagttttgaattttatctcttgatttaggaagaaaagactaatcttcatttgttattataccaagacaattccaaatttgatttgaaactagatcataatcttactagtggaagaagttataatactttagtaaagaataggtggagatagcactaaaagttggtgttttttaatgaattgttattctcatatttttggtttagtctgtgttctcaactgttgttctttgatgtgtgagactgtacttacagtgtttactgaatctgtatattgtactcttgtgaatttgaagtctttctgtactgaataatggatgaatttagtattggtttgattactcagaaaactcacactccaatccgaatagtctaatcttcttgttattatctcttgtgaatacttattgctaaggtgaaaaaagctttaggtgtgtgtgttggggttcttgtaaactctgtttttcttcttgtcattagtggatttctcttttgagtctttttatgatcatgttgtggtgctcttcccccagtaatatgttagagcgaaactagagaaccttttgttttgttttatttgtgttgactctctaaattcttcaacagatgatcacaatggagccaactggttcttttgacttgataagaacagcgagaatggcgagctttgggttgatatttctcgggccgtctcagcatctgtggttcagttatctttcgaagatattgccaaagcgcgacgtgttgacaacctttaagaaaataatgatggggcaggttcttttcggacctgttagcaacacagtcttctattcctacaatgctgctttacaaggtacataacataatcaaacctctatggattgaacggatttagctttttacggtttctctgcctgtaaatttatggtgctcattatgagattggttctggcacgttgttggtcctttttaaggcgaaaattctgaggaaattgtggcgagattgaagagagatcttctgccaacattgaaaaatggacttatgtattggccggtctgtgattttgttacattcaagtatgtgccagttcatctacaggtaaaccaaatatctatcttattactttctctattgtttgggatgtttgaagacacttcttaacttcaacttgtaatcttctggttgcagccactgatgaatagctcgtgcgcatatatatggacaatctatttgacatatatggcaaaccagacgaaagctgacagctgaacaatgacaagtatgagtgttctgggtcacacgcaatcgcattctttttattcaattgaaccaaccatcagtactagtagattttttttgtttttttggtgtctacaatgcagcaaaagtatcgcatagatatggacataaacatgtatgaattttgatcatctaagcatatatttatcaggaagtctcaaagttccatcgcgttttactgcgaaaacttgcttcaccatcttcttttactttttgttactttcttgtaacattttgactaaaaaaataatttggtttatttttgtttatttaaattaatgccaaaaataaattagggtaggtaaaactagtatgaggttaaccacataattcacaaatg

SEQ ID NO: 32688 - DNA, 3003 bp, Unknown
  misc_feature (1)..( 3003): 2750-1469P.txt file - cDNA_ID_3060034; gDNA_ID_1620345; Annot_ID_154140
tccattggagggaagaaatggaaaccaattaaaatatctcagactgagccgaagctctcacacatctgttttgcagacgatctgattttatttggagaggcttctgttgaaaaaattcgggtgatcaggggcgtgctggaaaggttttgtgttgcgtcgggccaaaaggttagcttggagaagtccaaaatctttttttctaagaatgtctcaagggagatggggaagttgattagtgatgagagtggcataaaagctacacaagacttgggaaaatatttggggatgccaattcttcataagaggattaataaggatacttttggagaggtgcttgagagagtctcgtcaaaattggcgggttggaaagggcgtacattgagtttggtgggcagattaacgctaactaaagcagtgttgaattcagtcccggttcatactatgagcaccattaaactgcctcagtctacgcttgagaatttgataaaatctctcgctcttttctttggggcagcacagcggagaagagaaggcagcatttagttgcttgggacagagtgtgcttaccaagatgtgaggggggcctaggcattcgttcagcagctaacatgaatagggctttgatcgttaaaattggatggagagtattacatgatcgttccagcctttgggctcaagtagttcgaagcaagtatcgagttggagaagttcatgatggatcttgggctctcgctaaaagcaactggtcctcgacttggaggagtgtaggcctggggctgcgtgatgcattttgcaaggtgttaaatgggtaatcggggatgggagacagattcgattctggacaaatatgtggttatctaatactccacttattgatgaaattacagctccaattccaccgaatttggttaattgtacagcccgacatctttggcagaatggagagggctgggacatgttgagagtagcgccgtttgtcacagagaataagtggttggaactcttggcagtggtagtagatggcctcacgggagttttagacatgctagcttggggagagtcctcagatgggctctttacggttacatctgcttatcatatgttgactggaaatgaggctccgggtcaagatatgagtagtttctatgggagtgtgtggaaagttctagtgcccgaacgggtaagagtctttctctggctagttgtaaaccaagtcattatgacggattctgagcgaaaacgaagacacttgtgtgagtctgatatttgtcaagtttgtaagggaggcgttgaaacaagtttacatgtgctcagggattgtctggctatgacaggtatttggctccgcattgtacctaggcgcatgcaaccggggttcttcactatgtctttacttgagtggattcacacgaatctgcgacagagtggtaataaagaaggtagtgattggtcgactttgttcgccttggcgtgttggtggggatggaaatggagatgtgggaacgtttttggtgataacaggagatgtcgagatagagtgcgtttcttaaaggatgtagctgccgaagtttctttagcgaattcaaaaaaaagggaacttaggccggtggtggatcgagtgggcaggttaatacaatggacggctccaactgtaggatggcacaaactcaatacggacgatgcctcacgggggaacccgggcttaacttcagccggaggggtattgcgggatagtgagggcgtttggtgcgggggatttgcggtcaatattggtagatgctcggcccctttagcggagttgtgggggtgtactatggcttatataccgcttggggaaaacggattacgcggttggagttggaagtggattcggaggtggtggtaggttttctcaaacaagggataggtgagactcataccttgtctttcctggtacggttgtgccatggcttcttatcaaaagactggatagtgcgtatttctcacgtttatcgggaggctaatagtcttgcagacggtttagctaaccatgtgttctctttgcccttgtgctttcatatttttgattcggttctttttgttgttgatacgctgtttatcgaggataataacgggcctgggcgcctgaggcatgtacgtttgtagtttttttttctttagttttttttaatacaattccggggatttatccccgggaaatcaccaaaaaaaaaagatattctagaagattttatactcctaattttactccgagctaaactcggatctttgtatttatatagatacacaagagcaaaatttttagtattagcacgaaactccattcgagctaacacacctccgccgtttttgtctcttcttccgatctcatctcatctcatctcatcgatcacctactctcaaggttaataacctaagacttgatccttagaaaaaaacaccaaagtccatgttttgattgttcggtcaatatatagtcatggttaattgattaagatgtaactgatctatatgcttcggttcatctgttattgttatatttgattatcgatcatcgttattacgagttgcttgtcaatcgttactacttattagttctgtgtcataattaagctttattagggtttttatttagaataatcgttcacaaactgacatagttcatattgttttactaaaggcacgttttatagatttattgattcatgtattgtttggtttggtataaatcgttggtttaacctagtttgagattctgatgcttaacggtttttttttccgatattcatcatcaagattgtttataattatacataaatgccttcaccatgattggagcatgttacaatacattcactgcataatattgaagattcacagttatagttttactcatgattactctttcattataaatatacaatataaatctctaattaattaatatctctctctctttttctgtttagatttttcagctcctccttgattttcaaaaccatg

SEQ ID NO: 32689 - DNA, 3000 bp, Unknown; identical to SEQ ID NO: 998
  misc_feature (1)..( 3000): 2750-1469P.txt file - cDNA_ID_3060052; gDNA_ID_1620345; Annot_ID_154128

SEQ ID NO: 32690 - DNA, 3000 bp, Unknown
  misc_feature (1)..( 3000): 2750-1469P.txt file - cDNA_ID_3060085; gDNA_ID_1620346; Annot_ID_154181
tatcttttaatagtggaaaaaagatgttttgatattaataagttacaaactcataacaatctgcagacaagatcttaacatgttcaaccattctacatagcaaaaagatgggtttgcgctgtaccttcaagcaattaccaatggcagtgagatgatcagcagaaaaaaacttcccggaactgaaaggaactggcagtagcttgctaaatataggatgatcgactgaaaccttttcatggagtttcagcgctaagagcaaagcatctgggtttcccacctcggtggcttgttcaaaccatttataaagttctggagcttccataacatgagtaacaacaggttcagtaggcaactgcacaataaaaaagataggatcacaaaaaaacttcacaatgtgtaataaacccgcactaaactttgcacataagaatgaatctattataccttgtcaacaaagtctagaagaatatgcacagctggttcctgcaagtaacgcttttttgcagcaagaccaataagagcattggtaaattctttgattatcggagagtctttatcagattgccaatcttcaatcagtcttccagaacgtgcaagcgcaccataagcaaacaatcgacccaataagcattcctttatatcctgtgtcaatttcaattcaaagcatatgagtctctataacagaatcacatgaagaacgaagcatataaaaactgctacttacttgtcccgtcatggatgaagatacagacaaagaatcagcaatgagattcagcaaagattccacattaatgctagaaataacgctaacaggtaatgtcaaccccaaagcaaatccttgtcttgcgcactgttaacgaaacataaacataaacaaaaccaaagaattagtaattgctagacaaagcatgaacatttcgatatacgaagtgaaactgaagaatagatacctctcttgaagaagagactccacgaataagcctgcgtagagcatatctcagatgaggagcacagttatccaaaccatcgtttttctcagcttcaagcatcaaaccaccatcaacagattctttatcaggtaacatttcgtattgcttctgaatctcttgcaacctcaataccaacgactcagcagctgcttctctaacggaagcatcagaagaagccaaatctgtaaaatagttcagaggcaacgaggaagaagaagcggctgcggagggaagagactcgtcgtcggcttcatcggagtttgaatttacagccacaggtataggcttaggccgcgaagctcctacaccattgtttttcttcagagcagcttctagtctcctctgtttatcagaagcttttctcatcttcttcttctccatatccttaccggagctcgcaacaccaggaacttccgccgccgccgccgccgtatcagaatcataattagcaacggtattcatcttctcagttttagatttcttcttcttcacaattgaagaatcggggaggttgtcgttctccaccaactccgtcgagtcgtcgttgcttctcttcttactacccattaaaaaagcttcgattttgaatttgggaattggggcgagaagaaagaaaccctaatcgactagtgaagctttcctctgtcccctctaactaaaagggttttagtttagggtttataattaaaaaaataatattatttatacaactcgccgacaaatgatatttttctcatcaattacaatatatcaatttgcaggaactcaaaacgtttaatttcataattcgtaattaaacagcatcatattttaatttttagtaatggtttttaataattatttgcaaagaaaatcatcctctcatttttctccatattttttagtgcaatcattctctcactaatattaatgaaatctttatcaaatataaaataaaataatgaatcatgttttattaaataatatataaacattttttgttgatattgttttttgttctcaccgatatgtagaacgaaaaatgtcatgaagcccaacttcaattagaatcctgaagcggtaaagcccacaaagacaaattttcaaggagaaggaaataagtggtaacaataagaacacagagctctaagcccaaatccaacgacaagagtttataaacccatatgttttgaatgctttgtgttatcccaaagaatgagtacttttgactgtattacaaaactcataataactgatttagtaaccgagaaaaaaacgattcattttgttattcaagaatttaggtttgacatatttaacactaaccaaaattaacatattattttgacgagtttttgaatgttagtcttccatgaatgaggaggttattcggaacaactagactgcatcatatatatagataaggattgctatgtcatatatactaggaagacaaagaaaacaatttagttgatatttcttctccttttgtaaagttttccacaagaagtcaattaaacttaaaagcatgtagcgttggtgatacacaaattaaatacaatgtgaaagcttggaaaattcattgtctatgccgtattctaagatgcaaaaacggagactatcaacgtcaaaaaggttccttcaactctttaaactttcgtattttattacaagcatctaatttctaaactaaaaacattattttattttcacgtcataagcaagcatcatgcataattttgtaattctatcttcattttggccactagtcactactaatagcaaaataataacaaagtttcattggttcaaacatcatatcttcatatagttgactcattagattccaatcaacaattatatcaaaataatctaaaaacaatttctctttattaaaaatgaaaacaaatcttgattagtataaaaatagagatatggttcttgtcagtctcacataaagattcctagtcttatactctgtctctctctctctctctctttttcacactcacacacaaactaaaccggaatg

SEQ ID NO: 32691 - DNA, 3003 bp, Unknown
  misc_feature (1)..( 3003): 2750-1469P.txt file - cDNA_ID_3060089; gDNA_ID_1620346; Annot_ID_154178
accgagtcggagaacggcgtaccagtctggcaagttggaatcacctaaacgagtctctccggcgagaagaatgtcgcagattgcgaggatgtagtctgcagcttctgctcgggtcgggtcagcttcgcatgcgcggatcgcaaatgtctttgctccttgaagatcactagacgctagaagcttctccgatgttacaagccactgatccgcctccactctgttaccaccaccaccgccaactccgccgcgtccgcctaccatatcccctatttctttttgttccctttcgtttttcctctctccccgttgaatttatttattattttatcggtaaagagtaaatacagatctaaaaattaaaaggacgaaaacatgatggatcgtcaatgggccggaacaacaacatgatggatcgtcaatggcattttggtccttttcattttatataatatgtgcaatgtgatggatcgtcaatgggccggaacacttttttctaaatttttcacttacaaaaaatattaataaaataagatgtaatattattctcttaggacagtttctctaaacaattggaaaagtttcttgtaatctctcaaatgagagactcactcatctttactgagagatttttttaattaaaaaaaacattatttactattttatttttatttttgtagatgagagatttgaacgaaaaaccaccaatacagatgctttttaggatgttgtaaagcccaataattcttttaagaattaaaatataatctggtgggctttaggtctggacagcctaactaaaataaaatattacattccgattcccagaaaataattcgtaatcaattgaccaaaccgatcgatcactgttgtcataaaagtcatcgccatcttggtttcgtgatcgaaaaagactcgtgaaaaaatggatcatatgatatcagaaaacggagaaacaagtgccgaaggatcgatttgcggctatgattcgctgcatcaactcttatcagcgaatcttaagcccgagctctatcaggtgacgtatccactccctccaaactaaattactcttctagtgtgtttgatctcgcttttgattagcctgtctaattcgaatgatgatattatggatcttttgttctagtggtttcaagtgtttattttagttatgttgatcagctttaaaaaatatggattgttgatgattggatttgcaggaggtaaaccggttgctccttggacgtaactgtgggagatcgcttgaacagattgttctgccggagtctgctaaagccttgtcttcaaaacatgattttgatctccaggtttatacttcgttagttataggatcagatcattgaacttaatagattgagacaatgttttgatttgatttgatctttgtataaatattgtctaggctgctagcttttcagctgataaagagcaaatgagaaatcctcgagtggtcagagttggtctcattcaaaactccattgctcttccaaccactgctccattctcggaccaaacaagaggaatattcgacaagttgaagccgataatcgatgctgcgggtgttgctggtgttaacatactgtgcttgcaggttttgcctccatttgctttcttttattgaaaagttgttacttcaattgtttttgaccttttctttgggggggaatgaatggttttatcgataggaagcttggaccatgccatttgcattttgcactagggagaggagatggtgtgagtttgcagagcctgttgatggcgaatcgacaaagtttcttcaagaactcgctaaaaagtataacatggtgattgttagtcctattctcgaaagagatattgatcacggtgaagtgctttggaataccgctgtgattatagggaataatggaaatatcattggcaagcatcgaaaggtatatttgtgctaacacgtcttttgttgctctgtcttttctcttgtcagctaatttctattacttgcttggtggcagaaccatatacctagggtaggagatttcaacgagagcacctattacatggaaggagacacaggccatcctgtgtttgagacggtgtttgggaaaattgcggttaatatatgttatggcagacaccatcctctgaattggttagcttttggtctaaatggtgcagagattgtcttcaacccttcagcaactgttggtgaactcagtgaaccaatgtggcctattgaggtttaacttctgattctccactttactcaatttgaagctttctttctttagtaacactgtctaacaatgcaatatgttccttaaaacttgcaggcacgaaatgccgcaatagcaaacagttactttgttggatccattaaccgagttggaaccgaagtattccccaatccttttacgtcaggtgatggaaaaccgcaacacaatgatttcgggcatttctatgggtcaagccatttttctgcaccagatgcttcttgcacaccgtctttgtcccgttacaaagatggtttattgatctcggacatggatctcaatctctgccggcaatacaaggacaagtggggatttagaatgactgcaagatacgaagtctatgccgatcttttggcaaagtacataaagccagacttcaagcctcaagtcgtctctgacccattgctccacaagaattctacataagaagaaaatttcactctgtgaatcttcaaagaagaaaagtccaataatcaatgttcaatcatttgtgtaaatgtaacggtaactgaaaatctgtttgtagctgaatatatgttgatgccaaaaggcagctcctttgcttttataatcgaaccggtttataattgaaccggaatccaattccaaaaataaccgtaatcagatactatgaactgtggggttttctactcctcgtcatcttctattcgttatccgttttgaagcgtactcggatgggattgagtttcgcagatgctttaaattctagaaaataatg

SEQ ID NO: 32692 - DNA, 3000 bp, Unknown
  misc_feature (1)..( 3000): 2750-1469P.txt file - cDNA_ID_3060111; gDNA_ID_1620346; Annot_ID_154158
ctttgggagttacttcctttgaccctgttcccatgagctgacgtccaaccatctcgatttcctaggaagagaagacaatctcagcaaacatgcaggaatttggtaaggcaaggaagcttgtaaaacagaaagcaaatgaagtacccaaaacagaggttgtattgtaagaattgattgtgctagcattctgatgatgcataatctgaggaacaacagtttgaggttcaggattttgttgcaaactggaacttgcttgacgactatcccctgcgtcaaaatgatattagtttgtgttgaagcagaaccacgagcagcaatacaatcaaccacaaagtctcatcactgaaagatctacactcttaaacaaaaagatactaaagcagattatataagagagaaattatataccagaatcagcatcttcacataatggtgacaatatgctggatcgggttgctgtggaatcaacatttacagaacccgtgccactcagagaatttgaatggttttctttagttccactggtactcattcggttaccctgtataatagcatgacgtacaatataagatgactataacaaaaccacacataggaaagacagcatccacttaaaaaggaagatatagtgttgagcgatggaagttcatattttaagaatatattagtacagtacaaaacaaaagctataccttaacctccaagtagtgaacgaaaacaatgtgcatcagatccctgtatccatgtaacacacaaacagtggacatgagcactaacactgaaaagtgacaataaatgaagaaaagtaccaacaagcacatttcattccagaagatagggattttagagatcacgtgaaatgcctttggttcagtcttgtcttgtataaacattatcctcgatttcatctcacaacttagaaattgatgttttatagcagaatctcggaaattataataatattcctttctatagcccttctagctcattttctgctaatacaataaaaaggccattcccaggacactagcagactaccatgcacactttatacaaagcacataaatgctgaaaaactaacgcttatgatactaaacagagcaaaacatatgaaatgtggacaaacatagatagactcactgttcaagcatccagtagcaccgcctctggaagttctcattatcttctccatgtgcatagtaacaatgtaacacatcaatgcttcctacctgtgtatacttacacaatcttattactctctaacattgagatgttgcattatcagctagaaaaatcagtagtaaaaccaaggaattggtttcaaggtcattgcattaatctgcactaatatttaacgaggacacataaatagaaatattaaccttcagcttttcgtgagcctctttcactgttttcccatctttcttcttcctccaattgtgcccgtcttttcggaaatatctgagcaccttcctatcgaagagaaagagtgaaccacctagaagagcagggaatttctgttaattagagaagacaaaccgcaataaattattgtcaaggcacacaacacgcaaaacttctgaactattcaggactaacaggataaacgggggagtgaacacgtcaagcataaagttcgttaaagcaagacagaaataaaacccaagctaatgtaacttattcagcatctattgattgtacagctcaaaaaataagaatatattgcaaacaaaaatgaagaaaatcagcaagaaacatactgggtggtcggttgggaggctctgacgcaatatgaaacttctgatgattccgaagaatttcacaaatctcagcaggtctcagccacctgtgttgtgcttctgacagcaattgcttgatatctacaagttcataaaagggtaagaaacacattgatactacaactctgtagctaaacatccactaacactctcttgcactaaccaacatcaatcaaaatatcaaatgtaacagagcaatacaacttaagcgggaacaactaagaagcaaaatataaatcgtaattcaacaagctagaaatccttcccttcactaaaatgcaacaaaacgaaaaactagtaatgatcagatccaaaacaactaaaaaggagtacaaaacacgaaaaggaagatagcaaaaaccctagatatggcgaaatggtagagagacctaatcgaggagcaaatccgaaagatccgcgatccgccatggaacataaacccaaaatccaccagagatagatctctagctgtcgcaatcacagaaaaaaaaaaatcaaacgaaccctaaatcgatctaggtgtatgaagtgagcttgataagctctttagaatttttttcctcttttcgagctttccaggttgtgaaagcgaatcgatgattactttttttccttttttcctctctattttctgggggaggacgaaatcggaaggaaagcgccgatatggtggaggttgttttataaatttagtgaaccaaaacatttttatccaatacaaaccttacacgtggacacgtggatgaaatttttattcaatgtgtgtacttttgctaaattgattcatgaatgtaattataattaatgttccttttaggaacttttcttaaggagacaatctattaatccgaattaaaccaaaccaaaagatattggaccggacagttcagtcaagaccagattcacgtgcgctctgtctgctgaacgccacttcaagattcggacaaacttaaaaaatgtgcattcgtttttttaaaaatagttatcttaaaagtaaagcaacagttggatatgagccacgtgtattcagcagtattcgccgcgtatcagctgataacgtcattttttatttccttcttgtttcccctacttacactttctttcgagaaaaaacagagttgaatcattttctttcagtcagagaacaagcctcttatctgagaagtgaatctataagtatacgagagagtgtcgtaagatg

SEQ ID NO: 32693 - DNA, 1949 bp, Unknown
  misc_feature (1)..( 1949): 2750-1469P.txt file - cDNA_ID_3060115; gDNA_ID_1620346; Annot_ID_154156
gatccccagtggagaaattttcaaccacatctacgtggccaccattgaaaccatgatctgaagtatttgtatcctccaatgtcatatcctgaacatcttttcctgttcccgtatcacgagaaaccgaagagccaccactatctttctcaggccatggattttttcctaacatgtttgcctctctcttgataaaagtattactctttagatggtttgttccactacccatatcatcatttcttcgtttcttcctgttactaactagaattggaaactgacctccatcctcatacgctgagtctggcactataccatcatcgttcccatgaaattcatccgaaagataatcgcctagctgaaaggaaaagaaaggaaagaaaacttcagccaccaattagaaatccacattaccaagtcaaagaaaaaaatgactagggaaacatcaaaccgagtagactaacaaagtatccccaatcctgcacagaacacatccaagtggtagcgataacaagaagtaaaatatgagatgcaagaactgtcctatattttaaacgattttgaacccaataaaaaaaggaaatttcacaacagttcattttccgggaacatacgacaagagcaacaacgaaagatctaaatccatagtctcatagaaaaaagatacacacacatatatgattgtgactccactcacctcatgaatgtacaagtccgacattcctcccaacttcagactctttaatcaccactaaaatcatgcacattaccccgatatgtcatctctattgcaaaacatgtaactcccacaaacactatttctggttctggataggaaatataaatatattaaacagcttccaataatagagaaatcgaacccagcatataagaaaacttgacttttcttatccagaatcaaatcccatgaaacccgaaatacatgtaatccaaaccctaagagttaacccattctttcaactattcatgaattccagaaattagactcaaattctacagccaaaaagtcaaatctcatagcaagtagcacaaaaacaaagtaggagaaaaatcagatagtaggattcaaccattttatgctcgtaatttctagcaaaatcgagttaaactatcattattaaaccgagagtttacaaaaacaactaaaatccagtgaaatgaggcattcaatgaaactaactgcaacaaaaaaaaaaacaatcaaatctgagaaatcctcagctaccgctgctatggaaacactgaggataagaaccaaattttctaattaaattcaatcgaaatagattccatcaaagccgaacgaaataagctcacctgtgagacagattcttccactagcaactccagaaaactccacagataaaattgtttaccagaaaacaaaaaactcagcagatagaagagattgtatcaattcatcgaagctagatcgaaaaaaaaaactgtgtaggactttctagagatgttcggcagaagacgatgaaggcttcctatttttttttttttgacaaacattttaaattttaattaaactattgtttttgtttcgggagaatcaaaagacaagtgaccatgatatcaacacgtggcaactaaatcaaaaggtttaacaggcttgggtttttaatatcagaattcgtggacgagagagcagtgtgagatcctatcagttccagttttattattggtacacgtcattagtaccttctcgaaactgggcacgcctcatcttcttattggcttacatcgtaatgatgacatcagcctttatttacgtataacaaattaccatgcggttaaaaaaaacaatagttatatgggccgaagaaagcccaaagaatctttagttgtttttccgatcgatctgcgagtcgagtagtttttttatttgccggcgccgggagagatcctttgatctttttccgatg

SEQ ID NO: 32694 - DNA, 1915 bp, Unknown; identical to SEQ ID NO: 1012
  misc_feature (1)..( 1915): 2750-1469P.txt file - cDNA_ID_3060141; gDNA_ID_1620347; Annot_ID_154214

SEQ ID NO: 32695 - DNA, 3003 bp, Unknown
  misc_feature (1)..( 3003): 2750-1469P.txt file - cDNA_ID_3060145; gDNA_ID_1620347; Annot_ID_154213
caataccttaattctatatatgtgtaaaaatattcagcaaagtaattaaagggacaatatgatttttagggttttatggatcaataaaataagaaaatttgtcttgattgacctgaaataagaattcctcaacccattggataaactttaaaaagtcaagatttctcaaatagatccaattagttttactgacttattgaacattattaatgtactgattaagaagtagttcccgcactaaagtataggctatatgcaatactaagactgataaattggtagacaaaaaaggtaaacaaaaaatgcaacaaattgtcaccttaacacaattttgtactaagcttttacttttacgactctccgtcacacgcgttctcattctcttgaagttggacctcttctacgggttttctagttaagccatctcttcttcttcaacatcagaactacattttccggattcaaagtgtttatttcaatcggcggcgttgaatatacgagatggtacgttgtctccggatgtaagagagccttttttaaacgagttaagaggaatgaatataatcaaatcaaactgaaggattaataattggttaaattatgagctattccggtttggttaagtcccaccgttatattcatctcctctgaattaatcaaatagtcaattattctaattactgttgattgtctcattaacttggaatagaggaggtttggactctatttcagttttaaaaaactgctaattaaaccagattaaaaaacgaaactactaattaaatacagtaaaatttcgaagacgtttcaatacacaattaataccatagctcaatttcttcccctataaaaacagccaaggatcttactattattcatcattcaaagacaaactcgagaaaaataaactttgaaacttttttttttgtgttttcatcatggctatcaaaaacttgatttttattatagcggttatgtgcgtttttgtctccgtaaatgctcaactaccacaatttccttttccattttcattctaaccgatttctggtatgccaggattacctgatattacaaaatgtttgtcatccgtgatggatattccgggatgcattgcagagatttctcaatctattttcacaagaaaatttggtaacttaggtccggcttgttgcaaagcatttttggatgtcgaatccaattgcatgccaaaaattccattcattccgttatttccgccgatgctaaaagaacaatgttcaagaattgccggtgctactcctcctacaccaaaatagagtcttagtttatttttaaaacatataaaatatgaattttttgtcttttcaacttctttcttaaattttataattctcagattactcaacatgttttacttaaaaaaaaacgatgatacattaataacatttgagaagtcgtatttgtgtttaatttttagtcgttctttatttctaatgaataataccttcaaacatcgagtagataattaatttaatattgcaatatttcagaatttgttgttttcataaatcttttagatacgtcgtatagtaacacaaaatctgtcaacggtttataactttttatatacgacccaaaaccattctcaagatcaacacaagtaaatcctatttttgtaagtttctaataaggaaatgaacaagaaagacccaataattcaagaatgatgaagcccaaagtatgagtcttcttgcttcttgggccgaaccgaactgaactgaactgaactgaactaaagctaaactaaaactaaagttggtacggttccttctcttctctctctctctttctccgtctgtcgctgtctctctcgtcctctcctctgtttcgtagcttctgcagcagatctctctttgtccttctctctccctcagatcactgtaagtacacgacacttcacttcatttcctaattcgatctgtttcttttactctttctcgatttgcttccaatcttgatctcttttctctttctatatcgagcttgatctgactcattctttattatatacttctcttctcgattccttttttgtgaaaaaaacatctttaaaatttcatttttgttagttgcttcgtgtcttgattagtgttgttcttgtaataaatgttgtgatcttatattcattctagggttttgtgtgtgtgtgtatgagcttaatttcatacagaacagtgaaatcttagactttcgattagatcgttgacttttatctgaattattggaatttaggttattgaatcagtctttaggttattgatcaaaatgatttacttcagagaagattgtctcaataattactaacacagtggttgattattgataatgttattaatcctgagctatgtaaattttgattctcaccgtatatatatatattgagtgtagatggcacagcaggaagctagtccttcccctggtgctgaggttgttggtcgtgcctttgtggagcaatactatcatattcttcaccaatctcccggtttagttcatcggttttatcaagattcgagctttttaacccgacctgatgttaccggtgctgtgactactgtcacaactatgcaagtgagattatcattaagtctattactttaacaagattgctatgatgttctcttttgatttatattaacttggtttcgctatggatttcaggcgatcaacgacaagattctgtcgttgaaatatgaagactacacggctgagatagaaactgctgatgctcaggagtctcatgagagaggtgttattgtgctggttacaggacgcttaaccgggaacgataatgttaggaagaagtttagtcaatcttttttcttggctccacaagacaaaggatactttgtcttaaacgacgtgtttcgattccttgaggagaaagaggtgactgcacaagcccgctctgtccccatcaatggaaccactagggatgttcaggctcctattgaaccaggtaggatg

SEQ ID NO: 32696 - DNA, 3000 bp, Unknown
  misc_feature (1)..( 3000): 2750-1469P.txt file - cDNA_ID_3060154; gDNA_ID_1620347; Annot_ID_154201
gtcctaataagagacctcaaagaaaaaatagtaaagtttagcagttatgtaagatacatggagatccagaaagcagacctcgtgcatcaagtgaaagcacaggttagtagaaaacatcttctactctttttgtataagacagtaaatgtctgaaatttagcatataaaaccattggcattccatattacagacctctgcaatgaagaaattgtcagcagatgagaacctaaagaacgagcatagtatgaaaaagcaggaaacccgaaactcgactatagttcttgaggacatggatacctctgattctgaagcgtcagaccatgaacgggaagatccagatcttgatgatgaatggaaacctgaacatgaatcagagcgtgagtccgagcaggaatcggttataaagctaaataggaaacgaaacttcaaagtgggaagacggcgctcgagtgtggtcatgaggcgttcatatgaagagaattcggaaactccttcagatgatgcagtgaaatctgacgtgtgttgttgcacttgcagcaagagctcctcttgcaagacaatgaagtgtcagtgtcgagctacaaagggatcttgtggtccgtcatgtggatgttcttccgtgaaatgctccaacagaaacgcagacggaaaggagaacaattccatctcggaatcagaggccttggaaaacggggagaactcgcaagaatctgatgaaaaggacaaaggccaacaacaacaagttcttgcttcacgtggagctatgctgctacagaacgctcttgctgacaagccagaggaggagacaaacgatgatggaggaacacgaagaagaagaaaacctctatcagacataggaaacacaacggtaaaaaactctctaaagtttccactgttttggtcatttcaacatatctgtgttcatgtagctaggaaacaacagctttctgatttaatgaaattttggtttcagggtaaatcgaatgtgccaaggccaagccaaagaaagaaatggaagaagactgtgcttcagcttgttcctgtaggtccaccagcactaccacccacacacacaaacacacacctgattccagaagctaattcagtgactgtggactcggacacagcgagaatgccagaaaacagtgactcaggagagtctaatagcatcaaactgaagctaccgagggcaatgaggtcagcgtcttcaaatggcagcaacttgctgagagaaagaaacgctgatcaaaacggaagtgagtcgggaggcaatagtggttttgtgcagagcaattcgggtagggcaagtggaagtagaacttcagatgaaaaggagaaccacactcgtcgggtctaaagaggagacgtcgcttgaggtgcaagaaagatgggtttgaaatcttttcaagggtttgtctttttgtttatggtgtgattttagaacataacaaacgtaaatttagggttgtgaattcaggttcctgttgtgaattttctcagacagatacagttgttaaagtttgaagtttgattaagatttgactgatttaagtatggtatttcttgtggtaaagtgaaaagggtgtctttaagattattgttgatagtgtcggcaaaataaagttatactctgtatacgtaataatcagccaggatacacgtaatcacaggaatttaataatttggaatggtagtcttaattaacgtcttcacatattgataatgattgcttactaaccatgtatatttttatacattgagggactaatttagaaatataatttcacttttgattgagttattagtccaataactttcacagttttactataatataatattgaaagtatggttaattgacaatagggtatttccactgataatcagtcaccagtaataataatttgttgggactagaatcaatcacttgagttttaaattgatatatgcctagatggttgttaggaccaatattcctaaacaataccaaattttaatatagaaatgtaaaataattcgccgacacattatttcgttattgacattgaatatttcaatgatatcaactctgtttatttacatctatttagtataatttcttgagcaacaaaaaaagtagttttaaagttattttccctagatttttctattgtaaaagcctatatatcacaacaaaaaataaccattttctcttttggcaagtttaaaatttttataatgaatataccatttttaaaaaaaaattatccaaactaaattaaccattttctcttttggcaacaaaaattaaccatttaaaaaaaaaaaaaaaaaaaaagtttaaaatttttataacaacagaaagtaatattatccaaactatgaataattaaaaaatctgtccacatacgatcatatatttctctccaccgacagccgaaaacactgtcaatggcccacgttcctctaaaagctgtcgtcttcggtaatattttccggtaataaactaacttccgatcacaattacacaaaagcccctttctcgtttataatcataggctatgattcatagcaaacttacagagttggttattaagaagtcaaaaatacagattccttaaaatattttttttctgttcatatattttttatcgagaaacaattacttaaacataagaagcaagacaagaattaatgttcttattaacatgatgctaatataatcggaaaacaaaatcaaatcatgatagaagggtaaaatggtcaaatcatcgttcccggctcaaattttactaaaacagccactagccagccagatcccaaaaatgtctcattgcttctctcgttctaaaaaaaatcttgctgctatctctctataagtccactcctccttcaagcaaagcaccttcctcttctttttgctcctctgagattggtttaagattaaaccagacccatctaagggatctggaacaagcttcgtctctggttccactctgatcatcagagtattaaaaatg

SEQ ID NO: 32697 - DNA, 3000 bp, Unknown; identical to SEQ ID NO: 1014
  misc_feature (1)..( 3000): 2750-1469P.txt file - cDNA_ID_3060162; gDNA_ID_1620347; Annot_ID_154198

SEQ ID NO: 32698 - DNA, 3003 bp, Unknown
  misc_feature (1)..( 3003): 2750-1469P.txt file - cDNA_ID_3060176; gDNA_ID_1620348; Annot_ID_154234
agcgatacgttgagagactctttcactcgatagcaataaactccgccgtgacgtcaaggggagatggtcttcctcaaggaatgtaaaatcagactccgatgaagagatgttggtaggttcatggcacatcttatacatttgaattagagtaatacagaggaaaagtacatggagactgaagaaaattgctataatcgagatttctccaaatttgctaattgcgtatagagctacaaaagcgaattagataataagagagaagggtttgttaagaaggtaaggagaatgaagaaaggaatctcctttggacatgaacacaaggagaagaatctcagattgtcgaaaccctggtaataaacatgaagaagcttttgtgtcactcacttttatgaacaataaaaaagttgtttttagccaaattgaaacataaccagtgaaacggagaccttacctcagcatattcgatgaaacactgaaattgagacgctcttactgattaacaagttaagaaagaaatcgttttttttttttgtgtgtgtttatcatcgaaacagaggggaaacaggagggagcgaagagaaaggttattttatttgggctaatgggccaataaaaatagaacctaaaggcccatagatgtaaaccctaagctataaataaaagacttcgtctttgatttcgccgcaagatattatcttcacgaaaagatccgatttttttgttctgattttctgttaaaatctgaatttttcgctacgaaatcttaggttaagaatagcatataaggaacagatttgtgataggagtctttaagcttagcactcatgtatagcttaaaagaaatcttatgttccgatgctaaatcaaacatcttcattgatggtttggagtctctggacatgtagcattctgggaattttttttcccgtggattctagcattttctcgagattcgacatcttcctatgtttttaattctgatcttatgtttggatattttagatcttcgaatttctatgataaagtgttaaccttttctcaaataaaggttttgtgaaaatttgctttttgatgctgctctatgatgattctttttgctttaaccacactgaaaagatggggttgagaatgtgattttgctcttcttgattcaaaccagagaaagattagatttgatctcggagtttcttgatgacactttgatctaagttgcttgaaggggattctttttctcctttgtggtttagattaaggtagagagtaatgtcgagctcttatcaacatttttcatggtttgaggcttgaagaacattcacgtttttcaagctcactcatgtggacaaccttggcccttgtctgagaagcagctttttctcatattcagtttttctaaatttgttgttttaaaaaaaaaaattggtttgtttttttggctgttctatgatgattatattgctttaaccacactgaaaagatgggcttgagaatgtgatgtggttcttcttgatttaatccaaagaaagagttcttgagctatatgtattgcttgatgacactttgatctaaaatacttgaaggggatttgtttccctttgtgttttagatcaaggaagagatcagtgtagagctcttgttcgatatttttcttagtttaaatcttgaagaacattatcattttctcaagcactcatatgtggaatcattgtgccctttgtctgagaagcagctatgaattctgtttttgtcttcgatattgttaaacgtagctgatttgtaagattactttgtgatcttttttggatgcttgatatgtatccaaccaagagtgggtttcttcttacaaagatattgagttaggaattttaatgtcattttatgttcgaattggggaaaattcacaaaaaattgggaaaatagaagagagcattattcgatgtttaccacatggtggaataatttgacagaacaatgtactttgggaatgacatatggaacaaactgtgtaaaccaatttgatgatgaaggtgaacgagttacatataggagacttacacttccataataatattcagaaactatatgaaagtgtatctttctttattactaaaactcttttctaataagaaatgtgtaaactatgtaactcggcaacggttccagactctctaatcctaaatcaatgttaaaggcgtaaggctcttgaacctgttcattgtgagctttgaactaagtattcaattttttggacaatccgaaaaacacaacagtataactacaaatggattagtcccatttgggcgtagtctcattcgtttggacgagaaacacaacgaaaaacctagccaattttgttgttctcatgtatgggcttaattggggactaatccatctgtggttccccttgtttccatagttcgtaattttattcgtttttcgtcttaagttttcccttctttaggtttagtttccggagatatttttgttttccgccggctttgtgtttcaaatttgtattccaccctttgtatttcacaacctataatacaatggaaaaattctggatgaaaaaaagaaaaagaacacagtatatagaaaaatctgaatcacagtactaacatcattgattttctgctacaaaaatgagtgtacactgattcttaaaatagatacgggctataacataacaaaaagaaaaagtgggggatggcttttgcaataatctcgaaagagtttctcactcacatcacacccttggtttataaataaaactcattgatcttgacggtgaaaatatcgccacctgttaatttgtaaaaaggtttcagtacacttagctacactggatccaagtctagtgctaaactcaaacctcgtggttttagaccaaaatctcttcttcttcgtttccttcttcctcatcatatctttcatcttctccaccagaatttgttttaggctctccttcttctgtttctttttctcccaaagaaacaattagatatg

SEQ ID NO: 32699 - DNA, 3003 bp, Unknown
  misc_feature (1)..( 3003): 2750-1469P.txt file - cDNA_ID_3060181; gDNA_ID_1620348; Annot_ID_154229
aaaacttatataacacagagatttgataattttttaattgttgaatactttttttttgtgctaatttttatatgattaagatttaattgattttgtatattaaatattaaattgttttacgaacttatttgtttataatttggtaacagatagatatttgagtattcagtatattttgcttcagtttaggaaatctttgatgacccgtctttagatccaataagccctataatctagatattaacctgtagtataacgcaggtaggctaatattttagttaaactaaaaacttttattgtaaagatgatttaaaaatatatgatattattttatttgattttaaatgtatagtaaactgtgagttgtatatgttttgttgatattatctatattgtttagtgtttaagattatacacttgtagtttgattgttaatttaagagtttcacctgtagtataccatcttgtattaatatcgatctaaacccgtcaattctaggattttccagcttgtattaaaaaatgaatcacatcatacacataaaaaatctaatatgttattaattattatagtatataagattataaattttcaatataatatgtatgaaattaaatataaatatttcaaattatgacccgttactcagtagaaagttttcttaaatctatttttcacccgttataatattttttcatgtattgaacaatttatattcgtttttaaaaattctaattatggcatatgcgaaaaaattctaattatttttttataatgatgatattattttttcgcaaaaatagaatcatataaagatgagaagtgaattataataattaataaaaaattaataaaaaattaatacaataatttagatatcaaatctaatttgttgattttaattggttacttttttggaaattaataatgtatttcatttttctaattaaatcaaattaattaaaatttagatatcaaatcttatatgttgattttgattggttattatttttgaaaattaataatatatttcgtttttaaattaaatttaattaattaaattagtatttgactttttaatccttaaagagatacattaatttactctttaaaattttatttctaatggcatacctatgtaattacttacaaaaattaagattatatttaaaatgtatttcccaaataatatagtaggactaaaaagctttgaatcttataatactttaacgaaaaaaaatttgaactaaaccaaatatcataactgtctgtgagctattattgtattcgcaccacccaattagaattttgataggtactacaatattaagtttgtgataacagccaattattacaattgtttggtgggtcattatgttcccgtgactctgggctattttgtatatatgtcactatttttgcctttcttgttgtaaaatttcgaaagctctttattttcattggtgggagagtcctaatcttcttaatttcttatcatatagtcccaacttgtatgttttgtaattgtaataacaagttggaccgacgggatattgtgtaatatgattggtaatacgcaaacgcaaagtaacatcacagaacaatgctcacacggaaaatatgaattcataaaattttatcattatatgaatggaaagtgggaaaaaagcatacattacgaaattgttttttgcatgacataagaagaaccatttaaaaacttggtaacgtcaatttatgctagttaagtactatactctttcgtcaaataaagaaaaatgctagtagtagtagagtagactgatattgttgtcccatgaaataaaaggggcttcaaatatatagtttgatttaagaacccattcttgtataagcctattttatgggccgtaatcaataataataatgggcttactttctacaatgtactcttaactgaatatcaattatagtttgggccgaaataaaaacgttggtctcatcaaaatcctaattgttttactttaatatcatgtcttcagtactaaaatactaatgaggtaatctaatttgtatattttcttcccaaaaattttcgatatgagttattccattttaatacagaatatattcttacttttagaggaagtaaaattttgaaactactcaaatcctattctatatatgtacaaacacattttttttctgccgatgacttagatagacacaaagctaagaatttcatattgtaaaaaaagttaacacgtaaatatgttccacatatccgaaaggaatttaaattagtagtggttcagtattattaagtcagacatttttaggagacgttcaataatataacatactttcccaagagttgcatgtttccatcgtacataataaaaccataactaaacaatttaaattattcattaaaaataaaaaaacggatagtatttgtttaattttcacattaaagtatcttttaattaagtatttattattatcttttatctacttatgtaatgtttataacacttcttacaaatctctccagattccttcataaatggaaacaaaagcatttaaatatgtaaatcatatgatttgttactgaaaatgctaaattacacaataataaaaagatgtaagaatatacagcaaactcatttcttcttgctgtaaaaataatcgcacggaatatttaaataaattaataaaagattctgtatctcactgtaaaaactaaaaaggtaaaaaattgaacaattaactttttctttccattcactgcagtctgcaattaatagcctctctctctctcctccttcatcatctccccatagccgtcgagacagatagagagagctgaaatttctgtgagaagattttcttccgacattttctctttccaaacactgttctacacgtagtcggaaatctcggaaaaaccaatctccgagtcagagagagagagagaggcgttcactgttgtaaaggattaagctttgggtaagaagaagatg

SEQ ID NO: 32700 - DNA, 3000 bp, Unknown; identical to SEQ ID NO: 1023
  misc_feature (1)..( 3000): 2750-1469P.txt file - cDNA_ID_3060206; gDNA_ID_1620349; Annot_ID_154259

SEQ ID NO: 32701 - DNA, 3000 bp, Unknown; identical to SEQ ID NO: 1027
  misc_feature (1)..( 3000): 2750-1469P.txt file - cDNA_ID_3060218; gDNA_ID_1620349; Annot_ID_154256

SEQ ID NO: 32702 - DNA, 3000 bp, Unknown
  misc_feature (1)..( 3000): 2750-1469P.txt file - cDNA_ID_3060230; gDNA_ID_1620349; Annot_ID_154245
gaactcatctaaccatctatgaaacttgattaaaaagtgttgtagaatgatttgtgtatgtttatgtaaaagttctatcgctcccaatcatacccgtaactggatacacgttgcaattgatctttttattttttggttggccgcgcactgcattgaattaacactaccttatccaaacaaatagtattaaatatctacttcaatcgaacactcttaagcctctctttgttcacaataatgataattagattagtgtcagcaacgttgacacatattcgtatctacaacacacatacgcatacatttatatataaattaatttcgacaagaataaattatgacttgtatggtcaccaataagtctcacatttttgggtacacaaaagagtaataatgaaataaataaaaaagataatgtggagtggtttatacagtgagtgggatggtcaaatctgaattttagataagatgcaaaattcaggttgcctcaatccgaccacgtctcacacgccctgtgccagacctgcccatctctgttttccctatagtatttttttctaattgaaaaatacaaaaattccattctccatatatttgaagttatataaaatccgtggcaaaatatgtgatttgacttttgagtgccaatccgatatgtgagccgttttgtaaacacaatttttggtttcagtaaaagcaagatattaggatctgatttcatatataaatttttgaagataccttattatatcacccaaaaaaaaagctgtgtattcaagaaagtgtagtattttaaaaataaatatgtaaaatgttcatgagtgagactccctactagtttaagattgtcaaattcacctagttaaagttggatcacttatttatccataaatagataacttaagagattgtcaaattctatttaaagagtctatctaaaaggcccattctcttttttacataaaccaaaaccgctcattaactattttgatcagtccagtccaatagtttgtgttttccttgtttttgggctactagcccatacacatttccaaaaaaaaaaaaaaaacttttttttccccctattttactacatttttgttaatttaatgtttgattcaaaatttacctcaccaatttatcccctcttctaatttcctttctatgtatttttttcaattcagaaatttcataccttctttttatcatccaataatcgccccatatttttcatactcacagttattttttttgatttttctgtatttattttcccatatttttgaagataatatcaaaacttgaaacatatggtagcagataaaaagcttaaaatagcaagagcttagtagattttatttggaaattggaaagccaggtgacgattaaacaagaggccacgtcatgtagatgcaccagtccgatgccaaaaagtatcctcgcaaaacaattggcagaagacacgtggctcaatactggtgaagagtcggtcttggcgtcttggtcgacttcgtaacgtatccacttcatatttgcaatccaattaatttagtaaaaagtgtgtaaaccatttttaaaaacaagtaaagtaaactacgtgtgaagaaagaaacaagtacggctaaaaaaatactaaaaaaattagttgaagttgctttgttttcttttgttgaaggtcgttgagaacatagtttaataaatacaatgaaactcttccgataagataagacaaatttcggtgttatctttctctacaggagtatttaataaaaagtataaatcgaactattttataacacgttcgaaatcaaatatactcatgttttccacttcccacgtttacgctgacaatctaacattatgtgtttcaacaagtaataatgtaacactcaccaaggcatgaactgatggaagtgctatgaatagaatatgattgattgtagtgtgtgtttggagcttttactggtcaatacacttaaaacagttgaggattggattttttgactaacattaatgacccaactgtcaaaaattagtcaaactttgcggtacataatttaattaacacgtcaaatgttggaccatcactataaaaaaaaatatttgttcatcatgagaatcgtccttggcccaaaaaaaaatccgaaaacataacaagaattataaggttagtaaaatgaaaaaatcataaacagatggaaaatcacagataaccataattacgaaagtgaagttgagagaggattggacaaaaatagtgacaaggaagacgtagacagtgcagtgctgtgattgattcgagaatgtgaaacctaaataaaacaagtctttctagattgctttttcgtatttttaggcggttggtttttttttttttttttaaatagctacgtgttcccattttattggaaaaacaaagtggcatttccttttaaataaaaatttttaaagataaaaagggagaaactgtaacaaactggtagcaaaaaatcagtaagtcaggtcaggtgttaaccctaaaattaaaattgaaaataaaactgagagaaagagagagacaaaagacatcccaattgcagagaaaccgtgttgaagttggtctctgagctgcttcttccttcccttttttatttttatttttccagctctttattttcttatttacaaaaaactttcccaagaataaaaaccagaagaatccgtataaattatcctaacagtttcttccaatatccaacaaatttcagatttttgtttttgttttcttcttctctacttgagtaatcatcaacgattatggcgtcaagtcagtggacgaggtcggaggataagatgtttgagcaagctttggttctttttcctgaaggatctcctaatcggtgggagagaatcgctgatcagcttcataaatctgctggtgaagttagggagcattacgaggtcttggttcatgatgttttcgagattgattctggtcgagttgatgtccctgattacatg

SEQ ID NO: 32703 - DNA, 3000 bp, Unknown
  misc_feature (1)..( 3000): 2750-1469P.txt file - cDNA_ID_3060230; gDNA_ID_2926256; Annot_ID_143124
gactcgacgctttaagatgaagaagaagcaatggattgactgattttattttcatgggtcgaactcggagcctttgatgctgttcactgaaatccaaaatccaaaatcaccaacaccaccaactaaccgcatgtgtatatgtaatccaaaatcaacactatttttaccacaccaaaactcactataaggttaattcgaatagaactcatctaaccatctatgaaacttgattaaaaagtgttgtagaatgatttgtgtatgtttatgtaaaagttctatcgctcccaatcatacccgtaactggatacacgttgcaattgatctttttattttttggttggccgcgcactgcattgaattaacactaccttatccaaacaaatagtattaaatatctacttcaatcgaacactcttaagcctctctttgttcacaataatgataattagattagtgtcagcaacgttgacacatattcgtatctacaacacacatacgcatacatttatatataaattaatttcgacaagaataaattatgacttgtatggtcaccaataagtctcacatttttgggtacacaaaagagtaataatgaaataaataaaaaagataatgtggagtggtttatacagtgagtgggatggtcaaatctgaattttagataagatgcaaaattcaggttgcctcaatccgaccacgtctcacacgccctgtgccagacctgcccatctctgttttccctatagtatttttttctaattgaaaaatacaaaaattccattctccatatatttgaagttatataaaatccgtggcaaaatatgtgatttgacttttgagtgccaatccgatatgtgagccgttttgtaaacacaatttttggtttcagtaaaagcaagatattaggatctgatttcatatataaatttttgaagataccttattatatcacccaaaaaaaaagctgtgtattcaagaaagtgtagtattttaaaaataaatatgtaaaatgttcatgagtgagactccctactagtttaagattgtcaaattcacctagttaaagttggatcacttatttatccataaatagataacttaagagattgtcaaattctatttaaagagtctatctaaaaggcccattctcttttttacataaaccaaaaccgctcattaactattttgatcagtccagtccaatagtttgtgttttccttgtttttgggctactagcccatacacatttccaaaaaaaaaaaaaaaacttttttttccccctattttactacatttttgttaatttaatgtttgattcaaaatttacctcaccaatttatcccctcttctaatttcctttctatgtatttttttcaattcagaaatttcataccttctttttatcatccaataatcgccccatatttttcatactcacagttattttttttgatttttctgtatttattttcccatatttttgaagataatatcaaaacttgaaacatatggtagcagataaaaagcttaaaatagcaagagcttagtagattttatttggaaattggaaagccaggtgacgattaaacaagaggccacgtcatgtagatgcaccagtccgatgccaaaaagtatcctcgcaaaacaattggcagaagacacgtggctcaatactggtgaagagtcggtcttggcgtcttggtcgacttcgtaacgtatccacttcatatttgcaatccaattaatttagtaaaaagtgtgtaaaccatttttaaaaacaagtaaagtaaactacgtgtgaagaaagaaacaagtacggctaaaaaaatactaaaaaaattagttgaagttgctttgttttcttttgttgaaggtcgttgagaacatagtttaataaatacaatgaaactcttccgataagataagacaaatttcggtgttatctttctctacaggagtatttaataaaaagtataaatcgaactattttataacacgttcgaaatcaaatatactcatgttttccacttcccacgtttacgctgacaatctaacattatgtgtttcaacaagtaataatgtaacactcaccaaggcatgaactgatggaagtgctatgaatagaatatgattgattgtagtgtgtgtttggagcttttactggtcaatacacttaaaacagttgaggattggattttttgactaacattaatgacccaactgtcaaaaattagtcaaactttgcggtacataatttaattaacacgtcaaatgttggaccatcactataaaaaaaaatatttgttcatcatgagaatcgtccttggcccaaaaaaaaatccgaaaacataacaagaattataaggttagtaaaatgaaaaaatcataaacagatggaaaatcacagataaccataattacgaaagtgaagttgagagaggattggacaaaaatagtgacaaggaagacgtagacagtgcagtgctgtgattgattcgagaatgtgaaacctaaataaaacaagtctttctagattgctttttcgtatttttaggcggttggtttttttttttttttttaaatagctacgtgttcccattttattggaaaaacaaagtggcatttccttttaaataaaaatttttaaagataaaaagggagaaactgtaacaaactggtagcaaaaaatcagtaagtcaggtcaggtgttaaccctaaaattaaaattgaaaataaaactgagagaaagagagagacaaaagacatcccaattgcagagaaaccgtgttgaagttggtctctgagctgcttcttccttcccttttttatttttatttttccagctctttattttcttatttacaaaaaactttcccaagaataaaaaccagaagaatccgtataaattatcctaacagtttcttccaatatccaacaaatttcagatttttgtttttgttttcttcttctctacttgagtaatcatcaacgattatg

SEQ ID NO: 32704 - DNA, 3000 bp, Unknown; identical to SEQ ID NO: 32702
  misc_feature (1)..( 3000): 2750-1469P.txt file - cDNA_ID_3060230; gDNA_ID_2926256; Annot_ID_204561

SEQ ID NO: 32705 - DNA, 3000 bp, Unknown
  misc_feature (1)..( 3000): 2750-1469P.txt file - cDNA_ID_3060234; gDNA_ID_1620349; Annot_ID_154243
gaggtcttggttcatgatgttttcgagattgattctggtcgagttgatgtccctgattacatggatgactcggcggctgcggcggcgggttgggattccgctggtcagatctcttttgggtctaaacatggcgagagtgaacgcaaaagaggaactccttggacagagaacgaacacaagtatgtttctttatcaatcatttcaaaaaaattagggttttggttggtttgagaatttaggaattaaatgcaattttgctaaatttaggtgatttaattacattgtttgatatgaattttattgatgcagattgtttctgatcggattaaagagatatggtaagggagattggaggagtatctcgagaaacgttgtggtgacgaggacaccgacgcaagtcgcgagtcacgctcagaagtattttctgagacagaactcggtgaagaaggagaggaaaaggtcgagcatccatgatataactacggttgatgctactttggctatgcctgggtctaacatggactggactggccaacacgggagtcctgttcaggcgccgcagcagcaacagattatgtctgagttcggtcagcaattgaatcctggtcatttcgaggattttgggtttcggatgtgatgaagaaagggggagacaaattgggatggctttagtttaatagggttttactcattttatgtgaatagggaaagaaataggattgggtattttcttatacagatgatgatgatgatgatcaaagaataaaaataatgtatagggaagctttttgtaaacacaaatatgtttggtaaccattttggtattttgaatcaatgcatatggttgtttttctcgattattttaaacttgatttcttacaacacacaaacacacacatcagaaggttaaagatctctgtacaagtacaagatctctcataccaagagagaacataggtcaaaggcattattgtttttcactactgcttgccttatgaccggattctgtatactgtgagtgataaactcatggcttgtttgtctcaggtttctgcacaagagagtgaaaagcaaacagtcaacgagcaagttcatttctttgctatgttaagttagatcatcatttgctgtgacattaaagccaaattcaggttcagaaatgcgcttcttctgaccacagggcatttcgtacgtaaaactgaacacttgaatgaaaagagaccaatggaagttgatggtatgatgaaagtttaccttgttggcacttcctttctcaccatctagcttatcttgctcgagtttcttcttcttctccagtctctccctctccattttctacaacaaaaagatcggtttcttataagtgcgtgaagagaaatagcttccttcattaatttcaatagtcatagccaaatattctgagcctgagtaatgcaagtgagatgcaacgaagctataaaattgtgtttaaactgtaactatgaggtcaacctcaaatcaaaaaggaacacaaaaagctatagagattgcttaacaacaatgtcaacaacacacagttcttcccctttctacaacaaatacttttcgtagaggcgtaagttggatcacagattcacacagacaacatttacttcaattattttccatctgtatgaactaatacgccttgaaaaactcatccacacactatttgaccatttattatcaaaagacgactttacaatttgatagacaacaattggattcaagtcttatgataagaataagcctcggatctttatcagtgtatctcataagcttaaaaatcaatgctaacgcaatttcccaaacgatatttcatataatttgattgatttcctgagatcagatttttaccagtattcgctaacttgaagcaaaatttcgacaaccaaacattgaatccaaataagcaacagcggctaaacaaactattatagcatcgatacataaatcaagagttagaaaaagtcgacgatgaagaagaacctggatatacatgctctctttcgcgcgttcctcttcgctgagcacacgacctttatcgtcactgaagtaccgaatcgccggtcctcgagtcgataccaccgaacgcgatgcaccaatctgcctctccccaaaggatcgagccagctttagctttgtgatcgcagaacgagccgacgacatcttgctaatcagtgagatggttttctcaaaatcgttttttttgggtagaaaatgtctttggagtgaagagacagttaggcagcttcgggtccggaccgggtcgggtatagattattgaagaacccgctagaacattgcaccggcgtaattgttagctaaggactttggtctaatgacccaatgggctacaatagcccaatagtgagaacctttccccagactcgtctacaattctttggtttaatggcccaagttgacatacatgttttcccctgtttttagatattttttccttttctttggtcaacgaataaaagtttttaattttttatacaagatttttttactttaaactttttattagagacaaaacaaaatattttttaaaattctttagcaggtttaatttaaaaaatctgcaaacagcaaaccagtccgattggcttggagggtaaaagaatagaaaagagaagatatttggtaacttgcagcgtagaagtttgaacgtcagcaagcaaataattgcatctacattcgtctcactatgatcacattattctatagcaatttgcaaatattcaattagttacttgtagaaaccatataaaataaaaataaaataaaagcttagtagatgtataggtggagcatctcgatagtgacgtcacacatcacatcagcagattcagcactccatcatctttttgttatcactaaacgccaatttctctcgccattttatagattaaggtgttctctctgacttcggaggagaaagaaagaaaaaaaatattcttgtttcaaacttcaatg

SEQ ID NO: 32706 - DNA, 3000 bp, Unknown; identical to SEQ ID NO: 32705
  misc_feature (1)..( 3000): 2750-1469P.txt file - cDNA_ID_3060234; gDNA_ID_2926256; Annot_ID_143122

SEQ ID NO: 32707 - DNA, 3000 bp, Unknown; identical to SEQ ID NO: 32705
  misc_feature (1)..( 3000): 2750-1469P.txt file - cDNA_ID_3060234; gDNA_ID_2926256; Annot_ID_204559

SEQ ID NO: 32708 - DNA, 3003 bp, Unknown
  misc_feature (1)..( 3003): 2750-1469P.txt file - cDNA_ID_3060244; gDNA_ID_1620350; Annot_ID_154302
catttataatgaacctgcaatattaggcccatatgtttattatgatttcttacatctttaggcccagattttaatcgtccaggctcaatattaggcccataacgttcggtttgtagttgtacaatcgcaaaaaacgtaggtagtcccgctagttcagctactgttacttccactaactatccttcgtctctacagagcatcaaagacttccatgtctttacaattcagtcctcacgacacctctgtaattacccttttgccctctgtcctccataactatccttgtctctcttccctctctatttctcgcggcttcaccaaaatcaataccccaagcgttcggatgatgatcattttctctttttattactatcatacacggccgctagtcccgctactgttacttccactaactgtagcatcaacagtagtgggcttttactattttaacatcaacttcaactaaagataatcgacaagttgtaataacgaaattgtacaaatgtttatgtcagtatgtaataaagccacaatattctctggcgaattattggtaaacaacaaaattgtggcaaagaaaaagtgatcctgttacagttatttggaaagttagaaaaaaaaaataaaaaaaatccatgaacaaaaaagaagatggctggcgttttcattgaaaaagtgatttgatttgatttttcttttttaaaataatactttgaacgtaagttaatgaataacaaaccattaaaaaaaaaagtaaaaaccaatatgatctaatatcttataaatatatataatacattaaattataaatgaacctcaatcttgatacctaaatctatatcactagattttaacccgcggtataccgcgggacgatttattttttaaaagtaatatatattaaaacttgcaaattttatttttacataatatttatattttacagtttataattgttattaagtaacgctataccatgaattcatgagacaattgttaaaaaaactgaagttttaacccctattaaaacagtatattaataatattttaaaattttataaatattgattcaaatacatcaaccatataacccaattccaaaataaaacacgttctttaatttatttacccgtcccatgattttttttaaagtagtaatttttaaaatttaaaaattattttttttatataaaagttttgcaaattgtatcattctctaatacatttatattttataatttaattttatatatagtaacattatacatacgacataacatttttggttttatataattttttctaaattaggatgatttgatatgtttaatattagtggtcttaaaaataataaattaaagatttaatccatattaaaatggtggattaattatattttacttttttattaatgttgattcaaaaacccgcccctccaaatccgtcttgccaaaaagtcatttattttattaatattagttttattaatgatatgactctgaattataatctaaatattttagctaataacataggagtgcactttatttatttaataggagaatgtaccatatgacctgaatgcacttttatccaaatccaccaaaaaagtcttgcaaaaatactatagagataagaaaacattgatattgcgataaaaaattaaaaactaatttttatgtgattaagatttaattaatttcgtatataaaatattaaattgacttatttgtttataatttggtaacagatagatatttgaatattcaatatattttgcttcagtttaagaaatctttgatgatccgtctttagatccaataagccctataatctagagattaacctgcagtataccgcaggtaggcttatattttagttaaactaaaaacttttattgtaaagatgatttaaaaatatatgatactattttatttgattttaaatgtatagtaaactgtgagttgtatatgttttgttgatattatctatattgtttagtgtttaagattatacacttgtagtttgattgttaatttaagagtttcacctgtagtataccatcttgtattaatatcgatctaaacccgttaattctaggattttccagattgtattaaaaattgaatcacatctaatatgttattaattattgtagtatataagattataaattttctatataatatgtatgaaattgaatattaatatttcaaattatgtctcgttactcagtagaaagttttcttaaatctatttttcacctgttataatattatttcatgtattgaacagtttatattcgtttttaaaaattcaaattatggcatatgcgagaaaactctaattatttttttataatgatgatattatttttctgcaaaaatagaatcatataaagatgagaagtgaactataataattaataaaaaaattaatatgataatttagataccaaatgtaatttgttgattttaattggttacttttttggaaattaataatgtatttcgtttttctaattaaattaaattaattaaaatttagatatcacatcttatatgttgattttgattggctattatttttgaaaattaataatgtatttcgttttttaattaatttaattaattaaattagtatttgactttttaatccttaaagagataaattaatttattctttaaaattttatttctaatggcatacctatgtaattacttacaaaaattaaggttacatttaaaatgtacttcccaaataatatagtaggataattataaaaaaaaaaaacttaacaaaaccaataaaaatgtgtattatatatttgttttcaaataattgttttcgctaggggatcaattattttgtattaaatatggaccaaccaaagtaatcagtctacccctatatttacgttccctatccattatcgacaaaaagcaatcactcctcaagcaaatcactcctcacaccacagaaaaacaaataattgaagaaatg

SEQ ID NO: 32709 - DNA, 3000 bp, Unknown; identical to SEQ ID NO: 1036
  misc_feature (1)..( 3000): 2750-1469P.txt file - cDNA_ID_3060263; gDNA_ID_1620350; Annot_ID_154288

SEQ ID NO: 32710 - DNA, 3003 bp, Unknown
  misc_feature (1)..( 3003): 2750-1469P.txt file - cDNA_ID_3060267; gDNA_ID_1620350; Annot_ID_154287
ctggaaaaagtagcacaggtgaaagttaagataaacagactttaaacatatagccatacagtgcaacatatacaaatacagcactagaagaccaaaacatatctttctgaattaaacatttgcctgaagcttaaccctcctttctccatatcttcaaattaacaagaagaaaccagcaaaactagacatagaaagcaacctgccgttcaaggagctggttgttagatccttggaaatgagtatctgtgcctatcttcccgtttccattaaactgataactcaaaggggagctcacatcagaagaagaattgtctgttacacggttgttctcaaacttatacctgcaaatagattgacatccaattgcttatgttagtccaaagcaaccctggaacaagaacttaagaaagcagagacgaaaactgaaaacttataagagacagagatacaattatcattgatcagacatatcttaaagggagtccaggaacttcagcataagtactaatttgctatatgagtttcataatcttccacttgtgtgtcaagaaaattagcaaaaatagcatgcaaggtgcatttgggtgaaccataccctgcagaatcaggagtgcacaataacaaagagtggcataagaaggaaagtcaggacacaccttaacatttcagcatctgctctgacatcaatcttctccatctctctggatatcagagtcttaatgcgtaaagtgtatgcagcaatagcctgaagcagcagaggaggacccctcagggaatttactataacagttttcatctcatcagttatttctccatcatactcaaaacccagcttggcagtttccagctctggaagtgaacaaattccatttccttcgtatgcagggaaggagttacgtattctttcaatcatgcgtgatgcaagcaaatcacatactatcctgatatttcgttctcgggttgtttccatgagaatgacatcatctgcagacttagttcctttgacagtggaataaacagcttccctctcactgttagcactgaggctgcttaacacttcattcgatgaattgacagaccgttgtgcatcatttgcttgattaacatagacttgtagccttttgtgatactctgcaaatattcttgttgcttcatcacattgttgatcatacgcttccaacaatgcttgcttgtgtctgaaaaaaggaaaaataaaactcactaaacaatttgaaagatctactgaacataactacaacaaatattttgatttgttgtatgaacagaatcaatgcatttcaacatagataaatgctgttgattgaggttcatgaagagggcaaaaagacaatcaatatcgccatacaaaagtgagaatcttaagaatgggcgatgtggcatatccatgaaaccagagaaacaaaatagcctgactaaatcccatatattccattctagggtatattaaaatcattggagaatcaacaaaacgaaagaagaatacttcagggctatatatctatggctcctgaaatcatagagaaacgaaatcgaaataccaccaaaactctaagcagctaaccatactacacatagcaaccatacttgtaatggttctgttgaggacttaacactaacgataataaagcataacaacaacaagagaaaatattaaatgaacctgagctgagtggtgcaggttatttctattgtattattttacaagtgagaagcaatgtatccaaatacagtattcaaaattgaaagattcaaaacaaacctgtaatttgctctttcatcaagcatcctcttccgctctgcttcttctctagagacctccaacattctagctttcaaatcttttctttgcctcctcactatgttcctcaatctctccacttcctttgcagctaattccctttcctgcaatgcagcttctctatcctccgcataactcgaactctcaccagtcactgtcttatccttccgccttcctttactcttactctcctccttcccaggatttaccgaactcccaatgctagcattactacttcccccatgaaccgtaatattccgcctaattctctccactgtcttctccgatttcactcggtttatcaaaaaattccatataggtatcatattccctctacaaatcttccttatagcatcaatagaaggaacatgagatttgctcgatccattatacggacctaattgcctgtaccccatttccttctgtaaccattctaatatcgcctccggtgtcggagccgagctcgataaactctgcattctctctacaactacaatacctaactcaatccctcaaatcttcatgaaacttccgaaatttctactcatactttgcgccttttcttcaaatccaaacaatcaacgtagagaaatacctaggttactcaaatcgagcgaaaacaggagttcatagacgctataaacctaatacaattcgcgaaatgcagcaacaatcgagcgaattggtactctgatgaacacagagacagaaggaagacgtagacaaacagatctggaatcccgacgactaactcgccggttccggtgacggtagatggaagattgtgacggagagatggatctggataaagagatttcaaatcgaggtcccgcttgtttattggattttcaattaaaggaatcaaactcgaatttttctgcaagtgtcgtcgactgttgaaagttgaaactgggtaataaccgcgtcggactcgggtatgagatgtatccgggtcggactaaggtatttaagtctaaccgggtcgaattgggtaataagaaaacactatgggtcaaaattagaatagtttaaaattacaaccagaacatttagggtcaaagttgaatttatataacactaaagggatggattccgaattgttttaattttctcaatctaaaacccagaggttccttcctagggttttgtttgatactctcaaatcggaaaattttgaaacaatg

SEQ ID NO: 32711 - DNA, 3000 bp, Unknown; identical to SEQ ID NO: 1039
  misc_feature (1)..( 3000): 2750-1469P.txt file - cDNA_ID_3060275; gDNA_ID_1620350; Annot_ID_154283

SEQ ID NO: 32712 - DNA, 3000 bp, Unknown
  misc_feature (1)..( 3000): 2750-1469P.txt file - cDNA_ID_3060311; gDNA_ID_1620351; Annot_ID_154317
aaggatcatctgccctaacaacatataaattcttgctttccaactcatgtgtacacgtaatcatttcggcaacatcactatcaccacacaaatccttacgattctgacctacttctccagatgggaagtaagaaaacttactcatattttctgtataaccagcactcaaaaccatatttgtcaacattgctaaactaggaacttcaaaatcaagctgtaaacatcttgtctcaccgccatggtatgaaccatctgctgcccaatatcctcctacatgcaatcgaaagaaaagtgtcctgacaaatacaattatcaaaaactctctaaaattctgatcaatctcctaagtttttaatattgtatcatgtaatgcaaggaataagatatacgtctcaaaaccaatttaaaaaattgaaaaaacaagaatattttccaacaaaattcaaaagatataagaagtgggcacgagtatacatgtagcatctctaagcatgaacgccatcacataaactcaaagacgtggctctatagtgcaccaaagaaattaactccccaaggtgagtttaaaagtcaaagtatggatcgaagcaaaaaaaaaagtttttagagtacgtgaaaaggaaaactaaaaccaataagaatgtcttgtaacagttaccttaacatcttgcaagctccagccgcattcagtctacaaaatttcgcgattcaatgtcgtcgatttaagagctaaagtggatttaggggtttataataaggtataagaacttcgtgttgttttttgattatttcgtgttgttttaagcaaaaaaacatgtcatttttttatatttaaaacacatcgttttattttgacggtactgtagacggcgggtggttttcacaaataattttaaacttcaggtgttttttcattaaataaataattgaggggttttttcacaatatatctttagttggggggtttaattactaaaaatcctattttttatatgaagaaaagaacgataattaaagagttaacaactccaaacaatatcatatcattttgaggtttgtactgttttatcggcgtgcatggcttgaaattactattagttcattgatcgattatatatcatagctactactagtgcctagtggaatacaaaaaataagggtaccaattcaattcagtggtattgcgcatgtcagacctaaatctcactttcggcttcacgttgatatcaattcaagggcttatgcatgtcgtatccaacaatcggctaaaaaagaataagattattggtggtgcatgcttttaaacatttgggagttcataacgatataaccattggaattaagttttgttcacgtgtcaacgatccaccatttgtttgtaccaacacacgtgccatacgatacaccaccagcatatttatcgatgtggttgttctatgtaacgtgtgtgggagtgatcgggtaaatttatcctgacacagaccattttttccttttttgggcaagaaacatatccattaatcaatctcaccatcttactctagttcgacaaaaatgtctttggaatgtccgaattgttaataatcagtttatagaaagaggtgataagtagttagcccgacgaaaataatttcaatagttatcaacagattttgataacctcaagcaaacgataaataattttactcacattattaaagttcttctctttagtattttatttttacatcttagttcttatctggttataagcaatcaatgcaaaagaatagtaaaagactcgtctaaaaatgtcaataaagaacttagcttacggaaatgaaaaatgtacaaagaaaaccatttagttcaaacaaaaacaaggattgtatgggacatttagttttaaaaacaattcaaaaaggcctcagagatcttggtggtaaatatcatcaactgaagaaattcttcatcaagagtagcaaatattttgattacatcaccggccaaaacaacttagtaaatacatagcaaacaaaacttaagaaccaaaaaacataatgatggatgatgagtcaaaagtagctggtaaataatcacataatttcccgtacgtaagggaatcattgggaatccgaatgatttttttcatcaccctcaccattccatcaaccactatcaataacacagaatttcacaatttcatacactacatatatctaatggaaaaaaaatcaacaaagcaatttcgattcagagattgatagatgtatctgcctctattcaccgagtatccttcggtcaagaaaaagaaaactcggagttttcagaagcagagcaagcttacggaggttcacgtaagcttaccggagattattacaaatccatcatctctttcgcctaacgatagattcctcaatccattacaaataaattgtatagattaagaaatttgcaaattaggctttctttgaaaaaaatcgaatcaacataagatatctaaaccatagcacatcaaataagcggcggagagaataaaatttgatcggacaaagtaactgagcagagaagatgagtttatatatgcaattatgatagtggtggactttcgaaaaccctagttcttaaagcgtgacgaaaggccattttattcggtttgggctagttataggcccattagtttaaccaaatttatagtttgagtgacggctaataaagaaagaaagcgacgacgtttcgacaaaggacagagttaaaaaattgatggcccatgcaggtttcgaacctgcgaccttcgcgttattagcacgacgctctaaccaactgagctaatgggcctattttattactaagttgaatcaagctacctaattttaattatacaaaataggatgcataaccaaactgtgtcgttttatcaaatctgccaaactttgtctcacagacactgcacttgatctttctcgtggccaaatcttttgattctccgttcattctccggttccgatctcgaagaagatg

SEQ ID NO: 32713 - DNA, 3003 bp, Unknown
  misc_feature (1)..( 3003): 2750-1469P.txt file - cDNA_ID_3060345; gDNA_ID_1620352; Annot_ID_154361
aactgcttttcaccttataatttccagattggagacgtcaataaggacatatactatagagataaaagcggattttccaacaatgactatctcacacttggagtcgatcaacttcctttgttcggtggccgtactgctgttcaatgctatgaagattttatgctcagtttttcaacaaaatttgagccatatcttgggaatgtgattgaagaaataagtataggtcttggtccttcgggggagcttaggtacttctgatcttctgtggactaccaccggtaaagccacaatagctacaataggagtttcttacacagttatctcttgcagatatcctgcacatccttctggagatgggaggtggaaatttcctggaattggtgaattccaatgccatgacaagtacatgtgagtgcttatttattgaaaatttgtatttgcctgtactaatcacacttacagatttatactacttggtttaggatggaagacttgatggcagtggcatcccaagaaggcaaacctcaatggggaagcagagatcctccgaataccggctgctataatagctttccatctggagttccgttctttgaggagggcaatgatagctttctctctgactatggtcgtttctttctagtatgttctatatcatagcctctttggtgattctgatataatatattgttatgatataaaagtggctagtaggctggattatagataacaacgtgaactgcttttcattgtaggaatggtacagtgggaagttgatttgtcatgctgatgctattcttgcaaaggcagccgatgtcttgcggagacgtcaggaagaagagaaaagctctgtaatgctggttgcaaaaattggtggaatctattggtggtataagacatcttcacaccccgctgaactaactgcaggttattacaacacctccctcagggatggttatgatcctgtagcttccgtcttgtctcgtcatggtgctgctctcaacatcccgtgagagcctttttctgaagttttcttttactatgtacataattctcagaagctgcatggtccagtttcactaacgagagaatctatcatatcttttcagctgcttggatatggcagatagtgaaatacctgagaaatatctttgcagccctgaaggattacgtagacaggtactttctttcgtaaacccttgatccagaattcaattatgttcatatgaagtatgtatgttacttgtatttagaccggtcactgttgaagcactatttacttccgtagagacacttcaaactagtctagtctctgtgttcttactgcgctgctacattagacaattaagcatgccttataagaacatgaacaaatcagcattatcacattttcttttgctagatacatgatgtttcgaagaagtggacaatacatgtgactggtagaaacacaagcgaaagatttgatgaggtgagttatttgcacatgctttagtcttatacgtctgaggtcaaagtggtggttattaaccattttctatatgaattctgcaacagatgggactaaggcaaatacgagagaactgtgtgcaaccgaatggcgacactctaagatcatttacgttttgcagaatgaatgagaagatctttagggtcgagaactggaacaactttgtccctttcattagacagatgagtgcagatatgtaaacacactcaccacccattggtgtgtttgtcttttgttacagaatcgatctttcctcaccatattgctttttcagatatgtgatgaggagaactaatcaaatcaaaaattgttatatgataaaatctctctctgtttctattcttcattttgttctatctctattgcaaaagtcttgcagaaacctttttcattggatcaaaaagttacattgtatgttttgattatcagaaagcgatccaatacagaaggtttaatcacagcaaatgtgttacatacaaagatattattgaatcaaaggacttgcctatcagcagcctcggcaacaagaggcaacctcggggtcagaccaaacaagcaagcagagaatccatagatcaaagagacaagcaagaagaggaacactgtgctgtccaaactcatcaccacatctaaaccaaacccatctctaggattaaagctcctctcaagcaaatccgggaaaatcaacaacacatcaagcacaatcgcctgcatcgtgttgaacctgacgtacctgctgaaattagggttcctcacaacgacgaagtagagagtgatgaagataagaaacccattgaaagggaagctcttgaaagctctgatggcgggaaacaaaggttggatgagaatctgaaaaggttggtactgtgtgatgatgaatttgccgtattgaatcccatcgaagaatgggtagaagtaacagacggctgagattatccgatccgatgcatcgacggaatcatcacccttggattggagtacgagtgtggcggctctgtccctggaaagtctaggttttgggaattgggtatcaaggtttagagggagaaaagaacgaccggttagggttagggttccggtgagagatggtaatggagcaaaaaactgagatattattgccattttgctctgtttttgtttcacttcacacaaaactgaaagactgcttaacacatgatgagaggataataaactaaactccactctgttttaaaagtttagcttaaaacattgtgtcgtcttcttatctttctaatatgataaaacggtacgtagttatttgaagtaaggtaacaattaaatagcctctgttattgtctttgttttttgtgtatatttaaatatcaaaatccaccggtataaaacggcgtaatgcctttgtattggacccaattctttcaattttcacctaatttaattacctccgtatttattttttagtgcacttcaatgtctcttgcatatatatattggagcaaattataaacataatg

SEQ ID NO: 32714 - DNA, 3003 bp, Unknown
  misc_feature (1)..( 3003): 2750-1469P.txt file - cDNA_ID_3060353; gDNA_ID_1620352; Annot_ID_154350
ggctccaaataagaagattgtcttagttagaaaatggacttccctctttaatataaatattaaatactttcacctactttctccttgcacaccaagccacaactgttttatacttgtccccacctaagataatgaatgcatgaatgcatggttttcaacaccctgaaaaagtaaaccggtaaaattcatcgtgggagtcaaaattggtagagtttaacatgcttattattaatttgcacacccatttctgttgtatgagtgtaatccacacacaaaaaaattgtttagcaaattgttacacaaaacagagcttaggtaataagaaaattagcaaattgttacagaaaatatattctcctaagttgtctagcctctagtatcccgataccatacaatccacaaaacagaggatggaataaagtgagagaggaaggaacagaacaatacataagaaataaaaagcaacataaaagattgggtgttcttgttagttaattagaagaatgttaaattgtcattataaaatattttttaaagaatgttaaatttctagaaaacttatctttgtgggatgaagagaatattattttcttttaaaaaaagttttgtattgttaaatctaaacatatacatcaaactttaaaaatcaaagcaaaaaaagaatatctctccttttgcatgcttttgacatattgaatttaataggtaattttcttaattaagatgttaaacttatggattcatgatttgaacaaaactgaaaaaagtatatggaagcgttggtgagattcatacctatcaaaatgaacaaaaggatcaccaaccgaatagtaaaaccaactactgtatttatcatggccatttttcttcttctttcttaatttctctctttattaaaaatttgttaattatatcataatcttaactgttttatataaaaagtgttttttcctagaatatacaaggtattccgcaaaaaatgccaataaaaatggttttaaattaaaaagaaagaccaaaactcatataacctcaaaaacatagtatgttatttttagttaatataaatattaaatactttcacctactttctccttgcacaccacaactgttttatacttgtccccacctaagataatgagtgcatgaatgcatgaaccatcattggccgatgcgtttcctggtgcatgtagctcacagccgtcgttctcacattttgttatttatgatcatacttttttttcattaaaaggaaaaaggtttactggtttggtttagaacaagaactactcgttataatcatacttttgtttaattaaaaaaacaaaaacaaataatttctagtacatcttatattacatactatagtttgatgataaaaataaaattcaaatgacgattatcatgtcgaaaagacaaataataattgtcttactgacctacctgcctgcctctatatatatactagtctttggtcgcctttactataaccaaacatcgagcttgccttagagtttgtctcaagcttctccttttttggtattttgtcttaagcttccttgcttctctttcttcttcttctctactctttctctctatttcaaaccttcgttttctttccttttttgtataaaatcttaaaatcaaccaagacaatggaaatgaaattgctctttacatcggctttcacccaaatgttcggctactcgaaccatatggatcaagccagcaactgccaaagcacccgcaacaaaattataaagatgatgaagaaagaagaattcccaagtggattccaagtccctcttcactaccctaaatactccaagtctgattacgaagttatggatgatctccgccttgacttgctcctcaaacaatatggattctcctttgaaggatctcttgaagacaagagggtttttgcaattgaatcatttctctggcctgatcagctttagatggtctatgttggtgttgaatgatcttatatcgctctccacatgcatatcaatgagcctatactcgagtggttgaatgtttttaaaattatgtcaaattaccatgtatatcaatcacttagtaatgttttagaactatgtcaaatactagtgtgtgttatatttctttgtgtgtggggatgttttgaagtatgcaattcttcacatatatatgtatcatatgagtgcattaataacatctttgatgtcatgtataacactaaaaaaatgtgatttatcgacttataaaaatcttaacatattgacattaacataaaacatatagattattgtatgatatagattaaacatgacgtcatgctggatattttggcttattggcttgtacattacttgtgattatgagtgtataatataaaactaattactagatttgcacaaaaaaaaaacagaaggatagaaaactaactagaaaattaagacattacatacattcttctatatgaaaaaaaacatttaaaaaacaaaacaaaacatttttatactaagatactaatgaaaaatcctatcaagaaaatgaagaagatcataaaaacaaaattatcggatttgaagagaataaattttgaccaaaaaaaaagaagataattaaaataaaataaaaacaagaattggccaactgtgagaacatcatcaatgaagaccaattgcgagatccgacaacaccgcttcttttgatttcgatcttactttcctgggtatgtctcaattcttcttcctccttcagttcgtgttctgtgtctgattgattactctcacaaaactcatcttttcattgtctaaaggtctaatctttagctataactcaaaatctgtatctaagttctgacaagtttctgttacgaaattcaaattttttgatacatatgttcatttctcagaacaggagatgtcaattttggcgatggttttcgtaacataaacatgagatttgattgttctgtgcagatctcatagttaatctggtttgagtctagaaatg

SEQ ID NO: 32715 - DNA, 3003 bp, Unknown
  misc_feature (1)..( 3003): 2750-1469P.txt file - cDNA_ID_3060369; gDNA_ID_1620353; Annot_ID_154395
tccacgcactctcaagcattggatccatagcaaccataggtctagtaggcctctcttccactcttgctgcatcaactctctcagccaccacagcgaaatctccctgatatcgaagaacctcaacttcctctatcatcttcattactctcttcccataacggtagcttgagacaagattcttggaacaaaacccacaaagacacaacctttggacttgaacagatctcattctgacgagttcgttaactcgaggtactattgcttcaacttttgaaacccatccttgcacaacagaaagtcgttgtaaacctcgtctttcttcagacaaaatctttctcaacaaatcttctcgtctttgctcaatctgctcaagagctctctgcagagctgtcagattctcctctaagccatgaatgtaatctccattcctgtttaagcaactacaaacattcttcgtcaactgatcacatgatattgatacagagacacaacctcccatcctgcgtttacacaaaagaagaagtaaacttgtggcagagaactagaagaagaaaaaggataagagctgctgagttgtgaaaattgacaataatccaaactctaaagtcgtcgctattgtaaactttaaacaatattctgaaaagagaaatttctacgaaaaaagactaaaagagtatcatttcagaaagataactttttttcaacgcaaataactctttaataaatattgactgaggtttgattgaaagagataaaaacttcatttgccagcaagattggcacaaaactcgagcagaggacatctgtaggagttgtgtcgtggtcgtctttggttaagagaagaagaaatgggttcaatgttcagtggaaaccgaatgagcaaggaagagatggaggtggtggtgaacaaggctaaagagatcgtctctgcttatcccgttgttgtcttcaggtttgttctcgttgaaatctcccatctttttcatctgggtattactcttttcgttcgtgattatgaatttgttgagaaaattggatgttgttgccttgaggggttttgaattagtcaaaaagtttgagtctttaccatcagggggtagagtctgcttctatttgacgcagaggcaccaatggatcattgtctgcttgttttgttgtttccatctgtgaaattaggtcgtgaatgaaagatcgaacatcatcttatattagtgattctccatccaattcagagattatttgtgggttccctagacgattagggatgtgatcatgtaatatatactgatagatccagttctcaaatttgattctgactagtctagaaatctttgaagaagctagagtttttgaagattgatccgtgcaagctcctatgactgatttggggatgcctttcggagttttgaaatgaagcttaatttgttgttgcttagagtcttgagtttgattttgcttagtcttaaaaggaacgtatttctttccactttttgagatggtctaaaggttacttttcaaatgtaatgtcttagctctgatccatattttctctttcgcagcaagacatactgtggttattgccagagggtgaagcagttactgacgcagctaggagcaacttttaaagtacttgagctcgatgaaatgagtatgaaaccaaatccctgtcaatacctgtatattaatatatctcaatgaacctgaattatctcgatgctatgtttacttcaggtgatggaggtgagatccaatcagctttatcagagtggactggacagaccacagttccaaacgtcttcatcaaaggaaaccacatcggtggatgcgatagtaagtgaaaaacctacacaaattctctgcacaataatggaaattcgggttgccggaaaaactaactgcgtttttcgtgttgcttctatattttgcaggagtgatggagaccaacaagcaaggcaagcttgtgcctctacttactgaagctggggctattgcagataactcttctcaactttgatgaaactcgaaactagtgtgtgaagagtgtgtgttgtgtttagatcatgaaaaaagaggtatcgtcacatactcaataaagaaagatcattcccgttgtttaatacagaatatctaagtgtatacttttcatgttggtgtttcggttaatggaataaaacttgagaaatctgctctagtttcttgctctaaattactgaagattactggttgcatcccaagttgactttgtagcaggccggtcaagtaggtggattaaggcttttggttgaaccaaacttatctagtaaccggccgtgtaggtgccttaaaggctgaaaaactaatattagccaaatcgatcaacggaaagttacgattgaaagagaaatgaatattcgaacagcagaagtgcattttcactgatttgtgtaatccaaattcggattcgaacagcacaagtacatttttcactgatttgtgtaatccaaattcggagaaccaatgtccaatggcaatgaataatgtcaatttggttaatctagatttattataaagtatagtgcaaaatcgtagtttaagagaacttgtggggtcaattagtaaatattatctagagccggttaaagaagagaaactgaggaaactgaatttgaccagagagtgtgttcaagcgaagcgttgtagaagaaaagacaaagttttggaataagcggagcaaaacctagacaggcccgtgtaagatggagatttgttttaaagatttatcaaatcaataactactaacctaagcaagtaacgaagccgtggctctcacaaattagcccaaatcctcaaatttcaccaaaagtcttcgaatttattctccagtatcagtttctctgggaaaaagttctacttttgcggactctgaggaaatcttttgtatctgtacaccattcatgggttaatccgattaaacccgtgttgctccgttagggtttaagagaattgccgccttcaccggccatg

SEQ ID NO: 32716 - DNA, 3000 bp, Unknown
  misc_feature (1)..( 3000): 2750-1469P.txt file - cDNA_ID_3060371; gDNA_ID_1620353; Annot_ID_154391
agggtgtcattgatgtttaacaacattgaaagtatacgtgatgctcctgaatctccccaacttataactttgctcctccgaaagaacttcttggggcatatctcaagcagcttctttcggttgatgccaatgctagttgttcttgatctatcaatgaacagggatctcagacatttgccaaatgaaatatcagaatgtgtctcattgcagtatctgagcttatcacgtacaaggataaggatttggcctgctggtttagtagagttgaggaaacttttatacctgaatttggagtacacaaggatggtagagagtatctgtggcatatcaggtttaacaagtttgaaagtgttgagattatttgtttccggtttccctgaagatccctgtgttttgaacgagttgcagcttttggaaaacttgcaaactttaaccataactcttggtcttgcttctattttggaacaattccttagcaaccagaggttggcaagctgtacacgagctctgcgcatcgagaatcttaatccgcaatcatctgtaatctcatttgttgctactatggacagtcttcaagagcttcattttgcagactctgacatttgggagatcaaggtaaagaggaatgagacggttttgcctctgcacatcccaaccactaccacattcttcccaaacctctcgcaagtgtctttagaattctgcacaagattgcgggatttgacgtggctgatctttgctccaaatcttacggttctacgagtaatttcagcgagtgacctgaaagaagtaataaacaaagagaaagctgagcagcaaaaccttattcccttccaagaactaaaagagttgcggctagaaaatgttcagatgctaaaacacatccaccggggtcccctgccatttccctgtttacagaaaattttggttaatggatgctcagagctgagaaaacttccactcaatttcacgagtgtcccaagaggtgatcttgtcatagaggcacataaaaaatggatagaaatccttgaatgggaagatgaagccaccaaagcccgtttcttgcctacactcaaggttctttctctcgcatttatctgccaaaacttctttttaattattcattcctttggatcttactctcttttttggatgttttaggcttttccggagaacatcgacgctgacggctatgagatttccttctgagacgatgacttcttgttgctgatattgagtgacttaaatattcagacataagtgttattgctccaactcaacatatgttattaaattcactttcattaagtatggggttcaagttgtttcaaccatatcagatggttcttgaaacaacttcaaccaaataaatattccgggaaataaggaaaacgaagtacaacaacatgacccttcgaaatcagagctcaaagaaatttcctaattcaagtcggagcacagatgaatctaccttaacagctgtgttcttaagtttaggaacatcgtgtggaaaaatcagttatcggcatccatacccgaagaagccgatcataaaacgaacaagttgccacaacgctttgcttctgatctttccctctgtaccaatctgctccataagcaagagaatgatgcttgttataactctccaacacttcacctttcccatcactaaccttcgctaaagcaaaaccgttatgcatacaagccgccaatacaacaccgctcagagaaggatggtgcttgattctccacactccaccacctaaagacactgatgtttcgttcagaggtctcgaaacagacctcgtgtcccaaactcttaaggtttcatcataacttccggtgaatatagagtaaggatcacttgggtttgatgaaatacagcaaacacccattgtatgaactttggaattctgaaaaacccgattgtcagccggactatctctgatatcccaacagctgaacttgcaatcatctgatccagtatagaccaaattaggattgttgagatcgaatgacgccgtccaaagctcaaagtcatgccctttccattcttgaactgtttctagattagaatccgtgaatgaaacaactgaagcagagccatctgataaaccaacaacgattgatgttgatgatggatcccaatccaaacaaagacacattgatgagctgattcttttcccggagacttctctcagagtacctgtttcaagcataaaactttactcagatcaccaacaagctaacaaaacaaagcttagctgcatattaagaacaacccagcaattgatcctttacagatctccctttggattacaccaaagttccaatttttatttcacttaattactgagtccattgattcagaagtttccattacaagataaaaaaagttagtacctttactttcagtctcatctatcttgtaaactatcaagcatccatcagcatcagcctgagcaagcgccacgtctcctccatcgccaccacgactccaccggatatcgaaaactccagcagtgtcaattttctggataagattcaagccaacatcttcaacatctccgacatcaaatagatacactgacccggatcgagagggacaatctccttcttgaagtgtataagtcgaagctgcgagcaagtttgcgtaagactcgtgaggacagaattctacggcgtcggcgtttccttcgagatagcaatctgctgcgtccatggcgactctctctgctcttgtcaccaattttttccccggcggctaaaataaagcgttttaaaggaatacgaagacgttccgcataagaaaacataaattggtctatgcgaccggttatgacaaatttaaccggtctaggaaaatttgatcggttaagatagatcgccgatgattaattaaaccgttctggtcgtcttctacctttagttggactgaaggagaaagagactacggcggagaaggagattacggcgatagtgtttgatcagtcatctatg

SEQ ID NO: 32717 - DNA, 3003 bp, Unknown
  misc_feature (1)..( 3003): 2750-1469P.txt file - cDNA_ID_3060411; gDNA_ID_1620354; Annot_ID_154421
ttttcttttatggatgatcttcgaacatctactgcgaaccgtcactattatgaaataaggtcttcagaaaatttcagtaaattgtgtgtattgattacttaacagtgctttcttacagttttcacttatatttctcaggttacttcaaattccaggtgctgtgattgttgcggttctcggaattcttgttgatttcccagtgatttcactcttagcattgtgtaaaagcccgtacatgttgttcaaagggtggcaccgtttgtttcatgatctcattggacgtgaaggtcctttcttggaaacaatgtgtgtcccaatcgctggccttgtgatcttactctggcctttagctgttgttggagcagttttaggatccgtggtctctagtgtcttccttggtgcttatggcggtgtagtctcatatcaggttattaaacaatgacttttttttttgaggaaaatgtgaatgctgatgatactgaattggtttctcttgtcataacacaggagtcatcgttcttcttcggtctctgctatgttgttgcttctgtttctatttacgatgagtatagcaacgatgttcttgatatgcctgaaggttcttgctttcccaggtttgtctccattggcttatctagcaatctttacctctctctctttcttttcattctaaaacagtggttttatggttttgtaacaggccaatatatcgaagaaacgaagagggcgctagtacggcattttctggtggtctttcaagaccgaactccttcaagacaactccatcaagaggaggatcaaacaaaggcccaatgattgacctgaaaccgcttgatgtactcactagtcacactcttcttttggttatctttgtatttaaacctgaagcctattcttttgatctttgcagcttttggaggctctatttgtggaatgtaggcggcacggagagattatggtaacgaaagggattataaattcaaaagacattgaagaagctaaatctagcaaaggcagtcaagtgatcagctttggcttacctgcttattctcttcttcacgagcttttacgctctatcaaatctaactccaccggtttattactcggtatgtttcaacagttttctgtcaattttcataaccgcattatctagtaactatttgaacatcatcaagaaacaaacaaaaccgtttctgtgtttttgtttaggtgacggtgtaacggagataactaccagaaaccgcccaaaagatgcgttttttgattggtttctgaatccgtttttgatccttaaagaccagatcgaagctgcaaacctatccgaggaagaagaagagtatcttggtaaattggtattactctttggagattcagagagacttaaaagctccattgttgaatctgaatctcctcctctaactgaactcagaaaagccgaacttgatgcctttgctcgcaggtaaaaaaggcaaaaaaaaaaacacacacaatcttgttacggctttctacttcggattctaagatgtgtttttggttttggttaggcttcaaggattaaccaaatcagtatcaagatatccaacattcagaagacattttgtggaactagtcaagaaactatcaaatgatctagacaataaacataaccgttttgaaggcggttcgagatcagttccacgtcccgggaaaacggtgtctcggattttcagccaaaaatcgttcaagaaaaagacaagtagcaatgggtcagatcaagattcaccaaacagagggttaagagacattgatattgtgtaagtaaatgttatgcgaccagaattagaccgaaacttcgtctgcttttagctctgtaatgataaatttatacagattccaagtgaatatgaaactgtttcatttatctaacaaatgttttacattcagcttttgcttgatgatgtgttgtttctcagaaacagcagaaccgtttcttctgcaatagaaatagcaagcttttagtttttctttcactttagacctcatttgatctaaaacataacaaacataggctgatgttttcgttagtcataaaatcttgagcaattgggattagaaatgttaccgtaggttcatcttgagatttgttattgtcacggcgttgtgaggcggcacgaccacttgcgtttgtctttttgtcgtctcgagctttagcgaatataaccgtaaatccttcggctgatgctggatcgttcacgtcccattctccaaattttggtaatggtcgatcttgttgttgtcgttgttgattattctgaaagtttccaatcacaaaaatgtttgatttctattataatccaacgaaaacacacatgaaaatgctattttttgtatcaaatttgtgaaacaaatgagaaagaaatgagaaagatcttaccgatgccattcaaagattgtgtaaaagatgcaaacagaacatgagatgatctttcttcaaacaacaagaaaacttgtttgtcttctcttttagtttttgttttcttaaaagaatttgattacgtttaaagaattagaatttgagaacagattagcgttttctgaaagtttaaatataggttaacgttttaattattgttgaaacttgaaaacagaaaacaccaatcttttgtagcgaaacggaacgctttttctcgtaccgtcttttgttttcgagtgaacttcatcgtatcaaaactcgccacgtgatctacacacttctcgaggcgaacacgcgcatttcagaacttatccattaatctctgtgattaacctataagccggtatttataaacggtcacgattttccaagttttttaatcaacggtcgttattacgtagacgaagctaagcctcacatctacaaatacgtatacatacatttttacataataattaattaataattacaggttattaacaaattaatcatttttaatagactattaaaaaaacaatttcatttcatttgctctcttctccgagaaaatg

SEQ ID NO: 32718 - DNA, 3003 bp, Unknown
  misc_feature (1)..( 3003): 2750-1469P.txt file - cDNA_ID_3060419; gDNA_ID_1620354; Annot_ID_154428
tctttgattgtttttggtgtgagcgaagatgggaagatcgaattctcaatgcccatctcattggattctcctctgcttcttcatctcttctcagttttggggattctcacttcccacttcgataattcaacaaaatctcgaggtgaaatttttagggtttttcagcaatttcaactgtaaatttcgtgtagaagaatgtctgtatcactttagggtttgtaatcgatttggcttacttgggatttacttagaattctagattttgttcaaattttgaagctttgtggttgttgttctacagggttttaaagatcctgaagacggttttcatgagattcattgttcaagagaacgtagcagagttgcttggaaaatcattcaagaggtatgaattgaaagcagtggtttttattattttttatgcaaatctgtagagttttctcattgatctttgttgttgctgtgaagtatctcatgccgtatgtggaaaaggagcggtatcagttaccgagtacttgtagagttcatcgagacaatgacatttatagagaacaagaagagcacaaattgcgttcagatattaatgagtggcgttgtggattctgcaaaaaggctttttatgaagagaagtatctcgataagcatttcgattcgcgccattacaatttacttaatgcggtatatactgatgcattattgttaaaatgatccatctttctgtgacaattcatactgttttggggtctattagcgattcataacttatgtgcttttgaatccagagtcatggtaaatgtctgtcggatctttgtggagcgttgcattgtgatcttgttgtagacacagctcggcttaagtccaagtgtaatcctgcagctgctgcaaaaaaccggcacttatgtgaggtacatatttttttagttttgattcggtcaatatcatatgacaagtttggactctaatactcaaagaaaccttgtagcttctgagaattgcaaagaacatttcactgaaagatttgaacacttctgaacatattgtcttcgttctgtttcttgtgttcccgtgcttatctgctctggtgtggttgcattgcagagtttggctaatagttgttttccggtaaataaaggttcatcagccaaccgtcttcacggtattagaaccttcctgaattttactatcttatttcaacagtttttgcttgtattgatccataaagattcaccactacttttggggtttaaactttacaattgtagacttcttcgtggggggttttaatgatccatagagattcaccacccttttttgggggttttaacttttaaaactgcagatttcttcttgcgtcagttctgcgatgcacatacatgttcaggaggatcaaagcccttatctcaaaaaccaaaggtaacataataaaccctttttttgtaaatgatattatatcatatcatatctcatttaatctcagtcatatgttttgcagaagaggagtatagtgtacattattttctccatcatcgttttggtagtgcttcttctctattacagctttgtctatttgttccgaaggtaacaacaacattaaaatactgtttcagatttccttacaactctaaaaccgaaaaaggccctcatgaactcattgttcttacgttttactaatctgtagaggattaaagagaagatctcaagatttgaagcgtattagacacaatggtctgaagaagaaacccttctaaccatatcaagctttagctttaatggcggctgagagagagtacattttttttctttgcaagatgattacaattaggatcagattagtgcattttgcaacatcccttacaattatatcactacttacaccaatattgttacttagaattcaatagtgtttactgcaactagagcggtacaatcgcatttaacatttctaaaacatttcaaaggttcaacttaatttcatttttcatatttgttagtatcattcttaattatttggtttagacttttgagtcttgatcaaccatgattatctcgatcattttatcaattgggccgtttgatgaaaggccttttgggccaaattacaaaacagatatctttggaagaaccaaaacgacaacgtgggatagacgttagagatgacgtgaagaaaaaaaaggagataagtggaacctactttttcccagtataagtccaatatcactcaaagtcaggacactaatcgaatcatagcctcgtctctttcaatctcaacttcaacgataaacaaaaaaacaaagtggataaattcaaagcacttaaaataggtaaataaataatgacgtgaaatataacaagcaaggtatcctaacttttcttttgctttttttcttcttttgggcaaatctcatacatgttcctgcatattttaaacactcttcgaatgttttatcgaaaaattaaaaacattcttaattaggatgaaaattactacgacagatcacactatacggtactataacgtggataattactacatagtattgtattattgagcttgtataagtatttgtgacaataataccaaagagttttagatattttattggtttttctaaggaaatacagatagataaacctgtcgaaccggttgatttagcacaataagcggtcatgaaacgtcttctacatcaaagttcgtaaatttccatgaaacgtctttgagcaccgaggaagaaagtttaaaattcctaaagaaacacacaaattaaaaaaggcaaaacctaaaccccatatttatttgtctttttttctttatcagagaattttaaaaaggtaaaaatagattatattctattccttcagaaaatttttatcgtcctaaaatcttcgtagcctgcaacaaagaaagactaagaaagaactaaaatattttgcttcgtctaattacttttttcctttggatttaattctcagccatcgccgccgttttcggcggtgtaaaaaatg

SEQ ID NO: 32719 - DNA, 3003 bp, Unknown
  misc_feature (1)..( 3003): 2750-1469P.txt file - cDNA_ID_3060423; gDNA_ID_1620354; Annot_ID_154423
gaggagagacctctaaaggaaggtgctgaggactctttgtgcttcttcaaatgtttcttgaataaattgcaactatatgattgtatctgtgttattaggttaaagttttgatctctcaaggtattgattgtaacaagaggtttattcacatatgcaggtggataagtgatagccgagatgagtacactaaggaaagacttgaagccattgacgatgagttcaaactgtatcgatgccacacaattctgaactgtgctcgtgcctgtccaaagggattgaacccagggaaacagatcacacacatcaagcagcttcagaaatctggttgaacaacaaatgaatcaggcagtacctaatggatttttgattctaataatctgcaagaaactccaattttggattcattcttgtattgctgtcacaactatcagaattagattattttgtggtatatcttgatgaattttttttgcctacaacaagcaataaaactctgctttttttatcatccactcattcagctttgccttaatacaaacatttggatttcgagttttgctttattggtgaataagagagaaaaatgtttacacatacctcttgcaacttggaaagtaaataactaatctacaaacagataagcttgttttttaatgtgttgaggaaaatgagagactaatgatcagttttcacgggatagagcaagaaacactgtagctgatgagatctgaactttgagatcagcaacatcaatgtcatgcccgccttcgactagtccccatttgtccacctgcatgaaacatgcgacaaagattagtttttatagaatgtcaaagcaatagattttggccaagtgagtgacaaaatgaaacctgtaaatcttcttcaagtctaatcaatttgattgcatcatcgatctggagtttcccacagaagataccgagggcgattactatagagtgagctgatgcttggagtgcatcaatgcttgcgagttcaccatcattcgttttcttgagcagttcttctactgctttcactagcttgtcgtcttgtttacccccgaagatgctagaatacactttcggtttgacccgaaactctgactctatccactcaagtagaggatcaatactctctacctgaatatctgcaaaagacacaactcaataagtgtaaaatctaggaggtagttgaaattgaagagaaagtgtattttaccatggacgtcactagttagatcattatcttcaggtgctcggaaaaagacgagatcttgatgtatctttctcgataaatgttctatgatctttgaacgcgtaagaggaactctttcaagtgcagtacatgctagtctcataagcggcattgtgaatggtctgatcccttctgttagctaacacaagatcatcgtattgattgataccgagtcagctaccacacaaacataagtagatgcaaaaggatcacaagagaaaatgagctagagaactgcaagcctagttctttaaatctcacttcaactaatcgaattatcaacctattgatcacattagaactcagattgcaaagtccagaaaccgatcaaacattagggacactaaagaacggtaagctctcagctttaagttgaataagcaatgagcagacccaattacaaggattctagctaacttaaatcaaacccagtactgatcagctacaaaacaatagctaaatagcttaaagcaataaactttagaagtaaaacagatcaaattagtgaaatggaacaaacctgatactcccactcagcagcaatggccttagcaagtgccaaagaacgaagcttgagaggtcttttcgaaggggttttaagggttctataatcaagcatcacagtccatccatttccatcatcagcttctctagtcgtcactttcttgtaaaacctcttccctacgatcgaaccagtcatgaaagacgtcggcatcgtcactgaatccgattcgtttttccggcgagagttcggagctttcactaagatgggtttctcattttccttctcgaatgtgaacgacgacgaagattccgatggctgagtatcggaatcgggttgacgagcggcagatgtcgtacataaggatctagcacgaatagcaagattagagtttctcgctgacttaaaagctcttccgattaacatcgccgccattaatcctccctctccggtgacgaaaatggggacctccttgcttagggttttagatcacatagatcgtcagatccaagcctaaacgacgtcgcaataacccggagtgatagttaacctctactacaatgaaggtgttttgataattgtgattataattacaattttattctatctcattgtaatcagctctgtaatataatatttgtaaagaattttttgacaaatatcatttgggttatatagacaatcttttttaaaaaaattggctaaatttagtttgtaaacttttctataattttcaagagttacacttacaccaattcattatgtgatatgtattgtttcatccgtaaattaaataaactaaagtattcttacccaaataagtaaattttattactctaaatccaaaagttttgttaattaagtgatccgagtcccgagaaaaaaatgatccgagtcaaaaatgctgaaacttaactcaaaacggcatcgttttagccgccggtttcaaaactttaaagaaagaacgtaaccataaagagcgccagattcagagataaggctcattaaaatcacctgcttcacccatcacgctaagatcgtggaatcttatatcactagactctcccagatcatgacacgtcatcatcttcatcatgagacccataattttttgaaactgttttatttcactccccaataatattttctgcttttagctctttttaaggctcttcaaaaatctccgtcaacgtcgagaacaaaatttggagaaatcgaacagacgatcgagatcgaggaaaatg

SEQ ID NO: 32720 - DNA, 3000 bp, Unknown
  misc_feature (1)..( 3000): 2750-1469P.txt file - cDNA_ID_3060436; gDNA_ID_1620354; Annot_ID_154416
cacctagtttggtagttcaactcacattgtaaacgattttttttagtttttatgaacaaatactaaactatttgtggtccaaatggtgatcttaaaatggatgacgagtgtgtactactaagcaaatcaaaaactatatatatgagtttaaaataaataaaaataatgagttgtaataagcaaatcaaaacaaataatgtgtttagagtaaaataaacagaataaactatgtgaaacgagcatagcaaaatatgatcataataatttttattttatttttttcaaagtaatcataataattgctgtatgatctaataatgatcaaattctaaagtatttttttttatagcatttcataatatcaaaatgatatgattcagattactctatttaattaagttcacaatatagttgacagtattgaaaaagatttctgcaagtgtaaatcgattttgattttaggccactgaaaggacagatttccatttatctaacaaatggtaagtttttgattttgaactaaccaactcgatatgaaaaaaaaaacagttctaccgtgctgcaagccgtatcatacatatgtagttattccaaaacgtttattggatcttagattgatgccacaaaaaaaatccattaaatttacgttgcatgtgtacaattaattaatggattatgagccaaaacaacatcgttttattaaccctcaaaataaaaacaatccagcagcaacgacaaagacgacgaaagaggaagaataagaagaagaagctgagtccttaggctgatttgctttcttatctgatttaccttcaggttgtgcaaactcatcagcttctttatcttcttcttcgacaagtggcaagtcatcttgcacgactttgactccatcaggtgctagattcatagggacttcgtaatcagagtaatctgcaggaacgaccgttgcgttaaccgtggagatgaagggggtctccggaaaaaaaaagtttgtgctatttgacggtggagaaggtgcagatgaattggcggcataagctccaccggctagagcaagacctatgaaaagaattacgaaagagaaatgttgtcgagacatataaatttttatgtatagattgatcctttttcgattcaatatcggcttttaacgcgaaatggtataaatgtagagaaatcaatgaagaaaattgaagagtatgaataaaaaggaaaaagggagataaataggggatttaaagctattaattatgagatggatatgtttggtaatttaaaacaggtgttaatttagactctaaactttagagtttatgtgtgttttccgttgtgaattagccaaaattgaatcatacaggctgtgtttttccacagtttttagaatatggtttcatattttttttagcgtttgtggttgcttttcgttaaagtgataactttgaactgtgcatgggttgttattaattagagcaatacgtcaaacggatttgataacactatatatatataaaaaaatctaaagattgaaactgatggatcataacacaaatataataatctaattaattataagataaaagtttcaattgataacagtacataatcggttttgtttctagttttgtggtttctgtatatatccatggagagattatgaacttgtaaggtatgtaatgaatatattttcatgtcttgaatttaccaaaccatacattatattatatagtttagaagacgaaaactatgtcgtgaattcgtgatacgtggacttcgagccatttaaaaaaatatgtcgtgtactcactcgcttttcggatcaaaccaacgcaaatcgtacgccactaactaacgataaaagctcacatagattgctatatgacgcacaaaacaaatagtgataagtcaaatctatatatacattttcgatgaagtacgtaaacataattacactatctaattaaccaaacacatactctaattttttttcctacggagcttgttgcgcctaatctaatccaaaagtggttcatgtgaaaagttacaagtagacgaacaagctaccgcatgactcggttactcagtatccgaactcggtcaaaaatagacattttatttacacttttcacggttaagatacattctaaagcatacttggtctaaaactttctaaacatatcaaactcctcaaaacttttgtatatcattttttttcccttccaacttttgtatatcatatgtaggtgttttctaacctatacattttccaagctcactatgaattgaatgttagaaagacttggaaaggcactagtgactagactagtattcagtggcggagtgagaacaaattttctttttattgtgatcaatattacaataaacaaaaatgacaatatcttagtgattttgatatgttgagtgatttagactgtttttctctcataaccgtcgtattcctacttatacccaaatttaagtttttttttttgttttgtcatccgcttttaattaaatccaaatttaagtttggtaaaacaaacttatagaaaaaatgttaagtgttctcgaaatttgaatcccatgtatgcaaacaattcatgtaattatcatttggaactaagaattttacgttacaataacatatggaaaattcaatagaaaaacaaatattatgtaattatgcatctcgtttttttttgtttttttttttacccatcatacatctcgatttatgaagtttacgttacactaatttatagaaacctcaatataaaaataaatacgctaacacaattatcaatctagaaatataattgtttttggtcggaatttaggaacataattaattcatatttgtttttaacaaaaataaaataaaaactaatgattttttaaagataataataacagaagtaaaaaaaaaaagaaaaaaaaaggagaggattaggaagagaggaggaaacatagagcaaatcgccaagatccaaccatcgaaacatg

SEQ ID NO: 32721 - DNA, 3003 bp, Unknown
  misc_feature (1)..( 3003): 2750-1469P.txt file - cDNA_ID_3060450; gDNA_ID_1620354; Annot_ID_154402
aacattcaactttgggtttgctctacaggttgaaattaagcggacgataccaagaggatccatgagctctaacgatttcaaaaccaagaagatatttgttggtggaattccttcatctgtggatgatggtaaacactcttccataatatgattttcttctttcagaatcatgtttttatttactaagtttctcatctggtgattggtgtttgtatagatgaattcaaggagttctttatgcaatttggagagctgaaggaacatcagattatgcgtgatcactcaactggaagatcacgtggctttgggtttgttacatatgaaagtgaagatatggttgatcatctcttggcgaaagggaacagaattgagctttcagggactcaggtaactagccgctcttacaaatattgttgagattcttagactttgtagctataatcagaacactgacatctgccctgtatttgtataggtagagataaagaaggcagagcctaaaaaaccaaactcggttacaaccccatcgaagcggttcggtgactctcgctctaactttggtggaggttatggagatggttatggtggcggacacggtggaggatatggtggtccaggtggtccttacaagtcaggtggcggttatggaggtggccggtctggtggttatggagggtacggaggagaattcggtgggtatggcggtggtggatatggtggtggtgtgggaccttatagaggagaaccagctcttggatattctggtcgttatggaggaggaggcggtggttacaatagaggtggatacagtatgggagggggcggtgggtacggtggtggaccaggtgatatgtatggtgggtcatacggtgaaccaggaggtggttatggtggacctagtggcagttatggaggcgggtatggtagtagcggaataggtgggtatggtggtggaatgggtggtgctggtggcggaggctatagaggaggtggtggctatgatatgggtggagttggagggggaggcgcaggaggatatggtgctggtggtggcggaaacggtggaggatcattttatggaggaggaggaggtagaggtggatatggaggcgggggcagcggacggtaccatccttatggaaggtagagagttcgatgaaagcttgaatcttcttcttacttgttgtgtcatgcttagcatcatgtatggttatcaagattgatagctagtcattgtattttgagagatgaggcttttagggctttgattcccctgagtagtttaaatcaatacattttttagattataattatctcggcgtaacaatgccagattattttttactctcatgtgacatctttagagttagcttgtagcaacgcttttgaggttttggctcaaatcttattagaagaagactcttgtttgtaccattgcatatttttcatcataagcctctgtatgtgtccgaaggtttgattgtcttgttcttctccctgaagtgagagccacaaatagacttaaaaaatatcttgtggtcaatcatctgtttctctattctctgtttcgtgttccacttcacgattgagagaacactttcctaagtttatcaagaacatttcttttcaatttctcgattctttctggctcattctctcatctctgtttcatatctaaattattgattgagaattcgacttgtggaaatggcaacagttgcatcaaatctcgcttgtatcggaaaagtaacgatgtctagagctagttcaatggcaagtccttttttttatcatgctcgccaaagaaatggtataaagagtggatttggaatggattttgcaggtaggatggaggttgcagataaattgcagaaagaaagagaaaggaagagatcagagtcattatccttacaaagtcattgaaatcactcctcctcctaaatctctcggcattcgttgccttcctcatgtgagtctcaaatctttctcaatgctcaactacacttcataagcatttcattacagattccaagtgagaatgagaagcttttttgatttgcagaaccttcaatgtggagagaacgtgatgatcgaagggcaaacgtacacaatctctgctgtgactcaccggtatcagctccggaaaggcaaatacgagccgagtgagaggcggctcgatgttctctctgctgctagatacgttttaaacctttacttcgacaatttgctccaaaactcctgacaacttttatttagctaaaaagtttggtctagaggattttcattgtatccatgaatgcttgtgaatttgttaagcaatgatttgtacttctcttaatcattccacattatatcactgatataccacaaattcgtggtcttacattttgaaaatgttaatacattacttttgacaattcctttaacattcacgaaggattcatgttttagcacaaaaacttgaaaactaaatgatataaagtagcttaatgatttaaccattcaacaacaccccaaagttctttttaaaggaaacaacgacttcgctaaactaccaggttaaggaaatgtatatagctaagaactcaagccaaatgcgtaaattcttcatcttacgcctcatggtttagcttctataataaacaaacattttgagtcatcctcaggcaattagcttgcaaagaaaatgatataatacgtctaattgctcccataattttacaatttagttgaccaacgtagcttgatttaactaaaacaactgtctgtcaccaaacaaaccaagacggacgagtagatttgtatgtaatctctatacgaatccgtttgtgaacttcatttgcgtcaccgccttgtcacattcgtgtggacgcctcacgacgtgtttgcataatgttattgaaacagaaatattgcactcttcctccattttttgattacttccatttcctcaaaagtcaaagctctctttcttctctctcgagatttgctaacttgtcaatg

SEQ ID NO: 32722 - DNA, 3003 bp, Unknown
  misc_feature (1)..( 3003): 2750-1469P.txt file - cDNA_ID_3060454; gDNA_ID_1620355; Annot_ID_154469
tattattcttacttcatttttggttgtcattttccttattttaatttccacaaaaagctcatcattgcttaagaaaaatatgatttataaagttgctttttatttagttgacaaaaaaaaaatttgtttgtttattattctgcaactattgatctttacgtattgaattgaaaatttgaatgtttaaattatataactacaaatgtgtttttgatcatttttatattataaattataaacagctgctacattctataatttgttagttgtagtatttacttaaaacaatacaactatactaggagaaaaatgaacacagaacataaagtaggaaattggatgaaagtattatctaaattgtggtccaatagtttgtggatactttaactttagatgtatgaagactatagacttttcctagagatttatatataggtggtgtatatatacactgatttacacatattaagttatgtgtatatctaaaaaagatagtgactaatttctgaagtagagatttactatgaatttcttcagaggttgaacctaagctaaatgatatagcatgaacaagaatttaaatgttaataaatagattcgtagtatcaaaggcttaaagatttaactattatttttgcttggaatctacttttcgtgaaagattccagccaagcaaacacttggggctctgtacggacactctaaaacataataatcatttaagcaattacgatcattattctatctcttctttcttgtttgtttgttaaatgttaaaccatttatcgaataatggagatacatatataaataaaacctcttccacaccactttttttttttccatagaaacgaaaaatagttgatgatgacaaaatgaaataataacatgaaaacttatacttatagttattgtatagaaataaaatgatgagtatatataatgagtagagaaactattaaatcagtatagacccctcacctacgctttactctttcactcctctctctcctgctttgctccgccgtgagaggagaaacaaatggggaattgtcaagcggcggaggcggcaacgacggtgatacaacaaccagacggtaaatcggttagattttactgtacagtaaacgcgagcgaagtgattaagtcccatcccggtcaccacgtggctctcctcctctcttccgccgtacctcacggtggctctctccgcgtcactcgtataaagcttcttcgtccttctgataacctcttgctcggtcatgtttatagactcatctcctccgaaggtatataatatattaatcacaattcacacagaacatgtttcagttttaaattcaggaaagaacagaaccctaacttatagggttttcttcaatttgtttcttctgcttcacgtttgattacaatcatcatatacgaagtgtataaaatttacaaatcagaactaaaagctttaattttcaggattcttatcaatttatttgttctgcttcactttttgatgttaagtcagtctttcttttttgtgttctattaatagaggtgatgaaaggaataagagccaagaaatctggaaagatgaagaagattcatggagagttttctgttgcagaagaagagattaacccactaaccctaagatctgaatctgcttctgacaaagacactcaggtattattatcacatactacaattgctctgtatcagatgtttcagttttagttctctgattgaaacgatagagtgttacaaaagaataatagagttggttttgatttacagagaaggatacatgaaaagcagagaggaatgatgaacacaggaggagctaccaataaagttagagcttggcagccttctcttcaaagcatctcagaatctacaagctaaaacacttcaatccatatttttctatctttttttcttacttttgactcttttttttatcatttcatttctctttgtattgttgtttttcccaatcaaatttgtaaaggaagaagacccatttgattgtggttgaagaagaagaaacttttgtcattttttaactttaataataataactgaagaaagaaagatccaaaggattattttcattttctagatttctagattttcttttacgttttcaataaatagttatgtcatagatcaagttttacaactttttttacgtacttaaaagattgataaaattgtacttgttgttgttgaccattgaaacatttccctttattcactaaaactagcttttgcaacctttttattcaactgtattggtttgttgtatgtttttattattcaactctatttaattattcatgtagcttaacatatcaataataactaacatgccataaattccgaagaagaaaaattgttataaaagaactatatgcacctaacaaaaaaccaacaaaaccatagtattttctttttgggttacataaaaatatctttgtatgaagaagaagaaagaatcattacacagctttcactcacaagattacaagtttgcaaattgcatataaggaaactcccaaaaaatatcatcaaagatcttttcagaacacaaaaaaaaaaaggtaaaagtatatctcttttgccatagttagactcaaaaatacgacatcgtttacctcacacgtgcacactcaccgacttacagaagaacccacacgtacgttgagggtactttagtcatttagcatcgaacgaaattgtctgagcggagaagaggagtttccgttatccctttatatattatctctctcacctttcttctctttttctttgatttttattaaatcaacaaaaatagaaaaaaaaacataaaaataaaaataaaaaatcttcacgtttcttctctctctctctctctctctctcgagccaccaaatctgaattagggtttttgagaatattcatcttttgatttcaaattcttcacccactgtgtaatttcactcgtcaggattcatctgcggaatcatg

SEQ ID NO: 32723 - DNA, 3003 bp, Unknown
  misc_feature (1)..( 3003): 2750-1469P.txt file - cDNA_ID_3060490; gDNA_ID_1620355; Annot_ID_154458
gagaaccgcactactactcttgattatcagagaagacgaatcagataaacagtgtgagagagagagatgatgataagaaaggaatctggatttgaatggtacccaacagatttttgtcattttttaaagatttcgctgagcatttagtaacaaggacctttttattaaggtaacgacaacttgtaagtggtaaataatccagtcttactatgttcccattttctatttgatttctttagagtattaaacagcagaatctgtatcatcaattatatagtttgtcaaatataattattattagaaatatgcattacaagggattaatggttaaggatttctctcttacaaaataaaaaagaaaaagtttatggtattcgttcgtattatgaatttttgatatgaatatcttaaattgaatatgttttgactaacatgttgtatgctgtctttttcaaaaataaaacatgttacatgttttttttttcttcttctcttttttttttttttttataaagtacatgttatatgctgtaacaattataatccaaatgtcaaacttagtttagatctttgacaagtatataatatacttttctttttaaaaattatgtattgaatatttttcactatcattcttttttttttgtcaacatttttcactatcattcttatttctttgatatgttcctcaatgttcaatttgtaaatttaaatttcaaaagccatgtaactttaaccaacttgaattttttacgtatataattctctatatctctaattagagtcatgttaggttcgattgtttaaataaaattagtcttcttgtagactattagatcatccgttcaaaaagattattgttgtttgaatggtgctctcttttctttcttcggaaaggaataaaatttatcccataaaaagaaaagaaaaagaaaaaagataatttactttatttaagtgtgattaagctgttatgattgactatcacattacatagtgttttcgtggggatacagagatcaatagataaatgataatggtaagataatggtatgttggtattggtagatgagtcagtaaatcatttactactgctaatggatcatctgaggacaagtgttgtacgttaagtgacacatggcaaaacagtgaaagagacgttaaacaagtgttacttgctgcatccactcaaattccatcccaagtcatgcatgcaactttttctttaaacatcggaaatcggagcctgaattaatgcgttaactaatggaaacaaaaaccataattacggtgtagccatctctccaattccgattccatttcaagttaaccttatcgatatggaggatagcaactctcacccgcaaaatcaaacatcaaaaagaaaaagctctcacccgcaaaagaagcaacgtatggagaatgaaacacgatcggctaagttgttggatcttgatgttcttgactgtccggtttgcttcgagccgctcactattcctacctttcaggttatgttttgaacttgcatgcattttattttgtttcatgtgacattttgatttcgcttttgttaatttattttattgaatacggctttgattgtatctcgtttggtatattatgcgtttcagtgtgatgatggacatatagtttgcaatttttgctttgccaaagtgagtaacaagtgccctggtcctgggtgtgatttacccattggtaataagcgatgcttcgcaatggagagggttctcgaatcagcctttgttccatgtcaaaatactgagtttggctgcacaaaaagtgtctcttatgaaaaagtgtcaagtcacgaaaaggaatgcaactactctcaatgctcttgccctaacctcgaatgcaattacactggctcatataacatcatctacggtcactttatgcgtcgccatctttacaatagtacgatcgtttcctccaaatggggatattccactgttgatgttctaataaacatcaaagaaaaggtttcagttctctgggaatctcgtcagaaacttttgtttgtagttcagtgtttcaaggagcgacatggtgtttatgttactgttagacgcatcgcaccacctgcttcagaattcaagaagttctcgtatcgtctttcgtatagtatcgacggacataatgttacttacgaatcaccagaagtaaagaggcttcttgaagtgaattctcaaatccctgatgacagtttcatgtttgtccctaactgtttactgcatggtgaaatgttggagttgaagcttggcatcaagaagttgaaacaaacgtaactagatctagtttggtttggggttacgaggcgttctgttttgttgtgtttgttttaattctctgtttaagaacctttgtacttttgtagtagcccactcttgaatttattgatgttgttgttttgagttagttgtataatccaaaagctttctggtttggttcccggttcggttttgtacatagtaggatttttaataaagcctgctaatgaggttcagcaagttaccattgctcaggaaactgttatggaggatcctccaacgtctctgtttaagaattcagtaccaattcgagaggatcaaattcagaacgctatcacaaattccattcgctaatcttagaattgggcataaattctggaataatgggctcatttggtattagcgtccatacacattgtaggcccaataaaataatagaccaagaaaaaactaaaaaccggacaacgccgttatctcttcttcgtgtgaccaccacacatacatacataccactcaccgtaccaaaaagattagaccaacaaaaaaaaaaaaaaaaggaccagctcagatgagtctggagtttccaagtttaaaacctctctacctcgatttgagcaaatcctgatttactctcatcctcatcatctctcatcatcgagattcatagtctcttttgccgcttggattcttccaaggttagtgagctgctatg

SEQ ID NO: 32724 - DNA, 3003 bp, Unknown
  misc_feature (1)..( 3003): 2750-1469P.txt file - cDNA_ID_3060498; gDNA_ID_1620355; Annot_ID_154449
agtaaagaagtacacagaagtcaagaaacaaaaggatccatccgaaacaagtataacatttgcataaaagagaaaaactagttttcttttcttcctgcttatcatttttctaaattccgtttcttcatttgtctttaaaaaaaggtaaaaagctgattactttccatggtgatcttccatactcttcaactgagctgattgagaagctagagtctcttgacgaggaagacattgtgggttcgggaggatttggcacggtttatcgaatggttatgaacgatcttggaacctttgcggttaaaaagatagataggagtcgacaaggatcagaccgagtttttgagcgagaagtagagattttaggtagtgtcaaacacatcaatctagtgaacctacgtggatactgccgtttaccatcttcaagacttctcatctatgattatctaaccttaggaagcttagacgatcttcttcacggtaaatacagttatacatagtttatcttcattttggtctgtgatgcgtcatattaatctattttttggtttctttatctatcaagaacgagctcaagaagacggtttgttgaactggaatgctcggttgaaaattgcgctaggttccgcgaggggtcttgcttatctacaccatgattgtagtcccaaaattgttcaccgtgacataaaatcgagcaatattctactcaatgataaactagaacctcgagtctcggactttggtcttgcaaagcttcttgttgacgaagatgctcatgttaccaccgtggtagctggcacctttggctatcttgctccaggttctcttctttgctaacttcttttttgaatcttggacaataatttttaaagtttctaactctttgatgaatcttggaaacagagtatctgcaaaatgggagagcgacggagaagtctgatgtgtacagctttggagttcttctccttgagctcgttaccggaaaaagaccaacagacccgatattcgttaaaagaggcttgaacgtcgtcggatgggtaagaagacacctcaaatcttgtctccgagaagaaacgttctgtttttacttcctaagatttgggttctaataaagtgttatttctctcagatgaacactgtgttgaaagagaatcgattagaggatgtaatagacaagagatgcaccgatgtcgacgaagagtctgttgaggcattgctcgagatagctgagagatgtacagatgctaacccggagaacaggccggctatgaaccaggtggctcagttgcttgagcaagaagtcatgtcaccttcttctggtatcgattactacgatgattctcattctgattactgttagggacttatgcacggctaaaagtaaccaggagatcattagcctgcgacggttttgttgttgttgctgctgcgttatgaatgttgtgatttaggagcgagggatttgtttgtatattagatatgaaggtggagtcaagattattgagcgtgcactgttcttgtgcactttatatttttgcaacaaaatgatcgatgttattgcgtatgcattgtactatgactctttcaaagggaagacacacatacgaattatcgatgttaatgtcgttaggcttctttcttacgttttgtagcgtacattgcttagctctactaaagctggtcctatgttttacaaacctgaaagtagaagactctcaatgcacaaacgttgctacaaaactttcatctttctgaataattagctatttttatttatgaaagtgttatttctctataaatcttataatttggaaactgatattaaaaaaaaaacatcttctttttatagttacaaacaagtttttttttttttttttttctgtcaaagacttgagagttgataaaaaaaagagttgataatttcttgatttttcttctggaacattttaatattatcttctgaataatcaaatgacctttcgtttaatggaagagacttcgaccatcatcaaaaccccatccacctcttaaaaggccaacgcttttctgccctatgtgctttgctagtttcctacacgtacgtatatatctataaaatcatttttcatatatatatggtttaatgcatccatagtttatacatattttatatttaaaccctaccctatacgatacactatatacatatatcgtatagtagtaattgattatataaaattttacatagatgtacaagagcattgatatcgatagaagttagaaccttttgaagatattcgtaactcttgaaaaattcgattcttagtgacatagtgagcaataactacagattatggagattaatttgaattttagtctattttccctcttataaaagaacaattaccaaggaaatcctaattctgaattaatcatttacaaagttgtagtatatatataaaaaaaaagttgtagtatatagtattaacaaactaacacaatttttttcaactttgatagtaacctttttcaaaccaatatatattagtgttttaaagtacgccattatcttgtataatatgcatggtgtattgatagtattttatatgtatgtaaaatgaaaactaaaaggcgactactagcataaaaaataaatgatgaaatttaacaaattttgtaattttaaaggcaatatactattgtaccgtgaaaaaatatataggtaaaattttcaaaatatttgtgttgaccaaataaatggcaagatcataatattttgcataattttctatattttaaagccgattttcattgctaaaatatattgtataagtatatgctaatacacatatttgcgtgtgtgtatataaataaaaacatgcatacatgtatcatttgtctgtctcctattggctaagaaaacagagagaatcggtatttttagcctttgctaagatattttgatcaaaaatcccacttttgagcggtcttatctttattctccacctcaaaggaccatttctcatg

SEQ ID NO: 32725 - DNA, 2409 bp, Unknown; identical to SEQ ID NO: 1083
  misc_feature (1)..( 2409): 2750-1469P.txt file - cDNA_ID_3060510; gDNA_ID_1620356; Annot_ID_154516

SEQ ID NO: 32726 - DNA, 3003 bp, Unknown
  misc_feature (1)..( 3003): 2750-1469P.txt file - cDNA_ID_3060570; gDNA_ID_1620357; Annot_ID_154539
agtctaacaagcatatacaggtttacacaaattatatgtatcacatattgcaagatactacatgacagcaaaattctggaattataagaaacagaagcagaggccaacctcttaggttgcttgtgcgtgtcaaaacttctcaccagattcaggatgaactgacacatcccttgatcagtctggtcataaaacaacttatacagcaagatgcggacagtaaaagcttccttagagtcttcaggtagcaatttgatcaccagatctagtaagcaaagctgcattggaaaaaccacgtgaacaatgaacaccatgagtatactagtttctggataaaatgcagaaggaaatgactatcatttctccatttctccatctcataaaccaatgatacttgcatatgtctaaagaaaaagatgagctacaaaaaccatttaaaaagcaaataggcggcagaagaacagtcttagggaactagccagtaagagattaaagcatgcatattgcataccatggttttcacaagagagcttgctgcagatagaaacttaaaatctttagtttctttcagaccatcaaatgcacagcgccattttgaaatgacaagcaaaaacattctgtcgttaattgttgctgcaatcggcgcacaaatgtcactcttggaaaagtttactccagccttctggttggtagtgagttcagaggtttcctctgtttctattgctggctgaaaaaaaagccagacaatcataaaattaccgagattcagccttgtcgaaatgaaggaaaaataaatgcatagcaacttagaccaatgagagacaaaaccaaagtagctcaattactcacactagaagccgaagacttgtgaaactgaaaagaggtgatggactgagcaacttggaagaaagtaacaatgtcgctattttgaatggagggatgctccttttcaatatcttcacataatgactgcatcagaactaagagatatggtacgctggcatcagcatcagcatcaggatacttaaaaccaagtataaacaaaagaggttgttatattgtgtcatctaccattatatccgcctgacataaactgattgatgaaatcatgcagcaacttcaaaactttgtcatttgtcacagacattggtccatgttcccagacaatcttttcggtggctccacgaccttgctgaggcttaagcattgtgctttccgtagtagaaggtattccctttagtacagctttagtgccatcctatcaaaaatctcattcaagttacataactatttacataaacctaaaattttaagcatcattgcgagaaacaataccatggtaacccgggtgaatgtcccaccaaattgtgaatgacgctgattcatattattgagtcttgcaagctttcttttaacttcctcctccttcattaatgtcttcaaactatctacagaagcttgtttcccctgatccaactgcaaaacaaaacatgatgatcgacgtcagcatcaataccaacaatctcaggaatcatattgatccagttgaatcattaaccttctcaggagcctttgcaacgagctccatgtcttgacccaagagaatataatgataaatctcaagcagaagtaagttgtcatgcctcaacaaactattgaaaccctcaatagtctgagttatcacaagaactatatccatcacattctcacgagacagaacttcgagaaactgatccctcaacgacaaaaagtaacaagtagactctccagctttctgaatcggagatacatcatgaatagcaagtaaattcctgaataaagtaagcacaagctgaaccaatttccaatcttcctcattgaatacatctctgtaaagcataaataatatcagtaagaaagaaaaaatcgttttgcattacttaacacaacaatgagtttcgaacttacaattctaagttctcaagaggagcttcaagcaaagacacaatcactgcaacaatattactaaaagtaattgcagatttcaatccccatagatactctaactgctgaggaatatcatctgaagaaggctctataggcattgtaagaaacaccaacactttaactgaacaaaaacagatcacaatctcatcagaaaaattacaaagcatcacacttttatttaagggcaacagagcaaactcagtacctgcatttaaaactaagttatgttcatcttggtaatgctcaatgatcggaatcaaatctttagagactatattccacgcacagacttgtttgaaaacttctctgctctcaggatcgtcgcgtctcagaaatctcagtaaatctttcaaattgtcgagacagtactcgcttttcgagtacccaattcttcttctgtcttcgtcttcctcgggaagacccagatcgctgcagattactgataatccttccaaatctatcttcttcttcgttgagattctctcctccacatccattttcttccgcggaatacaaaaatgaaataaaaaatctcaatgaaattaagaagagatttttagcgaatcaaaacgtaaacttcgagaaatcagaattcgaaaaggctcagcttctctgtatcatcactaatctcaagtgattagggctcttgtgagcgcgaatagctccagacagtttcccgccatttcgcaatcctcaaaagttacaagtcaaactaaaacaccgagatttggcccacatggtctaaatgggcttataaattggtccaaaagtacgagtttaaacgccgtcgttttgggttgtgtcttattttgtttttttctaaaaattaatttaattttccaactacttaatgatttgtcatgcttcttcgatacgaactaagcacttcttctccgccttcgtaagttccgccgaaaagaaccaaatccttcactactctgtctcagctttcgacctctctcttctcattcctttgcaacttctcacttctcgaattccttctcttcaaaatcagaaatg

SEQ ID NO: 32727 - DNA, 3000 bp, Unknown; identical to SEQ ID NO: 1092
  misc_feature (1)..( 3000): 2750-1469P.txt file - cDNA_ID_3060584; gDNA_ID_1620357; Annot_ID_154531

SEQ ID NO: 32728 - DNA, 3000 bp, Unknown; identical to SEQ ID NO: 1095
  misc_feature (1)..( 3000): 2750-1469P.txt file - cDNA_ID_3060662; gDNA_ID_1620359; Annot_ID_154592

SEQ ID NO: 32729 - DNA, 3000 bp, Unknown; identical to SEQ ID NO: 1097
  misc_feature (1)..( 3000): 2750-1469P.txt file - cDNA_ID_3060666; gDNA_ID_1620359; Annot_ID_154591

SEQ ID NO: 32730 - DNA, 3000 bp, Unknown; identical to SEQ ID NO: 1099
  misc_feature (1)..( 3000): 2750-1469P.txt file - cDNA_ID_3060670; gDNA_ID_1620359; Annot_ID_154589

SEQ ID NO: 32731 - DNA, 3003 bp, Unknown
  misc_feature (1)..( 3003): 2750-1469P.txt file - cDNA_ID_3060679; gDNA_ID_1620359; Annot_ID_154577
catttttctataaatccaaactaacatctactttctttaaatctataaccctaaacacttttttaaactcaaaccgatatataattttgtttaattttaaatctaaactctagtgacttatttataaacccaaacctaaaaataatttcgttttattgtaaatttaaactctaatttatatttataaatctaaactgacttataattttgtttaattgtaaaatctaaattttaaatataattaatcttgtttaattaaaagtatacagatttgttattttagtttattatataatatgatataataactagtttaaattaaaagtaagagtttattcttagaggtaaatgcaagtattgtccgaaaaaacaaatctaattcaagtagtgtccgaaaaaaaattctaactagtttgatagttaaaattttgatttaaaaaaggaaaaaaatcaaacaagatattaattagaagtgtgagacacggcacaagagtcacatgagtgtacgtacttatcaagattgactctgtctgagtctgaagtcccaaaccatgatggcaccacttccacatacgatcgtgccccgtattttggatagaatacggacagtggttttcgtttggacacgtgtcctgctttatctcttcgtcgccccaaaaaataccacaatgtcttatctcaaccacacgtgttctgcttatcccaacctcacaatttgtaccaaaatacacactttgcatggaagattttctaattatacaactcacattattcgaatttaaatttcgattttttagtttcaagaaaatcattctttgatgggtacttgtcttatttaacaggttgtatacttgtattcattgttctgccaaatgaaaataaaaatgaaaatgatgttcattgtttaataaaagtactaagataacaatcacgacaaatttctgtctagttcattaaatatttaatcaaactctaaacgattttcaaacaatttttataattcaaaaaataagttacatatctttgtttaacataatataataaaaataacatgaataaattattttaacataaaaaattcagtttttcaaaaataagtttagaagtttacgttctaaaataaggtaaaatatgaatgctgttttaagacgcaatctagataattttttttaataaaaaccgagatacatttaaatctatctaaataacttataactacctaattgttacataatctaccaatttaactctatgtaaaataaaactgattttagtaacatttaagcagtacgagaatgctagcgcctaattaaacgatcttctaatccactttcttgaatatttgttttaactaaatctaaacaaaaatatagttatataaccacaaatattaatgaaatttaaacttatagtaactgaaatacccaaaactaaaaaaaaaaaccaaaattataataattataaataagaagatattagtttatgtttacaatcgaaataatcaaataaatgattgtctttatttaggactacgatcaagaaccgaatgggcttttccaaaccaaaccgagatttgaattttatggtgcggattcggttaactggagaatagctatcaacaacaatttaaaatagatttagctagatcggtttggttcggttcgttttgtattctctgtcactcctcacaatcgcttatattttatattgtatgtttaaaagtcaacatcgaaatattgtacgttagtatgtcacttatgataatgtttattcgtaaacacaatttgaaaaggtcaaagaaagaggaaagatagttaatcaagcccttgttgtcaaaaataattattttatttactgtcatcgtaatgtttatcaatgcagttattaatctcatttttttctcttccgaagtcgacgaacaataaaaaaaaccaatctcattcgaagtacttattactgatatgatgctgagctgacacagtcgtaagccttggacaacaatcattcatgacgtcactgctgtgacgctagaatgatgacattatatcaatgtttttttgtctgaattttgttatggtaaaaataatgaaaatgtagagcttgagtattttgattttcgttttattgtaaactagctgaatctgaatcttgagcagttaattaatttcgtaatttattaattctattctgactttttaaaatataatatatattaactttggtagatgcttaaggtaattcttttttaataaataagatggttagagtatcttaaagttagcttataagaaaatcggaaaaattacttttggtgggttaattgtttctgtttgaagtaatgtgtgtagatttttcttatgaatttagattaaaaactatttgtttttcagatgttttaagaaaaaaattgtcattcatagcttgtccattcttacataccttaataagaaaaattataaagttttgtggattcacggaagctaatctaggttatgtatttgcccaaaaaataatctaggttttgttatggaattaagaaggaaaaaaaaattgagataaatagtatataaaaacaatttaaactaagtattattagcttaattgataaagattttaggtgaaacttaaaaatagttggttaaagagattacaaacattaaccaaattaaccaagaacctcctagtatttaaaaaaaacacttaaaaatatccaaacatttaattttttaatcataaatcttataaaacccacagctgtcctttcgaaaatccactatattcggtggattaagaattaaaaatcattcgaataatatgcatacttatataacaaaaacaattcacttgaaaacataatcaattgagagtaggaccgagtaacactgcattgttttatatatatcatcgatgcacatcgcatacataatatactcaaagtcgagccttccttcctttatctcttataccctttttgattcttcttcaattttctgacatcaaatg

SEQ ID NO: 32732 - DNA, 3000 bp, Unknown; identical to SEQ ID NO: 1102
  misc_feature (1)..( 3000): 2750-1469P.txt file - cDNA_ID_3060687; gDNA_ID_1620360; Annot_ID_154623

SEQ ID NO: 32733 - DNA, 3003 bp, Unknown
  misc_feature (1)..( 3003): 2750-1469P.txt file - cDNA_ID_3060718; gDNA_ID_1620360; Annot_ID_154630
gaaagataatgctcatcaaagtaaaaagttcaaaaacaagatatagaatcggcttattcaggcatgaatattgtcatatacaatttacaaatcagatgcatcttgatttacattttccccaggttcaacaagtgaaaacgaaacccctagtcttcattcgactagcaaactagctgatgactacacaagataactacggcaaatccctagaactaagctgcatcatccaagtaaaattatgaaacctgagaattcacaaaatccatagattaaccttctctgcatagactgatagatagaactcacctgaaattcgctcagttggttgactccgactcagacggaaagcagaaatcgaggagaatgtgttacatagaaggaagatcaaaacgcagctcgataacttcatttttctctctcagaaattttggttcctccctaaaaactcttcaaaatcccagatcatataaagtatataaagatcaactagaacagctgaaatgtcagaagaagtagttgctaaaaccggaaccccgagattgagacttcaaaaccggaacaaaatttacaaaattcgctaccgattgttagatctcactcacgcccagcgttgacagcgagagcccagcgattttcatttgaagatgcgaagaaagcaagaagaaagttgaagaagattcgtctatggcctatacgacgtcgtttgaaagggatccatttttcgcaaaggaaagtcgttggggacttgaacattccacgtcagcctcttttccactttaaaaaataacaatgtaatgggctgaccgagaagatataaacgcagcccattatttaatgggcaaaagtgttttctttttgggttaaagtgtgattccgttcttgtgaacctagttgtaaacttttgtaactgcaaagtgtagttcggtcttgtttatccggtatattgaattttgaaacagtaataaatagctgaattaagtcacttttgagttgtttttctttaatgtgaaaatgatactgagaaaatagggtagtaataggaggctttagaacagattattcagtcttttcaagattctaaaactccaacagttaaataacagtggtgaaaacagtatcaagagtacgagccgctactcgcaatgatgaagatgatgatatataatagtaatgaatttatatgttgtaaacttgtaatgttaaagattaataataaactaaatgagagaaaggacaaagaaaaggtaagaggaaactgagggagtgagacagtcaaaataaaacagactgagagcattaagaatgccagtctctcagaacttcgatttgacctgtcgtttcctcattggctacctttccaacattaaagttttttatcggctcaattccaatgttataattttttatatattttcacatcattcttttttttcactgtttagtcacaaagtttacgtaacccatatgtccaatcccacactttaatttgtatttttagttccaacatataaaaataacaaaataaccattgcttttttccccactttaatttgtaagttctttctgttatttaataaatttgacattaccaaaaaaaaaatttttagatgggtgaatatatatagaaatgtaacttatcaaattgattcggttttctgattttcttaacgactaaaaaaaatatatgtgtactagggcaataggggtaattacaaatcagggagatgacaacacgtaagagatagttgaagagattagaccgaaacacacctgacctcctctccttctggagttttcacactgcatttatcaattaatgtttcctaaaacgcagatagataaaggtttcatttattagcttatgtttatttaaagcaaaagaacaacttgtggctatatatagtagattaacaatctcagactcagagtgctgatatttcttatcatacaaaatttatcttcccctaacaatacttccaaagcttatttagatagacatatatggaattatggataatggattcccttaagttatatgaatcataggggaatataattttagtaacttatcgggcttctgcaaagattgtgcatggtaccatgcgtccatgccaatacagttaaagtttacataatacaaatttttacgtatttctatatatcatatatgacttacagattatcatagcttaatatagccagtattgccaactttccattcgtacctagaacttataagaagattggaaaggatattaaaattgaaaaagacgtaggttggccatgtatcttaagatagttaaacgatatcagcaatctatcaataatcaatctatcgtaacaaatatttttgtcataaatgtatttgtagatttttttttttatacttttagatggttaaatgttcaagaaatctaaccaaatggtggaatggttccgtttgatcgtgctctcatggtacaaacaatgagaccccccaaaaaaaaaaaacccccgaggatgaaattaaaacaaataacacagcttgaacaaaacatcaaaaacagaggatcatcacagtaaatattaatacttgaacaaaacatcaaaaagataggatcatcacagtaaatattaatatgcataaagaagagaatcaccacagtgaaaaccctaatcattttatattcctacgtgtcaaattatgaatggtcataatcagagtagagaaaaagaatgtcgatgaaagaaaaagtttgacttgttaagtcccaactgtcaatttcccagcaagacacatatcttcttttacatcacattacatctacacataaatgctttattgcaaaaatagcgatataaaaaaagaatatacaaaaacctagtatttattttctagattctttactgttgtatatatagaagttgctcgagtggtcatttttacaataaagcaatctgctcaaaagagtaaagaaagagagaaaaagagagtgatagagagagagagaaaaatagattatg

SEQ ID NO: 32734 - DNA, 3000 bp, Unknown; identical to SEQ ID NO: 1105
  misc_feature (1)..( 3000): 2750-1469P.txt file - cDNA_ID_3060726; gDNA_ID_1620360; Annot_ID_154628

SEQ ID NO: 32735 - DNA, 3000 bp, Unknown; identical to SEQ ID NO: 1106
  misc_feature (1)..( 3000): 2750-1469P.txt file - cDNA_ID_3060734; gDNA_ID_1620360; Annot_ID_154624

SEQ ID NO: 32736 - DNA, 3003 bp, Unknown
  misc_feature (1)..( 3003): 2750-1469P.txt file - cDNA_ID_3060738; gDNA_ID_1620360; Annot_ID_154622
tttaagtttaaccaacacatctaaaccaatttaataaaattaatatttttccaaatttcttaaatatacaagcgatgaaattgagaaaaagtaaactcgtaatttttccaccaaaaaacataaacccgtgattttcccgccaaaaacataaacccatgattttcctaccaaaaacgtaaatccataattttcccgctaaaaacgtaaactcctaattttcccacaaaaacgtaaacccgtaattttccttccaaaaacgtaaacccgtgattttcccgccaaaaacgtaaactcctaattttcccgccaaaaacgtaaacccgtaattttccttccaaaaacgtaaacccgtaattttccttccaaaaacgtaaacccgtgatttttccgccaaaaacgtaaacccatgattttcccgccaaaaacgtaaatccataattttcccgccaaaaacataaacccgtaattttccgccaaaaacgtaaacccgtgatttttccgccaaaaacgtaaacccgtgattttcccgccaaaaacgtaaatccataattttcttgccaaaaacataaacccgtaatttttcaccaaaaccgtaaatccgtgattttcccgcctaaaacgtaaacccgtgattttcccgccaaaaacgtaaatccataattttcccgccaaaaacataaacccgtaattttccgccaaaaacgtaaacccgtgattttcccgccaaaaacataaatccgtgattttcccgccagaaacgtaaactcgagattttcccgccaaaaacgtaaacccgtaattttctcgccaaaaacgtaaaaacctataatttttccgccaaaaacgtagatccgtgattttacgtacaaaaaacgtaaacccgtaaaaagtggaatccgtaaatatcttaagtttgatgataatgaattaataattattattatttattattgttttataataataattaattaaattattacttaaatgagttaacccatttaacaactcaacccataaaattaaatgagttatgggttgacccaaacccatttaacaaaatgagttgggtcaacccataactcatttaaccctatactcatttgattatgagttgagttgagttgggttacccattttgacacccctaaagatatcacaccctaaagatatcacaatctaaataaaattgagaaagaagacgtttttttgacaatatgaaaatatgagctaagtttcatcgcgtcactttttgatttataactgttgatttaatttgttatttttaccaaaaaaaaaagaaaagaggttatatggaaaatgactagtagctaatcgtattagcgttgacaacggatagtgtgatatatatatatatatagtcggacgattagctagctcataaagctaagtgacaaaactaattatcaacggtgaatgagattggtcggcaagtaggtagagcgtggacagatcaattttcagacagaattcaaagtattaatgaccaatttgatacccttgaatgaagaaccaaactaattaaaacgtgcaaggaaaaaaacgtgtatctcctcctcgtgtattcacacctcctatttaatttatcatggatttattacttatattaattgcagatatgtttttcctcaaaatcacatgcaattgtttcctcattcttcaacaaattaatattacgcttactactatttctcatttcaaacttggtcaaatttacatattcagttaagacaaaataaaattatatagttaatattttccaacaaattaaaaatatacatttatattaatatatatatatatatactattgttttggtaacgttatctagtttcctatcaaaataattttaaatgttacattaaaaatacaaaaatacatttgttacaaaatggtttgtattgctatattataagaaagaaatacatagaattgagttgttgacaaaaaaaaacatagaattgatttaatgtagcttaaaaaaagaacataacttttttaaaatttgttttcaccacataacttttttaaaaaagtttacaaaacccatatttttctaagaaagataaacaagtgtagtaaataatttaaattttttttcttcaaaataaactattttctgcgaaattaaatctaaaatatttaatggcataaagaggtaaataaatgaaaagtattagggtaaaattacatatataagtataatatccgatttctctcatgatgtccttgtttatatttcatccacctctcctctgcacaatcttcttcttctcagctctctctctctcaatctcgagatccgttctctttaaatctgtctctttctcttcaatctcattgtctttgagctcttttgttgagatcaatctcagattgaaatcaatcatcatagacaattaagttttgatttacgttttttttttaatttcttcatcagatctagtttttaccaataacggataaattcaggtatgttcatcatcgtagatctatctctgtctattgattcaaattggatgtatttagattcaatcctgatctgatcttttggctttttgcgatcgcaagttttgattggtgagaattcgtttttttctagctcgatcgaactctgtagtgtagatcgagacgaatgtagagtttcgtgattcgtttttggttatatgatgttatgttttaattgatgcatgtgagttttttttgttttttttttgtgtgtgtgttgtgattcattgatctgtgagaaaagttttctgaatcatggttgtgtttattgatttgttggagtatgaatcatagaagaaccaatgcaatcattttgaaaaggaaaacaaccttttttaaaaaactttattctcatttcgcgagtgtttttagtgattgtggtaagtgggtaacctttttgatgttaggattactattgtttgatgttttttttttcattgtttatcgtgcaggtcttagccaatcaccaacatg

SEQ ID NO: 32737 - DNA, 3000 bp, Unknown; identical to SEQ ID NO: 1113
  misc_feature (1)..( 3000): 2750-1469P.txt file - cDNA_ID_3060750; gDNA_ID_1620361; Annot_ID_154660

SEQ ID NO: 32738 - DNA, 3003 bp, Unknown
  misc_feature (1)..( 3003): 2750-1469P.txt file - cDNA_ID_3060754; gDNA_ID_1620361; Annot_ID_154657
gatataactaagaaaatgtcaaagagaccatattgtatcggagaaggactgaagaaaggagcatggactacagaagaggataaaaaactcatctcttatatccacgaccacggtgaaggaggctggcgtgacattccagaaaaagctggtacataactatatatagacgcatttgtgtctctataatatgaatttattcacaatctgttactaatatgtattaattattctcttaattgatcatttgatctttatctgctttttttcgagtttagggctgaaacggtgtggaaagagttgtagattacggtggactaactatttgaaaccagatatcaagagaggagagtttagctatgaggaagagcagattatcatcatgcttcatgcatctcgtggcaataagtacgtatggcatttctctaggcttgtttgtgctcatatcagtttagtgaagacatgatcatcaatgttttgatatatatgtaccctgtgtttttattttattttactaggtggtctgtcatagctagacatttgccaaaaagaacggataacgaggtcaaaaactattggaacacacatctcaagaaacgtttaatcgatgatggcattgatcccgtgacacacaagccactagcttcttctaaccctaatccagttgagcccatgaagttcgatttccaaaagaaatccaatcaggatgagcactcttcacagtctagttctacaactccagcatctcttcccctttcctcgaatttgaacagtgttaaatccaaaattagcagtggtgagacgcagatagaaagtggtcacgtgagctgcaagaaacgttttggacgatcgagctctacatcaaggttgttaaacaaagttgcagctagagcttcttccatcggcaacatcttatcaacatccatagaaggaaccttgagatctcctgcatcatcttcaggactcccagactcgttctctcaatcatatgagtacatgatcgataacaaagaagatctcggtacgagcattgatctcaacatccccgagtatgatttcccacagtttcttgagcaactcattaacgatgacgacgaaaatgagaacattgttgggcccgaacaagatctccttatgtccgatttcccatcaacattcgttgatgaagacgatatacttggagacataaccagttggtcaacttatcttcttgaccatcccaattttatgtatgaatcggatcaagattccgacgagaagaacttcttatgatctgtctatagatggcttgtcaatttcccaatgttgacatgcccaagattatgattaggcttttctcttagataaatttcaagttgtttgaaacaaataatcccgtggatcgattagtttttgatttgccggagtttttatatttttgtaactcttttgtaatataattttaaatagctttacatatatacattatatatgacaaataagaatctaagcgaaaacgtttacaaaaatatatacattataggtccacaaaaacactataacacaaaaggtaaatagcaatgagtgggcaacaatattggatctgtgacccggcaaaatttatccgctaacaaaaacgaatctgaataaatgtccactgatatatgtgtatgtgtgtgtgagagagatatgacttatgcgagcttttgtttctatgtgtgtggctgcacatgaatgatttagtttttgttgtgtgtgtgaaaatgaaagttgtattttttctgtcggccgattaaaaactccaaattcgaaacagaatttgaaccaaaaatagacacacaataatcctcacgatcaaataaacccaaaagaaacgtagctattacaagtacgatctctcaggaacaaataatccgcatagccaaaataggctacatttcaggtagtcacatatatgactgcaatcacgaaatcacacgttgagctatcccaaaaagctctcttcttcgaattcgatgaattggtcgtaactgagagttttatgaatggattaaatgaaatagacgtatataaaaagtggaataaataatgcctttatgtttgcataaaactagtccttaattgtatttatgtatttcgtttccttttaatggaattttctatgtgcactcaataaaaattgacctaagattcttttcatatttgaatataagtttcattcaagaacaaatccattgatcaaaccaaattacatactgccaaaaactttaaacgtggaaatcttttatatgctccagcaaagtggagattttataaattggaaaatagaagaaaaccttactttatgataaatttaaataaaattgaaaaatttcctcatgtaatttaacaaaactaaattattgcagcattttcgttactcattattaagtgaaaactgtataatggtcaaaagtgcatctaattaactcctattaatagttcaaactaacacacgaatctttttcagattcatatgaagagttgaatctttttttattttccagctgaatcttctgatccaaaaccagaaggtccaaaacacatttctgtttttttcaccaaaaaacaaacaaacacaattctgtttaaagtaacctaattaggccgttaagaatataaaccttatttgggtcgtcaagaacataaaagcctgtataatagttttcttcttttttgggctaaagttttagttttaataatcaaaattaaacaactaatctatttgttaaatcatcatcttaacaaacctcggaacaaggacaagatcaccaggtttacaaacgaagcaacgaatcaacaattggaatcaaaaccttacctagaaagataaaccctaaagtaaattcagtttttcactttacctgcagaattggacaaagtaacttgatcttcatataatccctcgatgatccctcaaatgttcttaagaaatttcgaaacttttcacattcaccactcgattgaaccggacccgtttattcaatg

SEQ ID NO: 32739 - DNA, 3003 bp, Unknown
  misc_feature (1)..( 3003): 2750-1469P.txt file - cDNA_ID_3060761; gDNA_ID_1620361; Annot_ID_154648
tctaaaatttcccaatctcttcaagtttcctcaagacttgtttgacgtttggcctaagagaaggcgaaggagagcaacaagacattgcaagctgaaaatacttgaggacacattcttcacttagattatcatcacttccgagaatctcaggacggtataaatcagacaacctatgatcaagaacagcattcctcataaaatcaggaagatagaactcatcatcgccagttgcattctcgtttatcggttctttaccagagactagctcaagcatgatcacaccaagactatacacatcactctctttgctcacgtccttcatctttattaactcaggagctttgtatccctcagctgcagaaacatcaagaatctcttgtcctgcagacaggttcaagagcaaatgtaaaccgaaatcagagattctaggttcgaaactcgaactgagaagaacgttcttggacttcagattgccatggacgattggtttttgcattcctgtatgaagatgatcaagggctttcgatattccaattgtgattcttaaaatattgatccattttcttgattcatcatctccacctgtcaaaacaaaacaagaatgtaattttcttattagtctagatatttgctgagattgatgttcttagtgtcaaattttgttcttactacactaaagaagtggaaaatgacagaaaataaaacaaaaatagtaccgacaaaagacaaagatgatctcataccttatattttgaaaagcttgaagaaaataatatttaagacaaataatgaaacactgaattaaatgatccagctaatgtgcttaattccagctgtgtggttctcttttggataatcttaacacattgttaatcttacatagtatttttaatttatatctttatgaatatatatgtatgtatgtacatatgatatcatcatcatgggaatggtaaattatccaggaagattctaagaaactatatatgtatgtatagaatcttcccgggaaaacccatgaaacaagtaaccacgagattccatggggttaaaaggaaaaaaagaaaaaaagttaacattctttgctttctgtcggaaaaaagaaaaagtttggtcctttttaaaacttttttatcaagaaagtagaaaagaaaacagagagacttacttctgatgaagtcggaaagattcccggaaccgaagaaaggatgaaccataagcttctctcctctgtttccagcgtagaaacctaacagaggaaccaaattctcatgtcgaacaaacccaagtgtttcgatgatgccattaaactctttagaatccgatctcactgtacacaccggtctaagaaacctaagaaccctaatcttgccgcttctttgtaaagacgctttgtatagagtaccatagcttgattttccgatgacttctccgggagcatcgaggatatcgcagatcgtgagatcttctccgccttgaaagattacgagttcctctgtttccgaggagaagccttgtttgttgtggtctagtgattcgacgtcgtattgatctgattcagtagatgatgattcttttcttctaaggaagatgataaagaagattactatcaagaatgctgataaagatactcctagtaacaatgttagaagtagagattttctcatctctgaaacacttttttaggtgagagattttttggaagatttatgattatgagtattgtgaggtttgcagggaaaaaaattacagagaaagagagaaagattgatagagacgggagatgaagttgatatataagttcagaggacagatctaagaatatcttttttattttatttccttgtatcaatgttgactttatgatttcttggccttgtaagggtatgtgtatatttgtatttacatatatatgcaaatttactttcctcttatgttctcaaccaattatgatgacctaataattccaaattgtattttcgttacacgtcgacctatatgtacttattttctctctagggttgatgtttttcagtttcacacatgcttgtatactccgtataaaagagtttttggaaaataatatctcgagtagaacgttttagtttctttcaaggtaaaaatattaatgagcgaccgtggtaattaattgtaatgatctcaagaaaaaatgaagaacgttggaagtggtgatgataattaaatgttgggtttgactagtgatggtagttgaagtgcgtggggtacatatttagatccttgattggatgttttatccggcaagttagggtcagactggtggagaggaaataaattgaaggcaagtacatacaactcctaacttgagaatgaaataaattgagaagaaaaaaggatagaggaatacttttctctcttttgttgaggaacctttcttctactaataccaattttttctgtttttcaagctgaaattgttttggaataagtatgattgtgtttagagaaaagactgaaaataatgattgttgagaagtgaaaatcgacatcacgattaatctattgttagctgtaagctttgtctctactccttaattagacagttgacacagatgatgaaattcactttattcaacggctcgaaatcacccatttttggttccactatcccatgtcatcatcattttaaattgttcaccaccaaatacgattgtgaaagcatactcgttcataatcataataaattgcacgatatatattggctagccttttctaagttttctcgtaactaatttatatgtagcactacaaagtactataaaaccatatgagttgaaaaaaagaaacacatcacatgagcccacatattaagttaggagtagttaattagctctagattgagaagatgggaatatagattttctttagcattacattttgaagaaaaatcggaaaaatatcatagcaatattttactaatattgattattgagtacatgggttcaaaataataaaaaaaaaatg

SEQ ID NO: 32740 - DNA, 3003 bp, Unknown
  misc_feature (1)..( 3003): 2750-1469P.txt file - cDNA_ID_3060765; gDNA_ID_1620361; Annot_ID_154646
tgaaactcccttggaaccatgctttggccactgaacatgaacacacgccgtgtttaaaagagaccaaaccgttaaccgcagctgaaactctgacgtagtgagtatatgacggctatctggactccacctagcgtatgaaataccagcaggaccttcatcaatcttgcaagtccattctggttgagtcaaagaccaagcttgaatcatcggttttttataaagaccacaaagaatgtactctgaatcaagagcccattctatgtagcttattttatctaagcaagaaaacaattgcacaacctgcattcacatccataacattgaagattagtacatagaaagaaaaaaaaacttcaacgacatttatcatctctaaggttaaaagttccaaaatttagcaaacccaagttagtataatccaatttaagcacacgatctagttgcatttgaacattagaagaagtaagatccaaaaatctcctagctgaaattgccattctaatcaagggtttaggtggataaattactaaatcgagcttgcttatacctgaaacgaaaacgtatcacggatcacgagacgataatcattggcgacggcgacgtaacgagagtttggggagaaacaacaaggacctgtttgcttgtaagcctccgtgaattccatatttgagtatgtgcaacgagattctcagaagagaagaatcaatgcctatgatctatgataatctaagctcctggattcactgtgatacgagactgcgagaagccatggatatcgactttttcgagagaaaattttcaaaattgaaatgaaagagagattgtgagtcgggtcgggtttgtattgggtgggccagttacggggatggatttcagattgataatgggcctgaggcctattattcattaactcgtttgttgctggaatgacaataatagccttatttaacaaacaccttcacatagacgaaatcatgatcacctaaaaatcgaccatattttgatgttcacgtacgtaaatgcacattcatcttaatcacgtgaaagatgtttttccaactgatacaatagagttgttgtatttttagatcagacagactttcactataagcagattcaacattacatataaacataagacgtttaattgtaatttttttactaaaaaaatttgatcatagaattttgaattactcataaacatgaaacgttgaattttgaagctgctacatgttggaacagctcgaccaatgtcgttcacctcgggggggttttaagggtgtgcaaccggcgcaaatgaatgcagaggctccaattttttttatttaattctctgctaatttgagggtccaaatctttcaaaaatttctagacacagaacgatggctgggattgaatattaggttttatctgggaaaaaaaaagatgactatgtgaaactgtcacgttagctacggcactgcacggatcgatacgcacaaaacatgacttaaagaagaaaagaaatttgggccaattttccattttaaaaaagcttattatttccaacaaaaaggccattattagccacatcactgaacggatctactttttctttgagccggccttacccgccttacccgtaggtgcgggtgcgggtgtacctgcaccagcaccaggaccagcaccagcactagctgcaccaagaccaggaacagcagcagcagcagcacccgcagcagcagcagcaccagcaccagcagcagcagcaccagcaccagcaccagcagcttcgggtgtacttccacctgcggtacttccaccgccagactgatctccaaactttccagtaaaggatcttcctccccaatttgctgtccaagttcctccataactaaaatttggcgtagcttggggtgacgattttcctccccaagaccctttaaaagttccttcataattaatctttggcgttaaactgaactgggcaaacatagttggtggagctcctattgcaggtatattgttcttcgactttactcccatgccgcgcctacatcacacatacacaataacacaagtgtgtgtgtttgtatatatgtcatagtttcattaaattaaattagaaaaaaaaacattgtaccatatgaatatttcaataaaatttgtttgatttactaaatcagcaacctgatgagagcaatggccgtagctccaagggcgccaccggtcgtaaaccctgtggttaagagagtaatggctatcgtggctggtacgagaatcgggctgaatatgatgaaaagcggtgtggttacggttaatccgacggctgtaccagcgagtgttagacccgagaacacgaagaagactatagaggccacgacagcgataacaaccttataaacctccaacaagaagataagaaaagaaaacatgttgtgataaatgttaaatttctatgactgatgagatttgttttgatgtaattcttcagctcatactttgtttttggatggttacgttgtttggggtctacatgcaaaacgatgggagtcgatagagtcatagagatctacgtcacgttacattttctttttttgggggttgtcatgttttttggaccttttttctttcttgttcttgtaaagagttcaaaaattaactgtcgtgttgttcacgtttgtggttggaacatcctaaacatgtaacttatccttgatcctctacaggtctatagcagtttcgagataacaatatttaaaaaactttaagtttcagaagaatacagagtttataagctaagatttgtattagacacgactcaaaattcagaagtgagaacaggtcaatgtcaacgaaactcaaagaataattgataagcaaagcttcctccacaatcttcttgaccaaaaaaacataactcatcacatccttacctctctatataatccaacaccagagtctctcttcttcctcactccaataaaccctaaacaagtttctttttaaaccactccagcgatg

SEQ ID NO: 32741 - DNA, 3000 bp, Unknown; identical to SEQ ID NO: 1119
  misc_feature (1)..( 3000): 2750-1469P.txt file - cDNA_ID_3060769; gDNA_ID_1620361; Annot_ID_154645

SEQ ID NO: 32742 - DNA, 3000 bp, Unknown; identical to SEQ ID NO: 1125
  misc_feature (1)..( 3000): 2750-1469P.txt file - cDNA_ID_3060792; gDNA_ID_1620362; Annot_ID_154694

SEQ ID NO: 32743 - DNA, 3003 bp, Unknown
  misc_feature (1)..( 3003): 2750-1469P.txt file - cDNA_ID_3060819; gDNA_ID_1620362; Annot_ID_154687
aaggaatcaaccgcatcaagctttacgacaccgagacaactgtactaaccgcactcgcgaactccggaatcaaagtcgttgtctctctccccaacgaaaacctcgcttccgccgccgcagatcagagctacaccgacacttgggttcaggacaacataaagaagtacattccagcgacggatatcgaagcaatcgccgttgggaacgaagtgttcgtcgatccgaggaacacgacgacgtatctcgttccagctatgaagaatgttcaaagctctctcgtcaagttcaatctcgacaaatccattaagatctcgtcgccgattgctttaagcgcgttggcgagttcgtatccaccgtcggctggttcgtttaaaccggagttaatcgaaccggttattaaaccgatgcttgatctcctccgcaaaacgtcgtcgcatcttatggtgaatgcttatcctttctttgcttacgcagctaacgccgataagatctcgttggattacgcgttgtttaaggagaacgccgggaatgttgattccggtaacggtttgaagtataacagtctcttagacgctcagatcgacgccgttttcgccgcaatgtccgccgttggatttaacgacgttaagcttgtggtgacagagacaggctggccttctgccggagacgagaacgagattggtgctggttcggctaacgcggcggcgtataacggcgggttagttaaaagagtgttgacgggaaacggaacgccgttaaaaccgaaggagccactaaacgtttatctgttcgctctgtttaacgagaatcagaaaacgggtccgacttctgagagaaactacgggttgttttacccaaacgagaacaaagtgtatgacgtttcgctcaacggtaagtcaacgccggtcaacgataacaaagagaaggttgttccggtgaaaccgtcgctcgtgggacagacgtggtgtgtggcgaatggtaaaacgacgaaggagaagcttcaggaaggtctcgactacgcttgtggcgaaggaggtgctgattgccgtccgattcaaccgggtgccacgtgttataatcctgaatcgttagaagctcacgcttcctacgcgttcaacagttactatcagaagaacgcacgtggagttggcacgtgtaattttggtggtgcagcgtacgtggtctcgcaacctcctagtaagtaccctatctttcctctccaaaattttattttgattagtaagtattttgcatatacagtatagttattttcacgttcttaatagttggaagatggttagataataattatgggagttgggatggtttaacaacaaatgttatttttttgggcttcacttacgtatacagatttataattaaattgtgacgtatagacggaaacgtaaactaaattaattattttttgttggttatgtgtttgtagagtatgggaaatgcgagtttccaacagggcattgaaatggatatagagaagaagaggatcgtgcggatttatttacgttatttattttgatacattgttcttttgtcattcgagtatatgatttgcgtatatttatttttattattgtatatttggttggtttcatcggataaatagtcagattttctttcccccttaagccttaacttctttgctcgtgagtttataaaactgacaaaactttgttgatataaaccattatatcctgcaactgatccaataaacaacattgcaatattattttcaaaatctcaaattgattcgttttgctggtgatcaactgatcatgatccaagcaaaactcaacagtatatattgtccatattgtttcattccaatactccagagtcaaaaccttgagctgcctacttcatcaaacttgattagcgcctaccatcaattgagctacgactacactaccaactcccatatagaagcctgtaactcgaaaaatgggttttgagttatagtttgtcacaaagctctgtgaatacattatactacatgaaaactcatcaagtcttttgatatggaatcttcagaaccaagaatagctttaatgcttttatagttgtgaagtctgttattattctattactgaatgtgtattctcctccagaaatatctaagatcttagatgagtcagtttagacgttttaaatagcaagaatgttctgcttttttatgtcattttaaaaagcttaaggttttggattgtaagcatcgtgtggttgctaatcgaacttccttccctttgcattattgagatagtgtactcgcaaaacacggtggcaatttaaccaaaacatagtacaaacacggtttcaaaattttaaaaacaaaaccatatacagtacttgattaccatcccaagacttacatattcttagatggactatgagtctatggctttttcttcaactactaccaacttgaacttctcctccaaaccaattaagtgggctttcaattggtcatgccttctttccatatcacgagtttcttctagccagcgggagtgatttgatggaaaggtggtcgcattcgtggagtatgcttttgtaagtcttgattggaaaagctgtaaacaatgctctttctgaaatattgagggctagctttggatcgcgccatcgcggctaactcttggcaacaccaatggcttccttgtgtcttcttccatcaaagcgtgttcctttcattaattacattctcttttgtggccttctattatattgttgcgtagttttcagtcttttatttctcttcgttgtatctccgtgttatgtaaaaaatctaaaatttcgtataaaactttaaattttaccaaaaaaataattaaaaacagacaaattctttagaaataaaatctaacaccttttatattttcttcataaacaattgaaccaaaaaaaaaaactcaaatccaactcctctcccctataaaactctatcttattgatgattttgctcaaaatgtagtagtaataacaatg

SEQ ID NO: 32744 - DNA, 3003 bp, Unknown
  misc_feature (1)..( 3003): 2750-1469P.txt file - cDNA_ID_3060823; gDNA_ID_1620362; Annot_ID_154686
tcaagaaaaaagattttaatcactctatactttagatcatcacagtttggaaaagagtatcatcaaagttttcatatcaagaaactgtatatatagtattatcaaccaagcagcaacgacagaaaatttcaaggagattaaagagggaacacagtgaaaaaacctggctcttgaccttgagaatgacatgagcttcttgttcttggtcgatgggcttgtcatcttgagggttagacatctttccttttatcagattttatgaaacaaaaactccagtctgtgagaaatacgaaggcctgatagagagattcacaatacagtattgcaaaataaggggttgacttttgagaaagagagacttgtcaaaaaagtgactgaaaccagttcttgatcgcactcacttttgatctacagattcttgtggtgatatatcgaacggctcataatcattgtagcttatcatccgacggctaggagagcgtggaattcgtacatgaaaacactgccgtttaatcaagcattcgtaatgggctattgggctggtttaagatcaaatatgctcatatgtgggcttaattacttctacacagtatataaagttggaacccattttcgtgaaccgaccaaatagtttttagaaaatttataaatcatatttaaaaataaaatctaattaccacggtaatctaataatttcaaaaaaaatacaacagttagaaacttttaaaaatcttagcaaacataacttttgtggtattttaaaaagaaactcaaaattatgatattatttgacaaagtttagggcaagctctctttataaaatttatatatttcttgatgttctaaacttctaatgcatgcatggttattatttaatattaaaaaataatgtacgtcgaccgtcatagtgtgtaaatggttagtctatgtttcgtgacgacttctatttcggcccgacataatatatttccagtttttaatttgataaactaataggcattgtatcgtaacgtaaagatcagggacaatgctaacattcctatctaaaactcaatttgttggacagcatccaagtgacctaccacattgaattctttctcttggttgataagaaactaataatgatgatgttatatttatacgaatatattagttaacgtttatatttagaaattcgtcataaactcataatagttacaaataagtcaatctgaaggtgacacacctctctggatattataatgttttcaattttcatatggacttgtcattgtgtttcattttcaatttcatgtaccgacttaagacttaagggccttgtcgaaacataccgtacgatgtcgacaacctccatagatacattattaaattattgttactttcataatccaaaaattaaattgttatactaaagtatatgtaaaccagcatacattgatacatataagattaccacctagtggacaagttgatacacaaacaaaaacatgtatataatcatcaaatacaatattaccaaatgatgatgtctattattttctcttttgatagtggagttattatgatgtctactcttaattagtttcattattcaggtctcaatcaccgaagataaaactatatttcaaactgtagtagtaattaccgtatgtgtattaacattctatgcctatatgtacataaccgttaatattcggccacaattattaaattcaaataaatctaaaaagcatctttcaccaagtaattagtaaaactagccgtaaatgtcatccaaaattcttggttttacatcagaaggaaacattaattgcttagcgatagagttctatttgtataggacaactaaactctacaaatatcgttttttgtttatccatggacggagatggaccatttagattaattcattattatactactggaaaataatttgaggtgtttgcttagcttagctaaccttaaaatgttcatttttcctccgcacatctaaacgcgttcattagcccaatttgctaagtcaaaatattagttacaaccaacttgtgaatcagtcaatgttactatcaaatatttcatataaatctatacttggatttacaaatttatcgaaacatatctaaacacaattattaacataataactccaaccattcaaaataataataaaaaggacggaatatttaggacgtacgaaaaagagacgttggaaatcagagagctcaacgttcaaaatttggtacatgtatagaacaatgaatgacacatggccccattgtagattcttcatttctcgacgagacccagttaccattaatttacataataattctaattccgaccaatcaatgcatcacattatcgattaataattatcactcctccgaccagtttttttcacctattaatcctaactttaacggataattagcagctgttttcaaccagtgattaataggtatttattaccagctgatactacatgttttatttgcctcagtgcccaaatcccaataattatggaacgtattaaaagtgttgttgcaaatgcaattgtatgtctaaacaaattcgttttgttatacaattcattttatgcagaacataacgttaataaaatcccccaaaaaaggaaaaaagctgcagtaaaatcgaccctaattaattaaaagtgaatgctaattttggcacgtacccccacaatctctgacaacatttggtacaacaatctccaatcagtacacgactgaaacggtcaaatccacaattaaaataatatttactttagacacgtcatcgagttgaaatatttacatcacaaaaccgtacagttaaaaaaaacaaagtcatccccaatatctcacgtgggtcctacccactacatccacctccctcgttctccttcttcttcgtctctctatataaacaccatctttagcttctccttcaccggaatacaaaaactgaaacctttctctatttatctctctatacacaacaatg

SEQ ID NO: 32745 - DNA, 3003 bp, Unknown
  misc_feature (1)..( 3003): 2750-1469P.txt file - cDNA_ID_3060829; gDNA_ID_1620362; Annot_ID_154678
gagtctctaagtttgcaagagggatgttgagtgaatccgggagagagacaatcttatagtgatgtgaaggtcgaacatcgagcagaacatgttgttccttcttttgaagaatttctttgaactccttgctgctaattcttgattctgcaggaagcaggttcaatgggccctgtgatcaaatcgatgcaggcaaactttctaatatgagactactgacaacaactattggattcaagataagagaaaaagaaagaataataccgcaaataaaggaaattgagtgaagtcctcatagtcaaaatctttaaaagtttgcttattgaaagatgaattgtctccacacacggtgcactgtgatgacctgcctctgatcttgacctgtgcaaacactactccatcagtttatgcagatggaaacacaattgaatgtagttatgatcagaaatgaaaatagtaaaactttacaatgcgcatccttgctgataaagcatcaaaaagaagcatccgttcagagagtggttctcccaccaggcttgcgagtttaattgtctctagcgcttgtagacaaccaataacacctggcactgagaacagataaagtggaaaagatcatttaaagaaggacgaaattggtagagatttgcaagcaatagaaaaagaaaaaaatcgccattcaagtacctactccaagaactccactatcagaacatctttggcacgctgaggtaggtggaggagtgggaaaaagacaccggtaacacgggcctccgttatgattataaaccgtaagcttgaacacaaaaatcataatgacagttaagtgtttaatatgtggcttaacatctataaagagtaacacaataatgtagcgaatgtcatatcacatacctgcccttccataccaagcgcagcacccgacaccaaaggctgtatacaaagtacaaacgctcagtcaatactcaacaccggtgcctataaaactgactacataattctattgaagtactcaggtatcaccattgtttacagcgtatatacagagagttcagaaaatgattcacctttcctaacaagacacaacaatcactgatcatgtaacggcttggaggattatcagtcgcatcgactatgatatcatatctaatttatacagttacggaaacacagcctttcaatgctttactttgaggagactaataaagatacagaaaactgagacatcctaaaacatgtttgcatatctaaggatactggctgaggatttccaaagcattggaagtgcgaagagcttccacatattcatcaactttgatcgttgaatttatcctggaaataaggaaaaaggaattctgattagactaaacgagtaaaggtggtcataattttctcgaatgcttgtgattaatcatattaatccgcaaggagtttgaattacgagcgacaagcagcagcagcagatttcactttgggatgtccaataaatgcttctgtgtgtataatctgaataacaaacaaaccaacagagacacaaatcagccaaaagtagtacttccattcagccattgaccacagattagagccaagaaaaagaaagagttgccaacgcagagtgttccaagtcgtacctgcctatgcatattgttgagctctacaacatcatgatcgataatacccaactgacctaaacgaatacaacaaaagatgaaacagaacataataatgaagggagcagaaccaatagtttctggagaaagaacggtatatagaaactactctatcgatatctgaagataaacttaaggtaagagtctgaaaccataccaacaccacatgctgcaagatacaataaggcaggtgaacctagtcctcctgctccaataactaataccgaagacttcaaaagatttgactgccctataatcatacacacatataacagaacagaagaattaatttgtggaagacactagcagagaaaacaagtaatccagaattcaaatttctccgacatcactaaactgaatcaaaacaattaaatggaaacagaagaaatccaatataaagtttcaatctttcagctatatcatcacaaaactcagaatcatccatctcagattatcttcctattggctaaatacaaacgtgaaaagagtttgcatttgagtgtttgagcaaaagtaccttcaacagcaaacgaaggaagtaacagttgacgactataacggtaaatctgatctggagataacccatgttcaagctccggtgccgtcagataagagtcaccgttggatacggcgtcgtacagttcaactgccgccgtatcctggagcttagcttcgagggtcgaaatacggtgctctatttctgccttcttgagctttaactcttccagttcccggacaatttccgacgaatcaccaccgttggacatcataacgacaatgttagagaaccaatagtagaaccctagaagcagcaaagaagacgatgtcagtcaacggacaaaacgttgactatttttattgacgccgtggtggatctctgtctttaaccggtatttaaccgcgaaccaggttggtaggccgggttgggttttaagagaattcatgcacttacgaaatttattaatttacctagttaaataaactaaatttggatgtcttttgaatgaaacataatcccaacatatggcagataatgaattcatgaatctttgaatgaaacataattccaatatgtatatgtatgtatgtctatataaatgtacacccaagaccaccacaaatcattctcaataagtattaaaatattacaaatacaaaaggtaagttaaattacaaatatttagaatatgctcctcttatactagattttcgtttttgttttaacaataactttgaaactcgattttagtaggttttgctttttcctgagacttaaatactatagtttgagaaggagttatagaatcctctacaaaaataacaaatgacaaccaaaatg

SEQ ID NO: 32746 - DNA, 798 bp, Unknown; identical to SEQ ID NO: 1122
  misc_feature (1)..( 798): 2750-1469P.txt file - cDNA_ID_3060840; gDNA_ID_1620362; Annot_ID_154667

SEQ ID NO: 32747 - DNA, 3003 bp, Unknown
  misc_feature (1)..( 3003): 2750-1469P.txt file - cDNA_ID_3060865; gDNA_ID_1620363; Annot_ID_154729
agtttgcaagtaaaaaccacaaaacaaacgagtctgtaggcacgaccgcacgagtgctaaagtccgctgcatattgatagttcgaagacggtgttttgtcgatattattcactatttacgtgtcgcggattgattagcgactaaagaattagccttaacatatgttttgttgaaatatattttgagtcaagattattcttaattcccaatagaattttgaagtatttgtctttgttccaacctttaaaaggatgcttgaagttccaatcaaactacaactcatgctctctccctcttctgccttaactatgaagaaaacaaaagacattcgtttttatttttctcttcagtatcaaattcaagaatccaattccaatagccacaacataaattctctttgatataataatctaaaattagaaactgattcacgtctctaaattaaaatttctgatctattcaagtaactgttcttatatgagttttgtttccatacatgctttgatttaaacgttttctactacaattatatctacctctcaacactggaatccaattttctttatacggtttatatcaagtattgattgtttttgtccaaaacaaaaaccaagtattaattgatatagctatagtacactcaaattttaatttgctcactataattctgatattactttgaatagaaattcaaaattatctaatcacaaagttcagtttatttataatatggaagctttgagcaaaataatgtaaatataattataaaaaataattagaaataatttaggacaactgaaaaaaatatggatttcggtctataagtttctattatatatcaaaggaagtacttttttttttttgataaaccctaaatatcaaaagtacttttcgtttttgccaaatatgtttaattacttattttcgagatgttatcttccatttttttcagtatcattgtaatcaatgataattataacaaaatcacgatatgaaaaaaaatattccattaattgatgtaaaaaaaaaagtcaaatatcataacattaaaatgtaactttccccttatttactaactaaagctcatgcatgcgtggcgtgatattatctattcaattccttttctaaaaaggttttcctagtcctattaggattaggaaacagaggttgctatataaatacttgattcgctcgcgtttatctcagtcacaaaatccctacttcttcgtaacaacttactaatatataggcagcttggagcttattcattggacgacgaactctttttcttcatctctttctgttttctttttctcttcttttgttctgagaataatgggcccaacatacagagctttgccagtaggtatgaggtttcgtccttcagatttggagttggctgtttactttttgatcaagaaagctttaggacttcccatgaaagctcttactgtgcccgacgaatgtaatgatatcttctcaacacatcctcgcgacttgcctggtgagaatactttctccgatccttttgacaaaacagatttgatagagtttttgagtttcttgatttaactttggctacttctttcttgcgtgacaagctttattttgtgaacttgtttttgctctgttctttcaggctatggaagcgaagagcattggtacttctactgcaagaaacccaagaatcaagttactagaacgaaatcttataacctctggataccaacgggagaaaaaactgatgtgttagatccaaagaagaatggcggcgaattagtcggtatcaagcattcgtttactttcattgagaacgaagaagaagaagaatctgataacaagaacggcgatgaagaagaacctccacaatgcaattggttcttggatgaaatcagcctcccattgacagttgtggatactgattggactctgtgtcatatcttttacgagaaggttaaacctgaatttggtaatttgcatatagtcgaatctgaatccgaatccgaagaagaagaagaagatgaaagtgttgataagcctgcagagagtttggatagtgttaaagagaaagatggaactgttcttcctccacctcctgctacaccttagcttcttcatgatatagtgttttactgttagtgttggtggattgtagattctctcaaaacctgtcaacgtccaaatctttattacctctagttgcatacctattgttttaaagatgcttatttcacttcaatatatcggttaggttttttttctttttctttccacaatatatcgattaggttatgtggctcgagagactcacttgctcgctgatacaaaagttccagaacaaagagatcatccctcatctaatggctcatgttagcaattgtccgcctaccttgctaaattgcgctcctacacctaaagaaaactattgatatgagtcgtagtaataatcaatcgatctctctattccaataattgttaggagggtcataatatatagaagaagatagatgatatatgttatataatatgatatattgatatgtccaaaaatcaaattgttcaaaagccttaatgaaaaagagaaagagatgtttgaccagcttaaaaacttccggtcaaacacctaaaaaccttttttccgcctttgtcataaatctttgactttttgactttttccctctcaacatctcttttcgagatttcaccacgtgtcaaacctctcatctgaaccgttcatcttacacgcgtgagattatctcattttctcctcctccgtctttctgctgtttcttcgatctgtttctttgaccagaaaaacaaaagcttcaaactttttagcttcttcttcttccttcaatgtcgttgaacacatcccacgatacttgacaaaatatctcactctttcgtctctctgttttcgactcgcaaaccatcgaagcgccgattaatcttagaggaatttcttcgtgattagggttttgtttagttctatctggagatatg

SEQ ID NO: 32748 - DNA, 3003 bp, Unknown
  misc_feature (1)..( 3003): 2750-1469P.txt file - cDNA_ID_3060869; gDNA_ID_1620363; Annot_ID_154727
gtatatcttcatgtcactctttatacaaggatgagacagggatttacaagaacctgcttcaagagacagcacatagagctggtcttgatctaccaatgtacacaagtgtgagatcaggatcttgtcacttcccaggtttctcttgtactgttgaacttgctgggatgacgtttacaggagaatcagcaaagacaaagaaacaagctgagaaaaacgcagccattgcagcttggtcctctttgaagaaaagtatatataactatcttccaaattgttccatcaaccccaaaaaagcttctcacttttctacttgaaaccatttttctgtttctctactgtgcagtgtcaagcttggattcacaagatgaagagaaggaacaagaagcagtagcaagagtactctcaagatttaaacccaaagaagtaagaagacgagagacaacaaaccaatggagaagaagaacaagtcaacaagattcaaacaaggatttgttgattgagagattgagatggatcaatcttttgaccaatcaagcttcttcatcatcatcaacatcaacaccgaatcaacacaaaaactccagtttcatctctctaattcccccaccaccaccacctaaatcctccaaaattttgccatttatccagcaatacaaagacagatcatcacaagaagctaagacagagacagcgacagagatgatcaacagcaaagccaaagtcaatgaaacatcaaccagattgagtaagcaaatgcccttttccgacatgaacagatacaactttgtcggagggtgtagcgtaaacccttatagtctggctccagcggttcaaatgagatcagtgattccagttttcgcagctccaccaccgaaaccaaaccccaaccttaacccatcatcattatcatcatcagtcaatgaattcacctcatccaataattcctgctctgttctgaatacgccgggattgggaggccaagagaagaagaatctaactcgcgaaatgatcaaacttggttcagaatcgagaattttggatcaaacccatgatagttagctaaatttggttaatgggttaatctcaaattaaatccttgtcaagtgtttgtcacatagataaattatagaccagtatgtttccgtttcttgaatgtgttcttgttttttttgaagtgtttgaattttctaaaagtccgacatgaactttgaatgcttgcgaattgcacagagaacgaaaacaaagagagagcattaattagggaagaagatgaagaagagaaatgggagtttgcaagaaaacaattaatgggttttgttttgtcttcctccattaatgcgccgaatgctctgctctgcttcccactcttcatcattaatggttttgctctgtaacgtcggttccaacaaataaacttaataattcgaaattataaatttcacaagttacatttttctttgtgtaaagattttggaccatataaacattatggtttgcgagaatgacgtttgtgtcattatccgatttagatccgtataatctatgttgttaggaactcaggattttgctcaaatattcaaattggtatattttgactttgatgaaattattttggtcagaccacgagacttgattgcttctcaattatttgggccggtccattaatttggggccatctaacttttacgtgggccgtaacaaaccgaaacataaaactagtgacctacctaaccatattaccccaaccggacaggaggtaacgagttaaccagccacttgttcggcttggaaatttttttaatcgtctgacaatttatgacgtggatccaagtagcaagaaagctaacatgttgttggatctgatctgatccacgaacctaccataaatcaattttctcattatcttgacaggtatatcttgcattattatacgtcagattttcgtggatacaatatttttaaaatgcaatccatatttacttgatttccaaaaatgggttttttcaaaagcacaatttccaaaaatggatcacaatttattaacggattctcaacttgcaaatcaagcttaaattataatcttttttaactcagaatttaatataatctttttttactcagaattgattaaactaacagttatattgatcttgaaatcacctttaatatcttgttttaaatcttgtgtcttgcaaatcacggttcataaatattggagaatcgaataaataaattatttctattcctatattgcgtaattttattttttgactctctattgcgtaattacactcgtcagatttcgtggatgagtactcagtaaatcttattttaattaaaaagcttactagtctaattgctgcaaatttgaccaactatacagttgtgttgcattacaatatttcaaaccattaataaaacgtgtaaaacatatttggagttgaatgaaactacattttcctttatgtcaaacgcacttttcaagatatatctcgaacaatttacgtattattttcacaaattttgttccacaataatttaggttattttggtttttgttgttgttttttgagtctgaaatttcaaatttgtatttttttttaatatatatttaggcaggaatctttaaaatgaaaccaataatatattcactaagtttggaaaaaaaccaaaatttcataattaacgggacaatgactaagctgtggaaaagataacataatctcccaatgactcaatgccacgtataagatgagaaccgtactcttctgtgttcgtaccagatccctcaaaaggcgggaagaaaccatcaagaaaggcacattgctgacgtggaatggaatattcgaacacgcatatccagctccttcctcctttttcctcatatcccttttttctcaatataaatactctgcaaaaaaacacccacaaatcctcacacaaaaacgttttcgaaatccctaatctactctctcttctctatatctctactcttgagaaatg

SEQ ID NO: 32749 - DNA, 661 bp, Unknown; identical to SEQ ID NO: 1135
  misc_feature (1)..( 661): 2750-1469P.txt file - cDNA_ID_3060879; gDNA_ID_1620363; Annot_ID_154713

SEQ ID NO: 32750 - DNA, 3000 bp, Unknown; identical to SEQ ID NO: 1151
  misc_feature (1)..( 3000): 2750-1469P.txt file - cDNA_ID_3060888; gDNA_ID_1620364; Annot_ID_154755

SEQ ID NO: 32751 - DNA, 3003 bp, Unknown
  misc_feature (1)..( 3003): 2750-1469P.txt file - cDNA_ID_3060920; gDNA_ID_1620365; Annot_ID_154819
ttttcttcttctaatttaggctactgatattgtccatatatctcactgtggcatctctattaacgtggtcatttgtacctcgttttctgaagctaatgattcaattatcatctcaagtacgttttagacgtcatatcttcatatacactacttgtctatctttatttctttcttaaagtgggatccaaattattgccaatgtctctcattatataatgcagacaaatgaactttaccagttagctgctgtggcattctgcttactatctgcatgggtaagtctaattctgtcatttctttgcatactggtgcttgcttagctttctgatcccttttggtgtattataacatctgagttaattgttacctgagcttgcatcttactaatagactacagaagaaaaaaatgatgattacaatagacactgaagtatttaagtataatagcatattgatgtaatttccaatttttaacttagagtgttggttcctcgcaaaactttttcagtgcagtgacaagctgggtcttagtcttgagttgggatcatttgtggctggcgttatgttgtctacgactgaatttgctcaacatacactagagcaggtattgattctaaactcaggtcgcttttgctttgcgagtacgtggtacaaaatgaagtcttaaggtggtggaatctcccttactttgtgatgtaggtggaaccaattcgtaatctgtttgccgctctctttctatctagtatcgggatgctcattaatgttcactttctatggaaccacgtggatatccttctagcgtcggtgattctagtgatagttattaagacagcaattgcagcagtagttgttaaggcttttaggtacaacatgaggatatctttccatgtgagtttggtctctctacttaagcttttgtgagtttctacatattatactattaaaaccaatcacgtaaatttcttgtcacaaatgttatatataggtcggggtactgcttgctcagattggagagttcgcctttgttcttctaagccgagcgtcaaacctacacgtaatcgaggtaacacccttttacccttgtagttgaacacactctttaccattttcttcttcctaaactttgtggctttgggattaatatgaatgaccaatgtaggggaaaatgtatctactccttttgggcacaactgctctaagtctcgtaagttacctaatatatgcaaacaagccttttccattctaagagaacatacttaaaataatatttagttcaaaactgattacctgaaaatgctgttacaggtaacgactccgttgctattcaagttaataccgagtgcaatgaacctcggtgtcctgcttcgatggttcccttctgagaacagttctccgaacgaggtcattctcttttccagatctatttatatttaagaactgagataagacatgacataaaaatgaaaatagatgtattgattataggaaactgacttgtgaggtcgtgactgagagttttgtttgtagagtttgcaggagaaagcatcattgatagaagtacataacagaaccaagtgatctctcttttgtacattgactgaagatttaagaagaaaaaacagattttgatccgatatactcaactaggaggcagaaaaaacatttgaaactgaccaaatcagatccaagacttgctttttgtattttcttaactctttattttttgtaatatcgtatatatttagtattcactaccttcttgtgtagttcaagcgcttatagcttgttttacttggtgtaaacgttgtaacgatattagccttatatgctgttgtttctttaatgttcatcacaaataagaatctcaatagaaaccacagagttctataattgtgtgctcaaactccacatatctaaagtgcgagcaacaactagatgaatttagaggtataaatccattgcaatgcacaacaaaaataacaaaaaagaaccctccttagaagaacaatgacatcaaagtatagaaaaggattgaggtggaatgaagtaagaggctggtgaaataggaatttagtagcacatatatgaggacacgtggagcttagtgattggttgaaataagaaaagatacgtggattcgattggtatgagctgaagttgctcaagcttaagatcaagttgttcatcgtcttcttcattatgcaaaaatctgagaattgtaaacttttcttcttcttcctttcttgtgtgtttggggttgttactcattgttagtttgagatacttccttcaattcactaatattatttatttacgggcaaatcttaatgtgagatttttgcatagtgagaagtgaatctgcgttttatgaacatcgtttcaatctatagttcgatttcatttgtgagattgttgagtttcctgtatcagctggttaaatagcaaatctaccattcttatcaccattacggagattgaattttccggagtcatggctttccacgtagtagatgaagtttggggataggccatacaagcaaacttggagacggaaatatatacaaatagaaaaacaaaataattaagattagttttgcacaaactttgcaaaaacatcaaaataggtccgacatttaaatcacttgcttaggtctataaaataacactcccatcattcaacatatttttcctcttgtgggttagacctacaaatccgtggataaaactctttaaaaacctgtaatctgtaacatattggcttattatccatcacgcatgctattttatggacatgaaaataatgtccaagcggaccaagcccgctctgcatggtattatttgggccgaggcccgttttactcatcagttttcattaccggtcaaaactcaaaagtcaaaattttctaaaagacgaaaaagccctttaatttgatttcccaatactttttactcctaccttctcaattcgtccgatttcttcacaaattcacgagagagataatg

SEQ ID NO: 32752 - DNA, 3003 bp, Unknown
  misc_feature (1)..( 3003): 2750-1469P.txt file - cDNA_ID_3060924; gDNA_ID_1620365; Annot_ID_154818
atttatgaatttatggaaccaagttctggggattcacaacatgacaaaaccgaatctgtcggaatcgtttactaagggaatctgtcggaatactaggctatcggggaccaaaattcttacctggagaaggagaacctaacatacttttgctagattgtcccattgatgtctctgctgctaggattcgagagggagtggattactatggaagcttttgtagacagcttcgttcgtattctgttttttttggatgggcttttgcgagcccagatccgtgaatgttgttggtgttggatttcttcactcctccgaaatcggcccattattatgtttaaggcccaataaatttggaaaattcattagattgagttttgactaacaaaaaaatttgatctaaaccaaatcctagttaatacggtttagtaactcgtttagggaaaatcagctactgtatatcttggctttggccggtttagtaaactaacttttgactttctacttacttaaccaaactaaacctaaatcggggaattcaaactataccataaatatggaggccggaaaaaaatcatccaaaacttggtcaacgctgagtccaacgtggccatcagccttcggcgaatgattattcgagaaagaggaaaaagtgagtcgttttaggggaaactgttaccaacgccgaaaaacaaatgctttaactcatcaccggaacaaatctgactcaacttggtttgttacttacctgggcggtgttcacggtgaataaaactagtaaaagtagtaactagttatgaggttacgattaaaaaactctttttgggacacaaaacaaatttatttactcaactatatcgaaactgactaatgtgggttacaataatatagattttatagatcagtgttgagaaatgatcagcataacccttgtcgatcgtgtttagaatgcgaacaagtatgttaagatacaaagaagaatataatagcatcaatgatttacgtaccatggtggcaaaatattcttgtgaatatataatggaataataattatatgaatacttgatccaaacaacacaacatacgaatttggtgtcaaagatatgagatggatatttctatatgcgataaatttgtaaaatctaaaagttgtcgattaaatttacgactttgttaattttaatgcatttttggataaaaatatattcaaaaattagaagaccaaacaaggatcgctaaggaaattttgaatatttttcctttattataagcttcatttcactagataattttcttattattcaattagacgagtatcaatacatcacacacaaacaacaagaaaaaaaacaaaaagaactactgtttcttgagaagaagagggccaacgttatctccattagctttgttgtgcttcacatgactcccatcacacaatggaaacgtccccgacctccaacacctaaagtcaaatcaaatccatgcatgaccatgattttatatacatgcacaaaaatacttattcgtacatttgttcgtttgtaaaaagactactaattaagaaaaatcttacgagcagaagctttggcaaaacatatggattagtatgaagatacattaatgtataaatcactactatgcatgattttaattaaaacatgattcaaatagtagctaactatgttcttttctttcctaattaataagagaatgtgaacctgcaatagggagttatgttcttggaaagctcggtgacaacgacggagtcaacaaccttatcttcgttctttctgatctccggattgatacctccaccgccttctgctctcaccaccaccattctctgctgctttcgtcccacctctcccccggtgactggcttgaatggaagctccccggcgtaacttagccccgtgccgaacgtgcttgcgatgatagccattggaataactctctcttactcactctctatgtggcagtgatttgtttatgaagtaagacagaagatattagatatatgaaaggtaaagggagagagagagcttgtggccatcacgctccctctgctaaacgacgtcgtaaagcgtgtgtatgagatggaagaatcaaaagatatggtcacaaactcacatgagatttaatcacaaaaatatgaaaaatcagctgcaaaatttattttttacttacatttagaatttacaactttttaatgttcttatattatattgattcaaattaatacacatagaaaattgtgtataacattattttaaagatgaaaaacactatttttaagatgaaagaatacacatatatactgtatatcttttctaatttttgttctcaaattcgtctaactaagtaaactattatgagaaatagttccatacataaaaaatttgcaaaagaattcgttgcaaattttaaaatagtaattttgaagtatttgcaaaggatttggtcataggctaaccttaactcttttttttctaggttgttatttaaaattttgaaaatggtatatattcacgatggtaaaattttttcaatagatgaaaattccaagaggatgtgttaatagatcaaatgtataaatatttttgagtatttctctgcacataatttcaaaactgagaacctaaaagtgaaacgcatgacgagaattcgagtcgaagtgtcgaaccaaagcttgtatatattgccctagctgtggaattgcttcaaaaatgagtgtcgtgcaaaacggactagttctcttctctctcacgacgagactttaataagaacccaaaacaagttcgcattgacacgtactacactaattaaacaacaactattaacaaccattcaacacaaaaactctttcccattgattcaatttcaaaattttggatctaataaaaccaaaactctcattaaaaaaaaaaataaaaaaatcaaatctgatttctgaaacgtttttgattcgcgacgattcccaaattcctgggaaaatatctctgatcgatg

SEQ ID NO: 32753 - DNA, 3003 bp, Unknown
  misc_feature (1)..( 3003): 2750-1469P.txt file - cDNA_ID_3060940; gDNA_ID_1620366; Annot_ID_154852
tttactgcggcaacgaaggtgatattgaatggtttgctacaaactctggattcatttgggatatcgctcccaagttcggtgccttgcttgttttccccgaggttcgttggtgttgttttatttttcctgttggaaattggaaaaagaagaagcaatttgttactgattttagggatttggtatagcataggtattatggagagtctatgccttatggaagcagggaagaagcttacaagaacgctaccactttatcatatctcactactgagcaagctcttgctgattttgctgtttttgtcactgatttgaaacgcaacttgtctgcggaagcttgcccagttgtgttgtttggtggatcatatggtggaagtaagtgagcaacttttgtgttagtggaattctttttaaatgagattgtggagtaattgtgtttttgtgtttgttgttattgatgcaacagtgttagcagcatggatgaggctcaagtatcctcacattgcaataggagctttagcttcctcagctccaattcttcagtttgaagatgttgtacctcctgagacgttctatgacattgcatcaaatgatttcaaggtaatacatacttttgcttcccttagtcgattgactttatcttgtctttctttaatcatatagggaccgtgtttttgtttgtagcgtgagagtagcagctgcttcaataccattaaggactcgtgggatgcaataatagcagagggtcagaaggaaaatggccttctgcagttgacgaaaacttttcacttttgccggtaaacaaataaattggagttagtgtgcgcttgttaagtgtattgattagtaatagttcaatggattgtttctcgatttgcagggtgttgaacagtactgatgacctttcagactggctggactctgcctatagttatttggcaatggtggattatccgtatcctgctgacttcatgatgcctttgcctggacatcccattagagaggtatatttgggaagtaacactttatgagtttatacgaatattgtagaagaaatctgagaatgcattcgctagatcatttggattttcatctttacatcaacgatccggggaggctatgctttaaagatttgcttgttgcgtcaggctattgttcaaccacgtccgttaaagtctttgttcaatgtggtgtatctttctataggtctgcagaaaaattgacggtgctggtagtaatgctagcatcctagatcgcatatatgcagggataagtgtgtactacaactatactggaaatgttgactgcttcaagttggatgatgaccctcatgggttggatggatggaattggcaggtatgaaaaagtcaactgctttgtttatctttcctttttctgataatatttcagtgacgccattattcactttcaccatccgtttacaataggcatgcacggagatggtaatgcccatgtctagcaaccaagaaaacagcatgtttccaggttatggttttaattactcttcatacaaagaggaatgctggaatacattccgagttaatccaagacccaaatgggtcacaacagagttcggtggacatgtaagacatcttttgataaactcaagattctttcaatgctgtgttctgaatctttactatgtctctgtaatgtaaaaggatatagcgaccaccttgaagtcatttggaagtaacatcattttctcaaatggtctgttagatccttggagtggtggcaggtaagaatattgttccctttactcaaatcccaagagctattttacaaaacgaatctcgtaatcgtgacaaatgcttgagtttgactcgtaatatgcagtgttctcaagaacttatctgataccattgttgctctcgtcacaaaagaaggtataactaaaagcctcatcaatctctctcgtaactaatctgttttttttttttttttttttttcatttgcatagacttaaaaacgtttgatcatagtagcagtagtctacattttattgacttgatgaattatttttggtatatctatcttacaacatcatgatcataatcataatcatcatctattctctttgaaactcacaaactaagttgattctggctttttcttctttttttctcaggtgcacatcacttggatctacgaccttcaacaccagaagacccgaaatggcttgtggaccagcgggaagccgagatacggttgattcaaggatggatcgaaacttatcgagtagaaaaagaagctaaggtttctctgttaaaacgttcttggtaagagaacaatgaaaagaatcgtctcagtgtgtaactcggaatctgcaaactttgtattgcgaacacatgctttgaataaatccatgtaactatgtaaactctcaatgatcactaatcttttctactagcttaactttttcgtttttgggtaattatatatgaatacacgcaaacaaaagaagtacagaataagatttatgagtctggctgatacacccaaacacatctgtcaaggatcttaaagaatcatatcttctaaatattaattttcatcacattgtgtttttatggcagaagaaagtatgaaacatttaatggttatgagtagaaaatctaaaatttaattaccatacagtcgtgactcttgagaaaatcggaaattttaattaccatatataatcacctcgtttaaactaaattgaaaattttggtattggccgctaaaaacgaggaggaaaaggcataaaacgccgtcgtttgggcattttgactggtcgaataaaaactcttttgactaaaacgtcgacctaaaaaaagaagagagagactagacctctctacaacgcactgtcacagaactcttctttgttgtgcgagagagaaatagaaaaagtgaagagacaagcaccgtgcttttgatcggagatcggaggaatttaggttcgattctccgtaattgtgatattgggagagactatg

SEQ ID NO: 32754 - DNA, 3000 bp, Unknown
  misc_feature (1)..( 3000): 2750-1469P.txt file - cDNA_ID_3060940; gDNA_ID_1620680; Annot_ID_164401
tttaactttcaatacaggaactaattcagaacgtcttagcgaatcaagaagttatcctgaggaaaagaaaatctgatgtggaagctgaattggaatgtaagagcaaatcggtggaagttgaaattgagagcaagagacgggcttgggaattaagggaggttgatatcaagcagagggaagacctagttggtgaaaaagaacatgacttggaagttcaatcaagagcattggcagagaaagaaaaagatataacagagaagtcttttaaccttgatgagaaagagaagaatttggttgctacagaggaagatattaaccgtaagactactatgctggaggatgagaaggaacggcttagaaaattggacctggagctgcagcagtctttgacgtcattagaagacaagagaaaacgggttgattctgcaacacaaaaacttgaagccttgaagagtgagacaagcgaattatctactctggagatgaaacttaaggaggaattagatgatttgagggcccaaaagcttgaaatgctggctgaagctgatagattgaaggtggagaaagctaaatttgaggctgagtgggaacacattgatgtgaaaagggaagagttaagaaaagaagcagagtatataactcggcaaagagaggctttttcaatgtatctcaaggacgagcgtgataacatcaaagaggaaagagatgcattgagaaatcagcacaaaaacgatgtggagtcgctaaaccgagagcgtgaagaattcatgaataagatggtggaggaacattctgaatggcttagcaagatacagcgtgagcgtgctgacttcttgttgggcattgagatgcagaaacgagagttggagtattgcatcgaaaacaaacgagaagaattggaaaattcttcaagggatagagaaaaggcttttgagcaagagaagaagttagaagaggagcgtatacagtcgcttaaggaaatggcagagaaagagttagaacatgtccaagtggaactaaagaggttggatgctgagaggttggagatcaaattggatcgtgaaagaagagagagggagtgggcagagttaaaggattcggttgaggagctaaaggtgcaacgagaaaaactagagacgcaaaggcatatgcttcgtgctgaaagagatgaaatccgacatgagattgaagaactgaagaaattagagaatctgaaagttgcattagatgatatgtccatggctaaaatgcagctgtccaatttagagcgtagctgggaaaaggtttctgctttgaagcagaaggttgtgtctcgggatgatgaacttgacctgcaaaatggagtcagcactgtgagtaatagcgaagatggctacaactcttcaatggaaagacagaacggcttaaccccttcatctgccactccattttcatggataaaacgatgtactaatctgattttcaagacttctccagagaaatccaccctaatgcatcattatgaagaagaaggaggagtgccttcagaaaagttgaagctagaatcgtcgagaagagaagaaaaggcttacactgagggactgtctattgcggttgaaagacttgaagcaggaaggaaaagaagaggtaacacatctggagatgagactagcgaaccaagcaataacaaaaagaggaaacatgatgttacccaaaaatattctgatgaagctgatacccagaggtaaagtctgatcattcaatattaaattttacacatttgttttcttgtttttacatcaattttaaaatctgaatcttacatcttctttttctcagtgtcatatcaagcccgcaaaatgtgcctgaggacaaacatgaactaccatcaagccaaacccagacgccaagtggtatggtagtcatcagtgaaaccgttaagatcacaagagtaacgtgtgagacagaggtgaccaacaaagtcacaacccttgactgctcagaaagtccttcggaagcagggagaaagatgggagaggagacagaagatggtgattgcaatcaggtagttttcatgaactctttaaagaagaattgcctgcaaactttacaacagatgaataataccctttggctatttctgtagactgggataaacgcgtctgaaacagtgattcataatgaagctgcaacagaagatatatcacataaggtacgtctcagtcttcaccagataactaacccccacatatgttgtcaaagtcactaacaagagtagttgtttcttgtctgttgatgcagaaactctatgaatccttttgggcttggtttctagagaagataagggtatgtaaatggatttgattgattttaaaactcgatcggtcgatgtgataatcatagtcagttttttttttttcttccagatttcgagtgagtagtgttggttagttaaggtagggtagggaaaaatcgttggcttctagtgtgttgcagtgtgtgtatttgagaatatatgatttgtgagactaaaaagccgaaatcattatcggggtttattgtttcttctacttgtaatgatgttgatgattgatgtcttttagctcatcggttagtaagtgtcaacagcaagagtgttcggctggactaccgtggcccattctgtagatttctttctagcccggcccacaacttccattgggctagatatgtttttctcacgtaaaagatatctgactgtcgatattgaagtaacttcttaaaacatttagatttaattgataatttaaatgtcacttttggttttttagatgacgattaaaatccttttcataacccaaaatattagttttgccgatattagaaatccgaagaaaatgacagaaaataggattaatcaatttagggtttaataaaaaatagtgagtgagagagaggctacagtgctccacattgacatcaacaaggttgaagaagaacaacatcattcaacatcagcatcacgaatattttcgagtcatg

SEQ ID NO: 32755 - DNA, 3003 bp, Unknown
  misc_feature (1)..( 3003): 2750-1469P.txt file - cDNA_ID_3060955; gDNA_ID_1620366; Annot_ID_154836
aatgcgtctcattcggatgatagtttaaggagtttggaggttgagctaaatgaacttagccggattaaaccgagaaatagtatattaaaccgaactgaagataaaccggagcagcttacccctacttcggcttggagagccgccgagaaattagctaaagtggctattatgaggaagcatttaaatcgagtcagcgatatgcacggcttggaaaacgccagattttaattttaatttccctttttttcgaaaattcgatttcaatgatttttgaatatataatggtacataatttatataaggaggataagcaataatttagtaaggtataaataatagaagtatgattattcagaaaaagacccacataggtgcatgatagcgacaagcagtagccgacgggtgtggccttttgtattgcagagagattgagaccctacattagaaggaattaattggtcttttagcatttttatcttcttcttcctttttgtaatcttcaaaaactccaaattaatgactgaatagttaaaaaaagttgtagatcaaataaatgaagtctgctttttttgtgtactatatagaattaaaagttgaggtatagtggattagagagtgtgcttgtaatgctggacttcaaaatcaaaagttaagtttatattatcatatgccgtttaacttaagaggatctataatatattatatctttccaaatgaatgatcatgattagtcatgtgatcatcattatagcctattttgttatagaaggcaccgggtttgaatgatttgaatagtgcgtggggattgtctttgttggttgttggtgaatggtttggtgggtgcaccgtggtagaaaccaggtcatgcgccgttgcaaagctttcttctcgcttaaattcattcattttatatcattaagacatttactaattatatgtagctagcgccaagttgcaatttgttttgaatgcaatgattttgtatacttttaaaatggatgaaatgattaactattgtcaaaggtccacttctcgatgtgattcactaaaatgatcagtggcagaagaatctcgaactatatatatggtcaaatcataactaaaaaaactaagctattattttttcacaaaaaaaaaaactaagctatcattcatcacgcagttacatattgcatatggacaatgttaatgtcaactaatgaaagggaaagaatctcgaactatatatggtcaaacggtttgacgcaccatacttaaaaaaatactaatcaaggtgcattacattcattgatgttacaattacttgtactaatgaactctgtgaaaatcagaataacccggtataacacactatttggagttataatggctgatccaacttttgggagattttgtcacagttgggctacagtttgtgcaatcggcaactgtaaagcccattgagaattccaaaaataatgtaaaccaattaataaagcatttacctttggcgcctgggacgaaaataagataccgaaaacaacctttactctacaaacataggtccatgtaaaataggcttaggcccaaataatgtaactctaaaacaaatctatgaatctattaatcaccaaagttatcttttacataatgtaatgggttatttaaggagagatttaataatttcgaaaatgtttggtcaactccgaaaaggtgaacgtgttaattaaaaagtcctggtactgcggcagagagagagattagcccatatgacgtggttgtgatgtgtccgaaagctgtcaacattgaaaatcaacggtccagatcagtatactgacacttggctttgtaaatttgttaattttcttctctggtcaaaagtgaaagtgttaattataattaaattttatctagttttcaagtaaccatccatttagtacagccaagattggattatctttaagtttttaagttattctaacagtctttattgatgactttgtatttgcaagagttgcaaccaccaatatcttctattacatatttacatcaaattcagagtatatgtcatccatacaaaataatacattatcgtaataaccacacaaactccgttaatccatttgttttcattggcggtggactattttaaagaagaaaaatatatttatttttttgtcagaaagtaaaatattataatggtgttgaaactgttaacaccattataatatatatataaaatctaagtcaaactactgtggggaaatttgattaggaaaacaaaaaacgtgctttaaaaactatgtttgtacgctgtacggataagatatttggaaacgacacactatatttataatccaaacatattttaaaagaattaccggactgtattagttgaaatgttattggaactgtttcttaattacatatattaaaagtattaccggactgtataatctgtattatttgaaatgttattggaattgtttcttaattacaaacgtgaagacatgaatacgacgacaagtattatacaaagttatccacacccatgtgcacgtaaagtatgcttaataagatttccaaatctatctataatcaacgtaatgtctagtcacctaattatcacaatagtggacaaatagttgcattatctacaaaatcaagattatactctctatatgagtataacgtgagtgtcatcatttaattatagaaaaaacacgattatgcaggctaattaaaacgcgttaattactgagtcaatgaacctataaaaccggcttatgctacccctcccaatctcatcacaaccattagtctctctttcagacaattttggttctttttcttttgtatttatacattcttaatcttctacaaaacaaaagaagaaagacacatttcggtactaacattgttcttcatacctctctttaaattcatatacgtgtatatactttgtttatacgtgtgtttgtgttaattgtgttgtttaatcttaatcccaagttagtagaaatg

SEQ ID NO: 32756 - DNA, 3000 bp, Unknown; identical to SEQ ID NO: 1172
  misc_feature (1)..( 3000): 2750-1469P.txt file - cDNA_ID_3060984; gDNA_ID_1620367; Annot_ID_154880

SEQ ID NO: 32757 - DNA, 3000 bp, Unknown; identical to SEQ ID NO: 1175
  misc_feature (1)..( 3000): 2750-1469P.txt file - cDNA_ID_3060988; gDNA_ID_1620367; Annot_ID_154871

SEQ ID NO: 32758 - DNA, 3000 bp, Unknown; identical to SEQ ID NO: 1176
  misc_feature (1)..( 3000): 2750-1469P.txt file - cDNA_ID_3060992; gDNA_ID_1620367; Annot_ID_154869

SEQ ID NO: 32759 - DNA, 3003 bp, Unknown
  misc_feature (1)..( 3003): 2750-1469P.txt file - cDNA_ID_3060996; gDNA_ID_1620367; Annot_ID_154863
cgataatgccccacatgatcaggtagttgcttctggaatgtatctgttctctcaatccatggctttagataaaggatggtaattaattgtctataggaaggaagctgattattcacattggcacttttgtttttgtttaacccagaaatcagcgtggcttgctgtattctacatgtgcattccgacaggctatgcttttggctacgtatatggtggagtggtgagttactttttgttattcgttttgtctatgtcatgagattctgattacatggttctgttttaccccacttccagtgacctcaattccctccttctgttttcttgtaggtggggagtgtccttccttggcgtgcagcattttggggagaagcaatacttatgcttccttttgctgttctaggttttgtcatcaaacccttgcatctgaaaggtgcgtgtctgaagttgcaaacacacacatcctatgttcctgatggagttcagctatttctaataaatcttgtatcttcaggttttgctccagatgatacaggaaagccccggacagataacttaaacgttttgccagttggttatgggttctcagctgttatgaaagatttgaaattgcttttggtagataaggtttatgttacaaacattcttggtaaccattttcccttgtcatgtattaaaaagcatctgtgttcttgtatgatttattgattacctgcaactgttttccttcttttctcagggtatattgcttacaactttgttttaggcgcctattcatattggggaccaaaggctggttataacatatacaagatggtaaaatattaccagagcgtttcgtttccatgtgtagaacagtagaagtatatctcttgatgcctttatcccattgcaggaaaacgctgatatgatatttggaggggtcacagttgtatgcggaattgttggcacattatcaggaggagtgattctagattacatggatgccacaatttcaaatgcttttaaggtaagatcatcaacttggaagacaaattatccgcacatggatggaaattttacattccaaacatatattcctaccacttatgatcttggaaaactagtacttgatcgcctctttctgtattttgcaggttctttcagtttcaacgtttataggagcaatattttgctttgctgctttctgtttcaagagcatgtatgcatttttagctctttttgctgttggtgaacttcttgtctttgccacacaggtaatctcgacttccaccattcatatacttcatgttttgcaaatccacctcttctgatttatttcatgatgtttagggtcctgtgaatttcatagttctccattgtgtcaaaccaagtctgagaccacttgcaatggcgatgtctactgtctctatccatatctttggagatgtaccttcctcaccactcgttggagttcttcaggtttggtttctcagctgtatccacaaaattcttgattcagagctctaatgtcttaatcaaattaagcttcagttaaacgcgattattcatctagattagtttgagccatcactgtatccaacttcagaatgttttctcatttactcacgcaggactacgtgaacaattggagagtgacttctcttgttcttacattcgttctctttccagctgctgcaatttggtccataggttaggcttttagccacaccgggatctcaaagttcaaatggttctttttttagtataatgtggtaatgatttgttgtgtttgtgactctacagggattttcctgaatagtgtggatcgatataacgaagattccgagcctgatgcagtaaccagagaatcaaccgctgcgcctcttctccaggaagcatgagacaaaaaaactcaaaaggtcactgtgagaattttatggtttattctcagttctttatctactttcttgtacaaatagaattgtggctgaaacataaacaaatgtcaaattaccttcatttgtatattcttgtttcactgtttgcaaaattatgaaaggaccatccctatttctctacagaaaaaataacttaatagtccattacgacatgaatctcggttctttgagatcataccgggaaatgtttttcaacatcatcattcacaagatagagcttaaggagcatccaaagaaatcgcaacaatcttccaatctagctctccttcatcaatcatagccaaaagcagctaaaggcttaacctttagaacgtcaccaatctcaacaacatcaactacaaataaaaaacacgaatccatattaagctacgctctgagaatgaaacccataaagaagccaaaatcattttacctacctggatcattatctccaaaagcaccatcaaccttagagtttgatcttcccatgtttgtggaaacaatccatagttccagcttatgttgtaactgtacatataaccaaaaaacaagaaaatattatagctactcaataacatgttatatttttgatgttacatgcaaaggtttcgtggtgtagttggttatcacgtcagtctaacacactgaaggtctccggttcgaacccgggcgaagccattgtcaatacttttattttaacgtaatttttacttagcttcacgacgtcgtttacataaaaccgttttcatgtgactcaacaccacgtcacacatcgtttattctcgcgccacatcagtctctacattcttattggctaatactctccacgtcatcatctcttcccgtgaaaacccgccatttaaaaagactccagaaccatccacaaccttcttattccgtcttaacaacaacaaaagaaaaaacactgatccaaatttgggtccttctaattttgcgcaatcaaataccttcaaagcctcaaatttcgttcgttctttgtgataattctctcgcagctttgcaatatataaatctcgagggtttactcttttaaggcctggttttttttggtcaatccaagatg

SEQ ID NO: 32760 - DNA, 117 bp, Unknown; identical to SEQ ID NO: 1168
  misc_feature (1)..( 117): 2750-1469P.txt file - cDNA_ID_3061003; gDNA_ID_1620367; Annot_ID_154861

SEQ ID NO: 32761 - DNA, 3003 bp, Unknown
  misc_feature (1)..( 3003): 2750-1469P.txt file - cDNA_ID_3061044; gDNA_ID_1620369; Annot_ID_154954
ttgtcacatttttaatctggacttatctatataccaatttgataatttcttctgctgtgttctttgtgacagccattcctagaattcaatgaaggaaggaattcagagaccattcaggtcactgttgagtgagttctgaccctaaatccctaatactagcctcatatttgattttcaagaagcttaagaagaaattgttttggcatctaacaattaagcacacatatatgctagtggtcgagaagcatcttataatggaggagggaacgtcagtttcagaggaaaactaaagagaaatgcacatttcacagcaagactattcaaacctcagcttcagctctctgctgccccaatctcaatcttcttttctgtaagttaacgcataagatttgagctcctcctcatctttacaaagtttcaatctttaagttttactcatcatgtaagtctttggactggtgcaggtgaagtcagataaaagatccgagctaagcattctgctccatttttcatctccttcacaagagaaaaagtccatgcttatggtgccaaatgaatctatcaacagatttggcgacatgttcctgccatgtcttctcacatcaaaacagaccacatccggttggacagtacacgaaacaaaccttgttttagatgggcacacactgactgagatatctgccttctgctccagaccagatgatctcacagaagaaacaaacacactagagtattttgcattgcttggacatatctccatcaagagccagcaaaaagccaaggtttatcctctggcgtcatcatgggttatagaggctcatcacgtaaagtttgtaccgggtgattctggctccaagaccttaagttgtaagctagaatggagattgaagcaccctgaagaagattctgtctttccaaagtacaatgtatatgcagagaatctgagttcgagtgagtatagaccaaggaaggttatggaagaaccaagaagcgagaaagtgtttcttggaacagctcatgttgatgcttattatgtctctgaaatggtcgttggatcagatgtgaagggagtccggttcgtggttcaaacctgtggtgaagatggttcatggcaggagttggatgcttcccctaaccttgtggttgaagtagagcgtgtgagttcaaagctttgttgttgtgggttgatttgaattatggttcatttccgaacctgcgatctaataagaccattgatggtttgtttagtcagttcaaggatatgaaccatacgataatgaattaatgattataaggttgataataataacaaaccttttcatgcacagattctttgccttgtggtatatgttggtccttatctgaaagattcaaaggacgacgactagtctcagtttcactctcaacttgttcattccactaaaaccgacaagtcaacacaatgaacataaagaacaaacaaaaatacacatccaatggaggaagaagaacaatttactgctccaaatgaaacataacaaacgagcttagctttctagttttagtaaaagttctgggcaacaaagtaaaaacagagcaggacaaccaaaaaattcataccagaactatagattcgatgataacaaagacgattaacaatgattaaggtttatacatattttagcactcaccagttgaaatctgaaagcgtgaatctagtttttgcctaaggagaggaaaagtaaataataacatagctagcaacatgtctactatttcattttttttttgcgtttctaaaccaatcagaaggctctatttcgtacccactcgcagaaagagcgcgttgagcgagtgagagcgattctgtgggtaaacccctttccaattcatgcctttttgtatcgacgcatttctctccaaattctctatcgcgtgactttttttgtttttttctcaaaaccaattgctaaccggaccaaaatcatttttaatttcaaaaccaaagtaaaccaaaccgaaatcaatttcaatttgcaattctggacaaaaatttctggcagtttgcatgatttcttaacaacttaactcaaaatcacaaactatgaaccgatagaaaaatttacaaaatcacagtaatctttgatcattacaagaagtgtaggaaaggattaaacttttaaattccaaaaatctcagaatcaaggcaaagaagattcctgaagatttttacttccatgacatccaatagaggaagaagaacaaaccattgattcaattaaaacattgcaaacgactgaacgagcttagacttactagttttagtaaattccttggcaacaaagtcaaaacagacatggacaaaaaaaaaaaccaaaaaaagaactgtagattcgataagaacaagcaagatttgtaataattaaggttcataaagattagactcatctgaaagcatgaatcttcgtgttcgccttttagttctaacttacaatttccttcttttatgttctttggtgtgaggtcgaagaaaggagagaaatgactatgagtgagtggtcacgattcgaaatacttctcgatgaacttttcccaagttaaaataatggggtaaactaagaatatttcgattattaagaggttgaagttgtaaattaatttacgacatattaccaaaaatacacagctcattaagttaagctaatctcaacattttaatctctttatttgaatcaattagtttcataacctttttagtaatttcagtacttttattttgtagattaaacggtatcgttagcaagccaactacaaaaacggtgtcgtactagaatgggccgtgagaatgtgagcgactcggcgagattgaagattatacgacgtcgactatttttaacgacagaatcgtaccaattttgaaaaccctaaatctcaatcctcgacgctctctactaagaaactcaatcttactttctctgtaattcgtagcttccgaaatcttttctcaagaatctcataaccatg

SEQ ID NO: 32762 - DNA, 3003 bp, Unknown
  misc_feature (1)..( 3003): 2750-1469P.txt file - cDNA_ID_3061048; gDNA_ID_1620369; Annot_ID_154953
tgatattatggaacgaatggagattctggattttcgaaatcttgaggtacttttcttcaatcaaggatttgttttaagatagatgttgttgaatctatagcttggtgtggttatgttgtctaaacaacttaaaagtttagtttttttacttaaactgaatcgttttgcgtatgtagattcttattctagatgaggcagataggcttttggagatggggttccaaaggcaggtgaattacattatctcacgcttgccaaagcagaggaggactggcctcttttcagctacacaaacagagggcgttgaagagctcgccaaggctgggcttaggaaccctgtgagagttgaagttcgagctaagtcgaagtcggaatcatcccagcaattgacaaactcgaaaaccccttctggtcttcatcttgaggtagcataagttcaatatataattatgtaataatatgtttcagagtagttagttttcctgttgtatccttcgttatcatttagcattactgtgacctgatttacgaaggatttccttctaatttgtaagtatccagtagttatacgattctcttcgtagctctattgtattcccttctcttggtagcaagtttgttgtattgaaaatacctattgatcatatgtgttgcatatgtatatacttctttttagtagaaaccgatgttctatctttacatgtcctaccgatgcgtttcttagcggtttatttctccttgtctctacagtatatggaatgcgaagcagataaaaaatcatcacaactagttgatctcctcatcaagaacagtgataaaaagcttatagtgtaagtttaaatattccacacagacttatataaaatgaagcatccttataaatagtctaagtaacgctgcagattcttcatgacctgtgcttctgttgactactggggactcgtactttcaaaaattcctgccctgaagtccatatctttaattcctatccatggggatatgaagcaggtaaattactatgatagattttaattttccttatcacctcattacctattgctatttaaaggttttgatgaaatatacttaacacatcagaatgcaagagacaaggcattagcttcgtttactaaagcatcaagtggtgcccttctgtgcacagacgttgctgcacgtggacttgatattccaggcattgattatgttgttcaggtagattccaataatgttttgtttacattattatgacatctttgttgcaatatttaagattcagaggttcgaacatgttcatgcagtatgatcccccacaagacccaaatatgttcaaccacagggccggcagaactgcaagattaggaagacaagggagggccattgtgtttttactgcccaaggtttagctttgaccactttatgttctcttgtgcaccccatagttacatcagaaagcatgaaaagctgaaaagttcacttgcatatatgtgtaggaagaagcctatgtagagtttatgcgcataagaagagtccctttggaagagagaaaatgctctgaggacgcatccgatgtcatcccgattgtaagaaaacctccatatctctctctctctgttgcacacaagaagggtcgctctgtctatctgtgtgttaatcacattgtttattactacaatgtgttcagatacgttcagctgccatgaaggaccgagcagtgatggagaagggattaaaggcatttgtttcctttgtccgtgcttataaggagcatcactgctctttcattttcaggttcattcatgaggctcagtcatttttctgtttctcaaaattctttatcgctctatcagttttgtaattgaaaagtttttttttttgttttgggtcttaacttacagatggaaagaccttgagattggaaagttagccatgggatatggcctcttgtatcttccttcaatgtctgaagttaaacaacacagactttccagtgagggtttcacaccagttgaaggtgtcaagtttgaagaaataaaattcaagtaggtttttctaccataatccctaaacatttatgatatatatccgccttctcccattcccttagtttccgagacactaaaaatctgaaacttgatacattcaactcgtctacacgtacaatgaccatttttagatttagaggaaacaagcttttgtagtgtgaagtctttgtacatccgtgtcttcaggaatcatatgctttctgagttgacaagttggcatttctctaaacctgaatgttttgaatcaacgcagggacaaatatcgggagaaacaaagacagcaaaacttacaagtaaggaaagagaaacggcaagaagagaaaaaagagaaaggcaagagaaaaagggttgatgcttctgctagtaatgatcctaagaaagcgtcgagaaagttaacggggaaacaaagacaaactattcaaactgctgaagatgaagaagtgatggatcgagattataagttgatgataaaagtaaagaaagggttaattaaagaagatgaatatgaaagacttacaggagatgatgatttattctgatgagaagaaacaaaacctgcatgctgagattggactaagcttagtgtctttctactctcatatcatatgtgattctgttaatttttttttttttttttgggtgagaattaatatcggatcatgttatgtcctttttcgttctacgagtctcacttttatatatgtttcctaataaatttagcaaataaattgtgaatatatctatagagcaaattcgatcttcataggagagtgtgcacgcttgcacatgctagtaaatgccctccataataataaattaacgactatcaccatcactaaggtatttcatgacacaacaaaaataaaaacaaaaatctctctgtatcatcgtcttcttcgtcttttgccgttgacttgtttgaattttcgcaaatccgtctctatccaacgaagaagtcatg

SEQ ID NO: 32763 - DNA, 3003 bp, Unknown
  misc_feature (1)..( 3003): 2750-1469P.txt file - cDNA_ID_3061052; gDNA_ID_1620369; Annot_ID_154952
tagtgaagaaaaaccagtaagaaactagctaggttaccattaaggccaacatccaatcccttaatgacttttccagcatctgtatgtgtaacagcaagcacataagtatccaagtaccactcacacattaataaagctcttactttcgcatcaagttataataccaacctagacgaaacttataacgtgattttccaacggtggaatcgaaaatcttcccattcccctgaagctttccagtataatggacacttacctgcactcagagacaatagactgacctccaacaaatatttgcacacaaactacaacagtttaggactaaatgctcatacccttttgccaggctcagctttcttgccgttggggtttcccatgcataactcttcaacaatgaggccatctaggtcaggcgtttgcttctcaacactaatagaaaaggctttactctccactgtagcttcctcacttatcttctcattcttcttagcagattcagatggggacatggagctttcactcctgcaataatatcaaaagaaaaaagcatagaaatttataagatgggaaagaatttgaaagaaccatttacttgtgagctaataatatcgaataccaataacaaatgtactaactgatatatcccaaatgacatgactacttttgattaccccaaaaagaacaaagtacttaaggcagaagaatggactgaagtcaagtagccaaaggaaacctcaagctgacttctattcattgttttgaaaagagtatgccggaggatcttatatatgaaggaatttagttaaaaccatttcaataagaaaagctaaattttacagtaatatttgaattgtggttataggatacaaaagtgactggagaaggatagaaaagttaatttacctgctttttggaatggctgcatccatggcagaaggatcttggagaggaggaataggtttactgaaattgacgcggcggcgaatgaggcgtataggtatttccggtttggcagtcacccaatacagctaatttgcgtcctcgcatgtagctcccattaagttgagtcacggtatcagctacgtcttttccgtgaacaacagctctaactgagctgaaaaatgatcaacaaaatacacaagtctctagtcgttaaagagtaataattttaaataaattgaaagttgggtaacatgggagaaagaagcctcaaacctctctttgacaaaatggaggcgtatgatatttccatatggagagaaaagtttaaccaaagccctcgagatttgactcttcctaagcgaagtatcatatccttcaactcttacaataaccttactgcagtaataggatattgccggagatgataaacattattattatcaacaaatcttatttttttaagaaatcagtgtttactcgtttgcgtgtgccggatacggataagcctcaacagagacattccatcctcccacgttaacttgagctgatgagttggaaagaaatggaggaggaagaagccaccaaaacctgttgagaatcgtattagtctcatcaaattttaagggaatataaatctcccagatctctccacatgaagagaaatgttctgccaacgccgtgtagagatcatcaagcggaagaccagtgtcatatcccgtaaccttaatcctcccaacgtcactgcaataataataatactatcaacgtgacatctgaaaacatgcatcaccttacacataccaaattctcaatttacctcagttttggaatgttattccgtttcgctccctaaaaagtacaggagatcaaatcagaaacacttgcactgctaactaacttgcaagtacttttcttacaaacttgtgaagaaaccatcaattgagaaacaaagataagaaaccagagtgaatcagaaaagccataagagtagagtaccatggtggatgagaacatggctaaaatttgttcgacaagagcgagactcgataacccttttaacagatttaatttaggtctgaagagggcatttatagttgtttttttctttttattttgggccttgaattagttagccccatatggttcctattaagtatcttagagcatctccaacgggagaaaaatggagctctcatgacagtctctctaaattattgtggaaaaaaataaatcataaaggtttaatactgagagaatcgtttctcttaagagagattttggagctgaagagagacgcatacgtgtcgttgtttttcagtatttcttttttttttccgttttttttctctactatcatcttttcactgggactttgaggatcattggacttacctgaaacgagctggccgacgttgatttcggtaggcttatcggctctgagattcatggattccatactttgcaaggtttgttcttctaatcttatcgttcgtcttgattcatagaactgtttttgtttgttcttaaattcgattgtctctcggttttcattgtcctattgtttttcttttattttgtctgtctgggttttggacttttactctcgattgctctttgattctcgtagctattgaactagaatttgcaaaaggttgtggaatttgaggttctaattgtgattttaatgtggtgatttggaaaagaatttagggacattttaggttgattaagggatcttggctttgatttgagatacccatctaacgtgaagaagctagtgaagtatatttcaaccccacctgtggtaaagtctaatctttgtgtttcgatagtttcctttacggtgttttgtatctgactaatatcacttttgatggctaatagagagagcttcaggggataatccatttgggtgggtatttttctggctgtaccacttgcagtttctcaaaagtgagtgaaggaactcattttggttgattatactctgagtgaaggaactcattttcgttggttctgctcttctaagtgaagagggcttacaagcttggaaaggtgatg

SEQ ID NO: 32764 - DNA, 3000 bp, Unknown; identical to SEQ ID NO: 1188
  misc_feature (1)..( 3000): 2750-1469P.txt file - cDNA_ID_3061056; gDNA_ID_1620369; Annot_ID_154940

SEQ ID NO: 32765 - DNA, 3000 bp, Unknown
  misc_feature (1)..( 3000): 2750-1469P.txt file - cDNA_ID_3061064; gDNA_ID_1620370; Annot_ID_154980
ataactttttaaaatatatagagccgaataaggatcttattacagtgtatattcctgcacaatcttttgaatgtacaatacataattgttcaatgatgtctacatatataggtcaaaaatatacttttagggaattttgagaatattgataaaatttaaaatgcacacgagtaaaaattattattttaacgatttttcttaataatagataaaatccatatataattgtaaattatttttcttttaccgaataaaaaatcaactaaaatacatagacaaacataaaccattttaaatgtatccctctttttttttggacgaaaaaggcaaatcattgtaaatttactttataaagaagccgttttatctatagtagaaaaccaagaaatagattaaaaaaaaaaacattagaaagaaatggttttattaatggtgtgatcatacaaaaagaaatggttttattaatcttatttgcaaaatggtgtgatcatactcaaacgtcatttaaaagctttcatgctcacactctctctccctctctctctttatcatctttcaacacaataagcatatcaacaagcttaaataaaagagaatgatctgtgtcaaagtgtttcaaaaactaggttaatctccaaacatacattcacttctcaaaatgtagaacataacatgacttgaaacgttttcacacacacacacaagtattgacatttgatgtttgtttctttcacgaggagaatctgtcgcgatcatgaggcgaagagtagtcgatattggggccgtgagggatgatcccgaatgggtttatcgtagggtggcttccgtagtaatgttgcttaatgtgttccatgtttacggtgctactcatgccgtgtatttggtaaatgtcttttatgtagttgaagatattcgggtactcccgtaagagtctcttgttgcatttgaagtgaactgcataaacctggaacgcagaaaaagatgatgtcaagaacctgatggattttctatttggaaacaaagaagacaagttgactcatatacctcatcaaatcttatgagagtgacgaataatcggatatctgcttcagtgaaagtgtttccgcagatgtatcgttgttttccgagtacttcctcacatctatctactgcttcatataactggttcactgcctggagagaaaagggatcaatttttgaatccctgttcaaatgtttaagacattgagggatatatacctcattatagggttcttgtttccttgcaaacccacatttataaacaccgttgtttattccgttgaaaacccatccgttagtctcgttgattacgtctctgagatgagaaggataaaggtcaagtgacggggttttcgcaataccattgaactcagtgttgaacatccggattatctctgaactctcattgttaacaacagtcttaagcttcttatcccaaagaacctaacataataacaaaacaaacattcaagaaacaggacaaagaaagattaaagagttcaccaaagagatcaaaacttacaggaacagtgtacttcccttcatagtttgggctagcaatctcgtagagttctctcacacttttggcaccattaagatagtcaggctcagctccagggagctcggtatccgaatccgggaaaacccatcctctatgatcatcagtttccttggttcttccccaaatggcatgaaccgactaatcaaatcaaataaaacagaaatgcttcaggttaacaaagtcttctaattcgatatgagcaatgaatttgtactaaccgagaaggtgattgcttcatcaagtcctttgatctttaagtaagaaagacatctacaagcccatggacaagcataagatatgtaaagatggtatcttcctgattcagctggaaactgagaatcaggatcttgtgaaacaaagttgcggaatgttgatgctgttcttacaaaagctccagattctgatgtctcatcaaccccagacctagccattttgctactaataaaaaatcaaacacgaaaattcacatgacaaacgaaaagaataaaaatttcagaatgcacaatttttctttttcacctcaatagagtgagtaaagttgaaaactttgagagatttcttatagatggtcacttgtcacataatcaatctcaattttctctaggtaaaggatcacaggaaacgaatcaaagcatcaaaaagttcagaaatttcgagtagggttttacttaattatctcattagagctagaaaaaggttaaaataaaatgttcataattcatagccttcaaatatgattttcaacatttatggatcattgggccaaaatcaaacccagaactcagaaaatgtctaacaagaacatgattcatgcagagaagaagataagagacaaaacctgttgacgacgatgttatgtatttggcgtcgaatgtcgctgttttgtggcgataaggttaaagaagaaaaagtgagctttaaggaaaaatggtaatgagggatgtcatcttatagtgaaagagaaggaatccgaaaaaggactttgctttgtcttcactgctctgtcacgcctagcgagttaactcagactaacgagttgactcagctgggttctgtggggaaagcgtgacaacttttggaccggtttgtatgtcatggatttggtcaagacgaatgcgactattggaccggtctaaaacagcttcttttaaacctcaatcggatatttttaatattgggtcggattcggtatgaatcatataagattcgggtcggattcggtatgaatcatataagattcgggtcggttattggaaattggtaattttccccttcttcaagttagacccaaaacgaaaaaaaggttcgtttaaagagctctggttgggtttaacttggaggaattaatcgagtttggtgatcttcttcttaggtttttttctcgatctggttgatttgcttaaacatctgtaactatg

SEQ ID NO: 32766 - DNA, 3003 bp, Unknown
  misc_feature (1)..( 3003): 2750-1469P.txt file - cDNA_ID_3061070; gDNA_ID_1620370; Annot_ID_154982
tatatatccctcaatgtcttaaacatttgaacagggattcaaaaattgatcccttttctctccaggcagtgaaccagttatatgaagcagtagatagatgtgaggaagtactcggaaaacaacgatacatctgcggaaacactttcactgaagcagatatccgattattcgtcactctcataagatttgatgaggtatatgagtcaacttgtcttctttgtttccaaatagaaaatccatcaggttcttgacatcatctttttctgcgttccaggtttatgcagttcacttcaaatgcaacaagagactcttacgggagtacccgaatatcttcaactacataaaagacatttaccaaatacacggcatgagtagcaccgtaaacatggaacacattaagcaacattactacggaagccaccctacgataaacccattcgggatcatccctcacggccccaatatcgactactcttcgcctcatgatcgcgacagattctcctcgtgaaagaaacaaacatcaaatgtcaatacttgtgtgtgtgtgtgaaaacgtttcaagtcatgttatgttctacattttgagaagtgaatgtatgtttggagattaacctagtttttgaaacactttgacacagatcattctcttttatttaagcttgttgatatgcttattgtgttgaaagatgataaagagagagagggagagagagtgtgagcatgaaagcttttaaatgacgtttgagtatgatcacaccattttgcaaataagattaataaaaccatttctttttgtatgatcacaccattaataaaaccatttctttctaatgtttttttttttaatctatttcttggttttctactatagataaaacggcttctttataaagtaaatttacaatgatttgcctttttcgtccaaaaaaaaagagggatacatttaaaatggtttatgtttgtctatgtattttagttgattttttattcggtaaaagaaaaataatttacaattatatatggattttatctattattaagaaaaatcgttaaaataataatttttactcgtgtgcattttaaattttatcaatattctcaaaattccctaaaagtatatttttgacctatatatgtagacatcattgaacaattatgtattgtacattcaaaagattgtgcaggaatatacactgtaataagatccttattcggctctatatattttaaaaagttatttatcccttattttttcacaattatttatatattacttaaactatgtaaatatctaatgaactaaataatagggaatcttgcaaaatctgtcatatttcactctatttctttcaatttctgtcatattctaaaacttttttcaaaatctgctacattttggtccacgtggaattcagtggacgaaattacccttaaggtgggtcagcgctctgacgaagatggtgacataacaacttttggccgatgtgatgatataagacgaaaaatcatggtggaagcataaaggattaggggacagaatagtggagaacagctggcttctactgttgttattgggtatttaaaaatgacttgtttaaacaaattggttatccaaaattctgcgggggacaacgtaatatataatacattaggagacatgattacctgatatcgggggacaacgtaatatataatgcattaggagacatgattacctgttagcagagaacaattggagcaagacttttgttttagtctccagatcttgtccccgaatagaaattctctgttgcatctacgttttgtcctcgatttcatcatcttgctctattattatgaatcatacatcttatatgcaattgttctcatttaagaattttgaattttatttagattttcgccatctattttggtccacagattagttgagcgttattgttttcacagagatgctgaaaccatctatttttcgccatcttatatgataattttgaaagatgataaaatcggggacaagatctagatacaacagataatttatgatgaataaaattgggaaacaaatttaattgaaagttatatatagagaatatgtgcaggttgtcaggggaagtgatagaaagacaaaagcttttcgttttgtctttggaaaaataatggtgtatggtcaaaatgcacggatttcgaggaaatagagataaaatatagaagaaatggtgaggataaaattgacatttcccatctaaatgtggcatgagttgtaagacctagaaaaataatgacacattatataaggattttaaaaaatatggcataggatataatttttcctaaataatataccaacaaacaataatgttattaaaactaaataaaaagtaaaaatacatttggcaaacaaaagcgtgtcgctgtttcctccgattatggttttgagaaaaaaagaaagaaaaaacaaagtcttcgtcgtccactctcaagctcaacaaagttcttgggtcctcctctctattattaccacttcttcaccaatccttttcgaagagttttgtattcacgacatgagaaagatcccaacactactgatcggttagtacttctttcttctctgtctaataagcccccaaatttcccaagatttttcttttgattttgattagtaactccattgtttcactcaatttctttagctcttttcatgtttccttttctgggtttatcacaattttcaatcttgctcattattttccaataaagctctaacctttaagatacataagctaatttgtgttcttgagactttggtattagtccctctggtttgatgattattttcttaatgttgcttgcttcagtctgtttatatttagattaagtttatttgatgagctctcttcttgtttatgtactttcaaattttagtctttttaaaactaatgtacatgattcagttttagtataggttggtgattgtgtatcttcattagtagaaggttaaagatg

SEQ ID NO: 32767 - DNA, 3000 bp, Unknown; identical to SEQ ID NO: 1193
  misc_feature (1)..( 3000): 2750-1469P.txt file - cDNA_ID_3061081; gDNA_ID_1620370; Annot_ID_154973

SEQ ID NO: 32768 - DNA, 3003 bp, Unknown
  misc_feature (1)..( 3003): 2750-1469P.txt file - cDNA_ID_3061089; gDNA_ID_1620371; Annot_ID_154997
aagttttaacttctaaattggttcttaactttatcactttctctcctttgatgttattgtttaaatcctcttcaccttcacgctttctaaaccatattaacatataatcacgttagattatctagcattgaaatttagcaaattttgttttctattttcttatttccatatgttacttttgaaaaattaacaaactttttttcttttttctttttattcataaatataataaaaataataaaaaaatatagaaattaaaaagttaattaaagtcatggctaaaaaatgtaaaccaatgagatggttaatcctgattggtcgtttaaaaacttatgtggacgcttttagaagcgaatagcctcaacttttatatagtatagataaataccttgcttatattcctatattcttgaacatattaagagtttataataccttgcttttaatcttgtgagctgattaatttatgtgatgattttaactatagtatatttgatagtatgatattgaaaaattaaatccgccatcatagtcgttcaatgttcgagcagaaggctgacctattgacaaaggctctcgggcgaatcaagtttaaagaaatgagggagctcattggtgtgaaggacatgggacaaggtgacttcaagtttaggagggagaatgttggattaagcttgaagaaagctgatgaagaaagtaatattaaaccgagttatggtttagttcctaaccgagttatggtttagaaagtgatcatctcaaatctctttaggagttatctaaatctatgttttcctattaggattaggactaatgctttcatataaatagatgtgtcgagttctaatatcaatgtgagagttgtattaagagattgagagagaaagcttaagttttgtgtaagtttcttaagctataaagtgagttatacttttatattcttgagttcttaaacaacaaccaaacctagattctataaactgagagtaatcaggcgttgaaaaaataaagactactggaataagagcaaagatattcaaacatcaatgtgtggtttaagtttgaaaactaccctctttcttttcatagtaaattgaaatttctaaccaaaacgaaaaaaaacacacacacaaaaaaaaaatcagagccaagagactaccaataatcaatatccaacacatttcacatcaactcgttcattcaatcttttgataaaatccctcccatgttacccaaaacacaattcaaaagatataaatcaccaaaaaaatatcgatattgattcgtagaacaacaaaataactatacacgtatagcatcaacatcaagtgaaaaatctagcatggtaagaaattcgactcatacaaagaaccaaagcaatataaaacaaaccataatatcagaactatatatttaataaaaagtccttttgatatggtgtgaccgagacttgtatttatagctaaatgtttaggacaaaccatcggaagttttactttttaattttttttatacaaatatttgtatataaaaaacaatttaacatatatttgtatacttggacgatttaacatttcattgtattaggaatataatagttactcctcaaaaccatattaacatgtaatcacgtgaaataatctagcaattaaatttagcaaattttcttttcaactttcttatttccatatgtaacttttgaaaagttaacaatttttttttgttttttctttttaatcataaatatagtaaaaataatagaaaataatatagaatttaaaaagttaattaaagtgatggctaaaaaatgtaaaccaatgagatggttaatcctgattggtcgtttaaagctcacgtggacgcctttataagcaaatagcctcaacttttatatactatagattgcataattcttcttgtgataatattattgatcttttctacaataatacaatttgttgtcttgtcttcattgtttagtccacataacaaattagggccgagcattgggatatgcgagttgggtttgggtaaaagccgattaggtacggattctttgggtagaagagtttagaactcaatatattaaataaaaaatatatgttcggttttggttcgggtcctttcaggtttaggtcgctttgtatatagatttcagaacaacttaataaattatcggataaatacccatattttcgggtaaatactcgcatttcagagtaaaagtttgggtattcaagtaaaatattaagatatttttgggttcagattttcgagtataggagtttaggatccaataaaataaatctaaatttttattgtgtttagaatctaattttttgggttggttcggttcagatattctgatccaatttttttccccagccctagaacaaatcataagtgcataacgataatgagcagtaaggtacttagtagtttgcatatatggacgaaagatattatttgtatcaagtgtggtacaactatgggcccacgaatattcagtatccagttttgtacaagcccatgtgatccttgcaggccaattgacaattttaaatatatttatagcaacaatacaaatatatatttttcagtcaaatttgaaaattgcaaccgaaactagagagcagagtagagatcaacaactggatcaaaattttgaatttttataaaatctatagaattaagaatatataatatgttaaaactgaatttactccaaacctatattgtacaaagctgattagaattagtaatcattttagttccacatttctagcttttacgaggctattcggggcaactataactggccctatttggctcatcagtggcccattaaagatatatatgagttacattcataattttaaggaaaagaaatagttggtgtatgctcctcgtaatatcatcttatctataacaactacaagaagcttacattgctgctactaaaatacaaaattgttggaagtcatttttcaagatatcaaaatg

SEQ ID NO: 32769 - DNA, 3003 bp, Unknown
  misc_feature (1)..( 3003): 2750-1469P.txt file - cDNA_ID_3061124; gDNA_ID_1620371; Annot_ID_154998
agaattaagaatatataatatgttaaaactgaatttactccaaacctatattgtacaaagctgattagaattagtaatcattttagttccacatttctagcttttacgaggctattcggggcaactataactggccctatttggctcatcagtggcccattaaagatatatatgagttacattcataattttaaggaaaagaaatagttggtgtatgctcctcgtaatatcatcttatctataacaactacaagaagcttacattgctgctactaaaatacaaaattgttggaagtcatttttcaagatatcaaaatggagtgttcgctgcagaaacagcttttcaacaacggagataagctctttagttgtaagctctaacactttcctccctcatattcacatctattagtgcaaatcaagaataacttaaaccaatccattacaattcttccatttctttgctttcagctcgacataaccgacgggtttcgatagaacaagtccatgtgacagattctctttccgtaaactcgataaacctgtttcataaacctatatgttatccaatatcatccatcatcacttcaagaaagagcaaaagccattttagtgtaagtgttggttaattgcaattttgtagaatattttgtaagttgataacatttaaaagattatgttgcataatttttggaaatttgtgatttcagtcattttgcaatcccggaaattaaattactgaactcatgaggttaaaggttaacttagtatgatttaacaaatgtctagttaatgtgattatataatataggtttgtgcaacaaggagaagaagggtgcattcgaactcggatacatacgtactgttagaggcaggacaagatgagcagtttgtgacggaagacgaactcaaggctaagctcagagggtggctcgaaaattggccggtgaactctttgccaccagacctggctaggttcgatgaccttgatgaagccgtagatttcttggttaaagctgtatgtgaactagaaattgatggagaagtgggttctgttcaatggtaccaagttcgtcttgagtaattaaataaacgtattatgtgttttgaatgtaacaagcacatctgtttaatctagtagtttggtttgttctttaatagataattgctattgttgtggatgtcaaaatcttgtgtgttggttttaataatcgtcaaagagaattagggtcatagctttcgtaaataagaagacactactcgaactaaacaatatgcgagtttgattctttcatctttgatagtcggcactaaatatccaaataaaaataaagattttttagtctcacctttaaatttgaaatttggttttgtgatttgaatctcttcttttttttcgtcaaacatcattttattaagttagcggacggaggttttcttctaaagagagtcaatccagagtcgatgtgcttacatggagaaaaaagattctcgtactctgaccttcttagctagacaatcgacacaaatattgttacaacgaggaatcttttgtgcttaattagctggtgcgaaattgatagcttatcttccaatttcccttgctttgggggatacatattctaccttgtggaacttatgacacttaatgggcttcgtattggattggatttgtgaaaaattgacattgcatttgcccgttagttcttcaggcgggatggtctactagtactagaagaacgaattgtagatgtagattctgtaatagttggctgttgggataaacaaaaactgcatccgatcacatcagaagactgagctgcatataactgtgatttttatgtaaataatcttacaaaagttttaataacattaaaattcttatattgtttattttgggggacaaaattgtgttttaaaaaattactttatatattagttaatcttatcgaaatcttagttctgattttttcagttcctcatgtaatattttaaataattacctaatttaactaacatattcataattatcaaattaattgattaaatcatagtatataattttgaatggggtttagtgttgttaatgcatttgattgtgtttatatatataaatctcagaaagatttatgcacccaataagtgtaggttaattttatagtaaaaaatgaagtcaattttatagttaagatgatcaataatatagaaacttttaaaataaaataataagatttgcaccaatagcgtgagagagaaactcaactttgatatattatgacttaataaatgacgttaattcttatgtaaattaagttataacatatacaaggattcataagtggtcaaactgcaattaaagtattttttaaaaaatgtagcaaactaaaaataaactattgtattttgagaagacatgtggcagaagtacaatatgcacatttatatgtcattctagaagaaactttattttataagattaataactgattaaataacaatttaccatgtaaatgtaatgatacagtgattaagtaagattctactacgcaaaggtaaccttatttaacacacgttaattactgtttggaagatattatggacggagagaaacaaaaaaatgttattagttgtggctctacgttttttttgtctttaagccttaaaaattagaaagcgtgtaaattgtcagaaaacttgtgtggtcatttcaaaacaaaacaacaaaaggtagtaaataaaaataacaagatcgtaatgaatgagcttggtataaaaacaagaaaaaaataacgaagttgggggtagttgcgttgcactttgatttaaattctattcaaatggttattgtccaaacataacactcttttctatatataggtagtctcttcaatgtcacaaataatcgaatcacacaatattaaacactaaattattcacagttttcttggagaaaagattcaagtacaagtacaagcagagaaagtgagagagagagaaatgatg

SEQ ID NO: 32770 - DNA, 3000 bp, Unknown
  misc_feature (1)..( 3000): 2750-1469P.txt file - cDNA_ID_3061128; gDNA_ID_1620371; Annot_ID_154990
tgatttctgtctctcgtgacgttgttttccgggaaacagaattcccttttccagcctctgtttttgactccacgccagactcgcagctctcaccctccaacgcagatcagtcattttttttaccatcagaattacaagctcctacaccggtcagtattactacaactctggaattaacacagtcatcgtcctctaccaatctcaacgatgataattttcatattccctccgacgaatcaagctctgttaatgagatgtctgacaatgaggatttgaattctccaactaccaatgaatcatctccgttcttgtcaccggcatcaccgtctctgcctttatcaccggcatcactgtctctacctctatcaccggcagcaccctctccgtctctgccaaaaatagcagaaccagaacctgaacctgaactacttggaaaaggaaaacgcaagaaaacacaacctgtgaggcttgcggattatgccactacattacttcaccaaccacacccgtcagtgactccatacccactggacaactatgtatcaagctctcaattctctgctgcttatcaagcttatgtttttgccatatctttgggtattgaaccaaagagctacaaggaagcgattcttgatgagaattggcgttgtgcagtgtctgatgagattgtctctcttgaaaatcttggtacatggacagtagaagacctacctcctggtaagaaagcattgggctgcaaatgggtgtttagactaaaatacaaatcggatggtacgcttgaaagacataaagcacgtttggtggttctcggtaataaacaaaccgaaggcattgactactccgaaacgttcgctcctgtcgcaaaaatggtcaccgttcgtgcttttcttcaacaagtagcatcattagactgggaagttcaccaaatggacgttcacaacgcatttctacacggtgatcttgatgaagaagtttacatcaaatttcctccgggttttggtagtgatgataatcgtaaagtgtgtcgcctgcgcaaagctttgtatggattaaaacaagctcctcgatgttggttcgccaaacttactactgctttgaatgattacgggttcatacaagacatctctgattattcgttatttaccatggagagaaacggcatccgtttacatattcttgtctatgttgatgacttgatcatcacaggctcttctctcgatgtcatcactaagtttaaagggtatttaagctcatgtttctacatgaaggatcttggtattttgcgatacttcttgggaatcgaggttgctaggagtcccgccgggatttacttgtgtcagcgtaagtacgccattgatattatcacagaaacgggtttgcttggagtctggcctgcatcacatcctttggaacagaaccataagcttgctttagcttttggtgacacgatctcggatccttctcggtatcgtcgtcttgttggcagacttatatacctcggcaccacacgtcctgagttgtcttatgcaattcacatgctttcccaattcatgagtgatcctaaagccgatcatatggaagctgctctcagggtcgttcgttatctaaaatcaagtccaggtcaaggtattcttttacgctcaaatacacctttggtactcattggttggtgtgactcaggttttgattcttgtccgattacacaaaggtctctaacgggttggtttattcaactgggaggctctccgatctcttggaaaaccaagaaacatgatgtggtttctagatcctcagctgaagcagagtatcgtgctatggccgacaccgttagcgagcttctttggctgcgggctcttcttccagctttaggtatctcgtgtaatgaacccatcatgttgtattctgatagtctttcggctattagtctagctgccaatcctgtttatcatgcacgtacaaagcatgttggtcgcgacgtacacttcgttcgtgatgaaattatacgaggtaccattgccaccaaacacgtctccacgacatctcaactagcagacattatgactaaagcattgggtcgtcgtgagtttgacgcttttcttctcaagctgggtatttgtaatctccatactccagcttgcgggggggggggggggggggtattgggctatgaggcctctcccgagcccacttagattgtatagctacactaggttaaatcatgttgttgtatataaggcattgcctctcttacgtatcaacttgaaacgtctttttacatcttcatctcctttttgacaagatatatcaagcaaacatgaaataaattcgtaatattgctatgctatatgctctactcatcgcttgatattgctatgctaaatctgtcagaaatatgtcaaaatatctcatatatatgcttgactttattattagttagaaacattattttttgtaattaaaggttgctatctttgaaaataaatgaagttattaattgttcattaacaagtaaataataactttatttagtgataaacaactaataaaaaatgttatgaatagtgaggtgcatttacaatacgtaggatggaatttacgtatttaccattaaactgctacactactctaattttttttcttaagaaaaagatagtactagaaattattaccacacacatatattctaccagacttgaaactagaaggtgcatgatacaaagaaaacaatattacaaatcaataaactgcaagctctggtcattgaattgtgtaaaatccaattttaataaaagattgattatcgatagactggttaaacgtttttgaactgccactttgaaacatgtgagttacaaaatgtatatgaataacttggaccacgtcaaatatgacaccggcctttttcctataaatactgagctcgaatgcttcctcattcacaaacaacacactacatatctagaaagcattagaacaaaaaaaaacctttgtttgaaaatg

SEQ ID NO: 32771 - DNA, 3000 bp, Unknown
  misc_feature (1)..( 3000): 2750-1469P.txt file - cDNA_ID_3061142; gDNA_ID_1620372; Annot_ID_155033
agactcatgatgtaactaagcaaatagagatttaggatggaactaaacaaagggttccgttccaagataaaactagtgaccattaccaatgatgaccatggtaataatataggagaagaaaagaaaagactcagttccaaactacggtactaatctagtttttggggtggcataaggtaattgcttttgaatgatgtaggcatcacatcagtaatgatggtggaatcatccagatcgaaaaagccgccttcgtcacagtcaaagagtatgacattgttagggcacagtccgggaaaagagctagcaaggacacaaaaaggttcagactttgaaagaaaaatgcagagatctccaatatcttgagtgtaaaccgcgtttccttgttcgtcaagcttgaacaccattaaagcttgtgttttcatttgcgcaatacccttgatgatcttgcttgaagacttcttgtaccacttaaccaagaaagtttcaccagctggtgactcaaccaagtgctcgctcttgcaacatgaatccagtagcttctgtttggtctttgtcagcttgggaaggttttgaaactgcaagctctgcaaattatgcttgtgtgtgcggagatcccatgttccaatgaggtgtcctccagatccgggaatgcaaaacatgttatctttcttggagtacatgacacgagataagtagaaacaagggttttcgattctgatgttgatccactcggagttactttgagccggtctgcaaaagctgagctgaggtcccaaaaacttgacagccacaacacagtcttcatcctcaggagaagatgcggacaatgacacattggtaacgatttgagtttggcaatgagggagagttacaagaggaggcaggggaatgcgtttcgggttagtatccgatgcaaccgggtttagatcgtcttggagacgcagtagtccgtcgtcctgactcaaagtagctatccagccatgggatgaaccgatggttacaagttcattatcatacaacaacgccataggcaccttcttatccaaagaagtgcattcatcttcataaggattcaaaatcacgagttttccctctttcgcaagtcttccacaacgtttagcgctgacgacgaaacaaggaggagtttgcagcaaagaagatgataagccatcattagagagaagaggagatgatctcaccaacacaggtttcctccgaaagcatagtagcttcaagggttggttgagaagcagcgccattgataagaagtgttttaggggaaagcgaggctgcaagagaatcaaataagaaagagtaaacaaaacaaaaccctagttgttgagatgttcacataaataaccaccaagatccgatacaatcttaattggatatcattttaattaaccacgttcaaaccttattatatgaagtttgtttcttcgaatatattttccatatacttgatttaattataaatacttatttacataacaatacatactccagaatcaatatcctcaaattttagaaaaacaatgtgagatgtacatgattgagataaagcttgaagctaagtctgattaagaagaaattaaagtttgcaaaatgtggggaagtctctatacgtgtcagagggtttgagatctgagaatacttgaagagaggctatggagagtaattcgagaagcaaaaataagcagtcgtctatttactatatgagaaaaatcttccttctagatgtgcaaatatcctcctgaaaagttggtcctcgcactgataacaaagagagatggctatgatgatcatatatttccaagctcatcccatcataatcgcgacgtcacatcccctaaaaagcatattaattgccaaagttggtagcataactctcttctaatggcgacttaaaatggaaatatactaagtggatctatatattttcaaaattggaaagtatatatatgtggatgaagttagagaagttagaaatttcaaaaggctttgggattatatttgtgataactcccgatgatattccacatacagataagtaaaggtgctacttagaccaaaccgattatgaggtttagagccagcgagagaccacttctcattagactacaaaacttttttaggtttattcacacacaatgtattatagttcctaatgtatacctattaaattagagtttgtcgaatgttaggattatagttcgtattgacaaacaaatatcagtttgaaaaattaggaatctaagagataataatataattatttttttgggtttaaattgaaatttgtgttggttggaacattcgttgactcatcgtcacatcaaataaaaatcttagcaaataaaatatgtcccataaacatcacataaataaacaaagaaattggaatcaatacaacaaccactccaaagtggatacagacataacaggtgatgagatggccatgtgatttattttccacccgcaacactctaatgcttatatatgaccaatcaaaaaaaccacttaaaccgccaaataaaccgaccttatttttgataaatcaaaacccacttagtcacaaattaaccaattttatatgattacactttcacaaatattcatgtgtagatttctttgaaaattttcaggtgctgcaatcacgagtgaccgaattatttttgaaaatttaaaccgaaatgaaattaaaccgaaccatattcaattttgaaaatgaaatctaaaaccggattaataaaccagtaccataatctgaacggtccaaaaagtattgacccatctctctctcttggtcgctcgttctcaaagggcaaagaaaaaaggatttttaattttcggagaggaagaagaagagagagatattgaagagcgctgaaggcggaaaagactattttgacctcgtcgtctccgtagatcatttttcttcagctcttcttcttcctctttctccgattctccttcttttgattttatctatccgccatg

SEQ ID NO: 32772 - DNA, 3003 bp, Unknown
  misc_feature (1)..( 3003): 2750-1469P.txt file - cDNA_ID_3061146; gDNA_ID_1620372; Annot_ID_155031
gataatatgatcgttattattattatttaatcagggagcttcaacttcaagtcaaaatctagtaaataaccaaaagaaagaaaatatacgtctagtagaaaaaattaacaatgattaacaattaaaaatcaatttatgacctaaaaccacgtacgtgtaggatgatgacaactagagctacactagactagactaagattatttggttatttaaaaattcttgtagatgattggttatccaaaagttttaacttttcatgaatcagtataaactttgattccgctggcgagtcttatcactctatcaaacacattgttatgtagactatagttgattgttaatacataatttaatttcaatcaaaattaacaatgattagagtgtaaatcttttatcaagcaaaattaaaaatacaatgattagttcacgtcaatactcgccgatctcaagggtatgcaaatattgcgcaattaatataaaatgatcttggtgcgggtaataattctacacacacacacccgtaagtattttcataagatcatttcataaacacaatattgaatttttttaaaacatgtctacattcaatgtttacttttgatttggagtattattttcgttaagttaaagtagactacttttgatgtttgcggtccaattcattaaaaaagacaatgatgagatgtgtttgcttaaggtacgtgattatgaatgtacataataatgctcgtgatttttaatgtggcatgtacaaatttgcatcttcttattatcagccttcttacgtccaaacacattaaagatcactatattatgcttgtgttgtaatacattcaatagttgtctatttataacatcagcggctgtaaattgtaatcggcaattgagttactaccacttcgctaaagttattgttctgatcataacaatattttcatttttaatttcgattggtaattttttttttttttttttaacctgagtgaccaaaactcagattaaccttccaaacttcgttaaaaaaaaaaaaaaaaaaacttccaaaattcatagaaatttggatttttatttgaaaacattgactactagtctaaaatgtttgaattagcagtacaaaatgctctaaatttatttaaaaaggacattcaactttttttttttaaatcactggaccactactgattaatttccatcgctatatagatgccttttttattattactaagaaattttttaaactagaacattttcttaccaactaccgatgacaacaaatagatatgcatctttttataagcgcatttcgatatttatgcaaggcaagttaaactttaaaaaaaaatattttaacagaaaagtcaaactcctaatctttttttctactccttaacccctttaaaatttatatacccctacttaattaaatggccatatacaatacaaaatattacaccaaatcaaacttttttatatattcaaatttcaataatgtaagatttctctagttctaactatagacaattatatactttttgtttattttccttaaaaatgtagacatgcaatgcgaggagttaaatgctttgcatcattgagcatgatggaaagggtaatatcttaatttattaaaatttctgacatatccacaagggaatgtccccatttacactcatgtctcttcatgtctatcccaattcgtttgtcctaaagtctctgacattcttcttcttttaccttttctcttaaaaaaacatgcttctgtcttttttcttgttttgtggttgtagtggcgcttgtattcgaagtacgagagaaaacgtaattcgccagttcgcctaattatcaaatttatcagtttgggtttaaactttgaattgttctggacttgttgtaaccgcatatgtgatatatgtgcatagaggacacatcaacaggacttgaatcaacgtcttaaagattgatctactacgctaattaacagagaaaacgacgaaaaatgtttgaaattttagttttatcacacagttaaagttatcagtaatattcccaagcagaccaatcatttcaaagagtgaatggttccaaaataaaatcatattctaactggaattatggattaagttatatatacgcatcatcatatgctcattaaaattttggtaaagctattatcgcatgcgagttcaagattttagcgatagttacgttgctagctcaataaaaagaaattcgttggatctttatatcaaataaatcacgattattgaactttatgaattgaagcaacgtctgaataaggaagaaacatgtaattgtagtctataccgttccatttaaataatttaaatgttggataagatactttctttaaatccatatgcatatcttaaaattgtccccacgaaccggtgtcgaccacaacttttgattttaatacgtgtgagtgaatgttggctagaaagtataaaacctaaaagtgggccaaagtatcttttacaaaattgggtttgttgaaaagtttggtaaaatcaagctaaatataagatgacaactgagtttatgcttttaaaatttcacactactcattagcccactcaacattactcattgtgcgatgtgatattaattacaatcagtagtcaaatttaaccccccaaaaaaatatcaacgcattttctaatttcttcttatttttggtagtttaatgggcttgtaaacataagcttagtaccatgtaaacaaccacaattatgctaaagattgttgctgatcgattagccctactattctaaatctttgtatatacacaatttgttggttatcagattggatccatagtgactttgtacactccaatcattaatataagttaatgggcctttataggctttaaaaaatcagcccattagtatatatcattaaataataatggaaaattagaaaagactgtgaagcgagaggaccgttaagacgacggacgcttatctggaaggagagtcatg

SEQ ID NO: 32773 - DNA, 3000 bp, Unknown; identical to SEQ ID NO: 1209
  misc_feature (1)..( 3000): 2750-1469P.txt file - cDNA_ID_3061152; gDNA_ID_1620372; Annot_ID_155029

SEQ ID NO: 32774 - DNA, 3003 bp, Unknown
  misc_feature (1)..( 3003): 2750-1469P.txt file - cDNA_ID_3061168; gDNA_ID_2926267; Annot_ID_143326
cataatggaacaatcataagaagaagctatatatggcgatgtgtatgcactgcagatggtttggagtcacaggctcatagcctcatatgtttacgttaatcatcatggaaagcgatttttgatccaaaaaaaaaggaaagcgataccaaggagcttgtggagtttatggtgatgctgcttttgcgctggttaagttgaaattcagaaagaaagataacccaaaatccaaattaatgattacttcaaacacttttgcatatggagaagaagagctgttcaacattaaacggtacaacgcagcattgaatttccgtgtcccaagcactgactgatgatcattctctaaagtctctataaatatgaccatgtgatcgtacgtggctcctcatgactgccccaacaagccaattactaaacttgtctttatattgcggttccaaaagatctgatgttgatgttctccaaaacagaaacacattttataagataaatgtaaattaaataaagcaattgggaaatatttatatagagtgatgatgaatacgtgaggactagtttatacaccacaacacaaaaacgcgttttgctcattctctctctctcgcacacacgtcaacaatcatatccatcgatgcatttgacttcctcgttcctccatttacatatgtagatccagttatgaaaggagtactagttccaatttcaatacatttatatttaatattttattcaatacaaaagtgttgaaagggattcggataaaccaagcatttttatgtgtatagaaaaataatacttgactttgcagtttccatttccaatcttcaaagtcatatcttaccaaactcacatctctagctaatatatcccctatattttgttacaaatatatatatatatatatatcttacacaaagacagtgcatgtgatatagaaatcaagatgggaagccaaggcatgagttcaccgagtcccttggtggtgaagaaatcgcaagtggttatagtgaaaccctcaaaggctacacctgatgtctctctttctctctccacactcgacaacgatccttatctcgaaaccctcgccaaaaccatctatgtctacgctccaccatccccaaacgaccacgtccacgatccagcttccctttttcagcaagctctctctgacgcccttgtctattactaccctctcgctggaaaacttcaccggggatcacacgaccatagactagaattgaggtgcagtcccgcggaaggagtcccctttgttagggcaaccgcagactgtactctctcttccctcaactatttgaaggacatggacactgacttataccaactcgtaccttgtgatgtagctgcgccctctggcgattacaaccctctggctttgcagatcactttgtttgcatgcggagggctcactcttgctacggccctctctcattccttgtgtgatggttttggagcgtctcagtttttcaaaaccttaactgagctcgccgcgggaaaaacacaacctagcatcatccccgtctgggacagacatcgtctcacttctaacaactttagcttaaacggtatatgttaactagtattatctaaatataatttcttttagatttagacgcattactaatcatcttgatagtttcagatcagttgacaaaaaatagattggtccatatcttttatatattgttgttttaactttattttatttataatgtgatgttactaattaacattgtatatatgtaagtagggcaatgttttatattgtagttttaaatttattttatgtatgatgtgatgttactaattaacattgtatatctatatgtaagtagaccaagtggaggagggacaagctcccaagctagttgattttggagaggcttgctcttctgcggcaacttctccctacacacccagcaacgacatggtatgtgagatcctcaacgtgacatccgaagatattactcagctcaaggagaaagttgcgggggtggtcacgactctagagattcttgcggcccacgtctggagagcaaggtgccgggccttgaagttaagtccagatgggacttctcttttcggaatggctgtgggtatacgccgcattgtggagccaccattaccggaagggtactacggaaacgcatttgtcaaagccaacgtagcaatgaaggctggagagttaagcaactcaccgttgtctcacgttgttcagctcattaaagaggcaaagaaagcggcacaggagaagaggtacgtgttggagcagttaagagagacagagaaaacgttgaagatgaatgtagcgtgtgaaggagggaaaggagcgttcatgttgcttactgattggaggcaacttggattgctagacgaaattgattttgggtatggaggatcagtgaatattataccattggtgcccaagtatctgccggatatttgtattttcttgccgaggaagcaaggtggtgttagagtgctagtcacgctgcccaaatctgtaatggtcaacttcaaggaacacataaatcccctaaatacatgaaattaataagcaggtgaatgtaattcacagtgtttctttaaaatatgaaaaggacctcatgcgattgtatatttaaagcttttgtttgctgtttgtttaagtttttcacatttggaaagtaatattttacaaaccaataatgtaacgccacgtcagcaacaatattccttctaaagaccccacgccaatattccttagtggagtttttaaaatcactgtttcatctaaaaactgattttagctacaacaaaatataaggccgaaaaagaatgctttagttgggcctaaatatttcatgctgtaaaaatgggcctatctaaataagcccaataaatttatgcgagaacaacactagggttttagtttttcttttgatatataatgtaaagggcgccgttaatcgcagcctcagtggaaacagagcagctgcaaacatg

SEQ ID NO: 32775 - DNA, 3003 bp, Unknown; identical to SEQ ID NO: 32774
  misc_feature (1)..( 3003): 2750-1469P.txt file - cDNA_ID_3061168; gDNA_ID_1620373; Annot_ID_155072

SEQ ID NO: 32776 - DNA, 3003 bp, Unknown; identical to SEQ ID NO: 32774
  misc_feature (1)..( 3003): 2750-1469P.txt file - cDNA_ID_3061168; gDNA_ID_2926267; Annot_ID_204953

SEQ ID NO: 32777 - DNA, 3003 bp, Unknown
  misc_feature (1)..( 3003): 2750-1469P.txt file - cDNA_ID_3061184; gDNA_ID_2926267; Annot_ID_143325
ctagtctcatggttagggtccaacatcttacacaatagtctctttacctcaggagcaaaccagctgggacacttgaagtctgctttacctatcttcctatacatctccataagattagtgtcatggaaaggaagataaccagccaaaagaacaaacaaaacaacaccacaagaccaaatatccgctttcgtaccctcgtatccttttcggttaataacctcgggcgcaacataagcaggtgtaccacaagttgtatgtagaagaccatcttgccgcttgcaatcagcaagcgcacttaaaccaaaatcagataccttaagattatcattgtcatccaacaaaagattttccggcttaatgtcgcggtgataaactccgcggctgtgacaaaaatcaaccgcactaataagctgataaaaatacttccaagcaacatcttctttaagttttccttttgcaaccttgttgaaaagctcaccacctttacaatactcaataacaaagtaaatccttgactttgtagccataacctcgtataactcaacgacattcgggtgtttagcgatcctcattacagagatctctcgcttgatttgctggctaagcccgactctcataactttgtccttgtcaatcatcttgatagctacactctcgttggtatgattactccttccaaaatacactttagcaaaagtaccttgacccaataacctcccaacttcatatctttcagttaatacacttggtttgttctccatccttaaaatctacaaacttcaaactactacctcaaagcatttgagtttttaaacccagtttgttgattccaaatcaagttaggttaactactactgaatcaaaaaagcacaataggatcaggactcagaagtctaaccttttagaccaacaacacaaaaccgatttcgatatctcctgtaacaaaaagattgagaagcaagacgaagagaaaccactcgaaagagaaaggaagaagaaacagtcacttctctcttgtatgatgaaaccgaattgagggatgaatccgaaagacaaaagagaacgaacggatctctctgtttggttgactagtggactcagttctgctcctctgtctaaattctttttatttatatttttggattttatgttttaaaaaagaaataaaggaaaatctaagagttcctttttaaatagttgcgtggaagtgaatagacattagagagagtcgcagagggtatttgttgctcgtgggctcgtccacctaacgcgctatatgcgccgttgatctttgatttttttttggtcggcgatcgttttttttttctttcttctttttggttaacttttattttgtggttttaaaacgataaatcctcctatttattttttattttatgtcgacgataaaagcctctttttttgtgtgtgtgccaacgataaaacctaatattaaaagcagttgtttattaaatatttaatccctggatttttttaattgagtttacaaactgaacttggtcaacattttcaattcttgattctttaagaaacaaccccaaaattacatattttaagtctcggtttgtttcggatgcgcctttagtcatagttatgaattatctatatattataactaggaaagattcaaaatgtgattgtagtaatttcgtgatcgtgaaaaccacaaccctgcaagatgctgatgaatcaatctcatggaatttttgcaaaattaaataattaaacctatagctttaagattgcactagatatatcacatctcaatatcatttatttctatctacattttaagttaagctgtgtaatgaataattttcttaagatttacgtggatcataataaattaatgaaagctctgatgaaggagtttgttaggggaaaaaactgaatcaaattcttgtacgtcatacatattttagtgtggttcgtaactttttcactaaatttttaaattcagttaaataaaaaaaactgtaaatttactaaaatgtaaatgaaatttataaaaaaaatatttcaacataagaagagttcataatggaacaatcataagaagaagctatatatggcgatgtgtatgcactgcagatggtttggagtcacaggctcatagcctcatatgtttacgttaatcatcatggaaagcgatttttgatccaaaaaaaaaggaaagcgataccaaggagcttgtggagtttatggtgatgctgcttttgcgctggttaagttgaaattcagaaagaaagataacccaaaatccaaattaatgattacttcaaacacttttgcatatggagaagaagagctgttcaacattaaacggtacaacgcagcattgaatttccgtgtcccaagcactgactgatgatcattctctaaagtctctataaatatgaccatgtgatcgtacgtggctcctcatgactgccccaacaagccaattactaaacttgtctttatattgcggttccaaaagatctgatgttgatgttctccaaaacagaaacacattttataagataaatgtaaattaaataaagcaattgggaaatatttatatagagtgatgatgaatacgtgaggactagtttatacaccacaacacaaaaacgcgttttgctcattctctctctctcgcacacacgtcaacaatcatatccatcgatgcatttgacttcctcgttcctccatttacatatgtagatccagttatgaaaggagtactagttccaatttcaatacatttatatttaatattttattcaatacaaaagtgttgaaagggattcggataaaccaagcatttttatgtgtatagaaaaataatacttgactttgcagtttccatttccaatcttcaaagtcatatcttaccaaactcacatctctagctaatatatcccctatattttgttacaaatatatatatatatatatatcttacacaaagacagtgcatgtgatatagaaatcaagatg

SEQ ID NO: 32778 - DNA, 3003 bp, Unknown; identical to SEQ ID NO: 32777
  misc_feature (1)..( 3003): 2750-1469P.txt file - cDNA_ID_3061184; gDNA_ID_1620373; Annot_ID_155071

SEQ ID NO: 32779 - DNA, 3003 bp, Unknown; identical to SEQ ID NO: 32777
  misc_feature (1)..( 3003): 2750-1469P.txt file - cDNA_ID_3061184; gDNA_ID_2926267; Annot_ID_204952

SEQ ID NO: 32780 - DNA, 3000 bp, Unknown; identical to SEQ ID NO: 1221
  misc_feature (1)..( 3000): 2750-1469P.txt file - cDNA_ID_3061192; gDNA_ID_1620373; Annot_ID_155065

SEQ ID NO: 32781 - DNA, 3003 bp, Unknown
  misc_feature (1)..( 3003): 2750-1469P.txt file - cDNA_ID_3061205; gDNA_ID_1620373; Annot_ID_155055
taggttctgtaagccttgagggatcaaaccagtaagactattatcagatagatcaagataggtcagaacatgtaaatcagcaagtgatggcgggatttctccggtgaatgcattgcctgctagagacaaagagacaagcttcttgcagtttttcagttctgggatctttcctaagagcctattgtgagagatgtttacaatactaaggacaggtgagtcgcaaaaattcggcggtaactctccactaaaccggttttgtgaagcagaaaacttatacaagctcttaaccaatccaagaccatgtgggatttcaccagaaaaggaattgttgactatctcaacttgctccaatgcagaagccaaagacacagactctggcacttgacctgtgaaccgattattatccgctctaataatcttaatcctgggtaatttccacaacacaactggaaactcaccagaaaatccattgttctgcacttgaagcctctccagactaaggcattcaccaatggagttaggcaatgacccttcaaagaaattcgagtggagagaaaggttaataagccttttaccactgcaaatgccactagggaaagagccagataacttattctgtgagacatcaagagacactaagttcttgagagaagggcctaatgatcgaggaatctcaccactcaggttgttcaaactcagatccaaggttctcaaacttgtcaaaccaacaaacgaagtaggaatctctccatggaaccctgacctatgcaacagaagctgttcaagcttgtctagcttcccaagaaaagaaggaatctcactaaccaaatagctgttttcagacaaatcaagaacaacaagctcacttagcttcccaatagcaggagggacgataccagtgagcaaattacttcccaagttgagaacttggagattaaacaataaccctaaatcttctggaatcataccttcgacatggttactgctaaagtcaataactttcaaggaactaaactcagaaatctgatcagggattgtgccccagatgagattagagctgagattaagagtctctaaagtaacacaacgagacaactgaagtgggataggctgattgaagaagttcaaggagaggtcaaggtgagtgaggtaagggaggtcacaaatggagtcagagatttcaccagaaagattcaaactttgaaggttaatggaagagacgtaaagagtaggagctctagtacatgtgataccagtccagttacaatggtgcgaagaagaagtgttaaaccaacctgaaagagagccttttggatcatcaaaggaggctttgaatctgagaaggttaccaagttcctcgttctctgtgaaagagaaggtcttggtgaagaagaagaagaatgtcaaggctagtgagattgaaaactggtgcttgaatctggtagccattaatgagttaagaatagagaatgaagaggatctgctgaatgagtgaagtagtgagagagtgagagtgagagtgagagtgagagtgagagtgaattgaatttcaggtgttgaaaatacggggtgggttttgcaattataagatagtagggttggttaatggtaaaaataaagagtatagggtttagtttgaaatttcccgttaaattttggtcgagggtctatggggaactggtagatttgtagacaaaacgacgtctcggagattggaatttcggatcgtgtctctctctgtttctttgtttcaatccgatttcgaatcaagccctttacttgtgcaccttcaagatttcgtttttccaggtcagtttcttcatcaagccaacctttttttctagggtttttcttcctttgttttttttctgggagttttctccttcacagtcctaagaagctacttgttaactctgtctttttgcttttgaagttaaacctagttgactttctcaagcttaaagagttcagcttttttttttttttaattggtgattttgttcttaattttgagctaccaaaatcatcgaattaaatgttaatctcttgaattctgtttcggtggtagtttcttggtttgaaatcatagctgcagcttcatgccgaattctcactggttctagatttagagtttagctttttttttttactttactcggatatgaatactgagtaaggaattgagtcaactcggatgtgaatactgaatagtttttgttctagctagagttgcaaaactaagagattcagctactgaagctactttagtgtcattcaaactgaattgaaatgatgtgtgtgagtgtgactgtacctaatttttcaaactcaggcattttcgactgtgccaacaccttaagtctcactgattttgactttgatccgcgagctaagcttaaggtctgaatgagtttctcagactttgtagattgtgcaagctacatgtctgattgggtttgatgaattgctttaaaggttgtgtttttgatgggctatttttgtcagtctgttagctacaaacagattgttcttatatatttgactttgtgacttatggtagtcagcagaatttcccttaggacactttgaataagtaaaggactctttagcattctttagctggcttgtttaactgaaacaaactagagaacctttttcttgactttataggacataattgaaaactatgttagcaaaagagatggtatgtaatgctgtttttttttgtgctcattcagcgcagccaatgctccgggtgaccaacatttgttcctgattcatttcctattgattcgtattggtaggtgttgatctttcttttatattctatcacctaattttgttctttctgtctttttttctttttcttaatttccttccgaatcctggcagtctgtgcacacaagagaaatttcaagaagttgttactaaaagagaggccacaagtggatattgtctttgttatcaagtgttagtacagaaaagtggtgagaaagtaatatg

SEQ ID NO: 32782 - DNA, 3000 bp, Unknown; identical to SEQ ID NO: 1217
  misc_feature (1)..( 3000): 2750-1469P.txt file - cDNA_ID_3061209; gDNA_ID_1620373; Annot_ID_155054

SEQ ID NO: 32783 - DNA, 3003 bp, Unknown
  misc_feature (1)..( 3003): 2750-1469P.txt file - cDNA_ID_3061220; gDNA_ID_1620373; Annot_ID_155049
attaccttattatctcgccatttttatttctaatgcccgcactggagcttattaaactatttggtaaaaagaatcagtgaaccgagactaaatcgaccctaacagcagagatgaaactaacttcagttagatcgacatttccctttgtatagtatcaaacaagaaccggttcttcactccacttgcatttgttaaaatgtgtccaggtttcaaccatagcaaatgagctctcatgaggatgtagtcaatcttcttcaaaatcatgtgtttaatattttagacaagttatagatgagttctacacaatttccaataaacatttctgaggataaagaattgtttttaccaacgtagatgaatttaagttgcctgaaattcaaaacctcccaaaagaaagaataaaaaggtgtggaataagttcttgtattgtttctttatcaaaaaagttataagatggttctaacattttttacatctatgttatatgtaaactatgaataaactggaatgctttttctttttaaaacttttatgaaggctaatttgaatttttatgaaccaacttatcaagttgtaaaggatccaactttagtggtccgcttttgctgcctcagtgatgcttagtaatgatgactatattattatgttcttttatgcatcatcttgatagacttgtcacataatatccatttttctcggtttagtttggttcacaattacgatttattaatgtctaacgaaaccaaagcatttagacttggcgtgaacattagacattttacattgtggatcagatacagttgatcatcatttgtgaacataagacttgtctagtggctttcatagtgcccattataaactaattgggcctcattcacgttcattgagatctgaaagatgaattaagcccacactttggctcttcttcggtaacttattttatttatttgttcatagaaaaacagaaatcacttatctcaatagagccgtttgtgataaatctcttccaacggtcggatcgatttgaagatgaccataaactttgttcgatattttcttataaatatgaaccaaaatctaaactttctctcaaatcttatgtttgttggatagatcaattgggttacttaaatttggatgaacttttgagaagttgtattagatggtgaagacattgcctcagtatacatttccaaatgcttcaaggagatataacttgcaccggttatagcctaattatatacaacgcgtaattgcattacccaaacatattcaacgccgacatcttgactatatgatatgtattgactattattacggtccatgtggaaacagagatcaaatcgaatccgtctctctaagtctatatcactcactatatagtatgtatatgtatcactaacactttccatcaaaattcaaaaccaacaccatggataagacagcgacattgtgtctcttgttcttgttcacattcctcacgacctgtttgtctaaagatctctgtaaccaaaatgacaaaaacaccctcctcaagatcaagaaatctctaaacaacccttatcacctcgcttcatgggaccctcaaaccgactgttgctcctggtactgccttgagtgcggcgacgccaccgttaaccaccgtgttaccgccttaaccatattctccggccagatctccggtcagatcccggctgaagtcggtgacttgccgtatcttgagacccttgtcttccgcaaactctctaacctcaccggtacaatccaacccaccatcgccaaactcaagaacctccgaatgctcaggctcagctggacgaatctgacaggtccaattcctgactttataagtcagctcaagaatctcgagttcttagaactttccttcaatgatctctctggttccattccaagttctctctctacgttacctaaaatcttggctcttgaacttagcaggaacaaacttacaggtaaagaacgatcttttcctttattacatcattcagtgtcttgtctaaacaacgatctttatgttgtaggttccataccagagtcatttgggtcgtttccaggaacagtccctgaccttcgcctatcacataaccagctctccggtccaatacccaaatcattaggcaacatcgactttaaccggatcgatttatcccgcaacaagctccaaggtgatgcttcgatgttgtttggttccaacaaaacaacctggtctattgacttatcaagaaacatgttccagttcgatatctcaaaggttgatatccctaaaacacttggtatcttggacttgaaccacaatgggatcactgggaatattccggtgcagtggactgaagctcctcttcagttcttcaatgttagctacaacaaactgtgtggacacatcccaactggagggaaacttcagacatttgattcttattcctattttcacaacaagtgtttgtgtggtgctcctcttgaaatttgcaagtaaaccaagcttatctctaggattacgaaaaaatatatttgagtcaataatatagacaaatatgtaatgttattcggattgattaataaaacatgaaccaaacctctcatttgatgtattcatagcacattttcaaaatgttttatttgatggattaatcctaccttaatggaaaaacaggggaaatatggataacggaatctctgagtggtttggtatggtttctcgattcgatttgggtttatatccaaacttgaaaagtaaaaccagattggtttaaacaaaaaaaaaaagaagagaaaaaccctgatttccttattcttccaaattcccaaatttctcaaatcgtcacaaatataaattccaaaatttctgcaccgaaacttgtttaaaacgtggtctagtcagcaaaatcattactacatctgtatcgcaccatgcattcatagcctatatgtatatcaatcatagtttccataaaaactcaaaacacaaacaccaaaaacactatg

SEQ ID NO: 32784 - DNA, 3003 bp, Unknown
  misc_feature (1)..( 3003): 2750-1469P.txt file - cDNA_ID_3061223; gDNA_ID_1620373; Annot_ID_155048
tctagagtcgacaaccggatccttaccttcccgattctcgaatccactttggctccactgttcgatttctcacttccgccaaggtgacagttatcgaaaactcccagtgtgataactgtacaaggatcatacacttcccatgtgtattgctcattccatttagggctagagctgtcaatgatggttcttgttctcacccatttttgaccgtacttggcaacacaatacggatctgttgtcgctttaccgtcttttgttttcataggcgatagcccttgagcactcaagattcctacttcaaggatgccaataggagacttccatagttgccttgccgtaggtttcacgtcactgatgtacagagttgactcgtccattacatggtaacctccttcaaggcaaactcgtaggtggattcggctggagaacttgagctcgtgtctcttgtctccttccagagccccaaacccaaacttttcgaggttgtaccatttggaatgaacagctctgtgatctaaccttttctcaaatacgctcaaaggtgagatcagcctccccatgacttcatctttagctggtgtcaccttgttttcgaccgtcaagaagaactgttcttcaaatggctctgcagctacaaaaacaagatcttcgttccacatcggattcgtcgtcttgttaggacataactttgttttcagaatctgattcccaacttgtactttaacgaaagcttgaggtggttggctcctgtcactaggctcaacatcttgcgcctcgatgacattaacccgcagataccacaatttgggagatacatagactttagacctcacgctttggacaccttctccttgaacagaggaagcatccgaatgccaagcatcaggaaatgcttcatcggcttgcgtcccaagccaaaccgctaccataacctctcctcttttcttactctcacctcgccgatcttctaatctgtaccactgaggtgcaagtggactatcaggaggaactcttgtaggaacctcacgcatatcaaacacaaccttcccgatgtattcatctcttgtaaccatctccttatcgcgcacaaagacttcaacagtagaggattggaccttgtcttttgaaaatgcgaaaacttgattccactccgggttggttcttttctcgaagtgtttagtctttcctttgtagtttcctattttcacttccacataaggatcacagttgctggtgacagggtttggaggaagatccttggctttgacgacccgaacatagagataaaacatttgctcaacaaggtcatatgtgcttgcagctcgttcactgccaatccatccggttcctccacgctgtcctccatgtggccatctctctccaagctctggtttcatgtctttaagcttatagtcttcttggctcttagctccatctttggctgccatggttttagattacttgaaccaaaagattctcctgtttctttcaaaacgtttcaattctgttcctgacatacaaaaaaacagaatctgagaattgcaggaaaaaatgattagacaaaacctgtttcttggatgtaaagaaactaatgtatctcatcagaactgatttaaaacctttataattagtatttagtaatttactttcaatctcaaccaagataattgaaaggattcttacctgatttaaacaatatatactaagtggtcgacgcaaatataagctttgtctcttggttctgttccatgaactcattcaagtgtttgcaggaaaacacagaatgtcttgaattatcttttgcaaatgaaaagtaagagaaggattaatatgaaaacgataaatagagagtaaatgaagagaaaaagaagatagcaaacaaaatcaatgaaagagataaatctatagtattcgaacttacaaaaaaagagagctatttttatatggaccaacaatatttcaagaacatgtatatatgtaaagaaggatgcgtttaacttagtaagcagtaccttgagaaagatgttgaagaagctgccataaaattctctgtttgctgctgtaccatagaaatgaaaaaaagaaagaaagaagaatttaagaaaccaagaagttaagagttattccataatcaaatttttgtttgatacacagagagagaacgaaagagaaacaattctatctcaaagaaaaagaagaatcaaaatgaaaaaggaagaaccctaaaaaattacttcttattctctctgtttttctccttctttaagagggaagctgattctttttttttgttatcttcgttttattaaataggaaagcagattcttcgtttgtcttaagacttttaggtacattaagaaatttttcagcagtgacaaaggtagaaatagtagattctctcacacttgtaaaaaattacaccacatatttgccaaattgcatgactgatttcaaggatgaataaacccggataaaacactcaaacccaacatcaagtgaaactttctcatgctttaatcaaaacttttcacaaaaatagtttcgcatcaatatataaaataaaacatgtaaacataaatttacaagaactcacagataatatacttagtgccaaagtgataattagaaacatttccaacaccaactttcccctgtgagtatatatatctttagtgtttctttctttctgcctcattggaataagcatctaaaaaatagctttttggagtttgaaactttttcataaaaagcaaaagggcaggctaggctaaggagtgattattattatttgattgagtaacatcattaccttattatctcgccatttttatttctaatgcccgcactggagcttattaaactatttggtaaaaagaatcagtgaaccgagactaaatcgaccctaacagcagagatgaaactaacttcagttagatcgacatttccctttgtatagtatcaaacaagaaccggttcttcactccacttgcatttgttaaaatg

SEQ ID NO: 32785 - DNA, 3003 bp, Unknown
  misc_feature (1)..( 3003): 2750-1469P.txt file - cDNA_ID_3061240; gDNA_ID_1620374; Annot_ID_155113
agctggactcctgaaacttggcaggtgtgtgaattagcttgttgggtagataaaggaagaagctttatatatgtaatggttgaattttttttttgttactttgcagaaacagaaggatgatatattagctagtcctattaagagtagatcgaaggctcatgaagtgattaagaacatgttggctagtttgggtgatcaatacactcgattcctatcaccagatgaggtttttgttctttacattctatgaatttgattgatggagaaaggactcttaagttgtttcagttactcatatcattgtttgtgtcacttgtttgaagttttctaggatgtcgaagtatgacattactggtattggaattaaccttagagaagtttctgatggtggtggaaatgtaaagttgaaggttcttggtcttgtattggacagtgctgctgatattgctggtgtgaaacaggttataaaccggtctagtttctttcttgtagtttcgttcgctgttgatctcacttaaaaaagtgtgcaatgtctctctctttgatagggagatgaaattctggctgtcaatggaatggatgtcagtgggaaatcatcctttgaagtatcgtctttgttacaaggccctagtaaaacttttgtagttctcaaggttattattcttaataataagatacatactaaattcattagtacttgatttaagtttggaatcaagatttttatgtagtttaagcatattgcaggtgaagcatgggaagtgtggacctgttaagtctctgaaaatccagagacaagttaatgcacagaccccagtttcttaccggttggaaaaagttgacaatggaacagtctctgtcgggtatattcgtctaaaagagttcaatgcgctggctagaaaagatttggtgattggtaagccttttcatgttgttacatcaaagttatcaactttcggtcccatccttttatctacttgtgtttaaatagtacacatccttttcactatgtgcagcaatgaaacgactcctagacaagggtgcgtcttattttgtaatggatcttagagataaccttggtggacttgtgcaggttcattctacaattgtaacttaagaccatttcttctcacaaataatttacaggaacttgatttttcacttagcccttcgtttcttggttatgtttatttcaggctggaatagaaactgctaagctgttcctagatgaaggagatacggtaaatcaacattcatttagaacttttaaaacattgtcaatcgttgttcaggaatatgaaacagaatagcttgcttcaacttacatgaatgagttccataacgattggcttaaacttatgttacatgttgcaattgtgtaacaggtgatatatacagcggggagagaccccgaggctcaaaaaactgttgtttcagataagaaacctttgatcactgccccacttattgtatgtgatgaatcatgtaagccagttaatctttcacactattatgttattttgcatcttgcactgattagaatccttattattgttgcaggtaatggtaaataacagaacagcaagtgctagtgaaattgtgagtaatctcaaaagatttaacccacgggaaactcttctttttttggatgttaaacggatgatttgtgtcatatttctccaggtggcctctgcacttcatgataactgtaaagcagttcttgttggcgaaagaacttatggaaaggttattccaaaggcttactagtttcataaccaatctatcgattttgaattgtttttgatcatcttcatgtcatttgattaatgggtttcagggtttgattcaatcggtgtatgagctccgagatggttcaggagttgttgtgacaataggaaaatatgtcacacctaaccatatggatatcaacggtggtggaattgaacctgatttcagaaatttaccaggtttagttatgcccttgaatcttgatgtttttctttgtcttttgaatatctgatgtgattcattaaccttgtttttgatatatacaatatgcagcttgggatgaagttaaagaacgtttatctaagtgcagtattctccaacaaagttgacatgctatgaaactcatcaagctgtgtacttattattctttgctcaaaccacaacaaaaaaaagctaatgcatacacgatcgaatctggcaaaaaaattgggtatgtcaaagctaaaggaaacatttgagtgtatattaagtttgggctgaacttaaagactctaaataataatattggtcattcttgatcttttggacaaacttagcttcatggccattcttgatcttctggacaacctccaacggatttttatttcatttttttctagtagataagccataagatttttagtggatcccaaaagggcggtgactcacccaaccctctgaagacgaactccacgacggccacacagattcataggaaccgttgttaaccactgaatcaacactgcgaaacccaccaaaacgccaccaacttccgccataacaaccacaacaagagaaacggttgagccctgtggaaccccgaagcactccacgaagtcctcaaccgcgaaccacgccttagagcctccacatgcttaccaccagagcagcgactacatcagtgacgaaaccacaccaccaaagacggaaaggcgcccctaccaactcctgaaacataaacaagaagcttcaacccgacaatgaagatcatggaagcataaaagtaaaaatagactgacaacggatggcgggttaaaatctagtaaaattttatgctcaaatctaataatccggataaatctatttaaattattttagagttggggttaaaaaaataaccataaatatcttaacaatttgtgaaaattcaccctttgtaaagtagcattcatagtttcatacgaaaacccaacacctggaaaaaaagaaaaaaaatctaagtcttgtctaccgatg

SEQ ID NO: 32786 - DNA, 3003 bp, Unknown
  misc_feature (1)..( 3003): 2750-1469P.txt file - cDNA_ID_3061248; gDNA_ID_1620374; Annot_ID_155099
ggttcttggctcactttatctattttttcgggcaaaattggatattataaattcagacggagaagacaagatcaaggaaagtaaaagctcaattgttctaaaagcccctaaatgcttacaagttacaactattcacttttttggcctcgtagttctattccctcaagatttaagcctcccgtaaaataagacatttcactttcaaaatgtacaattgtgctgggtgtattaggtttgtagaaaaaacaattgacttcaggtagattgtaattgtagtgctaagattggcaaagtaacgcgatagcatctttgtgactcgtgaatatgtaatgcattgtatagtgtttgttttacgaaaatatgatgctctgtaaaatagaatggcaacatgctatcaaatagaatggtagcatgctatcaaataaaattccattgaaactcatcaaatttttgtttggaaacccctaactatgttatattgcaaatcaatgaaatatatgggataatttcatgttgtcaattatttactctctaaatttttatttatcactttctttacatcccgaaaactgccaatttgtcaactcgaatttgtaggtaagaaaatcttgcgaaatttcatattttatgtagttttaaaccgtgtttgattgtcaatgaagtaaaaaattaacagatctgttattttttaaagttgaaatcatgtagacaaattacctataaatgtaacaagtaaccggaaaataaatactggaaatgcagttaaatagagttgggcaaggtgggtgaaccggtattcacgtgggggcattgatcttacaatagccaagtcaacaatcaaagttgtaagtagaaagctggtataagttgttcaccacccgagtttttttcttctaacctttcatataaagtcttattgtcttatgttacttgtttaaatgagtatgtacaattgtcactattcacacccaaaaaataggtttataatttgatcgtttcaaacgtaacttttgtgtttgtatttttactttcatgtgaattttacttttacatttttgacttacaattgtcactattcacaaaaagtaccagttcgttaaatttgcttcggtgcttcaccgtaatagcagccaaatccacatttaaatataaatccgttttggttcaattttgcttagcgtcagccgtcaactacgtgactcctgcatcattctcttataacaaacataaaattttaagaaatgaaaatcttgttttctcctacgtatatgtaatgtatcatagttttcagaaatatataaaagtagcattttaacatgtttgagcaaatgtaatacttttgtgtcttaaaagtatactatcaaaattagacgagaataaatgaaaattgatgttgagaattatcattgggtttttattgggccaaacccaacacaatttctataaacccaaacaatttgagaatctgaaagaatatattccacacaaaaaaaaaaaaaaattgttattgaatgaatctagtgcacgactggctaatctcatgtctattaaggtaaaagtagggtctctcctatacaaaaattgaggcaaactacgaaatcaggagactagaagtagacattctccgataactttgagaccaaaagcgacgaattgttttatagcttccaaaactcactggcttgcactatttacgtaggtacaaatacatttgactttttacaaatacaactctacattgaatttttgactaattcaacatccgttcgtatcagtcaattctacattacattgactcaaattatactaacataatttgcccgccaaaaaagactttgaccctttatataaactattgagagaaatttgagaatcgacttggttggaatcattacaagatgactagaacttattactaccaactctagtttagagtttcatacacaaacaaaaaaattgcatgaaatttgatcagcccaaaaataactcaaagccccaaaaaataagttaatgaatgaacgtcacgtgaataacacgtgttggttttctcaaaaaaaaaaaaattttttctcaattctcgtaaaacctaattttcaatttcttcttccttttgttaatgatgataaaatttgcagttttgagttatctatactaacagagttaaaaaaacacaaacacagagatgaataagaaactttcatattgaattgaaggaatgaaaaaacaaattttacaaataaactagatatacaaaaaaaaacagagttacaaaaaaatcaaaactaacttttgttagaatttacaaccacaacagaggaagaagaaagcaagcttggataccaaaaccatagcctcgatgatagacatgattctgtatctcaaagtttccaaaaacgtcatcttcagattcaatctcttccactttagccctcctccaagtcccaaaaatttcaatctcgtcctttctttagtcgtcttccatatcgaaagcttcccttttctcatcatcttctcaaaattttgagctgcttcaaaaaccaaaatgtaacaaagaattagggttctgtttttgtttcaggtgttgttgttataataaagtcttcgaagagtttattttttatacaagctaaagttgagggtattttggtagttttcacagtcatagattcgaagcgcgtttccatgatatcaacgtaggtgttctgacgtgggagcactctgtttctccaaagaatttcgtggatatattttttaactcctttatatagataatagatttgtttttatatatacataccagttgtttttactgaatttattcttttttagtttcaaatgattatcctaattcttacttcttaggaatgtataaaattacgaatttttttaacgtcagattgatcggaaaaagattgtttatttctgctaaatttatatacacacagcccaagttttttttaatggaagacatacattacaatattggaataattgaagcccatg

SEQ ID NO: 32787 - DNA, 3000 bp, Unknown; identical to SEQ ID NO: 1236
  misc_feature (1)..( 3000): 2750-1469P.txt file - cDNA_ID_3061251; gDNA_ID_1620374; Annot_ID_155097

SEQ ID NO: 32788 - DNA, 3000 bp, Unknown; identical to SEQ ID NO: 1234
  misc_feature (1)..( 3000): 2750-1469P.txt file - cDNA_ID_3061255; gDNA_ID_1620374; Annot_ID_155095

SEQ ID NO: 32789 - DNA, 3003 bp, Unknown
  misc_feature (1)..( 3003): 2750-1469P.txt file - cDNA_ID_3061259; gDNA_ID_1620374; Annot_ID_155093
tagttttttttggtagggattaacttcttctagctcgtggtaattgttttatatatcaaatatatattttactaatatatatatatatatatatataaataatactaaatatgatgaattaattctatggtaaaaatgtcagtagaagtagctacactataaactttggtatgttatgtatatttttatataacgaaagctacattttgggtattgtttttatcagggaatgattgatattgaagcaacttttatttagaaattcattaaaacattttaatggttctcttgtaagattcacacctatctttaaattttctagtcaaaaaaagaaagaaaaaaaaagcgagagagcttctgtttttcaaaattagtgcaaaacagaacaaatgcgaaattgtacattttttcttattaaaaattattatagccaaaaaaagaaaaatattatggcctcctatatttgtccccaatcatcctatttattttgacactgacttttctcacccctattattaggcaagttctacaaaaatgatggccatgaaaaatcattatgagttattttccctcgtggctcgcgatggttatgtttttttgacaccgagtctcacgtgacttccacgtgaactatatgagtggaggttttggatatggatcaacttgaccatatactagatttgagaccaagacaaaagagagttcttaaaagtctcccaagatcaaaacagtaaaccctaatgattttctataacccttttgttgtatggaattttagagaatacagaattttagtgtctctttctatagttttaggcttttagcaaaaagtctcaccttttctttgtaatttctctaagataaattgtttttcgaaaaatgctcaaaaagtactgcaaatcagaatgtgtactgcatatcttctatctacgcgaacaattggaataaagcactgttattctctcgtgaaacgttgatacattatatacaacacatatgagtttgaagtttctgtattacagttttctttttgaacagaaatcatttaatgaaccgtgttacttttttttgggtaacatgaaccgtgttactataagactatgaattataggaatcttctaatttgtcatttatgtacgagttaaattgtatttgaagtttcatcaaaaattagtacttgattatgtcgaatattatctatatttctagtgataatttagtgttgttacatcaaatattctaatttagaaaagaaaacaacatgtgtgtacgatataaattgatagttttattttatttaaagtaatgagatgcccttaaaacaaaccttttactcattataataatattatcaagaacaatcttgatcaaacaatgtatttatcatttacagccaaaagtaaaagaatttgtacttgatatagactccatacaaactgtagtaagagagatgatagaatataaatgttccccatttatttggtggaggaccaaatgtggaccaaaacataacttagccaatcgcatcttaaggcaatcgagaagaaactacatgcatgggcatgcaactatactgtttcatttattttgaaattcatttggtccaaatttatcttcaattcctttaaaactagatgtacatgacaaggttgaagtagggaattcacgtaatcatacttttgactttgacaactatatttagtcattcagtgttttattgctatatcgaattatgttcaatgtggcaagaccacgagattatgtttcatttagttaacaatttatgaagttttgaaaacctttgtgtaaaaatactgtaacattacttaaaaacctttctgtaccagtacaatcatttcgacctatattctaaaatgtaaaagtaattcttacattattcttctattaaatgggaaatcaataacttatacggaataaatcactcttaaacttaaatggtcaatttcaacatgtatagtgatcaatttggtaaataatatttgatgatatgttagtgtatagatcaacattccttttaagtggttgataagagagactataaaattttaatctccgagtcatcattccaatataagtgttctcaagatttgttgctctctcatgtcctaatcgcttagggttccaatccaaaccaatgagtttagtcacatcacttacaaatgtgtatatcaatatatctttacggaaaaaagatatattgataaaggatgtacaatcaaatacaacaaattagtatgcaatgaaaatacaattttagaccagaaccacaaaattacaactactcaatatatcgagtattacaatatattgagctataattcaacttttcacctatagttagctagttttgaccataatttgtagtatagtagtatgtgttagtacgtcgatgtgtcaacattcatgttcaaacttgcatattacatgttattgacatgttcttcctgtagtatacaaattacacattttcataacttcatatatgaatctcctgcaattttacctgcaaactattggtcaaagccttttaaatgggctagatcaagcccactaactgccaaaatattcacttcatttattcttgtagacagtatacacattatcaaatgtacacacattttcatgatttgatcttagatattatttcatgcaattttagcctctattgctaggctttcctttaaaaacttaccgggctaatcaaaacctcttaaaaagcctccatatcaaaagcccatcaatgttacctcgaacttagtggaatcaaatacggtgtcgtttgatagaaaatgacgaaactagccctttgaccgttcaggaaaaagtcttccgacatataaaaacggagaagcgagaagacgtgtcggctgagaggtaagaggaagagagactcaaaacggcaattagcgaaagtgggcgggaggattcttttccggcgactcttttatgtcttctcttcctcttcgctccggtgagaagatg

SEQ ID NO: 32790 - DNA, 3003 bp, Unknown
  misc_feature (1)..( 3003): 2750-1469P.txt file - cDNA_ID_3061283; gDNA_ID_1620375; Annot_ID_155140
agaaattgatgctgtaaaacaaaggataaatattagtcatgaaaaatttgctccagtaaaatgaaagagaaaattatcggtgctacttacatatctgatatttgagcttccggagagagacgggaaacaaagagcgtcttttttcttacagcaactgcctgaatataacagccaagtgtgttagctcgactctttaaggagaaagaaagaactaaaattgcataacaacaaaagtagattcatcccccaaataagtcatctttcgactttgtggcaacagttctgttattaaatatctaagcctgacatattttgaagataataagaacaggtacctcaacaaaattgggagtttcatcaagtccttccactgctgtctcatcttattctatcacaaggttttgtcgtcgaaggtagtcttcgtaactgaaacatcaaaaattctagtgatctcataccaagaactacacccaatgtgctcatgataacaaaactcacaaggaaaatagttaaatcccttaccaaagcttctctgcaaggttgtacctagttaccaaaaataatagcgttagtcttctgtaagggtatcaaaactccaggaataagtcacaaccagtgttacagaaaacgtgaaaatcaatttacttgggtcgtgtagggtatggagctgtcttagccacttgaagaaaaatctgatgatcatgcaaatattcaccattcttcttttgcagcgcctacagtataaaagatttagtcagcaattgtacttttcaaatgactacttgaatacctttttcataattacaacaaaactactctcaccttctttgcttcgttagaagaagcaaagtcaacaaagccatagcccacatgcttggtttacaataagtcgaacactaacaacttctccaacatctttgaagaattctttgctgtaaaagtgaaggataaaatatcagtcatagaaaacttggtccgagaatgaaagtggaaatttgaggtgctacttacacatgcaatattttagtttggggagagagattggcaacatagagtacttcctgaattcaaaaaaatagagattggcaatattttagtgtgtgaataatattcatccctaaaaagaagtcatctttcgactttgtggcaacagttctgttattaaaatgtgtgagcgtgacatattttgaagaggtacctcaacaaaatcggaaggtgtctcattttcttctatcggaaggctttctcgttgaaggtagtcgttgtagctgaaaaattaagaaaacctagtgagctcttcatgtattcaaaaattcaaccagtgtaatcaaactcaagaggtaaatagttaaaatcccataccaaaccgtgtaatctatgcaatacctaattaacaaagttaaaagcgttagtctagcagtaatattgtatcaaaagctctaacagtaattaataaccagtgtcaccagaaacaaatgtcaataacatggaaaattgaatttacttgagtcctggaggtcgtggacgtcgtggaggctgtggacgtcgtgaatacacataaagaaaaatcttataatcgtgcaaatattcaccgttcttcttatacagcacctacggtaataaagagtttattcagcaatcgtacattcaaattgaaacttagatacactatatatttttcatcataactaactataaactagtctaaaccttttttgcttcgttagcagaagcaaagtcaacaaggccatagcacctatggatacgcttggcggttacaaaaagtcgaacacgaacaacttctccagcatctttgaagaaattgatgctgtaacaaacagtgtaaggtaaaaatatcagtcatgctcagagaaggaaagtggagattgaagatggtgctacttacatatctgatattttagtttggggagggatatggccattaaagagcgtcttttttgtcacctggatttaacagccaagtgtgttagcacaagattcttaattgaacagaaatttgtacaaaatatctagcaaatccgttggttgtttcctcctgttacatatgatacaagatcaaagagtagccattagaagaagacagtgtaaagaagattgttttgtcaaagaagaagagtaatacgaggccatcttagggttaccttattctacttatgtctcttgagaatggaattggtcaccaaatcatcttcttcagggttacgcttacctaaaagaagagcaacaaaaaaaaaactcttgagacaagtttaacacattagataaaagagagagagagagaggcaaccaaaaacaaacccaataaattgctactagaagtggccatggagaagatgaaacgaggtttatgtatttttccgttaagagcaagcaataatatagccctaaagaaatatagacctagcctaggaagaagtttctaagaccatccttatcaatgaactcttacataaagttctaaacaattttgatatacaaaataatgtttaaacattagaatggctcttacaaaaaaagagaataaagaaaaaaaaaacttagctaagagccatttttcatttcttaagcacacttttttatttttttattcttattttatttaatataatattttgatagttcttatgatattgttaacaacctattgataaggatgctctaactaatcttataaataaaacaatgaatctggtttggtctgggcgtaacagaaattatactcttttttttttttgtcaagaggaaattatactaagaagcaacagattaaacattaaagcgtatagtaaaattaattgtttgagaatcttaaaccaaaccgaaccggtattaaaccggaaccaaattggcaatgaaatttagatgccagtagtaacccgcttgattcgtttgaagtgtgtagggctcagacttgaccggagtggactcaatcggcgaatctgtcacggaggacacggggaatcaacgcggcggagagtgatg

SEQ ID NO: 32791 - DNA, 3000 bp, Unknown; identical to SEQ ID NO: 1242
  misc_feature (1)..( 3000): 2750-1469P.txt file - cDNA_ID_3061287; gDNA_ID_1620375; Annot_ID_155139

SEQ ID NO: 32792 - DNA, 3003 bp, Unknown
  misc_feature (1)..( 3003): 2750-1469P.txt file - cDNA_ID_3061317; gDNA_ID_1620376; Annot_ID_155166
gcttaaaacatgaatgttgaaactaataataataccttttggagaagatcttcatactcatctggagatgtgtgaagaggtggagatgcccactgaatgagaagggacctagcatattcatatttcaaaggtaccaaatggtaagtgggccataaactcgtaaaatcaaactgagaagtcaccaaaatcttataatctggtaaatcaatttgaaattttcgaagcaagaactcggatccctgccacacatcatccaacaccaacaatatacgaccatcttttgtgagttcctccagaagatctcttaagccagtttctgcttgagaatcatcgtcaaatgtaattgctccgcaaccgttgtcctggagtaagttttgtactatggccctgaaattaggagtattcgacacaacgctatagaagattttcttgaattctcctgccaatgtaacaaacactacatgagaaacaagaaacatgtgtaaaaatcaaaactttaagacacctcatatatatacataccttcgatctctgggtcgtcacaaagcttagtaaccagcgtggtcttcccacaaccaggaggaccagacaccacaaccacggaattgtcaaggagtttcttcttcagctccaccaatggccaatccaatccaaccagaaccatattatcaagcttgggaacagaacaacgcttcgaaacaagcggaggagcaggagaaccactcaaacggtcgagcttcttattgatgttttggaaataattgttaagaatagcttccatggaaggcatagacttcaattggttcctaaagagaagaagctgaagttgaacctgacagaacttgagcatcttcctattgatttcctcaacttttctcgtgtacttcgatttcaagattatattccacttctcgacatgtgaacacttctcaaccagtaaaagagctttatcgatcgtgtctttaagatcttgtagttccataccatcttgcatcgattcgatctctttgatcaccggaagcaatgactccatcgtcgatgcgagctcgttagacacagatttgaaagctaacaccttctttgcctctgaaatcaaaactttcagaccttccgagaccaaagctccagcaacagagcctaatcccaaaccaagccaatcgaccacgaccattcttgtttcctcttcagattcctttcctccaaaatttgccaaaacagagaaaaccaagaatgaaaaaatagctcacagatttgtctgtagaaactgaaaatctaacatgttgagaaagatttagacaaggaagactatatcagatgctttagatttgttgcaaagcaatctcgtagttgacttcacttcacagtgcctggaaactgcaatcaaaatgtttttttttctgacgtcatctttctttacgtcattgcaatcaaaagtttcaggcccattgatacatatatttttccttcatacggcccattttgatagaccttatatgggcccataaaaacaatgcataattgagaagctcataaatcaatagaatatgatcaaacaagagacatagcatgtgactgtccattatttgtgagaacttccacatgtcggaattgggtcaagcccatgttgactcttttatattactcgtttagtctaaagtctaaacagtgatcattaagagtctattaagaataaatacataatcaaaattagtggttcatagtttaattaattaagaaaatgatgcctaatcaactactcctcacatgcttcatcttttgttctaatatataaaatcatgccggatacatcattgtgttgcttatgtatcaatgcatgtatgtatgtattcgatttcttctaacgtcatttgtcgtttctcatgtattgtgatctgcatgcatggatggacctttgatatgatcggtgagttcattcatcatactaattagatatgtaattaataatataattgaaaacattttaataggtggaccataatattacaccgactaatttcacaaccacgagtttcttttgtcaacttttgcaacttacaatttaaaacattagaattcatccaaacaaaacaaataaaataaaaattatctttttctatcagatttgcagtaaatcagcaaaaatggcacagctttcaatagctcaacgccgagcccatcacaattcacaacagatgctcgttcccaaaagcataatactccatacataaacctttttttttaaatgtagggaaccagaaacatcgttaattagtgccaagaaaaataaacaaaaaactttcttaattgatttgtttgtctttcgttcaatttctgactctttttcctttttcgttttctagttttaaactatttccatttagctttttatggtaaccgttatccgaataatgaaagctaagctttggctggaagcaataatcatataaaccaaaacgcgtgaaaccattcaagtccgttctcaccgcattatccactaccactttttctcacattaacaactttattttattttacactaatcaaccaaaccaccaaaacttatacttttacaacaaaccagaccagcattttcaaatgtgaatgataatggataatgtatatagatcaaatctgccgacaagtatgtataagattcatagttctgacataaaatataatctgtgtttaaaatctaaagggtgtaaatttaaaagttgttgaagttgatttatgagagagttgattatgattatatttgaccaaacccaaaaacaataaaataaagtcactcgagatcttcactgtcattgattggaaccacctttgggactcctttttttttcttctctcacttacttatgtcacccacaactttcgctatctaattgcactttttatagaccaaagtccctacattactctattttctcaaaccccatttagaagaagagttcttagctgtcttcaatctctttgtctgtatcattctttacggaagccatg

SEQ ID NO: 32793 - DNA, 3003 bp, Unknown
  misc_feature (1)..( 3003): 2750-1469P.txt file - cDNA_ID_3061325; gDNA_ID_1620376; Annot_ID_155150
gaggagagagtgagagttgagcgagagttgttcggccggagaatctcgggtttgattggaccggagaaaaccggaattcatagagaaagaatggaagagaaagagcaatggcgggtattaatggagaatgccggttttgaatcggttaagctgagtaattacgcagtgagccaagcgaagattctattgtggaattacaattacagcaatttgtattcaattgttgaatctaagcctggcttcatctctttggcctggaacgatttacctctcctcactctttcttcctggcgataaccaaaccaaaccgatccggtattcttagttttgttttgttttcaatgttatttttggttagacaaatattcaattgttaatatactccgtggtcagagtgttttgtttttcttttagttcgaacgttgaattaattcaggggtaggttttgaattctctgaaccttatgtgttttttggtaacatcatttggatttgtgaactaggtttaaaaactggtcttagtcttgttgttttctcattagataatttaaactggtttgcttctttatttttggttggataaagtgaccggttctggtcatctgtttgagatgtaattactatttcataaaattaggaagttgaaagccaaatatatttgtaactactcttttatttgtaattttgctcaaaaaagtgatgaaatgtagttttgatatatgaatatctaccattatacataagtatatctgaacatggtacaacttatgaaagctaaatgtcaatacttgcaaagatataacaaatacaagttacatgaataagagatgtgtgttgaatttataagtgtcattttcttttcactttaaaacaaacttcatcttcttttgtttcttatgtgtcaaagttgccacagttgctctatttgagtctttcagtgtcagtctcagtcactgtactgattttacttttttttgttgagtgtgccaatgatgacatcactcccacgtcctccatccgtcttcttttaacggtcacgtggctcccaccctcttttctcgatgtctttaccgacttgttctagcccaacttacttgggccatttagattttttggtggcccaagttgctaaaagaggatttatcatagaaatctgaacccgttgcagcgctcaacacatgtcacagtcctgacaaacacgtattcaaatccttgttaagtcccgccacctgtcaccagagcaccacgaggcaaactctgatcaggacaccgtcgtactattatgtcggaagacaggaaagcttaattaagcttaaacctgacgtatttaacttcgttaactctaccttactaaagggttttaatttaaaacttatcatctcctcgtaagaataaaaactacttactctataaatttaagcttcaagaaacctccaaaagcagagaaatgatcaacgcttttaagactatccgatcactgccctcgaataccaccgtctcgttctgctcaacaccatctcgattaggccggaaagtcactggagttagttttgccaccacttctgatcagcaaaagatggataaaaagcctgaaaatccaaacgagaaaaccgggttcgtctcctccccatatgtgtgtagttgtttctgattcgtaatttggatgttattcaaaaaaaatttcgttctcttctttactttgatggagcagtgacgtgatgtcgcattcttatggagaagggtacgcaacaaggtctgacgaagaagggtttggaggaatctatggaggaaatcaaacacttcagaaggaaaacgagatccatgagaatcaccctggtactcagaatagttagttatcatatacacgtttattactacttatatgatcacttttattgtttacgattctgggtgtgtgtgtgtgtgttttcatgttattgaagattacgacaaaacgcaaggtagcgaatcgaaggagaaggagaaagcaaggaaccagacacaatcccactgctaaagaaaaaatgatgatttagtgtctttgttctttatgctttaataaaatcagacttgtgctctgtagttcgtagactctggttagagttttttttttgttaattgcgttttttgacccgtaacctttaccgggtttttgttggttatccttatcacttttgtaacactcgttgaattagtagtttttgttgattgttgaacattcccttaatttgactgtgtttgtttatttatgaacaaatctacggttttttagttgaaccgtcgaggaaaacattcttagataacgtcagcaatgaatattagcctgttttcggactttcgattccgatgcaacacgttaaaagtaacgtcagcgaagataaatttggtaaattcatctgaaactccaatgctgatggaacttagctggtgtgttgcgtgttcataatttatgttattagtaacgtcttagaagttggaatattcactccaagttcgcacttcaaaactttcaacaagtttttagttcttatcgtacgtctcaaaacagagttgaggagatttagcttctactgtttagtgttctacacttgcttcgtacaaagaattgaatttttatttccatagttacatgcacatatttgtattaacaatctcttattattggttagtatcatatctgtagttattcgaacactgggggcaaatttcatttaatcaatcacctaacgaggctatgatgcatgattaacgaacgttaaagccaaaatgtcaagactacccccttattatcagctcgcagttggtcaatgcctcaatggtctgaagttcagactctgaactataatacaaggtcaactcaacccgctggtagtaacgaaagtacgaaacagtcaaaaacatatcttaaaaattacataaaaaccggaaacgaagttgcagaatttacagtttctgccattgggacaatcattcgatctcatcattatccttctttctctccatg

SEQ ID NO: 32794 - DNA, 3000 bp, Unknown; identical to SEQ ID NO: 1257
  misc_feature (1)..( 3000): 2750-1469P.txt file - cDNA_ID_3061372; gDNA_ID_1620377; Annot_ID_155203

SEQ ID NO: 32795 - DNA, 3000 bp, Unknown; identical to SEQ ID NO: 1258
  misc_feature (1)..( 3000): 2750-1469P.txt file - cDNA_ID_3061378; gDNA_ID_1620377; Annot_ID_155200

SEQ ID NO: 32796 - DNA, 3003 bp, Unknown
  misc_feature (1)..( 3003): 2750-1469P.txt file - cDNA_ID_3061380; gDNA_ID_1620377; Annot_ID_155198
aaaaaatctccctttctttgataatacacaaatcaatcaatatagagataattaaaccacgtctttacagagaatagaagcaaatctttgagctagtaacattttagtataaaaatctcaacaacaagtcatttacatcattgcaactgttttgttctcttcatttgacttgggggttgtttgcttgcaaaggaggctttgtttgtacgtcgtcgtttttattccgtatataaaatataaattaacgaactaatctttaaagcctctgagacgagtagaaggttctctctggtgaagaaaccaatgcatttcggcgacagcctgaaactgaaaagccatcgatcgaccgagaaagcgaaaagagagagagatgagactcgtcgtctcaagctgtctactagttgcagctccttttctctcctctctgttacgagtctcactcgccactgttgtcctcaattccatctccgcctcttttgccgatctcccagccaaatttggtcaatttctccccctcttcctttttccttatccgaaacaatttctcgaacaatctggttaaaaagaagttgattttgattctcagacggctccgtgaccaaaaacggaatctgtggagctctatacgtcgcagatcctctcgacggttgctcaccgcttctccacgccgccgcatccaactggacgcaacacagaactactaagttcgctttgataatcagaggcgaatgttcttttgaggataagctgctcaatgcccagaactcaggttttcaagctgtgattgtctatgacaacattgacaacgaagatctcatcgtcagtaagccttttgcctcccacccaagtttaaaattccatcttttcttctcctgatgagctagggttgagctgaatttcattggagttatttaatttagtcaacgcccccataagtttggagattgaccaacatctgttttgcacagtgaaggtgaaccctcaggacattacagttgatgcagtcttcgtttcaaatgtcgccggtgagattttgagaaagtacgcgagaggccgagatggtgaatgctgccttaatccgccagacagagggagcgcttggactgtgttggccatctccttcttctctctccttcttatagtcactttcctgttgattgccttctttgcacccagacactggacccaatggcgagggaggcacaccaggaccatcaggttagatgcaaagctcgtccacacactcccctgcttcaccttcactgattctgctcaccacaaggccggggaaacatgtgctatatgtctcgaggattacagatttggagaaagcctcagacttctcccctgccaacatggtacttactcctattcttctgtggaaataaactggcaacttgccacccttaatgtgttcattgaggtcttggaaatgtatatttatgagacacagatcttcccttcacaggattgaaacatgtgcttactattctaggaagactttgataggtttctcttagattctaactttataaaatagatttctttctagcataaattcctctgttttagggttgaaggtacaatatattccgtttctgtcaattccagtttgataggtaagcaccgaatgcgaactttttggtattactcattgcttcgaatgatatgatgggtcgaatatgtacatcagaagaataaattaaagatttgaccttttttagtttatgtaagtgggggtaattcatagcagttggttgatttgaagctcttatgcagcttttcacttgaattgcatcgactcttggttgacaaaatggggtacatcttgccctgtgtgcaagcatgacataagaaccgagactatgtcttctgaggtgatcctgttagactgaaatgtataaatcctttcagtagttattttgttgtttttgcgttgggttcaatacactgtttgtgttgttttgttgcaggtacataaacgagagagtccgagaacagatacaagtacgagtagatttgcctttgcccaatccagtcaaagccgttagagttattatcggcttagcagctgaacactcatatcagtgctcggttacctggatcaggtccaggtttgcatcttatattgaatggttaatcatggtgggataagtttaggtaaagggaccggatctgccatactggtcgtgctttgctggattcccagatcaaaaagatatgagttgctttgcctctttttctttgcatgtgtacatttacatacgctctgagtcatgtgtacatttgatcattgtgtgtgtgtgtgtgttatagattgaaaaaatgtgtgtgatagtacagatatgcaaacaaattgatagaaaacaaatgttggtctaatcagattttctctctccgatccaggcaaatctctaatgttatcttgttgataatttctttgcctaaagtttgtataatatgaatattgaatctgattcccttacatgggggaatggaatccattgaacgtggctttgattttgtcttgtctgtagtaataataagaaaagaacacgtcatcctcatctctacctaacgactcatccaatacgatgactcgttcatgggtttgttagttgcgcaattccatcaccaaaactttctattacatactcaacttcttttgattactaaattcagccaacatttccttctcatctctaatcagtgaacacgttttctatgcaggctttggggcctatcttaccatagctgtctaagaagactattatcttatattctttattgtagatttcatttacttgcgtatggaattggaaacaaatttctaattgttgaatcatataccattatttttatattggccatgcatgtgtataagtggaagatagaacaatattaaaacaatattattgtgtttggtcctatttattactctctgctctcttcctgaagcttcttcatctttttgtttgacaagaagaggtagagaagaagatg

SEQ ID NO: 32797 - DNA, 3000 bp, Unknown; identical to SEQ ID NO: 1262
  misc_feature (1)..( 3000): 2750-1469P.txt file - cDNA_ID_3061387; gDNA_ID_1620377; Annot_ID_155195

SEQ ID NO: 32798 - DNA, 3000 bp, Unknown; identical to SEQ ID NO: 1266
  misc_feature (1)..( 3000): 2750-1469P.txt file - cDNA_ID_3061393; gDNA_ID_1620377; Annot_ID_155193

SEQ ID NO: 32799 - DNA, 3000 bp, Unknown
  misc_feature (1)..( 3000): 2750-1469P.txt file - cDNA_ID_3061401; gDNA_ID_1620377; Annot_ID_155186
tgaaaccgctctctgtttcttggccgatcaaagcccctgtcaatgctcccagcaaagtccccactgaatcaaatcaacaaagaagtcaaatcatattcatatcgtaattgcagaaacaaggaaaattcctcagggatcacagagattgattaatgaagatgaatgtgaagaaaagaaggaacctaaagcgaagaagaaggtgaagagagcggagaagaggttggcgagaagggcagagacggcgaaatggaaggaatctttaatccggtggaggacagagatgggagacagagaataataaccatccatatctgcaaaagagatgaagaggaggagggaatgaatttgtgttttctttgtctggaaaaacaaggaacctttcttttctcctttttatttgaagatataatcaatcgattagaaaaagagaccaaaggcaaaggaaccttctctccgctgaccgaaagtttctttattaattaataatcacgcgtctcatctttcttaatattcgaaaggaaaatatcttacgacgacgagtggatttgattatttaaagaaaacgatgagtgggtaagacttttgcgcccttcttctgacttttttggcttccaatttaatcaaaaacaaaaaaaaaaacctttacttctctttattatacaaacaagttttgtgttaacattatactatatgtgaaacagaaacaccacccaacttctcatcaatccaatgcgcttttcttaatccattaaacatacagtatatgtatgtatatatcaaacgaatcacaaagcctacaatgtatcatcccctaacttacctctacaagcttgcttctctattgctcctcatttcccaccgctgtcctcaaaacttggtgacccactctctctcagtctcaggctcacctcctcacctttccctgtacgaagatcagatcagagtcttcttctttttacattttacattctacattctacttttccatccatttacaacaactaatatatattattttttaaggcaggtagtgtgactcattttatgtgtctctcacgcacacacatcacttacttgaagaagctggaaacttaaacttacctcaatcatccctcaaaccttgtactcgtgtacacgcaaccactttgtggacgaccacttattcccttttataacagcacacccacctgcccaattggaccaaattagtgatgggattccacgaatttagtctcgaaaccaactatacacaagcactatgctttcctctcattcatcattttatatgtctgcaaactcatctactcaccatgaagactagatgggtctagcgtcgcatcaggcgtcatgctccagaaaagcaatgcatctcccatctttggtttcacagacaaccctcctttcccacactctgacaactcattccaccatggcactgcgctatagtttcccttggctgcaggaaacactgtttcacccccctcctcaacatctgatctgcaaagtccctaagaaccgttataggaagaacatagaaacagcttatggaagcccaaagttgcttggtcagttacgtacaggtacatgagaactgtggctatccgctgtcccccattcctagtgttatactcatccatgaagtagtcgtaatgaggctcatacttttgcccaatctcatagtgcagaacttgaagaccttccccatgctctgcatgttgtagcatcaacagaaccagtcaggataatgatagggctgcctaagaaatctagggagaaacgggatcaagaaattgtcaaattattaaacaaaacagaaaactagatcataccaactggtatgaatgtaaaatctgatatccttttctcaatttcacggatagttttgtcacgccctcttgcgagaaatgtccctgaactcgttcgcaccctaggatgtggggttggtcagtaaaggagaataagcttctgaggattcacttaatactactacaagaggttgcattgagtgaaaagtataaaacctgctatctgtgctctttccagtcttctcgtcgacaacagttgatttctccatatgcggtttagctagctctattagatacttgcattcctcctttgtctatccagaaaccgggtaacaaaaccattccgtcagtagcggctaaccggggaaagcaagcgaaccaagagcaaatcaaatcatcactaatcacttccctatcatttgctttctaagacattccttacaatgattatatctctcaaggaaacgtgcaagaatacattgaaaatacagatagagaagatgaatatgggagccaaaacagatttaccaagggaggaaaaaaagtcaaatctgtatatggataggtcataggctcaccaagaaattgtggtaaacagaagctctgggttcccaagagattatttcaacccaacgctcgttctttgaatcatcttcgccacttctacgggaaaaaagagaaggaaaagttaacccgatcttgaagcacactaaattgaaattcaatattggcatgggatggtatcttacctctgaagtgtttttcggacaatagaagtgagatcattggcttttgaggatccggcattgttgctgggcaccgagagaattccaaaggcgagaagaatcaaaatcacgaaagtggacatgatcaatacggcgaagacgagcgttgaatgcgaggatttccgagctgaaggacgatgattcctcggtctcgccatcatttttgcaacaaggatgagatccggccgagcgagattcgaaagaagcagagcagcagcaacaatggagtttattttcttactcgtggtgtctggtagattgactaatcaaaggacgaacgggaagtcaggcccatatgtttaagtaaggcccattagaaagtgaggcccattgaaattgtcggatactacatcagaggccggcgaggaggagaggagaaagctccgttattcaagattattccgataatg

SEQ ID NO: 32800 - DNA, 3000 bp, Unknown
  misc_feature (1)..( 3000): 2750-1469P.txt file - cDNA_ID_3061408; gDNA_ID_1620377; Annot_ID_155181
tttgtttgtcatatctcaggctccaatatatgtgaacaaagcaatagtgctggaagaggctatcaaaattggttatggaggcagaccgcagagcgcaaagcctgttttcaatgttatccttgacaggtttttagtttgttaatgaatctcctgggttagttacactgtctcactctgtcacagttgctaaccacatggtgggtgttcttgttcagcgctcccgatggaccagatcctttatcggaagagcttaaattagtgaggaatatggatttggcgtctaaagaggaaaggtacatcgatgcaggtatacaaactgttctggatggcatctatatccagtgtgctttgcagactcctcatttttttcttgtatcacattttgcagcgatgtggagggacagactgaagaaccttcagaactcgaggtgagaagacaattgttggtgataattgagatgcattaatgaagtgacattgataattaacttgttttggttgcagctctgttgtatataataagggtgtagaaactcctgagagctatgagtagtgaaagaataggagctaagaaaggaaatggatgtagatataatgtggtggatttcaagggtatggagagagaaatataagaagctcatagattgatggtaccgcatgtacctgagaggaagctcttagattgatgggatcgcaggatgtattcaaagtaaatgaaagatgtatgaataacctgagggaatgtgtaaatgtaaatggaagaagactaaatgaaatgcatttctttaagtgtgtatagtatttttattgaattggcgataagaagattatttaggagaaagaaactgagggcagaagcagacaaaacgaaagagggacggttacatacagtgggaaagaagagatgtggattgttgtgccttcataaatgtctacttgtggaagactaagcagtaagttaaaagaaacgtgaatgatttcccctgaaacgatggttacacaacactcccttattcacttggttttcgggttaaagttagaaaaataaaagaggtggcccagctttggtgcattgagagtagcagagttattaaatgcttcgcagaattgcagttgcacattcactcccttcttcttcttaatctccttacagttacagacattctctcacttgcgttcttgtttcttttacaaaacagatacactatgtttccgagagagtccctctgatattggcctggttcactcagattctcttttactaactcatctgattgagccgtgtcaatatctcagtcctctctcgtcgcttctctcgtattttgaagtttgcctcgttaggtcacaccacttgttttgtacacacgatcgagttgttgatatggtgttgttgtctttgtgtactcatcgatcactcaatatatacacatatattgtctgttgccaagaacagatggacctttaaggtaacaatcttgtagatataatcgttgatcggatgctcctttctcctttctaattgattttttttttaaactatatatatagagatttcgatgcaatcaacacacactcgtatttttatatattttaaaaagatgcgatgagcccctccctccaagctatcacatcagacagcaaagagaaaggagggtcatttattgatgattacatgcggaaaggatgcattattgaagaagaaggagacgaagagataaggaaagatgtttggtgaatggtgagtcatcaagcctttgtaggaaggccattcttggcccaggcactatagccaccgacgatatctttgactcccgtgaaaccctgcaaattcgcaaattatatatcaccaacaaagtaaaagtcagaaagaagagctttgtggtggagcttactgcatggagaagatcggtggtggctttgatagatctaccaccgctctggcagccaacaatgatgttatcggattgtccgaaatgggaggagacttgttccaggaagtcggggttctttgacatccctgtttcacaatcacaaaattatatccatcactcagttatcaactaaccaaataaaaacatacctgatgctcctcgattcatgtaaggcacgttgatcgccccacaggcatgtccctggctgaactcttctggagtcctatattcatcatccccattacatcaagatcctaatgatgctatgttgatgattgaaatagtcaaaagagaaaggtggggcggtacctgacgtctagatagcggtggccggctagaagaaggtcgtgggcgactgttaccgacaccgatgatgggactctgctctcctccgccatttttttcaatggcttattattatatttgactggacaaagacttcaataatttcattttatataaattagttgggaaagtgattataattgggccatatattacaaatacataatgggcctaagttgctgctttatgggctaagctgttttcggactgtccttcatattttcatattaccattccaaaacggcatcattttagctaacctcgtcttgggtttacttgatgaattttcaaaaggtttaaggcttctgaatgcaattattcattagtaaaacaccctttacacaattcttaccattcttcgtcagtcgatcagatcaacgttttaccgtctcactgatcgacgggaaagagacgacgacgtttttaacctttgggttgagatccgatccaatatttcgaaatcgtgattccttgtttgtgacctctctctctctgcctccacactcttctctaatccctcacctcaaggtaagcttcttctctggcactgattacattcaaatctctcttctccttgcgttgcttttgctggtttattcgaatttcacgacttgactcctttctcttttgattgttgattcaaatcccgattttgcgcttactagttgtcgtcgctctcttgagtgtctgggttcatctttctgacatctgctctgccaagatg

SEQ ID NO: 32801 - DNA, 1895 bp, Unknown
  misc_feature (1)..( 1895): 2750-1469P.txt file - cDNA_ID_3061420; gDNA_ID_1620377; Annot_ID_155173
aagcttgagtgtctttcagttcttgcaaaattggggcctcttttcacaatctgttcaagagccgagagtcctgctgcaatggaggatttacctgtctggaagcatgaaaatcgtgttgaatctctgccaacaaaggacccagttcttgcagtatttggccagaaagctactcaagttgatgaacccgaaccacaggtggacgtcagtctaggtgcttctggtcctgccctagttggagaagattttgcgatgccaatcgtggtaacttcaaagggtcatgccgtatacagtggtgaattgaagattaatctagttgatgtgggtggtggtggtttgtttagcccaagagaagcagaaccgttttctctagaaagccatcatgttgaaatctgtggtattgatggggcagagggcaacaatgaatccgagtctgaaacagggagcataaagaaaattcagcaatcttttgggctggtttctgttccatacctgaaggaaggagaatcatggtcgtgcaaactggaaatcaagtggcatagacccaagcctgtgatgctttttgtgtcattgggttacttgccacatggcagtgaagccaatacccaaaaagttcacatacacaagagcttgcagattgaagggaagatgcctcttttaataagcaatcgttttatgttgccatatagaagggatcacctattgctcaataggataaagccagcccctgattctgaagacgtgtcttctctgccgctgaacgaaaaaagtgtgttagttgtcagtgccaaaaattgctcagaaatagcgctgaaactggtgtccatgtccattgaatttgatgatgaacaaggggaaacttcatgtttgattcagcagggtggtgggtgtggagactccccaagctctgcaaatcttgcgccaggggaagagttcaaaaaggttttcacagtcataccaacgacgagaactccaaagcttggtttgggatcaatacatttaaaatggaggagagagggaggtaacataacagaggcatatgtttcaacaaagcacaaacttcctgaagtaaatgtggaggcatcaccactggtaatgagtttggactctcctccatatgccattcttggagaacccttcacttacgctgttagaatctgcaaccagacacagttgctgcaagaagcaaagtttggtctggctgatgcacagagttttgtcctgtctgggtctcacagcaatacggtttcagtccttcccaagtcagaacacgtcttaagttataagctagtgcctctgacttgcggtgaacagcaactcccaaagataactttgacatcagcgcgatatgctgctgagtttcagccatctgcggttgcttcaagtgtctttgtgtttccctcagccccacaagccgagaaagccatctctaccagcaagtagtgtaacttcgcatgacttgggttttcagatgtctatgcagtttcagccatatgtggttaagacagacatattgaatcagtttggtaaattttgatcctgaagtgtcgcctatgttgtattttcatttttccttctgttgttgataataatggatattttttggagaacccaaactagacacataggattaggacacaatctgttttgagatgtgttttgtggcaactgtttttctttcaatgcaaaaagtgtgtgtgtgcttaaaacgaccatacatggtcaagctaacgcagataaaacattcaatatttcgttgtattgggccttttgatatttgggcttcaaattatcacttgacgttgggtttgccttttctcacttgacgacaaatcagaattagcatctgtttagattggatcttgatcactggcgggcgaagttggagaagattgatg

SEQ ID NO: 32802 - DNA, 1649 bp, Unknown
  misc_feature (1)..( 1649): 2750-1469P.txt file - cDNA_ID_3061430; gDNA_ID_1620378; Annot_ID_155248
cttacgtgaactaccgtgatttagacctgggaaggaacacgaaagacgtgaaaacatgcatcaaacaagctcaagtctggggagctaactacttcaaaaacaatttcaacagattgatgatgattaaagcaaaggttgatccagagaacttctttagacacgagcagagcattccacctatgatgtaacgaggtcaatcaaataagaataaattagaagaaaatcagataatggttcttctgtatttcggaaaaatgttattctagctatgcttgtagtagtactatgtttcacctaaaattcgatatgttgcttcttagtacctaattcttcaatcaactcgagaatcctatttaaagttttgttcttgttcttgttcttaatggaatcaagtcgttaaaaacttaaaatcgatagttcttggtaaattaagatcgttatacggtacctaactcttaattaatgatcacaaggttgtgatgaaaccttgaatatttaatcaaaactaacgatataattggatatttttggatgtgatctttgttgcatctaaaataattagatatattggatttagtagaaatagagtttgcatgcaccaatctacatatacaattttgcagcaattttctgaaataaatcctggagctaccattggcatttaataattgtttttgataattagaaagaaaatctttgaattaaatatttaacaatcttcccaaaatctctccatattaactacacgattagttacttaaataaagcttccaaaatatttaatatcatttaattactacaaaattatcatttttgatattgtttttctacatgactataacaattcgattataatcatcaattgtaactttaaaaaacttttatatataaacttttatatgtagtaactttaaaaaataaattgtccccgcggtataccgcgtgttaaaatctagttatatttaaaagttaaaactaacaaaaacgaaagtgtacttgatagaaacatagcttatatggcctaaatgtggtattaagtcttccaaagcaaaccatgaatagtttaagttttctagtgatgtaatgcatataattttatggattttagatagtgttgttttgagaaccatagtgttatttatatagagattaattcttaatttggcccttaatcaaattagaagttattaagtatatccagatatttacttttcattatatttatgtctcatgtcatttacttcatatatcaattgagtacataaacttagattaatcaaacaataaccataacatactgattaataccccaattaagttttagagaagtaactttgaattcatatgactctttttaacttaattttggacaactgaatgtgcattattttgtcgctttacaaacccgtggaaaatgttggtcacgttgctatcatttcacctaatcgtttcgtttgacaaatcaaaccatctttgaatttagagaaaaattcaatggaccttattttatcagaatcgctatatatttattaaaaaaaatggaaactcatttcttcttttacaagaaagaacaatatacaacatttccatcttgaagccttattgtgtgtttagcttctctcttgcatataatattcgctgctaggatg

SEQ ID NO: 32803 - DNA, 3000 bp, Unknown; identical to SEQ ID NO: 1272
  misc_feature (1)..( 3000): 2750-1469P.txt file - cDNA_ID_3061448; gDNA_ID_1620378; Annot_ID_155241

SEQ ID NO: 32804 - DNA, 3003 bp, Unknown
  misc_feature (1)..( 3003): 2750-1469P.txt file - cDNA_ID_3061490; gDNA_ID_1620379; Annot_ID_155280
ctgaaatttcaatgcaagagttctgatattttggagcaatatccatcagaaagcactgaagtgtgaacaaggcttacctgattaactgcacacactgcagggacgttcatgtcaaacaagacattgaaaatagcagtcttaagttgccgccttgatgccttggctgattcagtatctgataacaaatttaataaaaccttaaaactggaaccacgagatgtaatcctgaacataaacaagtataataacagtagctaaccatcaaaatggcagagaggtagtgataccactattggctgcatagagggctttacctgcatcctgtaagcaaactatccacatgaaatcgggaaagcaaaagccatagagacaaatgctaaaatcattcagctgtcactccaaaagaaacgaaaaacaaacctggtgaaaatggttgcaaagaactgttgaagtctagcataaatcggtgactcaatgttaccaaattcctggcgatcgatcaaactagtaagaactatcttgtgttgcaagagagaagacgcaagcttactatctttgtaaatataaataatgatccgcatttagtacaaaaactatctcaccaaaaaagtagcagaacgtccagaaggagacgcatacttgctccaaccaaacttacaatatccagaaccaccttcaatgagtcgtagacgacacatacagaaacaaacgagacatattgagcacaattgaatgacataaatctatatgattatccagaaagaaaaacaaaaacacaaagcataccatcaataatgatagaaccaggaacttgtgccctctgactataaatgtgcataaacgacaactctcctgattgactagaaatcattctgcaaaatcgttaaactttgaatcatctacaatgttttaacactgaaactaccaaattcaaaaagaaacaaaattcaaaccccatcaccaaaattctctaccgataaaagcaagcaaaaaacactcaccggagaggataaccagaacgcaaactagtttcagcgaagaaaatggagtcccatggctcttgagaacactggagataaaatatccagagacgattaccactagctacgcatttccaggctttgcacgttaagcccaatttcacagcatcttttggctccatcatcatcagtatctggactagaatatccatcggtagctgatcaaacgcaccaagagacgatgaagaagacaataacagaggaggaacatcgatcgctctctgatgattcaccaaatccttgccactattcgatcggttccacaccgatccccatactttcttcaggatcatcgtcgagtttgcggatttttgttttttctcgaaatcagaaattttcccaagaaaatcgaatcaggaaaatttgataaacacggcgttttttctttggtgtgacgtcgtttctagttgggatgagactgactgacgtgtactgtttaatataatgacacgtgttcaatagcgttgaagaattttggtactggctcactaatgtcaataatcataacgatattttgtgagcccaattggaaaaaaaaaactcgaagtggtcaatatcacgtgctcaacttttattgttgttgttgtgaattacaaaatttcatagaaacagaaaaataccaataagtattgtttttagtggatttttcttaatctggtcgactccaaattttgttattttgttgtgagagcagtcctcttcctttttaagagtgttttgttaccaggcctgatcatttggttcctctttaaaagtgttgttactaggcctctgatcatttggttacttggatcatttttggatcgtatccattcagattcggattttgggtcttgggattttggttttgttaagagattttaattttcggtttcgatttggttcaattatatatggttcccaaaaatatttagttctacgaaaaaaactttcaatttcaaaaccgtttataataaccttagaaaaagtattttgttactttggcttccaaatttttagaccggcctacgggttaccattcggtttggttcagacttggtactggttattctagtataggaatcgagattctattcggatatttatattggtttattatgttcgggaattagtccgggcctagttgttaattgggttaatatctgatccaaaccaatttggcaaaaataagtaattccatgatgtatctgacacgtggatactaggtattggctgctattagttgacgtgtatagtatttgaaaaaaatgattaactaccttttttttatttacggagcatagatttttttttggagaagctgtgtataaattggatcctcagatccggtgattacctaaatcgcgtcaattctcaacccagttttcagatttggtattcgattttatttatgtaattctcatgttatttatcttttctgttgaaacctctctttctcgaaactactaatattagggttttctgggtttgagaccacgatcttatcgaattattaatatcctttttttttcctgtttcaaacatagggttttagtgcatgagatcgaataatatttatttttgtttccgtttctagggtttattcaattttttgcgtttttacgttgcaatttttattgaaattcagatttctggagaagtgaattttgcggtaagcgtaatttagaatttgtaatccgtattctcatggaggattcgaatataatatgagctctaaattgattttatgtttgcaactttgttttgtttatgtttttttttaattggtttgtgaattttgattataactaaatttatgaattttgcatggttgtgaattactatattgcaggtttttggaagctaacttattgttggaggtggagagatatggctgactttggtttgttctgtttcccttgtttaatggaagttgtttcatcatcatcatcatctctgtgattgtaattgatctcacaccatg

SEQ ID NO: 32805 - DNA, 3000 bp, Unknown; identical to SEQ ID NO: 1279
  misc_feature (1)..( 3000): 2750-1469P.txt file - cDNA_ID_3061494; gDNA_ID_1620379; Annot_ID_155279

SEQ ID NO: 32806 - DNA, 3003 bp, Unknown
  misc_feature (1)..( 3003): 2750-1469P.txt file - cDNA_ID_3061501; gDNA_ID_1620379; Annot_ID_155270
attggatacaagaaagctctaagaccatgagcacttcttagcatcaccacagctccaggagccatatgcttctctaaatgctcaatagctttgacctttgactctttatccatcccaacaagagctgccaagaaaacaacatcgtattggtctaacccctccttagcgtttaatacatcagttgtgtggaaaatcatgcgtttggaaaggtcagaatcacgagaaacgaggtttgaagcgagtgtgttggcgtgtgagtcgatgtcgaagttgtggaacgttgtgttggggaggtggaacttggccaagacgatggaagtaagtggcatcggaccggaaccaataaaggcgactttggtcgggacatgggttgtgtgttgagataggagatcgaattcgagtttgcctagtttgagatagttgttgtaataggggaagatgtgtaaatggtttagagggttgtcttcaaaagagcctaagattgctgaaaagtgttgctctaaataaccttcggcttcaccacaaagcttgatgagatgagatctcatgtctttgactttttcatcgtgtatctctgtgacatcgatgttcgtgtccgttggtaagcacgtggacacaagttgtctgaacaaagtgtcgacattcttggatggttttaagctctcgaggtttgagatttggttgtataagtccatgatttgcttcacaacgaggttgttttcgcaagccatgtcgacactatgaagagagaatattgagttttgaaattgttttcaatacttggaaaaaagcttgtgttgttgtgttgccttaaccctcgcaaggggtcgttatttattgacgcatgtggggtccattcttggctaaattttgttattttatttatttgattcgattcatataggttacaaatatttcctctaggtcattttaatgtatgttttagaactattgtttttttgtttcaaaacgtttcgtttccaaataagtcctcacaaattttataactgacctttatcattactatcctcaaaatagtaaaaataccatgtacaacttaaaaaatgtaaaaagaggacaatactgttacctattttcacattgcttaggaatgagagtaattaatggctgatcaagttactttagtcacaaattggcggggaacaagacaaactagtaacttatagaatcatatacactcttcaactaaaaatcgcgatatgttccatttatggattttattgggtttggtttcatgacgaatgaatttaccaaaataataagagtttaacacacattagaattggcttcttttgttacacataatagttttagacacatattttgtaaatcagtaaatggtaaatgccaacatgcaacgcaaacatttttttcttttcattttgtttatcgtgttttcatttacaaatttttaggtctattaattatagttataaggtaacggaaatgaacattttaactatattttcatgaagaaaaacgaaaaggtaaccaaaactcaaaaaattaagagtaatttttctccacaaattcacattaaatattagcgttactcgtcgagtgtaaatattccattagtgatgtgtgcgtatgcgtatgcttatgcttgtcattacgtaatctcactgttatgcatgaatggaatctaaaggaaaatactacgatttagtcattatacgtgtagtcgtgaataattgttaattgtatcaatcatacgagataacgtatagttagagttggtaatttaggcatgtctcataacatttttaagtcgccacgaaaatgcatcatattttttttttttttttaatgtaaaagaaataaagatgaagtaggtgatgatagcccgaaaaaataatgttctatctgaattttatattatatactgttgaattctaaacagtcatcaaacttaaaaatcttagattccattcactactcatcacatgctaatgctttgttgggaataaatctcagtcctttggggtcactcatccaattcagacatgtttttgtttttgttttttgaagaatattgttagacacgtaaattaattgaactcgctataatatccgaatcaaagtttgtattctaaacatgttttttagaactgaataattctgaattacatataaaaaggaaaaaataaatctgttttattaaagcaccaaactgaattaaaacatactactatataggttttgcaatagactgatgttacacatacattaatttatatcaataatgcctcttgcatgaaatgaatggccaattttacgtagctctcatcatacgttaaacgatcctataaaagaaagaagcggttctgttttcagatttgaatattaaccgtactttactaagatttatattcttgtcaaaatgcatctattaattatctatagtagatatggtaatgctataccctttaaattaagtgcgtatacatcatggtcatgttgagtttgagtgcgacgatccacgtagtcatatactcatatggtatcaaaatttctggagatttagtatggtaatcgaaaactcaaaaccctttatgatttttttgttaaaacttaaaacaaaacctttaataataaataaaatttgataggtatttagatatgtacttgcatattatgtcggacttttaaaataaaagtttagatcgtttgaacatccaaaaatcattaagtaagtcagataaaaaaaaaaaaaattattttttttatcataaaaaattaaaggaaaaaaaaaattaattgtttttttgctattgatgtatgttgtttcctgttttcgttcaacacatcgtgtcgtttttatacccggacattgttagtgtctaccatatagccaccacagcaaaacccgaacccggaaatattcgggtcgggtcgaagttgcagaatgagatttgatttgccatactttttgtcgcctgaacgcaaaaaccttgcttaaaccctagagagatagagatg

SEQ ID NO: 32807 - DNA, 3003 bp, Unknown
  misc_feature (1)..( 3003): 2750-1469P.txt file - cDNA_ID_3061509; gDNA_ID_1620379; Annot_ID_155265
ctttgattatatattgactatgtgattcgtcgtccacattaatttaagcatgaatctaattattcgccttttctaaatactaatattagaaaatttcctcttttttggattggttggttttccatattatcagcaagtatctaaatggttttcttactacagtgtcttcgtagtcgtatgagtggttacaaccaatggaattttatcaacatggccactcataagacgtagcattatcatgatcaaccataatatatgttatattcattggatcgacaaattaacaaagaaataagtagttttgatcgatgcccacttcttttcacacttctgccactacattcttggactgcttctgctactaaataccccacagtggaccagtttttattattataattgaatttataaaattgatacagacaaatgcttgtatatacttaattagcagaaagaaagaaaaaaaactaagtaaaaaattgcccatcataatcatcgatcagatccacttaattagtaatttataacactcacttagtaatatttatccttagttgcttatatatatatccctagacgtattttctattgctctatcatcatgtggtgagatctctgacctaatcgaaacgtgatatagatccagatcttgttccattgtcgtaatcaagtctacatcttttaatttatcttaattgttatcatcactattaactttcttaaaagtaagaaaaaccatcacacttcattataataaaaaccatcacccttcattgcatacatatgtgaacatgtataatttggaagctgcttagctataacagtcattaattgtcgacgacactaattcaaataacgatagatgcgatagacaaaagaacaatatggaccatttaatgataatcataagatttgagaaagaaatcaaaattttaacaagtttggaaaatacagttgggtacttgtcttttctcttgcatcttttgctgtctctttacttccttcttgtttgttggtttttggcttattgttttcccttttatttttcctctttatggaccatattcatttaactctccccacacatgttcgtctcttattttaattttattttggtatgactctcttatttatttattaaaactaaacaaatactccataagttataaaccaaagaaagaagttatagatcaagggttgacaaaacgttggagcttagtccaaatgatgaaatgcctcacacgaaatatgtacatacgtcgaattcaaagcgttagcaaaacttttggtcttaaagttgaggtcatttgtaccacggtgcgcctgagaatgatttagacacactagtactgtttatgcaaatgatttagtatgtacatttcatgtaaatgtggtagaccccaagagatattcgtatttttgtgagaaagaaactttgttacttgcttaccattaatgtaactctttaaaatgaaagaatatctgttgtctctaacttacaacaaaagttacatattacgaaacatattacatcaatatatgattaacatcaccagtttttaagtgaaatttacggtaattagagtacacactattccataattaaatacctgcagaataaaaccatgttgtcgaaatgctttctctcactttactatgtgtatagatatgcacatgcataaccatctctctacatatctattgatacatatttaatcttttgattctactatggcatgtgacttgaggtgtggtgttatatctttatatataatcttcttgacctaatgatgcttgacccatgatcttaattttagtttactttatcttttccataatctttttgttttgtccagttcctcctttttaatttttctaatcagtattctaaatttccagtccaagaaattggatctaaaacaccttcatcttaattcaatatatgtatgagcaagtgtatatatgtatatggatattaattagtattagcatacgtatgatataaacagataattacagcgaatgaaatggaccgacaatgctagcagagatgagcattagtaaatttaattaatctttcacataaattcctagctttcatgtgcatttcacactcttcaagattccatgtttcaactactaatttaataatttatatatcagaaatccaaagtagatatctccatctttctttcagttatttactaatctcatttttaccactatatagccacttcagactctcccaaagtaaacaaaaaaaaaaacaaataatcacaatccaaattatctaaatgtttctttcgaagcattagaaaaccccaattatgttatgcgtcgtttatcaataataggtagtagtagtactactagtagtagcattcaacaaatatcattattagtaactagaagtctagaagtcattattgatctgagtaaacgttatcttccttttgtttcttaaaagataacaatccagaaataacaaataatagggccaattctaacatgtcattttctgaatttgataacctaattttcttagatgatttatgactatgtaatagttagatctataggagttttttttttttaccatttatgaataatattatcagcatgcctcatctagaagcatttaccacagataaatccacttacaagaaaaggaataaatataatttaccactcttttcatctatatttttatttaattttcaacttatataattctgttttgttcacaaacaaataatggtgaaaaaataaagtgacattgtttggaaaataataataaagggaaaaaggtagaggtgctttttgggatccagatcttcctttactacttcttcttctctctctctcctttggtttgctctgtttttatatatttctataaaatcaaagtaaaaaccaaatccatggggttcttcgcttcacaatcccaacgcacctctctctctatctctcacttcttcttcttcctctccctcttcaccaatg

SEQ ID NO: 32808 - DNA, 3000 bp, Unknown; identical to SEQ ID NO: 1283
  misc_feature (1)..( 3000): 2750-1469P.txt file - cDNA_ID_3061517; gDNA_ID_1620379; Annot_ID_155261

SEQ ID NO: 32809 - DNA, 3003 bp, Unknown
  misc_feature (1)..( 3003): 2750-1469P.txt file - cDNA_ID_3061530; gDNA_ID_1620380; Annot_ID_155308
ttctgaaaggtgcaaaatgcaattatttgtcataaaagagagaatcccaataattagtgtatagtataatctaaccattatttacttaacaaatatggatttggaagcaaaaggaaatgactgtaaccagattctgcatgaaccccttcttatctattcaatgtattcaccattaatgccaatataacaaaaggacatatattttggacttccaagattttttttttggtcgaaatggactttcaagattttatattctaagattttgcaatcaaaactcagtagaacaaaaatgaagattgtaaggatagtgaaatcaccttaccttgtcatatgttgccttctcttgatcattctttggttattgtctcatcatgatcataatcatcactcttgtgctccatacatgaatactatcagaggaacacaattctcgcatcttcaacctgtaagatcaagattatgatccaattatgatgctttttatttaataacattatatattgatagatttggtatttctgatcataggaatcttcaggcttatcgagtctacttaaagaagcagctacagaagacaagatagtgattattaccatggtcgatcgagaatgggcaaaacctgactctattcttgatctattcctggagagtgtacggattggagaaagaaccaaacacttgctaaaccatttgatcgttgtggctttagatgatcaagctcttcgatattgtcttcgtgcccacccacattgttaccttcatagatattctagaaaaaaatcagaatctttaaaaccagatggtcttgttaccggttggaacaagaagtctttggttaaagagatcttagaactcggctaccacataatgttcaccgtaagttctcttaatgcaaatgtttccctttctacaaccagtttttatagaacaagtatgactttgtattcaagaacctaggttaggtacttaggtgggcacctagctagattggcatatcccgctccatgaataaccttagatggtggatttatgagttttttccacctaatatatatttttttttattcaaatttattgtttttgtccatctaattcttcagaatcattatttctaattattatatatgtcttagaatagtgaaacaactagagtttgaagtagaagaaatgttctgatatcacaaagccaaaaaaatagatcaaaatttattttatttttatctaaatcatttgtttgtaacaaattgtaatattgatttgttaacaagttttaaaattgaattattgattgtagtgtttatagaccatgttgtttacgtttttggttacatagacgcttaaaattggttgcaggaagcagatgtgatgtggctaagaaatcctctaatgcactgcaacccacaaaatgcaatatcagtggcttgcgggaactcattaattgatcatcaacatgatcatttaacaacggaaaacacaggaggtttcttctatgccaagtccaatgatataaccatagacatgtttaatatcttgaacgtagaaagggttttgtatcctgcaactggaaaccaatccttgtgtgatattgtcaagcgcgaagatgtaatcaaagcccttgataagaaagtcaccttcttggatgatgctaactttgggaagttttgtcaaccaaatccgcaagatcaaagcaagataacaacagtccatgcaagttgttgtcatgatacaaagagtaaggtgcgttacctaaagctacttctccaggaccggaaaaatatgaatccgcaatggattattccaagccagttatgcagatgattttattcgttacaattttttttaacatatgtataacattttgtacaacatgaaagaacgaaaaactacattaccttaagaccatgtttataggtgattttatttgagtatcataagcccaaaaatcattttttaatgcagtaaagcatgtatttgggcatgatctgtatcagtccactgatacttttgatactgagtatcagatgacgtgacatcacaccattggttcagcgaaaacaaagaaaaaaaagaaaaatcttctctcctctctcactgataatactatttttctttcgttctcttctacaaacctaaaaaatcagagcgataaacgaacaggtatgattgaactgaacctaaaaaccattttcctttcgtttttatatatttattttcgatgttgcaatttttttctttttatgatatttaaaccggtctcaccaatagaaatcgatttattacgagtatcatacaaaatcttaaataataaacaaacattaaaattaatattaaaaaattactaatgatattctatgagtatcaactatatacatgctctaagttttgaccaaaaagtagcctcatctgaagattcatcctctaaataactcatcttttagactttgtggcaacagttgaaggcacatgggatcaatgttatctaccatgtagattatccatccgaaggataggcgcttgagatcttttgtctatatgcttttaaacaaagttctcggcgggatggttatgaagagcatgcagcaaaagtagttaagctttgcggtaatcttccactggccattcgtgttgtgggttcttcttttaatggagacagctaagatgagcggatgcttcaattatatgggacagaaactaatcttgatagaaaaattgaggatttcgtcttcagagtgggttatgacaaattgttggagaaacatcattctcggtttcttcatattgcatgttttatgtgacaaccatgggtcgaagaccccaatatatttttgtattctttattgggctgactttatcataaagcccataaggcccattactttattctgtaggattcgtgaaacggccttatgattatgaattctgcaataaaaaaaattcgtgatttgtcgttacggaagaaaaaagggaaaaaatcgcgaagcttgagaacacatagatatg

SEQ ID NO: 32810 - DNA, 3003 bp, Unknown
  misc_feature (1)..( 3003): 2750-1469P.txt file - cDNA_ID_3061538; gDNA_ID_1620380; Annot_ID_155303
ggaaactttcagcatagtaattttacaggttatttactgactgatgtgatgaaaaacataaacgatatagatgaagagaaaactttttaccactttctaaaaagttatttagatcgttgtatttccccaacagaatttctggttctattacaactactggttcaagtttctagttccttctaaactgtgtgtttcgtaatggctttaatattttttatttgggcttccaaatattgggccattggctctgtaaaacttttttttctgatgctttatataataagacaataatgcttaattgttttagaaaaaatcaaaatataacatgcttaattgattaacattattatataatttattattttgtattttttgaatataaaaaccttttctatatacatatataatttagtgtacaatttcaggatttaatatgtggtatgacaggcagaatctttttttagtagtatagacaataatgttagattttacaaatttttttttgtattaaagttaataattgtgtataagtacaattaaaaaaaaaattgatgctgataaaatattcaaataagatttaaaccgtattactacttttggttgatgatattataaatttgtattaatattgatccaaacccgttccaccatataactctcgtgaaatattactttttataagtttaaatattaataatgtttataaagtttaaatagttcaataatatatttcaaaaattaatatgtttttgccttttacgtaatgacattttttgtaattcttactaaaacaaaataactctataaaatgtaattcaattttttaatgtagataatgttaaaatttataaataaatatttagtttaatcataatttatgattgatatgtatttgagtttttggactacctttcacgtcatttaatagcctacattgggtagttttgtaacattctttgaaataataatattatcttaatctatatatacatttttgcagtcattttagcaaataaatcttatagttggacttatttacaacccaatgccattagcattaaatctttttccaaaataattaattttactttaaatttttaatttaaattgtcaattacattatcaatcaaatttaatccaaacaaacttcacatcaatcccttaaaattagcataaacgtattttattaacaatattttaaaacaaagttttttgtttaaataaatattgttcttactaaacgttttttgtttaaataaacaaatcatgtatttgaacttatttacaatatcatgctacttacattaattatttaggcataaaaatatttatataagatttaaatcttctaaattcttgcttttagagttattatatcattacctaaaaggcaaaaaatattatttttttgaatattattatttgtatatttaaacttcataaaacattatcaatatttgaaattatcaaaagtttaatatatcaaaaaaattaacatcattatataatatatagagtttaaaaaaatctcaaaaaaaatttcgtcatattttgtgattcgaaattttaagaatgaacatatattaaccaattggcaaaaaatgtgtggattcaacgtcccgcaacgactaaaatattttgacaatgattcataaacatattataaagaagatcaacattaataaaataaatagtttttttttttgtggacgggtttggcaggacgttacttagtaacaatggtaaactataaaataatttacaaatttttatatatattaattttagaaaatgaattgtcttcatggtgtaccgcgggttaaaatctagtacatgtacattttactaactgaaaatatgagattgattctttatattacactgataatgaatgattcaaaactaaagatcagagtgtaatatagtttagcttagaaaataattaaaacaattttattatttatttagtttcctaaattttagtttagattcagaaaataattgtttaacttctttagaagatgataaacatatatggaagatttgaatctctattcatatatatttaaaaaatcaataatgtcaatataattaaaggatagtttagaagaaattttcttgaattctaaataattaatttgtatttttaaacaaatattaaatactgtaaaaacgaaatattaaataaatatggaaagaaaatcctgccttaaaagattttgtattattgaaaccgatttttttttacagcaaatttaaaccaaaaattaataaatacttaaaagagatcttaggaatgattttgtttgaagtaatgatttagtcgcaaactctagcaactaatcaactcctaaatcataaaaaccccaaaatatgcgtttttctttaaataactataattgtaattatctttaaaaatgtaacttttaaaattataaataatgtttaagataattataattgaaaatttcaataaaagcattttagagcagaattttgttttatccacttttggactattttgatctcatatacattttcctataacaagtgtagctttgttgattggtataaaatggaagtaaaaaagtggaatattccttattatgtcttttattttcacaagcccaatacagtttctacgaaatgtatatctatttatccaccaaaaaaaaaatgtatatctattttatttgtttcttatttaattagcatcaccacaatttggtgcaataaagagtatcaaattatcaaaacataaaataaataaatttataagccaaatattaaaataaaatctaatataataagatttgttcctatcccaaatcctaaatgtaagtacaacacattatttataataaacaagacagaggtctgatatttgcgttgaacagaatcgttgtcacttgttcagtcttcactacggagctgttttttttcgattcgccggaaaaatcataaaatccaaatctacaaccacctttttatcgcaatccaatg

SEQ ID NO: 32811 - DNA, 3000 bp, Unknown; identical to SEQ ID NO: 1285
  misc_feature (1)..( 3000): 2750-1469P.txt file - cDNA_ID_3061544; gDNA_ID_1620380; Annot_ID_155297

SEQ ID NO: 32812 - DNA, 3003 bp, Unknown
  misc_feature (1)..( 3003): 2750-1469P.txt file - cDNA_ID_3061548; gDNA_ID_1620380; Annot_ID_155296
tgtatataatatttacaaataactattcaattttatttataagaaaatacatatctcataatttatcttattataggtgtaacattatttgttcttaatagtcgtttaaatgtggtttattaattatatacatatacaatcttaattaattacatgctaaacaaaattgtacaagatggtatattggtattcagtccacttttatagctttattattcagttgtggctctaatcaaattttttttagttctttttcaatttatgcaatatagaaactgtacggaaaggagatggttcggttttgcatgatattttccagctataaatggcatggtagactacttagcagcaagtatttgtataaaatatgactgaaatcttctgaaatatctcgggctcgaatcctttaaacgagcattgagattcgagatatatcaactaagctctccatataaaggaaataaacaaatatgtatggtcgaagccgattaaaaagcaggcacacacaaacattaaattatactataggcaatgtgactttataacatatatctctctccacataggtctatatgataatttaattggatggttatccaaagcacccaaataattctgggaactgcgatgtgtgatctgattggcttattgctctttattaatatgagatttataagtatatgataaaattaggtgtatgggtcccatgatcaggctaaaacagcatctggtgttttttaccacatttcaagactcttgtatggtccttctttgtcctcccaaccaaccaaattgcatgaagtgtcctccatttcaaaattgaaaaaactggcatgtcagggcacatttggaaatatatacatgtgtatatattgtgtctctatttatggaagtgtaaagcaatgacccataaggtcttctcattgtcctatggtcggatctatgtacttatgtagctccggttctagggatgtgctctcattctatagctaaagtcatcttggtgtggttttgggtgtgttaatcatttaggttcggttagaacatttcacggaataaacctatcatttgcatttgatatctatgaaaaacatttcacggaataaacctatcatacgtatctttcattacctttacataatacatcacacaaaagcataagtattctttcaccttgtcatttttttttgggataaattctatcggtaaaaacatactgaaatacgctagagtggattcttttcacttgtcataaaacccaataaaaatcatatttattattttattattatttaagttcgtttcttaacataatacattaccactatctaatacctcatataaaattagatttaaaatcctataaacacacactaaattctgaaagaaataatgttaggttgtttaatttcttttttttgtttgtcaaatcagatatattgatataaaacaaggttacaaaatatataaacattataatacaattattatacgcaaatacaaaaatttgatacaattttgataaaggagtgaaagtaacccgacattacaagcaaataggcgttggtcatgatacataaatattttttaattataagaaaattactattattttaaaatcacaaattttaaactgtatattttcttaattaggcactgatgaacaattcgtgatacaatgtggaaacatgtctcaaatcgaaacccttatttgatatgttattaagatacctgctggggaggtgcctcatcccaaaataaactaaattaattaacattcatttaggtagaaaaattactataatgacatacttaatcatataattatacttttccttcataccaccaataaaagcagatcgctatctagctcttagacaagataatagcatagcttttaattttgataaagctgaatggtccttgtagataaagttaagagaagaatatgtttttttttttacaaaggcttgttttcattcattcacataaaaacaagtacaagaaggagtgattcaaagatcacaaagtttaaaacataattaaaggaggtattccccaaagccaaaacataatagaggcatttctctaagacacgaaaggaaatgcatagcattcaaaccgactcatattaaatcatctctcataaatgaaaaactacttccacttgagacactaaaggactcaccaatcaacatattaagaaagttactgtttcgtggcttgaaaatatgtagaaaagcttccaggacgatgtctcattcattaattttctgatgattccaaattcgttttccgaaccacaacttatgattgcaaaaacctaatgattcggcttgagttgagtcatgatgagaatttctcctgcttaattaaaattctgtttttaggtataagagattctattcagcaaagatattcaagatgagtaacagatattaaacataccatgaacattcacaaacctgtgggaattaatatatgaacttacctagcaaaagcgaacatgtaatttctcatttacattttcccgtactatgtaaaattgaaacacattttcaagtttaaggaagattataattttggagtcgatgtagtatcccgagagcatacgaaacatatgttgtattttcaaatttgcgcctctcgatattgaactacaataatgcatgttagattcaaagcagcctcgctttggaccctataaaatgagttaatgcaagccataataatttatcgatcgacatatttactaaacaagccagaatgtgatctcgatctcagcctgtgttaatctttttgtaattgaacattctggactaatgaactcttcactattgaaaaaaacaacaacacatagatcatttacacaaagtctccctttactaaatttcaagatttggtccatttattccaatgagaaatattccagatattttttttggctgttgactgtacggataggcccttaatgggcttttaatggattaaattaggcccatg

SEQ ID NO: 32813 - DNA, 3003 bp, Unknown
  misc_feature (1)..( 3003): 2750-1469P.txt file - cDNA_ID_3061563; gDNA_ID_1620381; Annot_ID_155328
acattcatacatccatacatgcatacattcatatatacatgcatgcttacattcatgcatgaatctatgcatatttgctttcttgatttattgattgcttatttacttatttgatttcttaactagcttgcttgttttttttttctctctgtttacttacatttataacttgtttacttcttgtttgtttctttgattatttgatcgttactcactccatattgcttcatttcatttcttaatctgtgtgtttacttccttcttattcccttcattgtttgctcagaccgtacatgcaattcacttgtttacttatcgtcaatttcttgatttctttgattatttggcagtcgcttattcaactgattcattcatggcttagctctttcacatgtttcctctttgattctttgtatctttacttctgtagttgttttcttacatgcttactttacttgttttattgtttctttcatttttttgtttactcacatcattgtttatttatttatttgcttctatttagttatatacttctttcattgtgtataaattttttgaatttatacaaatgtactcatataattttgacaacaatatgaaaaatcgaaacactaataaatatccgaataatcaaaccgaaactgaaatataaatattatttcaaaagttattattataaatctaaaaatatcaaaataaataaatcaaaaatactaaaatacctaaaataaccgaaaaatccaaaaattaacaaagttttttttcaaatctaaccaattcctcatatataaaatacatgtatggagcctccaaacctaaactctaaaaccataatctaacctgaactagtacccaaacgcctaggcctaataacgtatatgccacttataaaactttataacatttccaaattttcattaactgtataataatttattatagatgaatataacactttagctagagatatttcaaaaaaggtcactcgggatggtagaataagatcgtatctatctataagtggacctttgtggcttcattctcttaagatatattagtcgacacattatacatgttaaattatatatattaatattaatttgaattgaaagtaataaattattattgttttagttgatacaataaaagaaaattttaaaaactcttaccaaatattaaattatttttgtttctacaaaataactctaattagtcaatagttaatacaattgaacaaaaaaaaaataatttgatatgtttaaaaagtattaataaaagatagtaaaaaatagaaaatattcaatagtttctgaaatgaaaataaatttttgttttaattgtttatattaactaaaacaatcgacataaaaaataataatattaatattgatgagagatatgggtgcctcgtcatcaacggtgcagaatctctgttctctgagtcggacccgtattcgatcgattttgtgtcgaccggacggcagcaggattagccggtgagaaattccaaaccagcgggtgggttaaaaaagggaagggagctaggaaaaagtttcacttttcttgaagtgaactatggatcctgcgcagcgaatcttcaggtcaaggtggatgcttctgtgtcatatcgctgcaagttggttactacaagaactagtcttaccatagtccatagatggttgtttgaagattcctctgcaaggtaaagctacgaaggagatgatcgagcttaacgttgagaagttcattgatgtgggaacagtggatcaccgcagtgaaactccgtactcaattcctaaatcgaagctgactctagagtatttgagagaccatacttattttcgtgcaagaacctccatgattgcagcagttacaagaatccgacataagatgtgtcttgcggcgaagaataggggccggactgcataatactattatttcaagttattcactgcctaactctattgtcttgtttattttaacgtgttagcattagaaccctaaggttcgatatattacagtgatcaatatgacaacatgtcatgtaaatgtaattccactctccttttttcttcttcttgatatgtaattcattctcttttcttctaattctaaacttttttttttccactcattctaaacaattaataaactcatttcttataactttttccttttgaacccaaaaaaagaaacttttttgactagaatccgatcaactatggaaaaggactattgtgaataatctcctgaattaactagaaagtgccaagagctccattaattttaactggattcaaacatcaagatcccaaaaagatgcaacacttgtaataataatgataaattagattttaaccgcgatacaccctgagacgatttattttctaaaactagtgatttttaaattaaatgattatgcattatattgcaaatgacatcatgttataaaatatttttttatataaatattttaatatatagtttgcaattgttataattatattatatgatattttggaagagttaaaaaaataccaaacaaagttgataggtaaatcataatttttaatcttaaccatttgttttaattttaaccagattcattattttaactggattcaaacatcaagatcctaaaaagatgcaacacttctaaaactaatatagattaatcaaatcaaaacattactaaatcaaaagttgagatcacaatcattagaacaagtcaatcgagctaaaaatatccaacaaatgtgtcaaacttccatataactctgatctcatgaactaaatatggattaatcatcctaatctccacttaatccggaacaccccatattccaacactttactgacatgtgtcagaagatgaaagctccatgagagctatataaattatggaacctttggaggaacttaactcaattcaatctcataatcacacttttattcaaagaaaatacttaactttcttttcactaaagctattcgaaaatg

SEQ ID NO: 32814 - DNA, 3003 bp, Unknown
  misc_feature (1)..( 3003): 2750-1469P.txt file - cDNA_ID_3061585; gDNA_ID_1620382; Annot_ID_155357
aaggaataatttggttaatgtgaagcgttagtcaaaaaagttatatcaaaagaggactttgcagaatgtctttttctttagaatctctgtttattaaaaagaagtgggtccgttcagaaagaagaaagagttactttttataaacaacttgtctatttctggtaaaggtttcaaaattccttcaaatcaacccaacacaatgaatacaagatggggccaataggaatagtaaaacaagtggtcaagttagtaactcaaaatgcaaattacactctccctaaccaaacttaagacaatgatgatcagacagagaaactctacttgaaacaaacatgcagtatagtggatgaagaaagagtacctgtttcgccatgctacaagctttctctgaagagttgagaatctcgtagtaaaacactgagaagttaagagccaaaccaagcctgatcggatgtgtaggtgctagatcagcaactgcaacgtccttcaatacaaaaacccacgaatgagcaaaaatacatattttcagaacaattatatattactaagacatattagggaagcaattgatcttaagcccaaatagtaaaagttgactacttctaacgataggatcaatacaatagctagattcgagaccaatttacttattatgagacaactgattacagattagctaattgaagtaatctcagaaatagggttttagctccacaacaggatcgattcaaggatttagggaatcaaagatatacctgagcagctttgtaagcgatcatagtatcttcagcagcagttttcctctcatcaccagatttaaactcagccaaataacgatgataatctcctttcatcttcaggtaaaaaaccttagactcactggcagtagctgaaggaattagatgcgaatcaagtaacctgagaatcccagaacagatcgaagaaagctcagtctcaactttagatctgtaatccttaacaagcgacacgtgttcttcgttcttcctgctctcttccttttgctcaatcgaagacacgattctccatgccgcacgaagagatccaatcacgttcttatacgcgaccgagagaagattcctctcttctacggtcagctcaccggccggtgtagctccacttacgagctgttccatgaattgaaccatctcttcgtaacgctcggcttgctcggcgagcttcgccatgtagacatattgatctctgcttaaggtcgtcgccattagagaagaagatctcgctttttttttcgatttcaccggaaaattttgaaatcggaggaaatttctggaagaaaaaaagaaattgagaagaagaataaaaagcttcaaagccgagtcataatgagctgtaaaaggaaattctcttcactcgcgcgtgattaacacactctgataaacgacgtcgttagttgaaataaggattaacagcgtgaaacccacgttgagtgtacgaggcgcgtggctaggtttcggtttttttgataagagcgagtgaatggacgataataatttagtgcgtcagcttccccaactagttgacactgttcaaggtcaaatgttagaatacgggcttttgattaggctttagatgggctttttgaagcctgttaaagctattaccttgctggctaagcatatgcgttttcggcgtgacctggacacaactaatgtggtcggagaaaaggcatatgaagacaagaaaaagttgtccaaattctttctttcgttgatattaatttttcttttggtcaatactcatattctttaatttcttatattgttgattaaagaaaattaattattttcattttccaatactttaaatttaaaagaccggatcaaattaattgaattcgttttttgtgggtttttatttgttgattcattgtaaatttcaataaatgagaattgatgaaaattatgctatattaatttgattagtcaaatgagataattgagatccggcaggacatttgtttggcatgaaaaacaaaataataaagagttggttaatcaaatgcgaccaaatcattagatcgaaaaatctgaagaaatcgattactcatgtttttaatactggaaagttgtttagattatttgggttaacaaaaatctgtatacactcgtagttcttactaatttataacaaaacctaaattctccaaaactaatgtaatgcaaattgattctctgatagacgcaccgtcacgcgcgcataacgttgccgttatgggagaaagaaagggcgtatcttcacttgccacgtcagttttacgctaagcgtaataaaagtcgccgtcaccgttaattgacgtctccatccaacgccgctcttcttctccgctctcaccgtatatatttttttcctatggtggcgcaatttttactaaacttacataaaaaaaaaggaagattaaataaaaaaagagaaagaaatataagagcttcctcaatcgatcttccatttttcttcttcttcattgtgaaatttgagtccaatgactgtcactggtcgaattttccacctgtagtcaatttgaagaaatttaaccagtttgttctactggaaaaatttctggtttcacacttgtgttgactctttcactggaaaaaaagaaacgaaaaaactccgaagagtcttctctgggcagtgtaagtaagctaatgcattaacattttttggcattgagaagtagatcgattcttcaattttgtgagtttccgttcacgatttcgctttctttcatgtgaatttcgtgaaagagagaaaaagtaattctcatctttcttgctacattctctttttgccgttttcactagaatttcgcttttgtagccttcgattcgtttgatttcgtttgatttcgtttcagttgctatgttttagggatttcattatagaactgagatttgattgttgaatgtgaatgaaaattttgataatttttcttctgaaatttaggttaaaaggtaaggagcaatg

SEQ ID NO: 32815 - DNA, 3000 bp, Unknown; identical to SEQ ID NO: 1294
  misc_feature (1)..( 3000): 2750-1469P.txt file - cDNA_ID_3061589; gDNA_ID_1620382; Annot_ID_155356

SEQ ID NO: 32816 - DNA, 3003 bp, Unknown
  misc_feature (1)..( 3003): 2750-1469P.txt file - cDNA_ID_3061649; gDNA_ID_1620385; Annot_ID_155429
ttataccaaaacaaaaagttatcactggactctaatttatcggcccaatatatcggtccttttatttgagttgggctagttacaatatatcggtccttatcacgaagtgcccatccaatacctgcaggttggtttggagatagccatgaaccatcaacgaagcaacaatacgaattagcttgcttaagaattaatttgagctattccattttctttcagactttgcactttctttgttgcttcctgtttatgctttacgtctaatccatccatattcacagcttcgaaccacaatttacagtcaaagcatggctttacttattacctccggtattgcccacttcctattattaaataaaagatcatttctcattttccatatcctcctccagcctatagaagggtttaactttaaatgataggatccctttaaatgatttaaatatttaattgtctttggaaaaaaagagagtcaaaattgcctctgcaacaactaaaaaaaaaactaaaaagggaaacaaatcctcatcgaatacagtgaatatggaaaatggggaatcaatatcaaacaataccattcttggaataattctcggattcatttttgaagaaaaaacaagtaatggcaaattttcccaagttgtgtccccctttttataagaaaagaagactcagcaattgaggtttttagagtgagcaagaaccttgtgtagcaaaaaccttaaatccgtcatctatgggaagtataaactctgtggctgaagctaaaacagaggaagatccttcgacaaatcagggagatggggacgacgaatcacctagaaccctaattgaagatcagagagatgtggaggaatcaaaaaccctaagtgaagatcaagtagatgtgaaggaatccaaaaccctaattgaagatcaaggagatgaggaagaatctaaaaccctagatgaagatttggatgaaacagaggaagagagtggagagtgccctttatgccagttcataaagggaggtgagtgtaaagaagcattcacagaattggagaattgttgcgacgaagcaaagaagaacaatgaagatcacgtaagtaaatgtaaggaggcaagactcatctttaagacttgcatgtatgataaccctgtttactatgagccccttcttgctggtgaggctagagcgatggccaagatgttgagcgagttgttgaacgcggaaaaggaagctattatggctggtgagcctgcagtcattgcgagggcgtttagcgggttgcaagaagagaatgctgagccaattctgcctgctgaagctgcagcgatcgggaaggcgtttcgcgagttggaagctggaaagaagaaggagaaggaagcagagggatccgagggtaatgagagtgatcatcagaatcagaattaggtaaagctttttttatgagcatattgagacttacattgatctgaatgaaaattcaaatttcgttactcttaattttgtttaggtgtgtcttcttatatacaccattggttatgtaatttggatgcatctataaaatactgtcgtaatcaccttcttctacaaaaaactaagaccattttaatatacattttgattttttttaagataagactttgtgcaagagtttttatccaatgatagaatcttaagtgagacttgagtagtacttatgctcaacttttgaaacaagagatagaagtaaaagaaagaagcacattcctttggcacataaaagtcatcagcagtggtcttcaggatcttccgcaatacgcttcaacatgaatagcagccatacggtccatgaagtgatcagtggtaatcactgcaagatgatcttcaacaaaatcttcaatcttcttccagtcacgatcaaacctaagaaacagagagcagtagtatcatcagcacaatcaggtcctgctaaaatcaatataatacttttaaaaaaccacacaagtataaaattattacagttgaagtgcttcaagaagcagatctatttagctaatcaaaaaagatcaattaactcaaggaagcagatcttttttagcttaagttactactgacctaacactatcataaacttccctctcgttcacttatgtatctgccttgacatatcagtttatatccctaaaagccagcaataatattgaaggatctaacactaaggaaaactaaaacatgcattgctcgccaatccaaacagaaactcaccaaatcgtaagtttcgatatcatccaaaccaaacaaattgaatgcctggggagagagagtcttactgaggaaaaatgcttcaattagcccaaatattaaagtcccaatataaggagactttttgttaaatttttagcccgattaaacataacattttttaatcagcatgcaatattttcatttaatgtgctcggttctgtcacggacactgacatgtaatttttcattttcacgggtgagataattttcagacaatattagaatttttttcttccctttgtagttattcgaaattatgttattgttgggaagtaatgaaaaaaaactcaacaaaattcgatttaatacctatccataatattattgatcctaaaaatagaaaaggataattttgctgagtcagaaacgtgatattcgcgacgttgtttccggataaagagtaaacgtacgactgctttaactcacctataaaatcacgaccgtcgatttcatttatgtcaaggggcaaaactgaaaatcacacaaaaacaaacaaaactttgcttacgtcacatcattatctgtgactaattcttaatcatcatcatcatcatcacttacttaaatctaaaaaaatctctgtttgtatatatattatctttgcgatttttatccaaatcttccaaagcttagttttttttttttttcaatttctctcttgcgttttcgattttattacaagaactttgttttgggcttcatccatcgttcaaggttcgttgaaaactatg

SEQ ID NO: 32817 - DNA, 3000 bp, Unknown
  misc_feature (1)..( 3000): 2750-1469P.txt file - cDNA_ID_3061653; gDNA_ID_1620385; Annot_ID_155426
acgagagggaagtttatgatagtgttaggtcagtagtaacttaagctaaaaaagatctgcttccttgagttaattgatcttttttgattagctaaatagatctgcttcttgaagcacttcaactgtaataattttatacttgtgtggttttttaaaagtattatattgattttagcaggacctgattgtgctgatgatactactgctctctgtttcttaggtttgatcgtgactggaagaagattgaagattttgttgaagatcatcttgcagtgattaccactgatcacttcatggaccgtatggctgctattcatgttgaagcgtattgcggaagatcctgaagaccactgctgatgacttttatgtgccaaaggaatgtgcttctttcttttacttctatctcttgtttcaaaagttgagcataagtactactcaagtctcacttaagattctatcattggataaaaactcttgcacaaagtcttatcttaaaaaaaatcaaaatgtatattaaaatggtcttagttttttgtagaagaaggtgattacgacagtattttatagatgcatccaaattacataaccaatggtgtatataagaagacacacctaaacaaaattaagagtaacgaaatttgaattttcattcagatcaatgtaagtctcaatatgctcataaaaaaagctttacctaattctgattctgatgatcactctcattaccctcggatccctctgcttccttctccttcttctttccagcttccaactcgcgaaacgccttcccgatcgctgcagcttcagcaggcagaattggctcagcattctcttcttgcaacccgctaaacgccctcgcaatgactgcaggctcaccagccataatagcttccttttccgcgttcaacaactcgctcaacatcttggccatcgctctagcctcaccagcaagaaggggctcatagtaaacagggttatcatacatgcaagtcttaaagatgagtcttgcctccttacatttacttacgtgatcttcattgttcttctttgcttcgtcgcaacaattctccaattctgtgaatgcttctttacactcacctccctttatgaactggcataaagggcactctccactctcttcctctgtttcatccaaatcttcatctagggttttagattcttcctcatctccttgatcttcaattagggttttggattccttcacatctacttgatcttcacttagggtttttgattcctccacatctctctgatcttcaattagggttctaggtgattcgtcgtccccatctccctgatttgtcgaaggatcttcctctgttttagcttcagccacagagtttatacttcccatagatgacggatttaaggtttttgctacacaaggttcttgctcactctaaaaacctcaattgctgagtcttcttttcttataaaaagggggacacaacttgggaaaatttgccattacttgttttttcttcaaaaatgaatccgagaattattccaagaatggtattgtttgatattgattccccattttccatattcactgtattcgatgaggatttgtttccctttttagttttttttttagttgttgcagaggcaattttgactctctttttttccaaagacaattaaatatttaaatcatttaaagggatcctatcatttaaagttaaacccttctataggctggaggaggatatggaaaatgagaaatgatcttttatttaataataggaagtgggcaataccggaggtaataagtaaagccatgctttgactgtaaattgtggttcgaagctgtgaatatggatggattagacgtaaagcataaacaggaagcaacaaagaaagtgcaaagtctgaaagaaaatggaatagctcaaattaattcttaagcaagctaattcgtattgttgcttcgttgatggttcatggctatctccaaaccaacctgcaggtattggatgggcacttcgtgataaggaccgatatattgtaactagcccaactcaaataaaaggaccgatatattgggccgataaattagagtccagtgataactttttgttttggtataaacaagtgaataataataataatatctcctagttagaccaatcgaaaaaacaaatgaaaaagcttttgtaatctatgaagtttgttttggattataaaaaaaaaaaaatctatgaagtttgttttcgagtggagaaataaaatatattaaaaaatatcttaaacggtgagatattttatcttgaaaaataaatatcttgagaatatgtactttcagaaatcagtaaagccaatgtaatccacttgtggacaaatttgaaaaaagccgacaaaatacttttctaaaaaaaactggcgtctttggaatggtatttttgttttgaacgttaaagattaaaatttaaacactaaaaatatgtttattgaaaaagaaaatcctaaaaggatattgtcgaaaattagatatcttccagcaaatttagaatcaattatcttcttttctttgttctttcattttcttaatttaaggcggaaagaatacaagcaataaaggaaaaatagaataaaagaagaaaaaagcaataatgacagcccaatccacgtagcttaccaacttgagaactgtgacgaatatataaaccacaaaaaaaacatttgtttatgaaatcagttgttgagaagattacgtagctaaagaagataacacattctctcaccccacgagactcacgatctacgagtcactcacacacactaaccaatcggtcaataaacaacacaccaataatatcttcttttgattacttcaaccggtcaatatcatctaaaagtcaaattcttgatcccacaaatcacattcttattagttagagtttactccttccaatcataattcgaacccttcaagattttcttctctctatctctctgtttctctctgtttctgagatg

SEQ ID NO: 32818 - DNA, 3003 bp, Unknown
  misc_feature (1)..( 3003): 2750-1469P.txt file - cDNA_ID_3061657; gDNA_ID_1620385; Annot_ID_155424
ataatgaaacattggtttgtcttattacagtatatacaccccttttatttaattacctttaatctaacatatctctcaaatcttatctggcttcacattttgaatttgagatttagctggatccagtatttgaacgttttcttcatcaacataaatttttgctcaaatcagtattttcttttcaaatcgatatataaaagctagtaatgatttcaataactagtaagaatataggttcatgttcagtaaaaaacatatataactcacatgatgttaattccagacttccagtattaagctgttagaaattatttgttgaaaatcttggggatatatgatatataaagaattaaagattagctaggaaatgaatcaagaaattgattatttaattcaatttaaagaagcaatacacacctatctaagcttatcctcttatgacaattaaaaatatcacccacactaatcagctcgattataatgtcttaaagattgggttttgtcaaatgcatcgattctagggttttgaaaaaagacaacaagaaacatttgcgttgcttttatttaaagctctgaatttcctggtgtctttaattttttattatattatacagaatatattttattatattgtagggttattaaattatacagaatattagttgctcctttatgaattttgatggtttcctcttgttattttgttgcctagttgggttccttatctcacttgattatttaagtaactaattaatcattttaattaaaaaatatattcttttgtaaatatatgctttaatttttcaaaagatatatttgtgataattcaaggtcaattagtgtaagttgtctggttgttcagatcaattattgtattcaagcttctcctgattatgataaatatagtcttaccaccaatcaatttaatttccacaattagatgtccttggccgcattaataaatcctcgaaactgatatttgcttaagataagaaaagtaaaataaagtattcgtatatataaggttttagcgagctaaatttaatttgatataccgaatcggcaaatcccataaacaacctccgatcaaataaatccttatcaccgttacttgttattgatacaaacttacttacttgatttgacaaaaaaaaaaaaacttacttactttaaaacgtaactcttgcatggttggaaaagccatacaatctttttaagtaatgattgttgaccagattcatgtaaagcaatttgttatataaattatgaccattttaacgacagtatatatatttaacaatgtaattaataaatctacggttaattttgcaaaaagaggcaaaataatttaattagatgaatgacaatttggtagataagaaacttaatgtattatttagttgatagtatttttgagttttgaaactattccatctaatattttggtagatggctatagtaataaaataagatgcaaatcttagttaagaaaatacaaatgtaaacttacatggcgataacacaaatccaattaaaattttgaatttccacagagaaatcatataagttaccataaaaatgataaccctcaaaaacttagatgattgataaagttgctaaagacgaattcacgatcattattatagaggattacagttctaaatatttacagatttattatgtttatatataagtcatgcatctattcctattcaattctattcgaagttgaaaatgcacccatttcgcgtagactatagaatccatatgattaaactatacctagctaaatgcatatatttatggaaaaagagactataagtcaaagaacaagagtttctagaacaaaaatgggagaaaaattaaaaacggcctagacatggaaattgatgcttactttaagatgaagtcaatcttattttgcaaggagtcgtaaccgtatatgtatggtcttctcgatatcgacgttgctccttacgacgcacgcattttcatacataccttcggttattttctttcttctaactgcactttctatagttgaggactgagtatgtttgaacaaagttgttcttttatggttctcgactaattttatgatgggcatatatgtttcgattggtataaatgtacaaggaaatgtcggaattttaataactaaaaaaaactgtgtaacaagagaatccacacatacacattttgtcgtcatcgccgagatttagtatactggccggctcagtgtttatcatttatttttttgttccagtgttcatcatcttgttaacggaaagtaaaaatatttataatttgaagtttatttctttggtcattatacattatgcaagttctgaaaactcacttggtttcttacccaaaatttctatcataagaaagtcagaattttgtatccctttttcattagaaattgaccactttataaacttcagcaaattatccaaattcaagaagtaaattaaaatagctaatgatatttgattggctgtagagggaacatttcaacccaagtcacgacaaatcaagatgatggtttgtttcctgccctttaatttgacctattaattaaaatatataaaagtgataattggacaaatttttcacgcaagtgtttctttacgttaatgattattaaaactgagacaacttttaacctttttcaaaacaaatgatataatttaattagaggtttagaaaactaatccaaaatgcagaaaaagcaaaaaccctagttagaaaaatatacaattagggttgaagttgaattatgagaaagacattaaaacgcggagaggacttcatatagtattttttttaatatttacttttcagttataataatcatcaactaatatcctctttttctcgtctttatatatcatctcatccaagcattagatcatttcatcatcacaccaaacataattaacacttggaagagaacaacaacgacaagatcaagaaaagacaaagatttgtaagaaaatg

SEQ ID NO: 32819 - DNA, 3003 bp, Unknown
  misc_feature (1)..( 3003): 2750-1469P.txt file - cDNA_ID_3061661; gDNA_ID_1620385; Annot_ID_155418
tgttccaggtgatttcaactgttcatatacaaaaaaccatttcagatacaagaactttataatatgcaaaaacgaaaaacagagattgttttgttgaacttacgtaaagtgttgtgactgttcctgcggagtttccagggacaagcttcatttgcatggagactttaccaaacaagtactcgtttttggattggaatccagaaccagaggatttatctagagataaagtgagaagctctccattgttcttgatctgtccacgaccatcaccccaagtgatctcaacgtctctttggaaattagctgaaacagaggaggtgatgataagagaaagaaacagaggaagcaagtaagtgatcgccattttctagagattgtagatattcttgtattgagttagattggtttgtggtttttgagggtttatggaggaatgtatatatagtaagtgagtgaagaagatttttaagaggcggttcgtatagaggaaggttcgtatggcgaaagaagaagccgcgtctttgaggcaacagctggtgattgggccatcttgtagtaaaagcctgtgttttatttattggctttggaaatcacgcggtttttgtttagtaatgttacctttttttagtaattaattattacttttatttttttggtttcagatttaattggatttgggagttttttcctcagaaaaagttggatttgagagttggattctttaccaccggcttggaccgaccttgacagaggtagagttttagtctaatagaaccaaattattctgttataaaccaaaaaaagggggaaagtgttggtttttaaaaagttaattaaaatatgataaaacttttgagattttttttatctaaaagtatttatacgattttctgacattattcagtggttttccaattttgtagttcttttgttattactcttgagtgttattattcactaggtagtaatttttaaaaaatgaaattgaactttgagtaatttttgtggtctcatatttgagtttttttttttttttgattgactgacacttaacaaatttagattggttaaggtgctaaagaaaataggataaggatcaacattgtattttatgattttgttttattataaaaaagctttgatgaaaacaaaatttgaaacggggataagaaggaagatgccacgttaaagagtggatatggtagtagttggtaaaatgatgaaattgactgactcaaatgtttaattgtcgtagtggagacagctaatacattcaacttggttggttggttacggtcgtggtcaggaagcttcttttgtccaaatggctagatcctgtgatgagcagtcccaactcttacgcaaagtctagaattcagcatttgatttcattttcttttacttcaattctcttaaatgtttttttgtagatatttttctttacgaaaagttttgttgttttggatttgatatgtaaaggaatttctttttgtatcattataatatatttgctaatttcgggggttataatcctctatcttttaaataattgaaatttacggatatggatttcgaaataatttcatgaccgcggtgaaaatcccaattttaatatgatgagagacacatttcttaagttttgggtgaggaaagattaacaggagatattaaagactatacgtaaaacaatatatcgttatgggcctatttaaataaagcccacgaaacttccgtccgcttaggtgaaaggtttcaaaaacaaaaaaaattggtcattggcgcttcgtctcgtctagttgacttgctcttaaaggttagtcttgattctcttatagagttataggaatggccttattacgattgttaaaatttcgcagtttgtatgttagaatatcgtcatctccggcgatgaagttgctcaatgattttttttacaacctatatctgaccagttcaaccggttagcagattaatgacgaattttcccagtttgaagttaccggtttctagtactaaacccaaaccgaaaaaaagttcggattgtgggttaaccagtaagtctaggtcaggcgtgaaaacactggtaagaactcatattagtaatgtttgagacaagacaatgacattggtttttttgatgtctcacaaactttaagggaaaaatcctaaaagagactcaaaataaatataatttggacgtttaatacccaatatttttttgttggaaaaaaatatctcaaataataaaatacttaatatataaattattgatagaatcaaactcacgttaatagtcgctaagggaagtaacgtagccatttaacgtcgttaaatttaaccatttgaatatatattagatgttttacggtttatacaatgatatatatgtggtccagaggttaactatttccacttctacacatgacaccagggttcgacacctgacaagtttttcttttaatttttttttttttggtctttgtcctcgccgtcgacgacgtcccagagagatgatagcccatgaacaagagcctccaattccaaaatttcaggcttttaaactcttcccctcctagatcgatctccaatcatcacatatcgctacacccacatcattcaatcatagctctcgtatctccaatcatcttttcattcacctaatcttacaataaacgctaaaactctcatacccaatcgcaaaagagaatgaagaagaagctccagcgtctaaagagtacggattttataactgtggccaaatcatcctccaattgtgctatccgggatggtggtcgacggcggctctagggcgaaggaaaaaaaaaattccaaaaattaattccaaaaagactcttgagagtcttgattccccattttccatcttcactgtatttgatgaggattttttttccctttttagttttttttttacttgttgcagatttgactctcttttttttttccaaagacaattaaatcatttaaagggttttgcctctgatg

SEQ ID NO: 32820 - DNA, 3003 bp, Unknown
  misc_feature (1)..( 3003): 2750-1469P.txt file - cDNA_ID_3061685; gDNA_ID_1620386; Annot_ID_155443
ataaacaaccaggacttgatcattccttgctcaaaaaccacacaatccaggtatatatatatatggtttcagaaattcgtctgctacatacattttagatttttaaaaatgtgagttttgaatctggctattgtttttgttaagatgaaaccatcattatcaagacatgagctaaagaatcaaactagcaacaacaaaacatataagaaggacatagaatgtccatatggaactattcctgtattgagaaacacaaaagaattcaacaccaaagcccaactcttggctgccaagtatttcaatccgttatcagctgatagccctggaacacatgtacgcattcacttttctgttaataccttagatctaattatatattacaagtgttcatgtatattggtagatcgctggggtaaagcaacacggtggtccatatcatggtatagaagctaagtttaatgcatataacctaaacattggagaagatcaagcctcatatagtcaaatgtatttaggcagtggacattatggcgaagtcaatttcatttcaacggggatgatggtacgttttacattttattgttcttttttttccttaaaatctattttacgttatgggtagtcttacagtagtgcaagtctttttaacagataaatccaggcatttttggtgacggacgtctttggacatatggattttggatggtaagcatgtgaacatattatatatgctgaaatcattaaccaaataatatgtaaatattacatatgattttgatagggtaaaggtggaaaaggatgttataacatggcatgtccagggtttgttcaagtatcgaatgtggttcccttagtcaaacccatgtaccttaagccaggggagcctgcatcgttgcaatgggccatccatcaagtaagtttttaattttctacacttcgtttgttttttaataatatgttttgcagattttttgtttgtttcaattattttttaaagtttctaggcaatattttcatgtcattctcacttagtagtgaaggatttatgattcttaaaactaatcattaatacaatcaaatcagtgatatcagactatatatagcctttttggtccaaacactttgattagcacatgattttactatgattttttttttaataaatgaattttgttttgtctcttaaaaaggatgaacaaacacgaaactggtggattatacaaatgtcgccttatacatatatcggttattggccaaaagagctattttaccttatggataatggtgctactatggttggagttggaggtgtagttcaggcttcaccttctggtttaagccctccaatgggtaatggtaaatttccggcaaaaggtcctttgagatcagccatgttttccaatgttgatgtcttatattccaagtatgagaaaggtaaaataaatgcgtttcctatagtggagttgctagatagtagtagatgttatgggctacgaattggtaagagagttcgattttggactagtccactcggatactttttcaattatggtggtcctggaggaatctcttgtggagtttgatatttgcgagtataatctttgaacttgtgtagattgtacccaaaaccgaaaacatatcctatataaatttcattatgagagtaaaattgtttgttttatgtatcatttctcaactgtgattgagttgactattgaaaacatatcttagataagtttcgttatgagagttaatgatgattgatgacatacacactcctttatgatggtgattcaacgttttggagaaaatttatttataatctctcataaattctccgttattagttgaataaaatcttaaatgtctcctttaaccatagcaaaccaacttaaaaatttagattttaaagttaagatggatattgtgattcaacgattaattatcgtaatgcatattgattatgtaaaataaaatctaactaccggaatttattcaataactccattgtgtgactgcatttaaatatatgttttatgtcccattaattaggctgtaatttcgatttatcaatttatatactagtattaatttaattccatagatttatcaaagccaactcatgacggctagggttttccgtcaccttttcgatcatcaagagagtttttttataaaaaaatttatacaattatacaatttcttaaccaaacaacacataattataagctatttaacatttcaaattgaaaaaaaaaatgtatgagaattttgtggatccatttttgtaattctttgttgggtaaattcacaaccaaaaaaatagaaaggcccaaaacgcgtaagggcaaattagtaaaagtagaaccacaaagagaaagcgaaaaccctagacacctcgtagctataagtaccctcgagtcgaccaggattagggtgcgctctcatatttctcacattttcgtagccgcaagactcctttcagattcttacttgcaggttagatattttctctctttagtgtctccgatcttcatcttcttatgattattgtagctgtttagggtttagattcttagttttagctctatattgactgtgattatcgcttattctttgctgttgttatactgcttttgattctctagctttagatccgtttactcgtcgatcaatattgttcctattgagtctgatgtataatcctctgattaattgatagcgtttagttttgatatcgtcttcgcatgttttttatcatgtcgatctgtatctgctctggttatagttgattctgatgtatttggttggtgatgttccttagatttgatatacctgttgtctcgtggtttgatatgatagctcaactggtgatatgtggttttgtttcagtggatctgtgtttgattatattgttgacgttttggttgttgtatagttgatggttgatgtatttttgttgattctgatgtttcgatttttgtttttgttttgacagctatg

SEQ ID NO: 32821 - DNA, 546 bp, Unknown; identical to SEQ ID NO: 1312
  misc_feature (1)..( 546): 2750-1469P.txt file - cDNA_ID_3061695; gDNA_ID_1620386; Annot_ID_155439

SEQ ID NO: 32822 - DNA, 3003 bp, Unknown
  misc_feature (1)..( 3003): 2750-1469P.txt file - cDNA_ID_3061732; gDNA_ID_1620387; Annot_ID_155493
tgtgaagatatgtctaaggtttgtgttatcattgctgcaggtgctcctgtacattgcttttgctttggtactgatatttcctttcgatattttctacttgtcaagtcgatattttctgctgagaacattatggaggatagcttttccactgcaggtaaagtgatagacagctgttgattaaaattaaacttgcaattggcgaatttctaggttttgcttaatagctggtttataagtgttatgcttgatcagtgacgtttgtgtttgttcaaactcttacattactttggtatctttgtataaattcattcatttaggcataaatatctgatcctgtttcttttgtttcacagccaattacatttccagacttctttttggcagatattctgacctccatggtaaaggtattaaatttcaaccagttctctgagagatcttcctaacttctaataattatgtggttaggaatatattgatagcaggaggcttagtataacttgtgccttttttattggccaactactgctctttagcattttattttgtgctgataactataatgccgctgatacttgattctcattcaagatttgacatcggtaactatatgcaggtcttttccgacttagagcggtccgtttgccggatggtgcatagacaggtaattgattcatttttttgtgacatccaatgtagattagaaatatcttatgctggaggaactagttccatttatttcctttgatctctggaatatatggatagctctgtagctaccaaaatttatcctccaagactgaaaaacagcgggatatgatttatttagccaaattttcgctatcctagttttgctgatgaaccaatggaaatcctggttgtctgtctaacatgcacgggtctcataccgtgttgtctgttgtgaaatgatggaatatatgagattaaaatggactttcaggtcgctacaattgcttggtttgaagctgacgctgtctgtggcagtcatcaaattgcaatcccattggttcttgttttcccctacatttgccgtcttttgcaatgtcttcgacaatacaaagatacaaaggaaaaatcatctctattaaatggtaaaagcctaaccttctagcattaatgttaaattttcccacactatgaagaaagatgttcttttcctaccatcaatcttatagttgatctgtgattttttcagctctgaagtattctacagcagtacccgtgatcttcctttctgcgcttaaatatcacgtgatgcccgagagctggacatcattttaccgaccgctctggcttttctcaagtgtcatcaactcactgtactctttctactgggatgtaactcgggattgggacttgaggtaataggttgaaactgcatcttcctatccactaagcagtatttgcatatcataatcacataacttctctctgttgtgcagcggtttcactaagatattcaagtttagccgtccaagtaccatatcaaacttattatatggccgacaatgggtgagattcagtttccaatgaaaccgccatagtgttttcttcgtattgtgatgtctgaacctgtcaagtattgttgcaggtatatttctgggtgatagggagcaatctggtgctaagatgcgcgtggacatacaaattatcagcacatttgaggcacaactacataacggtgttcacaatgacagcgatggagatgttgagacgatttcaatgggtatttttcagagtagagaatgagtggaacaagatcactaaatcacatccaatgggtgagatttcacttgaagaagataaactacttggttctactacacctcatgatgtttagcatccaactatttttgtttatttcctctaatcctatgcaaaattctggttttcctattcggactctagacacttttagattatacacaatttttcatgaattgaaccaaatttaatgaatgacatattaataggaaaaaatattttcatactgtttaactgagacatcagattatatacggagatctgctataattaacctacaaatttttgtaaaattacctaacaaaaaaataatatagaccttctaagaacattttccccccatatatggtgttaaatttaataattctaagaagaagaaaaatctgagaattagggattgaagtttaatttagggatttatttgtcgttttggtcacaaacatagagccgataacggaggataacgtcggctaatgggtctgttaaacgatttaacgacattggacctgctcaacggaaagatcatgttttaaatattggtcaacgataagttgatgttttaaatgggttactatgaagttgacttattgaatgaccactttttgaaagttaagggattaaacaacatttttctctcattttagaatgtgtgtacaacatttatatcaaatttaaaaataataatattgaattttaacagtaaatgaatgttctcatttttcacatttcattctctatttttattatttttacactcatcctcactttcctctccctgtctcataatcccaataattatgttacgatatttttactctataatttgagttttgcattattgttcggttgttaaataaagtggatgggtttaagtgcttaatcacactttttaatataataggctgttacacctaatcgtgagagtaaataattgaaggcgaacaatggaatttatccctaccaccatttgttattaaacaaaaatattataaaattatatgtaaagaaaataaaatatagctagatattgataaagagagtagcactaataatgaaaagcaaattccaagttgcccacttgcaaatcaatctttcacacaaataaaaacaaagcccataacgtttcctctcttcaaagtgcctatatcatcaacacaagaaacaaccaaaagagactaaactaaactcctaaaactcaagatcaaagacaaagagatg

SEQ ID NO: 32823 - DNA, 3003 bp, Unknown
  misc_feature (1)..( 3003): 2750-1469P.txt file - cDNA_ID_3061759; gDNA_ID_1620388; Annot_ID_155533
aaacacaacaaattaatcatatcctcccaatgtttaaaactcaagcttaagagttttttttctcctgcaagctacaatcatttttgatagaaaatttataccttttgatggattcagaaatcagaagtctccttagtccttaaaaaaagaaagtttagtacgctaaaacaaattcaccctaaaactctataaattgcctatatttccattgggttttcccgcttttttcttctcttgtaaatttctataattttccatgttttagaagctaagttagttaatatcaccagaagtcggtttaattaataataaattctcaggccaatggcttaaccatgcgatgatcataatcactagattgttaattcaaaactaatcttgagtattcaaatgaaactacaaaatcaaacataaaatgcgtgatttgtgaactaccacatgataataattttagttgaagagttttaacgtttactagggaatatatttccatccaactatattttttcaaggatatacataaaataagacttttattgtttcgtaaaaaatgcatttagttttaaacaaaaatctaaaatgatacttgtaatgaatggagtagtagaaaataaaaattcaatgcatatagtaatagaatattcacaatcttatttaaaattccttctatataacaccaaaatgacaggcaaaagacaggtacaaaaagcaaaccaaaacatgtaatgtaataaactcatcaaaaacagagctctgtttatcttttcttccgtcattcgaatggctgatcagattgagatccagagaatgaaccaagatcttcaagaaccattggctgagatcatgccaagtgttttaacggcaatgtcgtatctcttgcaaagagtatcggagaccaacgacaacctgagccagaaacagaagccctcaagcttcactggagtaaccaaaccttccatttccatcagaagctatctcgaacggatctttgaatacgcgaattgtagctactcgtgttacatcgtcgcatatatatatttggatcggttcgtgaagaagcagccatttttgcctatcaattcttttaatgtccataggcttataatcacaagtgtcttggtctctgctaaattcatggatgacttgtaagtaaataattctgaggctaattaactttttgaaatttactaatgagttaacattttgtttaattgttaatatctttgtgtaacaattttaggagttacaacaatgaatattatgcaaaagttggaggaataagcagagaagaaatgaacatgcttgagcttgacttcttgttcggaattgggtttgagttaaacgtcaccgtttctactttcaataactattgttgttttctacaaagagagatggcgatgttgatgaagatgaagtctctgtttcttgaaccttcttcattcaaaatctcttctaagacgaaacttgtgatgtatccacacgaggaagactctttatctactcaccacaacaagaagcaactcgctgctgcttgattatatttatgcattgggtcgttatcacgttgtgtgatgtaaaacctttttatatatccgagggttcttgattagtgatgttagcttggaatttgttttgtacatctagagattggtttctttactcgatacaagttgaactaaatgcaaatctgataatatttgttttcatcaaatgatcaaacacataccaaaaacactaaatatacttaatattgataccaaaaaaaagaaagaaaagagatcacacttaagagacatgcagacattataagatacgtcgagcgcataatctatataaaaagcatacaaggcaaaggaagataagttacatttaacagaggaccaaagtccaaacctaataatcttttaatattgcaaacgcttatactcctcccaaaatattatagttgggagaaattaccaaatcaaacgtccttacggatgaatcttactaccatggctcaaagcggcaacttcaccgttgaaaccaccaccaccaccaccgccaccagaccgaccatttccgcttccgtaaccatatccaccaccacgtgctccaccacctccagaaccatatccatacccggtacctgatcccgatccagatccataaccgtatccggatcctcttccccatcctgttggtgatctacctgagcctgccccgtaaccccatccagatcctggagcagagccccaaccccaattgtactcccaattcggcccacggcccgacccactttcgcctggcatgttacctctcgaccatgcaaacggacgtgaaacagaagtctttgcagtgattaaaaagaaaaaaaccaacaagagccctttgatcattttcgatatattcttagggtttattttcttttatgttttacttcaaaatcttgttttgttatgaagttattgtaagaaagcttctgccaccatttataggcaacaacggtccgtaacaagttggtttgatagtgtgagatgggccagacacacccttttgttaagtcgtatctcgaaactaaagaaattttgttaggaaaaaagattaaacaccatttttttataattgtttacttagacataattatcaactgaaaataagcacctaacacctaacaatataattacaagttcaatcatgaagtcactagctacgaacccttttatcatatagatactaattaccatgacttagtgcccaaattttttttactatgattataagattattgttaattataacgatattgccaaaaacgaaatgaaatgtagcctctattatagttggtattaatgtattatacaaaaagtcaaatgaaatgatgactatttgatattattactgatctacttgagtttttttgaagtagaaaacattatccttcaagaaccaatttaagatgcatctcaacgtcaatcccactcacaaattttctagttacgggcctgtgatctgcaaatgatg

SEQ ID NO: 32824 - DNA, 3000 bp, Unknown
  misc_feature (1)..( 3000): 2750-1469P.txt file - cDNA_ID_3061767; gDNA_ID_1620388; Annot_ID_155526
tcctaagttacccatatttttatcaatatcaatcctaatcttaatataactggaatttacttacttttatcttcatccatattagttaatatctcatatttcctaagttacccatatttctatttcttccaaagtttttacatatatatactcctatatatatttgcgataaattcagagtataatttttttaaataactttgtgatataattcgatccaatctaaacgcgttgagatctaattggatacttggaaatttagatcaatataggaacaaagtcctcgtttccttatttagggaaaccttttttgtttatttgtttattgcagtcagtgtgtgacacatacaaaatctacggtggtaaaaaatatgattagtttgatcaaaaattaaaatctagtaggttctgagttttagatttttatttaatctcgactaagattccgattgcaatttttatatattaaaataaaataaaaaaacatggtaatctgacaaattgagagattccacctgtttaatgtgttttttcataactgaaatttacgctttctaaagtacattaatagcagcatatttataaacaaaaacacattagcttatagtatttaataccttcaaaatgataaatttcgtttgaactctttataaggtaaaagcgtaccctttaaaataataaccacccaagtcccaaatgtcatatatgaaaatggtttacgtattttttgtcacgagatgtaaaatatttatatgcaaaagctcctacacgggggactttttggtattctttcataaaaatagatcgtgctttagtagcattagcatccatggcgaatcgaaatgggtgacaccttttagtacaagtacttgggccgcaacacttggggacaattgggttttgctccaccaccataacctaccattaatttatgaagggaatattaaagcagaacagtgtttaatcttgctaatccaaattcttttcccggcaattgctaaatgtgaaaaaatcattaacgaaaaaatttgaacatcactaatatagtacctttggtatctcagggattgacaaatgctcaactcctcctaaaggcatatcttcttccacatgcttatctccttccgccggtttatctttttgtggcggtttgtcttcctccaccggtttatctccttccgccggtttatctttttgtggcggtttgtgtccctccgccggtttatctttttgtggcggtttttcttcctcagccggcaatttatcctcctcgaccggcttatctcctttcagcagattgtcttccttggatggcttgtcttttctcggcagcttatctctttctggcggcttgtcttccttcaacggattatctcctcctgattgcttgccactttctgccagcttgttaggcccatcaggcctacctcctcgtgcatgcaaagtagctctggaatactcttctttcctaagtgtcattcacacatacataatgttaactaacacacaaaataaaaatgtggtcaatgcatgtatgaacaaatttcaattggtacaatcaaagcattagaagagttaattagttactttaacttaagtaattacttgtagagccatatgaggagggcgatccccaatgctccgaggctaccagaagctaggaaccccgttgccaagaaactcgatgtgattaccgccggtacgagaatcggactaagaaccaccaaaaccggtatcataacggttagagccacggccgtaccggcaaaggttaaaccggtgaggatcatgaaggatacgacggctataccggcataaataggagctttgtctttcgtgccaaagaaatgcatttggcagtaatagaaattttgttacaacgtaatctgattgtgtattaaagagtgggtccagtggtgagatcgacgtgtacgacacatgactgaagagagtatttgtcctgtccatgcatgcaactgacacctttgttagtgaagttgctctacctcacgccaagttacttcgctttttttgttcacatcttttttgtatgtattaaaaaatttcacatttttttggcctcgttcgtttacttttcttctttcgtaaacacacacaaatttgaaaaaaggaactcaactattatatatcaatttgaaaaaatcgacacaatatgtgaaatgaaagatatgaactagagataattagcaggcaaaataaaatctgataagtattgcaagtttgcgacgaacaaagagtgaatcaaaagactgcaattaaacaaaaaccacagtatctgcaggctatatgaaactacaacttcaaaatgttaccggataaattagtttcaattttcgacgatatgtagcatagtgtggttaattatattgacgaaacctttgtattgattgcaattataagtgtaaattttggcaagttgatgtgtaagctccttcgtggatccaacaaataattaacagctatggccgatggcgttgatgagtggtcgcttctttagtcatagcggtcagacaattcaacttcattttattttatttatttattttgccatcattcaacttcatttcttggatgaaacaaattcaacattcaaaatttttttttttttaatatatatataaattatagatattccattatactttagtttccattgaaaccactatttgatggatgattcttcatttattcttgtcgaccaaattaaacttctaatggttttaggtctgattagtatttctttcaaaaacaattttcttttaagagaaaaggtcatattactaaggaatagcaaagaactaaaactaataaaacaactagctctaagcgtttttttgtgcatcactataacaagagacgtgcacttttaattagtagtttagtactatataaaaccctattacttgtgtggatttcgaccaacctataacaaacaacgtttcggtataattttaagaagaatatatcacaacaacaatg

SEQ ID NO: 32825 - DNA, 3000 bp, Unknown
  misc_feature (1)..( 3000): 2750-1469P.txt file - cDNA_ID_3061771; gDNA_ID_1620388; Annot_ID_155515
ggactgtgacggtaataaatattctgttggtgccacgtgtaataagtttttctcttcacaaaaatggtccttcatcttcttttagtatctcatttgtgacctaagcttctaatttcacagcttatcatccccttaatgttttaagttttttgaccatagagtaaaattattttactataaaattaaaagcaaaaaataaaatttactataaaattataattataaaaagtgaatgtaaaaatgattccataaatttacatgattgatagtaattattctgccaacttaattccacatgtatatcagtatttatatatagaaaatgatggtttttctacatagtcaaattccaaaacaaaatatcagtattatggaattaaacaatcaaagtttgcaacttggtatgtccaatatcatcgaaagagctttatcattcagtcgttgaaaaaagtatagccatctttttcttctatcgattttcaaaaaaaaaaaaaaaaaaaaaaaaaaaaaaaaaaaaaaaaaaaaaagaggaagataatgaaggtaggcagtgaaaagtctttcttcacatgtcttttattgtccactttcgatatctcatcagccagaaccgaaacaaacaaaaactataagtcccacactcaagtcaattaaagcactccaatggtccaacaagtttcgtcgtctaccttgaaactcaacctttggatgattgatatacaaaaatacaggatctaaaaacacctaccgaacttgaatagtaggtgtgttgtgtttgagtgtctctctaggtaaacatggtagcagaagaagcaagaaaagaagccatggctaaatcagtatctggcgggaagattacttattttgtggtggcttcatgtgtcatggccgccatgggcggtgtcatcttcggctacgacatcggggtttcaggttcacatatatattcttgctaattaggatatatatgttctttcttttttttgtttgtgtttgtgtttgcgtttgcaaaaagaataaatcatatttttgaagtagaaaacattttagtttttcataatatttaaatgaaatgttgtggttctctaaacctaaacataaatgcaaacatgtaactatataaatatgtaggtggagtgatgtcaatggggccatttctaaaaagatttttcccaaaagtgtataagctccaagaagaagatagaagaagaagaggcaatagcaataaccactactgccttttcaatagccaacttcttacatccttcacatcttctctatacgtttccggtctcatcgctactctgttagcttcgtccgtgactcgttcatggggtcgcaagccctctatatttcttggcggtgtgtcctttctcgccggcgctgctcttggtggctctgctcaaaacgttgctatgctcattattgcgcgtctcttgctcggcgtaggagttggattcgctaaccaggtaacaaaagacaagttgattaatgatgtttcaattttctctgtatgttgactggtttgttgttttatattttagtcggttcctctgtatctctccgagatggcgccggcaaaatacagaggagcaatcagcaatggtttccagctctgtatcggaattggatttctatctgcaaatgtaataaactacgaaacccaaaatatcaaacatggttggagaatctctttagccacagctgcaatacctgcttcaatcctcactttaggatcactgtttctcccggaaacgccgaatagtatcatccagaccaccggagatgttcacaagaccgagcttatgcttcgccgtgtccgtggaactaacgacgttcaagatgagcttactgatctcgttgaagcgagttctggttctgatacagattcaaacgcgtttttgaaactgcttcaaagaaaatataggcctgagttagtgatggctttggtgatacctttctttcagcaagttactggaatcaatgttgttgctttctacgcaccggttttgtatagaaccgttgggtttggagagagtggttcgttgatgtcgaccctcgtgactggaatcgtgggaacctcgtcgacgttgttgtcgatgcttgtcgttgacagaatcggtagaaagactctgtttttgattggagggttacagatgctcgtgtcgcaagttaccattggtgtgatcgttatggtggctgatgttcacgacggtgtgatcaaggaagggtatggttacgcggttgtggttttggtgtgtgtctacgtggccgggtttggttggtcttggggtccattaggatggcttgtaccgagtgagatttttccgttggagataagatcggtggcgcagagtgtaactgtggcagtgagttttgtgtttacttttgcggtggctcaaagtgcaccaccgatgttgtgtaagtttcgagctgggattttcttcttttatggagggtggttggtggtaatgacggtagcggtgcagctgtttttgccggagactaagaatgttccaatcgagaaggtggttggactttgggagaagcattggttttggaggagaatgacgagcaagcgtgatatccaagaaaccaccattcttagccattgaaaacaataaaaaaaccagcacctcatgatttgagatgagacgcatcttttgttgccaaaaaaattattgcatataagttttaaaattttcaaagttcaaactaaattaaggatatttttttactattcacgtaacaataatcaaatcacatgatccaagattcgattattgttcaaattattttgtaaatttagccatagtttcattttttcacttatatgtttgtgaaataacgatttgtgtttggaattaaaattaggggtgttttataaatatagtaaaactaggatagtgataatgtaatatattgaacgttaaaggacaaagatgggaaatagaaaataaagttaggaggcagagaagaaatgggggccataagaaaatg

SEQ ID NO: 32826 - DNA, 3000 bp, Unknown; identical to SEQ ID NO: 1345
  misc_feature (1)..( 3000): 2750-1469P.txt file - cDNA_ID_3061781; gDNA_ID_1620389; Annot_ID_155552

SEQ ID NO: 32827 - DNA, 3003 bp, Unknown
  misc_feature (1)..( 3003): 2750-1469P.txt file - cDNA_ID_3061785; gDNA_ID_1620389; Annot_ID_155549
cattgtttcagctattcgtataaagcaaaaataaagatttttgtgttctgtgtagtaccttcaagaactcaggaacgagctggaatttatctgcagtagacttgataggagctgaaagcttttccttgtcaatgaaatgatcatcattggtcaagctgtttcaatagaaagagtaacattagacatatatctaaatagttcaattaaaatccaaaatcaatgaagaattaacaaaaaaaaaccatactctaaatcttcttgatcaagtcccatcgctcttaactttgcaattaagctgtcagttatctgaaatccatggagaaatataattaacatcaacacatcataatcacaagagaattaaaccacaaaaacccaaatactgaatcctagttttccacaatttcatcaaaattcaaataaaacccagaatttcccagaaaccagtcgttttgagaattgaagacgaagcattgtgatttacagagaagaaacagtaagagaagtaaacctaacgactctacgagtaccggaaatttgtggaagagattgtgaggggattttcgtgtgatttcaaaaaggagattgaagatgaaaatcgaagaagagaacctgcgattcgaaggagattgaagctggagttgatacagtcgcttcgctggctgaagattttacacagtcgaagtcggttaagggaagaggtttaagagacggcgaaagggttttaaacagtatctttgcgtttattacttttttttttgtcatcctttgcgtttattacttattggtatttaattcactttagtagtccttcttttctttttacgttttgaattgttacccaaacttcaaagttgattaatatttgccaataaccacaattggcctctaaggagggtgtattcaaattagaatttaagaagaggctcggtatagtttaaggcaaatgtctttgttttcttttttttttttttggccggaaaacgggagaagtctcccgctttattattcataacaaaagaaaaaagaactataaccgaacaaaacgtaaccttgagaccccattggcatcttccaacaaaatcggattaacaatatccggtggaagattaaaagaatagaaacctaaaggtaaagaaaaagcatagttcgctaacccatccgctagacggttagcctccctatacacatgtgacacacggactaaccagtcccttgataaaaaagccatagcacaaacgtactaggaacgacagggggtgagagtcactgatccctgaagttaaaaaccccaccacaatctccgagtccacctctagctccaacctcgcgacccgcctctcccaagctatgtaaagtccatagtagaccccccacagttctgccaaaggagctgtacaaatcccaatattaagcacaaagcctccaatccaattgccttcctcatcccgcaacgcaccacctgcagtcgcctctccgggattcccatgcgacgccccatccgtattcagcttgacccagccctcatttggtttcctccatgagacttgtcgctctacccgcacaatctccttcgtattcccggggagctttaagtgagcagctgaaacctcatttgccaaatccttaatgaaccgtagtctatcccgacagcggccaacctctccaaaaacatttccacaacgccatttccaaccccaccaagctgccaatgcaaaaactgtggaccaaacactgcctctcacctcaccgtggtctcccagatttacatacaaccactcaagaatagacttctcaaagaaaaggcgccgtttgctcaccgggacaagccgtagccatattccttccattgcagggcaatctctgagaacatggataatagactcttccgctcccttacaaacttgacagatgctcgtggtactcaaatgtcgacgatgcctttcttgattcgtcataatggcttgttgtgctactaaccagaggaagagtctcactctctcaggcgcagtcacgttccatacttggtcaaagaatctcttcatatcttgtctcggcgcctcatctctagtaagaaaagaataggcggtgctcactttgaatctcccatcttgactctccccccacgatattctgtctctagctcccgttatatcatctaaaacaaccgattgtaattgtaatctgttataagaagatatatatggagctatcgccgccatatcccaaccgatcccatttctccaaagatccctagctcgcattcctttccaacccgccggaagctcctgaaccaacaactcagctagaggaatatttgttagccacttatccatccaaaacagaatctcccgaccatctccaatcacccaacttaagcccgggattaccacctctctcatacccaacgctacacttctccaagtcgatgagcagacgcttctaactttagtccaagcaccatcccgaacatcttgtactctgtacttacatctcatgattctcgcccataagctatgatgatcctgaattagacgccatcctagcttagagagaagagctttattcatatcctgagctttcctaattcctagcccaccttcactcctaggtttacaaactcttttccaggaaataagatgctgcttcctttgagttacagagctgccccataagaacgatctagacactttgtctaacccatccaacgttgatttcggcaaagcaatggtgctcatggtgtgaaccggaatcgacgaaagcactgccttggtgagtgtaactctccccgcaagcaatgtctttgttttattttgctactttagtctttattgggtttgtggtactggtaggggtttaatttttcaaaactaaagttaagggtttaaattcatgttgttaacaacggtcacgggtttataaccttaaaaaatagttcaccgcatatttaggacaggtcctgcttgtgacatgacctactaactcagcttttcgtcggagatg

SEQ ID NO: 32828 - DNA, 3000 bp, Unknown; identical to SEQ ID NO: 1343
  misc_feature (1)..( 3000): 2750-1469P.txt file - cDNA_ID_3061793; gDNA_ID_1620389; Annot_ID_155547

SEQ ID NO: 32829 - DNA, 3000 bp, Unknown; identical to SEQ ID NO: 1349
  misc_feature (1)..( 3000): 2750-1469P.txt file - cDNA_ID_3061811; gDNA_ID_1620390; Annot_ID_155587

SEQ ID NO: 32830 - DNA, 3003 bp, Unknown
  misc_feature (1)..( 3003): 2750-1469P.txt file - cDNA_ID_3061815; gDNA_ID_1620390; Annot_ID_155586
ggtttgattttttttttataaagtttttttttctattacgaagcccatacattttggtcaataattagtttcgttttttttgttccttttttctgttttgcacgatctcaattttgttttgaattatttttataaaaattaaattataaaataccattattaattaacgacaaagaaataccatttgatattcatattttgtagggttccatattgtcacgtttcattgtgtagctatagccagatgttcaactttgatgttgaaagtttgcgtgggattgtatcccatcaatccaaaataaatacccataaatttaaacttaacaaaatacacttcaaattattatcaagaaccatacatgtgtttatctttctctacccgtggattcaccatgaaatgttcatctagaaacaacagttagattaactcaaactgcaattacataatttgagtcgtctttatatatctacgtaaaagacaagtgaaaagaacgatactactctcttggttacaactaattcgggtaatcttaaggttctatctacaatgtaaaatgaatcgacgacaataggaacggcaatgcgctgtaatttgtgctccaaacaaattaatttctgcatctaatgaatgtagacattaataacaaataagattcatttaattattttaccaaaaagtaaagaaggtccactgaatcacgtgaaatggaccattccaaattcttcggaaactttaaatacattactagattgtctcactcacctaatagtaaaatagtatagtggctccacaaaattgccgacactgtattttgttttttcttcttaaaagtattcaacaaatacatcacatacaactattttccgaaaaaatataaaaacaaatactaacttttaaatttggaataattatcataaatcataaacaattttaaaaatatttaaactatgtggttggagtcagaattcaaattttaggtgggaccaatgtttggattgaaaattatagttttgaatgtgatgcaaaaaaaaaaaattaattgaaaaattacgactaatatttgatattttttttcttttttaattaaaaaattaaaatttgggttttcagtcacaatcttctcaaaatcgtaactaagagcatttccaaccctactctattttagagtcaaaatgcaaaaattttctccaaccctactctataattgactcaaaatagaaatttctgcagattgactctatatatagagcaactctattctcaactctattttttatttcaacttttttatttatactttagtccctcaaatttaaacttttttatttaatacatataatcattttacaaacaacaattacaacacatagttttataaacttaacaaacaaacaaatactaaatttaatatatttaagaaccaatgtttaaaacaattatcctttaaagttttcacacagaaattaagaaatatatttaatatattttttaattcttttattggttaaaatgttaaaacagttaaaatctatttggaatttttattaaacatttacattaaaaatctaaaacgataatattaaaaaataaaattttagttatagaacaacgattaaattaaaaccgaaggaatatatcgcacgtaaacagaccttttgacaaaccgcaatttttcaaaacgttaatttagttgactttttggttacctcgtatcgcgttacttagaccatctccaagaagacaccaaatcaccaaatttggtgataattttgctccaacgtgacactataatggacggcataattgttttttggactattcacaaaacaccaaaaatttatattattttatttatatttttgatttagttttatatttaaattgttggttttttaattaaagacaagtatactattaatattttttaatgttttcgtttttgtaatatcaaattttaattaagttaatataaaatgataatgtgcacaaacttttgaaataaatatcacattaattaaaatttaaaatacataataaagcttaattaaacatttaaaacataaaattacaacatttaaaccaaaaaaacataaaaacaaaatgcaattagataaatttaaaagacataaagaaattctattatttaaaatttatcgattgtaattttatattaattaaattaaaattaagcagttctaaatttaattagtatttatcaaactattaaaataactattactaagtattagtatttaataatataataatgaaaattttgtttttagtgtgagatttagtgtttatggttggagatagaaaaaaaatctgaacactaaaacactaaatttggtattaaaatttagagttttggtgttcaatggttggaattgctcctatagatttaattgttacctttttaccatcattgtatgcaaatgttgactttttggttttggagattaccaaaagattcatcgtctactagttcttcgtagataacatagtatatctagaaaactcggaacgaaaattttataaaatgtggataaacgtgaagtcctaaagctagcaaagaaatttggtcaaacgttagtttattaatttctctcaaaatattagctatttagtaatattacccaattatataaggatagacaaatgttacttacccaacaatatttcaaatagatgctttgtttctacttgatgcattgttataatgaagtggccgctcctttttttttattttgtcaaacattataatgaaataatgaagtatgtttttggagaacaaaaatgttgtaaaattaccaataatttgggtagtggagttggtgtacactttaggcttatattccattaacttaatgacgttacttgtaatcattgtccaatcagtgacgtcatatatgattttccttttgttaatcttttcaactgttatgactgggtgaaggaaattatcatcttcgtccctaccaaatttttcagcagcgaaaatg

SEQ ID NO: 32831 - DNA, 3000 bp, Unknown
  misc_feature (1)..( 3000): 2750-1469P.txt file - cDNA_ID_3061824; gDNA_ID_1620390; Annot_ID_155583
atttttcgttaaagggtaactttttttgatattttataatatatatatatatatatatatatatatatatatcttttctaacaaaattaaaatactttaattaattaacatgaagctcctaaaacaacactcaatgtttttctcttgtctagaatatatagttcattccatgaaaacatagactagtgaaatgagtagatacatcctgataaagtcatttagtaaattgtgaagaaccaaagaccatcaatctcgcttctctacaaactggtcttctttactcgctacagtctcagggtactggcgcgatagaattgagagcttcgttgctcgatatctccttcaagcagcggttcacaccatatggggtgagaggaataggcgaagacatggtgaaccacctaatccgggaactcgactaactcaacggatcgataaacaagttaggaattgtatttcagcaatcaacgcaagtggagatagccggtatgacaaggccctccaagtttggttccactcaagaatatgagtaaactaattcatagataaattgtttatatagtttttttctcggcaaaagttcttgatgtaaaaacgctaattttttttttaatttaatttaacattgcattaaaaaaaaagaaccaaagaccggtccaacgtttttgtttgctctatgcaaactaaaaaaactatcattttaatttttatgcaattttattttaatatatttatgttcatttgttaaatttaccttatatttttacattcttttgtaaagttaattgattcgaaactgttatattttttctgtaaatcaactcttcattaaagccaatggagttgtttttaagaacgaagtatttttatttctgactagatcttctcaaagtttcttaatcatctagaggcaggacacgtgttttatgtttaaaaagttttagaccccatttgatcaaatcaaactgtcagagcatctccattggtcatattaatggatgtttttactatttttataatataaattaaagacatttgtgaagagagagaagagaatagtgtctccaagaagacacaaagacatctcttaaagacattttctacctacttgttacctttttattggttataatgcttttacaatttattaattaaaattttaatctatctaaagacattttacttttatcaccaatgtggttgctctcacaagtttggccccagttggacaaaataattgtcgtccaatgaaaaataaaaactgtagagcaataattatgggtgttaggctaaataaactattttttatggtttcattataattaaatttaattgtgggtgggtctcaactgaccccatattccttcacttggatctgtcttccaagtagcacaaacacattatgtgagagcaagtaacaaacgactcacctagtaatttatccaaacctttgtaaaatcagaccaaaatactcctaattaaaaccggttcgaaaaaccaaatgttgagttattttgtttttgtatgaatgtaaaataatactcaccaaaaagaatgtttacaataaatgcatcgtaaaaaccataatttctaaaaccttctggaaccagaaacgcattccaccttcataagtgcacgttaatgccatggtactcaactgattgcagacatttttatcaatcgttctcttaagcgtatgtgccggtgttgatgtctctccatgacaacgaccattacgctcccgccagagactgtaaatagtgatctgaaaaaatacctcaatgtgaaagtgtatataggtgtagtggacttagccgagattagaggaattatggacctccagattgtagtaaacctatgatcaaggatgccatgagctagagctgaccaaacttgggaggagtaggagcatgagaagaacaagtgatctctcgtctctacttcttccccacgtaaaaaatagttaccactggctccaacattccatttaggcaatctgtcccccgtcgtgagacggttatgaatagcaatccatgtaatgaaagagtacttcgagttgtagaaccaaaccccttgtaccaattactaactggatttacctgacgtgttaagtgccaagtatcttgagatgaaaacttgcacttataaaggctgttttccttttccagagtgggagatctttttcctccacatccacgatcatgaactggtattaccgcggattgaccacagtgatcgatttcaaagcaattttttccaaacccattgaaccctaagtgagtccccaaccgaaaccagacgccatatcaaattcaaaacagtcgtggtgtttgtttctgagagcagtcttcaaaatgttgggttattctcgtaatgtacacatagttgaagccagttacctagtcttacggacgatattaactccaatatcgacgataacccgaacactagcccaccattctaagattatgtaacccaaacagtttctgaattaaaaatataatacaagtaaaatatattaacactagttcccaccaaaaattaacactacaagcttgatcagagcaaccttaatggtagacttaattttgtcttttaactattttgatgaattgttttattgaaaaaaattatagctaagagtttttgtaatggtttgaagctcttatacctacttttatctcttatctaagaaacacttctaaactattcacatattattatgattaattacacctaagatttgtagtaagagacttgcaataaggatggtctcatgtcatagaatgcatgtctccatatgttttatttaatcgagaaaacataaactacaaaatttaatgttggttattaagtttggccccatttgttatccccacatgcactcctctctctttttgtccttataaagttcttctcccaattcatgaaacccaaaaataattatctcttcgtaagaaaatacaaacttcttcctctcttctaagcaactaaactatg

SEQ ID NO: 32832 - DNA, 2548 bp, Unknown
  misc_feature (1)..( 2548): 2750-1469P.txt file - cDNA_ID_3061848; gDNA_ID_1620390; Annot_ID_155563
aagcttattcctcttatctaccggtggaaggtccaccaaaaaatatgtgtgattaggctttaatatttgattcggctctagaggtttggcgcgaactcctaatcgtttcacggtctcggagtctaacagcacgaatccgggatactctttcgtggcgtcactcgccgtcaccggagttttgagccggaaaatatcgccgtcgatcttcataactttcaccttgtttctcctcaccattatagtgttccccatttttctgtcttttttgttgaatatatctcataaagcatgcaacgctatctatttatatgttgaggaggatttggttcaagctttttgattagtgtgtgaagctttgatattctctgagattcctcattttttaataaagtctaacgttgaatttaattaactaattatgttgaaaaaaaataaacgtgaaaaagtcggtcgattgcgatacattttctcatagcttttttcttttaggcattttaaaaagtaatcagtagtcgccatgattatcctaatattaacgactaggtacgtacgttacgttatattcaattctgttaggcggttatccaagttatactcggtcaccgtgttattatagtatagaaattcatcccaaacaaaaaaaagtattgtgatgaagctattggaactcacctaaaaagtaagaaaatcatacatctatttagaaactacgacattttgatcatctatatgtatgaaaaatatgtttcacagatgaaatatgaaaaatatgtttcaaactttatattggtactttatccatatagaaaggatattcgtcatcgcccatcaaagtgcttccagttccgaaaagacttgttttcttacaactaacatcatctttttgttaagttgtaggtcaatccaacctgaattactctatcgttcggcaactttcatgaccgttctcctagaaggctagatagttttgtacgtctcattgtctattctaaatcgattctctaattttcttgctccttttcattccttcctcttatttttttccgtaaatcattctaaattatggctccgtacacaaaaaagcacaagaagagaaagtggaatatataccacatttaataaaagaaaaagttcacattttgagttgttgttacataaggtagtacgtaccaaaaaaacataatctaaagtaaacaataaaaaatgcttactaaatacactataaattaataatgttagaccttgaagtttattaatttatagtaatattaaattataaaaagattacgcaaaatacaatttctttatttaaatttcttttaaaaaaatttctttatgctttcttgtttgtatattcaattatgttaaattttatttttcttttgacttccttaatttctttttatgcaagatagtatatacttatatctatgacatttatgaacttcaaattgtgattaataattttggttatcggaatagaaaagatatcaatagcctattcgactatatagttgaaaataaagcatgctcaaatttttgagtatagaacaaattgtagcttttgtttgcaatgttggtgaagaagttgaaaacgataatattgaacctttggaagtagtaatacataagaaagcaattgtcgagtttagaagacatcagaagtttttgatgcaatatgaaaaattagagatgaattttaacgagatttgaactttaatactagattcgtattatactagattatcttaaaatgtatgcttaagaattaatattattaatttatgatattattgagaccatatttttatataaaaaattttaaaaaatattatcttatcgatttttgttaatttttacattgatccgacttgaaacggataaaatttattaatttatctattaatttatagagtgtttattaacatttagtatatcacaataattagtttttttaatcatataacatctttaatagccaaacaaataaaacaataaaaaataaataaatggaaaaacagttccgtgattttgaaatgaatctggattttggtttaggattcccaaaaaaaagaaaaaaacgtgccagaccaaaaaaaaacctcacctaaccctatctagagacattaacttcgttgacaaattctcccgccgccgggtatagaactttaatatcgggtccggtttactgtaagaaaccaaaccgaatagtcctcaaattagcaatcgaaccggtttgagtccgggtatgaaaacagtgagctttagttaaaaagtctcatgggtcaaacagaagctatcttaaaggtcagctcttgatgccattctccttcccgacaacaacaaccacttctcttccattccacaaggaccacaatcacttcaaccttaatcgaaatctccggttttgctcaaacctgaaataatttgtacaattgtacttaactaatacagttgtgttttgtttttctttaatttgatatatatttgttttttttagtggattttgattgataattttgttgtaagatcgagaaataggagaatg

SEQ ID NO: 32833 - DNA, 3000 bp, Unknown; identical to SEQ ID NO: 1356
  misc_feature (1)..( 3000): 2750-1469P.txt file - cDNA_ID_3061894; gDNA_ID_1620391; Annot_ID_155619

SEQ ID NO: 32834 - DNA, 3000 bp, Unknown
  misc_feature (1)..( 3000): 2750-1469P.txt file - cDNA_ID_3061902; gDNA_ID_1620391; Annot_ID_155617
caatcttcgaacagatctcgtcttttagaaatacattagtttgctagttaattcattctgtgttttcttgtgtatcatcatcatagctttgctgctttatagttttgatgagttgtaaatatatgtttctctttagtaactttgtacatacaacaaataatgggaacaacttcatttaagctccaagtttttgcaaaatctctcaaactccgataaagtgagtatttttagcgaaatagaatgaaaaccatgaaatctctagaagttgccggttcagttgatacttacgacgtacgagggggacagtataaactttatggctcactcgttttctggataggttaagtctggttcgcgaattttcttttgtaaccacgttcttagaccggttacaagcgtggttcttgaaatctatcgaaaacaaaccggaatatacaaaaaattcaaattcggttaatatttaaccaatcataaaatcccatagattttgttctatgaccggtttatttttggtttagataattccagttatctctctccacgagaaacattcgtcggaagacaatctcaattttccgacaatggaaccagaagtaatcagagacaaagactctatgagaaaatggtctcgagccatgagatcacaaggcaagaccattggtttagtaccaacaatgggttacctccacgaaggtcacttatctctcgttcgtcaatcactagccctcactgacgtcaccgtcgtctcaatctacgtcaatccaggccaattctctcccactgaagacctctccacatacccatctgatttctccggcgatctcactaagctcgcggctctttccggtggtaaagtcgtcgtctttaacccaaaaaacctctatgattacggcggtgagacgaagaagataaacgacggtggtggtaatggtgggagggtagtgagttgtgtggaggaaggtgggttagggcatgagacttggattagggttgagagattggagaaaggtttttgtgggaagagtaggcctgtgttctttagaggtgttgctactattgttactaagctttttaatattgttgagcctgatgttgctctgtttggtaagaaagattatcaacaatggaggattatacagagaatggtgagaattggtaacattttgcacaatttcttgctggtatagagattgtagagaatggtaagcctgatgttgctgtgtttgttatgtaggttcgagatcttaattttggtattgagattgtaggatcagatatagctagagaaaaagatggacttgcgatgagttcgagaaatgtgcgtctttcagatgaagaaaggcaaagggtaaagtaacaactcctttatgttctggtatgtgaacaaggatcaaggatggcttactttgtttctgttgttttgttatgatatggtaggctttgtctataagtaggtcactggccatggctaaagcttctgttgcagaagggaaaaccaattgtgcagagcttaaggatatgatcattcaacaagttgttggatctgcaggacgagtagattatgtcgaggtaagcatttcattttattggaagtggagttgaatttcagttgttgtttggatcaatctgtacacacatgtgttttgatgtgagccatgcgattgtgtgcatatgcagatagttgaccaagaaactcttgaaggagtagaagagataaagagtggggtagtgatttgtgttgctgcttggtttggaacggtcaggctcatagacaacattgagatcaatgtctctctctagatctcactgtatgcatcaaacttcatgaaaaaacttggaagcttcgaagctagttatttttgactggaatatgtgacaaaaaaatgcattcgcaaatccaaaagattgatgagtatcatcgtaaactatcagcttcaccatgtttgtgtgtacgtgataggattgaagcaggaatgatatttgcacattctcgttgtctctgttataacctctttcattgcaaacctgagtgttttgagttttgaattttacacacagttttggtattctgtatacgcaagtcggaatgaattaaacatcacaagctggccatgatagagattcatctttatacatataatatgttacttatatggaaagacccgtctgaaggggatcgatcacgagcatcagattactccagagtgatatgatattgaatcactttgacaagctcattgtacaaagctatctgttagttatgcgtgacacaatggacatgcacacacttctggcaatggttaagcaaatgtccgcttttgcactaagagaggctgataatgctcttctcaaatggctttggctgctcctcaccattttaacgattaaataaaaaaatattgtggggtgagagaggctcgaactctcgacctcaggattactcagatagctatgagacctacgcgctagccaactgcgccaccaccccaattgtttactccctttagaaaatactctatcaagcatttcaaatcaacactatcgttctcgtctagtctctgtcgaggaaagagagatttttcacgtacgcacaaccccaatccgcttcttctgctctgctctgctctgtctcaattcgtccttgttgctcttctcttccatgctaatttgaggtttgtttgctacttttcactctagcgtgattctcgtcctttgactatcgattatcaatgtagattggtttccttgttctattttgcttgtaattggtgtttcttcggattgtctctgccattgacactggaatctactagtttggaatctgtatcttggtgctagaactgggattcaaatctcaaattcaatagccaagtctgtatgcaattaggttctggaatttgatttgttttcttcttgttgatgtagagattgggcttgaggatctgtttccgagattacgaaatgctttagtagtgtgagttctaaggttatttaccaatg

SEQ ID NO: 32835 - DNA, 3003 bp, Unknown
  misc_feature (1)..( 3003): 2750-1469P.txt file - cDNA_ID_3061918; gDNA_ID_1620392; Annot_ID_155650
taatggttggaattgtttgtagtgctttgtttcttgtttttccgaccactcgatatggtgttggttgcatgactggttaatttattttcacttttctgttttttggtttgttttagtatctatttcgtattttccttgtaatttagattatctgatttaaactccaatgttctactatttttatctattgtattgttaaataaaatgttgtgttgattctatctagacttgtttgataggaggagtacattatgacgttagtaaaagcttcctcaatgcagtactttttttgttaagatctcaaactatgcaattaattaccaattgagtccgtgatgtagtggaggccaaaaaaaaaaaaaagagtccgcgtgggctttgtcctttttgttgtgtaggcatgtcatgttggcccaaagtcttaatctccacgttgtgttttgtatctattttatttagattagattatgagttctttagatttgagcttatcaacccctgagttgtataagtgttcattgtcttcagtttctgatgaattgataggattaaaaagtgattttttttcataacacgttccttgtttcggcactctttcaaagatatcaacatagtcaagaagacgagaaggtcccttgttcatatcccgcaattctacaaagaaccagcgttatcaaagactaacaagaagaaaagtgacaaaatataagattggaagaaagaagaaaaaagagaagaagaagaaatttcaaatatgtgagggatcgaacaaaccaaaatactagtatttatatggttatgctttgatatcatgtcagaaaattcatcagtatgaaaagaaaattcttaattttattgattagccagtaaaattatctacataaacacataacttgatctacaaattttctataaatacgaagataaaaagtctacccaattagcaataatgaaatggagttttgtttttcctagtaacgatatgaaaatttattcgaatcaatcttgtattgtaatattcgaaatttgatcaccatgttttcattaagcaaaaattctccgttttcaccaagagtcacttaatgaacttagccagcttttacaatatagttcattcaagttcttttttttttttttttacaatatagttcattcaagttctttttttttttttttttacaatatagttcattcaagttcttttttttttttttttttacaatatagttcattcaagttctaattcgagaatgttcaagtcatgtgatatatcaacgagacttgtttttatacgaaaaatgctaattttaataaaacaaaactcaaataacgtttctttagttcggggaaacagtcgaaaaatgataaaatatgtttcctaagaatctttatcagtcgtgcctccaagtggggataatataataaatgtaatgaaaaaactttattatatagtatatatttgtgatttggggtggtctgaaataaaggtactatatacttatccacataattgcactttttcaatgttagacttggcgttcaattacttcttatccacaatattgcactttttccaaatcgacttggcgttcattagtaaccacaacttctaacatcgacttattacagccacgtatctctgatatgttgaagattttatgacaagaatataggcaaaaaagaggaaagaaactgaagatccactatatagtaaatacttgtagcttcatttaaaaaaaagaaagtgatttcaatgttaatttatttttcctacaagtaccaagctaaaactgtaactaaatgactattattatcagcgtaaaaaaacacatactccttttgttttttttttttgattttctagaaaaaaattgtttcaaaaagattgattttttggttttcaatgcaatatttatttagttataattgataaattgtaaacttcaataagaattattgaatatcattggtttagagttattgaaaattataaattacaaagaataatacatttaaaagcaacatttaatatgttttcttaatatttgtgtttttcctaaaaaatcaaagaaaaaagaacacaaggagtatcaatctgtaaaatggatttgtttgaagacaaagattggtttttttggggataaaatactatatttttttagtattttaattttttgttggatcttcttagttctttaaaaatgagaaaattaatgtttatatcatgtaatttgtttctttcataaatatgttttttttttctttctctccaaatctaatcatgatattgttttccatggatatggctattatagaaagctaggaattaaaaagtgtttcaaggttttaaatatgttttttgtttgttactctaaagtttgttttttcttctgaaatttcatttataaacagtaattttttaataaatgtgtgggtaacaaaaaatttattgacatagttagaattagaaaacatgtaaattagaagttaaatggcctttaatcaaccatttttacattaatttaaaaaaattcagacttttaaaataaaaaagttaaaaatgaaaagaaaagtaaaagtaaaaaaaagtgctgaccactgaccagattgaaaaggaaaataaaaagaaagccaaaaagagacgaaaaagagaaaaaaaaaagtccacaaaaacaaaaataaacttgtggctaagaatcctcacgtgtgatgacgtggcactctgggcgaatcaaaaggttgtacaattcgaaagatcacaaacccaaaaagcaaaatctgtaaatcttttttctttctctctcgcaaagacaaaaaagcattcccaattaacaaatctagaaatcaaaactcagacaaccaccgataacaagacagtcgtttctctctctcttttaaacaaataaaaattggaacttttttcctctgtcttctcaaaaagtttccgctttttgctcgctggagaagaaagaaagaaagaagtgaaaaggaatcattaccatg

SEQ ID NO: 32836 - DNA, 3000 bp, Unknown; identical to SEQ ID NO: 1368
  misc_feature (1)..( 3000): 2750-1469P.txt file - cDNA_ID_3061954; gDNA_ID_1620393; Annot_ID_155675

SEQ ID NO: 32837 - DNA, 3003 bp, Unknown
  misc_feature (1)..( 3003): 2750-1469P.txt file - cDNA_ID_3061967; gDNA_ID_1620394; Annot_ID_155710
atataactaatatatacttatatttgaaatatgtttggatacctattcgggttcgggttcgagtttttcgggttttgaagtttagacccgttcaagtatttgaaaattttcggtacacccgcctaaataggcgggccttatctagtatcaacataaactttaactaaataaggaagtttgagctaagtgtaacattagataattcaaattaatgtttgtggtagaagaaaaagacaatgttaaaaaaaaaaaggtatctgctacctagactcgaacccaagcacggattgaaagagtgtggggacacaaccactaacgctagcttcaaatatatcagttgtattccaagataaactttataaaccttgtgtagggcacgtgccctacctacccacaacgtagatccgcccctggttgtcaaaaagacttcataagatcattttgaccacaaaagttcacaactcttggctctgtacatttgtacctcaaccaccatctctcactttagattccagtaactatacagagagtgtctcctactaatataccgtgtttctattcactatcaattgcaaaaagtattgaatatgagagacttacttcaacttctagtcctcttctactacttactaagtattgtgtcaatgttcttggaagttactgtccttcctctcgaatcagattcgtgggctcacttagaacgtacctaggaagctcatatctagcacctgcattgaataagagcaagtcattaaggtaacaaaacaagaaacgagagaaacgaatcagaattgtgtattacaaacctctttcatcccagcacaatgttaggtcacggttctgaacaatcacgcctgcactgtcaacaatagtttgtgctagtttcaagtcagcttcagcagcagctcgaagtgcttcccatatctctggttttcagtaaatttcgctcagtttccaaatgtacatagtgcgatgcagcagattacaagaaagagagatatatatatacctctttgaccaccatagtgtggagaggtgtcccaaaattcctcacgcatgttcgtaagttgtgcccttgtgattggctcagtatgtgcccacggtttaggtttcatgattttcttcctttttgctgtgtcaaacgtacaaaactcataagagaatgatacaatataaactaccaccaattttaaaacagttctttcagtaacaccaatattatagccatctacttcagaagatcatcacagtttcaatttcatcaagacaacaaatacagtataaggcagaacgaatcagattatattgtctattgttcacagaacaatttttcttggtaaaaatggaatgttataacattagtaaacggccatttcatttcaatcataccatcgataacaactttctctgatccaacattctaattctgagcagtagaaacaatgttgaagagcattctaattctctgctgaactaattctgagcttcaaaatttggaatctttaacgaatcacaaacatgtcaacaccacaataaactgatatttccttcgaaatcactccaagaatcataacatttgcaagattagttcatgttaacacctcaaaactagaactatcaccaagaatcaaaacattacaacacaagtataaatcgtagcccaaattctgagaacaaattcagcgagacaaacggagtgcggaattaaaggtttaagagagtatcgattccactaacctccgccttcatttctggcctgagaagatccgatacaacccattctcgaaccgttgagagtcgcgtttgattaggtgaaaattggaagtcgcttcgaacaagtaaagtaaatgccagtacaaactcgaccgtcgggaacgaaacggagaaagatagccgccgataagagtttcacggcgggagaatcgccggagaagtctgcaagagtcgtcttcaaggtcaaattctgttttgactgccaaattaggccatgaatgttttgttgattttggtgggtttttggattttggattgtggcttttggttttttgtttttgattttatgagtttttgattttggtggagattttagattttgcaaaatcttaaatggtaacttttctagtttttgatttttatataattattatttagaaacgttttaaaattatttatttaaaactttatttttatttttaaaaacaaaaaaaaaagagtttacgatagaatttgttgaaaatcccaaaaaagtgaattttggattttaagaacaaatgactagaatcttttaaattttgaattccctataatttaggaaattaactttttacaaaatcatgaatggatgaaaaagtggattttgtaaaatcaaaagccaaaatcaactttaaaaactagtaccattcaaggccttagtttgttagagagaagaaagtgaaaacagatctccccgattttatttatagtcactttacttgccacgtcatattattctggattagtatattatatctgtttgaattaatcgtcagcgtctgtagtccaacggttaggataattgccttccaagcaatagacccgggttcgactcccggcagacgcattcttttttatcattttaatcagtttagaaaaacataaaagataaagacaaatgtgaattgacgaatacgtcctcgtctttatcgaagcgagcaaggtaatagatcagaacgcgttaacagggcagtttagtaaatttggccacacaaatgttagatttctttgtgataaagacagtacacaagtcctttgtctttctcgtttgatattttccaattccgcgtctttctctgttgaaatcgaaaaaattttcaaaacaaaatctaaggaaaaaagagcaacaagtttcaaatctcatttgggtttttcattttgaaaagaaggacccatttttatctctctctttgttttgttttctcgaatctgaaggagtaaagttaaaagctttgaaggagagaatcaatg

SEQ ID NO: 32838 - DNA, 3000 bp, Unknown; identical to SEQ ID NO: 1375
  misc_feature (1)..( 3000): 2750-1469P.txt file - cDNA_ID_3061984; gDNA_ID_1620394; Annot_ID_155716

SEQ ID NO: 32839 - DNA, 3000 bp, Unknown; identical to SEQ ID NO: 1374
  misc_feature (1)..( 3000): 2750-1469P.txt file - cDNA_ID_3061996; gDNA_ID_1620394; Annot_ID_155713

SEQ ID NO: 32840 - DNA, 3003 bp, Unknown
  misc_feature (1)..( 3003): 2750-1469P.txt file - cDNA_ID_3062004; gDNA_ID_1620394; Annot_ID_155701
ctttgctaaatcggtatggattatcataactcttaaaaggattgatttttagattcatttactctatggatcacagaatctgcttggagtagaagtaaagagtgatactttgctcattagtatacgaaatgaaggcatgggttgttgtcaagaattgtagttagaaaattggattttgattactgcaaatattgaatgtgaagtttctagtggtaatttgtaactgaaatgctctatttatgtgttgagtagctgagcttgagagttgtctcttatgttaggtctcaagcagaagtctgcttaagtagagaaaagaatgatactttagttaaagtttgatgaaagcatgggtgtcaagaattatagtgaaaaattgtattttctcgattactgccaattggaaggtgcagtttctagtgatactctgttactttttctgtaactggagttctctatatatgtgttgagtaggtgagcttgagagttgtctcttctgttaggtcccaagctctctttgtttttcgtaatggatagtacactaaacaaaatgcaatatctgcgcttgaagtagagaaaataatgatacgtcatacgttattcattgagttacgaaactaaagcactggtagtcaagaatttacagtaaaaggttagacctgattagtgattactgcatatttgtcatcggaactgttggagtattgttgcttcttagttgtttctaatgattgttctctacttgttctgttattggagttatatatctatgtgttgagtaggtacgcttgagagttgcatttttattattaagttgttccttgctttgctttgatcctaatggacctgtttgctattgaagttactctttgtctcgagcattcaatagagttttactgttattctctaggctgaaaacttacggacattgttgtgtgttttcgtgttataattgttagggtgcattgagggagttttgggagatggtgcaagctgaagtagtcgatggagagttactacaagactgtctcgaagtaggcggaaacgacgttaagagtttgcttcaaatagcaaaggacatggctgtacagtttttttcttctcaaagccgttcctctgatgaactttagctacaaagcagagcgctttcacctacgttccttctttccgttttgttccacatcggatgtgacccttttggcacgttgtactattgtatgcattagccaactcctctaggaaatcctccataaccattttgttcattacaactttcgctagataagttcaagggatgtatagactagaaaacgatttgtttgttcgtttataagtctaagacattcgtagactagaaactcgaggttcttttgtaatttcatcaatctaagcacacattttgtaatcgaaaaaagtcctaatgatcttgtgaatatctttgaaaacacacaagtctaccgacatctagagccattgtaggtatccaacacttgctgtgattggtaaactttccccattcatagttaatattttatcgacaaaacaactcaaaattcttctgtttcatagctctcattgctggaattttgcctctattgtatagtagagttcataaatacaacaaccatgtggttggtgaatggtggaatagatctgaaaattagttttttagtattcagaatatttctttgtttgaacatgtttgcttttttaactaatttttctgtcataatccaaatttattgatgaatgtcatcaattttgtttatattatagtaaccaaatttattgggatttctgttttccacactttccctcgtcttattaatccatgtggtgactgcttgaataagaaagtttgaatcttgatttgagtaaatttttgggtcccaaagtagattttgcttttaaggatcatatgcaaaacagagcaaatgaaacttaatactttcaactactcaacatttggttcataagatcatcatcatcatcatgacatggagctcactctctgtctttcatttaatttcactcccttcctaacacatggcaaatcctcaacatcattattcaccgttgattcgaccaagtgagattgagcttggccgttagatttgagtatatcctagaatgagaggaacatgtaatgcaaatgtggaccctttatgtcatgtttttatgtttcttacactatgccaatttcatttcaaggactagtcattttactttttccacatgcattgtactaaaataaccaaacaacttaaggtgagtaaatttagcttaagcatgttactgtcttgtggtttaaattaccgtgatgattttcatatgatgaatagtatatagatatttgaacctaaaacctatggaaactgttttttaatataattaacaacttcgtagaagttttgaagaaatgaagatagttttaaggttattaaagttatataatcacatagtattaataatcgtcattatgtcatttttcaaatctacaaatgcagtaattagttaatcttcactttccttctcgagacaagttgttttttactaactttctcgagcattggtactttgaggaaccaaagtcaacagctcgatttccaaagcaaaacattaaaatcgaaccgtcacaatgcatacaagttggggggattcagagtaaagaaaataaacaacattgacagaagtaataactctccaccatctttagttatatgtctctgatggatcaattcatagttccaccaaaaatactcaattatttcacatatataaacacacatcacatttacttttacatttaacatccaaacatcattgccgcgtgaacatttaatgcttcttcaaccgttaaaaaactttataaaataacagtttctcattctctccatattcttcaaaactatattatataaacacatttttcgtttcttcacattcacaaaacatctctctctttcttctcccattcactcactatcttgctcctagaaaaagatg

SEQ ID NO: 32841 - DNA, 3003 bp, Unknown
  misc_feature (1)..( 3003): 2750-1469P.txt file - cDNA_ID_3062012; gDNA_ID_1620394; Annot_ID_155694
acagttggtgatttgcaacagataaggaaagtgcacgtaagctaatgaacggtaaattcaaattctccaaacaggagataaaaagtgtgggtaaccgcttgcaccacagttactcaacattacaaagagtttcaccttccagcattgcgattcactaattaaatttggtaaaattgataagaatgcaaaatcctgcaaatggttgaaccctatcatgatatattctacaaaactagatacatacttaaaggctgctaactaagaattagatccaagtacatcaaaaacaatctaaagatccaatttagatgcgtcatttcgcctaacaagaagagaacaacattcactcacaagtctatcctcttagaagcatgaaccgtagaacattgccctctattatcatcagcacacaagtttctagactctgtttctttgcttttccccttcttaagctgagaacattcttgctcctggaacaatcaaagataatttcaacactatatatacatgaaaatggaaactccaatgaactaaaaaactcaaagatatgaatataccacatccagcaattgcttcgagacacgttccagctccttctgtttaatcaaataccacaaagaacaatatgagaaactacatctttgtgatcacagagaacgcaataataaaacgaaaccctaacctttaagcgatcaatttcgagatctttctcactatcacagcgacgattcgaagtagtcggagagataggtttagcagcagtaacaacagtagagttagagtaatccattaacgcgtcattgaaaccgcttactactctttgagagagttctctcggcggagaatagcttaagaaaggatcaggaacttgaatttgtttccgttgttgtcccgctgaggattgtaactgcatagggtgagataaagacgatgaaatcttcgtcgatggcggaggagccggtagaaacgttggaagatacggaggaggtagggggcgatacatatcggcttttttcagggtggtttcgattgaatcgatggcgaggagaaattcgtcgttaaattcttcatcatttccactcattctctttctctctatcgctcgaatgactgatagcgagtgagtgggaaaagaggcgaaatcgaaatacccatttagtgagcagtacgcctgacacgaattcggatatccggaacaattgtgatatttgttattcgattggttttaacggaatatctgattttgtgatttactttaattcaaaaaaatttggatatctgaatttttatgtgatattttcgaatatccattttgatactgacatattgtacatgtaaatattaaacaagactgtaaactatataacaatatcagatattcaaatttttcatttaacatgctttcaaaataaattttaaatagcaaacataaccgttgttgttatcaccggtcatcaagttgttgttatcaccggttatcaaaatgttatctaattaattccaaaacataacctaatagattaaattgtcattgatcaaaacataacataaaagaaaaatgagcaaataaacatcttaacatgaaaacataaggtaacaacaatatacaaactatttatgatatctatatttacggatccatcgtaaataatcatctttcgctttaaagtttttgatggagcagtcggtaaaacttaggatccaaaaaactttttgtactattactattatttatggttaaaattctctttttcttattaacttgatttctttatgtgttttatattatttttataaataattgaaaatcatttttaaaatttgcaatattttattaatattgtaaaataccgtcataataaaaattattatggtaaaccataaataagattatttagtaatcaaatgacattgatctaatatttatatttttcttttctgaaaaaaactttctggttcgtttctgttccggttttcaaaactctgtccggtcatgtggaatgctaaattacaaatccaccttattataatttaaattacataaataccccttaaaactcacatatttatactttggtcccggtagttctcttttctttttaaattaaaggattatctgcttagcaaaaaagaagaagagaaaaggcaatgttttgaaacccgacccggacgatgaaccggactaccttctgggtcaccgggtcaccgggtcaaccgggttggaccacgggttaattagttaaaatttatttaataaatttaatattaatagaaaatttagagtattttataataaaaaaatttgtagtatttataaatataaaacaaaaataatcatatcatatttaatcaaatataaaattatattatatttaacaaaatataaaatcatttacacccaaatatatatatatatatatagaaaaaatcaaacaataataataaagtggttaaaaatttgaaatccaataaatgtctaacaccgtaacaaatatattaggagatcatcaatgacataaataaattaataaaacatcgtgaattaaaacaactaatctcggttgtctctctcaccattcgattcaattttaaggcggtattgtaaagtcttcaacaaaatctaaaacatcaaatgaatttaagaactgaaaaaacttctaaaaataattgaataaagtctaaaatcccatattttattgtaaaatcaagagaactttttaaaacccacacccggccggttcaaccggttcaccgggtcacgggttaattgcgagtttttgtgggttttttcggttttgaacttgttgggttttagcactaaacccaaaccggaaaagtgttcgggttacgggttaaccggtcggaccggacggttcgggtcgggcgtgaaaacactgagaaaagggttttttaggattctttaaacgcagagctgagctgagttacataagatcgagagaattcgcaaactcgtttcttcattcgtcttcgtctttcgccatg

SEQ ID NO: 32842 - DNA, 3003 bp, Unknown
  misc_feature (1)..( 3003): 2750-1469P.txt file - cDNA_ID_3062030; gDNA_ID_1620395; Annot_ID_155745
tctctcaagagtaaaaagtctttgcaactttgctttatatagaaagttgaatggcaaaaaggcaaattagaggatgataactaaggtatggaatatgaataactggtccaatcgttgctttgttatttgtgttcttatcgtttaaactgtaccttgtgtgcttacattattttttctagttttgattcctctggactacaacttttcagtgcaattaaagccttgcattagatacgagaattgatccacaattaatgcatcatatgcgcattccttcaccattctggtatatgaaagtatcttattctccaaatctttttgacaacttttctacttgggcaggggaattcattctttttccttattcctcaattttttcaaagtccacagctccaacctctctatctcttgaggtatattctcaatgctttccacttgtctgtattgtttttgttccgacttgaaagtcattttttcagtctctacatacatcttaaatctattaaaactttaagttaggttttgaccaaaatcaataatggtttatttggccatgtttcaagaaaatatagtgattatgtttgtattattatatagcgtagaatacccaggtttgtgatatgcataatgcaaggggggtgaaagtttatgtttcaacattgatttttcttgaaagataattgagaaagcgaatgtagaatatttcttgctgtctccttcaacaagtttagtacctattctctctaaatagtataaaaattagtggggggtccatatcttacactctttgattggcacaacatatttggctcatccatgcatgtgttaatctatgtatgtgtgtaacctttcctgtctgttctgaatgcaacataacatgtcttcagtgcatatttgtatgtattgtttgtgtgtttatgtgtgcatacatgtacatatttacatgtatatatgtataagttcgtgaagcatatatgcatctaatgtttggctggtttcttacagtgtacttccttgaatctactttagtggtgagtacggctctaaattttatcatcattcatattatggtgttggatgcgagtttgatttggacttcactattatatttctactgactgattaagtgtagagatactctcctatatgatatacagctatatagaataagttgagagataaagatatataaatatacaagtcgtgattgccaaatgctgaaattatggcttctctatgtgcaattgagaatatatccactatctagtatagagtctcacatatcttaatgagtttgataggtgccttaaaaaaaaaaactaggtagaaatatggtctattgtttgaaaggaaaatgtcaaaaaaacaaatcttatgttccttgaatgatatctttgcatttttcaatctttttttggtgaaatctcatggttctgatttctcattaacactttattctgtttggtgaagaacctttttcataaccttcagttaaaagtatttgagcatattgcctaaatagttgattggcatgtgagtgggaatatgcttccacaaagagaggcttcatattgtgtgctgcaagtttgaaaactctatttgtataccatcaaaagtaaattagacgaagcaaacaatttatgttgaactcttttgattggcttctcttttgtcagatagataatcctctgttctatatcaaatgtagtttcagaaaagatcaaattttgtgtatgctttttgtagcaggttctgttccagattttggactactgtgtttttcttcagaactagagcttaaacgatatgttatcttggtcacaattgttatactagtttgtgcttaattatgtagtctttccccttcttcagtgaaagaaaagagtgatacagacaaaatgttcttccttgtacgttcatttccctttgacagattcttgttcttgtttactaactttaatcagtgtttgatcttccatagggagcataattcaacacgtgggattgtgattcgcttgattgaatgagagaggattggatacataaaacaggaggaagcgggaaatgaccgcggaattatattcgtttggagagaaaatggagggtaataagtgggttcgttcatgagattctagagaatgagaatatgagaatccaaaactaaagaaagcttggtgagtcgcattctcaactcaagaatcttttttgttcatcacaacccgaacccaaaaaaaaaaagagactattcgggtctatttctttccccttttacttagtctcgatttttgtggatattttaatgaattgtgattcttataagcacaacaaaagattaggagaatcattgtaggagttttgtgttcaccacaaggcagtgttgtctgcatccaaccgaatcatgtagcagttttgttatattggtttgaatattatgaaactataaaaaatcgagggcactgcgactggacgcaaacgcaaatgctggctaaattattcgacaagtcggatcattataaagagttgattgtctagttgcaagtagttggtagtagtatccattcttgtttttctttttttcagttttatacattctcttggttcgtttactttctttaagattcgttttaaacatttatttcaaaagttgtttgaaaccctttggaaaacatggagaagtaagattcttccgtagataaaactttggataagcaaaaacatccaccttttaagctaaaaatagatggaggtcaggaaccggttctgtgaccggtccaaattttctgattattttcttcacgggttggaccgactcggtttacggagctaaaatggtctaaaccgtaagtgatcgatcggtggactctctttgttgtcgaacagaggaagaaggaaacagtaacagagtataaaccctacgacccaaaaacaaaagagacgaaacaaaacaaaacaaaaagtctggtttgggtttctcgagctcttcttcttcttacaaagaaaatg

SEQ ID NO: 32843 - DNA, 3003 bp, Unknown
  misc_feature (1)..( 3003): 2750-1469P.txt file - cDNA_ID_3062036; gDNA_ID_1620395; Annot_ID_155739
agaataaagttcttcataagaatacactcacccagaccaagatcgataaggtagagttttttctcatctgctgttcctggttgaccgagtaaaaagttttccggcttcacatctccgtggacaaacctagtttgatatggggatggaacatagcatgacaatcagtacagtgaaagataatacattgtaattagttaaagcgaaatgaatgaaactatttgcaaagaagttacgaaaaaatatagtaactaaccctttcatatgaagtttctcaagaatagatatggactcaactgcaatgcaggctaccatgtttggagacatcctgccacatgacacgaacatgaatcaaatcaagaatcttgcaatcagaaggaagtgtggtgagaggagaagagtgcttacgattgccccgaagaattccaaacatcccagagactcggaccaagcatgtccatgacctgaagtatatattatagcattacttgtacatgataacacaatcaatatcgaaagtatatttaacaaagctcattgtaaattacatacaagaatgtaaaaatctccttgacgacccttatgatgtaccgcaggaactccatagcaaccattgagggtactttacaacaagaagaaaaagaaacagatgagatgacaaataagttgatcagagaaatttggcaggaaaatttacatagaatgcatgcaagacttacttgtacacttgccactcgtaaggtggaccaaaattgcatcctttgctatttcgatgctcaaatttcagggccacctggtaagaaaaataattaatttgttaacgattagacttctttcgtctgtatccctcaaaaatctcaagtatgcttctttacaatatacctcaattgcatcggccccaatcctatcgctgccaccactcacccttctaccaacaaaaacttgaccaaagcctcctttaccgagtttcctctcagtcttatatacaggagaatttccaacttgtacctatacaagtaaaatgaaatcaatatcagcatctctctcaaatgaaaaaaaaaacttgtgattgaatgtcattagcataaattttaccctttcagggactggagctgtgctagaatcttcttccacaccaactaccttctctgcgctaccaccttccatagcaatatccttttcagctaccgcttcaacttgattaaaagcaggttcacctactgctggacgaacttcacaaggttctgcctctaaatctattaatctgatgcctcgacccctaccgacaccaccagctggtcttggaggtgcagcacctttggcgtttccccttcctctaccaccaccgcctcttctccttgttacaggctgaggaggaagttcaatattatccgcctgaccagtcacctgagggctaggttgtctcaatctacgtgctccacttcttaactctggcattcttactccatacaaagagtaagaaagtattttgctttcagtaaacctctttaactaacctgcagtataaagagaggtagcagagagtacgtatttagttgataaaaaggtgaacccaaccaatttcatttgcatttccttcacaatccaaaagaaaagacaccaatccgttgtgttagcaagtaaaaatacaatcaaaaagaatacaagaaacattggcttgcacttaaagcattgtctttccatcaaaatcactttccaatcaaacagataaaaacaatcaaaatcacagtcatctgcaaccaaattcagaccatacactcatcaactttggttcaagagtaacaaaatcatcgttactctcgagaaaacgccatcaaaggctcttcgatgatgatgatgatgatgaccaacacatcaaaagaatctgtgaagaaagtcgattcactactcaagataccaatcagaaaccatcaatacagattctcatcttcacagaaacatatagattcaaaagaatagtgtaaccaagcgacagtttgatacaaaaacacgctccatcatcacccaaaaacaagatctttccagataatcaaaagagaaatatatgaaacaaagcatcaaaacacaacaaccaccacagaataaaaaacgagatgtcaaaaacattatacccgatgaacgatttacgattaacccttgaacagaaatgatgatcggagtatgataacgatgaaatcgatccaaaaaattaaaactttcagatctccttggaaatttcaaaatgagaaaccgacggctttctccaactagggcgatttaaatgtaagaactttctagctgtgataagcacacctagaaaatggagataaagagagagaaagattcagtcgttttaggttataaataatgaagattgaaggagatgaagaagatgagaggaggtgcagatttggggatgaattctttttttttttttcggtccaaaattttctttttttctttggatggattgatcaactttagcaaaatttctggcaaatatttggtagatttttattttattttcattgctttaatttatgaataaatctatattttgaaaaaataaaaagcttgtagacttctcgaatgtttatggtcttaatattgctgcttgcttcgttttgctcgcatgaatttaaatttgttaatatactaatttaatacgttcgtacgtatacaatgggacttgtatgttgttccagtaaggcgcacgtgtataagggcttaatgtaaaatccacatcctttgtcttgtacaaatcttattataaagaggattatagtgtaaaatctcgattgtttaggcatgtgaatacaatatgaaccctcttcggtttggattacaccgataaattcgaatcttagatcgaaacaaatcggttcgagttttccggttcaatttaaaccggaattgcccattgctaaatttctgtccaacgccaacggtaacgaaattgcacaagtgtcgcagctacagagcacacaaaagaaggagagaaagatg

SEQ ID NO: 32844 - DNA, 3003 bp, Unknown
  misc_feature (1)..( 3003): 2750-1469P.txt file - cDNA_ID_3062038; gDNA_ID_1620395; Annot_ID_155733
tggcaacatcttttttttgtcatttcatgtgtgtagataagctctaatttcttacctcaccaatggttatatgaatataaaaatgatttctgtaaacaattctgttgaaattatgtaattatcattatatattaaatcactaatcaacactttatactttttaacagtgacaacactaaatgcgtccatttaagagtttcgcttttccgtctcttcttcttctttgatcatctatttaaggatctagagaaaccacttcgcaacgatgagggagataggtcactcctcaaaattaccaaacacaaattagctccaataattgcaacaaatcactctcacccaaacaaaacttttcaaaagccctaatccgagaaatcattcgacaacaacacgaaggagatggatctagaagattgggaaatactccccaaaatcaactacaagggtctcgaacttgatctcggtcatgaagaggatcatgaagttacgaagatgatgagaaacaccgcaaaaagcttcgacagtgattacttcatctgcccaattcaagattctgtcggaaagacagagtttcttcatcagagatctagcgtggtccccacacaactcctccagattccaataacttgggaacctttgtcccccgtggacgacaaagatcacaataagtacctggatccggatttctcggaaccagacccggaacttttgacggagtcttttccgtcgccgagaataaccttcaagaaatcgaaggaaaccgaatttgccgacatgaaaatagattcaccagcagcgaggttcactagtcctctgccgcagaacgatgagagacactctgactcagaaggagggttaggaggagagtcttatgatgagatcatgggatcagaggttgaagaaagcagtgacttgagtagcaagaaagaggttgattgggatgaaggtgaaagaacgaatctgtggaagaagggtcttaatggaattggagctatatgttcatttggtgttgcagctgctgcagccaccatatgtgtcttcttccttggacacaacagtagcatccaaggtggtcggaacaagaaccagatcctcaggttccagatttactctgatgataataaggtaaaaaatttaaaatatgattcttgttagaagtcacttagttaaggaaaattaatttttatgatacgaaatacactaattttgataactgatatatctgattagttctactagtttagttagatgggtgtgtaatctcacatttgacttatgccgtcttaatcagatagcattaattttaaaattggttcccttttttttttttatcaagcaaattggctcctaatgcacgaaaacatgtcactcatttgagattttgatctaacagggtaaatcaagacaaattagctattaagtttggtttgcttccctaattgttgttaaagttagatctcaacttatacatattcctgtttgattgattgaatagtaaagttgtttgtgtctttgatacaacgaaagtgataaggatgcgtttggcggtgtggcctattacgtgtcttagtgaacaatcaataattgtagagaagattcttattttgtctttgtacgttttgtgtttatcttttcttgcgtcaccctcacactttgaaccaaaacacgtttatataataacgtcattgttccttgcatatcaataatagctagagccgcctagagatgtttgggaccgagttagccattattgatatatagatttatgattcaaagtcgttgatgtgtgattggttttaaactcgttattgcagcggatgaacgaggtagtgaaacatgcaacaaagctaaatgaagcaatctctgtgatgaaaggtcttccggtggcaagagctcaaatatcttttggaggatactacgatgcactttgaatcatagccatatagccatagatccaatgtcttctgcttaatcgcctctatagcttatgtatttacgaatttaggaaattcaatataaataatggttgtgaaattttacattctttgtccgaatgcatactacatactggctaagccgacgcctacataggaccagggcggactcaaaatatcatgtactctgagctgggaaacatatataggccttattttctatgtttttcggacaaacaaattttggaccctaattttaacaaatgtagttatatataaataaataaaatgtggaccatgtgcatgagcacctctagcacatgtttggaaccggcactacgtacgacaatacgacatcaagttctagcgaacgatgatatatacttattaagtcgttagaaaatgcaataggtaaatgatatatatacaagaacaagaaaaacaaagataatacacaagagagtataaacttagtattttgctattatgaataagtaaaaaattatgtatttaaattcttgtgtcagttgttcggtcactatacaaattcaaacctaatacaacataaccatcataatacaacataattgatgtatagaaaagtgctatcatcaaaacgattttaatggtgcgaaagatccacaattaaatagtttacctaattgtttcgatgtagagagtccaaaattttcgagaagtatcacagttcaaacaaaaattcaaagatgactaacaaatctcactttaaatttcaaatgtaaatgcctacaatgatgtagtttggtgtaaaacttactaaatcttttgataaacaaaaacatggatttgaacatgacacaatgacaacactaattcaaatcactagcctacatatctaagggtttagttccttgcgcttgcaaggtacatcaactgaagaacaagcccaataatatctaaaggcccataatctaacccaccagttaattttaacggtcctccgtcaaagtcgcctctcttctcctccaccacttaacgtcagtggtccgtttgacaaacagacctgtgactgtgagtgaagaagataatg

SEQ ID NO: 32845 - DNA, 3003 bp, Unknown
  misc_feature (1)..( 3003): 2750-1469P.txt file - cDNA_ID_3062041; gDNA_ID_1620395; Annot_ID_155732
cccccttgcagaaataaaatgacttgaattacttgtcagattgtttagatttgccagtaatcaatccgtcttttacactgatcagtaaagtttttggcttaatgagttagttttacaaagacaggacaaataattcaatatgacagaaatgatgctatgtgtgttcattgtctcttattcttgcacgctttgctagaggctactttttagtttatttggtgagcatcaaatgtagattagttaggttattatgctgtataacccttttagccttatgaaattgtttcatgagtagcttatcctctaaaatactaaatgttttcatcatttctttcccatttttggtccatgttaattgatatcatgaatttttttgttcatattgcagtgtgttttctaggtatggtatccatagcttgccttcaatcctgatggtgaatcaaacaatgaagatgcgataccatggtccaaaggatcttgcatccctgattcagttttacaaggaaacaacaggtgagagtatgcttcatgaaaagccagactgtgtctctgtttgtactttctggttttgttttctactgtatctgaatatattagctcacaacttattaaaatcctttgaagaaaatcagttaaacttttttatatctgtgtctttccaggtcttaaacctgtccagtatatggatgaaggtgaaccaacaagcttggacactgatggaaacctgatcacatggctacacaacgggtcatctatcagagaaatagcagaaagagagccatatatggtacttgcactaatgtttctgtctttgaaactggcaattttgatcttccccatcatgggatcacggttgaaaacgttatgggcattgtatgttccgcatctgagcttgggaatacttggtgagactagccaactgtttggccgtgccctacacatgatcgatgtgaggagactatggataaaactgagactcaccaaaacaaggaacttccaagaaagagcaaagaacgcacttgcatcagtctcactaggaaaatcttcatcacaatcagcctaaaagggtgatttagaaatccttcactgtcaatgagcttagtttagattactttactttactgtctgtgagagatcctttgactgacatgtttctatacctttggagttccactgtctctgtatgtaaatcctgttttgcttcttttgtgaatattttttcttcttcttttgaatattcatgttcttggtccacttcgttgtgcttacgttttgtctatattgattatggatggtttggttttaattggtgttagagatggacacttgggtcgtgtatgtgaaagaaacttgtccaacttgtggatcactctggttcacatgttttgaagtttcgttttcctgtcgcttttgcgtatgtgtctgacagttgaatctctctatttagatattttcaacttaggaatctgcttttatttgattctatcgtttattacagttataagatttagcttcaagcgtaaactgactaataaaccataaaatcaaaatcaaagaagcaaccttcaatgtttaaagtgtagggaacaaagtagcacaagaggtgaaagaaaaaaaaaagtagagcaaagcaaaaacaaacggaatcgttaacaattactatatgttatgaatgattttttttctttgtagacttaagagtttcttaaatttgcaattgaattctgtatgctaagtgcctaagttcaatgattattgctttttgttcatccgcatttgaattttttttaatggatttgcaactgataatctaaaagctaccaaataacctaatattagtgtttttgaataattgcctttgtattttacaagtattgatttagttgattttcgacgaaaagctttcctcaaattttttaatattatcacctatattctcattacgtaaaggatcatatcaaggatgataagaaattataataagaaaaataaatgattctaggtgtttattaaatgactccctctttctacacttgttaaatgaaaacgtagttgctttttcctggaataacactaataattccgagcaagcaacctccactactactatcttttatcatttttatccctagaaagggactttaaacttgtaacttgtataacacatcacatcatcttctttttttcttcctttcgttttgtggttaatttggtaatttactttcgatgcaataaacaagccgaaaatatgaaaaacgttcatctgttaattagtaccaagtttatacttgaagcttgaatatagttatctacaccaataatttttgtattattttacaagaaatttaaatacccgcttaggtagacgtcttaatccataacttatagaaacttaaaaaacttggtacgaaagattcttcttaatcatcagctaactaaatcttgtttttatcactaaatattttattagcaatcaaatattgtggaaaatgaattagcgtgttaaccaatgggtttggttataggaaatataaaatatcaaaggagagaagggaccttgtcaaagaagacaatcgatacttcttaacgtgggtcctaaaatggcaacatcttttttttgtcatttcatgtgtgtagataagctctaatttcttacctcaccaatggttatatgaatataaaaatgatttctgtaaacaattctgttgaaattatgtaattatcattatatattaaatcactaatcaacactttatactttttaacagtgacaacactaaatgcgtccatttaagagtttcgcttttccgtctcttcttcttctttgatcatctatttaaggatctagagaaaccacttcgcaacgatgagggagataggtcactcctcaaaattaccaaacacaaattagctccaataattgcaacaaatcactctcacccaaacaaaacttttcaaaagccctaatccgagaaatcattcgacaacaacacgaaggagatg

SEQ ID NO: 32846 - DNA, 2193 bp, Unknown
  misc_feature (1)..( 2193): 2750-1469P.txt file - cDNA_ID_3062072; gDNA_ID_1620396; Annot_ID_155792
ctaactctgattttcttgggttaagttgttacgacgaggctaagtagttatgatgatcacaaattaaaaatgaaatgacataatgagtagtgtggattaacaagtttgtcaaaaaggagattgcagagtatccaaacacccacgtgcaaggcaaatgaccatgtcactctcatcattatggctttttattcactttttgtttttaaattattctaatgttctaagaaattattttaagagatttttttaatagcaggataatctaatgttgaattcttgatgtattgattaattacgattttttttaaaaactaaattaggtatttggtattgaaactgttcatgtggatgcatgaaagaccacaaataaatttttggataatgaaatttcatttttggttcctactagcgagtcttctgccatcatcagacaccgcacttaattttgtacgaactttttcattcaaatctggttgcaccatttttaattttgtactgaacataagtactttacttataatctggtttaggcagaaactttcaaatacttgtatcatttaacttggaaacgtaattacttagcgtataatgatatatagcctgtaggatatagaatcacaaattagtgataagtattttgatacagtagtttatatcctcagaatctaacagtatgatattgtttagcaatatataatgttttgtgaataatgaatgttagttttctttgcattcattatttggattaagtcacataagaaaatataattgttaatttggaatggatagtttaaccgattagatacgagtaactttataagatggggttcgtcttaaagtcgacattagcagggaaaactactaatttaatctcttggtcgaagttactatacatcgtaaagtccgaaacttcttagatacatagaaaattatacagttaaacatatactattattcatatttttgttaaaacataaactattattcatgaggtcaattgttacatgggtttggtaaactttcgtatgctattattttattatattctttgggccgactctttgagatgttgacttattagtgtgataaggagaaagcgaattaaaaaaaactttatatatgattgcacttactttaatgaatccattttttaactttaaactgaaaaaaaagaattgaataacaaaaagtttcaatttgtcaagaaaagaggaagagagagagccaaaacaaaagctgttaacctcatgggatgttttccattctcaattattagtaaacttttgttatgatttttgatccgttcctttcgataattggatgtgatttgtggaaagccatttacatgtttagttacagtataatgatatagttgaagctctcataaactttttaagagtttaagtctgattagaagacatctttagaagataatacaatattgaaattcttgtgattgattcttctacattgcaaattcacttccaacaactatttcatcaaaaaatctatagaatagttatggtttcgaagtatataacattaacatatttaactaatttgaaatgtacataaataataataaattggatttatttcaaaaataagtcaataacaccagaccattttatgtttgacgtaagtaacatggatgatggaacattggaagtttgatgtacaatgtactgtttttttcttttctcttctttttgaaatatctatgtaagttaatcttctccattttagatattttcttcacaaaaaaacgaatatttctggcatttatgtttcaacttgtatttagctaagattaggaaaatgacgttttatctaactttttttctttcatactactaacaaatcatttctaagttctaactaagaatgaaaattgtcgtgtgccatataggataaaacctcactctataaaaatcattatgataaattaattaataaaattaaaaaattaaaaaacaatttgccttgagggaaaaagaaaatgtagtatttaaataacagccatttattattgctcactcgtcgcagaaaacagagattcctcgctgtctgaactgaaaaataagatcgcattaactcaaaactctcacaaagacaaagatcttctcctccttctcttctctttttcacttttctctcttcccctctctcgaagcttgaaaggtaacaacaatg

SEQ ID NO: 32847 - DNA, 3003 bp, Unknown
  misc_feature (1)..( 3003): 2750-1469P.txt file - cDNA_ID_3062079; gDNA_ID_1620396; Annot_ID_155790
aaatgtcttactagtatttaatcagtcatcgctctattaatttggttattcattatcataaagctggaggagtaaatttagttatgtcgttatcaccagtcctatattgatttgtgtttaatgcggtttcaaatggttagttcgtgtttaaaattgttgatctgtctcagctccatgcctaatcaagaaactatggttcagctctctgtttcttgtatgaaccttacctgtcataaatagcaacaaaaaagtgcagtaattggatttatttgaggatggagggattatcaaaatgagatggaattattacctgttatgattccagtctcgatttgatgaacttttggagacagtctctgaaagtttcaagcactgccctttcctgctccatgtatatatctgtttcattgacacttgtcttggtcttacattgggaatcctcttctccattgtattgaacatctatcagttcgatcaatcttccacgtgattgtatttcttcttccacattacgactctcagactcacttgacagctcaatggcttccttatcatcaggctttgtaaatatcctgttctggtcctctaagtgagattttaaaggaagtatgttgatgaagccaaaggaatagtagatccagtaaagtgtagattttgtaagagactacagatatacctgcagttgttgtagcagattctgacgctgcaacgagaagtgagcataaatctcccaagtccggaagaagtgtagaggtgtatcccatgagggaccttttctttctagtagcacaatgaaaattcagttaaaatatttatgattatgaggtgaaggaagatgaactatcattttaggaaatgcaaaatcgaacctgtaaggaagtttaggagagcaagacataggggaacccagagcattttgaatggaattgtcaggtatcgaaaataacggagctggacaagaattccactgctattccggacagaaaaatgagttttatggagataaacccaaaagtgcatatatgttatgaagcaagtagtatatttcacttgcctcagttagctctcggtctcttctcctccggtatacttgtggggaattgtgagcagaaaatgcaggaggctggaacgcttcactaacattcttgcagttgatgcatttacagttgtctgagcacagaagattagcctgaaagcactcacagtacttcttcaaacacctggttcttttacatttgcagcctctcgaaagcagtccaggtttagtatcaggtgcagccttacactacaatacaaaacacagaacatcccagatacttacaaatgaaaaaggatgtgaaatatacctctttgaagcttaacctacaaaagtgataggtgtcaagaacatacctgattatcagttaggctacctaaagccttttcactgaaggcatttgggttgcgacctagtacattcaccatagctgcttctctagcatcacatttctcagagttgttatgacaatcaacacaatcacagtctgtacataccactcctgatgcaaaacagtcacagtacctaataaccaagcgtcaaacaaatatccaataatgcatcaatctacagcagataatagaaatctcactattcaacattatactcaaatctctatcagcttaacactaagtaattcttggatcctgaaatgaacttacaactttaaacatttggactgcttgcatcgacatcctttgtgtttcctcgaagtaatgccttcttcatctgtcttatcctttgcttctgaatgctctctgcttcaaaatcaagaccagtggagatcagagagtagattttggattgaaattactcaaacgagaagcatctctagtgaaaattggcagagaaactggaacaataccgagaaatcggaggaaaaagaggaagttctttaacaggagattctcggaagacgggagatacctccaatttggtgaaaacgagcttcctagggtctttctctgtcgcgattttgccggaatctgcgtttcctgtcatatcggtccttgacacattatagtcgccacacaagttagttcctcaatttggcgaaccgattagagcatgaacggtgaggaatcctcagagaagcgtcgattcatagatcagatcagatcagtgtatcggagagtcgccatggctgacagatatcagaacaaaaatggaatgctggatcctaattcggaacgatgaatgattgtctctctctcgattttttttttggccagctccaaggggttttctaagaaacaaaaaggttctgtgaacaacgcgaaggtattcaaaagcgagagagagtgatcttggagggaatgatgatgtgttgatgacgaagatggagttggattaaagaaatctaatttcatgattaataatttaatataacaaaattagtcttctccaatgctcaaaccggagacctaagatgtacactccctttaaaaggtactgataaaaaaaaagttattaattgcatgttggcattaaatagaatcttcctctagagttcaaaacttcacaataataaaatcaatgcatatcaaagcatatgtataagatgttagctaaccacaattgttattcatcaacggtcaggatcacatcactcaaaatgcaatattcagatggtctttaattttgtgtaaatatacttagaaagaaattcacaacacaaataaatgagaaaaagcaaatcagtaattaaccttaaaaaaatgcctaataaagcgtcattaaagaataacccattatcgcctgtcactcacttttaatcatcaaaacacgccacgtgccaaactctccactgaatcaaagtcgccaaacgcttcagtcgctatttcatgatcgacacgaaggctctcttttggcgattgcaaccaccacctaagaagaacggctacgtaatttgactgtacgacttgcgaaaaaagtcgaaaccttttaacgaaccagacctaaaaatg

SEQ ID NO: 32848 - DNA, 3003 bp, Unknown
  misc_feature (1)..( 3003): 2750-1469P.txt file - cDNA_ID_3062089; gDNA_ID_1620396; Annot_ID_155782
taatcctctctcttaatctctttgaacatttttccccaaattcgccgcagtgaatactttctcttcccgtaaatctccaaaaatcgagttttttttattacttctcaattgaatttgcttcttccgattgatctcttaattgattcgcttgtgggttggatttgaatcctctcttactttccaaaggtcataccttttcacagatctatctttgaaattgtgaagaagaagaagaagaagacgatgattcgactaagaacatacgcaggccttagttttatggcaactttggctgtaatttatcatgcattcagcagcagaggccaattttaccctgcgactgtttatctatcaacctcaaagatcagtttggtgttgcttctcaatatgtgtttggttcttatgcttagtctctggcatttggtcaaatttgtcttcttggggtctcttagggaagcagaagtcgagaggctaaatgaacaagcttggagagaacttatggagattctctttgccattactatctttagacaagacttttctagtgggtttcttcctttggttgttactcttctgttgatcaaggctttacattggcttgctcagaaaagagttgaatacattgagactactccttctgtctctaagctttctcattttcgtattgtctcttttatgggtttccttcttcttgtggatagtttatttatgtacagttctatacgccacttgattcagtcgcgtcaggcttcggtttctctcttcttctcattcgagtaagttgattttcatctctcattcttagcaggactgaagacagtcatactggtgatattatgtagctgatgataggtttctgttgtaggtatatgatactggcgacaacgactgttgctatttttgtgaagtatgttttctatgtcactgatatgttaatggatggtcaatgggagaagaagccagtttatactttctatcttgagcttatccgtgacctgcttcacttgtccatgtatatctgcttcttctttgtcatattcatgtaagttttttcatccatttttttttgttctcaaattagattatttcaggaatatataatgcagaatgaaacatctgggaaagcaaagatgcttagactttgtagaacaagttcttgtttctttgttagactcattaatattcttatttgctgtttaggaactatggcgtgcctttgcatttgttacgggagctctacgaaaccttcagaaacttccagattcgtgtttccgattaccttcgttatcgtaagatcacgtccaatatgaacgacaggtttcctgatgcaactcctgaagaacttactgcgtaagtttcagatatcccatttatttttttatgactccactgaaaagtagacatattatgagtttggtcttatggatcttggatagttcttggggaatcttgtgttattgaatgcgttttctttcttttatgcagaagtgatgccacatgtatcatatgccgtgaagagatgacaaatgcgaagaaactaatatgcgggcatctctttcatgtgcattgtctacgatcatggttggagagacagcagacatgtcctacttgcagagcacttgttgtacctcctgagaatgccacctctgcagctccaggccaacgtgaattacaccaaggttcccaacagggtaaatcatgttgcctcacatgcaaatttgcaataaaattgaaatctgttatttatgcattatgtgttgaaataattttttcctttttagactcttaatattggaacaggaaagactaattattagttttgtgcaaattgaatcaggtacatcaagctcaggtaaccagggctctgaaataagttcttcagctggcgtttccaataatagtttgagcaggcaccacgccaggcttcaagcagctgcttctgcagcctccgtgtatgggaaatcaatggtttacccatctgcaaacacagtagcatggtatgtatttatctgttgactccatgcttggtctcgagttgtagaacagagcaagcgtcaactgacaaatatgtttgtcccttatgttaaggtcgtcgggagttcctggaacagagcaagtgtcaactgaaccagatcaaactcttcctcaacacaaccttcctgttgaaaactctcatgcctatgcaaatatgtcggagactaagctagaagaaatgagaaaatctctggaaacccacctcgaggtatggtacctgactaatgtaatatcttatatgaaactccagaacaggttgttatatcttgtcactgtaaacgttgtggtgtagattttgcgaaaccgacttcactttctggagacgaggaaaccagaatccgcaggggaaccagagaacaaaggaaagtcggttgctgatgcagcagagtgaatacagtggagaaaaagaaaaacagaacaaaaggtaagtaagtgaagcagagcagatagagaaaggagaaagaagatttgtggttcttctcagaaagacaaaaaaaacatgaatatcccaaaagtgtacatgttttattattattgtttattcagtgtcatagaaattagaagcttgagactgaaacacaaacagttttttttcttactttaaagtaattgttggtttgcattttaacgtgagattctctatattaatataactcttgaatgttccaattttttaatataataaatcttaattacataagccagagaatattcttgttgtattaatgaagatgatgcttgcaactgtataagattactgataacaataatataataataaaaataaaattaagttggtggggaggggtagtttaggaaaactgtaattgcagtattgttaattggttgtctccgtaactttttaaccaatcgtttagtatttttgtaaatcgcctctccaccttgcccctggagaaccatcaccaaaaaacagagccaaacaaaaaaaaaaatctaaaagcatcaatg

SEQ ID NO: 32849 - DNA, 3000 bp, Unknown; identical to SEQ ID NO: 1396
  misc_feature (1)..( 3000): 2750-1469P.txt file - cDNA_ID_3062099; gDNA_ID_1620396; Annot_ID_155771

SEQ ID NO: 32850 - DNA, 3003 bp, Unknown
  misc_feature (1)..( 3003): 2750-1469P.txt file - cDNA_ID_3062101; gDNA_ID_1620396; Annot_ID_155770
cagtgtttcactctacaaagtgcaatatataagatttgagatccacattttctgaaatgctcactacataaattgactacagcctatctcgaaaaatatataaacctttacgtgaattttgttttgcagacttatattagaaatttaattattgttgtaattattctagctagtctaaaatttctaaaaatataacgttttatcaaatcgattttcaaatttaatatggtctggtctatagattctatgatcttcaaatcaacgtgatgaaaaagtcaagtgtaatttacgatttttgttgcataccgttggaatcatgaccccaaatattaagaagataaaacatgatgggaaggtaccaaacaaattttaaggcctaatatatccttacaagtatttaaaatacgaacaaattgcgatcaatgtttaagtaaaaaaatcaatactgataaaaaggaggcgactagaaacaagagtttccttgataactaatcagatggctttgttcaatggctgcttaatattggggtaaaagaagcttagtgacttattcaaatattgctaaacaccaatacaattaatattctagtcaataacaagatcccatagatatttgtaatatttttttccagcaatttgtatatttgtaatatttacttgtaacgataggattcattttttcttatggacggaagacaatattttggtgatggactgatggtgcatgtatttttttagctagtttaacaaaatacccacacaaaaaaagatgatcggtagcattgaattataaaatcggatataaagatccataagtcagctgaaattaaaattttaatttcagaattaatgcaacaacttttggctaaactaaacaatatatacgtgatgctacacaaattttataaactaaaacgacaatatttaacccaaacatagacaaaatatatgaattgtacgtaagaacttgttttgaatcaaaatatattcaaaaatttgttcactaaatagaagagaaggggaatgggtttgcaactaggagtattatttgaacttaatcgtgttttctaccatctatctgagcaacacattccattattgttcatcatttcatcaacacgtcatattggtaacttgaggaagctgtttgaccaatgaaaaccttgttatttgggggatacttgttttctccatcgctaatgatttgttgattgttcaatggctgcttaatgtcggtaaaataagagaggcttaggtatgctaaacattttcaggtcaataaaataagattccatatatctttgcagggatctgtacgtatatatatatttataagatacgtgaacccttaaatctttagataatgctttttatttatgatggaagataagaattaggtgcgttaaattaataattggagtagtatacatactttagcaggtataaattattgattttgaatcaacttggaatctttgtaacgttttcccctttttcgttgtttagtactcatatctaacgtttgatatcgtgaaaataaaaaaaacgtttgatatcattaactatcaaattttattgtattttgttctggaaacttaaattgaagccattaaaagtggaggccccatcagtctcccaaattcaactgtcctcatgaccccaaaaatcaacgttcaaaattgatccacgcacttcgcaaacattgttgtgtgtaactcttgtttttctttaactcgagattagatagtaataaccctgtaagaaatctacttttttttatatatcttatctaaaaggctgaaaaccacaaatttacattcaaagatattgaccaaaataatacacatccattaactaccccaaattagcgtataaatctgacatgtaaagaacatacattaatgacgacctaaaatctgctttagttaatttgacctgcaaaaccgtgttagtgctgaaaattaaagacaaatagtatcttagtttagcaaatatttatgctatgtaaggaatattttttattacaatctttatagtaacacaaatcccctaaaaacaaatagtatacctcaactataaataaatttccagtaaacaagttttataaatgttgaatttgacccatatagataataatcaaaagaatcttttttttttgttttattttgttgatttgaccaacacaattatgttaatgatgatatatagaaacaaatatgttagtttaggaaaaatatatttaaatgtgctatacaaggaatgattttattagaataacataaaatccaatgtttttaatttaattattaataatataaatcatgtatagtcaatactatagtatcccctaaccataaagaaattgccagtgaacaacaatttttgacttcttttttgtaatcacaagtgtggtggatactcagaacttttgtcgtcgttttctcttgactaatccaagtcacactaaacgattcatctgagttaagtttttatttattatgattttcatcacaatcttatgagttctgttttctttttgaattatagtagttttttgttatatatctcaatgattcatccctcttcaatcttcatcatattcttcttcttcttcttcatatgccatgctctacagaaaatatgatttctttagatttcatctttttttacttgtttttattttagtcacttgaatgtgagggagaaaaaaaaaaaaaaaaagacaagatgtgaaacgacgcatttacccttaggaagccaaacatcgaaaatagaaaccgcttttttctttattttttttcttaaagtcaatcagtaaaacaaaaactgccattacccataataccaactacactttcacagccaagtgtctataaatacagagcataattacaccatctttccttacaacacaatctcacaacaattacacactaaacaaaattcaattttgcatctccatttctcgagaaactttcgttttcgtagacttataaaaccatg

SEQ ID NO: 32851 - DNA, 3000 bp, Unknown; identical to SEQ ID NO: 1405
  misc_feature (1)..( 3000): 2750-1469P.txt file - cDNA_ID_3062148; gDNA_ID_1620397; Annot_ID_155829

SEQ ID NO: 32852 - DNA, 3003 bp, Unknown
  misc_feature (1)..( 3003): 2750-1469P.txt file - cDNA_ID_3062152; gDNA_ID_1620397; Annot_ID_155823
aaaatttatcttaccatccaagttcattgaagctcaaattgtaatgatgatatctttattcaaatatatgaattacttgtattttattcctttttttgttatccaaaataaatctataaatctgaaaaacttgaatttcactaactatggtttcatatcgcttatctcattgtgatgatgagatgatctatatacaattccgttggaatctgttggattcctgctctaccaattcttacagttgatcaccaattctttataagctaccattttgttttcaatgttatgcgattctaatgttttcaatcttccactattttactacgattttgtttttcctttattcacctgacatttccagtcgcaaacaataagccttagtgaaacacactgcacaaaactgcagcaaatgttgctctcaagacaaaagacattccgggggaaacaaataaaaaaactcaggagagttatttaagataagcaaaaaaagatacatcttaaactgatgccatttcgtttttcagtttcatgtagacacaaccttcttcaccacttttgtaacctcttccggggccttctctgccggtatgttcaccagattctccttcttcgcataatagtcaattacctgcaacaacaacaacaagaacaaatgtcaaattctctgatagtcctcaagttcatgtactataaggaaacataccggttgcgtctgcttgtggaatgcatctagccttgatctaagaacatccgcattgtcatctttacgttgaatcaatggctctccagtcagctaacaaacaacgaagttgatacagagatcaaatcacaagagagaactcgatttactaagtcaaaatgatgaatcagaatttgatggtttttcttacatcatcgactcctggaactttaggaggtgcgaatttagtatgatagcttcttccacttgaagggtgaatccaccttccagtaattctttcttcgagaaccgaatcatcgatcgcaaaattaagcaccttatctatctgagctccccttctattaagcatctcatcaagctacaagatttataaacaaaaaaagtcagaacatttacaagagcgagcagatacacaaacaactaaccacagaaaagaaccagaaaccttctctgcttgagtcacagtccgcgggaacccatcaagaatgaaacctttctgacatttgggtctgttcattgcttcatccatgataccaacaaccaagtcatcagaaacaagctctcccttatccattgcttcctttgccttcacaccaagaggagtcttagcagcaacagcagctctaagcatgtcaccagtagacaaatgacacaaacaaaactcatcctttatgaccggagactgtgtacctttccctgaaccaggtggacctgcaaattccaaatcatacatgaaccaaaactcaattcttcctttctattgaaccaaaaaacacaaattcacaatcccttcgctatgatcatcagataaagcattaacgataacagcaaaatgcaatttttacacactaaaacagataaaaatcggaactttcgctacacaattttcacagagatcaaacctaaagtaccgattgagtgaaagattcagaggtaacgaaagagatgattgtaccgatgaaaacgagacgtttgtcaggtttagaggcacatttcatacggcgaagaagctcagacatgagatcaacagtctgaatatcttccatatcaacagaagccgcactgctcgttgccatgttcgtcgtcgtcgtctcttacaagagaattagatttggtccggtggagttgtgttctctttttgaagtgcgtgtattggattcgatgcttccaatgttttctttcaccgttttacgattttacccttaactgtgccaacaactacaaaggcctgcccttcgaacaacaacaacctgcctggggttggtgacacacccaactctgaaaacgagtctttcttcttacacatctaatatcgcacatttttcataattacataaaatcaaatatcatataatacttccaacaaaccattatgttttaggtcaagtgaaccaaaaaaagcggactagaaaacatagaataagtagagtctaacacattttttcggttttaaggcacgatggaccggtcatttgtccaattaacactagtgttaagaaacttaatttgatattaagtactgaggttgaagattttgctagtttatggtagacttatgaatatcagtataccactagaccacattcacttttcgtcaataagacaattaaactcttgaaaacccacatttttcttttttttttttgaaagccaaactccatcaatgtttggttattaaagatatgaatgaatactacatcattagtttctttcttgataatttttgtatatttatttattaataagtttttgtatttttctaaattcttaacattaataaaagagttttccaaaaaatgcaaaataatactataaaattcaaaatagtacataatataagcttttttttttccaactttacatatattgtaaacgtttttacgatcacatacatctgctttttgaaaattctaaaaatataaataaactctttacctcaaaagtttcaatttgctatatacatttttttaaaatcaaatttaacaataaaaaataaaattagattacatattattttagaattaaattaacataggcccacttcttatgttgggaaaagggaacaacaaatataacaatttagcaacaaagaagtagaaaaaagaggtgatgtcataataaacggtaaaataataggaacgatgagcgagcggatctagctttcgtcaaaatcatcatcactgagtacatctgccacgtcagcttgattgggatctatttggtcgcccgtacacaaaatctcggctcactcactcacactactcaagtcaacgtttctaagattctccggcggagcgattatg

SEQ ID NO: 32853 - DNA, 3000 bp, Unknown
  misc_feature (1)..( 3000): 2750-1469P.txt file - cDNA_ID_3062156; gDNA_ID_1620397; Annot_ID_155821
gaaagacctggttctccatttaagtctttaattcctatattttaagactctcaagaaaattcaatcaattaatccggtgtatctaacaactatcacttgtctcagttttgatatgcaacagtcatgaaggtgaaaagattcactgcttctatgagatgatagaaaactatgctttctttacctgaagaacattgggaagctcacaatgaagtaaatggcatagaaaagacatccaactctgtacatggcacttcggtccacaaactcatagtaaggaaactgcacaagtttgaaaacaaaaacagaacatatgagcggttattgtcaagtgactagtttctaaacaagattctagaatgattaagtagataaacgtagtctttaagcagactataagaggaatttgtgatatatgataaaacaccaagtagagagctctttttataggaaattatcaaagaaatgtagacatcacaacgtacatttgcgatagcaatagtctccaagtatgcaatgaaataagaaagcgcaagtatccatgcagcctcaaaacaccatttcagagaatctggtaaatcagcagtggaatggcgtagcctccgaagagtaatgttcgatgcaacgtggtaaaagaggaagcaaacatgtgttaggaagaatgttgtgtgaggcacctgttcaacacaaaacccctgccataagctcatggaaacaagaaaactactcaatagaacaaatctgccgagataatgctgtgcttacattattcattttccatgatggaaaagtataggacgctccaagaactttaaagaaatagtgagtccaaaagtagtttccgacatagctgaaaacaattatccagagatttgcctgtggtaaaaacatgttccaatcagtacaactatggatgagatcttgagaactctcaccagtactcaaggaagttaaaacaagttctaaaaatagtttgaaactagaactggcaagccaaaatgtcatgcacatagaaaaaaagcttgccttaacccaatagcggtccttccaacataaacttctgtcggcctgaaagaataatgcatatattctgagtccatatggtaaggaaaacaatagagatttgcattcaattggaagcaagtagctagtagacaaacaagtatagcaccacgaacacgttagctcacagtgaaagcaaaagttgtcaaaaagtaacctttccaacgagtaacatgggtataacgaaagcaggaacagctgaaaccaaagctagaagcagatactccaactccgtgaatgtctgctagtttgcaaagtaactaacacttattagtacttcttcaataccacttaaaagacaacttcatacaacagtaaaattttcagatctctaaaacactgacatggtaaacaatgagacatcatttcataaactttgttgatctaatttagcagataaaaaaaagtgaatagctacttcaactctgtctcatcgtctcctaaatacatcagacacttaaaaacaatgctcatttgatgatcgcatagacctcgtaaagcttgtaaggaacaacgatgcctaaacagagagtgagccaaaaaggagtgtagaagaggaagaagagctctccccatctcttgctcggattcggtgccagccacaagctcggtgaagaagatcctatcaaatgtaaatcaaaaaaatcagggaatggggacgagagattcgaatcagaagaagaagaagagatcggcgatagttttacctgacataatcgctccgccggagaatcttagaaacgttgacttgagtagtgtgagtgagtgagccgagattttgtgtacgggcgaccaaatagatcccaatcaagctgacgtggcagatgtactcagtgatgatgattttgacgaaagctagatccgctcgctcatcgttcctattattttaccgtttattatgacatcacctcttttttctacttctttgttgctaaattgttatatttgttgttcccttttcccaacataagaagtgggcctatgttaatttaattctaaaataatatgtaatctaattttattttttattgttaaatttgattttaaaaaaatgtatatagcaaattgaaacttttgaggtaaagagtttatttatatttttagaattttcaaaaagcagatgtatgtgatcgtaaaaacgtttacaatatatgtaaagttggaaaaaaaaaagcttatattatgtactattttgaattttatagtattattttgcattttttggaaaactcttttattaatgttaagaatttagaaaaatacaaaaacttattaataaataaatatacaaaaattatcaagaaagaaactaatgatgtagtattcattcatatctttaataaccaaacattgatggagtttggctttcaaaaaaaaaaaagaaaaatgtgggttttcaagagtttaattgtcttattgacgaaaagtgaatgtggtctagtggtatactgatattcataagtctaccataaactagcaaaatcttcaacctcagtacttaatatcaaattaagtttcttaacactagtgttaattggacaaatgaccggtccatcgtgccttaaaaccgaaaaaatgtgttagactctacttattctatgttttctagtccgctttttttggttcacttgacctaaaacataatggtttgttggaagtattatatgatatttgattttatgtaattatgaaaaatgtgcgatattagatgtgtaagaagaaagactcgttttcagagttgggtgtgtcaccaaccccaggcaggttgttgttgttcgaagggcaggcctttgtagttgttggcacagttaagggtaaaatcgtaaaacggtgaaagaaaacattggaagcatcgaatccaatacacgcacttcaaaaagagaacacaactccaccggaccaaatctaattctcttgtaagagacgacgacgacgaacatg

SEQ ID NO: 32854 - DNA, 3003 bp, Unknown
  misc_feature (1)..( 3003): 2750-1469P.txt file - cDNA_ID_3062164; gDNA_ID_1620397; Annot_ID_155810
aaacaaaaataaaataaataaaatggatcataatatattgtggtatatagttatatggtgtaatggatttttgagtcgacattaataaattttataatatcattaatctaccgcttcaatacggattgaatttttattttattattttctaacattaccaaattctaattacggtcttttcttcttcgatgtttatatttcatttgattgtcatccccgaacaaaatttattttatatcattcaccaatttttcaattcgtccccaaatacttgtcttctccctacatattgtattttagctaaaccaaacatgctacaacagctgaaagcaaaaccatctttttatatcacaataccaattaccacattcacaaatgaaaaagaattatgagttatggtaaaaatgacttttttgtgtagaaaatggtaaaattgaccaaatttccttatataaaaatgtccaataatattatattaggaacaactaagggaggttgtaaattccaaggagacataaaagaaatgcactgcttttaaacaaaactcagtatttactctaatcgaaagatcgttcttgtatatgtgacaaagatatgcttccctgcgtaacatgtcgtttcaaagaatcaaatttcagctttcaatggatgaactttcattcaccttcaatgttcaaatcgatctcctttagttcaccaagatctagtcaaaataatgttttcctagttgacaatatcgctatatattaatttctccacaaatcatacccgaataggaagatcaacaagttataatttttaccaaaaaatgaaaaaaaaaaagatcaacaacgttttgtaatataaaaactaattccaaatttagtttatacaaacaattatttgttatttacaagtttttaatacaatgaatcataaaaaatagctcattaagtgtatatatgtatagaaatatatacattcataaatgtacaaatgtatatttatacacacatttttattcgtccatcttattaagtgaaccaatgcatattaaaatatacacattttttattttgtataaatttttattaagagttggcaataacacatctattcaccaattagcacaaattgaaggatttagttcttattgatttgtttcattttatatattactttgctataatttacaagcttttttgatgatatgaaagtatatgtaaaggaacaaaaattagaagagccatacatcatttttctgtgaaatatacaaggcgtatggtatggtacaaaatggagtatttgactactgtagcattttgagtttttttgttttaagttctaatctatgcgaatatatttggttctttcaattaattttggtgttaaagatatttgtttatttagatagtctaaatcatatataaacgatgaatttttagaagtttttttttaaacaaacaacaaatccaatttaaataacaacgtaagatagtgcactagaagtgcagtcttcttgatattacatgactattataattcaactaagcttttatttttgtccattacttagttacatcattgagaataatgaagatgaagtctaattaaggacaacctagaggatgcgcttatctcaaatcatttatttcaaaagaaatgaatatttacttcgtataattagagagccaataaaaaaaacataaagagtttgttgctcataatctcaacaacatcgaagacgaaactgaaccacctcttcacatcaaaaacacattttcttaaaaatctctcgactgtttcgtcaaattcttctgaagtctctgacaatggttttcgtccggttaagctttaactagataagctttatatgacccttgaaaagtcacctaagtcatcttccccttcttttccttgagaatctgaaaaaactttttgaagaattattcgattccttccttcttatctgatcctatccatatccaaactattacttttcaaaaacactctagatttatcgtttttcaaccccttatattcgttgaaatctgagaagttgatctcccaagttttcgcaattcccctctagataatgactttatagccattaatctcggagttttgatagatcatttatcacagatccgagcgtgggctcaatctgatattgtttgtggtgtgtgtgatcttgaaaattgaacttatggatgtagaagaaaaaaaaatatgtaattgtaaaattcccaatttggcgattgtgaaaatgtgcaatttggccataatttaggaaaacgatcaaaatcagtccaaataatttgttaaatacttttttaacccaaattgtggtattttcaaataaccaacttgaaccatataagcgttagccgaattctacatcgacctttgttagtaactatcaaacgatgttgagtcaaatgacaccataacgaacaaagtatagtttgactcatcacaatttaattggtttactaacaccatgaaggtcgatgtagaaatcgactaccgatgatatgattcaggttgctactttaaaacttttacttgttcacgttcataaatacatgctatcatagtttgagttaggaaaagtattatgcaaattgttgggttgattttgaccgttttatacataattctagcattgagaataaatgcctataagtttgtacgaatctctttttctttctctataatgaattttgatttgaagttgaaatcctaacataactacaaaatatcgcaaaactatcatgagttaaaagcaccgttgtaaactttttcctaacacttcacttttaaatctccattgtgagattaagaataagaaaaagaagagacaaatgggccttcaattttccctccataatataagaaatgggcctggcctggtatattcatcttcttcctctaccttcggtagagaactgtagacagaacaagggctagtttcattgtaaacgctaatcttcgctctcagcctccaaacacacatcaaacatg

SEQ ID NO: 32855 - DNA, 165 bp, Unknown; identical to SEQ ID NO: 1411
  misc_feature (1)..( 165): 2750-1469P.txt file - cDNA_ID_3062176; gDNA_ID_1620398; Annot_ID_155861

SEQ ID NO: 32856 - DNA, 3000 bp, Unknown
  misc_feature (1)..( 3000): 2750-1469P.txt file - cDNA_ID_3062180; gDNA_ID_1620398; Annot_ID_155858
aagaaatgcagggaatgcaagaagttcttcgacttcacgacccatgtactcgatcaaatactccagtttttcctctaaagaagtataattatactgcaggacttgaggatgttttgtgctcattgctagaatgtcttcgaatgaaagaccataactcaagtacagtccaataaccctctgcatattgtcagagcttgttctggtcacagctcccatcgcaaaggccagttcctttgttctatgcttatatccaatcttcaccagaaaaccgagtttgtgcgagagattattttcggatagagctaaaatcaatggtgctttactcaagaatttgaacatgccgggggaatcaaagccgcattccttcagaaactctatcctcgggcgcagtttcctctctttactagtgctgataacattagggaacacatgaacaatcttaaacacttgctcactcgtcaagccagcaaaagacttgagaaactctacttggccgttcatatgctcaacactataactcaatatggcaggaagtctacgtagcaccgttccagtagcgaaatcgtcttccccgcttagattcctaatgaaatcaaccctaggaatcaactgactatccaagtcactattgagaatcactggccgcctagcaattataccaattccaccaaaaggttccaagaaactaatcaatctctcaatatcttcaactgatttctgatacagcaatttatttaggtacactttgttcaatacatgagagatcttttctttaggtatcccatggaggagaagcaatctcaccttctgattaaaactaagcaagatagatgtgtctaccacagagagtaagcgctcaactaattcaggatcaagccttccttcaagttcatcaactaagaaactaataacgagatcaaattcttctgaagtcaataaattagggcacttagctatcaaaccctgaagcgggaagccattgattttcagagactgaagagaagcaacacgagcaccgattttatccaaagatgtcgactttatatctgggttcttcgctaaaatcatctcagtttcttcttctataaacccaatatctcggaataacgaaaacagagattctgcaaagcaaaagagagatacttagtgtttgcattaacgcacacaagtgtttgcattaacgcacaccaagtgtttgcaaatatgcttcagagaacaaatgaatgcagagaaatgtcagatagtcagattcacctaccaatttgacttccggattcaatcggagagctaaggcagctacatcggaaagttaaagcaggttctcgatgatttaagcagctgataagcaatggttgtagctgagaccgaaatgtagaagaagcagggaaggttccatgggagcagagagaagttaccggcgggagatgaagccggagactaatcggcggtgagaaaacggagaaggaacaagagacgagagataagatcaccatggctggctatatccaaaaccaaggtttctgattttaacggtcgtgtttgattccaagatgggttaactttaataatcaaagatttaacaaaaaatgttattgggcctgagaagagaacatgtttcgtttctaatatgggaaaattgcaaaagaatcctcaaacttttaatcttatataatttacccttcatctaccaaaaatgcaatagtacctatcatcttaacattacgatagaaaaattatttaagccacccctagtatcggaacattactatctgtctatctctttcacctttgccactatattgcatttgccatgattgtggaaacgatgtggtaatggcaacaatggagtcatggagacgatcatgcgtggcaatggtaatggtggtgacaatagccgtgacaatggattaactctttaagtgttcttttaatcagtacaaaggttttcttttcctcatgtaacatgctatggtctcaatgccccttcaaggtagtgataaatttattaagataagtttgtttgtaatttattataaatcgtcatttgctccttgcacaagtggtaatgtgtctatggccttggcaaggtcaaaggattccaaattcgtctttgcaatattgttctttttttgtttaatgtccaaaacaaacatagttgcattactctaacatatttagcagcacaaatatacaattttgtactgattaaaacacaaaatatttttctgattttcataaactaactcaaacttggaaaatgatcttttaattcttaactcaaacaattttgacatgactgatcgtttttttggatacgtaaatattatgatagaagtaataagaaatgtgagaaatttttagttttaagaagatgaaagacctagtaaatagatgttcaaactttgaatacatcaaacagatgagttaatgctagtgagcaaaattccatagtcaagtcttccaaaaaaaagtcaaaacaatcatgttataaaagtttgtaaccaatatttacatttaacacatttataaaatgtgacatcaaaaacgcggctataaaataacgttacgatattaaaaatcaaaggactaataaaactcagaatttaatttggggaaagaaaaataaaccctgcaagatttgaagtgttcctcctaatcaaccgtaatttagaaatggtccttaatggacggtggtcgtcgtttcacactctccgtccaccattttttttttttgtttctcctcctctaaaaagcaatggtctttcaagctccatcaatggctactactacttagcgtctacgaataataacccctttaccataagtccatagatttatctctcttcttctcaccactcatgtccctttctttgtcttcttcctctcaccgccttcaaagttttcatctttatccaaataaaaaaatcgtttcttttttagtttcttcttaacatatttaaaggcgtaccctttctcttacttatcctctgcaaagttatg

SEQ ID NO: 32857 - DNA, 3003 bp, Unknown
  misc_feature (1)..( 3003): 2750-1469P.txt file - cDNA_ID_3062184; gDNA_ID_1620398; Annot_ID_155857
tttttcagattaaagctatacttttgaaaatagaggccatactccaaaaccttaattatattatttttactatgattaagaaaattaatcatcgaagtcaactaacttggatgatctaagtacattggatgataacttgactacataatttaaatttaactctaaatgagcttgtcgggtaactttgtcaaaaatagtattttgtttttccactataatttttatatattacttttgatcttcataaaccttggatgtgttattttggttgattttaaaatttccaatgcaaaagtcatttccaatcataaactggaaactggtgtatatgacacatgactcttaattaagctatctcgtatacaacattcgaggattgtcatagcacgatcctctttattgaatcaaatgttggactttacatctttacttctgtagttcaacgtaccaatttcgacggacagtaaaacagtatatgtaaattataaatattatataaatgttgtactttatatgtaaaatttgtatataaaacaccaatttcttcagtgaataaacttatcaatttcaacggacataaataagcaaatgtacttcttcttttttgtgtgcaaaaaaatccgtatgtacttgttagtcgaaactaataaatagttgtacctgacttgtggtcctataacagtttgtgtttgttatctgaaggcaatgcgaagtgttggagatatgttcacaatgaacatctttcagagtagtaggtgagagatgagagatgcttctctttttgtaatacgaaattctaccaaatcacaagttcacacgtgtctcgtttgaaaagaatcaatttttgtatcaatagttataagaaaataaattatttgtcttgtggttgtggttgtggttgtggtaggtgagaaatatcaaatatttttctttgttaaacaattcaaacaaagataaccaactctgatgacttacaatggtagtattttcttctttttttttggacaaaaaatggtagtattttctaatcatggattcttatcatagattactacgaatttatttggattggatttagtttacaaacaaaatttcaccttacttaattcaactgcaaagttatttgaagagtatatacatattttgatgaggatatacatgtgttctttatattgaagggtctttacctactaatttttgtgtatgcatgtattcttaacttaatcttgttgttaaagcatttaagaaaattaaaagtgatctagaaagtgaagtacatcgaatctggtttagtgaattatctttcacaattcaacacaagttgtatagaaaattaagatggtgtaaaagtattcgtcatgctatgacgacgataaatgattttaaaattttcacttaagtattagtgtattacgtatatgtatcttaataaagaaaacaagaataatcttgtgccgaactcaatttcatagttaaaaacttttttttttggacaaccaaatgaatttaattaaagcatttctaggtaaaacttttcaatcctttcttattttctattgaagtagctgacattctatgaaagcaaatgtcaaggaaatgatttagcgttgaaaaaaatgaatgataacgattttaagcagaaactgacaatcaattaggaacaagtgtgtcgtctgggtcctactcaccatactatctgtccgactttgattacacagtcctctcaagtctaatctttttccttttattaatctatttgtttatcgattaagagtttgatcactctatagtttgtataaaaacgtttggtttcatgagaattaaagttaaaatgacgacccaaaaaaatgtttaagattgtcaagtgtaatgaccatccatacattcttagttaacctactttcatttacatatctgctaattccaaattttagtaccgtactttttcatcttagagatacttttctttttccaactttttctagaattattctctctatttaacaaaacgtgtcattctaccactgtttacataagttaagaaaaaatgtgaaaaaaatattttatgtcctttgataataatctataacagtttatctctctagtcaatagactgaaataatagggattaaaaaaaaactgcaaaacgacattctttgttacacaaaattattatattaaaacaacattctttgtgaaaagggagtattattaattagagtaaacggttaaaacattatcctaacactaataatcagttttgaaattattgttgggctttgtatgatttttttgattgttttgttaaagaaatatgatgataaatttagatatcacgtaattaaagaaaatctgttatactagaaaatcttaatagtacaacttttagcgtagtttctgttctttcaaaaatatgacaaacttgcttactgttaccgaatttaatagctttttatttttggtgtgtgcgaaaccgaatttaatacctttatacatagcaagtttaacataaaatttagtagtacataacattgtgatactagctaggtttcctaaaaaaaggcatacttgttgttactgttagcgaatgtaatagctttatagcaagtttaacatatgtaataaattataaaagctactttagttataaatttgtatttttttagaacggatcgtaatatatttggatgtattatctccgaaatatttattttttcatggcctattatttatttttattaaattttctgacattatggcctattattaattgataaaatacaaaagaatggatgtgtctcgattttcaattggaccaaatcattaagccagatcagaaaattgcgttaaaatatgccaatcgtctctaccttctttaatatattttcatataaataaacctctcaacctccacactttctcacccatcacacaatcctcaaaacagagtaacccaaaaaacagagcaatctctaaaaaatctcaagaaacctcactaaaatg

SEQ ID NO: 32858 - DNA, 3003 bp, Unknown
  misc_feature (1)..( 3003): 2750-1469P.txt file - cDNA_ID_3062222; gDNA_ID_1620399; Annot_ID_155886
tatggcttctgaaacgtatggaagtaaattagatatatatctgattccattttatttacattgaaaactaatgacttaaatttaagtacataagcagtagaagctaagtcatatacctgaggaccacgcagaacagcaaaactttccttcatctacatgcttaacatcaagacccacaaaccatgaacccgtgctgacgtcatcatgagcatacgaatgaagaatgtctctgtcacccccccacccccaccccatcatcatacataacagacaacacaaaaactcagtttcaatcttatttctctgtttgaaagatatgtgtcatcatgcgtaactgagaggtgaaactgacctattgatcgatacaaatctagccaatgcgtgcgttataacatacatctccccataagcatgccggaagtatctataagataaatgaaacaaagaacaggtggttcttagtcacatggaagaaatgaatctagtcaatgcgtggttctgattatttataaaacttacgctttcttgtcaccgaatttccaccactctggttcataccatttgtggttcctgccagaaaatcaaaacttggttaagattatatcagactgacaatatcctgacaaccccaatggtcctagtggttttgggtttttaagcttaaaactcacggttctgagaagacttcgcctgatttcatgcaaccgatgtaagcccgtgggttttccagatgtgctgcaagcgtagttcccagagcatctgcataggatcaattacattaataccacataatcatgtcagcaaaatgcatacatggaaactcgttgacctcagaccttttttttttttagtactaacttacctatatttacgtagatattgtcgatggcttttgcataaaactgtgcatcccacctatctgcagcgtaggcaaagaacagttttaccttcttagaagcttcctcgggtgcctcaactacatcatcctgaaaaccagtaaatggccaagctctcaaactaacataggtgagcttataactgaatgattcaaggtaataacttaagaggggagaagcagaaaacacatacgagaataatgaagtcatcggtttgactattttcagtatcaatgctcttgtccatgctgtcccctttatttgcactacatatcacaaaaacaacgtttcaaaacaagattccagtaccgtataatcatctttaaacacatagagaaatcaaagagtgataaacagaatccaaaccttcttccaataacaaatcttgcaatcacacccttttcactttcaagttttttaagtgatgcacctgcaataaaaggaagtgctaagctcataacacattgcaaataacagactggtgtcttactaaaacacgtataaagagaaaccctaccagtccccatccatgcttgacgaactgcatccctcttcttcttgttacccaaacttgtcattatcccgataaccactaacggtcttttcttggtttcagttccatcagcaagtttgggactttttgaaacaaagccttcttgcctagctgaacttaattccatctcaagagctgctagtgtcttcttctgttccctagaaagaaaagtctgttttcaacagtccatgaagaccaaacaaattaaacgaaaaccaaaatcaaacaaagtaccaatcttttacctgcaagctatgatcttcaaagtatcatccactgatatagcagatttcccctaaaccccaataaaagaacatcataaacattcaagtacactaaaccaaagtaagacagtaattgcaaatgtaataactttctgacatgacattactctctgctgtaatgaaagtgacagtactcaaatactaacctgtccggttactctatcgagctcattgattagatgaaccctagtttgagattcttgccataaactatctcaaaaaaatgtagagacgagaccaattaacaaacaaaacaaataagtaattgttagatatggataaatgtagatttaagaactaaccggcctgctacatagaaggaagcaaaagttgcaaacataaagagcaaaagggttgatattctcgagctcgataatcttatactcgaccctttcctcgccattgaaatagatccaaaatcagatctcttagtcaaagcaatcagacgcaaatgcctcttcactgtcgaaattcgatcaaatttcactaattcaaatctccagaaatcggattttctggatccaatgattcgtcgtcactcaaaataaaaccgattaggaatgtatcattggatctgcaattctccggtgatgattcaccagcggaacacaaacggcgagatcactcacttcgctgagaaaaattggaatctggattgagaaataaggagagacaagagaagagagtgccgttgagatttatgatttttatcggattagtttttgggatgtcaattttgtgtgatcttcttaattactttctgatcaattaccaaacctagtctctctgattcttttgattataggttaactctacaatttaattctcatttatttctactgatttgtaaactttttcgaaactgtcaaatattacccaccgtgaaaaaaagggatcaggtgttctttactaaacaacatttgttttttttgttacccggcggttgaaaaggaggaggaggtcaagacgacgacgtttaaaaaaccatgggccgtcaaatactctcgtcaaactcttaccagatgattattgattagatattctctcttccatttttcccctttcgaatttttgcatttcatcatccttttcgtgtgcttcacaacttcatctctctctcgagagaatttgcgtcatcaattcaaatcctttacgcaaagtttcagtttttattcactttcttacataacccatcaaaccaaatcctcgatcggattatgttaatcaattgctaagagctttttcttctacttcttcgcaatccgccatg

SEQ ID NO: 32859 - DNA, 3000 bp, Unknown
  misc_feature (1)..( 3000): 2750-1469P.txt file - cDNA_ID_3062226; gDNA_ID_1620399; Annot_ID_155885
taaacaagaaaacaagaaaccatgtcgattacaaattttaaaccctaacactccaatcaccatgcaaagaacattaaattggaaatctcttttgtctacataatcaataatattagagtatgataaaaatattgacatttcacgatagaacaaatacatatgcatagcctttgttgtttgtgcaaggtgcaagccagaacatacagagtagagtgaagcacgacaaacctggatattgtcacctctagggtgtttcctagcgcctttctcaggtacatttacaatctatatccagaaagagagagttggaaattgggcatcaaacacaaaagaagtcttgatatcttaaatagcagagatcttaaagcaaatactacatggcttcctttggtaagtttacaatttagtgaagacttttgcggctatttaaactgtaaacttactgttccttccagcatttttagcaatgcttgttgaacaccttctcctgatacatctctgctgatgttaaggctttctgcctggtaaccaaaaggtccaaagaacaaaattcatctaagaagtacgggatatgatgttcaagttttccaaacaagcacgaggaaaaactttttaataaagttctaaccttctttgttatcttgtcgacttcatcaatgtaaacaatcccttgctgtgcagctgcaacattataatctgcaacctgtccagagatatcaaatccccacattactaacaatatatagaaataattatagttgtatacaaatataaatgtttgtgttttagaagcttactgtgagaagtttgtataatatagactcgacgtcctctcccacataaccagcctgacaaatcatttcatttccgaacaaaaaatgaatgtcacagattggtcatcatgaaaaggacatgcgccaaaaaagactagaagaaagacgagaattgcctgagtcagggtggttgcatccgcaatgacaaaaggaacatttacaaatcgtgccaaggttttcgcaagtagtgtcttccctgtgtttgaataaaaccaccaaaacagatgaggtgagacagctgaaactacactagattgaactaataactgtattatagcagcatatcaggcttgcgcatttatgcagattggcgtcagaatattacctgacccagttggtcccatcaggagaatgttactcttctctagttctaccatatcatcatctgctggtttcgctgcagtgctatctgtttctcccgcagacctagcttcccaaaaagtaccagcatcataactaacaatctcttaccggatacatgaaattacaaagaaacaaacagatgcaaatgcatgtgcaagcaaaataaataagaagtgaactaaccgtttctgtgatgattcgtgatatatcctcttgtagtgattgtaaactgccactgaaagtacctgcaaccacaaaatgacacaagaatgtgttaaaagctaaatatatttcccatgtctaaaccaaattagaagcatgtataattcacgaatattcagagatgaaatttagcattcaactaagtagtaacaacatcaaagtataatcatttcacctttttggctctttcctgaccaatcacgaacttgttcaaacccttacatatctcctttggtgtcggaaaatcagacccaagattggatccaccccaacaatcttctttcgaattcgaccctgttccgttaccaggaccaccaggactacttccaccaccaccaccaccacgaccgagattaacactggacccattaaccctaacggaaactccatcaccaggaggctgccatagatccggtgggtctccttgtgagctcagaataacaacagaagaaccaacaccgctgagcttcttctgagcagcataacacttagtcgaattacgtctctctcctcctcctcgattatccaagaaactcgttccaagagaggaaattttataggggaatttctcatcggatttagaacggtgattacagtgaggaggacttgtggcggttcgagcggtgtggatacggttgaagataaagtatctaaaatgagaaagtgtaagagaagcggtttctcttgacgtattcgaccttaaagctgcggccatggcggattgcgaagaagtagaagaaaaagctcttagcaattgattaacataatccgatcgaggatttggtttgatgggttatgtaagaaagtgaataaaaactgaaactttgcgtaaaggatttgaattgatgacgcaaattctctcgagagagagatgaagttgtgaagcacacgaaaaggatgatgaaatgcaaaaattcgaaaggggaaaaatggaagagagaatatctaatcaataatcatctggtaagagtttgacgagagtatttgacggcccatggttttttaaacgtcgtcgtcttgacctcctcctccttttcaaccgccgggtaacaaaaaaaacaaatgttgtttagtaaagaacacctgatccctttttttcacggtgggtaatatttgacagtttcgaaaaagtttacaaatcagtagaaataaatgagaattaaattgtagagttaacctataatcaaaagaatcagagagactaggtttggtaattgatcagaaagtaattaagaagatcacacaaaattgacatcccaaaaactaatccgataaaaatcataaatctcaacggcactctcttctcttgtctctccttatttctcaatccagattccaatttttctcagcgaagtgagtgatctcgccgtttgtgttccgctggtgaatcatcaccggagaattgcagatccaatgatacattcctaatcggttttattttgagtgacgacgaatcattggatccagaaaatccgatttctggagatttgaattagtgaaatttgatcgaatttcgacagtgaagaggcatttgcgtctgattgctttgactaagagatctgattttggatctatttcaatg

SEQ ID NO: 32860 - DNA, 3003 bp, Unknown
  misc_feature (1)..( 3003): 2750-1469P.txt file - cDNA_ID_3062282; gDNA_ID_1620400; Annot_ID_155933
tctaagattgttgaggagagtttgaaggagaaaggcaaaagtaagcaatttgaagatgatcaagtggaaaatgatgaacagcaagctctgatggttcaggagagtctatacatggtggagctttctgctcaacttgaagaagataaaaacatttcaacaatacctccgctgaatgaagatgcgcagcttcagaaggttatttgggaaagcgcgaagggtaaaggccaaatagagcatttcaaagatccagtggaagaagatggaaatcttccaagggtagatctcaacgttaaccatcctcataggtaagtgtttgtctattactttggcggtttccttgcatgctttattacaagatagaaatgtcctgacctggttaagattatttcacttgtagcatatgtgatggttgcaaatctgcgattgaatatggaagatctgttcatgccttgggtgttaattggcatcctgaatgtttctgttgtcgttattgcgacaaaccaatcgctatgcacgaggtttagaaccgtatatgaaagcttccttttttatagtgattggtactttaatatactaattgagttgctcattatgttttctgatgcaacatctaactcctgagggctacttagttttcaaacacaaaagggaggtgtcatataacctgctacgagcgtagtcacccaaactgccatgtctgcaaaaagaaggtaacttcccattggggtctatgagttgaaagttaaataattggtatcttataacagtttacgacttatgtataatctgttgtacttttcctggcgatgatggatcttaatgtaattgtattcagtttcctggtagaaagtataaagaacatcccttctggaaggaaaagtactgcccttttcatgaagttgatggaactcccaagtgttgcagttgtgaaagattagaggtgggtttactttcacttcaatatgaatattggcaaatgagcatgagataaagaatcaaccgccatttcaaaagaagaagtaaagctttctcatgatttttttttgtttgcagccctggggaacgaagtatgtaatgcttgctgacaatcggtggctatgcgtaaaatgtatggaatgcgcggttatggatacttatgagtgccaaccattgcactttgaaatccgtgaattcttcggaagcttaaacatgaaggttgagaaagaattccctcttcttttggtggagaaagaagcgctgaaaaaagctgaggcgcaagaaaagatcgtgagtacattttttgaactgaaaattccttatctctctatttctctttcactcatatgttttgtgagtttcaaaacaagcaggacaatcagcatggggttgtaaccagaggtatttgcctgtctgaagggcagattgtcaatagtgtaagagcttatagggggtaacacttacttgagactaaaactagattggattcatgactttaactctgctctggtccacatatacaggtctttaaaaagccaaccatggggccaaacggcgagctagtaagcttgggtacagaacctcaaaaggttgttggtggatgtgaggtcactgcaattctcatcctatatggacttcctaggtacaataatcttttttaagctcatctcatccttctaagtaatctcacgcaaatagactaaatcaaatctcttttcggacacaggttactaactggatatatcttggctcatgagatgatgcatgcttggcttagactcaatggtactactagtacccaatttgtatttgccaatcaatatggagagagctctcaactaaaagtgctatttggtttgatcacaggttataggaatcttaagttagagctggaagaaggaatatgccaagtgctaggccacatgtggttggagtcacagacatactccagttctgcagctgcatcatcagcttcttcttcttcgaggactccagctgctaatgcatcaaagaaaggtgctcaatctgattacgagaagaaactggtggaattttgcaaggatcagatagaaacagacgattcaccggtctacggtgttggattcaggaaagttaaccagatggtctcagactccagcctccataaaatcctgaaaagtattcaacactggacgaaaccagattcaaatctttgaagcacctaatataggacaaatcgaaacatacctctctagaacatatatatacaaacgcacacttatgtctggtttttctttctggatccaaaatacaactataacagaaaaatagacatgagcacgtccaattatataactttctattttcagcacaatatcatttcatagtacaattatgacaaattaagacattgcatgtgtgctgctacataagtttcaatatcgaaaaactatgtttcacactttcttaatttaatttccagtagttgcattgtcattttcacaaaattaacccttttacttatatcatattttgaaactttcttatatttttttaatgaatgatagttagtaagtggctaaatgctataaatattttcttttatttatttatcatgattcttattggatgttgttgacaagaaaactagtactatttgattggatacagtatttcgcattaaggagctgaaacggcaacgtttcaagagggagggaaataactaattaaaatcgtctcgaaagggtaaacaattacgaaactgccaccaagaaatgtgcttgcggcacgtgtgcaaaaaaacagctggtctttcgctttggaccacaaaaagtaagtgtgtgtgtgtgtttctctttcttctccacacgccttgcattctactactttctttttcttttcttctctcaaaaagaccaattcaacacagtagctgctcaatggtctttcgaaacttctcgaaattctcgtggaagacctcgcgaactttccacttgaggaaaagaatcggaaaccggtttgggctacaacgagacccaaaaagacatg

SEQ ID NO: 32861 - DNA, 3003 bp, Unknown
  misc_feature (1)..( 3003): 2750-1469P.txt file - cDNA_ID_3062286; gDNA_ID_1620400; Annot_ID_155932
taaaacatattgtaaacatcctccatgatgatttgacaaaaaaaaaaaaaagtcctccatgaggatcactattctcattaatcaataaagaaacctttttaagaaagtgttaaacatattgaacataaaacacctcttaaggacctcatgctatgaacgggatgggatgttgtatccaattagtttacacatatttaaaatttaacacttaaaaaccaaaatattatgtatatattagaaaataaaacattttctgttatgtaaaataatactttaaaaatcttaaaccttataatagtagtataaaaatattaatttaaaaatatttttaaataaaaacacaagtaaaagtttatatgtgtaaaacatattgtgaaaacaatttactttttaaacaaattgtgaaaatcttgtgataatcaaaagtattatgtatatttaaaaataaaatattttatataaattattacttaaaaatcaaaaacaaagtttaaatagtggtataaaatacaaataaaaaattaagtgttaaaaatttatatgtgtaaaatatattaaacctaaaacacctctgaaggacctcatattatggacgggatgatgtatctaatagtttacacatattgaaaatttaacactaaaaaatctattaaaaacaaaaatcaaaacaatttacttaaaaatatatttgtgaaaaccttgtgataatcaaaagtattatgtatattttttaaaaataaaatattttatctaaattgttacttaaaaatcaaaaataaagtttaaatattgatataaaatacaaataaaaaaattaagtgttaaaaatttatatgtgtaaaacatattaaacctaaaacacctctgaaagacctcatattatggacgggatgatgtatccaatagtttacacatattgaaaatttaacactaaaaactctattaaaaacaaaaatcaaaacaatttacttaaaaatatatttgtgaaatctttgtgattagttttaaatcagaaaaataagaagtggaaaacataaaatctttttgttccttttttaaaaatcaaaatcattatctttattaaaaagaaaaagggtagtaaagtaatatacctagaagtctgtgatatcctcaggcggcgactcgtgcttgttctgaaacttgaaaccacaaacgagagcgtcttggtgttttccttcgccatcctcttatttcctcgttgtctccggtgaaagcatctcggtggctagatcattatccggtgaactgaaatcgatcttgttttttactgtagacgacggtggattgatggagattatcattcaatcaatgaaacgatgatatgcttttcggctccgatcagtcttaaatcttacggatgttacagagatcatcatcatcggcttctacttggatcatcgtcgtcggcttctacttggatcatcatcatcgatcggaatccacagagtttatgtataaagagagagttttgatttgtctctaaaagaagaagatgaaaaagggtgaaatagagagagttttgatttgtctctcaaggaagaattagaagaagcgttgttgagactgcgtaattaagagacctagtttttatttataaggaaagaggttcaaaagaaaaaaggaaattggtaatcacaattaacggtcacataagatttgaccccaaaaaaaaataacggtcacatgagatttccttttttccttggatggcttttcatgggtttgttttctttgtttgttacgtgagagaatctgatgactttaagtaaagtgaagaattcactcattgcatgatccgatcataaaaaaacagagatggagttgatgattcgatcctcaaaagtatactaaccacaacactgtcttctttcatcaaaactagagagtagccgaaaaatgaaaactttattgattacaatctgactttctgcctccaattggttaatcctctctactagcaattcatctttctcattctttagcttctctaactcctcaactgcagctaaccgttgcttgtttaagataaggatatctaaaatacacaacaatacattcgggtgagttaactttcacatatgaaaccgaaaccaacctcaaccaaatttctttacttttttgagcttctataaagaggttccatatgtccttatgttttgcttcttttataatagaagattgtgcaagactttcctgtgaactaaaccagttacattctgctagaaaaatcaggaagtagtagtatacttcaaaaccaaagaagagtaacctgagaatcatcaaactcttcatgcccttctgatcttgaatcaaaaataatacagttcaattatagagaagcaaaatcaatctttgcagcacaaatcagcaagattgaaaaaggttcacttgtaacttctgtaaaccaaaattattgttaattgactttaattaagatatacgtcacgtggcaaaaccagctggaccacaagtgtttttttaattgactttcttgtccatgtgcctgcgtttactcctctttctcaaatctttcctcatttgctcactcccattctccagttgtggaaaccccccaaagacatggcatttgaaccttttgagtcatcatcagcgtattcattcacacgacgatttaggtcagcatttatcttctttaattcttactttcacttgatcctttttatctctccgcgtcgttaattgtgaaagtggagagctttacataattccccaaagtaaaaagcttcgaattttaattctcataacaaatttcacaacaggtcagcctctaatttggggaattctagaaaaccctagtggaaaattttaccaatttgattcttttaagtatacaagatgacaagttttgcttcttctgcttggtgctgtaaaaatttctaagtttagatttaactttgtgtaaatgcttggcttgttaagttaatttttgtttttcttctaatcctttggtttcagagaatg

SEQ ID NO: 32862 - DNA, 3000 bp, Unknown
  misc_feature (1)..( 3000): 2750-1469P.txt file - cDNA_ID_3062296; gDNA_ID_1620400; Annot_ID_155922
gatccatctttttattttctttaattttaataaaagttaatgtttagttggagaacagcaagaatctcaactactctcaacacgagacacattttcagataaattacgctttgggagaagcaaaaatcccactcatttgttaatcatttaaactaattctttagtaatatatacacacccctctcgttttctgctttccactgtttctttttatgtgttactatttcttttttaatgtgtaatgcattgtttcaattgatattacaaagtatattaattgattttattcgtattttttttattgatattcatttgataaatcatcaaaactaaacaaaagaggaagctgctttttgtttaagtggcagacatattatctagactgttttttagatataataacgtttcacctaattctgaaaattgggaaaatttgacgtttaggaagcccatgtggactgcaaggagacattaattggtgtttttctaaatttatatatatatatatatatgaaatttattgcaatatttacagatgtaaagtgagtagcaagagaaaagaaaaaagtatgtgcaattatcaatgcattgatttgttcatccacagtctaaaaccaaacaaacaaaaacaatacactaataattcgacctttttgaaattttgaatgtggaagcaaacattacggttgctcgtgtttattatatatgtttgtagtagacccctctttggaattgattgttacaaacatttcctttcatgtttttaatgcttatctaaatatgttcatctatcatctcatactagtacacattttcttcacttaggtttagggttttttgggagtttatgaagatgtaagatacgtctattaatatgtaacttcttagtatgatagtttcatttttttggctttccatttatgaaacaaaaatcgtatcaaaatatatatatacttattccaaaacattcttttgggctttaatatacttttcccccaaaaacatgtggtgtattcttgatctttttaagcatggatgcaatatcttggactccatctactaatagcacaagacaacaaaagaaacacaatcaaagtaagcgtagacttttgcgaagagaactttggaagtcattcatttttccttcatctcttttgctttatcttattccttatgatctcgtgttaggagaaatatcatttgatggaatgttggctttataaagttacgaaagactaaacaattgtggtttcatattctcctcacatcgtctcgtccatttcaaactttcacaccattaaacattagttaacatatacgttgaaatttgttcacaactaaaacgcttctgtcaatttttagaaaaaaacagaatatcaatcacataaatgtaacatttgtgtttatccttaattgacatacactatatcacaaactactagtctagtagctcgcttaaattaaacaaaccatttgatatacaataaacggtcaacgaaagtttagaccacaaactccaaaagaagcaaacattcatttaagaatctaaaattctatgggtaggaagttacccttgttcagaggctgcttcgtttgatttttttcttttggactttacgtagactctgaatagtcttaaatgcttataatttccatgaatagacttgaatagacatgacaaacatttttgcaactgcacacacgaaacaatcaaaccattttgatttggctgtttcgtggcgaaacggtaaaccacaacgctgattctggaaccttcttgaggaacatcagagtcaagtataacgtcaatatcgaagagctttcgagctttcttgaagaagacatattctttcttctaggccatcttcttagaggagccatcaggaatgttaacttcttcccctctggctgcatccttgtcatcatcaaaacacatcgttttgaggagatgtttgttcgtagagatggtcgtgatacacaacgtgggcgccgatcaccaccgcgtcccatttcttccactggtcatacacgtttcaactccttcactcagagtctatgtcacttgttctatctctgttactttctccccggtagtgtttagtatttataaaatagtcctagtagttgtacgattttcacaataacttccatatgtgcgagaagctcaaaaacaggcccaagggtatttataattgcaacccctttgaaaaacgtaaattgctttatcaccaataatgtttgataatttataaaataattcaaatagctgtaaggccttacaaataggcccaattgtttttatggcttgtaaactattccccatttttttttggtcgataactatgccccatttgaatacctatttttcttttccacaatttgaatacctattttacatttacatgtgacatcttcttattggatcatacagattacaggctgtgataaagaatggaggatcaactttacatatttttcttttcacaaacaccattttcgggaagacaaaaattccaatataaagaattccaatttcttactatcattgcaagaatgaagattttttagctagataacctaattttccatgactaattagctagatagcctaattccatgtgaaaggtttggttgtgattggtgagatgacaaaaaatatatataactataatgtaacggtaatgttaaactattgttaaaaatagtaaaaaactgtacatggaaaagatggattttatttaaaattttcataataaagctatagttaaaacttatgataaatgaaaatggagtattacaataatattcttcatagattgaaaaaatataaaaaaagataaagataaagttgaagggaattgttaagagttattcttgaaagtagaagaagcgtgtggattggacatgggcttaaagacacacaaattctttctacgaattttgttaatttttgttatatttccttcttcactattccgcttagagcacaacaccacgatg

SEQ ID NO: 32863 - DNA, 3000 bp, Unknown; identical to SEQ ID NO: 1420
  misc_feature (1)..( 3000): 2750-1469P.txt file - cDNA_ID_3062300; gDNA_ID_1620400; Annot_ID_155914

SEQ ID NO: 32864 - DNA, 3 bp, Unknown
  misc_feature (1)..( 3): 2750-1469P.txt file - cDNA_ID_3062300; gDNA_ID_1591080; Annot_ID_150487
gca

SEQ ID NO: 32865 - DNA, 3003 bp, Unknown
  misc_feature (1)..( 3003): 2750-1469P.txt file - cDNA_ID_3062357; gDNA_ID_1620401; Annot_ID_155967
gatctttttgaggagcatcaagactggcttactcaagataatcttcataagctctcggatcatctcattgagtgtgattatgtaagtgaaccaacggtctcaaacctctcaaagtcattgaaatctcgatgtgggtcttcttcttcttcagcacaaccattgttagccgtagatgtaacaactcaaagtcagggcgaaaaaccggaggaagatttgcttctgcaagatacaacaatggaagatgataatagtgctaatggtgaagcttgggaatttacagagactgaactcgaaacgttgggtctagaagaactcgagattgatgatgatgaagaatctagcgactctgattcactttcagtttatgacattctgaaagaatgggaagagagtagtaagaaagaatgaaaatgcttgtaaatttcctcaaaatctttagtagaacaaaatctcaatttttttgcttactcatctcacttcaaaatagtttcaaggttactaaacagatcatccacatacaataaaagatcagttatacagaatctcagattcggagaaagaacatacatatgatcaaactgcggatttacactgttactaaccaaaaaaagagagcagataggtttggaaacttaaaaaactctgcaggtgatgagatatcgcctgattcaagatcggcactcttaagaaaccagtaaacccactaagtatatatattttatggcttgctttgttacagaacttccccatgatggctatttctttctgtttcaccaaggatgattacggatcctgaacttcaaagctttcatggctgcctttgcaaatatctgagcagcttcagcttctgcttctgctctttctgcctcttttgctgcttgttcagcctctgtgatagcaaattctgcctctgcaactgctcttgctgcagcctctgcagcttcttgagctgtcatgccttttatcatatataattcaccgtctactcggaatttagtgagactgttggcaccgttctcctcgggttttgttgggtctttcttgttgtttccttccagaaagagttgaggagccttctgtcttgcacctgcgggaataaaattagaagaaaacctgtacttgtgctttatctgaaagtgagaaatcaccaagtaagtatttttgaaaattctgagagtaatgaagtgttagtgatcatgaatcttgaatcaaaagttgtgtgtttaccttaactaatgttccattcgatgataaatgctttaatcgtactgcgacatgccttttcatattcggtggagtcttgaaattctcctgaaatttaacagctactaagtaagtatgcaacaaaccccaaccaaacatgtaatcccaatggtagaaatacctctatatacagaaagattgatgttctgtcagaaccgcgtagttccctcaagttggtaattgcctcaaagatgatcttatccaaactacaaaaacagacaatagcgcaagatcaaatctttatgaactcaagaaaatcgttatgtggtgcataagtcagggaaccaaaccttgtaattgatctcttagaagcacaagtgcgtggtgatccaccaccagaacctccgggggaagttggttttgcacgttcatcatcattagtcaaagccacaatggtaagagctgtgttgttatcatcctgtttagtacctggtggagtcctcttaagcgcaagtttagccttcttccttgaaccccataaagctgtcacgcttatatttctccatttgtcctgttatgccttgaactatcaagattagtccgaaacacgcgatcacaacctccaaaaagcatattatattgtattaccttaagatcaacattagagcgagacttaaggattaaactaaactcagtatccgagagtatggtacgccacttcccagtcccatgcttaagaactccagctttaagagctgcttcttcttccggtgtccacttctgctttggtgcacccatccacagttatcaatatttgaatttcttcttttctctgccaatagatgtgaacgctaacattagaatctgttaaatcgtacgaaacttaaccacatcaaagccattgttgaacatttcttatccaatacaaaattttggtcatctaaatccagcagatacacaaagccacaacataaaaatgtaactacacaaatccaaagaaattagatacgccccaaagctcaattcaacaaaaaaatgagtgattcgagcaatctcgaaccaaaaaaagaggatcaaagcccattaacaacgtcgcaaatcaacaggaatttggaaatacagccatcaatctaaagcgatagctaaattatcaaccaaattcaaatggggcgatcgtagaaaattaaaaacaaaaatggaaaattcagagaaggaagcagaaaggaggaaggaggagaagaagcatgccagatcaaacgaaaccaaaggagagttttcgagagagagacttgatgatgaaagctaattccttgtatagatgtgtcatagatcaaatgtgattcgctgaaacgaacgaagaagaagaagaccagagaggctagcataaggaagaagaatatccatagaaacgagaaacaaacttgagcttttcttttgtattcaagctaaggaagatgtaaccctatatttctccacattcacaaatttgcctcaagtttatcaaattacacaataaaacctaccaactaaatgaataggatcaagctgaataaaatatactagtactattttttaaaaataatgtatctataaaatttatcgttgttaaatctcacagatagtttaggggctattaaagatttttcatataatagtaagaccgaaagcgtaatttataaaattttgatggctagattgaaatatgtgttttttttttctttctaaaatctacagaagtagaagaaaccaaagcgaaatcaaaaagctcagcaattttccagatttctctaattgacgatg

SEQ ID NO: 32866 - DNA, 3000 bp, Unknown
  misc_feature (1)..( 3000): 2750-1469P.txt file - cDNA_ID_3062369; gDNA_ID_1620401; Annot_ID_155954
gaaggaaaaatcaaaacagaaacagcttaaactcgataggatcacccaaaatataatcaaaatctaaaaatcatttcaatctacaggataaacaaattcgaaacaccagaacttcgaatcaatgaacaggcataaacgcacgcactaattgcgcgatttcaaccggaatcttaacgatgagagaaggaatatagaagaagagcgatacgatgataattatacctttggctttcttgccgatatcggtgaagagtcctggacctttgctcatggttgatcggagattgagagagatcggcaggcggtgaagatatcaagatagaagaattacgacttgtttttctcgtggtagacgaaaataaatagcgaagccaatactatataacagcctgtgacttttctttagtgactaaccactcacagccgttgatgtggcacaaaaaaacacatgacgctttatgagataatcgaatcgctttttggtaatgaggtctaatatataaaaaggttacgggttcgaaatcagcccacgtcaactttaccctctaattctctcctatttgttttataaacatgttaggcctagctcctgatgggcttgttaaacataattatactgggccaaatttactctctaattctcttaatttatttataaacatgtaaatgattgggcctagatactactgggcttattatccaattatggcccaacctaaatgactatcgaaccctatactatcacaaaccgtgaaggtcggatctctttcttgatttggccgacacatctgatctaacaatggcgacgaacaacatcgtacgtttgatcgctccaagccgatccgtctcctctagattcctcgagccagtgtcacggtttctaagctccggtacacctcctccgccgcaagctccatctccgaatcaggatctgaaccgggacgtgaagccagatcagaatcttcaacagaatctgcagatgcagaaggaagaagaagaggaaggagaaggtggtggaggtggagagtttgtgaacgaagatactggtgagattggagggcctagaggtcctgaaccgactcggtacggcgattgggaacaacgtggtcgatgctctgatttctgagaggattcatgtatccctgtgttttagcttgttcttatatatttctgggaaaaatggaaataaattcgttttatgtgtttatgtatttgcaaaataatggagaaaatggaagaaaatgtagtagaacttcaaattcgttgcctttatttggatcatcattctctggtgatcttgttattccagtaatagttaataagttcttcctcaggtgggttaaatgtgcatctatacatctctatctaaaaaatttgggacactttaatacaggtttagtgatgatttagaattaaggaaacaacaagagatgagtttaactaacctgagagttcagagttcaggtttgacattacccggtggttacatgagttctggtccaagtttaggcatggctgcatgggtcagtgagatgatgtcaaggtatttctgttgttcaacaacattgcaatgtgcacttctgtgataactacaattgcacaactgggtgatgctcaaattacaattaaatccgtatatgatataaaattacaattaaaaatatcagtttacatgatatatgtattatgttccaatactctttaaaagttagaaaaagattggcatcatcatgcattttttttttttttttttttttgaagttcttataactttactccgatcaaaaactaaaaaaaaatacaagaaaatgatcatataaaaagcattttgacttcttcttcttctgttttagattattcgatagaagaaacgtggcattatagtaaacacagaaaaaaagggaaaaaagggtaacaatcaattcaagcgaagctaagaaatatgaagagagaccagtaaaatatttatgacgcaattttgcggacctcaacataattcacgattagttaacatttttgaagagagtatctgatcatgtggttaaaattaagactaatctaaatttatctttgaagaagaaaggataataatacggataaaagtttgaaaaaacgaacagctaattatgagctgtgtaacgccgaacaagaacaaaaaaaacaaaggacacactgatctgtttttgtacggctcttaaattaaatcatttataaaaaaaaaacatgcagagtcgtgtttcaattgataaagccgataataaaaccaacttgacgaaagctttttcaagaacgaggaaaaaaggccgttaaggcgcgtggattctcagccgtccgtttcgtaaccgtagactccacgcgcctctcgggtaattttcgcaggtgggtgtctctgttgatgatatgaaccaagaaaatatcttcaaattattgaacacaaaagtaagaaaaaagtgagataataaggaaattaaaacaataaattatcctttcggtgggattttttttgtcgtcttctattgtttttgtgagtgtgtgtgtttatataatggtaagagatctctgatctctcaagcttctctatagagagagtttcttctcatgctctttctaccaaggagaagattttctcgttaattttgtttgacttgcctcttcgaagcaacctgattctgtggtctgaatcttttcaaggtatatatgtcggaacaaattagagcattgattgattcttgttcttacattttctatcgatctgtttcaagaattcttgttatttctgattgatattttcgtgtgaatatatatgtagagatttgttcttatcctattcgatttgtaatcgtaaatgagatctggttacataatgctgtgaaaattgttgtctgagtcacatatttcgtgtagaaatgacaatgaagtttatctgtggctaaagaatcgacaatatatattttcatttgattgatgcagggaagagaagataagctaaacaagagaatg

SEQ ID NO: 32867 - DNA, 3003 bp, Unknown
  misc_feature (1)..( 3003): 2750-1469P.txt file - cDNA_ID_3062384; gDNA_ID_1620402; Annot_ID_155995
agttatattgtggtctcggtttcctagctgtgcaaactataggctttatgcgtcttaccttttgggaactaagctgggacgtaatggaacccatctgcttctttgtcacaaccattcatttcatcctcggttacatcttttttcttcggacatcgacggaaccatcattcgaaggactttttcgacagcggtttaagaccaaacagaagaagcttatggagaggcatggatttgattttctgaggtacaatgagctcaactctttgttcacaacatttccgtgtaaatttcattatccggtttagttagccgcatcctctccttggctactctatgatttgtaattttgtatagcttgtgtagacttaatattgggccttaacttgttgtatctatatatgataaagttggattcctactttttgtgcaccctcatatcatatatatctttgcttagttttatgagcttaggcctgtgttacggaaaaagaaccataactattgttttatctaacccaaatcgtttcaagagtttctttcgtgaagtaatttaggtaattttcaagaaatgaagatgtaatcaagaaaataataattatatgttattatggtttattgccatcaagactggattttttttccatgaacatgtttcatttcattatgtagacgtttaacgtaacatccaatgatgtcatacgaaaccaaactctagtaaaaaatctaacctttaacccccatttagtaaattagccagctgtgtaaaaaatgttaggacagaaagtcattcttttttcttaaaaaaatatttaaatcactttattgttattttttaaatgattttgtgcaaaaaatatttttaagttgtacatttttgcaattttaccttacactttcaaaaaatacaaattaattatacgaaatcaaaaataatacgcaatgtaattttttcgcttttttcaaatgaaaaatattgataaatgatatgtcaaatcaaagtcataacgacgaagaattcaaatctactttcaaaaatgtaaagatttaatgtatgtgaccatgaaaatgtttacaatatacataaaaatgtcatattgcgtattattttagactttataaaattaattatatttttgaaataaaaggtaaaattgtaaaaattgacaagtttgaaagcttttttgcttaaaccccttatttttattcattgttattttcaaatattacatttcccttgattaagtaacataaaaaatagccgacaaaaaagtaatagaaaaataagaaaatcatccacaaataacatgtataataaacaccttgttgaatgttattaacattatatttcacttcatataaaatatagctttcactttatcaacaaaaaaagaaaaaaaagaatatagctatcattcaattgtttcctcaaataattattaatatgtcaagaaaagttgatccatagtcctcttgtaattggtaaggatttgtaaaccattaacaaaaagaaaagagagacgtcgatatctattaatagtcgaaaaagttaagttggtggaactttaatctaccaactataatcatagtgcgaattcgtttgtgatttggaacacgtaaatagctggaggcattactacattcttgaccaaaaacgcaacaaaagcaaccaccaattgcattactataatcttgacgcaacaatgcactcattttagtaactatttacactattttttccttacattttctgctaaacaattacaaaataatcaatattacatacacaaattgttgaattattttctacgctccgatttaatacaaaatcatgatatctaaagggtcggatgaggatatcaagattttaaggtttatatatatggatttagatccgtatccgttaaaaaaaaattaaaaatctttgataaaaaaattttgaaaaaaatttattaaattatatttctacataaattctatgatctttttatataataaaaagtaaattgaatttatttattttttatataatttaccaaatttatttaatatcttattatatcaagtttcattttaaaaattaataacttatatgatcataatacgtatcaagtcgattagactgatactatcaaatcttgcaaattacactctaaggcacatcttcatgtgcattagaatctgatgtcaatttaactgtcatagtccaaaaatattcattatgatttgtccggattcaaccatcgcattaccaaactcatatacgattcaaatcaatcaaaaatttcaaaaatttcggatatctaaacgtataagatttagtctgtttttaatccacaaaaccaaataccacaaaaaggttatatttatgttactacttaaatagtttaatatagaaacttgaaacagatttaaaatcttaagataaggatgatgatgtggatcaaagacagcgaatgtcccaacagttttcttctattcaaaaatcatttagactgcaacaaatgtaaaatgtgtatttaataccaaatctgtaaccacaaaaatttcaaattagattatacaaacaaaattgacaccaaatattgattctcactttaaatgtattacagtaacaattatacattataccctaccaccaactcctacccaatccatttgtctctctctctctcatcctttagtgtcacttgtttttgtacaaagagagaaagagattggaaaaaaaaaaaaaaaaaaaaagatttttgtttgttgaggttgctgaaatctagatcacctgttttgaatcagtcatacctcaaaaaccctaactcttattatcctctcccaattgaatttttcaaagcttgaagaaactagtagtagtaatcttcgctctgtcgtctgatccatttttttatcaaaatctcgagctaaaaactcttgtgtttaagcaaatgaaatgcactgtgtttgattttgagatttgatggaagtgaagctgtttcttcgaagaatttcatg

SEQ ID NO: 32868 - DNA, 3000 bp, Unknown; identical to SEQ ID NO: 1447
  misc_feature (1)..( 3000): 2750-1469P.txt file - cDNA_ID_3062410; gDNA_ID_1620403; Annot_ID_156026

SEQ ID NO: 32869 - DNA, 3000 bp, Unknown; identical to SEQ ID NO: 1448
  misc_feature (1)..( 3000): 2750-1469P.txt file - cDNA_ID_3062414; gDNA_ID_1620403; Annot_ID_156024

SEQ ID NO: 32870 - DNA, 3000 bp, Unknown; identical to SEQ ID NO: 1452
  misc_feature (1)..( 3000): 2750-1469P.txt file - cDNA_ID_3062423; gDNA_ID_1620403; Annot_ID_156017

SEQ ID NO: 32871 - DNA, 3000 bp, Unknown
  misc_feature (1)..( 3000): 2750-1469P.txt file - cDNA_ID_3062439; gDNA_ID_1620403; Annot_ID_156030
atttgcgcaatgttaacaaccttaacgactgtgaaactattgaatctccagttaaggctgttactggaggtttatttgaagacatattttcgaaaggaggctcgattttatacagatgggctccggttagtaaatacatttcttcttttcttctatattggtttgctaagtatacaactttgatctaactcatgtgattgtatcagatgggatctaagagagaagctgaggcaacagaagggatgctcttgagcacatttgactatgcttggaacaaaggaagtaacggggagcgaaggcagcttgatttgcttaagaagctcggtgatcgcgagtttatgagcaagagaaagtccggtatatctcgaatgctgtttccttttcttcggaaccaagttggtatcagaataaaaggagagaagcatgtgcttaaagaagagaggaagctaacctgtgatgttgatgaagagaagagtaataatttcctcacttcaatactcaaactcacccggtctagacctcaaccggtttcagacagatttgatgaggttgatggttcttgttctgatattgtttgtggagtcttacttgaagatggtggctgttgcattagaagtccagtcaaagggagaaagagatgcatagagcataaaggacagagagtttgccgtgtttcacccgaaaaacagacaccgccaaagtccgagattttcactggacaagatcatcacaatcataaagactctgatgttgtgtgtggagtgatcttacctgacatggaaccttgcaataagagacctgttcctggaagaaaacgatgtgaggatcataaaggcatgaggatcaatgcttttctttttcttcttaaccaaactgaccgtgagaaaaccgtcaaagacgagaaacctgatcccgaatcgcataccgagtcaatcgaagaagaagctttgactcgcttctgtgaagctacaacaaagaatgggttaccttgcacaagaagttctcctaaaggaagcaaaaggtgttggcaacataaggagaaaacttccagcgatacttcgccggtatattttcagccagaggcagcaaaaaacgtagcttgtggagttaaattaggcaatggattgatctgtgagagatctccggtaaaaggacgtaagagatgtgaagagcataagggaatgagaatcacctaacctctgcatcacttgtttatgttatttgttacctaaccagaattgtttgtaccaaaaccgttttggtttcggtattggtttgctgaacaatcatctgtactggatgactcacaatctcattttttataaatttaaaatcagttttgattaacatcgttgacttgcatctttgcattacattagatgtttttagatttaaaaatacatagacccgtttcccgccatgcctccactttgttacttgtccatgatgcgaaaaactgtaaacgacccatttctttttcaacttcccttcgcttcttccatatatctacgatcgtaatatatcagagctgccttctttcattatttttctgtagcagaaccgttttgttctgttttattttgtttgacaatgtcgtttgttctattatcgaagatggcgaagttgaagtttaaccatatacgacacacaatcattagcacgcaaaaaagcacaaccattatgccggggataagtcagctcttgaacaataggtctcttatcatctcatctattcacaatgttgttgcatttttatcctctgttttttttcttactattattggtccttcaggctttaaattaatggtcataatgtatcaccagattgatcggaaaggaattcagttccgccgtccccactatgttcaagagagaagactacaagctgactatacacgacatcgcattctccaaatggcggaatcttataagacacaatgattggaaagatttcaataatagaaaagaaagggtccgtagatacagacatgaggacttaccccctcaacgttgtacgggtctgtatgagctcggtgtaggcgtcatcggtcaagaccaaggccaaaactttgatcctgataataatgttcttggtgtatatgtcggacaatgtgtagacgtaaaatcaagactccaggattatggaagacgcggtggtcatttgccctcgggtttatatgaggacatattctcggaaggatactcagttttttatagatgggcaccagtaaatacatgtcttcttatcttctctagttggtctgctacgtatacacctttgatcctaactcatgtgattgtttctctgctttaccgtgatttatcagatgggatctaattaagtaggaagctgctgcaacagaagggatgcttttgagcacttttgattatgcatggaacacatgcagtaatggggaacgacgccatcttgagttacagaagctcggtgaccccgagtttatgagcaagagaaagtcacaagtgctagttccttctattcgagaccaagttgttaccatcaaagtagagaagagtaattatactttcctcacttcaacactcaaagtgatgagaccatttggttaaccggagtaaacctacatcgactaggtcaaagatatggcttttgtttctcctaaattaattggattgtaacccacttattcacgtttcaaatttgtagtgttagtagttaatttgtatagtttctttttttttttgatcaaaaatttgttacggaaaaagtttggtaagaatgtcggcagaatcaccaccgtcgattaacggaaagataaatctaatctaacggttattgataaagcataaaactgacggctccgattttattttctaaaaatcacgttaatcacgcaccaggtggactatcattgtctttaatctatggatttaaaaatttccgcacgattaaagagcgtctcgaaaattaacttttataggtaggaggagatagaaatcgaatcttatcgccgcgttaatatg

SEQ ID NO: 32872 - DNA, 2240 bp, Unknown
  misc_feature (1)..( 2240): 2750-1469P.txt file - cDNA_ID_3062467; gDNA_ID_1620404; Annot_ID_156062
agcttttgaagtttaaacccgagtaaaagaagctaagataaggcactaattatctgaagtaactcgagagaagccatttgtcagcgttcaaaactatcctctaaagaacctcgtacgtggcagtctgaaaacgtacgtgttagcttcgtagaagtgaagagagctccaagacaaaatcttcacgtgccaactaaatatgaggtgttgatagtgaattagtgatgtccatcctcaacagctccaccgcttgacatgtatcgatcgtgacatgtatctacaataaataacttgttgcttacgcagaccggtgcaactataaataacaatacgtgaagtagcataccttgtcatacgagcaaacttgtaaactcaattgcatggtagtaaaaatgaatacgaaaacgtttattgtatggtttcttttggtagcggcggttgttgtagctgttgcggcagagacttccgtggatgacaagaaacaaggtttttactatacttttttttctgtatatgttttataagcttgatagaattcttatgtgagtgggggtttgaaacaggtgaaaagcaagtagagataccaaccgtagaaggaaaaaacgacgctaaggatagtctcaataaaggagacgttggtgttgaggctaccgttgagaaagaggaagaaaacaattatgaaattgatcaacatggtgggggatggaagggaggcggcggccatggtgggggatggaaaggaggcggcggccatggtgggggatggaaaggaggcggtggccatggtgggggatggaagggaggcggtggccatggtgggggatggaaaggaggaggtggtggtcgaggaggtggtggtggaggcggtgctgagttagagaccgtagaaatagatagtgcgtcagatgaggatgtacaaaattatagaggtggccatggcggaggatggaaggaaggcggtggccaaggtggaggatggaaaggaggcggtggccaaggtggaggatggaaaggaggcggtggccaaggtggaggatggaagggaggcggtggccaaggcggaggatggaagggaggcggtggccaaggcggaggatggaaaggaggaggtggccaaggcggaggatggaaaggaggcggtggccgaggaggtggcggtggaggtggtgctgagttagaaaacgaagaaataaatggtgcctcagaagagattcaatggcaaggaggcggaggtggacatggcggaggatggcaaggaggcggaggtggacatggcggaggatggcagggaggtggaggaggacatggcggaggatggcagggaggtggtggacgaggaggaggatggaaaggaggtggtggacatggcggaggatggcagggaggcggtggaagaggtggaggatggaaaggaggcggtggcggcggaggatggagaggaggcggtggcggaggaggatggagaggaggcggtggcggcggaggatagagtaatcgaccgtctctactcatctgaaaaccaaatattatgagtagaaatattagtgtaagcaaatggtaaactataataaacaaataacgtctcatgcacggtttaccgatgcattaagccaccttacgtagcctagctcaaagccttaactgtcatgtaagttatatctgttgctcttcgtataatcaaagataagtgaatattaaaacttcgaacaaatcgatttttttgtgttcaattatcatatctaagatatacacatattaccaaattacttattaattaggtttagacagatgtggaaatacacaataatatgttctatcacacacatttcttcacatctctttatacgaaataacattttaagattattaagccggcatcaatatgctttcttgtcatgaattacatagttttaagaaataaaatcaaagaattttgaatatatgtcacacagaacacttccacagtttcttgtataaaatacaaatcatgctaacaaatcttataaaaccaaacagttttatttgtattgctcttccaagtgccacattctctgcttcaagtagttataaattaaaaaagtttggaagtcttgtgttttagtttatagctatttcaatggatagtgaatttaaaacgtattacaaaacctttgatcacaattttactctatttgtataaacagagtttataaggattaaaaatgatgttgataaaagtattagttaactgaaaagtaaaaatg

SEQ ID NO: 32873 - DNA, 3003 bp, Unknown
  misc_feature (1)..( 3003): 2750-1469P.txt file - cDNA_ID_3062471; gDNA_ID_1620404; Annot_ID_156060
gaaaatcactggttctgatttctgcaaaaccctgtttttcagataaactttcagattcaagttggagtttctggaggagattttcggtaagacctgagctgtttagaaaccatagacggtggtttttgatacaaaaagtgttagggaagctatctgagccgtcaaaaccgtcagaaaaggtaaatcataatcaccataacgattgcttcttacgcaagaaatttctgtttctgccaattcctgaaaccctagatacacagattcaatgtgtcatctttagaacagcgtatagaggtctcaacgtatttcgatcggaatgaatttttgtggacagttacgtcgcactatagggttgagaatcaacggtgggattaagaagttaacggtccattgttaagttactagcacgttttggtgacacttaaagattgatttggttctccaaattctaaatttcagtttgatttttcttttcaggttttaaagtcttgaatgatgatgaagaccaaggaggccgatgcctcgaccgtgaacggggcctcgaccggcttcagttgggacatcaacaggtgttcggctggggctgcagcgacaagcgtctggtgggacatcaacaggtgtccgcttcccaatgacgttgatgttcgtcgggtgagtccgtttataaaacgggcgttggagaaattaggctacactggtgctctcacaaccactgccattggcatactaacagacgttcctcatgacttcctcacacaagtctattcttctggaatcgctattcaccacatccctcttggttagtgtctttttacattattagattggattttttgtagatgaataggttgaacaattttcttttataatttgtcaaatggttgcatgtagatgaatggttgggaaatttcggtattgatcacaataaaaagttgaacatcatttaaataatttaaacaattttcttttataattaattcattttttaactttttgacaaatttttggtttcgggttttcgggtagaggaatttaagacccaatacggtaaatttttgggttcaatttcgggtctaatttttcgggttggttccgattctggtaatcggtttcggttttttttcccaggcctaaatggttcattcaactctctggactacatttttttgagagtttatcttttaattcttgaagtttctgaaacagatatctttgaacttagttcggctgtcatttattggacttgggacaatctacctccgtctaatataatgctcatatcaaatgagttaatcttctcgagtcttcttgacaagctatgtggattcggatacaacgtcgttcggtcaatatttccagatgatcctcagcaagccgcgtccgcttccacttcccagggccgtacttattctgggaaagcttactggcaagcttacgggcagatgctatgggttcggaggcactagaagaggacaagtgtagtgaaacgtgtgaaactgcctttccttgtgcgcaattcatagttgttgtccaaggctttgaaaatttctccacgcatctcaagagtgaagaacatagaaagaatgtaagcatcctatccaaaaaaagacagacttgttgtgtccatacatttttcattgtctaactacatatgtagggttcttctagttatctgttgccttaatttgactagattttttttccgtccgagcagggacgatacttcgataacgatacaaagcagctgaaagcaagaagaagaagaagaagaagaggatataagagttgatgggtccatatggcgaatgtcaagactcgcttttacttttcagttaactaatacttttataagaaattttcacggaagtggacgaaaaaagatttgctctcaccgtttgtcaaagtgagaactggttttcacggtttgtcttttcattcaatttcggaccaaattaccctgagaaaacttaataattgcacaaaccaaaccgtgcagcagttcgtatcggttaagttgatggcataaaccaaaccctacagcagttgttttcggtttagtttatgcggttcagttttgaaaaagacaaaaaaaaaaaaactgaaacgaagaaaccgaagaaaaagaaaaagagaagagagtaacggagagatttgagagagaattagaaagcgaaacgaaattcagtatccattgcttcaaaattcgacataacttcgaattgttgggtagttgaattgagccactgaactcccacaaccggggaagagaaagttactgtttttccccgcgaagccaagagaaagttactgtttattccggcgaaatttgaacctccggcgaaatagcaactttagctatggctgggaataaagcaaacgacaaagtcccgaggaagtagcatggtccagggaaggagaagcgggtattaagagtttccctgcggagaaaacgctctgcgacaaaggcaacggaggaactgggttagaatctctaatttaccgtttgttgtctttgggtgtatcagaattgtaaagcttgtttgattaaaaggttagaactagtcggaatttagcatatctttaggatgaaaaattgagaagtagaattggaaatctctgtttccgccaaaaatatgattttgagttataatctggaaaatgtttgtgtacgtacactacttcggtttgcttagcagtatatcacttttaattgcaggtagtccaagtgttgctccgactgaagatcttacagttgaagagttaccaccaagactctttgctctagaccggtacccttctgagacgaagatgaacgcgtactctaaaccggagtacatttcttacatagcaaatgtactaaaggggaaaccagagatgcagtttcttctcgattctccatttggggaactttttaaaatacccaaaaacaaggcatctttcaatgctaagcttgtccttggactaatatgccgtcagttagtgacaaagaaggtgaatgagatg

SEQ ID NO: 32874 - DNA, 3003 bp, Unknown
  misc_feature (1)..( 3003): 2750-1469P.txt file - cDNA_ID_3062488; gDNA_ID_1620405; Annot_ID_156092
tgccaccacatttctacttctacaccttttgtctatatatacacaccaagaaaaaagaagagaatatatatacatatctatagtgtgtgtatggtccattctcatcttattatcttatttgtgtaacagtctaatattctaacatctaccattccttcttactataattttcaaaataaataagtatagttttcgctgcaaaataaatgtcatttttaccacatgatacacttttatgtttgttaaagatctatgatatacacgtatgtatatgtttatatatatccttcgttttgaagaagacggaaacgacttttttggttgagaatgtgaaaaattggatagtgtgaagcattattattgttactcatgaggaaacgtgaaggtggcctaaagggataatttttaaaaccctaattaatgaaaatcaatgatgtccaattgtgtattttgcatctaatcaaatctacccctttgaatattgactcttccacttttttatttatttcttaatttttatttaatattatatagtttccatctttctatttttaagtaagtcaccattttttcatcatggccaacacacaaatccaactaaggctaaaaatgcacctatatatacatgtacaagataaacattaaacataaagtcttttaagtaactaataacatatcttaacatcatgtataacttgttgttttacattcaccaagttattactcccaccctagacatacacccattgtttaaagatgccttgtcacatgcaccacccataaagacacaaaaatttcttttaaaaagaaaattgacaccatgtaagtttcgctgaaacgttcgactacgaacatgtctcatggtaaagattaaagaatgtccggaaagttcaccgtctttgtatattttgttatatatttgttatatatgtatagtaaaaaaagaatatgaaggaagtatgaaaaatgagattgttgggtgaggactaagagagaaagtgaggctaacatgttttaggaagagaagaattgaatgttcaagaagttttgcccaagaattcacaatttggtgtggtgggctcctttaaagggcaaagaacaaaagtgtgttatgtctccattactattttcaataatatttagtcttttaacaatcactactatttctctgttttggtccaatactccaatcatatataaaaatagtccgaacagtcgatcatcgttatacattaattcataatagaaattgattttgcattaaccattttgttatatcagcatcacaagttttatatggatatatataaaaaaatgtctatggcagaattaagtttgaaaacaaaatttctcctatcatcatatatatatgtttcttcctcgcctaatgttcaaaactaattaaactttggaacttattaggttaagccaagagcaacgacccacctaatatctatataatatattacatgctcataacttagctggttaatttgataaaacttgttgattatctttgtttagttgttagatttctgttccatcatgatactttactaaaccgaataaatatttctccatctattattatatacacagttcgcgcgcaaatgtatatcatgtctttatcatggaaaaagtcagttacctgcaataacataatttctaaaattcaatcagatgtaacagtcaatttaatttgaatctacctaatttattatcgtgaataaatatgaagtgtattgggtataaaatttttaaaatattgacaagaaaatttcaagaatagtaggaggagcagtgaataataaatttacacgaacgttctactcttttcggagaattacatcattttttttcttatagtggattaaacaaatcttaacatagtaatttttgaaatagatcacctaaaccaaagaaaagaagaatagtaaaaaggagacggtgccgttcgatagcatcaatcaaagcagcaatgaggaaacacgacagagagtcttctcgtgagaaaaagtaagaaaacaccaaaaaagattgagaagataagtttttagtgttttggaaaaaaattactaatttaaaaaaaattgatttggtatatgcatgcataagtgattaaggactatatgattatattaatttaagaggaaccaaaaaaaaaacatgccgaaattaaataccttttaaatttcaatgatgtgtactctacaagatatctcatatgaatcaccgaatatgtagattttatacgaaaataacaaaatattagttacgcatataacatatttatattcaatagaactataagtattttcgttaaagcttcaaaaatttatagagaaattacctagcaaattttatattacttatatttatataatatatatatatatatacggatatttttctattgatattgaattaggttttcactgaaaaataaaattttctattttccaactcaaacacatatatagcatatatataaattgaatagatacattgcaactagttaccttcctcattttcataaattagtaaaacaaaatacaagaaactgctaagattgacgaatcaatacgcgtatcaaaaaaaacgaaatatacgtttccattaaaaaagaagaaaggtaaaaataaataaatgtagatgcgattcaaatattcaaacatagagttatgtaataaatgagaatcatgcttactatgtgcatataatagagagacttattaaaagcccttcccttaaaaacttcccaattccattcctcttcctcttccttctccttcttcttcttcttcaccatttatttctcatcatcatacttataaaaagtaaatcagaatcccgaagcaaactttcaatcttccatcatcatcatcatgtccgatacacatacatacatacatatctttcgtgtgatttatacttattaaagagagattctctcattaagaagaagcttccttctttcttttctttttcttctctctgttcatg

SEQ ID NO: 32875 - DNA, 3000 bp, Unknown; identical to SEQ ID NO: 1460
  misc_feature (1)..( 3000): 2750-1469P.txt file - cDNA_ID_3062492; gDNA_ID_1620405; Annot_ID_156087

SEQ ID NO: 32876 - DNA, 3003 bp, Unknown
  misc_feature (1)..( 3003): 2750-1469P.txt file - cDNA_ID_3062496; gDNA_ID_1620405; Annot_ID_156085
cagcaaacaggtaaatggttatgcaaagaaacgggtacctaagtagcctggggaaaaaagtcttcggtccgtaaatccttttggcttatatgttttgtttttgccttgtattattaatatacgctcatatgctctatattattatagtcagatatctgaagcctacccatatttaaaattggtggtggtgtttaatggtgatattgatatgatttacaagttcttttgctttatttggtttttatttttttcacggtctgaattcatgatttgtgtgcaagttttggtatcattggcttatgggcttgtccaatctgaaatttgttttggatttctaagtttcgttaaaactgattcgacttgaattttatgttctcaaaatatctctgagttgaagaatttcataaagattatatttcctaggtttagccgacatgattttgttgtccctatgatttgtttttgagtagatagaaatggttgggcagcattggctaatgaacacgaacatgttaaaaaaaaaattggacattagaatatcatattacattttggtgtcttagatgggttcttcgtgacctttgaacacatgtcatgaccatatgcgactgtgatgaatgagactcttagctatgtggacccacaagcccaaaaatctttttcgaagcgacacgaaacgctctatgtgtttctggtttgacctcaaacagacaaagaaactctcctagtttggctacgtcctctcgaggttttcgttttggctttaatttcaaatacaaaaactgaaagagataggaagtagaattatattatatattaagtggaagataaagtatcacgaaatgtgagatgccgtgaactttatacctgcttactagatttttatgatctagttggcccttctaaatcaatctcttaaattttccctaaatattggcttttgtcacgcctcaaatttcttcttttcaaaactactgaaacatgccataaaaggaaacaaaaaataaaaatatctacctaacatttttcaactctgttaagcacatatctcatctaatccttaactatgaaagatttcaatttcatttcttagtcttctcatctaatatttattcggaatatggactgacatgaatcaatagagtaaccgtctcgtatattttaaactacattagatatttttcccttaattttctgtcaacaacaaaatttagatattttgttttgaggcaatcttataattttggttttccaactattatctttgacccgcctcacatattttagtgtagatatagtacggacaaaataaaaatggtaacggttgcatcatacctgcaaaactcagaatggcagtctcgtaatttatggaaaaaaacaaagggtactgtagtaagacaagtcattaaaaataataatcttatcctatggaaacaaaacaatatttttcctactgaaatttgtgattatctttatatagttgtttagacataaatcaaacttaattaatgtgaaatcaaattacataactgctttctccctaatcttattatataaattatggttttcaaagttgctaattcgtaggattgtgccacgtgtcaagtcaaacgatcagatgtttacatgtgtcattccaaatttaacttttttattctctaaaaaaatagaaaatcttaaaaagtaaacaaatttacatatactaatttatatatctatatatttataaacaattaacatttattcaacaaaaggaaaattaacaaatttgtctttaactcatgtaatcataggtgaaaaataaaacattttgagaaaaatagcttagcttataggatttaacttttcaattattttcatttattaattttaactcatttaatattaatttgcatgatgtaaaattaacttacgagattacgacatatatacaaaatatattttcaacaatgtttggtttttaaatatttttatggattttttattattattaattattagccctaagcgtttgggtattcggatcgggtatttcgggttcggatttttgggtttagaagtttatgacccgttaaggtaatttaagattttaggtcgagttcgggttcgagtttatttatatattgaaatatcaaattttgtgtacaaatctattaaattacttgaaaatttcaaaaatttccaaaacaacacgagtagttttgcttgaatatatcttaaaatacacaaaataactaaaatatccaaaacatcctaatagtttctatatataagtataaatataactaatatatacttatatttgagatatgtttgaatacctattcgggttcgggttcaagtttttcgggttttgaagtttagacccgttcgaatatttgaaaatttcgggtacacccgcctaaataggcgggccttatctagtataaaataaaatgattataaagcaaagatttcaaaaacaaaaaataaatagtatttaattttgatgcagaggacagctgtacatttgatttaagcgtagcttcaactccataacagtcctctctctctctctctctcattctgaaaggaaaaaaaaaagaaaaaaggaaagctaagtgaaacagaaaaagaccatctctgactacactactcctgaagatcccaaacaaaaaagcttcatagtgaaaaattattccttcgttttctcgatttctgaatcaggtttaccatttttctcactctcttctctgcgctttcttcgtttgtgatgaaactctcctcgcgctgtgacattgttttttccgctttcttaggttttttcaaaatttccttatgcgatttttttctctctttgttgttgcagattttgtgaattcagattagtttcgattgtttgtggagtcgtatcggaattgaagttgatcgactgagaattgcgagttttttcttagatgtcgtcagtgttgttttggttctctgggatagtgtgtgactgatttttgcttttcattggtgatg

SEQ ID NO: 32877 - DNA, 3003 bp, Unknown
  misc_feature (1)..( 3003): 2750-1469P.txt file - cDNA_ID_3062500; gDNA_ID_1620405; Annot_ID_156084
atggaaaaattaaacatcccaacttgaattgttacaagatcttgcttataataggtagttattaaacatatataccaaccaaacctttcttctcctcaactcctccgcaaataaaacagaaataatattatatttatatggttttgtgttttctttttcttcttaaacgttgagattgttgaagtggtcgcacctacgtctcacttctccatctttatcgcccttgacgccgaccgtgccaagtttctccatcgcacgagcgaaatcctcaaagaatgctgtctcgttagttgcgtatagatccacaaacggcttggtgctgttgtctttaataaggatgtggtcagacgctaaaagccctagccctcgctttaggttcttgaagtacatgttgtcgaactttcctggagtcatcacgtcgttaaacgcggcgattgtatcatccacggtgtggtttttgcaaagatctttgagagcggctgcgaatcgcgggttgatttctttatcagcacgggatccgtagagtctgtcggaaaactctttgcagtgagagaatccaatggtgtgagccccgcttaatgctaccatctcgcgaagactaaaaccgtttttcttgaatatcccgtggatgtcaggaacagtctggtttgccattgggacatttcctctgactttatgagctttggattcgaatccgtctttacgaccaagctttacgtcaaagtaaggtcctcctaccattgtgacaaggtcacgtgtagcctgcgctagaatatccgcgcatgatactacaccaggacaagacaactcgagagctgtcttgatgcgggtgacgatgtcaaaagcatctcccgggagggaatcattgagatcatcatcgcgttccgctttgttgaacgagttggtcgcgatcaagacagatgcatcacaaccttcaaggaaacaatcatggaaaaagagacggagggtcccggccgcagttgttggttgttggacttgtttggttgtaacggcttcacgcacaattttgtggaaatcaggacatgttttttggtaatagtccgttctcaagatagcgacatcagccgatataattggtgcaaccacggcgagacagaagaggataacaaagggattaaaaccacgagagaattgcatattcgacatcagataataacaaacaatggtaattgaattggatttgtgagagagatgtctacgaggtagacttctctacgatcgattgtcgtcgaaagcaattagaaacgaagacgaagaaagggcctttgcgactatttcatggcttaggaggttactaagaagaggctacgtaaaggatggttttcatttccttatatgtacgtgtggttgtttttcgtttattcttttctatttttgtaatttatctattttttgtatggttttggttgctttgaatttgttttggttctagaaattttcttatgttcgacaaatgtggtaatatgatagttgctttaataggatgcatacacacgtgaaattgataaatacgagagaatagaaactcatgtgaaggaaaaaactaatattaattaaaattattcatttcgcacaaacaaacaaacaaattaaaatcattcatagtttatcaactaaactttaaacttgacgttattttataattttgttgaatcaacaacctgtgaaggtgaaggtgccaatgattgtgacaacatgatgtttggtatgcttacgttaatttgatccaagaacagttttctagcaaatgtttgatgaactagactcaaataaaaatacctactcatgtagaaatcacgcaagctcaacattattagagatctgattgaatttgatattttcgtcagattcgtatcaatctcaattttgtattacatataacgagcctaactctcatatggggcagatctttttgtaagttcgaatgagagttatgcctttggtaacataaattgctagaccacaaaattacatattttcttatttaacctacgcaaaatcgcaaatatctaagagtgcaaatgatttcataaaggaatttaatggaataaatatatgaataaaaaaaaagaagatgaataatgttattcaatcaattccacctgcgacatagtaaaaaaaaagagttgaataattattattttttaattttcacccttttcaatgtaatcatttaaaaaaaaaaacttttttgtcatcccaaaagtatagaattggaagaatggtttattataccacttttattcttctagctgtaccatttgcataataagtttctctataccggaaccaaattcttgtattttctatattaaatattctaatatgagaagttgaatgttaagaatttttttttacttatcatgctatcttattatagaaaatttggtttctcaaaagtagttattaacataatctaatatgagaagttgaatgttaaaattaaatatttacttaacatgtgaacttatcatagaaaactttggtttccaaacttgttcataatttttttctaaaataaaatagtaaaaaagtaaatctaattcaaataaaaataagataatcaattatttaaagtgttagaaaaatagagtgataaaataagaaataaacatcattcaacaaacctaaatatttagaaatatgtagaaatttaattgaaaaccccaaaaaaatatgaagggaggctttggtgtctaaaaattagtaattgggcccaatatctcgtgcgcaaagcccatattacatagagcatggcgcgtataaataacatacatcttatgtatttatctctctcacgcgcccctcttttcttcttcattgacacggacattcgtttccaattctctctaatgtttcactaaagcgcatacataaccctaaccctaactctctcgtactgcacaaaaaaaaaaaaaaaattgaagaagagcgatacgatcgtaaccagggagcttgatttctcccctgatttttctaatg

SEQ ID NO: 32878 - DNA, 32 bp, Unknown
  misc_feature (1)..( 32): 2750-1469P.txt file - cDNA_ID_3062525; gDNA_ID_1620406; Annot_ID_156128
agtaagacagagacacaaaggcgagagctatg

SEQ ID NO: 32879 - DNA, 3003 bp, Unknown
  misc_feature (1)..( 3003): 2750-1469P.txt file - cDNA_ID_3062536; gDNA_ID_1620406; Annot_ID_156119
tttattgttgatatctcttactatcttgatttcacctttcgttaccatttgcgtacaaaaatttaacaaagcaatgaatgggaatttcttattttttgtatagtcgttttaactgctaaactatgttaagttggtccacacaattaggtgctgaaaataaagtgacatcctaataagtggaaacttgacttatggagcttttcgtctgcttaacattaatttttatcatcttatctatttgacaccttccaaacactattggggaaatggcttcttctcttttttccggtgtaggtttaaggttttagatttgaaggcggatggtgaggagtttgtgttgatgaaatgggtgatttgaagttaaatcctttaagttcttttagccttaagttcttttagcctgtcattacaatatatgtttcagttgtgatcttttggtgctctccaaggtcttagggaatctccgtgtcccctctggtttctttctttgtataaagtctctggaatttaaagatgattttgtcctgttttcttcgaagaatttggcgaagaaacatcaaaagttcactatttgctttacgtgttatgcttgtttgactttgtgtgatctaacttttggttgaaaactaatgctcatcttttgttctttggaatgtcttgatctgcttgattttgaatgctttgtcacattgtttaaacaatttgttctttgttttcagttgaggaaaacatgaattcgacatcgacacattttgtgccaccgagaagagttggtatatacgaacctgtccatcaattcggtatgtggggggagagtttcaaaagcaatattagcaatgggactatgaacacaccaaaccacataataataccgaataatcagaaactagacaacaacgtggtacttttttacttcattgctcttcaacctcctgatgataaatttgtttggtctgttttcagaaatttaaactagctttcatttcttgacaatcttttttttttttttatagtcagaggatacttcccatggaacagcaggaactcctcacatgttcgatcaagaagcttcaacgtctagacatcccgataaggttagctattcaaatacttctctatcagtttcttaatcataaatttctacgcatcatatagactaaatcgttatatcgttacagatacaaagacggcttgctcaaaaccgcgaggctgctaggaaaagtcgcttgcgcaagaaggtatgacttcattttcttccccttggtaaactgtttctgtttgcctaatgagttgagagatttgattgttttttttttttgcaggcttatgttcagcaactggaaacaagcaggttgaagctaattcaattagagcaagaactcgatcgtgctagacaacaggttaatgaaatgaaatctaaatatatattcgctttctttcgagttccaaaatataatgcaatttctgattgaatatgaatgttttcagggattctatgtaggaaacggaatagatactaattctctcggtttttcggaaaccatgaatccaggttttgaatcaagaacaatgagtcttttggaaaaaatatagaattcaagattttgattggtggaagcttatttgatttgcagggattgctgcatttgaaatggaatatggacattgggttgaagaacagaacagacagatatgtgaactaagaacagttttacacggacacattaacgatatcgagcttcgttcgctagtcgaaaacgccatgaaacattactttgagcttttccggatgaaatcgtctgctgccaaagccgatgtcttcttcgtcatgtcagggatgtggagaacttcagcagaacgattcttcttatggattggcggatttcgaccctccgatcttctcaaggtataaaacaaataacaatctagcgtaatgtttaatgaatagaaggaaacaagcaagattacaatgtttcaaatgtttttttttgtaggttcttttgccacattttgatgtcttgacggatcaacaacttctagatgtatgcaatctaaaacaatcgtgtcagcaagcagaagacgcgttgactcaaggtatggagaagctgcaacacacccttgcggactgcgttgcagcgggacaactcggtgaaggaagttacattcctcaggtgaattctgctatggatagattagaagctttggtcagtttcgtaaatcaggtaaaatatatatattcaaactcatttgaaaatactatagtatcagtttcttgattttgtttgttcattcttaggctgatcacttgagacatgaaacattgcaacaaatgtatcggatattgacaacgcgacaagcggctcgaggattattagctcttggtgagtattttcaacggcttagagccttgagctcaagttgggcaactcgacatcgtgaaccaacgtaggtttgagttattttgtaacaaccaaatgaagaaaatggaaagacctcaaaaaatgaagaatgagtgcatctgaaaacagaggactactctgaataaatagaggggttgctgctgatatttatttttactctgcggcggaattagaaaatttgaaaaacatcatgtattgataagttgtaaatatcagaaaaaggtgggggtgcaaaaatttgtactttttagcttttgaaagaggcaagtttttcgaatgtttgtttgatttgtaaacaatttcagaattatataaacttggttccaaatcccctgtaataatgtcgagctatctgcaatttgaaaactataggggctttacttaattttacgttttgtgtgacacctatttgattttttttgatacgtttggaccagtttcgtaattagaggtaaataaaggggcaaatagtaagatataagaaaagccttatctcatagagtttcttctcttcattatcctcaaaatcgctcgagagtgagaactctgctcttcttcttcttcctccgccatagctacaatg

SEQ ID NO: 32880 - DNA, 3003 bp, Unknown
  misc_feature (1)..( 3003): 2750-1469P.txt file - cDNA_ID_3062540; gDNA_ID_1620406; Annot_ID_156118
actgtttattttcaaaaaactaaaatgctaaatgtttatgcgtgacgtctctttttctgcctgctcgtttttacaaatctatatgatgatccaattcgaattaatattgcaatattttaatatgtggatagagtgtgaaatggaatttcaccaatgtctatcattcgtaatggatcatacggaaaagccatcaccatatggaaaactttatacacacatcattaacacgatccaagtttcaaaagaaaagaaggattaataatattattcacttattaaacttatcctgttgtagttagtttcctcctagtagacaatccaatattagatcatgcatctctataaaaatatttttgtttaaatacttttcatctttattgtacctaatttgtggaacttatctcctctcactctgtatatgcatgtccacgaaacatctcacgtcatctgctgatgaccgtaactcttgagctatatacattcttgtgataatttaatgctgtatgaaagaaatatacatgtttatacaatttaataagtgaaacaaaacttataaacaaataaaaattaaatattatagcttcgttcaagcaaacacacacgcacacacattttatatacacgtctgaattgattagttctaagctaggtagatccaatttatgtgtaatgatgggtttagggtttaaatcgatatgtaggaatcaacgaagacatgtactacttttcattatgtcgaatgtcaataaccagacaattcttatttaatggtaaatcataatcaaatatgtatatgtctcctatggagcctgaagagccaagctgttttgatacattaactggctgcacacatattaaataggtgattccttcacctaataaactctactaacattagcctgtttagactaattccaaagactaatcagtttgtttaaaattatgctcgtattatatagctacgatttatattataaacaagaagaatatatgcaactttcttgcaatataaattaatgttatcatctttacactaaaatactaactatattccactaattaatacaaatccggttagctatgaacaaaatgatcaatatcttattgaattttagaataaataaacgttgcttgtttgaactgttcattcaggtcggtcgctactcgctaatttgcttaaccaatattattatatcagcatgtaataatatattatagctagttgttaaaaaaaagaattatatatagttttgttttcttatactaaattctacacttttttttgtcaactagtctgattttttttaatgagacagctatgatatttggataaacatcagtatttttttttaggttctctgcatttatatgttttaaaaacaggttgatgagatagaaaaaaatgaaatattgattacagattagattagtaagattacttaattatttatttagaaatagccgttactacgtcaccagaatcgaagcagactccggagttctctaatactccatttggctacgccgcgagtagtaaacacgcgcaatatttatcctctttagacgctaaattccttcgcttggaagtatgccggcgtttagtgtttacattaggcgcgtgtatttacgcttgccgtcgaaacgaattttatgttatcgccgacgaatgcgcaggttagaagcagacatgcgcaagatagaaaatataaaattataaggaaaagaaattataaattggagagaatttagaagagaataaaaaaatggatctacctggttcgcacatcagcgtgctaggtagtggagacatgacaattgaattttttaaaaacgaataactaaatattcataatcaaattattatcttaaaaaaaatattaagattcgattggtatcagtggatcatacatattaagtcgctgctaatcaaatttccttttcactaatttatttcctgcttttttccttagcaccatcaaacaaaaagtttatgtgaaaaaacgtattttttcccacaaacagataattagtccggtgtgttttgtatatagaaagtggaagaaaaaaatagtatagaaaaatgtaataattggttttgactcactgtagctgagttatgcgtgaagacaaaaatcaccgagaaaccacagaaacaaatagaaaaaatagttaaatatataaaacaaatataaaataactgcgtcaaaggtctcatttaagttgtcgtgattcttcttccttcgtctacttgaagatgatgaaacctgagtttctgagacagaaggaagagcttttaacatcccttctgtttatggtcggattccaactccggacttcttggctttaaccctttacgtccgatcttgtcgctgaaatctttctttctccttttacatggttttcacgacgacaaaagtttgcctttttctagttgctgccttgacttcagatagcatcacaaggttcggcttcagataacatcacaaggtttgattgactttgctctgttctaatctaatcttgttaatatcttaaaagcctaaaacttttctcttattgattgttttggttaattttgtttccccttttttttgttgtatttactcgattgattacttcaatatgattttctggtttgcttggaatttaagctggaaggaactgattcgaatatttcttgcataagaagatgtttcaatctacctatctattgacttcatgattggcttttgcttttattgttgatatctcttactatcttgatttcacctttcgttaccatttgcgtacaaaaatttaacaaagcaatgaatgggaatttcttattttttgtatagtcgttttaactgctaaactatgttaagttggtccacacaattaggtgctgaaaataaagtgacatcctaataagtggaaacttgacttatggagcttttcgtctgcttaacattaatttttatcatcttatctatttgacaccttccaaacactattggggaaatg

SEQ ID NO: 32881 - DNA, 3000 bp, Unknown; identical to SEQ ID NO: 1474
  misc_feature (1)..( 3000): 2750-1469P.txt file - cDNA_ID_3062574; gDNA_ID_1620407; Annot_ID_156156

SEQ ID NO: 32882 - DNA, 3003 bp, Unknown
  misc_feature (1)..( 3003): 2750-1469P.txt file - cDNA_ID_3062601; gDNA_ID_1620407; Annot_ID_156166
acaaaaaggcagtggctttggcacttttcaccttagtttggaacctctcctcagtcactgcccgtgtttgggcagcattcatgttactcgtcgccttcagatattatcaacataagatgatttggacaactgatcaagctgatgatgatgaggatgacaatgaagaagaagaagcagaagaagaaaaagaacaagtccctcctaaacacaaaagggctcctcctcatatgatgatgcctaataaactcaagaaaatttcttaaatatactaattgtttttcctccatatataaacaacatttactatgtaatctctttagtttttagttacttctctatacaaagcttacagtttataatgtgaatctgatcttctaagttcaattaacttatgccaacaatctaaaactcacacacttgaaatatttatccattcttcttaaacttagttagacttgaacccaaaaacaaacaatcttaattaggcttctaacgggctttaagcgggccttattacataaactattcagctttcgtgaaataacaaatcggacagaagttgaaagctttacttcttcacttttacggttgctcaccgtcgtgacatctccactcttttcctttcaaaatccaaaatcacgatttgattttctctcgcctccgacgaacaagtttaaggtaccactccatgtttctctgcgatttcaattcgaactccatgtgaccttttctctgtctgtgtttaatttagggtttactcaattcgtgactttcatttgcgttgaaaaatttatctgattttgctttgttgtgacttgtgagtggttttcagatgagcgtagcaagtgattctccagttcattcatcaagtagtagtgacgatcttgctgcattccttgatgctgaattagactctgcatcagatgcttcgtctggacccagcgaagaagaagaagctgaggatgatgtagaatctgggtaaactcaactctcatatgtcatgcattctctctaattgaatcttcgaactctctactggtatttacagtgtgtatattttctcaaaccatgtttctcaatcttttaggttaaagagacaaaagttggagcatttagagggtgaagctctctttattgattcagtcttatttttctgtctttcgtttgttcgattgtattgaattttgaaccttatgcttgcagaagcatcctcaagcaaaggcgaatgcgagcatccaggatcatttgggaatatgtgctttgtatgtggacaaaaactggaagaaactggtgtttcatttagatacatacacaaggtatcgatttcagaatagcttctcttaaatcaaatcttagtttttatttaatgagctttgggaaatctgttttcttaggaaatgaggctcaatgaagatgaaatctcccggttgcgtgattcagattcgagattcttgcaacgccagcggaagttgtatttagttctcgatctagaccacacactgctaaatacaaccatactgagggacctaaaaccagaggaggaatacttgaaaagtcatactcattctcttcaaggtgatacattcagctacattgttttgcttctttttcaaatgtgatctttgtgcatggaacttcagtctagtatttgtctttttttttgttccatctagatggttgcaatgtttccggaggcagtcttttcctactggaatttatgcaaatgatgaccaaactgaggccgtttgttcactcatttctaaaagaagctagtgagatgtttgtgatgtacatatacacaatgggagataggaattatgcacgacagatggccaagctgctggaccccaaaggagagtactttggtgatcgggtcatttctcgggatgacggcacagtgagacatgaaaagagtctagatgtggtgcttggacaagaaagtgctgttctgattcttgacgatacagagaatgtaagtatgatttgtaatttgtcaatgtttcatgtaacttttaatcatgatattgagttgtgctgatgatacttggtttgatgctcaggcgtggccaaagcacaaggacaatttgattgtgatagagagatatcactttttttcttcgagctgcaggcagtttgatcacagatacaagtctctatcggagttgaagagtgatgagagtgaaccagatggggcacttgcaactgtcctgaaagtcctaaaacaagcgcatgctctattctttgaggtatgcactcactggatctaaataaaacttatctcttgtcttgttggagtttgttgattatattattcgtttgtttcagaatgtggatgaaggcatatcaaacagagatgttaggttaatgctgaaacaagtgcgtaaagagatacttaaaggatgtaaaatagtgttcagtcgggtgttcccaaccaaggcaaagccagaagatcaccccctgtggaaaatggctgaggaactgggagccacctgcgcaacggaagtggatgcatcagtgacacacgttgtggcaatggatgtgggaacagagaaggctcgttgggccgttagagagaagaagtatgtggttcatagaggatggatagatgcagctaattacctttggatgaaacagccagaagagaacttcggtttagagcagctcaagaagcaattgaccgaagaagagtgatttatgtaacaacaatgagaaagaagagatagcttttttttgttggatattaattatgaatctatgtctaaagtaaagttttgtaatgtacattacattgtatctctgatatttaaacaaggtactaatttttggttgatctccttaattattttgtttcgtctatgcttatttgcgaaggtctgtaatctaccgacaacttttttgggccgggcctaaatgggccgtatatttatgtccctcatctactttcatttgttttgtttggtgtttgtttctggtttctgattccgtcttcttcgcttagacatg

SEQ ID NO: 32883 - DNA, 3003 bp, Unknown
  misc_feature (1)..( 3003): 2750-1469P.txt file - cDNA_ID_3062603; gDNA_ID_1620407; Annot_ID_156165
aaaggagagaaagagagcggaagctgcaacgcactattaaaccctagctaaagacccagccacttattttattttattttataaattttgcatttgatagagacaggagtttctgtttctgttttctgttacggtggtctataccgcgcctgattattaacccggggaatgaaacagtacttattatttatagccttaaaccctaatttaaaggaggttgaacttggaataatataaaaaccaattctaggcctaatcaatgtataagctataaatttagaactattctaaagcttttaaaatataaaaattaatgaattaaatccaaataaaagcttcaaaatgttgatattggttcttcacattttttttttatattttgtttaacttattttaaataatattaccataaaactaactcagtattgaattataaatggaattaaaaatcaatagatattcaatttttatttttctggtaggaatagatattcaaatttaacctaatgggaaagaaattcaaaaataatattgttaatttttaaattcagtcaaatttaattgaatcccttccttccataatcccctaaacccctgaattctgttcactaataggcctaattaaaaagcccatttatatgagtttgacgatttgttaggaagtttggaactaaaaggagaaactggattgggcttatttcgatgagtaaacccggagcttttgaggccatatataataaacccacactagttgcaaactggtgctgactattattaatctatgtaaaagtttcaatttaaataattttttatattggaaaaaaaaagcaattagtaaagaaatagatttactgcagaaatcttaaatctttttaaaaaaatatgaaattatgaatcaactttttaatttagagcaagagaaaggaaaacaaaagtttagtggaaaaagaaaaagtagaggaattgcatggggggagagaaaaattataaaactaaaaacaatagcagacagctattgtaattggtaaacatgtgtagtagtaaaaggatcccgagtcggtgaagactccaaagtacgtttgtatatttatatatttcagagtagtgaattggaggaaatcaatatctatctaatccccataagatacacccattattgaaaccatggcccattcatatatttacttatttgtttctgtgtgaccgttattacttatttgtctcattcttaaattagtgaatgattaaaaaaagattgtgtgtgtggatgggtcatcaactcatcatgggtttaggtaaatgttactcacaagtcacaattaacaactttttttttataaaagaaaaacaaatatgttcgttgccacggtagtttggctcactccaaatttaataacgtattgtattcgcaaaagaagatatactaggagaaagcaaaatgtgttttgtagtattaaaaaagagtctataaagagagagagagagaatgtgcatgaaaataagaaagacagagagaggggaggaaaacaaagaagcaggtgcatagggagaagtgccatgagtcacgtgccctcttactcgaccacgtgccgtcgaagcaatcccaatccaactccgattcgtgttccaatttttcattggggtctaaacttgattagtgtactactatgtaattaattagtgtggttactaattagacacgcacacagacgcaattgcaaattcacatttagattaaggagaccaggatccgttatagctgttaattaggtagggtagtttatccaatacaccaagcatgcatttaacgttaattgagtgtttgctagtacaatccatgcttgatagtataaatgtattgatattcatatattacaaattaaaatatgtatgcttgtactatctatataaagttacggattgtgactttttcttttggtgtaaaaccgatttattatcactgttttctgccacaaaaagctgtcggtggcactcacttcactaatccagtgacagtaaatttttataaaataagattatctaaattaaagttaaaataataacaataacacgttaaatacttaaattagatccatttgttcattctcatctcaaacactcgaccttttataaaggaaaatttagtttcactctctccgactccttccaaaatgatttactttttaatatccaaactcatctaaatttgggtctatatatggctccgtatagatatattctaatattgcatttaactgacgtagacaatattcaatgccataaattttcctcttggttagttggtgaaaaaagtcaaaaccgaactaatccaacaaatattcgttaaattttagctagtttggtgatgaagtaaagtctttaacatattcttacttttgtaaaaaaaaaaagttatattgatatttgatcaaagtatgagtatttacatgaaccatgtgaatacgtatataaccattcacttaaatctcgtgaggtacttgaagaacaaaaataatagtggaagaggacgcaattcaattgttaaacacggcacatgttgattgatagataacgtaaactttatttcataaagtaaaaaacaagaagtaatcaaaattaattaacttcaaataaaaaaagaaaagtaaaaaagtagagagattgtgatcataaaccttgatgattatgtttaagtaagcatctttgcagtgcaaccacatgcaaaggctttaggttaattttaaaagcagtagccaattatccaatttggtgatctatagctagtctcaatcttcatgagacaaacataggtccccctcctctgtctgatctaacaacccaactccaaattctgctttatcagaaattatatgaaatcaattaccttttggtgcccaacaacctccattttccttcagcttcaaggctcatcatcattactactttcaaattcacagctcgattactagtacgacatagacatagacataaagacagagaatg

SEQ ID NO: 32884 - DNA, 3003 bp, Unknown
  misc_feature (1)..( 3003): 2750-1469P.txt file - cDNA_ID_3062607; gDNA_ID_1620407; Annot_ID_156162
aatgtgagtatcaggagcatatgtattctttatgtagcatataataaaagaaacaactgtctctcgaaaaaggagggctgcagatctactcttccaacaaaattcactgacctgaacccttctcgtagttggatcaagagttgcaaacaaacgattttcagcgagaacattagcaccagtcaattggttcaatagtgtactctttccagcgtttgtgtaaccgacctaaacacaatgggtataaaacatttaaatgtaaactgaagtgttggtcatttcctacaagtctaacatgctgtggtgtacttaccaaggatacaacaggtacaggtatagcaacacgcctgcttctatactgcttccgatgctttcttacagattccaactcctttttgagaactccaatctgcccaattcaatatgaaaacgttcagaagatgcttctatcttaatggaccaatacagaaaaatctaaacaaagacagaacttaagaaagcattaatcacaaactttatcacacaccatttctttacaaatgaagaggatatcactagtagaacaggctaaaaactgcagaactatatattttttacttacttgagtacgcaagattcgcttatcaacttcaatttgtttttctcccatacccttaacttggccaccagattgacgctcaagatgagtccacattctagttaatcgtggcaactggtactccatttgtgctagagcaacctggaaacaaatacaatttgagccacggtttctgacaaaagcagtatcaaaaaaaattacagcggtcatctctatatatatgctttatcttgcctgcaaggctgcttcatgagttgcggccctttggttgaaaatgtccaagataagggcggtgcggtcacaaactcgaacatccccaccaaaggccttttccaggttacgcaattgcctgaaatataacatataaataagaaaatgtaacacatactcaattcacaagtcgacaaactagttttgaaacaaacaagagtaatgaaactccaacagactccaacaatccgatggctactttagtagatattattcagctgaatgaccgagacaagctacactatatagaaagaagaaacatagatggaaaattttaaacttataactttgggtgttaggaaacttcaagagcatatgtttccactaaaaacaaaagttacacagaaacattaccctggtgaaagttcatcgtcaaatatcacagtctcaacgtccaaagcattaattgcactttttatctctgcgacctttcctgatccaatgtatgttctaggatttggggaagctagcctgtagtataccatcaaacaatcatcgacttaagcatctgccgtaaactaacatggcagcagacactaaataaacaacaactagatcacaggggaccaagaagaatccagtcacatccctaagtagcaatacatagataactagaaacaactaacttttgataagtagaaccaaccactgcaagcccagcagtatccgcaagttgttctagctcctcaagagattcctcaatattaaacaagcattctccatcaccctttctttccacgcccactagatatgccttctcttcgaaaatctgaaaatcacatataaagtatccttcttcaatacttgaacagcaaatactaatttcatgctcaagcaaatctatataccaatttcatcgaatttaggaaagtaagcacttttctccgtttccgagcaaacatcttatgaacaaacgttatccactaaatgatgacgaagaagagaagatagaaataagttaaagtaacctcctttccatttctgagcttgaatctatcgtccaagctctcttcatctccttttttcttcctcaacattttagatggagaagcaatcgtttcgttgtcgagatttgtctcctctgttggtaagtcgagaacttgaaggatttcatcttcctccacagtttcctccaactcaataccatgttgagcaaggttacaagataatctccacgaatagcagttggcatgaagacgagaaggtggaaaagaaactattgcacgattgggtttaggtttatggtttgcgtgccactgaagtttgaaaattggagaagaagaaaggtaaaacgagctcatggtggagaatgaaggagcttctgagagattgagtgtgtggaaatgagttcatggatggtgaagaagcagtgagttcaactacgtgtcgtttaatttaatcctttaatgtacaatgattgccgtttttttgttttatttttgagttaatttgtttggttactagattagctgtatcttgtccatggacaacattattgatccataaatctatgtttatttattatgatttctctttcctctcgatttttcttgggaagaagaaactcatgggaattttcaggaattttgtcagccattttctctcatttgagaaaccactaaattaggtgtgcaaaaatcctttcttttctctgtcaagtcaaaatgtgctctttctctcttgtttattcacaaatgcaggcttgtttttgtcggtcttcaagaagcttatttatataatctgaatcattgacgttgctttttatgttacttctgtctgttagtgaaaacaagaacccctaaatttgtctggaaaggaagcttttttattgatgtttctctgtttactttgtagagcttcaaaaaacttctaaaggaatgaatgtttctttgatttccaagagagttttggttcgttgactgagtttagttttggagatctagcaactgaaagctggttaaatacttaaatggacgtagcaggctactgtttgtgaatcctctcgatggcgatgttgtttgtgtggaaaaagtatggcctgtttcagatgtttctctgttgattcaagttttaaacgagagccaagagtcagaaatcaggtcacaggctcgtgaaagctgctttgagtcaaacccatg

SEQ ID NO: 32885 - DNA, 3000 bp, Unknown
  misc_feature (1)..( 3000): 2750-1469P.txt file - cDNA_ID_3062611; gDNA_ID_1620407; Annot_ID_156161
gtgcagatttacgtgttctacccggaagggcctaaggtgggagtcccagtgattaagaaggaagtggcaataaagatgcgagacgataaagttcatcgagggatcgtagttgttccaatggccataactgctcccgctagaatggccgtatcagaactcaacaagatgctaacgattgaagtctttgaggaagctgaattggtgaccaacatcactgagcataaactcgtcaacaagtactatgttctcgacgatcaagcaaagaagaaattactcaacacgtacacggtgcaagacacacagttgcctcgcatccttgtcactgatcctcttgccagatactatggactcaagcgaggacaagttgtcaagatcagacgaagcgatgctacttcattggactattatacctaccgatttgctgtttgattcttatccactgtttcttttgttttgcattttactacaaacattgcttcttcattgttttgaatactaataatagactcaaattggaggctttacaaaacataaaaggactttaacaagttttaggaagtccttcttttcagacatacctttcatgttcgaatatacaatggtggaacctgaaacaactggtaagatgatcgtttgttatccctgctgcctgcatgaaggagtaaaccaccgttggtccgacgctgcggaaccctcttctcactagatctttacttatcacttctgcttttggagtttttgcaggtacttgtcgctggtacctgaacttgctcacaatcgccttattcttcacaaaactccatatatacttgtcaaatgatccgtattcttctatcacctgtcaacagagatagagcattcatcaatctgaatgcaatggacagttgcttgctttagtttcccatcctatgcaacaagcctatctgtccagacttgatcttctttttcttgaatcttgaaacaataatactttgataacttctagacctccttttatttcaatatccagaattttgcaaggctttgaatcaatgtgctcaaaattgggtatcttgagcaaccaaccaagagtggaagagaggtctaccttaagtatctggcgtgcattctcaatgactgcccttagcttaagatcagacaataaagtgcttgccgggcttcctggaccaattatcttcttctcattgattttcacaatggcattggggtcaaaatcagcaaaaacttccctgcattccacacttttcataagaaaacggaatgtactgcttcaaagaaatgagagaaacgttcatgcaaaatgagtgaaccagagtcatagcaagaacctgaaagcctgtctcttgctcagtatcgtaggccatgtgtgttcggccaaagcacccgaaagcacaaggagttcaaacaacctcctgaacatacaccagcaaagaatgacagtaaggaatattcatcaatcaaacagagagcagatatacacaagcgagaaaagcttgaaccgtacttgtcatcgtgaactggcacaccccattcttcatcatggaaaactatataacatggatctggcgttttcatacaaaacaaaaaacagtcaatagagagatctttgaaagtaagtcgatgattgtgtatatccatctacacctgaatgtagataagagtatgaaactgaccggagtttggtgtcacccaagtacacctcttcttagtctctgaaccattaggtggtgaatccaaagcaccttcagagacaacacttcttggcttggaagggtaagacttacttctacttccaacactgtacgacctaatcaagcgaccagttgatgctcggctgtggaacgagtccatggaggcatcagatgaaaacgatgcattaagtgacagattagaattcaggttctgctcatgccgtcgtagtatagaagccgcattaagagtatgcttctgagaagaagaagacacagtttctgttggtgtagcataagatgttttctcatctgatccagtacgcccagatgaggatctttcaagctttcgcagtgactttgatacagctttgtgtgtgatgaaaggactagcctttttagcagtagaccccagagttgacctggtctctgcttcagccacattcatggactgaactctaggagcacctgacatgggtttgactcaaagcagctttcacgagcctgtgacctgatttctgactcttggctctcgtttaaaacttgaatcaacagagaaacatctgaaacaggccatactttttccacacaaacaacatcgccatcgagaggattcacaaacagtagcctgctacgtccatttaagtatttaaccagctttcagttgctagatctccaaaactaaactcagtcaacgaaccaaaactctcttggaaatcaaagaaacattcattcctttagaagttttttgaagctctacaaagtaaacagagaaacatcaataaaaaagcttcctttccagacaaatttaggggttcttgttttcactaacagacagaagtaacataaaaagcaacgtcaatgattcagattatataaataagcttcttgaagaccgacaaaaacaagcctgcatttgtgaataaacaagagagaaagagcacattttgacttgacagagaaaagaaaggatttttgcacacctaatttagtggtttctcaaatgagagaaaatggctgacaaaattcctgaaaattcccatgagtttcttcttcccaagaaaaatcgagaggaaagagaaatcataataaataaacatagatttatggatcaataatgttgtccatggacaagatacagctaatctagtaaccaaacaaattaactcaaaaataaaacaaaaaaacggcaatcattgtacattaaaggattaaattaaacgacacgtagttgaactcactgcttcttcaccatccatgaactcatttccacacactcaatctctcagaagctccttcattctccaccatg

SEQ ID NO: 32886 - DNA, 3003 bp, Unknown
  misc_feature (1)..( 3003): 2750-1469P.txt file - cDNA_ID_3062615; gDNA_ID_1620407; Annot_ID_156159
gctcctgtaaacattgtcttgtctccaaattacaacagaagcgttgctgctgctcctttaaacgctcatatcatgaacaagggaagcctgaacacagcatggagtttgcttcttcttcttccattaggccttttggtttagtcttgtgaattacctctagccaattcggttcgatttcggtttgtattttccggtttacttgttactttggcttgtgatttagtcttgtttcttagccaattcggttcgatttcggtttgtaagtttacttgtttctttgcattactctgtctgagtgtttaatacaatgttagttttggttaatatcctaaattcaaattggaaagaaaacattaaaggccggatcggttatacaactgtggaatttggaaacaaatgttattataagtgggcctaatgggaacttctgcccattaaaggcccattatttgaacttattagctttaagcttgtccacgatttacattagctatcttcttcgtctccgggactgagaccgctctctcttccttatcctccatcttccaatggtttaatccagcaactgtcgacgatgtcgataacgtactccgctatttcctgtaagtttcttcctcactgtgtgtcgaatccgtcctcaatgctcaattttatccatttattgtgagactgtgattgattttggtttccgttgttttatccagctagtacagtttctgggttttcaccaaaaagtgtaccttttgctattcatagcgtaaccaggaggcaatttcttaatcccaacacgttttatagatttgggttctctccttctcttcaggtcagattcctttactagtcagtatcatccaattctccagactctgcttcgttgttgttttggttcttagaattagaccacacttcgttgcttccctttgaagtagagagtcaatgtttactgttatgtgcggatatgttgtgcagggaagtagcattgagtttagccttcagttgaattcaagagttgtgcttagtaaagagcgtcgatctctgccattagttgtgagaaatgatcgtcctcagaatgaagacttacctaagcagtacacaaggcgagagaagaaacctttcccagtccctattgtggacctgagacgagctgcgagggagagagtcaagaacaacaaagacaaacctaagagacctctacctccgcctaaaaatggtatggttgtgaagagccttgtgcctcttgcttataaagtatacaatgcaagaatcagattgatcaacaatctccaccggcttatgaaagttgttcgtgttaatgcttgtgggtaaaaattctcttcttcttcttgtttcatttttggtctgttttgagtatggcctttttttgatgttgtatgattggtctcttaggtggtgcaatgagattcatgttggaccttatgggcatccatttaagtcgtgtaaaggtcccaatacttcccaaaggaaaggtcttcatgaatggactaactcggttattgaggacgttattgttcctcttgaagcctatcacctttttgaccgccttggcaagcgtatccgtcatgatgaaagattctcgattccccgagttcctgctgtagttgagctctgcattcagggcggcgttgaaatacccgaatttccagcaaaaaggagaagaaaaccgattatccgcattggcaaaagcgagtttgttgatgcagatgaaactgaattgcctgatccagagcctcagcctcctccagtgccattgttaactgagttacctgtctcagagatcactcccccatctagcgaagaagaaacagtctccttagccgaagaaacattacaggcctgggaagaaatgagagcaggagccaaaaagctgatgaggatgtacagggttagggtctgtgggtactgtccagaggttcacgtaggtccaacgggacacaaggcccagaactgtggtgcattcaagcaccaacagcggaatggccagcatggttggcaatctgcagtacttgacgacttgataccgccaagatatgtttggcatgttcctgatgtgaatgggccaccgatgcagcgagagctacgaagcttctacgggcaagcacctgctgttgtggagatatgtgctcaggctggcgctgttgtacctgagcattatagagctacaatgagactggaggttggaattccttcgagtgtgaaagaagctgagatggttgtttgatatgtagaagaccttgtaaacttcttcttgtacaaaatcctccattccaccttgtgttgtataataatatcacagcccaggtctttttgacttttgaaggacaaaaaaaacaatccacgctaatcctattatcaagggtaaaaatgtcatttgcttcgttttcatcttttctcgttgccattttcttttttttgtctgtgtcaagtcgataccacttgtctggtagctttatacccactttcatctttttcatgttcgtagttgttcctctggttatcctcatcaacgggacccttgaaaccgtgtagccatgtaagcctttgtctttgtctctttctcttgcttcagcaagttcacgtctgctctatttctaattttgttctaagattcaattctccttttttctatgcgagaaatttaagattggttctctagctctacctctttaaatttgttactatgtgtcggtgtccatcattcatcaaattttttccttttttatccatttgagttgatgtaatgatgttgcttcgcttcatactggtcagagttagtctaatcttcattttagcacaacttgacaacttcatatggttatgacttatttttacttgggtctttcaaaggttaagtattttagtcttattttgggatgatgcagcttgcttaatgattagagtcttaaagctgtgctctttcttcatcgatttgagcaagtgatcttggaaggctcttgagttctgaattccttgtaagcaatcatg

SEQ ID NO: 32887 - DNA, 3000 bp, Unknown
  misc_feature (1)..( 3000): 2750-1469P.txt file - cDNA_ID_3062619; gDNA_ID_1620407; Annot_ID_156155
ctttgtccttctctgacttctcctcacattgatattagacttctacacgaaacccagaaccttcctctttctcatttctctctttcctctgttttcatcttttgctcttcatctctctctttctctccttgtgtgattctgtaatttactcatctgatgaatccaactcacggagatttcactcccttgaactctaatcatttcgaggatccaaaggtcaggtttaggcatcatagccttatgcaagactatggagaattgcatatggtacgaactctcttttcttgagttttagatcaagtttcagtttctgggtctggttttagttgtctctggatctgagaatgtaattttatttgctcaaagattgatctgggctcagagctactcggaaaacccggaaaaaggaacaactttcttctttaaaataatagaaagaagaaacttttaagtttaattgcttctgcttccttaacaaagttaattacttattaagatttctatgtgtagttagttatgcaaatctctattagtcttaactcttaaacatagttttaggatttaaaaccttgttgtgtacatattatcagctcgatactctgatctttgagatcatttggttatgagcttttgttaacgtgtgttggttgattatatacactaggaaaccgaagctatgagaaaaaggttacaggcagtgcgagaaagaaaggcaacactaatggctgaagtcaggtaaagacagtttcaatccttgacaaaatatatcattagtcctttcctttgatgttttcctcacttgttaatatatcgttcgtttataacctctttaacagatttctgcgacggagatacagacatttgagacaagaccagccacaagagattaaaaaggtcagaagatcaaatggtgggaagaagatccgagtggaagtgtctcctagtaacaaaagtgaggcggaaactaagcatgtttcgcttcctgacttaaaccactcggaaaaggctcacgatgaaaccaaaaccagtcctaagagaagagttcctttgtttgatctaaatcagatatctgtaagcacatttttcactcttaatcagattgtgaagagacttagaaaccaaacatgtctttactcataaattgatttatatagggagaagaagagcaagaaacagaggcagtggacaataatcaagagaacacgagagttgaagaaagtaattcatgtaagagattaatgatcagtagcattgagatgcagcagaaagatgtgaagccatcttcttgcaggaatggcggaaacggatcaaataagaggaaaatttcatggcaagatcctgtcgcagctctcagagtctaaaataagaagacggaaccttttgttcctcctcatagatcttgttgtaacatagcttcacatcaaagttagcttgcttatttacttatcttgattgaacaacatatccaattgtgacttgaaaacttaaaaaccttatccaatggtggcttattgcaaacgtgacatttctataccgaaacatgtgtcagcaaacgacatttatggaagtgatccaaaagtcaaggaacaaaattaacggtcagatgcattgacacgtgtctaaagagacacgtttcgtgtaactttaaactacattattaccgaacacaaagaaccgatctttgaaaacaaaacaagaatctttatggaagaagacgggtctgattggggcggattggctccagagatactcatcaacatcatttcaaggcttacgattcaggagctatggaccggtccgatgttcgtccaaaaatcgtggctaactgtttgcagagatccgtatctctggtctatcttcgatctggagccatggttcgattcctatcccgagtcgactcacttgtggtcccctgagttcgagcagaaggtagacttaatgctacgatcagtcgttgattggagcgaaggtggtctcactaagatccgcgtccgccattgcagcgaccacgctctctcttacgcagccgataggtaaatatctttcttatcaagatcgtgattgagtttgtgatatcctctattttggaattttctatggctacgagtctgattttggacatatcaatagatgcccgaatctacaggttcttgccattagaagcagtcctaacgtgacagacgcatcgatgacgaagatagcgtttcggtgcaggagtttaaaggaacttgatatcagttactgtcacgagatatctcacgacactcttgtgatgattggtagaaactgtcctaatctgaggatcttgaaacgtaatcttatggattggtcttctcggcacattggctctgttcctacagaatacttagacgcttgtcctcaagacggagacacagaagctgacgcgattgggaaacatatgatcaatctagagcatttggagattcagttctctagattatctgtcaagggtcttgcttcgatatgtgagggttgtcccaagctagagtacttggacttgtttgggtgtgtgcatttgtcaagccgtgacattacaagcaacgtgtcaaggcttaaatggcttaaggaggtaaagaagccagatgtgtatgtgccaaggtcaggggatgtggcgcagacggagaggtatggacattggagactctatgacgagagatttgacatacaagccatgagaatctgatttctacacacacactgccatgttttataataaagctgcccatagttctgacttgggtcggttgtttgttatatgtcgtgttgttaaaatggaccttaggcccacgggtctaaacgggctatttgtaatgtttgaacgggtacccatttaaacccgattactaacgggtctaaacaaatattaaccgagtggcccatttatttttaagtttttggaattttctatgctaaaacgacaacgttacgagttcttcagtttctcagttctccaaacgacaacttcgagccaaaacaatg

SEQ ID NO: 32888 - DNA, 3000 bp, Unknown; identical to SEQ ID NO: 1480
  misc_feature (1)..( 3000): 2750-1469P.txt file - cDNA_ID_3062623; gDNA_ID_1620407; Annot_ID_156152

SEQ ID NO: 32889 - DNA, 3000 bp, Unknown; identical to SEQ ID NO: 1483
  misc_feature (1)..( 3000): 2750-1469P.txt file - cDNA_ID_3062627; gDNA_ID_1620407; Annot_ID_156151

SEQ ID NO: 32890 - DNA, 3003 bp, Unknown
  misc_feature (1)..( 3003): 2750-1469P.txt file - cDNA_ID_3062631; gDNA_ID_1620407; Annot_ID_156147
ttgatgttgaccgtatcgatttggtgtgggaagcagccatgaagtatggtcttagtgctgtttcttcactcacaaattgagtgaagagagagacacgtttcattgttgtcttttgactctcccaagattggtcattctttgtacaggtgaaaggagatgcaagcaggaaaaaaaagtagaatttcaccttatgtattgttttatcttttattaatgatgtattactttctttttagatttccttaatattaatatatgcacctaatttccaagaaaattcaacaaagcttttaattatccagcttgatttgcttctctgtttggcacttacacaatcagacgacaaagtgtcttcaatgttgctgtcttctatacttttaatttgattagacattattagttgagagaaatatcgaaatatcaaactaaacagtgcattaacagaaattgtaaaaagctgatcagattgttgtttgttctgctaatgaattttttaaggtaaaagtttcaatgaagatttttgaatcaaaccaattgtttatactttattacaaacacattctctacactaaaccaacaaaaatcccacaataacaaaagagacagaggaagaagagctaaacatttgctcaaagagacatctgcttgagttctaaaacaaatgcagaagaaagagattattttacctaattagaaaagactccataatgtgactaacccttgaatcgttcccaaaaagtagccaagaagatcaagagatgagacatgagaagaagaatggaaatgacgatcaagaagataccgagctgccaccatttcctccttaccgatcttatgaatccgaacttacaagatctacaatcatagcataaaatgctccaatcgttcctccatagttgacagtcgctaatccttcccaccatcatctcatcaccgtacattaggttcatagacgacggtggtccttcgtcttttcttctgtaccaaaacgtcgcgtttatcgcgtccatgttacatgtctctggtggcatacaacatccattctgtaacaacatcaaatgtaaagataaaaatgtttgtaaaatcttatacaaatgttttacaaaacgtatatttgagtgatcttttcatcggtatattgttcgaatgtactaattgtacactttaaaagtcggtcttgagatcaaagaatatatatctatgatgatcaaaccttgattggtggcatttttcttctattgtaaggtttttcatttggagatccgtaaatgaggtcgttgcaagctcctttatcatagacacacgatttgatattgttccaggtcacatgatcgtccatgattttgagcttgaaccacatccttgtcgccggaaaccgccggctttgcatctcatttactccggcatacgccaaaccgatgaaaagcattaacaacaagaccaccaccatcaccacaagtgcaggcatcggaaacttccgccgcaaaaacagagctgcgttgctgacaacaaacaccgcgagaagaccgacactagctagcgtctggacacgtggcagaccgagaatatcttcgcagtcgtagctacgcatgtaaagaagccacactgcgtagccgaggagtgtaagtgagaggacgaaagtgaagatcggaaggacaccagcggctaaaatgttcacaagtgccatcaatgttcccatcggtggcttattatcactttgtgactccatttggtctgaactcttggcttctggctcagtcgttgcggttgctgtagctgtggctgtggcggttgcggctggttcctcgacgggtactacttgagcattatcagccatgtgaaagtgaaagaaagctctctctctctatggaggtgttgagttgatatggggaaatgtatatatagaaacagagagatcataaatataggtgtctgagtgagtgagtgtgtggtgggttttacagagtcaaatttgtaagttagagataaataagtacacattaattaagtacaacgagatcttgtccgaatatcaattatccaaaagtgttttttttttttgttttgtttaaagtataaattcattacagtttttaattgtttgttttgtttaatttatggataaatgaagtaaaaacccttatagagaaattataaaccacacaaactaaatattgcacatcaagattaatggatatatgtagtgaactaagtcaaacataaaatccctaaaaataatacattaaattttctaaaatctaatctaaataataggagaacagtaattattatgttactgtttttagacaaaagaaccagtcgttcttacacattactttgagaaaataaaaaaatgtttgtctaaattttttttttttttttttgtgtgtgaataatttcaatcccaaatatcatatcaaacaaattaaaacaaaatataaataatttctaaattctaatcaaaaatattagagaataaatgatgtttctactttcggacaatcgatccagtcgttcttagaccatccacatcggtcatttttttaaaatgtctttaagtataatttattaataatttaagctgatgctgccacgttgcctctcgaataggtaaaatgtgtctttccaaggacacaatagacacgggtcttacttctttattctgttttttattaacttttgttatatttaatactaaagatctatcaattttttgtgcgatgtggatgctcgtaggtcaattttatatttaatactaaagacatattgacattgattttaaaaaataaaatggtgaatcagatttcaatctaaaatcacataaacaaattaaaagacttaattttgggcccattaaagcccaataaaatgggctacttcggttctgttgtagtaaacggtcgaaccggagagatatgagtgtcatatcctgatttccccactcgacgctgatttcttctctgcttctgtaatttctccaattcattgatcagatcagccatg

SEQ ID NO: 32891 - DNA, 3003 bp, Unknown
  misc_feature (1)..( 3003): 2750-1469P.txt file - cDNA_ID_3062633; gDNA_ID_1620407; Annot_ID_156145
attttaagaaattaaatctttttttttggtatctgtgtgttactttttataaatgtattttgaaaagtattatttcaatttatagataaatataattatgactctcaagtggatttttttttcacggtcaattggagtttggctgtgaatcttgtgaataatatcaactaattaagagtcggccgatactccgtatctttgatcactttcacccatatcttgaaatttaccaaatgttttctttcattggggtttctataccttttttttttggttctttctgtaatttgggttttaaagaaaaaacctataattacaaaaaaggttaaaagttaaaactaagcacgttcaaatatgttctttcgagatcccaccttcctgtctatcttataagaagtcgaacacgtgtgctcgttgtgtgaattagagtggttatttcaacatatataattaaactatgtatgtatcataaatacactgaatatgttggagttgggtcttgtggtaggctaacttgttcgcttcactttggtttagtttagccttgtaatcggtggtttcatatactgaaatttttaattttctaatataatccagatgacaaaaaaaaatcataaatacactgcaatggccatttttaaaaaaactttaaacgaaatatatatacatcaccaagtatcaagtaagtaatttggttgttttgatttttcaaaaaaacatttaggtgattcttttaacaaccaatcatatatgtagcaaagattaattatgtcaatcttttaacgtcacttatatagtttagctgtagtattattgtaagccaattgtacggacttcgtaaccgtttcgacaaagatacaaactaatcaatgtttaagatggcataatattccgacttcccctgccactcggtagtactgctgcgccatcctacaagaagcactcgtaaatgagtggttagacggccaaaaattagcaggattcaatccttgattaagagatggttcagataagccctctaggcctctactcgtcacaattcatatattaattgatcacactgcatgaaatgataagatcaagtcaattacctcaaaattaattgaaagataaaatgataaagcaacaagtaatgatcatatatggatgtaacaaccttcttcatccatacgaatatgataattcttttgtcgatcatttgccacatctatttaactaagtattttgtacattaagatcattttgcgagtattcccgcgttcccaacaaaaacgaattgaaaaactacatagggtgaattttgctctcgtggcattaaagagagaggctgacattatagattatgatatatttattatttttcttagtagatttcttgaccagcctttagatatgcttgctctgtcatggcataaagccttaaaccctaaagccctttacatttgtacagtaccaacaattgtacccaatgttaaatgaatgcggattaatttgtgatatgagaccatcaaaataaaatacttataagatagtagatatatagaaccgtaacaaaaagatgagaagaaaaagacaaattgaatagaaactggaccaaaagataaaagagtatatgaagaagcaagccaccaagaagtgtaaccatcgttgcttcaactgtaaaccgcacattaaatgtgtgtgagagaaagagagatagactccagctgtgagagctacgtccattgcatcaattgggttatatgtcgttaacaattttttaaaaatacataaataaatcaataaaatatttagaaaaaatcaatattataatgatattttgaagaagttaggtccataatggaaatatagagacttagtgtctatttatcaagaaatagtgtctatttatcaagaaataatgtctatttggtccacaattatcatattttttgtggccactcaaactacgaaaataatgaatattgttaatttttgtcttatttaagtctataactaacttactaattcggttgaaattgctaatatgcattttccttggtccactattacagtgctactgctgtcttattcttgaacacaaaataaaaaagatttcaaacacaaaatatgcatttttttgttccaccattacaaacctttatttggagaagtatacagttggatattaaatattttaattaaaaaattgaaaatattgaagttctttttctccagtattttggctggagcaaaactaaataaattccaaattaaaagctcgaacggaaaacatttactatgcaccaaaataaatgttgatatgaaatttgcatcagcatatacagtatgtatgtagtacaattgaacagagtcaaaattaattgtcactgaaacagtcagattttatttctgttaaaaaatattttcagacaaaaaatgattttttaacgtttttttatataattttattaaacctcaaaacattcctcagcagattgttttataatgttattattattttttcttaaataattttatttgaatttcgttatagagagataaataaaagatttttggggtctagttggctctcatagtttgaatgcttatataaggaaacagagctcgaggctctcaataatgccacataaaacacaacaccaaagcctttataactctttctggggtttttaattctctcaacgaacaaaaaaaaaaactcaactaatattctccatcctctttcttcagatttaagagaaaccttatcgttatattctctcttctcttttctttttgactcccacaagaagaaagcaaatttctttttctcaggattgcttgaaaactgtagaaatctttaaggtttttttacaccaataagagtcagagagagagagagagagagaaagagagatctattcataaaaaagacaggtaatctcaactccgaggagataactgatataacaatttgagagaataagaagaagaagaagaagaagaccaagctaaagaatg

SEQ ID NO: 32892 - DNA, 3003 bp, Unknown
  misc_feature (1)..( 3003): 2750-1469P.txt file - cDNA_ID_3062652; gDNA_ID_1620408; Annot_ID_156192
ccaatggagaacagagaccaggtgaggcaaacagaatcagctgagaagagtcaccgcaaggaaaatgtgaccaagagtgagaaaccaagggatcaagaaggggtaaagaagactgaagcaaaggataaagacagaaataaagagaagaaagaggaaaaaacagagtcgataaataaaactcgtcaggagaaaccaaaattgatacgagggcccaagttagaggaaagagaaaaggactctccggatttaagaaattgcaagctgcctgacgtttcacggacaagcatcaagaaccttcacaccgagggaaatcttggcaaacggaaggatcatatgacaaatggattcctgtatggtgagttattctctgatccaattctctgtctggtgaatgaggagtgtagttgccatattaaccatcgtatgatatatggtttggtacttagaagcatctaatagttttatccaatcatggtatgttttcttaccttaaaagattttttaaatttacgggtatcttactggtttggtagtttcttggtttggagtaatgatgcaagatccgtatttcttggttttggtctgaaatgttaacaatgtagtttattacctgtttgttgtaacattagtctttaattctttcgcagaaaatggaaccacgccacacaagttacagaagctgagtgcttctgtaccatctgtggaaaatggaagaacattaggtgcaccccgaactcctccaatgcctgcttctgaggtgcaaggaacaacttgcaagccacaagtcaaagaagtcagaattaatggttttgctgtctctggagaaaaacgtaaagtctgtccaccaagccctttggctgcaacaatgaaagtgaaagtcaaggaaaatggtgaagcatccgcaaagccgcctcatcctgacctaaagtatctcaatcagatactccatgtacctacaagggagctgttgccagagattgatgatgaccaagaatggctacttggtcagtcgggtatcaaattaaaaagggcgagaacagatcctccagattctggcgaatccttgcaggtctggaaccaagctttcagaatagagtctgcggatatcacagctcttccttatgtagttccattttagctatgactatattcctacgctacaatccctgaggagaagaactatccctcgcacaacgccactttgcagcagcatctattaaagaagaccgacaacagcagtccatggctccccaaagtttatgagcagggatcaaatatgttatacacgcccataatatgaacacccacaaagctctgcatgggtgggggaaaagaatgaatgaggaagatgtaagtagagtaagtttatagagaagttgattgttgtttgacaccatgttgtgttataaggacaaggatatgtgtggcattttgttctgcacgcaattttgattccctgcttgcatcatcaacattagtggataaagtttgtatattacagagaatggaaaaagaaagagtagggctctatgtgtgttactgggcgtggagacggaagaaagtttaatctttccgttataactatagagtatatagtctcgagtttctcaggaatactattgtaccaaatcctgaataaaccaatgatcactagccaatcctagctccatgcctaataatgttgtgtataattttagtaaattcaatcatttctatcctaaaggttaaatctttcataaatttgacttaaaggatcggtctcttacttcaaatatcaaaccatggacttcaatcgtttcgggaaatcttgtaacttcatttttttacggatgtattataccaacttcagttaagttcaatgatcttagtcaaatgatcgaattcctcaatcagaagcaaattggtgaagagagattggttttcacactaattgggagagagcaatttcggttttggttactgtagtgatcaatgcagcgaaggtgttcgatgaaatgcgtaggagagactttcgggaaattacttcactaagagcttttttactgatgcgaattccttttaatgatagaacaagatatcaagcaaagaagccttgtggtcttgatactgaattctagaatacacagtgacgtggtggtcttgtcttttgataagcttgttgtagctgtctcctctctcaatggctatctcctgcgactgaaacggtaaacctttattctctttagattcgtgtgtattcatcagtatctggtcaggttacaataatatattgcttattaactgatcaatctgttactgtcctgccctgcttactatagtagacagtttctgtggttttgtaatacttaggcatgtgttaactattattagaggacttacagtgagttaaggtgtcttcgtgtgtgtttctctcaaaatgatatatttgttactctgtatatatatatatatgctcgtggaatcctgatgagaatttggttacagctttatcaatcctctaaatagttttcaacagtgcaaggttttgtgttcctctcttgaaaatatagtctctgaagtgttaacgagctctatatatgactagtttgcagagttcaggcagcaatgtgaatgagctagagaatccaataagcaatgataggactgggtcaatagttcaagaacgtgaaggttccgacaactaagcaaactgcttcttcaatttggttccgacaacttttatcattaaaaaatatataaaatatcttttattattaaaaaatatagggatatatcttttatttgattaatcattatattattgtagagaaccctcagccaagagattggtagctagatagataaggttgacttggagtcaacttctagcttagagttttgataaattttatagctttcttcatttatagtaaacgttttaactcatttttttccagagaatctgtacccttggcgttcttgtactggttcatcgtaggtgatactcgacgtctagttgttatg

SEQ ID NO: 32893 - DNA, 3000 bp, Unknown; identical to SEQ ID NO: 1489
  misc_feature (1)..( 3000): 2750-1469P.txt file - cDNA_ID_3062659; gDNA_ID_1620408; Annot_ID_156198

SEQ ID NO: 32894 - DNA, 3000 bp, Unknown; identical to SEQ ID NO: 1494
  misc_feature (1)..( 3000): 2750-1469P.txt file - cDNA_ID_3062667; gDNA_ID_1620408; Annot_ID_156186

SEQ ID NO: 32895 - DNA, 3003 bp, Unknown
  misc_feature (1)..( 3003): 2750-1469P.txt file - cDNA_ID_3062700; gDNA_ID_1620409; Annot_ID_156230
cggaaaaggtgcgatgttagatggaaacgcggtggcgattttggtagggaagcttagagaagtcggaggtggtgattcagaggcggcgcgtgagaattgtgtggcggttctgttgacgttgtgtcaagggaatttgaggtttagggggttggcgagtgaggcgggagcggaggaagtgttgatggaagtggaagagaatgggaatgaacgggtgaaggagaaggcgtcgaagattctgctggcgatgagaggaggaggcggaggagagagtgagtttggggaaaatgcggaggcgcgtgagtggaaccgtatgcttgaagcgactgggctaagtcggactcagtttcaaggagggcaaaatgggggttttgcttattcctcccagttctagctttttttaaaaaattgtttttttgggcatctctttgttgtttacctttttttggtaaaatgttatcttatttttcctttttttttgttttggtttgatataaatgggtgtaaattactaattttgtgtgaattataatatgtgattatggtttttttttccaatcaaatgacaaaagtgaattgtccatttgtttgtaaaaacatgtctaatgttttttgtaattttctatcacataatgttttttgcaattttctctctttacctttttaggaaattatcttatctaatttttgtaaaataattaattttgagtggaatatgatatgtgataaaaaaaaatttcacttgatgagtaaagcgaaatgtcaatcggttgtaaagagatgtattttcagcttgatgtgatttattagttgaattgacttattgcaaattagagagatgcgtggatgaaaacgagcgtgtgatggagagaattaagaagtcagacagttcgtgtgaagatgtcagaggacaaaactctgaattattctactacaaaaacattccgtgtgatactatgagatccaataactaaattttaagtaaccaatcctgttttattgtcaaattaaatgcaggcaagaggcaggcaaaatactaaaaaagaagattttgtatgttttttctagatattgtaaatatttgaattgatcatagattcataggtctcacataactgagcacttcttcatattcttgcccagcccaagtattggtctcatgggctataaatttttgatgattttgggaatataaatttctagaattctttcatctttataagtagtagtattgttcatatgattgtggattttcgattaataaacagccaaaattcaatttgtacaattaatgaatagccaaatatcagcttgaaacttctttaagacaaaactgcttaagcgaagattggttatatatagtttataacatcgtacgtagatcaacgatcacgtattcacatatatttcccaagtgcaacactgtatactgattcagagaatctctttgaagtttgtttttgaataatgatttacgtgtttgtgaaaactcaactattttaaaatgtttagtggagagagggttagtgtgtacgatttaaatataaaagaacttgagacaaactcattttcttttacccattcttcaaatcacgcgtttatgtgtatgatttgtgttggtactggaaaacgagtatgtcagcatctttgtttaagatgtgtataattaattggtgtagaagaagcgtttgtgtatatgtcacataattattaaatcgcattttgcagacgctttcaatatgatttatcagtagataaagcttaaaaaccgagttctatgtgtggttaaaacaaaaatagtagtcaaaactgaaaaacatatcatatctgttagttggcacagaataattatcacatcaaacatcgaaatgttttttttcgtttgtcgacccaattggaagaacaatatcataagacaagaccgtatggctggggcataagttattgttatccacaaggttcttttgtgaccaagctacttgattcatatccatgtgacaagaagaacaagggtgaattatggatgattgctgtttccgcatgcttgatgatttcgtcaaacagccctaataataggtaagagttaaaaaatttttgtttttatttaaaattcgaatgaataaaaaccaaaattctttaaggataaaatgaaaatagctttaagaaaataaaaaacccttatttttatttttatttttaaaaaccctcttctatgtatttaattgtttaagtacgttttctgctaactcaagataaataaatattattcttaattgtataattttgtttcatgatgttgtggattcaatcagttggttttatttataaacaagagaactagtagtgaagtgatgatttctttaagacaagattgaacatctatggcttgttagatgaaactagttgatctttagtcccttatccgctattatccaacaccctatacccataatgctcagaccaagcaatgcttctcagttctcagtattcggaagctatgttctaaactttgaaatttgataaatgtacttgaaaaaagatttaggtacggtctaaacttgtctctgttttagtagttagaagaagaagcacacacaacatataaattaggggttcctcgtcactaacgcggtttcggtgggtcccacaacacccaacactgagaaagaaacaccattcttctccgtgttctgtctctatctgctaattaccacaaagaagaacttgcaaatcccttctcttttgttcaagtcgtacgacagagcctttgaaagaaagaactggtggggaagcgttaagctacagataactccaagatacgggtctttgtttgttttgaagatcagattcattttacgataattccgttactcgttattgtgtatatatatctctttcccggaaatttcggttcttgttgtacaaaaactccaaaaaaacgcataaaaaatattctgtaaatggttgaaattctctgggaatttcaacgggtcttgtggtatcatg

SEQ ID NO: 32896 - DNA, 3000 bp, Unknown; identical to SEQ ID NO: 1500
  misc_feature (1)..( 3000): 2750-1469P.txt file - cDNA_ID_3062704; gDNA_ID_1620409; Annot_ID_156225

SEQ ID NO: 32897 - DNA, 3003 bp, Unknown
  misc_feature (1)..( 3003): 2750-1469P.txt file - cDNA_ID_3062708; gDNA_ID_1620409; Annot_ID_156224
cttggagaggatgtttgcacaatattcaatttaccctaaccggttttttggttttacagtgaactgaaccgaatttattccttcctaaacttgaaagattatctgatggattttcattgtatcacaaaaatgattttattaaatgttccccaataagtaaaattaaaaattacaaaataaatagtaccattgtattattaaagggtaatgtataatcctaccctcagacctggccatacgatatactttataattaaggacttgttgaattttcactttaaagaaatacaaagtaatggtattcaagtttccaagtggatgatgctttcactcttatccataagtttgaaaccaaagtccggtattcctttgatcccatccttcttatggtccggcattgcttggatttcaaccttcctcagatgattcttctgtatatcataatagagaatgtaaaaaggggaacacaagtcacttggtaccaagacaacctcgccgttttgagttgtgtctactaacgtcaatggaatgtcgttatcaactaaatgcagctgacaaggctgcaaactcaaaactgtcctcgaccagtttccagcattttccaagacccataagtctaccaaaccgttttctttaagactagtatgataaaaaatagctggtttcccaccgtactctataaaatccagagagtcaacatatgcagacaacacaagaggcgcttggataatgttaaattcttcagacctaacgtcaaaggtgacaacgatatcctgaaacatactagtgaaagcaagataatatataactccaccgatgcacagtccagatctcgtaggagtatgaggttgatcaaactcaattcttttccaagaacctccaacttccagtacgaagacccaatgctccgagattatcgtttccaaatcttgtgaggatgatgacacaaaagtgcaaactactttgtattgatcaagaacaggatcgtgccccaagaagtagaggagactatgttcgtttccttggacaaaaatgttgaatttgatggcgggtaaggttacgctctgtctggtggtgggattatagagacacgcttttccgcaaacaatgtataaaatcaagccacgaagagtcaccatatgtagtcctcccatcccttgcatggtcgtcaaatcttggtcgaaactagaaggcgatgagaatgatagcagtacagactcgcgggggctgtggcagacctcccttgaatcacacttgtggtccaccaaactaatgtatagacgatgtggtcgcagtggagatgcaaccgtaagataacggttgctaaaaaatcgggaacggataagagaagaccactgctttgaaacgcacttgaacctcataagcgatttatgaggcaatctagtcagaatctcgatcagtagatccaaaggaatctccggtgccacaaaaaaatcttctcctctttgtcttcttcttcttctttttcttcctcttctcataatcgcctttgaagacctcttcttccattgaaaagatgaaatcagagctacagacaaacgcatggctactactacaaacttgtatatccaaattctagggttgtgacagttttataaagtagaggacgatgatcgtctctaatcaacagttttccttttgttgattaggaaaagaaagtttaccctaaccggttttcttcggttttaaaaatgaaccgaaacccaatatatacggtatgttcctaaatttgaaagattaccggattggtttttatttgtctcgcaatgttcttactaggcttatatcgttcataaaatgaagtatggctcaataacaaattatcattgattcatgtatgggcttctgaatgagataattctaaaaaacatgcatgcttatgatttatgattaaggtaaaaaaaaagaaaaaattgattaaagtcatttctagctaatatttggatatcgctagcggtaagctcatttgaatcaagtttctttcgggattatttctaaatattcaaaaataaacagagttacctattgaaaacccaatttatttaccatttcattgcgattaatttaggatttttttacaatatgttttttaatcaatttgattacttatgcgttttcttaaacaagacttaattgtgcttataatatgactttgaaacatatacgaatctcaatttgttgaaaattaagagttcatacttagaagacgatatgttgttagtaaataagtttgtataaagacatttgattgcaatgatacaagtcaaacacgatttcggtgagtttaactatactaatctaatttaacctattcattgtaatcacacacattcacattgtttgtcgattaatttatttagttatacacttatgtgattctaactaaaataatattgaccttaaaattcatttaagaaattgaaattggttacgtataaaacgtgttacgtgtgtcggtcgtgtcctctcaactaagaaagacgcgatacaacacattctcgatgtccacaagcaaagggtaacttcgtcatttccgcttctacctaaaagccccacttgatccaaaggatattttcgtcttttcacaccaaccaacccgcttaacgaactccaacacggaatagacccctcaaagaaaaaaaaaacagctagcggccgcaacttacaaaaacttaaccaaagtatttattatgtaataaaataagaaagatatttagctgttaaatgtttgtttacgtcttctccacggagaaaaagacaagaaactctgagtttttgatatttataaaaattgcaaaaccgacggtaacagaaacaaaaggcggttcttttttccatatgtgtaattatttccttaagtcatagctataaatatgaacttggacctcaagttcttttcctctctcaagtaacaaaatactaattcaaaagctttataaagtttcttttctcattcggttctaaagttcctatttttcaatg

SEQ ID NO: 32898 - DNA, 3000 bp, Unknown; identical to SEQ ID NO: 1508
  misc_feature (1)..( 3000): 2750-1469P.txt file - cDNA_ID_3062724; gDNA_ID_1620410; Annot_ID_156255

SEQ ID NO: 32899 - DNA, 3000 bp, Unknown; identical to SEQ ID NO: 1517
  misc_feature (1)..( 3000): 2750-1469P.txt file - cDNA_ID_3062789; gDNA_ID_1620412; Annot_ID_156299

SEQ ID NO: 32900 - DNA, 3000 bp, Unknown; identical to SEQ ID NO: 1515
  misc_feature (1)..( 3000): 2750-1469P.txt file - cDNA_ID_3062797; gDNA_ID_1620412; Annot_ID_156296

SEQ ID NO: 32901 - DNA, 3003 bp, Unknown
  misc_feature (1)..( 3003): 2750-1469P.txt file - cDNA_ID_3062814; gDNA_ID_1620412; Annot_ID_156285
gtgttgtcattagcattcttaacataagagtgtctttgtgttttgttttctctccagatgctctcatccaaagacataaactttgtgggttatacttacaagaacgttgaaatcgtaaaccatgatcaattaccagggataggtagatctcacttacacaacaaatttgacttgtaagtaaacatattccatgtttgctctgttgtaatttgtgattgtgtttactgttgcagctgagctgaagaagaagagcacaaagccaaagcggccatcaattaaatccctctttggtacttatctaaaagacatttatcacaatctatttcaactcattgtctgatattagcatatggttttagcactaacaagaattgttataaaaacatttggcagaggatgaatcagccagtagcaccacaagccaccaaggaagctttatgaaactcttgccaacacaaatcgaagttccagagaaagaagacaaatcaagctcatctagtgaaaccctatcatcttccaccacacgtttcgacaatgccacatcctaaaccagactctttgctacactttggtcccggttaacacaccaaaacacggtttgaggtggcggatttacggttggagatagtacagtttccattgtggcggtgaaggctattgtgtgagaagattaaggatttgttcaacagtttctacataggataatatttggttgttcaaaaggtttagtttgaagcaaaaggaagtaaatagtcattttcagaatgtggttttatttatttgtttgattgttttgtttgggtaaaaatcaaatttggtttgtttaccacacagttctaaagcggacaatgggaaaaatgtcaaaaaaatcatgaactttcaaatttgggacgaaaaaaacatgaacttccaaaatgccattaaaatcgtaaacttttgtttgacttttgataaatagtcaagttttgttgactttgccattttgaacatgtcgttaagttttcgttaacaaaaagataacgtgattaattttctgttaattttttctgttaaaagcgaaacgacgtcgttttgaaattaaagaaaaaaacaaaaaacaaacaccaagtagagttgaactggtgaccttttaggtgctattgaaggactaaaaccattgagccacgttaactttttagaagtatagtaaacatatacatatatatatatatatacgtaactaattaaaaataaccaactaaaataaatcaataatatagaaaattacctaaaatttacacaatccttctcatatgaatataggattaatctatacatgcacatagaatttcattcaacttcactttatatataattttatttataataaaacatatattttataaattaatttgataaatatttaataaaagaaaaatataagatcattattccgtcttcaaatcaatttttttattcataattagatggaaagtatataaaaagttattttttggtaatatatttataggtgttatatttcacaagtttgatttttatataatttaagagaatttttttttaattcaatacgtttaataaaaaaatttacattgttatttgagaatatatattaatggtaggtgtatttaatatttttacatgtttagttattgtttttatagttcggtttttatttggtaggtgcatttttataatttacatcatttttaatatttttatttgccattttggttaatatggaggatttggaagagccggaatgatttagtcttcaacaaaaaagcaatcgctgtcgctgatgtgataaaccaagcgataatggacacgaaagaatggctggatgttaagcataaaaatgatgacaacgtcaaagggggccaaaccaagtcctcaagaacggacaaatggcaaaaaccaggagcagaatgggtcaaatgcaattatgatgtctctaaccatgcgggaagacaagactcaggcctcagatggattattcgaaactcacaaggaacctgtttggactgcggctgcgggaaatttcagggtcgacaaacaataaaggaagctgaatgcactgccctcatatgggcaatacaatgcgcttgggatttgggatataggagagtagaatttgaaggcgacaacatcacagttaatcgccttattcgaaacaaagaaactaatccacgacttcgatactatttggaattcattcaacaatggagcaaagctttcaccactgtgaagttcacatttcgacaccgggaacaaaacgtttgtgttgatgttctggcgaaaaaagcagtagctaatcatataaatcatactctatatcatttttgtcctagatttctaatgtcgtttgtaaacaaagatgctgaacacgtgaattaataaagttattggaaggaaaaaaaaaaaaaatagttcggtttttaattagttttgcgtatatatatatatatcagttttcattaatatcgaaatgttatcatagcatattggttgagcgcttgtgataatttaggaggttcacgagttcaatccattcttggcgcaaattttaatatatttttattttgaaacgacgtcgtttcgcttctaacggaaaatgttaacgaaaagttaactccgttattttgttgttaacggaaatttaacgacatgcccaaaatagtaaagtcaacgaaacttaatcattttatcaaaagtcagacgaaattttataattttagcggcatttcggaagttcacgttttttttatcccaaatttaaaagttaatgatttggtttgattgaaatgtccggttctggtttggttttcttttgtaccggttctcataataatagccacgtattaaaaatttattagtaatggatttgggccagacccattctcaaagcccaatcaatttctcagtgaaacatatataaacctaattaaagtgaagcagaagttgtattcttcttcttgcgaactcgctgaagtctgaaagatg

SEQ ID NO: 32902 - DNA, 3000 bp, Unknown; identical to SEQ ID NO: 1527
  misc_feature (1)..( 3000): 2750-1469P.txt file - cDNA_ID_3062820; gDNA_ID_1620413; Annot_ID_156321

SEQ ID NO: 32903 - DNA, 3000 bp, Unknown; identical to SEQ ID NO: 1521
  misc_feature (1)..( 3000): 2750-1469P.txt file - cDNA_ID_3062842; gDNA_ID_1620413; Annot_ID_156333

SEQ ID NO: 32904 - DNA, 3000 bp, Unknown
  misc_feature (1)..( 3000): 2750-1469P.txt file - cDNA_ID_3062896; gDNA_ID_1620414; Annot_ID_156370
aacaaatcctttgccgagtaagcggatgtcgcggctcctcaggtgcatacgacgacgccgatcaacacgtgtccaataactagatgacacgtgggttatttgccctcactttggttttggttctcatccggttcatcttattataatggtttggttttgaaaatttcggataaagtttggttcaattaggaactggtttgaaaacacaagcataacctcaatctcatacttcgattagtaacacagtataatgacataaattgcaaaaaaaaatttgaaaaatgaaaaatatatactaaaatacacagttgtatattcacttatttgcataatattttttaatatatatatttttagacaaaaatacaaattctacatttttgcgtcttgataaatattatgcagatttttttttagttggttaaattctttcataatcaaataagaaaacgttattccagtattatgtgttagcaatagaaacaaaatgagaccaggattggttttgttaacatcagctcggttttgttcggttaaaattaattacgaaaagaataagaaggttccaaagtttgcggaccatcatgtcggcacgatatgaccaatgacgaccatatggatgagtaatagccgttggattaccaagaaagttggaatcatgtgctctttgttataactttgctcttgagttttcttgatataaaagcgaacgacgactttttgtcaaagtgtccatacacgccagagaaggcagagaattaaaggcattataaaaaccaagtgtcgttaggtttaagattgtataatgattagtttactcttaatcatgagttgacgtttgaatagaatctaaacccaaatcactaaacgtaatccgatattcaatatgaagttatgaaccaaacagttcttgaatactaacagaaacaaacgaaacttacatcaaattaaaattcgtaaaatctaacctgatgaacattgatctgcttccctactaatttttttctttctataatccttatttgaatattactagtattatgaggatatggatttctatatttattagtacattgttttgattttaaccagaaacatcaaaataaccaaaccatatgaaatcagacaagatgaatttcagtactaattctatcaaaactatttataacccaaacgtaataagcaaatatcgaaccctagtgcttgttgttatcataacaaatttagatgaattggaaaagatacaaaaggtcgaatcatattcgtagaaaatgaccaagcatccttggtgtttatgggccacatcccacatgttaaaaaaagatttgtgtttcgagtggcttaaactctcaaccaaacatttgaatatattgcttaaagttatttgacttaataaactatatatgtcaatgaatcattttattatatgtattgaggttctccacccacacaatctaggctttcagattttaactactccgagaaaaaacgaacaaacgttttctatttcgttaattacatcatcgtcgagtcgccaatgataacatgtcactacaaaagaatttaaaatctctctttttatcaagtgaaaatgaaaccttactttaattgaatataggtgtcgttttttacgtggatgtgattagagctactttatcaagacacgcattagctcgtcatgtaaaacttctaaactaaatgtgtttttgtcgttttgactacacgttaaagtctgccgaaaaatactaaactatatatagtaaaagcaaatgacacgtcgtcggtgaaattgatgtcaaacaaaaatgtagtcacgtcgaaataaatatttatctattcgtattcgttttggttcttaatagagtatcatattggatgtcatactaattttatctattcatattgtgtgtatttggatattcgaattgtgccaattgctggagataagtcttagtggcccaaaattgtttcgttttttgttcattctgtaattgcattctctttcgggcatatataaaattcccacaaactcaatagtactcatagtctcatacgtacatgcaaacttctatatatttactcgcaatgtaatcagattcttgtaataagtctcctttggacattcgtcttcttttctcctattcgacttttttttccccgcatatatgtgcacgatattatctaatatactatgtagcatctctttagaacttggttgaaaaaatgacaccgtaacaaaattgtataatagtggattttcatcttgcgcatgttttattacttgctatgtaatcagattcttgtaagacctcctttggacgacattcatctttttttcttttcgaagaacatagttttttctttctattttcctttcgacatatccaataaatagcatttttaaaagcttgtttacaaaatgacaccatgataaaattgttaaaaattatgttaattttgcccatattttgatcaaacaacagaaaatttgggaatattttttttgtcgaccacttttatattattagaaaattttgaattaacacaaatagatttaaaatattattaatgtccatacttttttgcatggtggtaaaacaccgtaaaatgttatttgaaaaaaaaacaaacgaaatcaacatcattttatttttataattgattaaaattccaaaaatactatttattttatttttggggaaaaattgtagtttcttgggtgggcttccacaaaattctattatgagactggactggacccataaacagaggcaaaccttacttttgttttctttgcccatctcacataatacactctaaaatcaatttatttcattaacattaaattgattttagagtgtattatgtgaaataaagtaattgaatattaaattaaattttcccagaaaaagcgttgacagttttatcttcaaaaacatccacacactgagaaacagcagaagaaaggcttgagagccttcttctccactattttcaatg

SEQ ID NO: 32905 - DNA, 3000 bp, Unknown
  misc_feature (1)..( 3000): 2750-1469P.txt file - cDNA_ID_3062903; gDNA_ID_1620414; Annot_ID_156365
tatgttcaatttaatgcattggttgataaagttgaataaactactgtaacagccgttggttcaaaataattttgttcacattatagtatttaatgtagtgttgactagagttggggtagtaactggtaagtaccactagctagctagttatgaagtgaacgtgttacaattctctcgtatattagatttttattttcttacatcgtccttccttaaactaaatgatatgtagtagtatcatttagatctctatatgaaggaaatggaactaaaactgttaacacggaaattgtgtgaatacaaaccactagacaataactttcgaatgtctcgtagtcgtaggcatatatatacatgatcgaatattaatgtgtcctcgtatgctaagtagatattacgaggccctatggagaagaaaaagagaataatactactctcttttgtacgaactttacttttcttttcctatattttttttaaaaatatgtaattcacttcttccatgcattcctttgaataattatttatgacttttttacaacatttatgaggtactgcatctgagaattacctatttttaacattggattcaactgatggtgttaagtgtgagaaagcaagatcaaccatatgactatctatctataaccaagatttactaattacgtcctaaccttctcagcttgaccatgcctatcttcatagctagacctctcggtggatcctttctaatgattgaaagtatgatcttacccaagttcagttcatgtttgatcaattgactcttttaagtctacccaatttttgtcttcgcctcttgggaatattggaccttcacatctaaattatagttcactttatgccaaacgatacgcaccaagcaactatgatttggtataaaatggcactttcagttattttcatacgatacttttttacacaccagttattgaagaataaaacatgtcattttcattttctatcgtatttatattgatattagcattgtgagagatttgaattcaacatatagtaaattctgtaagaatgtatggaccactattctacttatttttcacagtgtaatatttatttagcttcaacgaatttgacaaaatatattatcaacttgctcggtttatttattcatatcttatcacaaagtacttttgtcattcaatatccctacatgtcccagttccgtctggatatatgtattttagcagccatcaatgtatttttgtaaactaaaaactaaaaaggagtctaattttttttttcctaaaccattttccatcgatcttataatattcgttattttggtcagtctcccaaattatttagtcttattatttatttattaaaaaaatattagactatttgataatggaaggccaaactaaaaaagttgtaagatattatatagttaggtctacatttttaaaaaattcatcgatcaatccatttcgcagttctcaaagactcaaatgtcatacagttgtctatagtcaacattcttaatattctagtggataataatgcatccccaactatatatgtgtttggtttgagatatataaagcataaaaatggaatatcagaacccaaacataaagtgacaaatgacaagtggaaggctaagaacttggtgctcttttttatttgtttcaaacaaatttagcgtttcgaatggtaacaacatgcatgatcaacatctctgtttctttttcttttctggtgaataaatgataaaacatggtggatgcggttgagaagaaacgcaattttgaagtcagtgtattgttcacaaccttgcttgtttgctgattctcacgtggtcttttagatctgcgtttgtctaacgcgctctttctcggaaagccacgtgcattttgattcccatgccaaaaccactttctgatcatcattgatggcgcttttgtattcgatattttaatccatttggtaagtttaaaagataaacattcgatgtatgtagaaagagaagaaataaaaatatcaaatggatgaaaaatattgaacaccaaacgcctttttttattctaggccacctgcttggctgcttcttgtgtaagtgcacgtatttttttcatggttctattgttattgaaatacaataaaagtcatcgagtctctcatcctcttaattttgtttgtctaaatttctacgatgatatgtggtcacaaaaaatttcatactccgttacgagaatttctttaactagcggaaaatgtttaactgtacaagattgacgaaaaaaaagtttatctccatatgaaattcctcacgatcaaagtaaaagaagttgaataatccatagagatatagtcatgacgaggagaacattattttacgttttggatttgatttgtgatatattaatttagtttgaagttgacgtgttagatgcatgctaaggtcaaatctcttacatatatcattcaatgactctttcacttccattatagtacgaaaaagagtgcacgggagatgaaacaacgaaacgtgtaaggataactcgataaacactcttgcacttgtagtagctatagtatgtcttgcatcttatctagaaataaataattgtgtagtgagtattgaataatagatatataaaggaattaaggaaatactacagagactatttttcaggagtcgactttttccaaatgctacttttgtaacaaaaacagaattcacaaaatcttataatattagaaattgggctttcgaagggctttaaatttcagatccattggcgaaacaccacacaaggcctattaagccagttccaaaacaattaccaatatgcacacaattctcaacgatattacgataatgccaccaactgttcttttcctgtaatttccagtttagagctttcttcttcctttccctatcctcaaccccaaacgaacgctcttcaagaattagggtttcgttttgaatcttctctgattcccaaatccaaagatatg

SEQ ID NO: 32906 - DNA, 3000 bp, Unknown; identical to SEQ ID NO: 1535
  misc_feature (1)..( 3000): 2750-1469P.txt file - cDNA_ID_3062907; gDNA_ID_1620414; Annot_ID_156364

SEQ ID NO: 32907 - DNA, 3000 bp, Unknown; identical to SEQ ID NO: 1531
  misc_feature (1)..( 3000): 2750-1469P.txt file - cDNA_ID_3062919; gDNA_ID_1620414; Annot_ID_156358

SEQ ID NO: 32908 - DNA, 3000 bp, Unknown; identical to SEQ ID NO: 1546
  misc_feature (1)..( 3000): 2750-1469P.txt file - cDNA_ID_3062943; gDNA_ID_1620415; Annot_ID_156407

SEQ ID NO: 32909 - DNA, 3003 bp, Unknown
  misc_feature (1)..( 3003): 2750-1469P.txt file - cDNA_ID_3062962; gDNA_ID_1620415; Annot_ID_156392
catgtaattgggaaagggaatcggagacaactaatgattgaagaaaatggatacgttgaacttgctggaagtaaccaattgtcaaagctttcattaccactagcacgggtctgtctctcaaatggtatatatctgctcaatgagtctctctcgaatgattctaaatcagatcttggatcaatattatccgtggggatgaatgagaccaaagaaggatcatcctctgatcatgaggaaggtaacacgaacacagactcgaaagaggcaaaaggaggaatgagccaagaaataattcaaaactcactctctgcttttgaggatattcgtaatagagaaaagcagttgatgagacaggctctctttgccaatatggcttatgtagaattggagttggcgaatcctatcaaagccttgtcagctgctacttcactcttgcaacttgcagattgttcgaagatttatgttttcctaggccatatctatgcagcggaggccctctgcttgctcaatcgacccattgaagctggtgcacatttatccgcctatctactcggacaggatgattttaaactgccatatgcgcaagaagactttgaccagtggtggaagcacacaagttctgattgtgaagagacattggatccctccacgggaaatacccgggattcagttttccttaagccagaagaagctcgtggagcacttttcgcagaccttgccgcgctgcttgccacacaaggacatcacgaccaagcaaaatctttgataacgcacgcgttaactctcttaccgaacaatgtacaagctacagttacagcagtctacattgatctcatgttgggtaggtcacaagacgcccttgctcggttaaaacagtgtacccatgtgagctttgttccagggagattggaagtgagagcctcatagaagatttgtactctaaattggtatggtttgttcttttttgaaattcaagctttagaaattagttggttcgataaatatcagagaataaacttttgtacaagtttttttttgtttttaatttcttgtattagtactgtgagatgatatttgcactcgtgacttagatttgggtcttgagggattagtcgatttcttgttcaggaacaacataagattgttagaacaaacaccagtttttgtacttttttttaaatcttgtttaagacagacccccttattctatggctttagtagatttgtttatttttgaacaagaaagtgtggcgataaacaggcaatgaccaacgcttagcgtttagaacacttagttggggtttacgcgattttaggtggtttattcgtttacgatattatagataaaaattatgttaaactatatattagaaaatattaaatcgaattctaaataaaaatttgacaaaaaatttctttaatttatatcaaacaatatatgaatgtttataaccatgtgtgtagaagtaaaacttataaatttaaacaatgtagttagaaataagaaaaatatattaaaataaaatttatgttattttaggcagtcgatacggttttagccgtcagctgaacgcctaacgtatagtcggaatctaaacgaccgcctagaccactttttaaaacactgcttttgaatctttcaaacttcatccgaaagcaaaactaaagcttctagaacatgtgaaagcttgtcaagaaaccctagttttgaactcataaaacctagttcagaagagttataccgcagcattcttttttttttgtaatacaaagtctctctttttctcctttctaatacaagatgcaattaaacaaaatgttcctctagttataataatgtagaaaaatacgtgtacgctagaaaatttctcgaccaacgtaaaagagggtcctagaacggtcaacttcgacacgtggctcgtccttatgtctttctctttgtgtacagaagcaatgtaaatgcaagcaagcgtgtaagaactaattgagtcattgacacatgagagtgaaaaaggcaatcaaaagtcatcaacacatttctcttttaaatttggtatgcttgtttcgtggaagcatgtttggtgagggtagaacaactttggttttggttactccaatgatccatgcagcgaaggtgttcgatgaaatgcctagaagaggctttggggaaattacttcacctgaagactgaagtctgttagctataagggtttagtgattttgtcttgatgagaattccatttaacgatgataaataatgatgcgacctacaaagaatctttgccgccttaagttaccattgtttcttgtattagcgttgttgctgatgattggaacgggtaaaagatatacatgcatctaaagttgttaaggataaacagtgacgtggtggtcttgtcttttgataatcttgttactctttcctcactcaatggctacctcttgcgactgaaacggtaaacctgttatcactctggctttgtgtgtattcatcagtatctggtcaggttagaacaaatatattgcttattaaccgatcaatctgttgctgtcctgccctgcttgtcgatagtagacagtttctgtggtttagtaatactagagaacttattacatgagttaaggtactgtgtgtttactctcgaatttgcttatgttttatatcaagttacatttttgcaaacaacaggtttcaactatgtctcctgtctttatcaaaaaaaaaactatgtctcctgtacaagtggtagacaagttgttacaattattcttcatgtgtcgcatctaatttaataatccgcactataaaaagtatgatttatttaactaaaaggaatcactagagtctagaggtggtaatcgatcagtaatcataatatatattattgtttagaaatgtgagaaccctcagccatacggttgagttggagtaaacttttagctgcttctagatctaattttccgagctgatttatcgtaggtgattgtcgacgagtagttatg

SEQ ID NO: 32910 - DNA, 3003 bp, Unknown
  misc_feature (1)..( 3003): 2750-1469P.txt file - cDNA_ID_3063002; gDNA_ID_1620416; Annot_ID_156432
tttttttggtaatcaatcgcaaactaaacacttaatgattcgatagttaccactaattagcagtaatttattgtaacaataagaacggcagggtattatcaaattggtttttgagactttgtggttataagtggcttgacttatggatattctattcagccacacgaaaaaaggttacaacttgcaaatctcagattttgatagagtaactaataaaacagtagagagttgatgagacaaaaacatcttttccattgctcgaatgagcaagatatttgcattagatatctcttcggatataattatattctgttgataatactaaccagtataagttcttaggatttttttttaaagccttttctatagttattttctttaaaatcgtaatttatccagactaaaaacattttaggatgaagctatataactaaaccatagatgataaatttataatttgctaaaacgaaacagtgacatttctctatataaaatagtgtgctttatcgtggattttcttaaaaataacatattatcggacaatataacacgttatgttttgatcaaataaaaatcatgcgctaaaaatgaatcataatgtttacgaaaatgctacacaccagttttgcagtaaaaaacatggtggttaagttgtcttttaaagtttaaattgtcattatttgtgagttcacaatatatatttgtgcgtgtgaaagaatagataaacatatgattgtgaatgatgattagttgtcgtgatttttaaccacatgttagtagtattcaaagccttgaaccagaaaacggtcattgaacaaataaaattgttgtatatgagcttcctacttaattttctaacgcatagtggtattttaataatcccgtattaaagtaattggaagaattgaacaaatcagaactttttgttatttgggttgatagtggacacacctccgtatcaactccacataatgagttgtaccaaaaggtattttatactttcttttcgcttttgcacgtttagaaaaaataaactcgaaagcgaggttgcgaatcgaacacgtaccttgcgcgatttcatttcatttgttaaataaaatctaaattaagatgaaccaaaaaggcaataaaatgacagaaaagagagagttaaaaagtcaagatatactttgattggagtaatggtgagcacttaaggaagccagccaaagcttggtaagacgacgagtctctctatatggagaatgattgtcctacacgattttgtttcacggtaggactctcctataggcttgtttttatttcttttctttatattgtttcattattacaacaacccacaaaatcattcaaaaatgaaatgagatcatcctccaatcacccatgacccatatatgatatatgttaggttaaactattacaatattcaatcctataggcttgttttttttgtttttttcctttatggttttcgaacatttttaaggtatatctcgacacgagttctctactgttcccacaaaacatgtttactacataaatataataaagaggaattggcgaaaaagctagacaaaaaaaaatccattaatcctctcatagaaactagtttttgtgagattaaaaatgctcgatagatgatcatatgaaatcatagttggacgtatacacatgattacaattagagaaaatgttaagtgtaaaatgcatatgtagatatcttataacgaaagagtaagtactggttagaaaaatgggcatgcaggcccctacgcgttgtaccaacgttaaattaaagccacatttcaccatacgacaacctccggtcctttagctctttcttgcttctttgctcttcgatctgactaattactttttgcatgttttttgttgtccaatgtccatcatcacgtgctaatagcctatcatatgaacattgtcttaatagcccattaaacgcttggtgaaccgtttttgtagtaaaattttgggcatctctgccaacattttcgattatatttcttagagtgtttaaaaaaaaaaaaaatcccatcttagatatatggactaaacattgataatccatttcttcacattttatgatgaatatgtttgaaccaatacaatgaatatataatttagtttttttttatttttaggtttttttttggtaaaaagtaaaatttcataccatttttgaaaattttgacaaaaattacaaaagaaaacaaaaaaaaatgagaaacctaaagctacataaaccaccaaaattactacataagcataaaacagaaaaacacacactagcaaacacggtaaaagacttttactaaaagtcatgaataaacaccgattctaaacagtaaagatcgaacatttataggtagaaaatttgattgtcaagcttcattcatcaacttttcatcttcacatgcttccacgtaaacctcaacaagcttctcaagtagctaatttgattaagaaccattgtgttattcccaagaaccgcattataaccaaataagataaattttctggttttgctattcgtaaacttctccaccatttcttccacatccaatatctaaatcgcatttacaagtgtttaaaggaatcgaaatttatgtttgagaaactctcggataactttttcgatgatcggtaaatggcggcagttgtatcatgaactagttggtgtatatgttaatcatatgcttagaatcgtgtaattgataatgcaatgagatacgattgttcttagatctatatgcaaaataaaatttgagaatcgaccaaatgattggatattatacttgtcatgtttggtgattcatacatccaaatgtcaaaaacgtaaaagttccattgtggccattaacgtgcgttctcgccatcctcgtatatcgctaatgaaatctaaaccaataaaaaaacttcaatcttttttttcttcacaattatcgatccaaatcaagattttcttgatttgaattccttgcgatg

SEQ ID NO: 32911 - DNA, 3000 bp, Unknown
  misc_feature (1)..( 3000): 2750-1469P.txt file - cDNA_ID_3063006; gDNA_ID_1620416; Annot_ID_156426
ctttaattgaatgtacaaagttgatgtaaaagctttggctccatcgttcatggagtctagtacattgttttgggttttaaaagttttctgtgttaaagctcgtcgtctaattgatgttgtgtttggttttagttgaaaggtttagacgtttagtaaaaaagttactcaaattcttgaaatctccttggccttgctgattataaaatcaaatattcatttataaaattatgcgaaagggtctaattatttttgaaaccgaatcgaatgaagacaactccattttgattgattttttttttgttgtattaaagaataaaaaactcgactggttcaacaagactggattgtctttaaactactggttcaatgtattttgggtacataatgaaaaaaatacacaatccgccttggccacgtatccatctttggcttagttgatgatgataatacttttgttttttggtaaggctgatgatgataatagttagaagaagttcatagaataatccaatggatttccaataataaaacacagaaataaatataatccaaacaattgccaaaaataatgaataagaaaagggacccacaccaaaagctaaaagcgcgtgggtcagattacaaaaagcgaaaccccaaaccgtggctagacagcggacgaacccgtcccttcaaacgtggctcacctttcgaaccacagagagcagtttacactccaactgtcaaaaacgtgttcccatgacgtcatcctcaacgtatctttatcactttttaaaactaaagactgttttgtctttttctaaatcgtcccctttctccgaacaccatacttaaattcaataaaataataaatatcaaaactgaaccatcgaatcggaaccagccacagtacacaatacacttagacgaagtaaagtgattcagaaggacacgtgtaagtcacataccgtgggacacttgtcgttaccagatcctccgtgtttctcacttttcttataaaataaaaacacaacacttcttcactttctgtaataaaaatatctccaaaagttccaacacctgaaaacataaaaagatagaaagagaaataaaacatcttatccaaagaaaaaatgaatccattttactctacattcccagactcgtttctctcaatctccgatcatagatctccggtttcagacagtagtgagtgttcaccaaagttagcttcaagttgtccaaagaaacgagctgggaggaagaagtttcgtgagacacgtcatccgatttacagaggagttcgtcagaggaattctggtaaatgggtttgtgaagttagagagcctaataagaaatctaggatttggttaggtacttttccgacggttgaaatggctgctcgtgctcatgatgttgctgctttagctcttcgtggtcgctctgcttgtctcaatttcgctgattctgcttggcggcttcgtattcctgagactacttgtcctaaggagattcagaaagctgcgtctgaagctgcaatggcgtttcagaatgagactacgacggagggatctaaaactgcggcggaggcagaggaggcggcaggggagggggtgagggagggggagaggagggcggaggagcagaatggtggtgtgttttatatggatgatgaggcgcttttggggatgcccaacttttttgagaatatggcggaggggatgcttttgccgccgccggaagttggctggaatcataacgactttgacggagtgggtgacgtgtcactctggagttttgacgagtaattttttggctctttttctggataataagttagtttagggattatttggacatctaggattggtccggagttccgtacctgtattttttgtttggtaccaaatctttagtaataaatcgtctatcatttattcttgttagaatgttctttgtttgtttttggtaaacagatttgatcaaattagagctatagaatttgaaaattttgttttgttgtatctgaaactgtaaatagatttctctttgtttcgttgatgtattgacaatctttaccaaatttccagagcttataaaagcttgaaacctctgcttttccaaatataatcctgattcacattatcatatattccttgtagactcagcaaaaaaaattaaaactataaaatctcttacacattagtccaaacacgtgaatgagtaatagaggtccttgaccattagactgatatagcttctatattgtggttcttaaaaaaggtagaatatttatatgtggcctcaagcttctcatgagtcacgccttatggtaatcatctatcttttttcttctaagcaaacactgaacacttggaaatcttttcactagaaaaacatgtccctggccctcactaactttacatgtccttttctttcagttatagaagtgtggggtttcttggctcgctagatttaaaaacccttcattatgtatagggttgtgcttgtgcctagaacccttcattccaaggcaaaagcataaacctacaatccggtctaaatcagaaccgatttaaaccgagagaaaacactaaagtaattttgtaaaatagagccatcatagggataaaatagtaactaaacaatagacgtcaagctgacgcgactggtgttcactttctctttctcttctactacttctgtcctctccacgaagatccaaagcttataaacacatacaaataaatccactccaaagtttttctcttttttctctgcattattatcacttcaccacattcacaacaatcccaaatttttctttctcatactttcatattttgattactacttctcagagattcttttggtaattagggtttcctccaattttgcagcttgatttatctatataccaatcggaaaaatccttacttttaagttcggtcttgtgttaatttgcgtctgttgttattgtaatctagagaaagagagtgagaggcaataaaaaaagctatg

SEQ ID NO: 32912 - DNA, 3000 bp, Unknown; identical to SEQ ID NO: 1549
  misc_feature (1)..( 3000): 2750-1469P.txt file - cDNA_ID_3063012; gDNA_ID_1620416; Annot_ID_156423

SEQ ID NO: 32913 - DNA, 2680 bp, Unknown
  misc_feature (1)..( 2680): 2750-1469P.txt file - cDNA_ID_3063016; gDNA_ID_1620416; Annot_ID_156422
gatctggtaagtggaagggtcgtagttgagcaactgagagtaagagtacaaaccaattcctatgtaatcaagacatgtgtaatgtgataaacccaagtgaaagtagtggtcggatctaagacggtcgatcttgtaagtgtcggagtagttggggtaagcttggatgaaatcggagaaagattcttgatgagaaggaagagaatttgggtcggtgaattcggtgtccgggaagatggtggagacggtggtttgggcgaaattacggcggagagtagcggaagtgacggtgggggttgaatgtggtgggtgttcggagctggtggtaccgtgaaatggtgacgatgagaagcagccgtgaaggcagtttggtggtgaagaatctccgggaaagggttggtgcatttttcttctttttttgggtgcaaaagatttatgactcttgtaattgtcaagtcattagcctatcttgtgttaaataaatacgctaaagtctaaagtttataaaagtagtgcacctaagacaaaagcttgtttctcttttcttttacactaaaaagaaaagcagaagcaaattaggcgggaataatgatgattatcaagaaaatactgaaaagtgttcactttgtcttgtttccgcaagtgtttttttttagaacgcgtagagtttagtggtcaagaaagtgttttctttttcacttttgtttccttagctatttacaatgcttacatgctaagatataccactatgcccaattgagtaaacaaaaacagccaatagttatgttatatacatatctattttttttatgttatatatcttgttaatgaaaaaaaggcggaatataaaagattaaaaatataccaattcttttagttagtacaataaactctattttttgtatcaaatagctatcaaaagaacactgatctgtctgttggtatatcggcctcgctcctcaagcttctattatttaatttacaacgttatcagaaagtgtaaacatcacactgcgttatttgtttattttctcatgttatgttattactatcgtaaaaaggacaaagttctctggtcgatcgtggtggtggttaaaggagcacgcgaaccgttcgaggactataatgatgagcgggagttacttttacaatttagaaatcttgctctttgaagaatttagtttgatttctcaaaattagtcattaagaaatatagatcgcgactaaactagggaatcaaacgcatagaaatatcgaataatgggagaaataaaagaattggataatcctattacacacaccaaaaaagaataatagttttttttttggggactctacttaacctatatttgtttgaatcaaagccaagctaattataggattgtaattaaaatacacattcgagagaatagggtgctacaaccaattcttatgttgggggtcaaaagcattgtccgcaattatattatgcatattacctcacgcatttcaattttcatatgcctgtttgttatacaataggtatatggtgtgaggttgtgtccaggtttggaccaactaaaagatttcaattaaaactaaactagattctgatccgcacatacgtgcgaagtttcatattttaataaatgtattggaatacatttttagtgaaagatattgtagtgtataaattataatatgcatagaaaagtgtatagtgttatttatgatacaataactaaatttttttatttttttatattatttatatttcatttgtgttttgcatagtaaatcgaatgttagatttgtttcgatttgcggaataatatagagatatttggaaaatctgtgtatttttgttagtttgatgtatagacaaattagttgattttgtttgaaatttgatcaattagatgatataatgtaaactttagtccgcgacaccgttgttcgatttttttgtaactaaaaatttgaattttaagttatagttgttttgtaaatattgttttttttgtttagtgtttaagattgtataattgtgttaaaattgttaattctaagattacactcgtagattatcgtcccgttatgagtatcaacccaaactcgttctactagataacttcattccgtaaaattaaatattatttttgttattttaaatattaatattgttatgagtatctaatcgtttttttaaagcaaaattcaagatatttatttagttggagtagttattaatttactaaattacttatacaaaaaattcatttagttagttttaaactacccttacaatgttgtagttcacacaatgcttctcaattaatagtatagatagttataaagttttttctcatcatcttatttgagagaaatataaatacttgcgtgtaagaaaatttaaatgtattgatctgattctacctctattgtttttaatatactaatgtcaagaagatttttttttatttcgtcctcacatggcataacatgattagggaatttattatatgatgactttcaaactctatgcagatctgaatttgttatttcttaatatatattctgcgatcgacctttatatagtatttggctttgagtagtaacatcgcactgcttataatgactatcatctcttgtataactattcacatttttcgtaatattttattcgcaattttaatcttctatg

SEQ ID NO: 32914 - DNA, 3000 bp, Unknown; identical to SEQ ID NO: 1561
  misc_feature (1)..( 3000): 2750-1469P.txt file - cDNA_ID_3063028; gDNA_ID_1620417; Annot_ID_156482

SEQ ID NO: 32915 - DNA, 3003 bp, Unknown
  misc_feature (1)..( 3003): 2750-1469P.txt file - cDNA_ID_3063040; gDNA_ID_1620417; Annot_ID_156477
aacaaaagatgttattagccccacctgcaagacattcacagttctaagattactcatgatatgcttcaaacagagtaaaaaactatgccaactcaatagcttacaccaattccgagaagtgtgcttgttgagaagaggtacaaaaagttcccaaatacttgcagcgccgtccaaccggttaggctttcaaattgaatcttttgcacggcgttgaacagtacaactgaggttgcatcattcaccactccttctccaaagactaagctgtatagcaatggtgtttcatcttgatggagaatctgtaaaagtttaagatgcaatgtaagaaaaaacttttaatagaagaagtagtaagacaaagaatcttctaaatcaagaacctgtagagtgcaaacagtatcagttgatgagaaaatcgttcctatggctgaatcaaaacaagaaagcattcactctcgcaaactgataagtaataaccatctcaacaagaaatgaaaagaaacatagatcagtgaaaaatcttaccaagatagtctctagcactcaaccccttaaatcccaacttgggaaacagccaccaagtccctggttcacattataaaaacaacaaaaatagagatggtaacaactccgagataatcaactttaaatcatatagtcaagtcattcaaagattaatgaaatattttttaccaaacgagataatgacagtggagatgaaaactccaatcacaccaaaggacatgatggttaaaaagttgtgaaaaaacttctttttcttaacttggaacctgccacaacaaaccaaaaaatcttcagtcaatcaccatcatagtgtaatctaacccattaaccacaacatagtaaccaaaaccatagtaagcttacccagcattgaagattattggaggaagaaggtaaatgaagaagagttcttcatcaaacaccaaaatatgtgaactttttcctttactaataagtaagatcactgttcctgatgctgctccctacttgcaacaaaaccaatcaaaaatagtgataaaattgttctttaagagcagaaaagctcaaaactttagctaaaacaaaaaaaagaagaaattttgaagaaaattactactaaaatggcggtaatagattcattaacccatcgattctcttcaagcaagtggccgataactaaacatagacagagaatggcgatgaacactgagattggtatcacctgaggatgctcagctgctagtttattcgtcacaaactctgttaatccgatactcatttttcactcgataatgttttcgatttcgtcgattttgaaaacaccaatcgcaaacgaagaaggcacacagagaacgatagagagagagacgaggaaagagtcagagagtgaggagagatttgaactgcgatgaacaaggcggtggttacaggtggcgaggagacgaaagacacgtggcatgtttccaacgtcatcagactgagtaaacgtgaggctttttggaattgtactgcatcttgggcctttttagggcccaaaactaactcatcatgtatttttttcttaccggatttggggatttttttcttttttcttttttgggtctaactaactcgcgtaaattgttgttctttttccttaatttatttttacctcttgttctttattctgtttatataaaattatgaaacttgaaaactcaatatttattacaacgaattatttggtgaagactcgaaccaatcgaaataaaacactctactgagtaacggtcccggttgcaacagccaagacgctagaacgtgatcgtttcgtttggtcgtgttttgatgacgtaaaaagtgactcagcgacctatttcaccacgtgtaatctttaacgaccatgttctaggacctacctgacttttaatcgatcatccaccaccgccttctcaacattttttaagatactagtatcattatagctataatataaattaagaaacttgtaaatattataattaacgtgaaaacatagaattcggatatataatgtgtatattagataaataataaatctgctcatatgtgatatgtatatgcatatatcatatatgtaaatgtagccattattggaatgcgtattgggtaatgggtagtatcactagaatgatacaatttttcttatatacagagaagagaagaggaaacaagaaaaacaaatacgttccccgcagtagactttttatttgttggtaccgtagaggaaaacagatatacaccaattactataggagtgattaagggagaaattgcagggatataattgatatctaatagccgtttctacactaatcctaattataacaagaccaatgattgacacatgtatattgcaattgcatgcattatatagtttattattatgcttgcttatagtttagctggttttggaaacaagtaggtagtaataaagaaaaacaaagagagagtaggtcgtaataaatgaagaacgcataactataaaaaataaatacacaaatatatgtaaaacaattgtttggtttctctaggttggagacaaccaatcaaaaaattatattctaatttaaaataaaacttatttagttatcccatgaaaattaaactcttgtattctcaaaaaaaaattgagtcaaaattacactcccaatattttctgtctgcaataaagatatggagacacattgaaaaacattttagtttatttatgaaaaaccaaaaaaataaaattttagttgatgttttctttttaaagtggaaaaatgtgtcaaaaacaaaaagtcgaagttcttttgttttcccttttaaaataatcaacgatcatataaattcgaatcccacaaaccaaaaagctctctctctctctctctctctctctctctctgagtaaatctcagtttttggtcgaagttggtgaagtcgccgccgggacaactcaggttgttacagatgataaacatgcgagataatccaacaatg

SEQ ID NO: 32916 - DNA, 3000 bp, Unknown; identical to SEQ ID NO: 1557
  misc_feature (1)..( 3000): 2750-1469P.txt file - cDNA_ID_3063055; gDNA_ID_1620417; Annot_ID_156470

SEQ ID NO: 32917 - DNA, 3000 bp, Unknown
  misc_feature (1)..( 3000): 2750-1469P.txt file - cDNA_ID_3063078; gDNA_ID_1620418; Annot_ID_156504
ttcaatagccgcaaccgctgaaaacgcccaacaacatcctacaaaaacatcactcattagtgtcactatcataaatattttcatgtgtctaactacatatctcaataaaacggtatgaaacaaaatatatataacttaacatagaaaaatttaataaaaatatggttattcgattcggtcagttacactatggatttggtttggatcggtttgttcactatgaattaactcaaattgattgaatacataaatttcggttggttcaatttgatttcacttatatatatatgaataaagatttgagttataccgcagctgccttgattcttgataggggtcacagctcctttcttcctccagtcaacagaaaccggcaaagcaccagaagaaacgttttggtacctaaacggcgacattttagtttggctttggctagataatgccgagacacctttgaaaccagtgtacatggaacgaaattcgtcattggttaaatcagcaaactgatttaccgcaagtttgaaagttcttccggcaggaatgctatttaaatgttcaatgcgttcgacgttgtttttgaacacaacgtagcgattgttttcctccttcacatccgcgtagacacggccgtgtttagtcatccactcgatgtgcctcttttgcatgatgagttcattgtcgagtggacgagaaagagtgatggagaaacagaatgatgaaaatatagcgacgaagagaaagatttgcatatgttttaaagccattgttttaggaaagttaaatgacttttgctcttaatttgattacttcagaagggtactgagatggggttttatagtgaaaataaggttgatgtaattgctaatgttcacatgaagtgattgatccaaatcaaagcatttttgttttacaagtaatgactacattcattcatacataactaaatgatcgttgatgtttgatacgtagccattttagtcctacatcaacctgaaatcaagtcttgttcactcactttgctcggatttttagttaattttagtggtgggtttaattagttttgtaaacatttatatttgatgattaggaagtttgtatctagtaaaatttaatttctctacttgtgtactatagagattttcgaagttggatatgtgttgatgatgttttgcataaatatatttccttatttaattaattaaaattaatatttaagaaagcatttttaattgacatttcaaaaaaaaaaaatctatcatgagtataaattatttggaaaaaaatacttttacatgctgatacgtagttacgtacatgtttatttttcttgtagtacgtaggtacctttcatgcatcaaaatcactaatcacataaaaacaaggaatcttcttttgtcttttcactaatcaaatagtttgaattcaaagattctgtttattcacaagagaaccattcgtgcaagttaaaagcttaatcaaatcaaaaagaaaaatgattcgacaaaattaactaatttgatcaaatcatagtcattcacaacaagtgaacttcattacgctaagtattcttttgtagataaatcgatatgatttgctaaaagtttcctgttcaatgatgtttcccaccaatttcatctatctgaatctctatgaaagtttccctgtcattagaatacaatataaatgtagctctgtagttagggataatataagaaatattgaaataatcattagacgacaagagggatacgtacgaaattgcattttggacttaaatccaaatcatatttggctgaagtgataacgtctaaaatactaaattcaaaattgacaaataactgcatatttacaaatataatgattagaattattttattatagtgatatagttagttttcttacacaaagaagaagtaagacatattcttggatcttcacatggtatttaaataattgtaaaaacgttataaacttataattgtcaactggagtatataaataaataatatatgaattcttgtacagggaaaaatgcggtgtaaataccaaactttacgaagcgtggcaaaaatgttataaaaaaaaaatctataaaactttgttattgtgatgtgaaggaatcgccctagtcaacaaattaaatcacaatcacctcatgaacacaactgatttaactatatcaactttttcttgaaccaaaggtaccaagtacaaactaataacgatacgagttgtcagttgtgtaccaagtttttactggcaaataaatcgacttgctaccaaagtaccaactaatacgagtgtctctgttttgttaacttgacccaatctttcttcctcgtctctttgcaaaacgcttaagcccaaatataactaatatggcccaaaatattcttgagagatccaaacctataactcgaatacccggtaggacaaaacgcttcatgtcatattctgacactttttaacacttcatgatcggtatttaaatagcattttcatttcttgtataacaactgagttcatatatatacatcattgatcatatattgagtattgatctaactaattcataatcaactattcaactgttttcattaaaaaaaacaagtttcgtatataaaacttggaaatattgtttttaattaatttgaacgtacattgttatgggttcttctaatgttaagaaaacaccaaagagagaaaaaagggtggtcaaaaaacaaatttagaaatcaatgctataattaagctatgataaactaatcatttttttatcgaaacgtaatgaaactaattttaaattttaacaatcaacgattttacttttttgtctcagtctaaaaataacaatcgggtttctaatataaaacaaactcggtgctccacgagaatagttgtcctcttctcaaacatatctcaacttattgtttgaatataaaaagagatatcaaaaagaagagaagaccaaaaacaaaacaaaaatctctaataaaaatg

SEQ ID NO: 32918 - DNA, 3000 bp, Unknown
  misc_feature (1)..( 3000): 2750-1469P.txt file - cDNA_ID_3063107; gDNA_ID_1620418; Annot_ID_156513
aaagtcatatatatatatatatatatatatatatatatatatataaattactgtcaccgtctttactaataaagtgaaagtaaaccaccgaacgacacttttgccaaagaacagaattttataaaatgttaaaacatcaagcaatcaaacattctctgttctaaattgtatttattttgtgaggattgtatccattattccatatccaacttatctactatcatttaagtattaggtttaagtgtcgtgttgcggtggagtaattaacgcagccatttttggccatgatgggaataaagatacataaataatgacttaaactggtaacaagctcttttatactctcggtcttaacattcacaattaacagacttatacatcaaatagttatacatatttaagatccttgccaaatgtttattggatagagaccaagaagtaatacgtcggtgtctaacatgtacactagaggctaatttgttaataggtgtccaacacatcatttatggataatttgttaaatatgaatttcagaactcagaagtcagatcattcttccttttaagtcaagttggtagatatatatgtaaccattttgagagagttaattaagtttatgaatttttttattgcaaaaaaaaaaacacgtaatcagagtgctatttatttgaataacatgccgttgtacgcctagtttgttgtttgggactattttatatacaaacatttaatttataaaaacatagtgttgggcaaaaagaaaagaaatatcattcttttatatttcttgagaaaataaaaatgcttttttaataagaatgttccataaacatttacctactttttgttaaaggatttaatcattcaaacctaatttattcaatgttgatggtcatttagctaagttgtcctctctatggtgttgtaatttttaccttaatagaaacgaaatattgttcattataatctacaaacaatagattttcaaaaaaagattatagttgataaataatttctatcattcattttttatacaattgtttcatctgtcttccttcaatattaattactcctcttagattttttcaagtttttttctgtttaatttattatatattatattacagccataaactttttagccttatctttttctctcttttcttagctgatatctcatcgaattttttgtttttttaatctttaagtgtttaatcatgtaaatatttctaacgaaactttcatcagatagctaattcatcaggtaagtaatatataataatgagtgattaattaaaccaaaatgttggggaaaaacacataaaaaaggatgttgacatgggctttgttattacttattaagtgacatgaaagtttccaaacagttttaggtcacctaatgtgttggaacataacagttagagaatggtcatatatccttgccggagtattaattagggtcactaacaattagcattgccctttttcaactattaatgtgtgtctactctatacatttacacacacaaggtcgggtcagtttatttaatgcagtttcggttcaaaattggataccatttcttactttttaatacttgaggaaaaacaaaatgcgacagatttaaaaataaaaaatttaaaaaataataccaggacaatagttatctaaatgtacctatcaaacagtatagttttattttttcgatttaatccagtacccaaatctctgtattattctagaatccagttcattatgtattaatatagaattcatgtttccattattatgataaatcccaacctttagtatacaattctatgaatcaagaattaaaattttcaagaatcatggcatattataaccaaaaaaaagatacgtaagaaaatgtagctgacattgattgctatataactttaaatatggagagtagaatgattcgtaagattaggtggttgtgtgacctatatttattagacacatcacccacttttctatatctcttgctctctcacgatcgactgttacttactcgtataattgtaattcactaccaaattgaattattgtggataaggaaacagatctactctcttttttattttattcattgtaaatcagtagaataataatctttatcaaaataaagaaaatcaatagaagaacactgactaagaaaaattatgggttcgagttcacttaaaaaaaaaaaaaaaaatccaaaataagttattttcttggtttttatatattttctaataattttctttgaatttaatacatattttcacttatatatttgaaaagaaaaatacaaccaagctacactaaatcatcttattcatgattgagctattggtttggttcggtttcaaaccaatctaaatcatttgggttaaagataggttaatcaaataatttgaacatatattctcctaaccgtttgggtcgaagataggttaatcactcatatttgaattaaccctctttcaaaaaaaaaaaaaggttaatcacatggtttgtacatataattttagttcagtttgaatctctttgggttcaattggttcaaatcggtcaagatgcacactcttaccatcaattttaccgtcccggtttttttttgaaactaatgttgagtaaacgacaagtcaaaaaatatttttgtaaatttttttttggtgaggaaaaatatttttgtaaatgaatagaataattaaaattttacaggaattaatttgtagaaaaaacttttattgaaaatgaaattaaattcttaactatagtaatttagtcaaatgaatttacaatatgccaatttaaaatgacaatgggctattgttgtccatatgatctactaaatatttgttgtccactctaacaaatctgattcttctttccttgtaaataaagatatggatctgttactaaaacaaagtcgctttattcagatctgaagaagaagaagaagaagaaacatagttgaagtctctgttaatatg

SEQ ID NO: 32919 - DNA, 3003 bp, Unknown
  misc_feature (1)..( 3003): 2750-1469P.txt file - cDNA_ID_3063117; gDNA_ID_1620418; Annot_ID_156507
aatttcgtacgtatccctcttgtcgtctaatgattatttcaatatttcttatattatccctaactacagagctacatttatattgtattctaatgacagggaaactttcatagagattcagatagatgaaattggtgggaaacatcattgaacaggaaacttttagcaaatcatatcgatttatctacaaaagaatacttagcgtaatgaagttcacttgttgtgaatgactatgatttgatcaaattagttaattttgtcgaatcatttttctttttgatttgattaagcttttaacttgcacgaatggttctcttgtgaataaacagaatctttgaattcaaactatttgattagtgaaaagacaaaagaagattccttgtttttatgtgattagtgattttgatgcatgaaaggtacctacgtactacaagaaaaataaacatgtacgtaactacgtatcagcatgtaaaagtatttttttccaaataatttatactcatgatagattttttttttttgaaatgtcaattaaaaatgctttcttaaatattaattttaattaattaaataaggaaatatatttatgcaaaacatcatcaacacatatccaacttcgaaaatctctatagtacacaagtagagaaattaaattttactagatacaaacttcctaatcatcaaatataaatgtttacaaaactaattaaacccaccactaaaattaactaaaaatccgagcaaagtgagtgaacaagacttgatttcaggttgatgtaggactaaaatggctacgtatcaaacatcaacgatcatttagttatgtatgaatgaatgtagtcattacttgtaaaacaaaaatgctttgatttggatcaatcacttcatgtgaacattagcaattacatcaaccttattttcactataaaaccccatctcagtacccttctgaagtaatcaaattaagagcaaaagtcatttaactttcctaaaacaatggctttaaaacatatgcaaatctttctcttcgtcgctatattttcatcattctgtttctccatcactctttctcgtccactcgacaatgaactcatcatgcaaaagaggcacatcgagtggatgactaaacacggccgtgtctacgcggatgtgaaggaggaaaacaatcgctacgttgtgttcaaaaacaacgtcgaacgcattgaacatttaaatagcattcctgccggaagaactttcaaacttgcggtaaatcagtttgctgatttaaccaatgacgaatttcgttccatgtacactggtttcaaaggtgtctcggcattatctagccaaagccaaactaaaatgtcgccgtttaggtaccaaaacgtttcttctggtgctttgccggtttctgttgactggaggaagaaaggagctgtgacccctatcaagaatcaaggcagctgcggtataactcaaatctttattcatatatatataagtgaaatcaaattgaaccaaccgaaatttatgtattcaatcaatttgagttaattcatagtgaacaaaccgatccaaaccaaatccatagtgtaactgaccgaatcgaataaccatatttttattaaatttttctatgttaagttatatatattttgtttcataccgttttattgagatatgtagttagacacatgaaaatatttatgatagtgacactaatgagtgatgtttttgtaggatgttgttgggcgttttcagcggttgcggctattgaaggagcaacacaaataaagaaagggaaacttatatctttgtcagaacaacagcttgttgattgcgacacaaacgattttggctgcgaaggcggtttaatggatactgcgtttgagcatataaaagcgactggcggcttgacaactgagtcaaattatccttacaaaggcgaagacgctacttgcaattccaaaaagaccaatccaaaagcaacttctattacaggttcactttagttaaagagctggcatataataattaaacagattaaaccgatttttaatcatattatccaaattaataaacattactatactagataaaattcatattttgaatcttaaaaagctcatgtacgttcacatatcataggttatgaggatgtcccggttaatgatgagcaagcactgatgaaggcagtggcacaccaaccggttagcgttggaattgaaggaggtggttttgatttccaattctattcgtctggtgtgttcactggagagtgcactacgtatcttgatcatgcagtaactgcgattggatacggcgaatctactaacggatcaaagtattggatcatcaagaattcatggggaacaaaatggggagaaagtggatatatgaggattcaaaaagatgtcaaggataaacaaggactatgtggtcttgccatgaaagcttcttacccaactatatgaattcaaaaccgtgttaagcttttaattgtgtatgtttgtgtgggattgatgtctaaaaataatttgaattgttttatgtaaaaaaattgtatttagactgttgtatgcattttatgaaattgtaagcttatgtaatgcaaaggattgataattttcgaaatgtttctttcaaatttcaacggtattagctagggataatttgaagcatatgcacaatcaaattccaccaagtaaaaatgaaaatttgttaaaaaaatgaagtttgaaaactcttaaccatttactgagaagactgtaataaaccgaatttggttcagtttgatttttatggaaaaagacgaaccgtccggttaatgctttttacttttttaaaataaaccggttttggtttgcttggatataaagccgacccgacccggattgaccatgttccttgcacgactcctttttctcaccgttctccgtcatcgtcttcttctttctcacattcattgactctcctccataataaacattgcaatctctcagaaagataagatcagccatg

SEQ ID NO: 32920 - DNA, 3000 bp, Unknown; identical to SEQ ID NO: 1568
  misc_feature (1)..( 3000): 2750-1469P.txt file - cDNA_ID_3063127; gDNA_ID_1620418; Annot_ID_156497

SEQ ID NO: 32921 - DNA, 3000 bp, Unknown; identical to SEQ ID NO: 1564
  misc_feature (1)..( 3000): 2750-1469P.txt file - cDNA_ID_3063131; gDNA_ID_1620418; Annot_ID_156495

SEQ ID NO: 32922 - DNA, 3003 bp, Unknown
  misc_feature (1)..( 3003): 2750-1469P.txt file - cDNA_ID_3063154; gDNA_ID_1620419; Annot_ID_156547
acgagctgttgggacgtggtcttcagatctcttacggcaacgacatgatcttctccagcgaagaagtcaaggcgacaggtacagacgtagatattccggcgattaagatctttgtcggttccttcgcgtcggaggaggaggatcatagctccaagaagattacggtgaatttagtaaagcgtaaagagaatatgttcaggagaaagattcgcaagtttctcaaccatttggtctgaagaacaaaactcgagtttgttgtgttagaatctaaggaacatttagagaagcacattctggtaaataaatatcattatccatatgatgtgaaaatgatgaagatgattttgtctatataacaaattcagtagaatatgatttttgttttgtgaaaccttaagtctataatttgattatattagtagtctatatagattgtctcaagagtcaagtctcaagtgatttgattatgaagatggcaataaaacttacattaatctacatgtagtctcttagctttggagaattaggattggttttcacaggaaccaccttgttgtgtggttgcgcttagttcagggcaaggtgtggggttgaccttgtcagcggctcctacgacatctgagcatttccatattggagacctttttgttccggtcagtgtaacattggagaagcagagattggtgaaaggtgaatcttttaatccctgaaccatgccagcacgctcgactttgatgccccatacgttcttgatcgttatgcctcttactatgggaagagcggatgtgttgaatttatcgtctggatgatctccggtgtcgccagagatcttaatcccggtccggactttttctaggtaaaccccggagattgttatcccctgtatgcttcctcctcggccaatgtttgtcttgatgtggatgccgataccagaattgtagagagtgatgttttcaactgttacattttggattccgccagaagtttcgcttccgatggctattccagcaaatggggaagatccagtgatgcggcggatggtgatgtcacggcttggacggttgtatgcaatgccatactcgtcccaaccgctcttcaccgcaacaaggtcgtcaccagtagatatgtaggagtcttctatacagacgttagagcttgaatctgtggtaattagtaaacacatcagtcatgatttgaaacgtaacaacatgattaagtagaagagagaaactgataaaaaaacctggatcaattccatcggtgttgtacgaatcagttggagcgaggatagtaacatgatgaacaacaacattactgtaagaaaaaagatagttaagtactaatggccaagtgcatattaaagttcatgagagatttgtgaacctgcaataaaccggatgaagtgtccagaaaggggagttctgaagaacaacatgagagacgaggatgtttgttgagttgttgaattcgatgagaccaggtctggtaaactttagagttccatgtctccacatgttccaccaaggttctccttggccatcaatcgtcccatttctgcctagcaaacgcattgacagacaatctgatttagaagatacatttccacgacatctaagctgacacaaaaaaaagtaacaacctgtaataacaacgtcgttgagtccgtctccgtgaataaagctgatatatcttcgtccaggatgctcccgtcctcttccataagacggcaaaggatcggtcaaaggccatttctccgtatcctaaagtaatcaaacaatcagaaatcgcaatgtagaaacaaacaattcctaacaatcattgaatcaagttatgtaaattagtaatcattcacctgaacggctttaataacagcaccatcggcgaggtataaagtcatgtgactcgtaagattgaagctttgagtcaaatacacaccacgaggcacataaagaagagttccttcgttactgttattggagtttcgtatccgatcaatagctgaattgaatgctttggtgttcaaggtcttgccgtcaccgacagctccaaaatccgaaattgatagcatctcgtttctgtgtttcattggaactataccagagcatgtaatcggagctcccagtgagagatggtgaggcaaaacagtggagagcaagaagagtacgaaaacagagatcggagcttgagaaatcttcatatctgagacgagagactttggtagagagtgaagaagagagagagagagagagtaaaatctcaatggaaatttctcgccggagaattttgattactgtggatctagctagagagaagtaatggcacggacgaagaaagctaaaaagcagggagattgttaacttacgtttttgtccttctcttagcttaaaacggtctgataattaaacttcgaatctaaacaatttaatattttacagcataatcccagtttaactgtaatctaaacaaggccaattaataaatatgcaagcccataactacagtttggcccattagtttttccccgcgccaaatttgccctagttcctttcttctttcccgctatttccaaaatctcccaaaaggtcaagttccagcaaaatgacacaatctttgtaatcaacattgttctccgtcaagcttctccttcaaaattcgtaagctttctgttctctaactctttttggtttcagtatatgaatcaatccgactttggaatctctacttaaaaataaaaatcgatctttttgctgcccagatagtgaataaccttaaaatcgatgacgagagaggagactgaaaccagtggagaggatatgatgattgatgacccaaaacccaaaatcgaaaacgatttcaatgttcattacctccgaatttactacggcaagttttaatctttatcacatttgggtatatgtctcttcataaatcaaatctgacttttttcgctcataacaacatatatgcaggaaatctatttccttacactgatattcacaaatg

SEQ ID NO: 32923 - DNA, 3003 bp, Unknown
  misc_feature (1)..( 3003): 2750-1469P.txt file - cDNA_ID_3063167; gDNA_ID_1620419; Annot_ID_156537
gagaaatggttgctagaatctcagaacttgagaagacaatggaggagagaggaactgaactctcagctttaactcaaaaacttgaggataacgataagcaatcatcgtcttcaattgagactttgacagctgagatcgatggcctacgagcagaattagattcaatgtctgttcaaaaagaagaggtggagaaacaaatggtgtgcaaaagcgaggaagcctcagtgaagattaaacgtttggatgatgaggtcaatggtctgagacagcaagtggcctcacttgatagccagagagcagaactcgagatccaacttgaaaagaagtccgaggagatatctgaatatctgagtcagattacaaatctaaaagaggagatcataaacaaggttaaagttcacgagagtattctagaagaaataaatggtttatctgagaagattaagggtcgtgaacttgagttagagactctagggaaacagagaagtgagcttgatgaggagctgagaactaagaaagaagagaatgttcaaatgcacgataagatcaacgtagcgtcttctgaaataatggccttaacagaactgatcaacaatctgaagaatgagcttgattctctacaggtgcagaagagcgaaaccgaagcagagcttgagagagagaagcaagagaaatcagaattgtcgaatcagatcaccgatgtccagaaagcattggtagagcaagaagctgcttacaatacgctggaagaggaacacaagcagataaacgaactatttaaagaaactgaagcaacactaaataaggtaactgtggattacaaagaagctcaaagattgttggaggagaggggtaaggaagtgacatccagagattctacaattggggttcatgaagagacgatggagagtttacgtaacgagctggaaatgaaaggagacgagatcgaaactctcatggagaagatcagtaacatcgaggttaagctacgcttgtcgaaccagaaactgagagtaaccgaacaggtactaacagagaaagaagaagctttcaggaaagaagaggctaagcacttagaggagcaagcattgcttgagaagaatctcaccatgacacatgagacttatcgaggtatgatcaaagagatagcagataaagtgaacataacagtagatgggtttcaatccatgtcagaaaaactcacggagaaacaggggagatacgagaaaactgtaatggaggcatcaaaaatactgtggactgcgacgaattgggtgatagagagaaatcacgagaaggagaagatgaataaagagatagagaagaaagatgaagaaataaaaaagcttggaggaaaagtaagagaagatgaaaaagagaaggagatgatgaaagagactttgatgggacttggagaagagaaaagagaagcgataaggcaattatgtgtttggatcgatcaccatagaagtcgttgtgaatatcttgaggaggttttgtctaagaccgttgtggctcgaggccaaagaagagtgtcgcagcgaacttaaggactcagtgccatggtacgttgtttatctttcccaagcctagtttccacctcacatgaatgcaaacaatgaaacaacatatatgtgtttattaggttttggactctggtcaatcaagaagctggtggagaggtatttttggttggggacttttggtgtacttgtgttcgattttgttgcacttttatatgtttgttaacttttgttgtattttgtaagtcaaaatttttggtttattgtgggcaaagttggtggtggtttttatgggaggtcagggaataaaggggctcacacaaatggagttgatatttttttttctttgggcgtcggattgtatagaacgattaaatgctactgttggtatagtgcttttgcttgtttggaatttgttatagtatcatctttgctctttcataacaaaattatacacatcgctttacagagtttcgttctctcattcatttcttattttattgggttttttttttttgcattagcagtcgttatatctcgccttgaatttctaatgtgaactagtttgaaatgtttgaaatgtttattctttaatagcaaccacttttttttcaagtgtttttcacaaccgaaaaagtcagccatgtgaatgatacacaaaataagtcagccagtaaggtttggtgatgttagatcaatcaaatatttgagaaaaaattccataactagttgatatttcctaaatcgaagttaattgaaaattaagtacaatttggcaatatcttaaattattaaattttaaatagaaactctattcacttttatgagtttatggaaacacactactttctcctctaaaatcagacagtgattatactttgaccttaaaatttgaaaagagtctaacacgttataattcccaattactttattatctgattaattcaccaagatacattaaatctaaaattatgtgatagatattcatataaatcatattggattattccaacaaaaaaaaaactcttaaaatttgtttccttatttacaaacaatacattactgaaaatttctaaataaaatatcaaaaagtaatttcaaaaccttgttttgtcaatttaatatttttatttttacaaaaaaaaatctgaaacatgcaaagaagcacaagtaaagtacaagtggaaatgtatgaaaataggaatcataaaactaattttttaatttaatgataggaatctgaaaaaagcaaaattttatcacatcccgaataaagaggaaaatgcaaaatatgtctccttttctcactatgacaggttgtttctttaaagaagcaacggaatttaacattatagcaaacattaactatcaccagctatcatgcgcccacctctccaccgtgctctccatcatcatcattccatatataaatcattcacttgtagaatcttcttctctttcacactaaaattcatcgatg

SEQ ID NO: 32924 - DNA, 3000 bp, Unknown; identical to SEQ ID NO: 1581
  misc_feature (1)..( 3000): 2750-1469P.txt file - cDNA_ID_3063185; gDNA_ID_1620420; Annot_ID_156583

SEQ ID NO: 32925 - DNA, 3003 bp, Unknown
  misc_feature (1)..( 3003): 2750-1469P.txt file - cDNA_ID_3063192; gDNA_ID_1620420; Annot_ID_156578
ttgacggtggtggaggagaaggtggcggaggagatgattggacaggactacatggattgtcgcatgaagaacacattgtacaagaaacaacctcgtcttttgatgtcactgtcggtgtcactgacactagcagcataacaacaagtgtagacaaagtgtataaatggtttgtttccattgtcagaaactggatttagaaacttaattttgtgcgaagaatatacagaggaagtagatgagagagcagaggagggagaaagagtaggagtgggaaagaagaagaagaagaagaagaagaagcacgttcagaggaggagtgttcttctttttatcgatggcttttacaaataatttataaataaatattttcagcataaaaaaggtgttttaataaagaaacaattagtaaaagttcggtggagtgtattaagaatttatctgattcttataaaatagagtttactggagattaattattggagattcttgggatattatatttatcaatagttttgtgtgtgaaaattataattatccattgcagatacaaaattattgtaatttttgtggtgcatgattttatttattcaaagcatgattttagtagtcgaggacgtagaattttttggtaaataattttaatttagaaatcacagtgttttaagaaaagaaatgaatagaatgcaagaaaaagttgacgcggacacgttaacctttttaaccaaaggtcttgtaataaagcaccggaaatacgcggatgtcgggggcaaagacgtcacgtaatctcttgaaatgtagaaattacgatgatacctctagtcccgtggcgacctcgtggcggctgcgtcgacgagccaagtagggttggggaaataaaagagaatcttcaacaaaagtcattatagtggggcttgactcttttgcaagctttcacacgtggacgtaattcattggttttttgttttatgacgtggtagctttagaagagtagacgtgaagatgacggaagtcccctacttaagcgattagtgtgaagtagcgttttttctcatcaacaacttctttcgtttcgacaataaaaacatatgagaaatttcgttgagtagcaaacaaaagcaaaaacattcctccatatataagacaaacaagaaaagttcaaagctctactaattagcgttgtgacttcaaatgtataacatcaagtttaaattagctctaggtttaaccatggtatgatcagttttatccagtctagacaatatgcaagtagaatatcaagttatgtggtatttttttccaaacaaatttcattattaacattaaaaagtatttatttaaaaaaaaaaaaagaacattaaaaagtaggcaattttacgaagcatttaaaacatcggatcgtcatgattataaatggcgtaaaattgggttacgtttttcttatttcataatcaaattaataaaattgggtcactgtatcagcagtgagagacttggaacataccacatgttcggatgttatgtcccgtattgagatgtcatattttcatagcaaaagaatatgtgaacattgtggaagagaaactaagtcacgaaacctagtggataggtgttgagcacatattttttgcattctataagaactcattttatcaaaaatatcataatcgaagtaaaatgataccgctaaaacgactgatttagttaaaaaagaacaagaaaaaaaaaaaaaaaatgtttcctgtttgtcttaatcttttaggtacttaaaataagatgataccaatcacaaaatctgagcaagcttagactcttagtttataatcaaactgaacaggcgattgaagatgatcacaccatgcttatggtgatctcatgattaaagttactctgctttttaaaagataaatattttgcttgcttttctgactcaaatcaattgttaatgctaaaacattttcatgttaacaaagaagaaaaaaaaaactggaaagtcatacaaaatcttaaactaatctctaaagtttgcaaagtatgtgaattttgcaatggctaaagagaagatgcgttgcagcgttgggttgagaattgaactctggcttaattagattcaaaatagcaattcaccatcctactagttattcgtttcgtttaaagacaacttttatatttcatttgattgttgaggaacaaaagttggttatataagtgagaactttttgctttttgggtttcaattgaataaaaacaaaaagttgtcgtcgatctgtgaaattcaatttatatctatagagagcatttcttctatttattgggccagttcttagtggcccaataacaaaaagcccaataaccctattggagaactgtattactctacagtcatgagaaacaccgctcaattcatcaccggaattaacaaaaagagtttgaaattcagaattgtcatcttttgtttcgatcggattccttattcgtgtatcttctccgattcgatgggaattggctctcatggcaatggtaatcaagaggtttcgcgttaatcaaaaggagtgaaacgatggcgttttgtatttggtgtttaagcaacttcagttcttaccgttttgagtgttgatcatttgtttggcagagaacttaaaaggttagatctttcttctgaaatgatttcattattaattgtctgcttgtacttgaatcatgttaattatgactgagcttttcttcttgaggatgaggaaatcgtaatggctaatgcatacaatttgtctactaaagattagttgaagttgataatgctaagcacgccacaagtatatgtcattatcatatgaatgttttgtcacagaagatattgacttcgtataatatatattttctaatgcaacttggtaatattcaatgtcaaccagtagtcgtagtccttgtatatatctggacaacatcaaacttttgcaatgtttttgaatctctgattgctatttatcttttgggctcaaaccaatg

SEQ ID NO: 32926 - DNA, 3003 bp, Unknown
  misc_feature (1)..( 3003): 2750-1469P.txt file - cDNA_ID_3063208; gDNA_ID_1620420; Annot_ID_156568
atctctgtactagtagaaaaaaagaggtctttattctgtatactaattactaattagagctaaatcaggatgagtccatcgcaacttgtctaattactgttagccaagaccaccctagagtcaatatcatatgttaacaatgatgtaaaccttttagtattgaaggccaaagtagtaattaatccattgactaacttcttttaaaccttgagacagtgaaatactaactcattcaacaaaaatggatcaagaacaaggaaatattctgattaaagccaatgtagtaattaatcgactgaataactaacaattttatgattctgattaaagccaatttattcggttatattcggtttacatatttgatttagaatgtttagttttattggtttggttcgagtagaataaaatattcactgttcgaacaacaacaaaaaaaattccttcatttctctctcagccctaaaaaagcttcacgccggtttgtttcaccgccgttgtgcttcttcttcttcttctacctgggttctctctcaaacaaacaaatctccgacgactcattcgttcctcccaggtaagcttcttcgaccaattttactttcgcatttttctccgattcacagaccctagctgttcccattaatcaggatttagccagaaacttctagggatctaattgtttttgaatctgaatctgtatttgagtttaacgttttgtctccttgtgtagaatcagaagatttagtgaaatggctttttgcaataagctaagccgtttcgtgaggaggcagagtgagaatgcttccatgattggctctctcaggtctttctctgctgatgccactcaccatagattccaccaggagactcacaattttcttgagccagaatactatattggtagctgggaagctccgagtgatccgaaagatgcagagagaaagcttgctcagcttaggagagattatgctaagaaagttcgagtgtatcgtaaagagtacattcatgagattgagatgcttcgtgttgagaaacagcgtaaggatgaggctagattgttggctgaacgagctgctaatgaagagaggcgactcttgaaggctgaggctgctaaggttagagctgaggaacgtaagattgctgacgaagagttcaggcaaactctggtgagttcactttctctcttctccgttctttgtttattgtatagaaaccatggtggatgtttgatcaagtagttggattagtgtgagatgattcttgagtaaataggagaatgggtttgtctggataaggttcatctagcatgtggagaatcaaattgttgttttcctcttgaaaatttggaaccttttcctagttatgcatcagggtgtagtagtattatatagaagagaacttcaaggtatagtattatgtttgtgattggaagagaactttagattagagctgatggagatgtatgactaagagctttgataaacgttgcttagcatcaagtggaggttttgatgaatcctgtagttatcattgtctccttacattagctgttgttgttctggttacagctttagcatcgtacctaacaatcaaaaataagatggattttgatgctggatcttgatgcttttaatgggaattcttttgagggcagtgaaacttgttagttagaagcttcctttgttcgggctgtaggtagatgagacatcgcacacacacacactgaccaaagcagtattcactgattcattaattgatttcacgtacttatgtctgcaaattaattcagaagagtagtaccactcctaggtttctatttctagtttgagttcctcatgtttcttggtcacagcctcagagcagtaatggtcatagtgcttttcttcttaaagttgtaaaactgattcaagcttgattcactgactggtttatgtgtttaataaactgtagataaaagaaagagcagaaaagctagagatgtggaagatgatgggccaaaagagggaagagaagatcaaagagagagagaagctactgcgtgaacagagttcactatggatcgagcaaaaagaactggagaggaagattacagaagccttggttgacaacgttgttctctaaaccaaagcttctcctctgaatctttgtttaagaaacaatcactttagtccttttgttgaagacaagtcttttttttttcttagagaagaaagcgaaggctgttttagcctttttgcatcaagcacataatgagaattgtggtcttgtgaccaatctcttgtttgttgtggttctggtgtcgtaatatcatcattaataagaagttttctcttgttgattgttatcagtagaagattgttttttggtaaatcatcttcctcattggtttcgaatataatgaacctaggcccaatagttaatcgagtaatgggcttagtaggcctatcagcgtgacatgttttgtaaatttatacaatgccatgagggacaatattgtagttttctataggaaccgaatttgtaaatttctagaggcccaatagttaattcgagtaatgggcttagtaagtctcttcaatgtttgatcgacaagtacaagaatctttatcaacggttcgtaaaaattgtctacggtgatagaaaagatgaggctgtaactagggttaaagtagatgatagcccgcaaaaaacagagtcggataagatcaatttggagggaaaaaggaagagaggaatgttgctggaccaacctgagagacctctcaagaaaaggagaaaatttgctataagctaatccataagaaaaaacaaaggccggtctcatcaaaagtactaaacaacacttgtgttgtgtagagttatgatatctagggacataaaaatctaaccgatatcgaggaagatatgtacaaatgcgaagatcagatgttcgaggtagatatattgatgggagctctaacaagtgtagtggagagtgcataagaagttattaagggagagatg

SEQ ID NO: 32927 - DNA, 3000 bp, Unknown; identical to SEQ ID NO: 1587
  misc_feature (1)..( 3000): 2750-1469P.txt file - cDNA_ID_3063220; gDNA_ID_1620420; Annot_ID_156563

SEQ ID NO: 32928 - DNA, 1544 bp, Unknown; identical to SEQ ID NO: 1591
  misc_feature (1)..( 1544): 2750-1469P.txt file - cDNA_ID_3063235; gDNA_ID_1620421; Annot_ID_156609

SEQ ID NO: 32929 - DNA, 3003 bp, Unknown
  misc_feature (1)..( 3003): 2750-1469P.txt file - cDNA_ID_3063239; gDNA_ID_1620421; Annot_ID_156608
aaatagaatatgaatgatttggtatggttttagtattaaatctataacatattttcatcaaatatttctaattttcgttcaagaaaaggttttacatcaggttttttagtcctactcaaataaaaataatccaaagaatggattatagtacttaatagatattgaaaaaatgaatccattaaaaaaatattaacatatatattccattttttggattagttacttgctttggtttcatatcttttttttttatgattgtaaactcctcatgattttaattatctatcattaatatgtaaaaacatttgacagaccaatttcgggagcatcaatgaatccagcaagaagtctaggaccagcattagtgatgggagtatataaacacatatgggtttacattgttggtcccgtcctaggagttatatccggaggttttgtttacaaccttatcagatttacggataagccactccgagaactcactaagagcgcttcttttctccgtgccgtttctccaagccacaagggttctagttctaagacttaatctttcttctcttagtttggtcttcttcagttgctcgttcctcttgaatattttcatgcattcttaattcattaattaacttttagtttcatctagaaagacatgatcacctctaactcttgattaaagttcttgatatccaaaaacattactaatcgaatatacaataacacaccatgttcatgtagaattcgctagagtactcccagcaaaatgtagataagatttattatagatactccacgagcacgatgaaaaagttttcgacctcttagaaagattggtatgcgctatggacatcacaaacatgcataacatgctcttccaaccaaaaattcattataccaaatcgcacaaagcacatttgtcacaatttatctccaaatttgggagaaacttaacatacaatattcacactgcgactagaaagatcctaccactaatatccagctcggtcctcatatcggattaagtaaaattatactataaatattagactgtgggcatccaacctaaaaccaattgacaataagtagagagatccatattttatatataccacttaagatcctactcaacttccgatgtgggacaatatccctaataataaataccctaccatcaagatagacatatatagtctttcaaacacacatgtacaacaatgtattctacgaagaaggtggatcaacgatcattcatggagtacgttgattcacctaaattcagtatcatcttccaaatgaataaataacccatttacagtatttatggtttttcctttgcgtcattttcgttaaggggtgggccttttgatttttgttagggtttgattcgcttttgatgtttttgttttaacaaaaatttagctaaactcaaaccaagattagtttcatttcgtctaatttactttggcttggtttcgtttgattctagttcgataaaaaaacaaacaaattaataaacattacacgaaagaaaacttatcgcaatttgatatatgatatcaaaaatagttatttattaggagaagtcaactcagttattgaaacaaaataagtaaaaaaaaaagcaatcatgcatggaaagcctcaaaacatatataaatgatttaatcaaataataaaaaattattcattagtaattattcaatttaattaattaattgttaaaataagtatatatagtttgaaaccgaacagtaattagtatacaaaaatgtcaaaaaagcgtcaactttcaaatttgtaacgaaaaaatcatgaacttttgaaataccatgtaaatcataaagttttctatgactttttttataaaatgatcaagttttgttgactggattatttcgggcatgccgtaaaattttcgtaaacggaaataatttcctctagaattttctgttaaatcaaaacgacatcgtaagtatatttcatatttgtatatattagatattctttttaattttgttatttttaatttatttcataagtttttaattaaatgtctatatatatatatatttatattcgttgttacaaatatatcaaagtgttgtcgtaactcagcggtagaaagtcccttaattggcatgagcttgttagtttgatatccgatggatgcatttttccctcattattttctatcaaaacgacgtcgttttatgagttccgtttacaaaaaaatctaaagcaacgtcgttttgatttaacagaaaattctaaaacgacgtcgttttgatttaacataaaattttaatggaaagttaactccatttataaaaacttcacggcatgcccgaaatggtccagtcaacaaaacttgaccattttatcaaaaagtcaaaataaactttatgatttaaatgacattttgaaagttcagacatattttatcccaaatttgaaagttagcgtttttttgatattttttccaattaatatataaattttgctccaattaaataagtttaggtttggttgttttggtttgaaaccaaataattagtagtaatacatactattacttagtagttagtactaattcggttcggtcaaaattaggcaatcaacgtagatacttttttctttttttttggcagataggtcaacgtaataattatagaaatacaacaaacacatttgactagctccttaactgctacaaatcgtaggcagttattagatacaaatcgtagaaatacaacaaacacattttacccatttctaacataacatcaaagcctgatcctgtttttcataaattacatctaagtacagctctatttttccaactcattagatataaaccaatcattctgtaattgtttcaactaatttctgtttcacatgtataaaagctcttcaacctccaagttctcaacccaccaaaaatttcaatttcttttctacttttctccaaataaaaaactcacatccacatttttcttaaagaaaatg

SEQ ID NO: 32930 - DNA, 3003 bp, Unknown
  misc_feature (1)..( 3003): 2750-1469P.txt file - cDNA_ID_3063243; gDNA_ID_1620421; Annot_ID_156607
ttacagtttataattgttattaagtaacggtataccacgaatccatgagacaattgttaaaaaactgaagtttaacccctattaaaacagcatattaataatattttaaaattttataaatattgattcaaatacatccaccatataacccaattccaaaataaaacccgttctgtaattcctttacccgtcccgtaatatttttttaaagtaataatttttaaaatttaagaattatttattatatataaaagttttgcaaattgtatcattctctaacacatttatattttatagtttaattttatatatagtaacattatacataccacataacatttttggttttatataatcttttctaaattaggatgatttgatatgtttaatattaatggtcttaaaaaataataaattaaagatttaacccgtattcaaacagtggattaattatattttatttttttattaatgttgattcaaaaacccgtctctccaaatccgtcttgccaaaaagccatttattttattaatattaattttatttatgatatgactctgaattataatctgaacattttagctaataacataggagtgcaccatatttatttaataggagaatgtaccatatgacccgaatgcacttttatccaaatccaccaaaaaagtcttgcaaaaatactgtagagataagaaacgatagtcggttttgataggtataagattagcaaatatattaggtagcttaaattagttaaagaatacaaattgaaaaggtatattacactttattcgaatataatatcaaaacttatataacacagagatttgataattgtttaattgttgaatacttttttgtgctaatttttatgtgattaagatttaattgatttcgtatataaaatattaaattgttttacgaacttatttgtttataatttggtaacagatagatatttgaatattcagtgtattttgcttcagtttaggaaatctttgatgacccgtctttagatccaataaaccttataattaagagatgaatattgttgttaaatgattttggtaattttaatgacgtcattaaagatttttgtttttgattaaatttttttaatggcattgtcatgtaattaattacaaaaattaaggttacatttaaaatgtacttcccaaataatatagtaggatatgatattctataatatttatacactgattaacaatcacgacttaaaaaattcctttaaaggtagtaaactttgtacgttcacgtgcatgcatgtttgattaatacaacgtgaggactcgaagatatgaagattttttttacttccaattataaatcacaaatattctttgtttgtgttagttttttttaattcattcaattagttcaattctaatataatctggattgatgagaatggtccaaactattttatatcgtgtaattggtagtcattcattattgcaggaatctttgatagtttgtaatattaatttaggaaacggtattttttaatgtgcaagtatgactatcaatattattcgtaaatctactcgaaatctgatgatcttcaaaatatatactactttattattctctactaattcaattaaaatatcatccagaaataccgtttataactaacactagatattaatcccaatatttttgttaaattttttttttataaataatttataaacatatgctattgttttgtttgatttaaatgtatgatacaccgtgataagataatttataactaaatatataaaattttaagttgtatctattttgttaatattgtttattttatttagtatttaatactgcattattgtattttgattgttaattctagaatttcaccgtagtatatattatgttatatcatctaagattgaaaattgtaaatgtttgagagaatttttgaccaaaaactctaccaaaaatatatatgtatatgtaattttacgtgaaataactgaagtaactttacagaattctatttagtatataatttctatgttattttttgtttttaatggtcaatctacaaaaagaaagaaattattagaacagtaagatttacatctataagatttaaaacagtataatcttgatgtatatgtaacaagaatcttgaaaacacatttccattgagatcagtcatctcttgaagtgattcgctcaatcggttaaaatgcatagcatcaagcatgggtcgaactttatcgatggtcctactcaaaataaactttcaatggcctataaatttttagatcataatccttggcttatgttatttatgctctaacccggcctacatagcatccaggtctaaaatatcaaatttaatatcaactataatgcaattaaaagagactggatgatgaagaaatcaaaccaaaacctcatcaagaaacacaagccggaatcacttttagacttgcaccagaacgcaaggaacccaatggtcttgtcatcaccaaacccaacatcgttttagctcgataccgaatacgagcccaataatgaaacaaagcctcaaacattctaacaagacctatataattggatcatccctacaaaggtggtttgtttttttcaacttttttttttggtcaaacattctacttttgttatacaatctgattttaacaggtctacgactacgtagtgaggaaaaataataactcctacaaatgtgcaactccaactagactcccattttagcatcttttacccatctccacataacatatgatcctacttttcatctgttgcatccaatcacaagtctactattccaaatcattagattcaatccaatacttctgtgattgtttcatttaaggtatatttcattttaaaaaaaaactctttatcactaaagttttcgtttattttttctttctgaaataaaaatctctccattcagctttaggaaaaaaaaaatttgtttctaagaacaaatccaaaaaatg

SEQ ID NO: 32931 - DNA, 3000 bp, Unknown; identical to SEQ ID NO: 1593
  misc_feature (1)..( 3000): 2750-1469P.txt file - cDNA_ID_3063256; gDNA_ID_1620421; Annot_ID_156596

SEQ ID NO: 32932 - DNA, 3000 bp, Unknown; identical to SEQ ID NO: 1589
  misc_feature (1)..( 3000): 2750-1469P.txt file - cDNA_ID_3063260; gDNA_ID_1620421; Annot_ID_156594

SEQ ID NO: 32933 - DNA, 3000 bp, Unknown
  misc_feature (1)..( 3000): 2750-1469P.txt file - cDNA_ID_3063272; gDNA_ID_1620422; Annot_ID_156631
gagtgtaggttatataagtttatcatatctccattggattaaaagtaggcaagatttaaacaaagtgattcatcaataatgatatgatatgtgtcattcatttacaaattatgtaacacataatagatattttgtaccctaaaattttgaaatttattgtacataaattttagaaaatctgttggactgtgactagttcttcaacttatagagagttgagtgtgtttataatcacatactgcctctttaaaaaacgttaaccaagtcgaaactcgaatatggtactaccacacatgacaaaatagaaaaaacacttgaatgtttaccaagtagtacttggtccattggcccaaaaaaaatgagaatttgtgctcctttgaaaggagttttcaactgctagacccaacccaaaagaatgtacgattaggcacattttccataattgatgtaatgtaaagaaacacttgaattttaagttttacatataatatttacatttaattcatcttcctcatgaatatgttgttcaattatcaaagaacctacaaagatacagtattataactataagatcaccaaagaagaaaacaatcatttgaataacaaaaacagtaaaacaccatataataaaaccgtgttctagatacaaatgtaaaccatagtatctcaccttgcttatcgattcatctttgtaaaaaaaacaaaaacaaatgtgttcaacttggtttgcaaaaaacaaataacacaagtacacaaccatccatccaataacacaatcacaatatttgtttcccaacatttatgcaaccttatttttagtggacactaaccatagaagaacaaatttcagttgtagtgttacaaagtccattaaaattacgcgttatcaattacaaaaccacatctgttttttttttttttaaacactttaaattttgtgtcagataaaatgaatatatgttatgacagcaatcactttcaaaaggcctatcaaatgggtcccaaatgtataatcctaatgtcaatcacaagtaacctaagttcggcccaaatacctgatggtccactttacaatttttcattaaataaatattaagtaaataaaataacagtaaaaaaaaagagttattcagtctgaagaacattaaattaaggttattaacgtcaaagaaaagataatcattttctctggtggcggcgttttaaaaacatagatttgaaatttttaactttattctataaaactaaaaagctctctgtctagtagtatctaaacgaatttaactaaaaccagctaaaaacaagaagcataaaaataatatcaaagtagaaactaaaggatctaataagtaagacaaaattcgaaattaagatccatggcggatttttgtctcttctctcattggatcgcacttgacacaaatgatggttcgagacataacagcagagaagggtccggtccgaaccgaaacggaggaagaaagcaaaaaggcaagacctttgttgttgggttgttgataaagagagagagagggggacacgtgtagtgaaaagagaggaagagaggtcactctccgttcccggttctgtctcgtgcggtgcgattgttgggtgccatgtcagagtccgttcccctatgagcccggcgaatccgaatcatatgcctttcttttcgctatctctctctctctctctctccctttaacccaaacccatctctcaaagacttgacctttctctctctctatctctaatttatttatcgtttcgcgtgtcgccttctctctttctctcattctctctctctctttcccttcgtatctctctctcgtgaggccgtgccctagaagaagaagaagaagaagcccctttctccgggacttcaatccctaacttccgtcgccggatttctcgtccttgattatcggaggactctttaacaactttattccgatttcagattcccagatttgtaagctgctttctcctttctgggtatttcctctttttgtatttgcttatgtaatttcgatgatttatcttacttggtgaggggttttgatgcttgtgtaatgttaatgctgtttaattaaggactgatttagtgtgattcggtttaattgagtttctttgggggggaattgggtttatctccaatgaagctttatgtttagtgccaatgtgtgttgtttagctcttttctctattgatttgtgtgtgaaattatgtttgtttgagtttcattaccaatggctgtctttacttgaatctcagtgattcatgaattctaccatctgtcgttgattatttcagttatataggatcattgatctatgttttagaactagtgtattattgccttagagaacacctgattttgaagtagaggaatgtagtttgcagtagaggaatgtaattaagtatgaatttaatggaagtattcgtaaggagtgagggaacgaatcgtttattataaaagctgtgttaagattagattacttactaggtttgtgtctcatctttaattaagacttttgattacggatggtgaggcttctaacgttataccaccatttttaggggtgacatcatttagtttcttagcttctatagcttatatgcttggatgacgctgtttgatttcatatcggtttaaaagtgaatgaaattgtggttatggccttatggtttggtacactgtgctttgtccgatgctgcatcattgatttgagttatacttcatttaatcttatcaatttttctgttcagtatttctgagcatgtgtacaatttaagtatttaactacctcactgttgtttcagtgtctcttgatcttagattatggtttacattactcgttttttgtttacaattttagtgtagagacagagttttttgaaggccagtattctttagttacttcggtagctgtgatttacacatgaaggtctatccggttctctatcaagcatatggtatggaaacagaagtagaaaatg

SEQ ID NO: 32934 - DNA, 3003 bp, Unknown
  misc_feature (1)..( 3003): 2750-1469P.txt file - cDNA_ID_3063281; gDNA_ID_1620422; Annot_ID_156622
aactagagcaactgatagcaaagggaaaagaagtgcattgttgagattctactcttacagttgagagtgacttcaaagcacgaggtccgggaaatgtctttccagaaccatgacttttggggagaaggcgaccttgcacttcttctccactgatccctcttgctatattccataaccaagtactacaagtcgggggaaaaatcagaaaaacgtattaatagacaaacaagcacgagttgcatgtctttaaatttctattatcaagcaaataagcaactattgggaatttagtatgctagaaggtactaatcaaataatgaacaatctacaatagcctacgagtccaggacaacaaaaattctatcttttccaaagctattacccagtatttactccgtaatgttcttgtagcttcgtttcagaaaattgcagcaagtcccctactgtgtcaactcccaagtcagtttgcaagctagtgcccagctttcctcccagttgtttcctgcacgttatgtctaattagagctcaatgattaccagcactaactgaaaattttatgatcctgggacagcgataaaagatgcaatacacaactttggactgtcttacatcttataaaacacagctgtgttgatactgacgcaaatatttaagtgtattccgtagaatgtgacaaatactaaaagttctcctacgaaaatatgtgttgtgatcaatacactattgaaacttacttacattttctttattggcaaggaacttagtaattcctgtacagctgcatatggtacaactgtctgctgcgcaggtttgttcattccactagcaagtttggctagcatctgcttgttgaagttatatgttattactcgccatacaagcgataaaaggaaaacaaaataaaatagcttcttgccttgttatgggctatgccagcagaacaagtaaactcagtctccttaagcacctgtttccggagttctgcaacaatgataattccacaacttaataacttatcacgtcgatcagcatcttctcgacaaatccaattgcggacactctccttgaaatcatctccatcctgaaagtaaaataaataaattcagatcataatattgactatcgactatacttttgttggagactaaaagacaccaaaacagacctctctgttcattccaagaatatgggatttaagaacttcctcatctatcaattccaaactctctggaggtgcatcagcaagcatgctttctgctgcatcagtgaggtcaagatacacttcatcaatcgaagccctctcacattttccgctttttgctagaatcgaaaccacctgcagcgacaacacatagaatgagatgaatttagcaaatgtcattgtttagacaaacacaaacagtataataataacttccacttccatcaacctcagaaccggcactgcgatataaattaaggtcagctttaccacgagccacaggaacttgaaccaattgaatctgaggacaagcagctttagcctcatcacctctcatcgacctgaacattaacccaaaacacaatttttccctatcctcaaaagattgatacaattgggggaaagaagcatttctgtaattacacactaaccgctttacgccacatttacgtgcttcgtaactaacagcaatcaaaccaccaccttgccattcattgtactgtacaactgcactaggcagtcctcgcaactccggttgcttcctctgctccactaatcactcactcataaaaaaatcccttaaccaggtaagtaaaggagacattttgataaaatagaaacaaaaaagcacactttttggtatttggtaatttcccaaatccctaaaacaaacgccaacgagaaaaaaaaagaaaagaaaccgttattaaaattcgattgaaacccaaaattccaacaaagctaaaaagttcaaaaaaagtgttaaaaagctttgctttctctcactaaagcgtctagtggctgaatacaattcgggttagagagagaaggaccttgaacgtagaagcaatccatgtcgacatgagcgataactctagcatccgatgcttccggtctcgctaccggcatttctatttcagaaatctccgcagaaatcagagggagagagagagagagagagagagtttttaccaccgaaagaggggtttcttggggatgatgactgatgaatagcgcgcgaaaataataattaggagaaaaagcgagacagattaataaaatgagaaagtttcaaaacgaaccctcaaagaaactaaactttgcaaaataacccgtttagaacacaagtaatttgacaacaaaacatgaaattcattgtaatgatctcaaaccctaaatatttctccaaatttgccgtgtcaaattatttgtaaaaataggttgaagattgacattgttgtttttagagatttagtgtggtaacaaaattatggacatcaagctgcatctttcgaattatggttgatcgttcggtagataaacaaaaagtatagataaaatatttaatatttattcattacataaaatttttattgagtttatttttatttatataaaacaatcataaaaataatatgggtcatgtttttttcatccattactatttgttcactactattattaatttcactattattgtgaaatgtcgatttttattgctcattaaatttggctagataatcttcactaactaaagatttggattcaagaaaaacaattttctctcaattatgtttatgattacaaaaataaaataaaaaaattaggtattaaattataactgtaaaaattaaaacttatggggatttttggaagtatatacaagtttaagtactaatctgaaaatgtttgtgttttagtatataaaccactcacaggttgtgactttacaaattggaaaatttcgttgaatgcttcttcttctccgtctcgttgagattcctccccaacaacaacaatg

SEQ ID NO: 32935 - DNA, 3003 bp, Unknown
  misc_feature (1)..( 3003): 2750-1469P.txt file - cDNA_ID_3063303; gDNA_ID_1620423; Annot_ID_156657
gtagaagagatactctctagggttccattaacatctctaagcgcggtgcgatctacttgtaaaacgtggaacgctgtaggattaacatctctgtagacttatattggtatatggtttatgcgtaagatttctcttttaaaccttttaaaagaagaatcttttattttgttaggtaacccctcgtcggccctttaagtttcttacaccacgtgatcggttatcctatgtatatactacgttcgtgaatgacctattgggtatccaatgcaaatcacaaggttagactaatactgtttggccccatttttaatgactctctaaagcacaagcttcacagttgcaactctatcaattatagtgatactttacttagggttgaagtcttgaagaggctgaagtagagctacatgtgtccacaatcaccgagaggtaacataaaccatagagtcgcacctgtgaatctacatgtgcccacaatcttttttcagcaatcttaaaacttctttcacactgccatatatatattctataataaccaatatgaaatcccgaaacaaatcaggaactaatggagacccaaaagccaaggtgactaggattctattacgtagttgacataaacaagaggtcggtataatacccataaccaaaccattaactatttgggacctattgctagctgttttcaatcaagcagctttcaactttaagtttataaattcttcaccaagttaatacaacctcttatttttatttatttctgagaatattaaatgggctacaagaaagatttgtgacttgtgagtgatagatttttttttagaaaatgaagacaaactttgagacaaggtctttatgatgaaagaaactttattagtccgtgatgtttcaaccccaactgtttcattgttttctttttttttcccttcttcttcttctttattttttggatcataagaaattaaggaatctattgcataaggttggcatgttgtagatatataaattaattagtctccatatatatatatatatatctaggttatatcttcaaatttgttgttgcagacgaaaaatacctacaacattcaaaacttcagttaattgtttaagaaaaacacagatatgaccaaaaaaataaatatagagataattaatagaataatcttatctacatatatatttattaaaataatcgttatagaaatgttcttttgttcaattacaaaaagaagaaaaatatttatttcgttttataaattaaaatatttattaatattctctaaatctcgcatggttattgaactacaactgtaaaatacaattacaaaaagaagtaaaatcttttgacgaccacctacaaaatgatacgacggagacacacaaagcgagttcaactattaacattaagctcagattattgaaccaaactagaataactcaaataagatatgttttcgattcggcaataaaatttgattcgagatattttagaccaactaatttactatccgacaactgagtttggggtaaaaacccgtaatttattaaaaacattgaaataaataaaatcatttgatatttctattttctcattgttcattaattgtaacatgaaagctcataatcttcattttatagactcaaatcaaatgctctttcaaactaacccaacaatgtagtaaaaaaaaaaaaaaaaccaacccaaaattggaaatcataccatgttttagatagtcaaaaacaaggctaaagaacggaaaaatccaaaaaaaagaagaagttatttatgaaaaaaaaagatagaccgacgttaatggaaagaagaaaagacccaaacatgtggcctatatacccatgggacttatacatgattaagattggcatatacatcaatgtttttcttggtaaaacatatacatcaatgttatgccatcaacattaaattattttaaatagaattttttaaaatatatgatattaatttcttctaagctaagtgaaaaaaatatcaaagcagccgtacagttacagaatcaaacaagaacttgacagcgtaagaagacataactcatcatactttctttttttttcaaacaaaaactacatttacatatttacgtaattttcattattattataaaaaatttctaggctcataagatttttaggataaaagagaaatttgcaaagaagaaaactagtgtattaatttatgtatatgtttgcatttgaatgataagaaaatatctcgcatgactacaaatctttggatatcattatcttactatttatacactaacttctatatatcattttatcgttttatagccaaaatcagaaatattgcaaatcttattttttaatatggtttttaatatttgagaggcgggaaatgtatggagaagaatgtgtacacgtggcggtctggggaccttgtaacaaaaatgcaattaaaaagcttttgaagcaagttagccatagccgcttggcgctgtgtcgtcttcgtcttcttcttccttcttcttcttcatctctctctttcgttttctcagtaagtgaaggatttgcagaagtagatgattgaatatccatggaggtaatttatggtttctaatttggttttaattctttgaaagtttgatttttttatgttatgagatttctgggtttttgattctcaagtttttatggattttagggttttcagtaattgcaaaactttattctgaagattgagtgattgcttgagatataggttatcaatttcctttatccctaatattccaaatctcgaaatttcaaattacttctctaagttgttctatgagtttatgatcttagaaaataaatctagtgttttgattactctgttttgcatatttttgatgggtttgtgttacttgttttgtaagctaagtgatattcatttttgtggttgaggtcaatagtgtatggattctggttctttatgtctcagggtgattggtttcaggaggtatg

SEQ ID NO: 32936 - DNA, 3003 bp, Unknown
  misc_feature (1)..( 3003): 2750-1469P.txt file - cDNA_ID_3063311; gDNA_ID_1620423; Annot_ID_156651
ataaaaaaccaatttattaagaaaaaactaccgttgtaaattagtgagagaggagaaaacaaaaaacagtctccaagctacttggcctaataaaagagcatatctttagaagaaacatgcatgaggccgtaactaaaagaaagttcagaagagaacttctccctcttaatcatctctcatctttttctcattctctcttctctctctgtctttctgagccaaaagttcaggtgaatgatgcctggctcgagaccattcaatctcatgatctcatgattataacgatgatgatgatgatgtcggaccaggcttcattcccctcaacttacacgttttgcttctcaatcttcaagaccaatcgttagccgatcacctaattctctagtaagccaagaaagatgaacataaatggtgtatccgtgtatatcatctttttttgtatgtatgcgtctttcatcatcaatccgcagcaatgtatataatatggtgtatatcaaaaacacattaggcatatctattaaaattgtttccttaatatatctgttaaaccttgctgattaagagaaataatataatcgaaatttcttttgacatgcatgcatatatataagagtaacagatcaccgagtaaagttgaggggaaggaagcctggtttaaaatgttatcaaatgctatattttctgaagaatgtaaagcatgaaaaaaaaaacaagaattgatgatgcagcttgaagctgagttggtcaattttgtatatatattataggatcaataggtaatcaaaacttcaatactattgttttcttaatttgttttaacatcgtactttataatatggacttaattttaggtctaaattaattgtaggaagaaaggtatcgtatcgaaattaaagtcagctttaattagtgaagggcgtctctttttatctttaccaatttcgttgaaatatcttgttgtaatcagtgtggaaattggctaaaaataactgtttttcctttctttctttttgactatttagctttcaacatttcgtatgtattatttccacttgtttctagttgattaatcaagaattatcctcataagattaattaatgtagtctatttactgaggaaatagttaaacttttcaaagatatatcttacggtttaatatgatatgtaatgtaaatactatatagctaaaaaagtcttatataaaaaatggtcgatcaaatttgtaatcatcagaagagaaaataatcactgaaatttgatttttcgtgagaatgtgaaaaacgttgttaaactgaaatgtgacgagacaaacaaattcattacacatgataaatacaatttaaatatgcaataattagtgtatttatggttaaattatagagccaaacaaaaaggccgtaacatatattatggatgcctgcataattatttctaaataaatactttcactttccttttcttacttgaccgcataattattatattttcttttgctttctctatggagcaaaagatatgcaatgtgttcatagatatactccatgctttggaagagcttagtatacaaattgtttagaaatcgaaactgtgttttttttttaataatgtatctttctcgaactaggttactaacctcgcgcttagtgttcaaaattcatatattcaataaatctataaaaaattattttccttatatatataatatttgaattgatattgtaagaagaaaaaatgaccatccacaaatgcatgccgccgcaaacactatgggaaaagaaattttgaaatatagcgatttaaagtggtctgaaatggtttatagcgatttgagtgatagtatgttgttaaacgctaatctgcaaccacccacaaatgtaatgtttttgagtagttgcatagaaccaatgtaccctttaatgacatttctctagtttcactaattatattattattgttattcaactagcattcactacttataaatctagtttctttcttcatcttgaataccagatgatcacaaatgtttttttattacaatatattaaccttgttggttgttcatcaaaaaggtcgtttccatttgcacaatagcattatgttactatgttacaattagaagttttgaatataaaacatgacctgaaaagaagtaacataatcaatcagtctccaccatgaaaacataaaaagcttgatagatttattgttcaaacatggatagagttctaatcaaaaacagcaatgttgtcaaaaaacaatcaggtcttctgatgaaaatgagggagactgattcgccggaaattggtcatcacccaccaaagactcattgatatcacattcttggttcatgatattggtcatttgattttgctatatttgggatgtagcttttgtaatactgtctaaagcaagactggatgagtactcttaatgctgtagacatattttgctgttgagtacaaaataactttgatgagtacaaaataattttgggctgtggaaagactttacagcaacaaccaatcatcccttttgttgttgttttttagatctcctgttattcaactaataatttctaattaaatatctttctaaatcctatgttattaaacatgaaatttatttaaagtcattcaaaaccatttataatctcttgtaattcaattaaacatttataaaagtcatactacataaacaagaaattgaaaaatctgtcacaatctcaaaataaatgatataaagataagataataaactaattgcggttatattaacgttagtcttgtcattattacaacaatcctataaggatatatgcgttatagcattactataaaagatttatttttccaaactattgaaacacagaacaaaaacatctatagaaatataagtctcattcctcttcttcaccttgtctttaagagacaagcccagtttttttcatctcctccctcaccaacaccaaacacaacctctaagacaaggtgaagaagatg

SEQ ID NO: 32937 - DNA, 3003 bp, Unknown
  misc_feature (1)..( 3003): 2750-1469P.txt file - cDNA_ID_3063315; gDNA_ID_1620423; Annot_ID_156645
acttacgaatcggctcgatggctacaaggagagaaaacgtcgtcgttgaaggaaatgaaatcgatttggagctgcgtcttggcttatgatcatcaacttcttaccctctatagatgtataataatacgtttttttggtgtatattatatggttttcgaggttgatatatgtaatctaggaaagcgtatatgagactataatatgtcaaggtaagatatttttggtgggtatttatttatgcatgttttgtgatctatctatgagatatatataaatcttttatcttatatcatattattttcattatagtttttttccataacatagtgaaatctgtcccataattaattaattgtccagatcttcgcattctatatataaaaaaatttggcaaatagaaaatctgtcccctgtaaacggattaatatgctgcacccgtggttctaggattgcggtttttaatcccaccactggcggtttggtggtattgccccatgttaaagccaacggaagagacatctacacacgtctcggatacgatcctgtcgatgatcaatacaaaattttgtgtgtgatgatgttccttaagtgtgacgacggccatagacaatacgttatagaacaagagcatctggttttatcactaacatcacactcatcgtcgtggagaaagatcgagatctcgggagatgcttactcctacttagaaggtgggatttgcatcaatagtgctatatactatggtgttggacatacaaagatagctagatttaatattagatccgagaagataatgtttattcaagcaccagaggattataatgcaatctcatgttattcaacccttacaaattacaaaggaaaattagcatgtgtaagctatgactcctattgtgaatctaagttgcgtgtatggattctacacgatgttgagaaagaagaatagtcaagcatcatgacttgtgttgtgccttgtgacaaggagctatctttgtgcagtggagagagtcataacaacgaggttgtagtggtatctagatgcttaaagtcatctaagcacttttttgtttactatttcgatatggtcagagagagtatcatcagaagaattgaggttgagattgatggaatcgccgattatgagtttagacatatcaatggaattggtaaacatgctcctaggattttgtgtttccctggtcacattgagaatcttatgtacttgtaagttctaagttctactctaccataagttcattagcttctattttcatttttagccgtttcaaatcgttttttgtagtttggttacttgttcatggactccttttagccgtttgttttctcgaacgccacaactacgtctaccattagtcatggactcatggtgatcacctaatgtaaatgaagcacgagtttaccaaattacaatgactgtaaattaatattttcattcagtttgaatggtcaacgcaaatacggcatttctttagatgggcttataacgataatgggttacgaacggcttatagcccattcaaagttcttatctttcaatttcaagtaatttgctttcaagcccttcgaatctaccaaattccaatgactgtaaattatttttttttcccctcaaaatacatatttacaaatattaatttacttatgtatacagacattaaaaggcactaaaataagctaattatcatgatataaaagtaactcaagaggaaaagtaactaagcttacatgtaattcataattaggtgacatcaaatttactattttttaattttctgctgaatttttttatttattaaatatacttattaatatcgagatgtctaataaatatgagagagtgtttaaaaaagagtttagacatcgacatgagacaaacaaaaaatgaaaaatagtggtacaaaatacagatatataacttgaaaaaataaatataatttatcaacacaaatacaagtcctaatctgttatttataaattaataatctcaaaatattactttgatataaaatcagtgttcgtgtaatctatcatttatgcgattttttaaagagataacaatttttttttctttagtgaaacattaatataccgtttatttagtatgttaagtactttaataaaactctttaacaaaacaaaacaaagttaagtattttttaatatataagatatttctctgcatgatccaggtggaatttttttaaaagttaacaatagttttttttttatagtaaaacatgaattttgtttgattattccattagataacaactatttttcttcttgacaaaaaagacaaattttttttaagtaaaacgttaatatctcgtttgttttattccgttaaataattgaaatatataaaatattttcccgcatgattcacgtggatttttttaaaaggtaacattttgttttcttaagtaaacatgaatttcgtttggttattccgttagatgcttttaatgtatacataataattatccgcttgatttatgtaattttttttaaatgtaacaattgttttctcttaagtaaaatatgtatatctcgtagatttattccgttagataattttgatatataaaatattttccgcaaaatttacatagaatattaagaaaagatcacaaaaaacagaaattttgtttgtttattccgttatatacttaatatgtaaaatattttcctcttgatatacatatttcaaaacgctaatatctcgtttggttattctgttaaatactttaatatataaaataatttttctcggatatatttttaaatatacataaaatttctcttttaagttttaagtaaaaaaataataaatctttcgtttgcctttttatgaaaatatagattaaactaattgatgacaagaaaagacattagttttcttattaccatattgatgatttcatctctttctcttgtaatacaaaatggataaaaaaagaacagagcagaaatgaaaacatg

SEQ ID NO: 32938 - DNA, 3003 bp, Unknown
  misc_feature (1)..( 3003): 2750-1469P.txt file - cDNA_ID_3063323; gDNA_ID_1620423; Annot_ID_156643
tattaatcaagttgtcattgtattatgctatttcgctaattataaggtttgacatctgtataggagactttgacatttgggattcaaagtttaggaaataaaagtatttagacgcgctttggtgtttattattctaagattaagataacttgtagaaataaatattctaattaacatccgagttttatagcaactagggcatatccgcataatatatatatgtgtgtgtgtagagaggataaggtttaatgaggtcaacgtctctaagtctatgctaattattatctaatttatcttgtgcaacttccatttgataaggttaattggtttaatatagttttgagtaatatattgtcggttgtctcccctcttctcaccaaaaaaaaaggttaattggttaaccatagttttaagtcttaaaacaaacgaaaacttctgtacagatcaattccctaccaaaaaaaagaaagcaacaagaaaacaacatgcatagatcaaataatgtgaatataaacattcaagtggtgcttcaagtgatgatgtagtgagtattctatataaactacatgcaagcatcattatttatttatatttttcttaaaactgtatccagttcaatcaagggaaattaagaaatgctaatatatatgcaagatctaaatttcaaatatggttggaaatttgatcatgtattggaatattattaaaaactttgacggtttaaagatagtgtcatccccgttagaaaagtttcaaatctatgcagtttcaggtatatatctttaaaagtcgaaaaattctttttctgatttcgttatacaagagtctccaagtttatcatcatttattactaatttagatattgaagatgctgcacaaaaagtaaaaaaaattgattaatacttaagggtttttgtcacttaaatctcttagttaagggttttttcattaataatatagctgagggctttaaaatggatttatcgatacttgaggggtttttttcgtttaaatctcaaaaacttgtttttttcttttttttttggtaaaacaatctcaaaaacttaataccaaatcttattaataatcaggttacaacttaaaagacttttgtttataagactttgaagaataatttgtttctatagataaaaactgaaaggtgtttgttcaaaaaaaaaaatgaaataaggtgatttaaagattttcttattaataaataatttaagcaatttataactaaaagatatacatatgtagaaagagtttggattgattcgaggcatataagaatttaattgatttggtcatctttaagatcataagtattaataaggaatccaaaagtgatttaagattttgttagaaaagcaagataggcatcatgagttagtatatatataatatagaactttttgatatttttaatcaaattatattatatatttattagttcctcgaattaaatattttaaataaaatgtgggcatcaatagtaatttttgaaatctaaagttttaaacatgtaattgtttgcacttattagatgtatattactatttataccaatatataacagattttaataactaaaaaattataattttaaaacaaaaacaaacgtaatatgttactaaattttactttataacaaaataaaacgtttaactgaaaattaactctttatataacatatttatctacagagtctataaatatgactaaatattgctttaatactccagagcaaaacaaaagaaaaacgattcacaataatatttaatatattttctttgtgatattggttaatttctaccaagaaatgaagttgcctattatattcttaactctattaatttttgtttcttcatgtaagtttaaattatttaattaggataatgtgtcagtattataatcattacaaaaactgtttaagaatttgatatatcttttgaaaatttgataggtacatcagtacttataaatggatctagtgatgaagagagaacatattctttcagtccaagagcaagtccttttgatccacgctcactgaaccaagaacttaaaattgggagaattggttactgttttgattgcgcaagagcttgtatgagacggggtaagtatattcgtacatgtagttttgaaagaaaactttgtcgttacagtattagtgatattaaataaggtattgtaattttgttaaacattaataaaaaacaaattatattactgcttaatgttcatccatgcccttctttttacaataatgaacatgtataataatctaaaaattttatagtgtgcacttaacataaaatttatctggaaacataagtcattgaaaaattaaaaaaatgttgaagatgacataattggcgcggatcctcatttgtaatgaccagttagagtaaaagaatccaaacctaaaatacaaatcaataatcaaatattggatgttatacaagctatggagcaattaaagaaggcaacacgaataaaatatttgggtcgaatccagtcctttggattgagaaaactgaagcgaattaaccgaaaactcagaaatctaaaaacattaactgaatttcaacaaaaaaaaaaaaagaaaaaggtgttggtagattttatttttatttaaaaatagcagatatccgaaccaaataattttttatcataatttcggtaagatttttgaaaaagcaaaaaaatcgattaaccaaattcgcttacctaattttaaggtttgcaaaaggaaatactctaaatatcctgcaaagaggcaaaattttacacataaatttggtaaattaacggcgagatttacagtaatttcggctccaaaaaacaccccgccaattttattaccaaacccattcacttcaattcgcgccaaaactagaatcccaaaagaccaattcctatttaaaacccctacgccccccactctcatcctccattttcgcctctctcttccctctcctcctttcttcccaaatg

SEQ ID NO: 32939 - DNA, 3000 bp, Unknown
  misc_feature (1)..( 3000): 2750-1469P.txt file - cDNA_ID_3063387; gDNA_ID_1620425; Annot_ID_156697
aaatagagagcctctcctgctgttatagcacctctgatctcattgaatgacttaagctacattaattagaatgttttgtctaggttgctgcaatctaacattttgtgtgaggcttttattttattcttgaacgaaaatgttgttttgctaatgcttaacctagttgagaccccatagattgataaactaaccagagtaaaaaggtttatatcattatggaattctgcaaaagtgcttaaagagatcatgtttttggttttcactttcatgatcttgtaagagatatattctttccaggatttaacagacaatcaacaatgttagttttaaataacacgtgggtatattggaaaatccaatgttgtcatcagtcctttttaataacactttggtattacaacatgggcgtttccgttgttgatggcaatgtgaaatcgtctattaaaaacattgttgactattgggtcataataaaaacaattaaaaattaagttataatagatgcaatcatgcaaacaagtcgcaaaagtcgtaacgggatgagaggaaaattagttggaagaagagcaactagctaacctaccaaccgtgtttactttaaatgctacatttaatgatatataatctatataatgtatcaaaaaaatgttaaagtttatatcataatttctttttaagttatttaagatagaagagccaatggcgatgaagaatacatcacatgttcttttgctaagtcttctgctttgcctgatgtttgtgattggtcttgtagaagctagtataccaggttagttcacatgttaagagaatcgcacaattcataacctttacaatctatcatgtttttgaaatattggtaaacgatgaagtagaatgaaaatcgaaaacgatgttgtgaaaagagaattattaacttaaatgtaaaatatttttattgaatcaagataacatttttagtaaaatagggacagagaaaaacagtataaaataaaataaaatagggacagaaaattgttcttctcaattaggatgaacaattgactcagatttcagattttgaatcaaatggagcagccaaattttatcactaatatatcattaccttggctatgaattagatgacgatatgggtccagcaatatatactccaccatcaggatcatgtggagctcctatttccaaatatgatttccaagtactagccaagagaccaccaccatgtagacgtcctcgactcgaaaacacagaagatgtgacccatactacacgaccttgaagtctaagaacaatactcgaactatatgtaatattttcttaaagatttttgaagtgatatgtggagtgactctaatctaggtcattacctatattttcactatactgatttattagatattgtttaacgtttttagatatattttgactgaacaaaaataattctaaactcaatgtgttacttgcaccgattaatttacctgggtgagattttaaaggagaatatggcaaagtcctagggtcgaatcatacctgcaacttctttggataccaagcaaaaattttttttttttttttttgaaaataatgttaaattatattcaaagaaaagtatagcttttgtacaactagtgcatcggaaaatagagaatgtagcagaatattagaaaacctttacatttagagccttgtttcaaaccaaaattgtaatcctttatcgaagcggttatcgcctagaagtcggattgtagaaaaacgattacgtacttgcttgtcaattacttagctttgcaattgcgagttttcttcgcctaagaattcatgagaagatatttcacctgtctagaaaaataagaatatagttaaagggccaagttccctaaactaaacttgatactttaatcatctgtatttacaaccaatttaatctgctttttttttttttttttaatttactcatattagatttagcttaattttgagactgttagctttcggtgtgaacaaaagaaatttgtgaaatttgatattgttgatacattctctagaaattttggaaagattgtgtgtttcttttcaaaattcaaatattaataacgcaccaaaatatctgaatagaaagaataaataatgcgccaaaatattgatatgatgaaaggtatttttgaaatatatcgtttgagttgaggcgcttccatcatatcctcttcatttgtctcatcatcctcttcaaatttatctaagaaaataccttcgcagcaaacattatcacgtcatgcaagtgttctcaaacctcgcttctcgagaagttttacaagttacaactttgagatagactctgtagagcgtgcatgtgatgaagttataatatgaagtatttggtggcaagttctaatacaactagtatatttaagctaatcttgtttcatggccatctccctagacaaacgccattagttttaaagatttattatggtgggagtcccgtctcaatatgtttttagaccctaggtaaaactaaatttacatatccttttcacacgattttttttttttttttttgactcttttacttaaaggtttttttaaaaaaatttgccatgcaccctggcaatggcttttgcccccacctcccccacaccccctagaaactgacatgggagtgggcgcagtatatgtgatagccactgagtagagataatagagctttaaataaatgaattttgtggatgcaaatttgtcgaacaactagtatttaagccaatcttgttgcatggccatctcccctgacgaacaccattaaagattcatctatatgtggtagccactgagtagacttaatagagcattaaataaatgaaattcgtggatgcaaattgtagaagaactagtatttaacggagtgttgcttcatcacaaattcatcaagataagcttatagttatcactaagagttttgtctacgtacattttgtgatcaaacaagtaatcaatcaaaagatg

SEQ ID NO: 32940 - DNA, 3000 bp, Unknown
  misc_feature (1)..( 3000): 2750-1469P.txt file - cDNA_ID_3063397; gDNA_ID_1620426; Annot_ID_156743
tgtaaaagcgagataataacggataatagcggatgccctcggaaaaaccctagaggcagtttatataagcgagaaatgaaacaaataaggaaactaaatatatagcgaatcatcacgtcatgatcccgcgaccgaatgtgtcattggcatctgacgggctgaaatgagcttcccagtgatcgagtatgtcattgatcaaactggacttcaagggctccgtcttgcgatcgagtagtgaagtcgagattgaatggtccagtgaccctgtgatcgagtgcgatcgagtggatgtcatgatttggtgatcgagtggtttcttcggcttctcttctcttcttagttctcagcttgtctggttgagtgcagaaagagcagataggcttcctggtggttgagtggtgatcgagtagttctgatgggatgattcctccggcttcgcgattgagtgaaactgagctgcttgcttctccggggttgcgatagagtgattggccctagcagggctctgaggctgcgatagagtatttttgctgaaggcgtcattgggcattctgacttcatgttctgtttttcctctgtttgaactccaaaaacatccaaagtacctgaaaacaaccaaatatgccatgcacatgcaatcctaatgcaaaatcgtcctaagtatgtaaaacacactaaaacgactcctaatgagatgatttgtggatgaaacaatgacaaagtggtgaagaatgaatgcctaaatcatgcaaattatagacatatcacacattaacaaacctcttaaaattactcattaattttcacttaaaagttaaaaccacaaaaaaaaaaaattattctgttcaaacccactttaattactcgttgactttccttaaaacaaaaatggcaacaaaaatttgactacccatttcttcttcttatgcttcttctctttcagttaggtctcttcaccctaacactccatccataagtccataatgtggcacgtacggccacctcccatcatcgcgatgatggttcttctcccataatctcagtccgtctctgccgccattaaccaataaccaaatggtatcgtaccttcatcctctattttttcaatgatttattaactcttcgtttaaattccttcaattttgcacttcacatgattttttagtttcattcatgtgcttagagatatacaacacgtccggaataccattgataaggttttagtctatctataaacttttgaacgtattaattagcacaaagcatacgttttttgttttttcacaaagcatacgtacgttgcatggaataatttgtaaaataattactaggatagaacacaattgtatgtttattcctagaataaaacacatctttttttttattattcacatattttcagtacttgtgtagttacagttaacatttttgatgagttttaattaaatattatttttaattcatttttaactaaatattaaattaaaaaacactaattatacatgtcatcaatccatgtcatcaatataatccacgtcattactcatctgaaaccgcataacttttcggtttcatttcttttggcattttactgttcatcagcggaaaaaaacctgtcgctttctttctctctcgatggaacgaactctttaccgtaattccttcgccgttttctcttttcttgtctgttccggccgaaattcttacgccggagtcgcatttctggtatcgtgaagtcacatccatgtcgctgtcgcatttgaactgaacttctctaagttccggtaagtatgtttccaaactttatttcgaattttccgacaagaattcgacttctaagttcaatcgcaagtgattcccgtcactgaaatcgttttccgatgcttaacgatggtttttaacgatgcttaaagctggtttttacgtcgttgttgattgacatatggtggccgatttgttagatctatttgatttgatggctgagttactgtttgtttatcgactgatttatgatttatcaattcatttgtgtctgagtttgttatatgatgtgattgagttatggtttaaccttacatccgtggctgagtttttgttatatgacggctgagtttgtttatgttatggttgagtttctgttatgctatggctgagtttggtttatgttttgatggagttgttgttatgttatggtttgactaagtttctgttacgatatggataagttagatttatgttatggttgagttatgttatgtgtggctgagataggtttatgttatgattgagttatgttatctatggctgagttaggtttatgttttgcctgagttatggtatctgtggctgagtttattttatgttatggctgatttattgaatgcttacggctgatttatgttttatcagatgtctgaagaccaagcaagggattaccctccaagattttacccatagggggattctaatctggaggttaaagccattaatcacaacataaagctgggagatttctttgcaattagagaatcaataggacaagatatatgggatgaactgaaagagacaccgattggattaattgctaagcttgttgatagtcattttgtatggtctcgtaagactctacattatctactatgcagatagttgagaatactgaagaaggagctttggtgtctcgtggctggtcaacccatcaggtttggattgaacgaatttcgccatatcacgggattaaacacagatccactacctacagaaaagtttgagcctgaagcggactacaaagcgttctttagggaattgcctgcgccaaccggtgaaggtcctaagttagaagaacttacggaaggcttagtaatgtgaagagcatggcctcataaaaagcgtagatggtttgggttattgactcttttatccattggattttatggcttgcatcctaactctaggataccattagagagtgccaaaagagtttttgatgatgaagccatg

SEQ ID NO: 32941 - DNA, 3003 bp, Unknown
  misc_feature (1)..( 3003): 2750-1469P.txt file - cDNA_ID_3063427; gDNA_ID_1620427; Annot_ID_156761
gcgctgaaggaagaagaagaagacgaaataatggaaaattaaacaacgaaaattagggaaaattagagaattaagaaaggttttattcaatcggcgcgtttcaaaagtctacgcgattctcgagattcattttcaaatccttcttcctcgggatctatagtatagagcttcagtaattttgtcctcttgaggtatttgtttgaagaagatacgaattgatttttagctgaatgaatccattttggcagccaagcttttgttgaagagttcgatggtcaacgttacgctaatttcttatttgacaaattagttgttgtcttcctcttcttctgacattgtgccatttaacaaatacttcttctctgatccattattgtttttttgtttgcagagacgtctaaagaagcttgaaaccattattagagtatttgacaatggaaggagaatccaaaggattaatcgttgggatctcactaggtttggtgattggtgttgtcttagctatctcagctttgttctgctttaggtatcatagaaaaaagtctcagattgtgaatagtggatcacgaagaagtgcaaccattcccatcagagagaatggagctgattcgtgtaatataatgtcggattcgaccattggtccggattcacctgtgaaatcttctaagaatgggaggtctgtttggcttgaagggtttagtaagaggagtaatgtcatctctgcttctggcattttggaatattcttacaggtttgtctcttcctctgacaaatcttagtttcctgattaggttattattttattgtcttaactatactcaggactagacttctcttgttatagtagttactttggttattatttcaaagtttgaaagttcattaaaaaggggaatgctgttgtggatatgagaaggtcttgcattcttggggttatattccgtttttgacatatggtctttggtgattgcttcagggatttgcagaaagcgacgtgtaatttcacgactttgataggccaaggagcatttggacctgtctacaaagctcaaatgtctactggtgagatcgtggctgtgaaagttctagccactgattctaaacagggcgaaaaagagtttcagacagaggtaagatatatctatggattcatttccgaagaacaagttagtgtgtaaaacatgtagcattaggcagacttttaagcattacaataggctttctgaaatctctaatactcaatttattagttgtgtcatctataagacaggctacatgaatgaacaatctatatatcttactctcttagtatctgcttagtttcttgaaaaactcatccactcgccttaatcttttcaggttatgttattgggaaggttgcatcaccgtaacctagtgaacttgattggatactgtgcagagaaaggccaacacatgcttatatatgtttacatgagtaaaggaagcttagcttctcatttatacagtaagtaactacctggttatacataccatattaatctgcttgtcactaaatgaactgttaatgcaatgttgagctattcggtatctttgtagaacatttattgagttgatggtttagacttcactaaatgatgagccttggtaaagatttgagatgcactaaaatggtacttttgatacaggcgaaaaacatgaaccgctgagctgggatttgagagtatatattgctttagacgtggcacgtggtctagagtatcttcatgatggggtaagctgcttgctaaaaccattcaccattttaatgcatctcttaaacaacaacttcaaaactcatgttctaatcaattgttccaggctgttcctcctgtaatccacagagatatcaaatcttccaacatcttgctggatcaatctatgagagctcgggtaaacatatcttctttctctttgaaatctcagtctattgaaccacctcaagtttctaatggtgatcttctttaacttcaggttgctgactttggcctctccagagaagaaatggtagacaaacatgcagctaacatcagaggaacatttggctacctcgatcccgaatacatttcaacaagaacattcaccaagaaaagcgatgtctatggcttcggagttttgcttttcgagcttatagcaggaagaaatcctcaacaaggtctaatggaattggttgagctggtaacataaaactaaaaagtcctcgaaatctccaattgttttgtttggagaattgcatgtaaagactaaacgttttgttgttgttgatgaacaggcggctatgaatgcagaggaaaaagtcggatgggaagagatagtagattcaagattagatgggagatatgatttacaagaagtgaatgaagtagcagcttttgcttacaaatgcatctctcgtgcacctagaaaacgtcctaacatgagggacattgttcaggttttgactcgtgttattaaagtgagacattgcagaaagcggcagaagaattctccgtcgccgtctccacggcttcctcctcctcctccgatagtggaggagtcagaaggtgagttaactgcaaacggatcattacgatcagaaattcatcggagggataattccttggacagtagtatagctgaagacgtgattttgtaaacaaaatgaaaaaaaagtctcaatttttttaattattattaacttttaaaatgtgattttgtttttcaattcttttgggtttttagacgctagattgtctatatttgtgaatgaaaatttgttctttgttttttcgtgttaaaacgagttcaaaactggagaaccatattatatatttgggctatgaaaagaattgaattcaaggcccaattaaaacctagcctagcccattaaggtttagtgataatacagtgtcgtttaatcgtttatccaatttttatcgtcatctgtggaacggataggacgaaggaaaaagaagaagagtgaaagttgcagagcgagaaaaaatg

SEQ ID NO: 32942 - DNA, 3003 bp, Unknown
  misc_feature (1)..( 3003): 2750-1469P.txt file - cDNA_ID_3063432; gDNA_ID_1620427; Annot_ID_156752
tttcgctctattattcgtttagattcatttgttttttttttcagatcgaaccgtagaatttaattacaaaattagttcgtttttcaaaaaagaatattgttattgtggcttgtggggaatagaagtggtacagtgaagtcatgggctttgggtttgtgttttttctttctcgtttatgtttcgacgactttgaaaactcttttggattttattgtctgatatctttgccggtttcaatacgagtcttgtctctgtaactgctgacataacatttcctttccttcttttactttcttgttttttacttgaataagtagtacattcgatcagtaacttttaccaaattttatcatttgttttaactttacctaatagtatgaatattatgtacgagtacaattctcttttcctagttcgaataacccacttcaagaaatggtaacaatacaatcattcacagaagttacatttttctaagaacagtttttcattctaacttttttggatggtacatttaaagatttattattggatttatgtatcaggtgttttgaagaaaaagatgagaagagatagaggatttgaagctcagaagtagagagaaagacctaaggccatattgtccatttgaaaattcctaaattgtaaactaatcagaaagattagtatgctaattatatgagtagaatagaattttgtttgagagttcttgtaaagatgagactccccatgttctattctatgttttgtgttttagaattttaaatttgatatccattgtctttgactaaattgatgatgtttatctttttgtgatggttacaaagttgctccaaaacttaaaactaatttatttttgatcgacgaaactcggtcaaaaatactatgatttgtgaaaaattcatgtataagattgtacatatactagggctagggccaccagtttttgaaaagttaggtctcaatgaaactgaagtaaatctttctaaaatactcattttatttttttctgtttgtgagttgcgaacctagtataatgaagattcggggtaatacactacactaacgtagaaccaacatttgcagcaaacaaagataataattgcttaacaaaactaaactaaatatgtctgaaaagattggtcggcttcaattcttctcactcaagtcgtcggtagctttgaatactcttaaccaatccttctctcacgcagaaaagagaacaaacatgtttctcggctacagattatcatctattgtgactgaaccatcaaacagttcgtgttcttgattatgcgacaccacagtcttaattattttcagaacttgaaccaatttctcatgaaacctcaaacttagattgcgacataaaccagaatgaaaaatagtatagcaataagaatacgacatttttcgatatttcaacatttcaaacaaaatgaagtgtgcaggatttcaatcaaattttttgcatcctacaggctacacactctattttttttttttttcgagttagaacaaaaaaatctcatttttcttcgctgtttgtttttctccacaatatacaaccattctcattctctttttcaaaaatgcaacatttgtttttcaaactttttgaaactcccatcaaagccccctcaaatcttgagtagaaaatgtgcctataaatgaagaaaacggatcctgacaaaaggtagaaccataaacattgtgcactagatgtagaaattggtgaaataaaaacaaaacaacaaaaactgaaaccatatcgactcaaaacttgatggacaaaatagtcctcccaactttgaagatgagaaagatttgtccatctttgtccttgtgtagcgatttttacggggcctaaaaatgtaatagaacttacttcagcgagacttgtaggtgtggattgctttaccaacgtcacatgtcaaggtgatcaccaaattacagctttctgcattattgactcatcgaaatctcttcttaggtaagatgtttcatatatagcttgtcattccttcatttaaatatatactttcattattattttttggtatgttttgattttgaatacattctatcatgtttattttgggcacatcccctgaacttgtcccctttgaatattttccaagttcaattatgctctttatggttaattttatgatcaagacttcatcaatgaatcgaaacgtttgcacacaaaaattgatagattaaaacgtatatttttggataaaatgggatgatcctattttaccattcaactaattccctaaaatgaatgtaggtagcatactcaccatgtttttaattttaatggatctaaaatattagaccgctcgctaaatacatataattagaaactttcaggattacattaatccctaatcgacatctacactttttgtttctagagagaaatcgacataaggagcaaaatcaaaatgaagacaatatgtaaacatcatcgaagaatataccacccaaaaaatctctaattatctttataaaaatcagtttctgaattcaaggaaaataacactaaaccgtaaccgaaattttacgtgattgtaaagaaaaccaataagtgacccttgaaatttcatttattatatattgacttatttcaaaatatttctattaaatccttgccaaaaattgataaaccgaatctagtcgaacaaacagattcgttgataagatatagtacttttttttttgtaggggttgataagataagatatactttgacatagtaaaccttgattatatgaagatgatttgcctaattacgataattaattaatattaaacgtcggtcatttactgctgacgtcatcattttaccttagtggataaggtattattctctttcttcaaaactcaaatcaaagaatcgcaactatacatttctccaaaatctccgagttctacaattgtgtgatcaatcaatcttctccgatttcaagcttctcgatcaaaagaatcatcatg

SEQ ID NO: 32943 - DNA, 3003 bp, Unknown
  misc_feature (1)..( 3003): 2750-1469P.txt file - cDNA_ID_3063456; gDNA_ID_1620428; Annot_ID_156796
atttcctttttcttgaaaaaacaaagcattcaagtactcaggcgcatatgaaacatatgaaaagtaaaatgcttcaatagtagagacagacatgccttggaaccttggtgggtaaaaaaaacatacttgaatggcttcataatgaagcaaaataatgagagaacatgagaagcatcatcatcaaaagccaacacttcaaaaagaaaaaaatggatatggatatccatgggaataaccccatcaaagcatcttctcctttttcttcaagcactcaaatgtcaaaaaggtcaccacttttattaaaactcatatatatacactgagccattagtccatgaataaccaaccagccttctctcaaagcaaaccaaaaagaaaaaccaacattgaaagaggaagttacgataagcggagcagtaatagggcatctttctattggcaggcgacttggctatttgtatcttttgtgttcttgactattggctatgtcacttgccaaaggagagttgccctgtcactgcttccgcttaaacacagtctataaccggttctgctaatatcaatccttcttttggacatgtccaaagccgagattgattgatagagaattggtctctctggctacaaaactagtgcggttctctcgatttaagttttaatagcattcactttgcacattgcatctttcacatcaaatttccatttcatcaaccatctaaacctctttgttagctttgatataagcaacgatctaaagtctaaaaaccattaatcctctgaaaaaaaagacaatttcgatggttctattatgtttctccaatgcagaaattgtatcgtctgaattatagtagattttttctagactaaagtgtaaaccaagacgaatctgcactaacaagacacaccaatagactttacagagaaaggttacgagttttgaaaatattaacggaccatagtcatcgcgaagacagttgaaacggctgaatctctccgatttgcagtatttcgcttcgggagtcagaaagcagaggttgaaggcaaacgccgctaacgtaaaccttctctttcaggtggaatctctattaaaaggcttttgggccttatttatagtcttgtatctcaataggcctttggagtttgggcttaattatctaaatcggcctttggacttatccaaaatattttattcaactgcttgaacgtctcccttacatatcgaccatttcattttttaaaaagatccaacatttggtgaggaaatccaaaaatcgaatatccaatcagtattaaactaagacttattgcccaaattgtatactaattcagttggaacggtaatcgaacaagtgaaacgaatcagtgcgagacacgtgacaaagcactgacatagtacgatgatgtcgatgccaattttcaacactgttttctttttggcgtgggccttttcgatactgtttcatctcctctcgttttctcctaagattaaaaataatagaaagaggacaatgtattattattctcttaactcatagacataatgacacgtagtaggttctctagttcctatcttttgatttctgttaacgactatgttcattaggagctactagtcacaatgccttcaattaattttaacaacatattttagctacgagcttgtcgagaaatcagtttgttaatactattaaaaaaatagtattcacgaaaattttgaaattctctactaaatttttattaaatcacaaaacttttaaaattgaccccatttaaattgactcccactaatcctataattaagtgttatgttctctagtaatgacgacatcgttagaaattcaaacactaataaatgattttattaatattgctcaaagcctcaaagtcgtccatcgatcttctctcccccaaaatttcctattttagcggagactttccaaaatcccttgttctttctttcctcgttaagtttgccaaaatagggtaaagaatatgtttatctcgtagaccaaatggatcttcctaatgcttaatagcttttttatatatatattttaagttatatttcgtacggctattattttaatgcaacatttgaacctgccacgattgtcttttttctcaattatataaataaaggttgaaatactataattggtgcacagctacaataattatgatatttacttccgtaacgtgaaggagaaatatctaataaattacatttttatataaaaactgtactaacttacttaaaatgagagtgaaaatactaaatcgtatgaatattacagtagtatttaattaccattttattgaaatttgatatatatatatatatatatataaccatatattggtatatacacacatttttgttgacaaataaatcaattcttataaccaagtttggttgttttccagataaataaaataaaaacaagaattatcctgtttcttgttttggcatctaattatccttttgtatgtggggaggagaagatatggacacaaatttaaaatactctatacataatttttattattatcaagaacagaaatgaaaataagaatggcatcattttattgtgacccataaaacaaaaaagaaaagtgataaaacataaaaaaaaactttctataaaaaaaaaaaacattaagaaacttgccccttccttctctcacagatcattctagggctcctgacagaaaaaccaaataccttttcctctttccatttttgtagaatttcaaatctttctttcctcaatctttcacaatgatcttttcctgtgaagttcttgattttaaatcaccctttcttcactactagcttatctcttcttcaattttctctaccgacattcaattactctccctattcggtgagatctctctctctcttttatgactttggttatgatgactggtcactggcttgtttagggtttcaatctttacagatcttgtggcagaaaaaatcaagtcaaagcaagaaaaatg

SEQ ID NO: 32944 - DNA, 3000 bp, Unknown; identical to SEQ ID NO: 1640
  misc_feature (1)..( 3000): 2750-1469P.txt file - cDNA_ID_3063468; gDNA_ID_1620428; Annot_ID_156784

SEQ ID NO: 32945 - DNA, 63 bp, Unknown; identical to SEQ ID NO: 1642
  misc_feature (1)..( 63): 2750-1469P.txt file - cDNA_ID_3063476; gDNA_ID_1620429; Annot_ID_156812

SEQ ID NO: 32946 - DNA, 973 bp, Unknown; identical to SEQ ID NO: 349
  misc_feature (1)..( 973): 2750-1469P.txt file - cDNA_ID_3063476; gDNA_ID_1564194; Annot_ID_149019

SEQ ID NO: 32947 - DNA, 3003 bp, Unknown
  misc_feature (1)..( 3003): 2750-1469P.txt file - cDNA_ID_3063506; gDNA_ID_1620430; Annot_ID_156838
gagttagcgaaataataaaatctttggttgtacttgtatgtatatatatgtatggagtaagattaagtgagatcctaaattctattgaagtttttttattctatgattgaatttttttgttagtttgtaactttgtagtgtacataaaggtccaaatttatgaactgtagtgtaccaaaaagctgaggaaaataagtggttgtaaatgggttttgcctagagatagtgctcttatctttgtaagggggtatgaggaaactgtttataatgccaaaaatgtggagacatgtgtgatttgtttgtaaaagaaactaaaagttaaaccaaagatttgttagttttaagtaatgagtaggaagtcttttagtgcctatcttatcttatcttatgtgtgagtttgagtatatctctatgtttagagagccgtgtgatctacctatgtttcttaattcttatagtcttgtgtacattagtaacgactagtctttaagtagtttagtaacatatataccgcaaaaatcaagattttccgaatattctttttggaactgagtttgtagtatcacaatttgaatttaaatccgaaaatttgctagtaggtttagtctcaaatttttgtttaaaccaaaatgtgaaggcatttgattttctgcaaacatgaagaacatttactgcataatcaacaatgaaagttgccaataagctacttttctccaccattgatgagttctaattaaaaaccaccaacttaagttttcataataaattgaaaaatacttttcatgtagtaccataaagttgacccctcctctttaaaggatgttagaaaattatagccatctttcatctatcttaggtatatgtatattaaatagttgttcactcattcgttcacactataattttgtaatgaaaatatatatgacaacaactattgttaattcttacaaaatttgtctttgattataaccaacgaccaaagacagaaaactctctcatttctatgaaggttatagttgttaattaacgtgtgaggcgatatccctacttacacatgcaacgtgtgtgttacccaaaatcgaatttacaaatatacacttttcactaaaattagattagttctcgttagtcttttactaaaataaaacaagaaacatattactaactaaataaaaccatatagtctctctttcttcttccttgtctctctctcgctcattattgatctccattgtcgtaaggagatcgcaaaaaagccatgagcctaaattgtctatcatgtcaagcccttccacgaacagattccaacaaagatgttgatctctccggtcctggaccaccaagggtcgagattaacaatgttctaggtaaaacatgttgtgtaaatcctattggtgggagaaattggtcagggaatttgagtcctaggatctatgagaagattggacggccaggatcgtctttagcgcataagatgaagaaggtgaaaaagattcatcacgttaggctaagtggtcctgttggttctagccctagcaatgtaccaacccggccggaacaaccaaagctcgtaaggagcactggagtccgaaggaattggagttttgagaatttgagagatcaaggattaatagaagaaaaaaggaagattaacatatgaatatatgatcaatgattgatcatgattctgagattttatataaatgtgagaggataaagctgattacatatagtttcaaatccagattcgtgattatataatcgtgatagaatatgtgagatgtataatagtattatttggacgacaaaacgtttccattgatttattacttgtcacgttttgttctctttgaatatttgtttttatgtttcttttttgtctttgaatgaaaacgtaatttcattaaagtgttttgtttcttttctaaaatcgttttcatatctgttttcgagtttcttgcgtaacacgagagatcatccttattggtggtatactattccatctaaatagccaaattgcataagcagtaaagcttttgctatctttcagaaaattattagtaaccaacaaagcaacaaaaaatcaatcataagagaaacaagaaaacttatctctaattctctaagagtattatgactcgacttaaaagttaagtaaatcatcattacaattgggcctactttcgcactgcgtaatttcgaaataattaatacacaattgacatggcagattttgtttcgaatcgtcatgacatatacttttgtggtatagcttcgtttctttaatcgttatccatatcggcatatcgctatatagtacaaactataccattgcaatacaagatatacggttttaacaatcacaccaatcataaagtaatatcaacgttactaaaacaatattctcagctatttcacatcgctagtttaacgataagagatgtaacagttctacaatttttcgacgatctattagattatcaacacttgtataatcaactttagtctgatcaatcgtagtaaaaccatggtataaaaaatacgactcctaaataatcaactttagtctttagtcatattataaacactaatcctcaacttgtttacgtatgtatcctaaattcctaattttaatccacttgttggttgtatctagtaaaaaatcgaatagttatcagaaactagttttaaattaagatttaacaacttaatggagagaaaaagagagacaaaaagtcaaagtttcttttttaaagcctcttgttttgttcttcttctcttgtttcttcttttccaatcttcatttttccagtcaaattcagaaaacgcgtaagttctctttctcgttaaaagggtttgttataaaacccttgattttacttgttttagagaggttcttggtttaaatcttcttgtggtttaagtctttgtggtttctctaatattttcttcccaagatttggatttgctctgttttgtttgtttgtttcagttttaataatg

SEQ ID NO: 32948 - DNA, 3000 bp, Unknown; identical to SEQ ID NO: 1645
  misc_feature (1)..( 3000): 2750-1469P.txt file - cDNA_ID_3063513; gDNA_ID_1620430; Annot_ID_156830

SEQ ID NO: 32949 - DNA, 3003 bp, Unknown
  misc_feature (1)..( 3003): 2750-1469P.txt file - cDNA_ID_3063521; gDNA_ID_1620430; Annot_ID_156828
taatattagccaaagtctcatcaaccatatcaatgactcgagttattaagcaacaagctcttcaatatagctaagtttttgataatttatcagttactttgtttaattttagtcatttgattagagttttggtcagagtcttttaagaattaagggaccaaagtaacttcagacaaaatgaccaaagacaccacttttgaaaccactggtcccaaaaacgaagccatgttactcatgtgctgcttctgaacacagttaaaaagctaatctttgaactatgaacctactctctagaactttttactatttgggtttctttgtttttaacagaaaacagtaaagttttttttttttttttgcagaggactaaaagataagactgagtctagtctctcgacgtggacaaatctgacaagaacagttactgctcttcgtcctctttgttgttattgtcgtctctctctctcggactttgtaaaatgttacactgacttctcttaatctctctacgtaagtacaaagatctattgcatgttagagatgatgttttcagaatttttttagagacatgaacacgtgtttgtttgttgatgcaacgaatcagattagagtagacacgttttctaggtttaaaaacattcacaggaatctttttaagttaaattcttgataagaaatagagacgagtttgtccaaaaaaaaaaaaaaagagagatagagacgttggaacttggaagcaaaaggtttttgttgcttgtcaaagagattaagagaatatagttttgaattaaccaacaaatagagtctgattaatattaagtgtgtatactttacttagcataacaaatgtgaattgtatttagcaattataaatactgagatcatccaaaaaccctagtggtggaaacaaatcgaaccgataaaacaactctaaccctaaaggtcgtcacaaagaaatcttatatgaaaagactcaaaataaaccaaaaggttaattaagagaataaaaggagtctacatactagataccttaaaactaatactattgtagtattgtttgattttcgcttgctattgtcaaattcgtgaaagttaacattttccctttttgggtattagagcaacggccattgttgagtggtaaacgaataaacaaatttagtaattgtagtctaattataggtcgttaatttggttttgtacactttatcacttgtagaattttgcatggagtgttttgtttctgttaccgaaaatatttgattgattttgtgtccggagctgttgtctaattcgtgaaagttaacgttttttgtttttgtttttgagagatctgacaatttgtatcagaaaaaaacaaaaaagtgcagatagttaaaaagtaatttaaataaatagagaaatttgttttaaatcacgggttgtgttttttaccttcatagcttcttctggtccttctaatgtgcaaacaaaactgactgatgaaatggagacagtccttttttaattataagcatacaattgcaattaataattactcacttttcccaatattataaaaaaaaatcttatggatatatatatattcaagaggaaaataaatagcaattgtgagattttgctttcttccagcactcatttgtctctttacgtgtatgttattgtccggtccccacggtccaacattgctaaatacctaaccggtttggtcccatttgtttttcttcttgagtcgaatatttggaatttggtctccatttagatgattgagttttcttcctttttttttttttatcgaataccatatcacatatatacgctttgtttttgcatttgcattataaaagtcttcaaacatttttcggtaaaatgccaacgcatgatctcaaacgtaaaaatgagattcaactatgcaaacaattgcgttaacatttctgtatagaagtctgagttttgcaacgaacaagaattacatatggttccttttgggggttgcaaagagttgtttttaggttgaaacttgaaaaatgtaaaaagattaaaggtttttagagtagtgaaaagggtaattaagtgaaaaagaaagaatggtccacgatttcgagaaaagaacaagaccttagactctctctgacccctctcacgtgccaccagcactccattgctcttcttccttctctaatccttttctcatctatgaatatatatacatatgcattttatatttatttatacactatgagttaatcaaaaaacaaattgtacgttatgattttaggtaaacgattacaatttatacagcttgtgtcatttatttttgccaactccttaaacatatatcaaagcatggtaaacgtagtcttttcttcgaagtcgataacttcatcggttaaacctggctgaactattaacctatatcgagtacatgtggtttatgtttccattttccaaattcttatataaaataaaatatatgatcaaaatagatgactcgagaaaaagaaaaaaaaaaacatatattgagaaatcatatgatctttgtatctcttcttatcataatttaggtttgtgataataagttagtcaagtgtacgaattgcaactgataatatgtggaaacatgaaaatgaatatatatgtgattatgcatgtttttagcaatagtcaagcttttacaagatttaataagaaaaagtatggcattcagcaaagtccataattaagttttcttcagaagtacccttccatgatagtaccgatcacaatcaaataatgtctcacatgtacacacactcagagcaccatagcttcaacgtttgtcaagaaaaaaatttccttttaatcattgccttttattttttcgaaaatgtcgttttcgcccgcaaatatttataacctttatatatttttttcgaaaacaataaattaaagatttggaatgttgctatataaatcaatgatacttagtaattcaataaggaataaacttcgtgaagagaaatg

SEQ ID NO: 32950 - DNA, 3003 bp, Unknown
  misc_feature (1)..( 3003): 2750-1469P.txt file - cDNA_ID_3063533; gDNA_ID_1620430; Annot_ID_156820
aatgaggtgagtgttgagtttctttctgtgtgtatgtagatcggctaggttgtgcggtagtgatgatattttgcattctctcaaacgcaggtgtttctggatattgtggaaagtgtaaaccttctgatgtcctctaaaggtaaataattgccttttatgaagttttttgaagttgtctttcttgttgatttgctgtgtatgactggttttgcattttatggaaacggttaggcaatgttcttcggtgtgatgtgacggggaaggttttaatgaaatgtttcctttcgggaatgcctgatttgaagttggggttgaatgataaaattggtcttgagaaggaatcagaaatgaaatctcgcccagctaagaggtatacgttgttaatacattgaacatcagtagccactgacttttctttgtgctaactgactctcgttttgtgcagtggtaaaaccattgagcttgatgatgtcacatttcaccagtgtgtgaacctgaccagattcaactccgagaagactgttagttttgtaccaccggatggagagtttgaactgatgaagtaagttttcgaatgtccactgttgcaaattgttctggtaccaaatgtgtattaactttatgatgtctcaggtatcgaataacagagggtgtaaatctgcctttccgtgtattaccaacaatcaaagaacttggtcgtacacgtatggaagtaaatgtcaaggtacataacttttctcaaggattacaggatacaaaaaaattggcttgatctttgctctcttacaatcccttcccgtgttttgtctgttcaggtcaaaagtgtgtttggtgctaaaatgtttgcccttggggtcgtggttaaaattccagtgccaaaacaaacagccaagaccaatttccaagtgacaactggtcgcgctaaatacaatccatcaatcgattgcttggtttggaagtgagtttatataatttcccctcatattcatctctataattcttttgttggtgttttatcaatcattcggcatctttctctcttttactctttaggataagaaaattcccagggcaaacagagtccacgctaagtgcagaaattgagttgatctcaacaatgggagagaagaaatcttggacaaggccaccgatccaaatggaatttcaggtcagtctttgtctcttttaggcactgttaaatagaaccagatttgcttaaagcaattattaaccgtctcagctttgttcttttctaggtgccaatgttcacagcatctggtctgcgagttcgttttctcaaggtacgcattgttatctatgcttttgaaagtaccatccttccaaaaaatgcaatgctaagtagcagaatctctaagccattgtgtcattaaatccgttcaaatcttttatgtgatttgcgttttggttaatctgtctctggtctttcaaaaattgattgctatactacttttttggacctgactatccggaacgattggcaggtttgggagaagagcggttacaacacggtcgagtgggttcgatacataacgaaagcgggatcttacgagatcagatgctgaacattaaacacagttcaggttcagtgacatcagacttaaaagtttcatggcttctagttttttgttccttatgcaaaacaaaaacaaaagagttaaatatgttttataccttgttttatgtttgttttgtcgattagagatatctgtgttaatatgatttcttatgtcttaatttggtattgaattctgtttttctttctttctctgtttgtgaaattgtacgagatatagtttagattaattctggtgtaatcgaacgtgatagagtatttgtgaaagcagtcggattctttttagtagtagaatcgggtgtaatatgttaatgaaaacaaattttacttgagaatagttcgaacttcgaaggtttttacacataacatagatcgttaaaatcttttgtaagtctactaattcttcagaaacaaacgggaaattgtaaaagtaatagactatcaaagctacacccaagtacgtctttcactcgtggttggttatgcatgatcgaatttctataacttcgcttatggcaaatgtggtcatggtggttctttggactgtgtcatgtggctctctgcccacaagacaccagatatcatggatactttgctactcacatgcaactcaaatatggtctaagacaacaaacatgattctattgaactgcttctccatcgattgggatcacctcgtcggtattctgaaatccacaagctgggtgtcttgtttttgcatcacgttacttttcaaagttccctataatgtttgacgagaatgcaacaaccgacgacatggataccttccacaaatatcaataacgaattctgaagtttaaggatttttaacttcagaattcgttattaatcattcacaagttattgtgttattttttataatatatccaatgcaaatactcttttttctcatctccaaactgaagtatttttatttttataaactcttaataaaaacggatgaccacaaatatttctgctataatttggatgataatgaaaacaaaccaactacaatctactaaagattcaaaaatattttctcgaatgcttaaacctcacgtaagtaaataccaaatcaattcagataaaattaacaaaacaaactcaaataaaatctcctaaaaatcctataaataaaaagatgatttcattttttttcttcctattaaatttacattttccgccacacttcatctctcccactagtctctcctcgagactctctctgtatgtgtgcgagaagcgagaagcgagagagagagagagagagttgttagctcacacgctttctctattttctcggaattcacaaaacagaaagtttcatcctttacgagaattaagccgaaagaaacaatctttgagtttgatttcttcttccttccttctctctctctgctctaatg

SEQ ID NO: 32951 - DNA, 3000 bp, Unknown
  misc_feature (1)..( 3000): 2750-1469P.txt file - cDNA_ID_3063537; gDNA_ID_1620430; Annot_ID_156817
tggttttaccactgcacaaaacgagagtcagttagcacaaagaaaagtcagtggctactgatgttcaatgtattaacaacgtatacctcttagctgggcgagatttcatttctgattccttctcaagaccaattttatcattcaaccccaacttcaaatcaggcattcccgaaaggaaacatttcattaaaaccttccccgtcacatcacaccgaagaacattgcctaaccgtttccataaaatgcaaaaccagtcatacacagcaaatcaacaagaaagacaacttcaaaaaacttcataaaaggcaattatttacctttagaggacatcagaaggtttacactttccacaatatccagaaacacctgcgtttgagagaatgcaaaatatcatcactaccgcacaacctagccgatctacatacacacagaaagaaactcaacactcacctcattctttttgtaagcaaggccctctcttctccaaccaacagcacctgtaacttgtaatgttgcatttggaacaggtttgtcttttggctgtaatgaaaagaagcttatgaatgcaaacatatctagtgaagaagcaacataatctctatttattgcgggaaatactgcttaacttcgaagaaccacacaccaacacaattacaaaatctgttgtatacacaaacaaatagatgcctttaccttcgatgaaaatggtgaccgtacaccttcctgagtgatataaagttttaaaatttcaggtgagagattttgtggatagccaaagtccataatctctgcaattcaatacaaaatatcattcattggtgttaccacaaaatagaataacatataacgactaatgcaactttacaagtgataagaaagtgatttgatcatgaccctatcaggcttacttaccatccaacaattcataaatcagaacaaagttatttctaatagcgtcttcatcaaaagctccaccaaagtatgatttgaacaaagctacagcctgaaaatgtgaatcaaaagcagtatgtgtatagaatcaatctgactctcttgaaatttgaacaagaatcaaaacaattgtggaatattaaaatgaaacacaaaaacaagtttacctcaacaacaaatttgaatccacaagcaacattagcattgctactgacaacaatgacgatgtagacattgctgattcgcatataaacaaaggagcagccaccaatctgacgcacaggacaattccctaactctttcgtctgcattatatgcgtacgaaatgcatccaccatgtttcccctaagtatcaaaatcaaatcaaaattttaaaatctcaaatctcacagctaaaatcctacaaagtacgactacttagaagcgataagaacaaaacatggagctgaaaatgaagccgaattcaaaaaattaaagagatcgacggtgaagaaaaggagaagctctcttacccgacgtcatctcggtaggtgcgatttatgagtacatcgccacggagattcagaaaatagatggcggaagcagccaccggcatcttcgatctgagattcgaaacgcagatcggataattagacgatctggttacaggagatttgagatttgaggttcgacgagatctcgacgacggagcaaaggaagaagacgacgacgaagaagttgaacaactgaaatgcgatatttttttaatttcttttttatcaaaaaatagaaacaaaattgaattcagtcgtcattttggaatgggccggtcttattcgattctgggcctgtgcgtctcaattatgggcctgtagtacattatatccttcatcatttttaattgttgtttacatatgaagaatggttaggtaacaaacaatgtatagaagttcttaattttcaattattaacactaggtgatcacctgcgctacgccgcggtattttcggatttttttcgtattgtttaatttaaatataatttttatttatctaattattcacttatacaataaacaattccttttaattttaaaaatattttttctaacaacattctcaacaatgcatcatacacataattcataaataacgtttgtattaaaccaacttaagagagggtagttttggattctagaaacctaagaatttgatgatggagctccttacgtattcttcaacctcaatgatttattgtataaatataaatttaagagaatataatatcaatttaagaaaataacttactcaaatcattaaataatccacgactattatatactcatactttgagtttggattacaaaaaaaaatcttcgagtatgagaaaactattaaatggttttattgaaaaatcatgtaatattaaaataaatttagtaatactataattaaatatgtaaaattaaataataaatatatcattaacttataaattagaagttgaagagcttacattaattacttaatagacacatggcaaatgctaaaatgatgatgtgtcaatcatttggagagagttagccaactttcatatatatgattaacacgaaacttttcgaattttttttgttcaattctctctgatgtcagtgatgtgtaaaagtaaaactgtaaatgatcgcaatttttttttttgttcactcacgagagaaaaaaaaaatgtggaatatttatttagtatattaatagaaaccgcgccgttaatgataaaaagaagatcttgctcgatccgtctttgatccaaaaaaaaattcatctttctataatttgttgcagtgcataagaagattaacacagtgttcacgagagagagagattaaagacagagatttctgggttttaacagtaggaaatgaatattgttggattaagaagcgatcggagaaagtagcaaaaatcgggagaggaaagggatattcgaaaaccctaattttggaagatcattcatttgagagaaaagctgttaaatttgagggctttagatcgaatttgatatctggggttaatg

SEQ ID NO: 32952 - DNA, 3000 bp, Unknown; identical to SEQ ID NO: 1651
  misc_feature (1)..( 3000): 2750-1469P.txt file - cDNA_ID_3063547; gDNA_ID_1620431; Annot_ID_156859

SEQ ID NO: 32953 - DNA, 3003 bp, Unknown
  misc_feature (1)..( 3003): 2750-1469P.txt file - cDNA_ID_3063567; gDNA_ID_1620431; Annot_ID_156863
aaaattgttgttatccactggaaaaggtgcgtctgcttcttttccatctttataaactgccaaacccgtggctttctgtgcatctatgtcttccaagcaatctatataaattataaacgcatgacatcatggaactaagacgcaatatacatttcttgattggtttacataaatgtaaaatcaaagtaaagcggacacagaccttgaaggccaagtttagaaagcatgagtcgtccgccaggttgcataaactcacccatcattctttctggttctctcatgtccctctcgatcacatgtactcgacgcccatcctatagtcggatattagcataggaaaatgattgtgtataatatttgtattcaaagccgactctgccttaaggtattttttcctatattcattcggtccctttttgactaaaatgttctcgtagacttgtaatctagtgctagaggtattataacgtggacgaaaaaagttctagagttacacatctcctaactcaattctcattagttttccttttaaagattcctaattattgcgctttaatttgttcttatatccttaggcgtttttcaattcttagagccgattttgattgtgtcatgcaaaaacaaaatattgcaatatctatcttgccaaaaaaaaaacatacataatgtgtataggttttatcctattattaatacggagattttagtacaagaaagtagttaataaaagtgtgatgcagatttaatatttggacacaaagctatgacgccactttacataccttagcaagagcatatgcgagagccgaaccacctacaccagccccgacgataatgacgtcagcagcaccgtctttttgatcctcagccaccgtatcagccaaatccgtcgccttcttcttcatgttggtaaggtagaacaccgtccacgtcagcacgaaggcgactaacgtccataaacaaacgtgcgtaaaagccatatataaccaaatctatttgttctcaatatgatttatgagtttttaaaaaaaatggcttatgagatagttgtggaaagaggagtgacatatatatagttcaaagatatgtcagtttgaacgtcgcattattaccacatgctcgttatcataatctcggctgtcaaagtttgacataaaagaaacgataagtttatatcagataacaaacagaagatattgaccaccctaattaatgagtttttgttactatatagaacaagcaaacaaaatgcaccactcaaattattgacattttgactattttaattcatttaagagtttcaaaaatctcaataatttgctaattatataaaatgtcaagaagttaactagatgttttagaagagagatgcagattcggcaggcggttcttgggaggatcttggagagcaaatgtacagggtccaaaataattttacaaatttttcttcacactttagggtctttcgtttaaaatcatctttattgtaggcttaaatatataatagtacagaacccaatattctaatgagccggccctgagagattcgatacttggaccgattacgaacaatgggaagtgcataggcgagaggcgagccgccaacttcggctccaacgatgatgacgtcagtaccatggtcttttctcatctaccgcattatccacaagtctgttattatcttgctccagatggctactagggaaaatgtccaagtcaacacgatagtttagtagcatctatcactacaattaacggcaaatccatatctataagggtttagggtttaggatttagtatttgcctgttactttagtctttatatggcttttaagagaatttacaaaagcacaaacgtgacatcatcacatacatgattatatccaaacttctgataaatcaaaaagaaaatcatagtgaataaacacatttcacaatgaatgatgtcacttcttgtttcgtgttccgtttaatgttgtttctatttttgtcaaaggtcgacgtaaaatatcgtttcgccaaaaattgttggagactaattcattttttggctgctttccatgaacaagtcaatataatcctcaccacataactttatcaatgattgtgattcggtgtccatattttcttcatatatatcttatctacacataaattcactatcgtcttaaagttttcttcttcacatttactctgtcttggaaatatagagttattgggagggaagtcaaaacaggaaagatcaagaaactaaacactgctcctaagaaactaaaataaaataaaataaaaattcctacatgcaagataattttcatagcgttagacgccgtacggtggcagacttctagtcttgttacatcaccgtcaccctctgattttctcgtcgtccagtccaccgtcttcaaagaaattattatgacttcaagacaaaacttctagtttccaaaaaagaaaagaaaagataagagctataaacgagtcagtgtacttaaataaacgagtcagcgaaagaatgtagcgttccaatatattaaataaaacaaaattatattcatatacccttatgaaaaaagcataatacttcattatttgatgctcattgctcatctcatacacaaaatcagattcataagcaaaggcgacgacgatgaagaatgactaaataagttgaaggagtcgtctccatgataaaccgtaaccaaaccctgcgacattctattgtatgtgtatcttttttttctttttttttggtcataattgtatgttttttttgtttcttggcattgtcactgaaaattataccttttcatttttgccttctaaataacccaattgtgttactttacagaaaagcccatccaacgattatttttcttcagcccattagcccattaacttcaggataaagataagagctacgttcaactctatggtcagaaaaatcagagaaagaaagaaaacagagcaattacttgaagaatccataggaagctgaagatg

SEQ ID NO: 32954 - DNA, 3003 bp, Unknown
  misc_feature (1)..( 3003): 2750-1469P.txt file - cDNA_ID_3063577; gDNA_ID_1620432; Annot_ID_156884
atatttgttttaaattttaaaaggaatcatggaagcaaattgaagactcattataagattgttcgtcttgtttgagcggttgtagaaatagatttggggaacttgggtttcatttagaaaacaatcctgattttcttttgattatcctcaaaacaaagtcgttttagggatactaatagagtcgttaacaagtgataatgaatgttataagttcttttaatgaatgatgacaacatgtttattttggcttggtcaacgaacttctcatgttttaaatggtagtcaacgcttagttcatgtttaaaatggccacatataaagtcgatgtttaaaatagccacaatttaaaacttgactaataaagtcgttaacggatgataacggacgttagaagttccgttaatgattgataacggcatgtctattttggcctggtcaacgaataatcatgttttaaaagttagtcaacgtttagttcatgttttaaacggccgcatacgaagttgatgtataaaatggccatttttttaaagttggaggattaattgacattttgaaagttggaggatttgtgtgtgtgtttttaatccaagatctgcttgtttatctgaatcactacatttggtattttattcccatattttatagaaatgtattggaataaattcatattttttcctttaactataatctcataatatattagattatttaatttctttatttgtttttttcaaaaaaaattaatgaaggatccgaatcacagatattcatttaattgtaatatttgttaatttactaaattaccctcacaatgttgtagttcacaaaatgcttcccaatttataatatatatatatatatatatatatatatatatatgttttttagttattatagactacatcacaacttaagataaagactaagacttttgcatcaagcgaacaacaaaaccagaaattatgcttaattaagtgtcagtgatcgctatataaacaaaactttaaatctcttacgattcaataaaaataaggaaacttcatgatacatcacaaattcccctaactctaattataaaagaatatgagtaaagaacatattccaaaataaaaaatttaataataacaaaatatataaaagacatattatttatttttttctagttattatagaccacatcataacataagataatgacctctgcatccaaagcaattcacaacaagaaactatatcccattttgggatttacttaattaattatagttacatactttatctcgtatgcttacgagcccaaaagaccttcccgttgatccgcagctttactgaatcattttctgataaagaccacaattttaccgtttcccaatggttgagtacgcgattcatggtagcgaccgagtccaagaccagcttcgcaaatagtgcttgctcttgaccatcgtcatgttgcatgtcaatgccttgaacacaattttctccatattgttcggtgaaacattgcttgatcacctcttcttgcgacataggaaccccacgaggaaacgttatatacaaggtccgttcgttagcatccgcgatggagttatccccaacagagacatcatgcatcatgttgatactcacggaagtcggatatagggaatgatgggaggatggtagagtcttgtgacaggaggatgagagggtggtggagtctgttgatagaggttaatcaaatcacacatatatatgcaggaaaattgtaaaacaatttagtaaattatttgtactatattataactggagtaaattataatatattataactataatttggatactatgatttttttcttaattaaagtggtcaattagaaattgtcacacgtctctatgcatttgtatgcaatgtctttacatatgatatgggcatatttatgatgtgctttaaaaaaagaaaactatttatggtgtttctttttatcacatatcctctttattcatatctaattggattatttcatgtttttatttattctctaattttgtgattttgttataagaattgctaaatttatttttgaataacttgtagaatttttaaccaaatttggatgacacttatggttaaaaaaatatgatatttgatttttcttttgtttcttttgaatatcagttattaccattaatgtcatccaaatttatggaaaaaaaatctcaacaactatatttacaaaaaaaaaaattaactatgaaaaaacaattttcctaataaacaaattttgaatacattatcaataagaaattgtcacatcaatttcgccatttattaaaaataaagaatatgtttgcctaaaccaacatatatatatatatatatatatatcttattttattttcacatcaaaactaataaaagttggttttggcacttggttcgtcgagcttaatagataaataaaattgaataaattaatacttctttttatattctatttttttatagagtaaataatttttctagatatgactgagactacatcttatgatttatttgacacgtatcacgattctgtgagttagcaagttcggtaaccaaaatttatataataaaatgttaccatgaaacatgaaaatcaatataatcgcattaactaattatctaaatcaataaaaacattgtaccgaaccaatgatttaccaaattgaaatcaccgatttaaaccgataatcaaacaaacaaaaacatctttaaccgatccggttattgtttgttatcatcaatattgttcaaaggttaaagacgaagatatctaaagcccgtcgacatttcatttccgacagcaaatttgcgaagtcaaatcgcgtaatcaaacttcagttttgttccgttttcgaattctccatttcgtataggagatctccataaaccctaatcccctcagagtgcatctaacattcgattgtgtttttctctattcaaagaagaaattttcatggttttctaaagcgatg

SEQ ID NO: 32955 - DNA, 3003 bp, Unknown
  misc_feature (1)..( 3003): 2750-1469P.txt file - cDNA_ID_3063581; gDNA_ID_1620432; Annot_ID_156881
gaagtttggagaacggatcctgttgaaggagtctgatcttctaccaaagaaacttaagaagaaaacaagaagacgtgtcgcctcaagcactatgaacacaaataagcagttggtctgttctgcggactggcaaggtccaccgccatgggactcatctttaggcggtgatggctgccctaaatttctattggatgtgatggtatttgaatcaatttctgttttctgttgctcttttgtttcttggttttatttaattagaggacaagaatttgatttcacctatttagtatctttgtttttgaatctaaccattttcagtagaatccatgtggtatcataatcagtttcttgtaaaactactttataggttgaaggtttggcgaaacatctacgttgtgtggggattgatgctgcaatcccacactcaaagaagccggattcaaggtactttatcctaaagctgctattaaagtttttctgtgacatggggttttgatcacaatatctgtataggattgattttctaattgtgatgttgacacaaatgccagggagttgcttgatcaagcattcaaagagaacagagttctattaacaagagatacaaaattgttgagacaccaggatttggcaaagcatcaaatatatcgagtaaagagtcttcttaaaaatgagcagctacttgaggtacaaacaaagttaattttcaacgtataagctgttatgcaagatctgtgatgtggcatgatttggtttactagatttattaatcaaaaaggacacataccctggaaattttgctttaaagaataggatctctcaagacactagttaacaaatttatttttaaccttactttctgggtggaacattttctacactacctgtaattatggcatgcttggattcaccgagccaaaataacctcgtccactcactgtgcaaccacttttcttacattcagtagaatgattacggattttttgtgaattactgaaacaaataagcttcgcaggtgatagagactttccagctaaagatcagcggaaatcagctgatgtccagatgtacgaagtgcaatgggaaatttattcagaaacctctaagcattgaagaagctattgaagcagcaaagggtttccaaagaatacccaactgcttatttaacaaaaatttagagttttggcagtgcatgaactgccatcaactatactgggaggtaagtcacctaccccatcttttgccgttgtgcattatagttcttgaacgagtataccttgtgtcaaaaaatcatctggtccatctatgttagttgttttgctgattgaacagtcaaattttagttgcctaacgatatttatcaaatcagtgatccaattaatatttgtatgaagtcttagttggtgaattgaatcttgatttctttaaaacatcttcatgtgttcatgtcttagagcagaaatcatctccacaagattcataacttcctatatagctctgatctgttctgtctctaatagtcagtgtccgacatatttaatgtttgttatgtggtttcagggaactcagtatcataacgcagtccagaagttcatggaagtatgcaagttgagtgagtgattcactttttttttttttttttgggtttttacaattttggtgaagtgttcaatctctcgttacctcagttcctcaaatgtttttattttatatcaaacgtctctaagcaaacaagatgtgtttgtaacttgtgtcgtttgcacacatgtgttccagaggttattaaccgtgtacaaatgttttagtttgttttacaaagttgaacacattactatcttatgagaagaatagacttgtagtattttctatttaccagttaaattcttgcataattttcaaagtggaatattattttcaatatgctttcttgagatgatggcttttctagccgtagattcatgcattttaaatatgatgatataccaaatttaggtattgtggattggattggtctagttcattagttaggcaaaaaatttaacctcatcaaatcaacattacctctcttcctaattttctccattgaattcttgttcaaccattttttttctttcactagcaaatacggtgatgaactcgaaaatgatatctttgcgacagatgaattaaccggtataattggaaagcgtttcttgagcatcagtgttcctacttgaggaagagttgtcttgtagacctaaacaagagatcaattgccccaacacgaaactatgtagatcaaataagtatttagttcactcttctttgctcacttcaaatatgttttagacttattagaaaatccggtgagtcagatattcgacgggcacattcacatcggaattaatagtttcatagggtgttgtctcttaaatttggaccgaccggttggattgcctatctgccgtataaagaaaataagacaagagaacattaatttcatggttgaaccggacggttcttggctaaattgaaccgaaccgattgatttcagaaggtatgtataactttttttacggagtcgtcatcactttctctgctcgtcggcgaagttcacattcaccggtcgtatagtgtcttcgtctccttcctcgtgaaatttgttcatcacagtctctacagtcaccaccataggaggtcgtaccgccggatcttcgccacaccattaatttctgcgttctctcttctcaattcgccgccgatctctctgagcgtaattaccaaatcgtgcttaggtatgtcatcaaatcttgtctcacaccttccaattcatctccatgcactaattcattaagtaattagtcaagggtttaattcaaactttatggttaaatcgacgagagtgctgatgttttggggttagggtgtgaagaaaattatattgattctctctctctctctctcctgctaattagatctccttctcctagaaactgctgtgaggatcgatctcgattgatcatg

SEQ ID NO: 32956 - DNA, 3000 bp, Unknown; identical to SEQ ID NO: 1668
  misc_feature (1)..( 3000): 2750-1469P.txt file - cDNA_ID_3063599; gDNA_ID_1620433; Annot_ID_156913

SEQ ID NO: 32957 - DNA, 3003 bp, Unknown
  misc_feature (1)..( 3003): 2750-1469P.txt file - cDNA_ID_3063602; gDNA_ID_1620433; Annot_ID_156912
tcagttgttgatttctcgattccagatctattaactccttcatcgtcttctgctctccatcttcgatttcttcttcaacgagcttcttaccctcatcatcttcttcttcttcatcctctatcaaatccggtacaatggggaatcgaatcgagctctttagcagctcatcatcatcatcgtcgtcgtgattagacctaacatcacacgatctgcgtcgtggctggtccaaaacagaagcggatgcgtcacgaacagagtaggagcgaacacggcggagctcagtggaagctgagacagaggaagatagagcttcgatggtagagagacgttcacggagacaggtggcacagaaaccagtggtgggtttggaagaaggatgacggtgacagacggcggagtgacgacggcgacgacgctgatgggtttggtgggtcatagctcacagggggtggtttgagttcagtgaatggaagaagaagagagtgaagttgaagaatctgtcagtcacattttcaggatctcgagaagaagaagagaaagagagtcaagagtggcgttgtcaacactacactaaccctttccctttccttaaaccttttctctcgttttattatttcttcattttaatgcgtattatatttatttctgtactttcttatagttaatgaaaaatacagaaatgagttaatgaaaatagagagaaaataatgttatgttttttgtacaaaatatcaaagaaaaaatggtataattgtgtcacatgagagtggcagagagaatcaaaaggaagaagtgtacaacacatcccataatgggtctgacctctggtatttgtaggacgaacataaaagactcttaattagtgaaaatattaaaattaaatggatagacctaaaagattgaaaatggtgaaaacacgtgtgccccatttgttttcttttaccttgggtggtaatatttggctgcttccgtcatttctttggattcccttcgaatcgagaaatagcttcaatgtcaacttttatttattcttctttatttggtttggatatattagagttctgattagtggagtgatttttaccaagaggttgtttagtgcaacaagatgtaacatttgaacaacacgctttactttttgatgcaacgacataaactagtttttgaattaagtgggtttgttcaaatgttacatcatttgttacctgaagtgtgttatcattcaaaacaatatttcattgttatcgtgaaaacagagaaaccactctttacaatggttttaatagattttaactatgacatttacctaaaataaaggagatttattttctctaaacgtttgtggacagcaatggctgacgagtgacattgagattcggagttacgacaagttcccaaagagtatgtgttcttttattaaattgaaaagaaaaaaaaaaccatagcaggtcccaaaaatacacagtagtaattgtttttgtctcaatgtgattgtaccggttttgttttctttctggtaaacaagattggaattttccgacgactttgtccaccacagacagaagcaaagtttagttttacagtgctcaatcgaaacgttaaagaaagcaactgctggcaaataaaaattttaatatggtaaaaagtaattaattattttgggctcaagattgtaatttggagcccaataatgttagttgggcccaaaaggaaacaaataagccttttaggattttggccttttcttgtgcaactgtaataacgaatttgccactcggaactttgccgtcgtcatcgtcttcttcgttcatcttctaccggcgcaaagaatacaaattaaatatcgctgagaaatgtgtccgtgagccttgaattccatgggaattgagtatttcaggttattgaagctagcttccttgtcgaaataaagggcatgttccaagttttgtatatcgtatacatcctttctgctctctttatattgggagatcgatgagatcgaccctaaccgagtcgatttggtttgggtcgatctcagatatctcccaatactttacaacatacatacaactggagaaagaaatcaactttttgtttgtcatagcaggtcagtctcattgcttatgtagtttacttttcggtgtcttactattatgcaccgtttagatgattctgtggcaaagtagtttgtacaaaagactcatctttcatcttaaaaccgtttagacggacctcattttacttgttggtggagatcatgcatacaacttgcagctttaaatacaaccatcactgttccttgtcaagagaaaatcttgcgtttgtctcctctttctgattctctactggatagaataaaagaatcaattaaacatttccttgttcatgtatagaaggtgcaacctaaaggcttcttctacattagatcctctagcgcagaggtatggattccgctgctcatatcactccttgagttgtaactgctttctcgatgagtataggatttgcatatagttcgattaagttttagttttggattaattttgactctgttacttagagaagagaggagatttcaaagacatgttattagttctcttttcttattctccgtcatccttagactataaaggttttaacatcaatgagtcgttttctactctcgagtcttcttgtgtggaaaagtcaaaagtatacaaaatactcagaataccatcatttgttcattttcattgactatgaaaatagaataacagcaaaacttgcaagaccaatcaagctctttgaatcggtctacaacacattaaagaacatataatttatatttctattgtatgtacagataataatggatcattatgcttatattatatgcacaaatgtatctggcgtttaacaaaaggaataagaaacatacatgacttcaacaaactttatttcttggaatttggacatctgacataatattcacttctttcctataaccatgtctatagacacatg

SEQ ID NO: 32958 - DNA, 3000 bp, Unknown; identical to SEQ ID NO: 1669
  misc_feature (1)..( 3000): 2750-1469P.txt file - cDNA_ID_3063608; gDNA_ID_1620433; Annot_ID_156907

SEQ ID NO: 32959 - DNA, 3003 bp, Unknown
  misc_feature (1)..( 3003): 2750-1469P.txt file - cDNA_ID_3063620; gDNA_ID_1620433; Annot_ID_156901
taaatattcttcaagaggtcaccggagaaaggtgtggttttattaattcattctctaatctatgattggttataattagtttacgttatgaggattataaaagtgatatacacatatgtatactatagttccatagaaggtcgtttggtgagaagttacaagaggagtttcaacggtttctcggccctactcactgagtcagaacgagagggagtagccggttagtgttcttagatcgagacacattttatgttgaaatgtttttaaagatttaaccatttgaaactcttttgtgttgttagaaatggagggagttgtgtctgtgttccggagtaagaactacaaactccaaacgacggcgtcttgggacttcatgggaatgaaggaaggtaagaatacaaagagaaacttcgccgtagagagtgatactattatcggattcatcgacagtgggatttggccagaatccgagagcttttctgataaaggctttggtcctcctcctaagaaatggaaaggtgtttgtaaaggtggcaaaaactttacttgtaacaagtaagtcattaaaatttctctaatagaagattagtattgttttaggcagagattgatgtgttcacaatttcagcaagttgatcggagcaagagactacacaagcgaaggcactagggacctccaaggacatggtactcacacaacgtccacagcggctggaaacgcagttgcggatacaagcttctttggaataggcaatggaacagcgagaggcggtgttccagcctctagagtcgcagcttacaaagtctgcaccataacagggtgtagcgatgataacgtactgtctgcgtttgatgatgcgatcgcagacggtgttgacctcatcagcgtctctctcgggggagattacccttccttatatgcagaggacacaattgcgattggggcttttcacgctatggccaaagggattctcactgtgcactcagccggtaacgctggtccgaatccgaccacagttgtgagcgtagcgccgtggatgttaacggttgcagcaaccaccaccaaccgtaggtttttaaccaaagttgttcttggaaatggcaagacacttgttgtaagtatcaagtaacattctcattttcatcatcatagtatctttgtcccattaaattaccaattgggttttcttaacaggggaaatcagtgaatgcttttgatctgaaaggaaagaagtatcctcttgagtacggagattatttgaacgaatctctggtgaaaggaaagatcttggtttccagatacttaagtgggtcagaagtagctgtttcattcataactacagacaacaaagactatgcatctattagctctcggcccctctctgttttatcacaagatgactttgactctctcgtctcttacattaactccacaaggtacctagcagtcttctttctatttcattactcttaatattctccttctttgtcctctgatacccttgtgtttgctttctcaggtccccgcaagggtctgttcttaaaactgaggcaatctttaatcagttatctcctaaagttgcttctttctcttcccgcggtccaaacactattgcggttgatattcttaaggtatcatattatttatgctcttgattctttctttttttttcctggcctgagagacaatggttggtggatggattgcagccagatatatcagcaccaggagtggagattctcgctgcgtattcacctttgagtttaccatctgaggacaggcgcgataaaagacgtgtaaagtactctgtactgtccggaacttctatggcttgtccacacgttacaggcgtggctgcgtacatcaagacatttcatcctgattggtctccttccgtaatccaatctgccatcatgacaaccggtaaacaaaagtccaacttttactttcttgcatcgcaagtaacgtgtgttgacaactctgttcttatactgtctcttaatgaatctttgcagcttggcagatgaatgctactggaactggggctgaatcgaccgagtttgcttatggagctggccatgtcgacccaatagccgctataaatcctggacttgtctatgagttgaacaaaacagaccacatctcctttctctgcggcatgaactacacttcgaaaacccttaaactaatttcaggtgatgccgtcatttgcagtggaaaaacattacaaagaaacctcaactatccttcgatgtcagctaaactttcggaatctaatagctccttcaccgtgactttcaaaagaaccgtcaccaaccttggtaccgccaactctacatacaaatcaaagattgtcttaaatcatggatctaagctcaatgtcaaggtttcgcctagtgtcctttctatgaaatcgttgaaggaaaagcaatctttcacagtgactgtttcgggcagcaatatcgacccaaaactgccttcgtctgcaaatctaatatggtctgatggaacacataacgtgagaagccccattgttgtgtatattgatggttactgatgaggcattatcagttcaccatagttatcaatcatcataacattttgctatacatatatttcttcaaaaacatgtctactccatatacgttttctgattatgtcatcataatgcaaaatgaaaataaagtactaaacgatcgagaaaaaaacagttgtaaaaaaaaaaaagattttgattaaggagttgaagaaacaaaaacaaaattgagttctaaatagatgtgaccaaataaaaagtagatatctatttcctaaaaatgtatttggtcaacatacgatacttctagttaccaaaagagttttgctcaacatacaatcacagcatttgacagaaatatcattaaaattactaattttatactagtgtataaattatatcatgttgatctcgataaaaactgagaaattagacaacctttaattcattttataagaaaaagatg

SEQ ID NO: 32960 - DNA, 3003 bp, Unknown
  misc_feature (1)..( 3003): 2750-1469P.txt file - cDNA_ID_3063628; gDNA_ID_1620433; Annot_ID_156899
cacggtacacacacagcatccacagcggctggaaacgtagtcgagaacacaagcttctatgggattggtaatggaactgcgagaggcggcgttccagactcaagaatcgcagcttacaaagtttgtagcggagcaggttgtagctcggagtacatactatcggcgttcgatgatgcgatcgcagatggtgtcgacgtcatcagcgcctccctcgggggagacaccgcgtacatgtatgaaaaggacccgattgcgataggggcttttcacgctatggccaaagggattctcactgtgcagtcagctggtaacaatggtccgaatccaaccgtgagcgtagcaccgtggatcttaaccgttgcagccagcaccacaaaccgtaggattgtcactaaagtcgttctcggaaacggcaagacacttgtcgtaagtaccaagaaacgttctcatatctatgatcctagtctccttctcattaacgatgtctctttttttttataacaggggcaatcagtgaatgcttttgatctgaaaggaaaacagtatcctcttgtgtacgaaacatcggttgagaagtgtaataatgaatctctggtgaagggaaagattgttgtgtgaagttatgcgattggttcacaagtccctgttgcattcatatttagagacaaaaaagagttcgcctctgttcaaccttggcccgtctcttctctatcactagacgactttggctctctcatttcttacattaactccacaaagtaacgaacaaatcatctccatgtttcatactcttatcatgtggtctggattctcattctttgtcttgatatctttgtgtttatttatctcaggtccccgaaagcgactattctaaaaagtgaagcaatctttaaccagacagatcctaaagttgctggattctcttctcgcggtccaaacactatcgcggttgatattcttaaggtataacatttgtatgatgctacctaattctctttcgtttcccagcctaagagaaaatggttgattgaattgcagccggatataacagcaccaggagtggaaatcctcgctgcttattcacctttggtttcaccatctgcaacaacgttggacaataggcgtgtgaactacactattacctcaggaacttcgatggcttgtccacacgtttcaggtgtggctgcgtacatcaagacgtttcatcctgaatggtatccttccatgatccaatctgccatcatgacaaccggtaaacaaaagtcatatacatctgttactttcttgtagtacaagtaacagttttgttgattactctgttcttattatttactactctttgcagcttggccgatgaatccttctggaactgacgcagtatcaaccgagtttgcctatggatctggacatatcgacccaatagcagctataaatccaggactcgtgtatgaattaggcaaatcagaccacattgcctttctctgtggcttgaattacaatgcgactaccctaaaactcatcgccggtgaagctgtcacttgcactggcaagaccttaccaagaaacctaaactatccttcaatgtcagctaaattgtcgaaatctaaaagctccttcaccgtgactttcaacagaaccgtaaccaacgtaggtacctccaactcaacatacaaatcaaaagttgtgataaatcacggatctaagctcaaagtcaaggtctcgcctagtgttctatccatgaagtcagtgaacgagaagcagtctttcacggtgagtgtttcaggcaacgatctcaacccaaaattgccctcgtctgcaaacctaatctggtcagatggaacacataacgtgagaagtcccattgttgtttatactgattatgcatcatcagttgacatcttttaagtttaaaatcaaatttcccattgttttatttcatgacatctcgtttagtatacattaggtttaagatgaaagaatagtaagtactgtaactcattttgtcattgaattacaatattatgttattggtttattgattctacacaaaatctaatcatcaaattattgtatcttgaattcttgataaggtattctaaaagcctttgagaatctacaagcaaaactaatctacgagaatatgcaaaactctttggcaagcatcgatacataccatttggagagaacgcaatgagcgtaaacatggtacaagacccaacccatctagtcgtcttatcaaatggattgatagacacattcgcaatcaactttcggctctcaaaatcagtggcgatcagaaatacaacaatggactccaactttggtttgcatcaaggaggatacattgagaacagtacctaagagtttctttttaaaattttcaaaacttctttaaaaattgttgtacttgttgtaaaaacgttcagttctctttttgaatctaatttaacattaaattcaaaaaaaaaaaaaaaaactctttagcaaaactgttaccaagacgattgaaaagcgattccgctatatattacttgcgttaaaatataactagaaaagacataacatgattaatccacttaaactcacttttcagcgttttataaaaattctacgaatattttatccatttaagttcgttcgttaacaattattttgttattccactatttatctgacattaccactcaaactcaaagtaataatgtaataccaagtgttattgtaataacaagaatcaaattttggtcaatatacaacgatatataccaatttcctatatattgtttttggacaaagccaacgatatataccatttgatccagtcatccagttatcatcactaaaatctactatagttggtaatggttattcttatcgtaatttacaaataaagaaacagaatcacaaggatttcattggaggattttttccttgaggcatgagtcaaatatttatacataaacaaattgaaagtttgtttcattgtcttgaaagaaaaagatg

SEQ ID NO: 32961 - DNA, 3003 bp, Unknown
  misc_feature (1)..( 3003): 2750-1469P.txt file - cDNA_ID_3063665; gDNA_ID_1620434; Annot_ID_156954
ggggcctcgggatttttgttatccgcgatatacctaatggtttggtttgctattatcttgagactcctaatgaaagcatcactcatggttaaaatgtaaatctatctctcactatcttcacaggtcgacgtttatggatacaaacgagcaagccttgtgttagagtggatgggaatacatgccttaccgatttacgttctcattgcttgcaatcttgtctttctaatcattcatggattctactggaagaaccccattaacaatctcgtaagttttactttcgtttttttttttaccgttattaacgttttgtgttggagttcaaaaatgttattgttgtttgcagcttcatttaatcggaatcggaaagtaaagaagagaagagaagggaggtgaagaaataagtttcatcaaccaaaaccttaattgtttttgttagaaataaacaaatgccatcttcatcttcacatcccatatggaatccaatttatgctatacttttgtaaacatacggtatatcgtagaaaaattaaaacttcatggctatataagcaaagccttttgtcgaaaatacacatgttggcaagttgtgggagccaccaacataagcatattatattcaaacaaatgttcaatcgcacatgtgatggtttagcgatttagctaccgcacaactgaatcaaaagacttgttaaattgctctcttagtcttatcataccttcatctcatatccattataatcatctttagcaatactattttatttttaactacgaaaaataaaccttgttacgccgttattaacagtgatcatttttttcgttaaagaaatttaacattcaaaaaagataaagaatgatcaccaataagcgtcatgatcttccgtatggtgatgataaacatcgtttgcagttttgttgtatagtacaacgtatatgtagccgtaacgtgtgaatagtgtatggttagggtcattttatttgtgaactaccacaattttgatagcagtggagataagtcaaaggttcgtcttctaattaattaacagcgattattagactatctaacttttcttcttttcttattttgataataactatatatcttctttagccaccttactttctcatcgggttctatttaaatagggacaaagaaaacaaaccatcgatttgtactatgtgctcaattatatcatatgttttgtctccatctatgtatctatttctcttttccatttggtaaattatttaagacccttaaactgacttttctcgtgggcggcgtcgaagttttggttaacagacaaaacatctgttcatgatgcctgcataactctatgtttttatactactcatttgccctctatttcatgctactcttaaaaatagctaaataaaaatacttcaatattagaaaaaaaatcttcttgatgtcaaaaatacactttagatatcccctctagttcttgtgatgctaatatattacaaaattgtttatatatatagaaatattacctctagcaatacaaaaatcttgttatatcaattaaatataacactatccgactagtgtttactaaaataacacataatttttaattatgatctttgaattttagtttatgtattacgctttataattttgttatcaaaaactataaaagctcaaaagtgagcatctataccctaattccgtttttatgcatacacttaggtttatttttattacgagaatctgtgtttagtatatataaaatagagtttatgaatgactaagttaaatacttcaatactaattaaagtaagtcgtattgatgcagacaatataaactttagatatctccgctagtttgtataatgctaatagattcaaattgtctttatgtagaggaattacctcaaataacataaaattttcattttattaattaaatctcattttgtcatttcaaaagtcattttaattactgtgttatttgtctaaagtatactccaaacaagaaaccaaagtagaaggtcagtgcccaagagacaaataaacttaagcatgtccactctttttagcgatcggatcgcttatctgttcttatccattatggaacatgaacgatgttcctttaagactaccacattcaaacgaaaaataagtcatcgatgatagactggatagttatagtttgatgatctagctaattgactttcatatttacataaaacagaaatgtgtttttatcaaaaaagaaaaaagaaaaaacagaaaatgaacaatacatctcacatggagtttgtacaagaatccataataattttttgttcggtacagtaggttagatatacatttgaatacagtttacaagccaaatgttagaagcaacatatttatatagtatcatcaatatacgatccaaaatgaattatagattgacttatggaaaagttagatactatatgcatgattgccaaatacattgaaaaataacaatttaagttcttcaaacaaaagtttataaatgactcggtgtttgacataactcggggttgtttttctttgttaattcacacacggggttggtgtataaatgacttcggtgtttgaaatgtatgacacggtataaataaaaaaggtaaggaagaaatgaagaatagaagaagaacaaaaaaaaaaggaaattaaaaaaaagtcaaaataaatggtcagtaaaggattttgaccagaccggagcggtccatccatagtttcccactaccttccctgatttagcacagaagaatggcaatttgcatgccatttatttcatctattcctccttcactctataaatatattttaaacaaaatcaatttcttccatacacaaaaatcaaacaccttttgagagcggttattttttctctatcaactaatacagtaaccttacgggtgtttatttgtatagatctctgtggttttcttggccaaatctagtgagatctttttggtttctcgaattcgatgaaaatg

SEQ ID NO: 32962 - DNA, 3003 bp, Unknown
  misc_feature (1)..( 3003): 2750-1469P.txt file - cDNA_ID_3063669; gDNA_ID_1620434; Annot_ID_156953
tttttcaatgttccatatccgttttgtgatttatagggtttttgtttcgttgtttcagaacgtttgttgagaagaattacaaagatttgaagtctctaaaccctaaattaccaatcttgatccgtgaatgtagtggagtccagcctcagatgtgggcaagatatggtaaatttgctttatctcttatctctgtgaaggaaaattttgactcaaattgtttaatttttagagatatgaaaattaattgtgctcttttaaagatttgatatgaatgtagttacatatgtgacttcttctattgcttctgcattcatattttgtatggaggtgtctttataacatcttgtgttcacccattatacactcactatcgagccttgtacatcttgtgatgaaaatgtttcttgttgtgtttgatgtgaatgctgaaatttatggtttatgggattttctaatgtgggttgttctttttctttctcgcgattctgtttgttttgaattttctacagtgttaaattttggtttgtttgtttttaaaaaacttgacatgaatgtggtcattggtaataacagatgtggcttctttcttttgtttctgcattaagttttttagggaagagtcttttaacactatgagttaaccaattacacttaaagtagtacactcacactcacccttagagtcttggtcattgatgataaggaattgtgtataaccgctatgtatattggcttgtgctttataagatgaggattgttttcccttgtcccttgttgtgttttatgtgaatgccaaaatcttatggtttatgtgattgcctactgctgttgttcattttctctctctcgtttttgttttgttttgaactttatggttgtcgcatatcagccttaaattttgagtgagttttaacatcttgagttactcttaaagtacacactcacccttagactattggtcattaatgaaaatgcatattggcttgttcttttgaaatgagactggtttccctagttccttgttgtgtatttatgtgaatgccaaaatcttatggtttatgttatctcattagctgatccattttatatggtttccctgaccaaacatatcagtgtcttcagcaacttaaagtatttaagcatctgtgttgagtgaactttgaacatctttaaactatgttcccacactccgataatgtagtaaagtataatactgtaaatatgagagaacaagatgattctttttctttttggtgataaacttgttttacgcaacagtcatatgcgttaaaattgtcatcctcgattctacttcggaactagtatttataaatgtgtctgtttttgtattgcgttaattcgtgcttggcttgtgcagatatgggtgtggagaggtgtgtaaacttggatggtctgacagagccacagattctaaaggcccttgaaaaccttgtgaaatccggagctacaaaggcctaagtttgtttgtttgtttgtttttctctatatgatcccgaataagattaaaccgcaaaacaatcatttgacatttcctgtcattctactactttgtaactccgtggtgtcatatcgccttgcatttgagttggtttttttgtgtaatccttgaacttggaattaaaccattccgtataattgaaatcacagaaaggagaaaaataaaccatctctgtttaaactttttgttttaggggatgtgggcatgtcggtttttgaccgtgttttccgcaacaattcccggtccgatcagccggttcagtccggtttcaaaaacattgctaagagcgaatcaagttcgcaacctcaatagggtccaatcccaacacattcacgtgcgaagctcaagtgatctctctcaaccgttctcgttaacacgcatctgtttcttttccatattcacaattttacttacataatgtttttttaagtttttccgaatttatattccaaaataaatcagatttgatcttctctatgagattttataattacactacattttataacaaatttgaaaagttctttatttatatttatagtacagtaaaacctctataaattagtaatgttgggactgcgaaattttattaatttagagaggtattaatttatctataaattaatatttatcaatttataaaaagattttcctaatttggtaattttttgaaaatttctacaaaatttctttattatagaaaatatctttctagaaccagttacaagtaaaacataataataatgtctaaaaacagcaccaaaagtattgatacaataaaatatgaaaactatagtcaaacaaataacaaatatgaatttaagcaaaaaaattattataaatatattataaagaaatcttttacatataatatatatatatagttgatacatttatacaattattaatttatgatattgatggaccatatatttacataaaatttttttaaaaaattattatcttattaatttatcgatttgtgtcactttttacactggtcccaattcgggaccagaagaatttattaatttataaaagttattaatttatagactattaatttatagaggttatactgtaatttgaaaacatttttttatatattgaaaatgcaccataatactctttctatttatttaagcattttaaattttaaatatattatttttaattaaattcgtaaattatttattaataataaaaagttaagaaaattatttaatatgtttagattaatcattatctcaaattttgaatatatagaaatataaaatattactattgaaatattatttagatattaattcattaaaaagtaaggaattcaaaaaaaaaatgattatataataagatatgtctccaattctacaaaattataatacaaatttcaaatttctgattttaggtatatacaatctaattattcctcttccatgattcttttacaatcttaccttctcttccgattttagttcgaaatg

SEQ ID NO: 32963 - DNA, 3003 bp, Unknown
  misc_feature (1)..( 3003): 2750-1469P.txt file - cDNA_ID_3063676; gDNA_ID_1620434; Annot_ID_156947
ttcgttattaggcgtgtctaccgcatcaaggagaaccaccaggacgagcggcgggtgctgctgattgcttgttgtagctaacagatagctgatggctttttaggagtcagattgttcttttcatgttgatagaattgacatcttatacacatcactaaatgagctcatgaggaaataaacctcatcctcaagttgcagatatttgtatgaacaatacaggttttatttgttctttggtttgttgtaaatgataaaatatttgtttagtgtccacttttgttcaagtaccttaagactgagacaagaaaccagagcagaggcaaagcgcaaaaagatgcaaagtcttttctttaagcgttaattgataagcataagacacattacaagtaaaggttaagacaaatttgaagtgttgtatatctcccattccattcaaagatcaacaacatttagcaacaaaatattacagtgaaggcaatttgccgcagattctcatgtaatggccaacaaaatagcatccttgtattacatattgctacaccagtacgcatagtgttcatctctcctatggatgctcaccagaccaccgcattgcagacagataaaactgcttccgtcagcaaaggcatcgagcatgatctgtgacctcccacttttttccagaatagatatgccatgagcatctgctgtaactgtttgtttggtaccaaataagtcttttgacgttgtaggctcatcaagcgcaagaggctgtgcttctgtaatggcacactctgcaaatatagaagccagctgatccatactagctgtttcttgaattctacgcttgtatagttcacgggtacggttcagtatctgaagaaccgcctcatctcctccttggtttctcatcgccatcacgacctgttcagaacaagatagactgactcagagaagggttttataaagaaaaaagttcaatgcagtctatatacataaagtgaacgatcttgccatcatacatttccacaaatgcgacgaacactcaaaaactaatcccaattcaacaaggaagatacttttatcattctaaaagtctaaaagaagataaagaataaaattgcaatcttatgataaagaaagagatcattcttctaagatgttatatctgcttaatatgatataggcaatggatgaaggcgatgtgataggattcaaaccagtaaactacttctttattcacatccccaatgaagagacagatttgaccaagggatgtagttgatgctgctgtatctgttggcaactagacgaaggaaatgaatgtaacagatcaagcttatgatacagctataaaatctgtcgttataatggtaactaatgatcatagggatagaatcacgaaacaaaatctatctttgtgattcatcaagcaatacacaagcctccaaaaactagttgttcatccttatgcgagaaaataaatttaacttctaagtagtatttaatttcgattctgtgacttaagccacaaattccaacgaaccctaattctaaagtccaaagatagcaaaaagagcaccaaagcaaaaccgtatagatatagaacaattggaagaagaatgtttgaaatgcaaaaatagggaaaatttcggagatggaaaagaaacctagaagaaatcgaaaataccgcttggagagcttgagatggttctccttgatcgacgagcctacgagcggcggagaggaaatctctggcggtgctgggtttgtcgagcatgaacgtttcggtggagtcggcatccatcatctgcgtctcgggatcactgttcatggcgtaatgcatctgcgaatggagagaatccaaggaaaaaaaaagacaaggagagactagtagtgatgaaaacgccagaggattctagcaacttcttgtctcattccctaatttctccgacaaattatacctcttatgtaattcggaacactttcaatcaaaaaataaataattaaaaactaatctgaacattttcaagcaaaaaaaaagaagaaattcggaacattttcaagcaaaaaaaaaactaattacaaatatatttaacaaatcatggaacatagataatccttagaatacatattcaaaaaaattcacagcaatagggtaaagtgtaaatatatggtcttaattttgtagaacatatcaaattagaatttctgaaacttttagaacatgtcaattttaaaatgagtagaacatctacaatgtataaaaatacatgatctaaaatatttagaatttagacaaaaattagagaacatattctaaactttttagaacgaatttcaactattttttaaaaaaccagttttcgacaaaatcataaattttcttctctaacacttcttcatcattattggtcaacatatgttttctgatctgaacttggcataaatgttaccttctttttcggtgatatattgtgataacctggtattcactaaaaaatgatgaagcgtatagctctagacattgaagtctcaaaaatgggaaaggatcaacattgctttatcatcacaacgacaagatttttccactacttagcaggatttgcaggacaaaaccaatctctgttttcaagattctactttgattaatataaaaacatagctgttggttatttgttacttaacataaggcgttttactcatttttatatatatgagaatgtcaatgatctatccaaataatcaaacaaacaaaactctatttacatcatctagatgaattagcaaatgatcaaataaacaacattcacatgctggatgcaaataccaaatgcaaacgaataggcccttaaaacaattcaagtataccaaatgatcaaacaaatagacccttaaaataattaaagtgagtccatttaggtttgggccctccactaaattatcggaacagtgaagtcctctggtccctctgtattcaccaccacaggctcattgacagaaagagagtgggagagagacatg

SEQ ID NO: 32964 - DNA, 3000 bp, Unknown
  misc_feature (1)..( 3000): 2750-1469P.txt file - cDNA_ID_3063687; gDNA_ID_1620434; Annot_ID_156941
agtagacgaaatagcaagctgtgccatttcttcccagagatcttttctaagaccttcatcatttgatgcataaacaatagaaacaaccatccaggccgtagagccagggagcaagacttcacaagtaatcatttgaagtgatatcgcaataacaaccacctgcacactcggatcccaaacaacccaaatttttcccaaaacagagaattgataattctcagcaaaagaccagcccggcaaaagatcgttgatgaacttcttctcctttggctgtttaacatgagtctctataataccgccaaaaagtggtttatttacttggaaccaatttttaaaaccgcgtcggtgagaaaaaatattaaaaccgcggacattccaacaaaagagcttagtacacatacttaagctggggttttgaggctcttgcctcgaatgcttctacgttgtctctttgacaacacctttataaaaacctcttcttccggatcagatgaaacgacatcagaagaatcttcatccacttctgaattagaatcagaccgctgacccgaaaccttattaccagaatttgaaatgttaccatccagattgataatactaggttcacctacctgaagctttccaagaccaagattcagcccagaagactgagccaaaagtgaccctgaagtactcacgtcctttgtagacggctgagatgaaccattattcttaacagcccaaatcttgccagagacctctttacctttagtggaagcagaggtatcttgaacaaggactggagcagcatcttgcttcggaacagaggcctttttcggcgatctagaccgtcttctgctagaacttcttttctttttcgggccattagttttctgctttggacattgaagcgaagagtgagaagaggaaagacactcttggcaagtaataggggctgttttgcagtgcctcaagctatgcccaattgctttgcagaacccacaaacaggcggcatccatggacttgaaactaagatcctctgcaccgcacccgaatcgaattggacattcaccgcttcaggaagcggcttacgagggtcaatgagagtgaaaactctggccacttcaagattagttttattagcagtagccgggtgcaagaatttaggatcccctacaagacccgctatgcgctgaagcccttcttcatgaaaaacttgaagcggaacatttcttagttcaagccagatcggagctgacgtcaattctggttttgcaggtacaactcctggatcccattttgcaacgaacatagtttggccatctatctgccaaaggcgctgattcaaaactcgacttcgagttgaggagtttggaatgcgaaagagaaacgcatttcctgccatctttgacacaacaatatctctaaaattcttgctccaaataccattcacaatattgtggattgtgccctgagctgggggatcagaatagaactgacccagaacaaagcaatcccacgcttttttgtttcgctcaatgatatagtttggaatattgatgcaggcttcaccagaatcaagcgtgaaagttgtaccttgtttctgtaacggtttggaggatccttttacgagattaacccataagtcagatccatccttagtttcagtctttctggtctctgtgttcggcaaagacgcaacattcacaggaatggaatgattgattttaatcggttcatcatctttctggtttgcctcgtcaatggtcgcgactggctcagttggaattacaactttcacagtggcgtcaacatcttccggcgaaacaataataagctctgagtcgacaacagtggtatcaacaatcagatctgagtcagcaaccaagactatagaggggacagtcaattggttgtcgatggcgttcatcgaataaggagatggcaggacaatgcctgaattctcaactaaatttggcgaagtacttagcttggtcgaaagatccgaagccatgggaatagtagatctagagacagaacgaagagccagctttgaattcgacttcttcccttttgaaattgaggacggagacttcttcacagatttcttcttcgccatggagagagagagatatgaagatgactccgggacaggcaagcaacgccgcagcaaacgctgccgctgcagaacagaaaaagtaggcactttgaatcggagagaaacggaggaggtgagagttctcaccgacggcgtgaggccaaccggaggtggagataatgatacgaattatcgcctaaaaagcgccctcagatctgctcatgagcaaaagatcgttgatgaactttgcttgtttttgaaaaatgttggttttgtgattgagtgtttctgtatagtgctatcaaaatgtttgatgattttggtattattttgagttatatagtaagagataaatcgtttgtactaaacacgttatgtttgatcgtttataataatttcggcatatattaaacttgttaaagtgtatgtttaatctctgtaatttatgtttcttttggtgaaattatctttcccttgcgcgggtaaaaaactcatagctgtattaaataaaacaaactctagttgtattaaataaagcgactaggtgacgtgtcgaggcctgcgcgactgcgtttgccacgtctccgccgcctcctccgattcttttaccctaactaaatttgccgatgttgtcactcatcaccgaagaatggccgccgaaactagcatcaggaagctcccatctctctccggcctccgtcaccgacgtaatccactggaagataatccctacttccacccctccaatggcttctacatcactccttctgacgtcatcctcgcccaggtcgcctacgaccactccgcccactcccaatcacgcgtggcctaccacagggctgggcctcgccgtgagatcatgtacgagccatcagctgtcaaggcggcgatcgttacgtgcggtgggctgtgccctggcatg

SEQ ID NO: 32965 - DNA, 3003 bp, Unknown
  misc_feature (1)..( 3003): 2750-1469P.txt file - cDNA_ID_3063694; gDNA_ID_1620434; Annot_ID_156938
cttcttcttcttcttctgggaattgatcactctggtaaagcacaattggcacgtccaaaacgacaccgttccatcgaaagaggccacattgtgattggtgagcccaattaggaaggcctattttactaatgttgaagcacatgttgtactataaaaaaacagagtttattatctgtttctttggcttgacatgacaaatgtacaactgggagagaaagtcagtccgattgtgttggggatgacgatggcaaaagtagtaaataaggaagaaacaggaggggcgttttcgggagaagaaggaggaatatgagtgtgagttgttgttgtaggaatctgggcaagacaataaaaaaggcaataccttcacatcatttgcatctgagaagtcttggtgggagtctctatcgtcgtcgtatccaaagctcttcaatggagaccgatctcaagtcaacctttctcaacgtttattctgttctcaagtctgaccttcttcatgacccttccttcgaattcaccaatgaatctcgtctctgggttgatcgggtatctctctctcatcagtcagatcccacatatatatccttcgaatgctggctgattctctctttctttgcagatgctggactacaatgtacgtggaggtcagacttgtctacaacagcctctttctctctctctctctcgcttttcatcgatctcctttttttttctcacacttacttcttcttctccagggaaactcaatcggggtctctctgttgttgacagtttcaaacttttgaagcaaggcaatgatttgactgagcaagaggttttcctctcttgtgctctcggttggtgcattgaatgggtataccaatgataaagacttatcctttcaatctctattagtaatagatactctcctctctctctctttatgtcgctatcactcatcatattcattatctttgcagctccaagcttatttccttgtgcttgatgatattatggataactctgtcactcgccgtggtcaaccttgctggttcagagttcctcaggtaaagttttcatattttttgtcacgctgcagtccactagactattctaacacaatgttacaggttggtatggttgccatcaatgatgggattctacttcgcaatcacatccacaggattctcaaaaagcatttccgtgataagccttactatgttgaccttgttgatttgtttaatgaggtaatctgttttggcagatctactattctcttttccacttttgatattttatcctcagtctattattccatttgctgtctaggttgagttgcaaacagcttgtggccagatgatagatttgatcaccacctttgaaggagaaaaggatttggccaagtactcattgtcaatgtgagtcaactgtgggcattgtctaaattttagatacggtttcttctgatggttgattagatgaaaggcagtattctgacctgatgcaatggttttcaacttgcagccaccgtcgtattgtccagtacaaaacggcttattactcattttatctccctgtgagtatggattctcttcttccctagtcatatttggggtcaaaaacaatcatgttattccttttgtctccatcattgcaattgtagatcccgtgacaagctgtgtttttctattcaggttgcttgtgcgttgcttatggccggcgaaaatttggaaaaccatattgatgtgaagaatgttcttgttgacatgggaatctacttccaagtgcaggtagattgctgttaagtattcatgagagctatatgataggtagtgttgggatgttgataaccattcttttgtgtaggatgattatctggattgttttgctgatcccgagacgcttggcaaggtttcactcgtgctaacacttggtttctcaggctgatgtgaatgtattcacttggttcagcatattggttttttataatgcagataggaacagatatagaagatttcaaatgctcgtggttggtggttaaggcattagagcgctgcagcgaagaacaaactaagatattatatgtaagaaccatatcatcttgatcaaaaaggtttgtatcctgtttggaacctgaaacatgttttgttctgatttactaggagaactatggtaaacccgacccatcgaacgttgctaaagtgaaggatctctacaaagagctggatcttgaggtttgtagcgaacctcagagatatgatgttgtaatacacaactaacatttttgctaattggacatggtttgatctgaacatgatagggagttttcatggagtatgagagcaaaagctacgagaagctgactggagcgattgagggacaccaaagtaaagcaatccaagcagtgctaaaatccttcttggctaagatctacaagaggcagaagtagtagagacagacaaacataagtctcagccctcaaaaatttcctgttatgtctttgattcttggttggtgatttgtgtaattctgttaagtgctctgattttcagggggaataataaacctgcctcacttttattcttgtgttacaattgtatttgtttcatgactatgatcttcttctttcatcagttatatgaatttgagattcttgttggttgatgcctgtgactacatacataatattgaccaacagaagaagataactcgatacatacattgattttataacactgagatttaagcaactcttcttcttctctaatgcctacattccattccaaaggcaagaaaataaagcttcaagcgcaggcctcgacacgtcaccttgtcgcttaatttaatacaacaactagagtttatttataaataatggctgtgaagggtaaaagcgtcttatcctcaacgaccaccatcatcatccagctagcagcaattggtttttcactcacacactagaaacaagaaaaagaaagatgggagatttaatggctcggtctctctcttgatctgacgacgacgatg

SEQ ID NO: 32966 - DNA, 3003 bp, Unknown
  misc_feature (1)..( 3003): 2750-1469P.txt file - cDNA_ID_3063698; gDNA_ID_1620434; Annot_ID_156937
aaaaagtgagaaagaatagttaattcctgaatttcttagaaaagacaaatgttatgcaaatgatgatagattatgttttaatttcacggtgcagacaaactagacatctgtgttagtaaagcatcaatggctttgagaagaaagagagaacaaggcatgctaaaagcaaatattaggacaagtatttgatttgtactctcttccctcattatgttcctttgcaaagacacagcagaaacatccaaagtgaagatgagtttcatcatcacttgcaggggagcggaatattcgctgacaatcacatcacatgccgtttggattggaacctttttttattaacttaagtcgagagctctgtgttcctcgatttacatttttggtttctattatcaatacgcatcacatgtttctggactaagcagggctataaaggctaatactagtaataaacaatggaaccagcctgtgcttttggactttccccatgataatcttactatttgcttattaccattctttcaactcttcatcgacttctcaaatcctttattcagcaacataacaaaatgaaatcatgttttctgatgcttcatcagattactaaccaagacaaagaatcagaaaaatttcatcttgcaacaggacgtaaatcactgttccaaagtgtaaagcaagatgatgaatgatgatgcccttacttactagggggactccatcagttttatgatatcagagactgtgcttgtgtaatagtctggttctatcttgttgcccttatctagtagattagattcacttgtcacccctgttttgacatacccaatcactgtcagttcaccccaacactgtccagatatcgacttgtattggcttgcaaaaactcaaaagagtatcaaacagttaatgataatgacctgttaggacgaggagagttttgcagccagcattctgcccaaacaagatatcagtatctagcctatcacctaccatgcacattcttgacgtttccgtcccaaatctgcaacacaagaaatacacctctttatcactctatcctgtataatgcacactatgaactgagacaggctttcatgtgcacatacttttgtagcagaaagtccatcatgaaagtagatggtttcccaacaactattggttctctttcagtcgatccacacatggcagcaaccatacacccagcacctagaattacgagtaagaatttgatgctgtgacaaccaagctgctattctgggcaatgaggcctaagagtctagtgaccataccaggccactcttgcagatccgtcatatgtcctactgcatcacggttggtcgcaatgaagagacatcccggattctcgcgtacacagagagtcccgtacctgccatttccgttattgtgttagccaaaactctcagaaactcaattaaggcaaccgacttgcatgcaatagtaatccatcttactgaagcttatagtagttaatgttggggtctagtccaactacaactgctcccacctgtcacaggaagtcatgaagaaatatacaacattagaacctagagcaaaagagaataagaaaaacgcaagattggagaaggaatcaaagtcttatggcccattacacttttatcatgttcaaagagagagtttgatttccattgtgccttcttttcaccatcttcctgcatggaagcaaatactgcttcagatagacagaggaattcaaattatacaattttggttggtttaaaaacacaggagcagtaagtatcaaacatcttgtacaatgatatgagtcctcagagtgaccaaaacatgacctgatcaaaacatataacaaaaggaagactacttacaggaccaccaagacctgtaaaaccggcaatctgcagctcctcaagaacaccctctccaccaatcacataaacctacaaaagcaaacacgaaaggaaaaaaaagtgagaaaaagatgacgatagagagacataagccaatgtgtcagtcgaagtagaaccttcttgtccttaggaaagttattgactttgagatacatagctgccgcaaatgacgaagagaagatctcatccttccaaagtaatcacatttttttgttttagttttaatggtaatcacaagtaatacgaagaaggagaactcaaagtttacctgagtaatagaagtgacacccaaagatcggaacttttcagcgtattgcctcctcgattttacggaattgttggtcacaaagacaacatttttaccctgaaaatcgcaaaagatcagagagagagagactgaaaaggaatagagagtggggaaaagggaaagcaccttagaacggataaggtcgagagtttgggagacgccatcgatgagcgtttcacccttccatataacacctgaatcgaatcatcatccatcatcagagtagtaactaaagaggataacaatcgaatggaagaaagtagaatctaccatcgcagtcgaagaggaacgtatcgacagagtcaaagagagatttgaagttactggaggagagaagctgaggcgccattggaggagtgtcttcttcttcttcttctgggaattgatcactctggtaaagcacaattggcacgtccaaaacgacaccgttccatcgaaagaggccacattgtgattggtgagcccaattaggaaggcctattttactaatgttgaagcacatgttgtactataaaaaaacagagtttattatctgtttctttggcttgacatgacaaatgtacaactgggagagaaagtcagtccgattgtgttggggatgacgatggcaaaagtagtaaataaggaagaaacaggaggggcgttttcgggagaagaaggaggaatatgagtgtgagttgttgttgtaggaatctgggcaagacaataaaaaaggcaataccttcacatcatttgcatctgagaagtcttggtgggagtctctatcgtcgtcgtatccaaagctcttcaatg

SEQ ID NO: 32967 - DNA, 3000 bp, Unknown; identical to SEQ ID NO: 1683
  misc_feature (1)..( 3000): 2750-1469P.txt file - cDNA_ID_3063702; gDNA_ID_1620434; Annot_ID_156936

SEQ ID NO: 32968 - DNA, 3003 bp, Unknown
  misc_feature (1)..( 3003): 2750-1469P.txt file - cDNA_ID_3063712; gDNA_ID_1620434; Annot_ID_156930
tattcacagatcaaaacaacactgaaaatttaatgggagaataatcggaaggaatatatctgcttgtaaaattcgaaagaaagaaatgaagaatcatcgatagagtaccttagactacgattgaaatgctttcgcaacgcggctccggctcgagagatgaagtatcgctagggtttttgattcagtgatgtgacgcagcgtttataaagaaagctttgtatcaaagcttcattagggctttcaaaatatatatattcattaggcccatttaaagatcttctggacattttcagatttattgggctttgagtatgtattgggcatgtctatttggtgtggtcaacgaattcttgtatttcaaatgttaatgtttatgttttaaataaaatgaacacattttgaaagttaagggattaaaataacatttttaccgtttaacattatgctgcataaaaagtgtgagatgtttattacacaaattcgcatggtcctatattggagctttaatggttagaccgagtcaaagcgtgtcagaggccacctctgatttcaagcatataaacaatttttaaagtttttttttttctttttcgtgtggtaaagggtcacacaaaagtatttgattcactaatttattataaccaggattaggtttacctaacttttgtagtaattaattcattaccgttactgctacgttgttcaagaatcaaaggagtattcgataacttgtagaatatgatttggataattttactgttttcattagttagataccactaaattactattacggtcaaaacgcatgttaagactttgtttggtcaaataaaattctttatagcaacctcgagagtcgagtcgagaccatggaatttgtctttaagacaacatttgtataaaaatgtttttcaactaaaaacaaaaaattctgatgagaatgatagtcctcgcctcctctacaaaggtgtaagtaagtagctgctgcgttaatctcaaagaagacgaatacaagtctttctgttttgctcaattcatcacaaccacaagaagacgattttttattcttgtttccaaactggtaaagttgttcagtaattttctgtttcttatttattagtttttttcttctaaagtttgcaaatttctcagtgaaacactgaaacttccttttcagttcgtaccgttcttcgctactttactcattctttagggtttcaaggttttctattggtcttgttgtagactcgagtagcttctgggttcaacccacaaagtttgagccttttttgatttgcagagtcctctgtgtttcttggtttgtctcttgatcaaggtctgcttgcgatttttgtttctttctctaccttactcgctagatagatgtttctgtagattggcagcatttggtctctctgtgtggttttattatttactgatataagtgtgaatctttcccagaatttcgttttctatatcaagaagctctcagaaaattttgggcttggcgtagttgtttagatatatcctagcttcctagagattgaatgttgaatgttgaatgactagtacttccttctctttctctgtgtcttggttgtcatattcaactgattgtctaataaagacagttgctttagctctgttattcacgaggattgtctcaagaagtttctaaagttggtagcatgtgtttgtagaatctgagatgggcgagccactaggactgctccaggtgactgttattcaaggaaagaaactggtgatccgagatttcaagtcaagtgatccttatgtgattgtcaaattaggaaatgaggtatgtttggtcagtgtttttcattgttcttggcaactagaaccagtgtttgtgtttctaccaaggaaacaagtatctcgttgtgtttatttgtctgttgatgtgatgttttactgttttgaaaaccagtcagcgaagaccaaagtgatcaacaattgcctgaatccagtgtggaatgaggaactgaactttactctgaaagatcctgcagcagttctcgcattggtatgtctacatcttcatgaatctttccttttgtgaccatcatgatcatgatgctgagattgttaatggggtggtgcaggaagtgtttgataaagataggttcaaggcagatgacaagatgggccatgcctctctcagccttcaaccgcttatctcagttgccagactaagacacgtagtccgcgtgtcctctggtgagacaacgcttaggaaagtattaccggatccagagaactgcgtatctcgagagagcacaatcagttgcatagacggagaggtggtgcagagtgtgtggctgaggctgtgtgctgttgaatcgggtgagattgagttgaagataaagttgattgatcctcctggaacaaacaagtagcaatagggtattttatgttagtttgtaacacgagacccgtttgtgactagtataattgcaacatcagtatggtcttgtcttgtttccaagtgtgcctttgtgactactcaccaatttattaggaatctttgagatacattgttctgctctcatcacttagctcttccttatttttcttcttgtgtgtacattttgatggaaactccaggtaaactaccatcaatggcagattctcataactctctaccttcttaataataaaacacctggaagaaattatctggcaacaaagctatcacgcataccaaggtggtggtggaaccgacactgatattggtatcttacgtcacacacacactttgttgttatctctatatccacctttttctttttggctcaattatgatctctctctttctcgtttcctcgtaatcttaacacaagcttgatcgtcctcatctgccaccaaaccaaaggtgatgcgttttcttagccaagaactcaaacttgtgatatttcttttgattctcatcatctctgcattttctgaattggctcagacataatttcttcggtgacttccatg

SEQ ID NO: 32969 - DNA, 1671 bp, Unknown; identical to SEQ ID NO: 1689
  misc_feature (1)..( 1671): 2750-1469P.txt file - cDNA_ID_3063736; gDNA_ID_1620435; Annot_ID_157005

SEQ ID NO: 32970 - DNA, 3003 bp, Unknown
  misc_feature (1)..( 3003): 2750-1469P.txt file - cDNA_ID_3063740; gDNA_ID_1620435; Annot_ID_157004
caattatttttaatttatacgtttaatattcaattattttttgttgaaagattaatacataaagtaataaaactgtgtaatttaatatccaaaccattaactgttgttattttcattctcacgatcttacaacaaaaataaaatttcaattttacctttaccatctcaattttttctagaggtggatctatcagtccaaccgtctatgtctctccagggaattcacgaatcgatcgatccagaggtggatcgatcgatcccaccgtatatgtctgaaacgttgaagtacggaccgatcggtccaaccgtctatggccgatttgttgtagcctggaccaatcggtttaccccgtcttctctccgcttcagcttttctcgttctttctcgacccgaataaactcaaaactatctaatccattcacaagtacctaaaacctgcaaaagactcaagacttgatcaaaaagacgtaaaaacggactacgacatgataaatgactcaaaacgaaggttagacaagagatctaagacaccaaaaacgcaacatatcaatagtcttatcacttatgttaccatgaaataaacatataatgtagttacaaacttacaatgttttttagatgattactaatgtactggaatttgtatatcacaattcttttaagttattcaaggcactagtggagaaagattcaaggcactattggagaatgcttttctctcaaatttggctcattttatattgacaatggaggcaagtatctagcactggcaaacttccttgcatatcacggcatcaaccattacaaaacaccaccacacactccgaagcataatggtttttctgaaagaaagcatcgtcatatcctagagacatgcttgtctttacttattcacgcttccatgcccgtcaaagacgatgcttaaacaagttctgcaagcatgtatcgacgagctggggcagtttcttctcagtgttgggtttagtcttatctccgcaaggttcagatttaaagatgttcttaccaaggctttaccacggacgcagtttcatcttctctttgacaagattagactcacaaatggtggttcatcttgagggggcatataatgatatattatatatcttcatcttactattcctgtgtacattttcctttcctctagatataccctatgcacacctcaccaaaaaaattataaccacttatattatacgaatgccaaatctcgatataacaatttaattaaagtaataaatgttaatgaatttaggacatttcaaccatatatttactctatcaccaatatctacatcttacttgccccatactcacccttaattagtacgaacagaaatttcaagtaactacgagactctcacacatctgacatcttaattctcaaaatattcagacaaacaacaccttttgaactttaaacgatccacaacaaaaacagaacaattgttatatatatatatatatatatatatataaaagaaccaaaaacaatataagaaaaccaaagtgaaacaatttgtttcggaaagacattagacaatatgcaaatgattaatgccaaatgaagacattatactcgaccacggcatctagaccaacaatcttataagtcttgggcagtgcatagcctctagcaaacctgaaagcaccagttcctccaataatcggcaactctctcaccttcgaaaatatatcattccgtccatacaccgcgatggtgcttccattaaactctcctgccgtgaaaacatagttaaagaccattgtgaagactatgtccttcatggctgttgatgcgtacatcccctgagctcttcccacttcctttgagctcgggtctggtccttcggtcaacggatcatcagcgatcataatcacgccaaacttgacgttgagggtggttgttgggcgggcttcggcaactttgacggcggtaggtttgtcaccggagatgacgtcatggaagtagaagtggaggtgggtgaatttctccggcttgtagccttgatacggcgttgttgtggagtaagctgtgacggacacggcaagaagaagaatagatgacaaaagaggaagaagaagcagaaaacgtttagccatgttcgttgtttgtagctatggaaatgtgaaaatgtgatttatatatatacacaaaacatgatcgttacgcaattgttggctcataaaacatttgaatatgtcgtttctcgattggtgacaacaacatgtccgttgacgtggaagtaaactaggtggttcgatttataaacaactagatatttccacttgtacgaatcatgatataaactggcaaatatataaggatgcacgacgaaagaaaaacaaaacaaataagaataaaacaagattctgcattgtgatacactacatataaatatataaagaaagatatatagtagatgcatataattgaaattaagatcaaagatgtacatagacattgatgtttaaatttaggattgtcaatctgtatatatgtacctaagatatatattaatatatacatatggttccaaactcaataccagtgttctctaattaatgatcttatattttgtacactgaattaatcatccactgagtcccaaaagaggagggcataggtgcgacgggctagagttaaatcataaaatagattaaaaacaatacatgatatttgaaacaatgatcaatgacaagactttagttttcttgcaaaaagtatataacttattttagaaactccttgaattttgttataaaacaaaattggtagttgcataatttttttttttcaaaaaataaaacaacgatcaagaattttggtagttgcataattttgaagtacagttgtgctagttactcaattaaacttaaaatatattatatcaattgtttggaataacattcatctttcgtcttctcagtttacttggaatgcacgagagctttctcgttgtgagaataactcttgggtcatg

SEQ ID NO: 32971 - DNA, 3003 bp, Unknown
  misc_feature (1)..( 3003): 2750-1469P.txt file - cDNA_ID_3063751; gDNA_ID_1620435; Annot_ID_156992
catatgtatctaatatcttacatattaggaatcaaatggttgatgtaagcagaaatacaccagtatatatgtaaatccaaaccaaactataactaagatcattcggttctatttttttctttaactatatcataaaattaaacacatgtttggcctcgaacgacatttgttttcttcttgaacaatgatgatgcttgaaggctctagatgatgcttgaaacgttcattaaaattatttcatggtgatgataatcgattggcagtttgtagggcacggattgagaacgtgtcataaacctatttcacatgtacatttcaaagttttgactatcttcttaacataaggtatgctttatgagttttgagcctttgagatattattaaaaacaaagactaaaggcaaattactttgtgagtgttaaaatggagtcgtttttaagaaaatgaagaagaacaatgtatattcattaatagcactaatgatcaaccaaacatttccaaggttaaataaaagtttgcgtggatcaagacatcatgttcacattttggtcaattaataaacctggcatataacactaagtggttcaaagctggaaaatggtacaagatcatatacaattattttttgtttaaactctcaaaagccattatgttgaggtttgttgagtctagttaaatctgtcaaacccttaagagttatcaagtgtctcgagtcattctaattcatgttggaacttgttttaacaaagaggctccaacaacttttagctgggtggttttttggtgagaagttcgtcgtcgtattcgagcggctaaaatgattattcttaaataattattgattaaatgtataaatatagatggcttcaatatttgtttataacagaagacctaatgctaatagaagattcagatgccacacttgtaacatgaatgctaagaacgtccatcaccatgtatgtctgcgtaccaaaacgatgtctattctctttcaaatattgaaaacattcaaattggaatgatttttcatctctattatatttaggttttccaaatacatatctcacgttgacctgccttctttaacttctttaacagcatctaaatcaaacatatcatatgaaacttagcaggttacaatctaaaaataataataagagacaaataattaatcaaaagattacatgcccaagttcttacttcctctttctaaaacacaaggcctcttagagtactcacaacaaaagtcgaagataatgttttcttatgttcaccaaaaaacttacaaaactaactctcgagaaaatctaaattttcttttgaagtgtggtttatatatgtatatatatttttatatttttttggaaaagattaataatatttaatcagtatagaagttctgcttagactcattaatatttaatatgttaactcattataagtttacaactcaactcattgaattgatgaaaccatttgatctaataactcatttggttgtaagcttctatagttattcttatataagtctgaaaaaatattatagttgtatttttggatatctaaggaattaagaaaattgataatgtctcacctctacgataattccttttcatctttccgttttgtttttgtattatcgatttatgttctttaattattattattttaaaaaaacttctccagtcatctttttatttatcagttacattatcgtaaatattcatgcttcttacatgaaaaaacgaaatattttaatgtgatctccactagttcatgaagaaaatgcaaagttatgacttacttttatggattggctgcttaaacaaaaagttaccaacagactttgactttgactttgcgtaatgcaaaaataacggcagcatgaaaagaggttcccttcgcctcataatctgcctaagttactggtcaacaagcactactatatatttgtgtcattttcttttatttgtgttgttttttatatatagtaaattataaacatattaattattcctactttccttagaaatgatgcatggtgaaaaatttaaaaatattcatatacaaaaaagagagggaaaataatattatcagttcgataaatatgtattggtttttatgaaaataatagttttattcaaaatattagctaaaaagtactctcacacagttggtttgtttcatagttatagaatttattatgtgacacaaaaagttcaaagaatattaaaaatatttggaaattatgcaaataaacaaatatttgtaattatattatttacataacacaatcttatgatatttattttagaatatgtttacattattttatccatatatatgtgtcaaatacgatatcatttttggacatttacatttgttgtaaattaaattgtatagagttaataaaaaaaatcaacagataattttgattaaggtttgtgaataatttagtcaattcaatgcaaaattcaagatttatttgtctaatccactaattgagagtttctttagtcataaataaataaattgaaaatcttcaaatcacgaaatattttttaaagatttaatttacagaaaatctcaaatctcattacaaaaaatcgttaaaatcaaaatttgcaacaactaaaaaaattcgattatcaattttgtcataatactcatctacaacttttgtcactacataatcaattattttcttgtccaaaaaaaaaacataatcaatgattttcttaatgtaattgtaatgatgaattttgatgcgggtaaagtaaaaactaaatctacttacacaacttcctttttaaaagtatttatttcagatttgagatttgtcagatatttttctcaacgtgaaagagagaaaagagaatctctcagaaggtgagcctccaacaaagcgtgaatctctctttctctctctatctctctatctccgagatcgcatcaccggaaatctccttctacggtggtggtggtgacagttgaccagagatg

SEQ ID NO: 32972 - DNA, 3000 bp, Unknown; identical to SEQ ID NO: 1686
  misc_feature (1)..( 3000): 2750-1469P.txt file - cDNA_ID_3063758; gDNA_ID_1620435; Annot_ID_156988

SEQ ID NO: 32973 - DNA, 3000 bp, Unknown; identical to SEQ ID NO: 1699
  misc_feature (1)..( 3000): 2750-1469P.txt file - cDNA_ID_3063762; gDNA_ID_1620436; Annot_ID_157037

SEQ ID NO: 32974 - DNA, 3003 bp, Unknown
  misc_feature (1)..( 3003): 2750-1469P.txt file - cDNA_ID_3063788; gDNA_ID_1620436; Annot_ID_157023
cttagtatcacatttaaatgaaaaagaacctattgctaatttttttttttaactcgatgagtcttgatctaatttttatgtattgatcgtaacacgttagtcaacttaactagatagattatatgtgttttttcactctggacttgaatgagttatggcatggtcaggacactaatacaaatcactagataatttccttatacatgtatgcactaatacaaatcactaaattctacagtaaaaagctagaaggcaaagtagctctcataactggtggtgctagcgggctcggtaaggccacggccagcgagtttctccgccatggtgcccgagtcgtgatcgccgacttagacgcggaaaccgggacaaaaaccgctaaagaactaggctcggaggcagagtttgtgcggtgtgatgtcacggtggaggctgatatcgctggagccgtggaaatgacggtggagcggtatgggaagctagacgtgatgtacaataacgctgggattgttggacctatgactccagcgagcatatcgcagcttgatatgacagaattcgagagagtaatgaggattaatgtttttggtgttgtctccggcatcaaacacgccgctaagtttatgattccggctaggtctggatgcattttgtgcacatcaagcgttgcaggtattaacataaaatcaaagtcttagattagatagaaaccttactatatcaaaccaaaagatggttacttagtagttagtacttagtacttagtacttagttaagaatgtataatatcatatcgtattaatcaaagcttggttagtacttagtacttagttaataatgtataatatcatatcgtattaatcaaagcttggttaaacaaaaacttaaatgaagcttaatagttttcaatttgtggtcaacactcaaatttgacttttggtatggacaaaacaatgtaggcgtgactggagggttggctccacattcatacacaatctcaaagttcacaactcccggaatagtcaagtcggcagcaagcgagctctgcgaacacggcgtgcgtataaactgtatctcaccgggtacggtggctacaccgctcactctcagttaccttcagaaagtgtttccgaaggtatcggaggagaagctacgcgaaacagtgaaaggaatgggtgagttaaaaggagctgagtgtgaagaagctgacgtggctaaggctgctttgtatttggcttccaacgacggtaaatacgttactggccataacttggtcgtggatggtggcatgactgctttcaaaatagctggttttccttttccttcggattcatgatcaatcattttgtatcgtctataaataactttgtactgtattcaagattttatatcaaagttggatcttaaaacatttaataaattttcaaagcaaccaactaaatataaaagtttctatagtaagagttaactttgataacatatgactttcatttgaatacaagctggcatgaacttgaagctttgatcacagtttccaactcctcgaccatctcaactctctctttcgaggtaaggcgttttgtgaggaaagttgctttatccaaacgacttgcgttactaaggatatatttcgtcacctctttttcatcttctcgccattcgtagtcttcccatacaaatgtctccagatggagtaacatacatttaggaatattctttggctgaatccatttccacaagggtacgccatctaaacttttctgccatggctgtggttatgagatcaatggcgagttaacacaaagtaaattacatgtatattagatcatcaaaccctaagttgaggtggaaatttgctaaaagatgaattttcaatgcttacaccgatgagcttgaggacttgtaaattaggagaatgatcgagcatgagcattagtagattccaacaatcagctctatatatacacagctccaaatataccaactgataaaatataggaaatggaatctatacatgaaggcaatattattagtagagtaacaatgcaataataaggaaactaactaattacaagaaaaccttaccttcaaggctgatatctccaaggagagacgtttgactgaagtcagtgatctcaagatgaaacttttattattgttgacaatatttgcctccaacagcataggtgcattctcaataagacaagatccacgaccaccaatccatatacttcaagtattttaaagaaggagcatttatcacaaagcccacatgttctttatcatttctattacaaatcgatagtctttgtaaggaaggaactgcaatagttaaaggcttcacattggagtatagagttccatgcacatccaagttttcaagattaggacaaccagataaaaggttaagaactgatgtattgtttatgaagttcacatagtgaaggtgcagagttctaagagatttcagacaaactgaagaagggacaaccatacgaaccaaaaacttgacttccaaggtatctagtgtttcacaattgcacaagctttcaggaaatatgaaccgtcctctaggtgcaatctgatccagtatgaaaattaatggaagatatctaaagttatttaatccaaatctatttttctaaataattttgataatatatatatatatatatgtatctatttttattaatagtttttattttacaatttaatttaataagtttatgcaattatttttgtatttttgtttagctacattggtggatatagcggcgttggtgaataaaattccagcgtatacaaggccagacgttttatcctataacgggccgggcccaatatttaaaccttctagctcacacagaggtcaaagtttttgctctcgtctctagatctgtagaagtagaatggtggagccatcgagccatgtgatgtgatcgaaacaaaaagctctttgcttcttcttcgtccatttctcgtagcacacttttcacaaagaagatg

SEQ ID NO: 32975 - DNA, 3003 bp, Unknown
  misc_feature (1)..( 3003): 2750-1469P.txt file - cDNA_ID_3063794; gDNA_ID_1620436; Annot_ID_157021
agaagtaaagcctgtaaaacggtgtgttattgtctttattgtctctagaaatgtagacaaaactctctatttttataacatgattaaacctactcaacaaaagttagtggccactaacatgaattctttttcttactataatccttttctatctttcggttttaggtcaaccacttttcagtggattttagctttttgagaatctctgtcttatccaagattctcttcttcttcttcatttttcaattctttctttttaaaattcttatccgctggatgactacattggttgaatgaattaatggagactcagtatcgttttttgcgtttaaattagtctaaagctttgttgtattatattaaagcactagaatgaaaagactatgtgtactaactaactaatcaagtatatatataatgcaaaagtataactacatttttctttttagaagaatgtggaattttaacattgcattacacacgtatcttatgtacattcgatatttcgatccttaccaaaattcagtaaaacgaaacaacaacaaaaatctaactttaagtttaaacgacatattaaaaaggtttatatatttcaattcgtttaaatataagtaacctgctgttttaaaaaaaaaagtaacctaaaatgtgttttgatgtaaaattaaagtttttaaacaaaacacaaaaaatctgaatgacataaaaaaataatccaccaaaacagttatgagtaagttaaatgatataacaccattctttctgtcatttctattttatttgagttaccatgcaaagccttacattgagaaagagatatagaatgatcaagtacatttctcattgtcatttgattgaaaatataaaattcaaaaaaccttacatcaaaacaatagaaagtggaatgtatagctatctatgtggaaagtggaatgaaactttgaagattaaagaatgtaaaagaatcatagaaagaaataaaaaatagtttatcaaatgggatctcgatagatataatctaaacttcttctcccaactttttctctcgttgtttcccatgataaaaagctttaagacatttgcaccaaaaagatctcaaattcacgttcacatagaaaaattaacaagaggcagaaggaaaaaaaatgtggaggtcattcgcaaggtaaacacactcgcaagacatacgtctaatctcttctttattatctaattatagaattagtctccatctcaatttcttctccgtggcttttctctgcagaagcttcaaactcattaatgtaccaaatggtttgatatccaagccaattcgctctactctcctctattcaacttcttcaaggtcgatcctacatatataaatactataacgagattcgatcttttaatcttaattaaaactcacaaaaaccctcttaacattttttgcttcgactatatgtatagaaagttagaaggaaaagtagcggtcataaccggcggggcaagcggaatagggaaggccacagcggaggaatttgtgagccaaggtgcgcaagtgattatcgtagatatagatgaagaggctggtcatatggtcgcgaccgaacttggctcagccgcacatttcttaagatgtgatgtcactgaggaggaacaaatcgctaaggccgtggagaccgccgtgactcgtcatgggaagctcgacgtaatgctcaatagtgcgggaatatcatgtaagaacatattaaacaattataatgaatttattttaaactaaatatatgtatactaatacatcatatataagatttaaaaaataaaacattacttctataattctacatatacatatctttatataaataaattgcttatgtatacaatgcaggctccatatcaccaccaagcatagcggacctagacatggacacttacgacaaagtgatgcgtctcaacgtgcgaggtactgtcttagggataaagcacgcggctcgagccatgatccccgctggctcgggctccatcctctgcctctctagcatcagcggcttgatgggtggtctaggcccacacgcatactcaatctctaaattcacaatcccgggtgtggtcaagacggttgcgagcgagctgtgtaagcacggactaagaatcaattgtatatcgcccgcaggcatcccgacgcctctaactttgaggatgtttcgagaggcgtttgcgggtcatagcattcgggaggaacaacttttggcgattgtgaacgcgacgggagaactaaagggagagaagtgtgaggagatagatgtggctaaagcggctttgtatttggcatcggatgatgctaagtttgtgacggggcataaccttgttgttgatggtggatttacttgtttcaagtctcttaatctcccttctgcttaattaatttatcaagttagttaaagttttttttttttttttagttttctgatgtggttattacgagtgttttggccttttgggtcattgctgatgtgatcgtttgtaatctatgggacattatatggttggaatttggaattataaatttagcctctctgtggagtttcgacatttcactagtatagttgattatatcagtcaacttagtattagataatcattatgtgtattgtgtaattctaagtgattcattgtttctgatgatttacgtaaagcttatcagaggtttcaaaacatattgcaagcagagttatctatcgtggcctcaggtgttgtaagaatagcttgtccatcagataacatgtatgtagaaccgttagttgtggtctatttaaaactttttaaatactttctttgagatagatgtatttctcctaaatcacatatgtttcttagttatggtcaaatatagaatattaaaatattgtacctaatagtgacactagtcactagagttaggtgccactacaccaagctcttctgactttgtatccatcaatactagaaactcttttgatctcaacaagcagtcttatg

SEQ ID NO: 32976 - DNA, 3003 bp, Unknown
  misc_feature (1)..( 3003): 2750-1469P.txt file - cDNA_ID_3063822; gDNA_ID_1620437; Annot_ID_157068
agtcatatgtaattatgtaaacaatagtatcagttttcagaatgtacaaagaccaatacgtcaatatatatacagctatactgttaaaaaatatatattcatttatctgcagttaattaaacttgtttttttaattagcatgtttagagcgatgttatactgtagtagacaagagaaaatcgtttaaaaatttgtatcttcgttgtagatgaaatgtcagctattatgtgtactatatatgtaataccgtccaattaaatgcgatgtgcagctgatagacacgtgtatccaacactaaacatcacaattctcccatcacgtttactaattatggccattataattagcaaagttcacattttatgacttactacataattgaatgatagaggtgctatatggagtttttctcgatatttcgtataatcattaacataaatgcgtttgtcaacaacaaaaaagatttaataaataatctgaataataacaaaatttattataatcgtacgccaaaaatacgttttatagccctgcaggaagatttttacgtgaatgccacatcaattcaatgcataattttgtatacgaaccataataggacgaaaaaaacagtctttttctaactatacttgaaaccaattctagactcaagcgggaataaatacacgaaaccgaattcgtcttatgcagtacatagcatgaatgcaatataatctccataacactatcgctctataagccatatataactcatagtcacatgcagtctcatatatgtctcatagttacacatattacaaaatgtctttaacttttgtgtttcctttctacgtacgcatgtgatgatgcttctccgatgtcttagagagcttgggacgtgaaaggttgatgtatggtgttggatactatcagccaaaaaccgtcaagcaacatcgtacaagattgataaatgtctcacatgtgtagtacttaatagtcacaatttgactacacaaacctctaccgacactaatgtagcaattatatcatgttatatgctcttaaggtatagtatgtataacaacatttcattctgtaaaatatcatcatttatatcaaatttatgatatataaaatatcattatcattttaaaataacactaaaataatcagtgcaattccgtataatcttcatatgaaactgcaagaatccttggtgttccaaagattatgatgattattgtgagctttgatttatggtttccatcttgtcaaaaaatggcttttataaatggtagagctttcttagttttccttaagatatacacaacaggttacaaatataatttatttttgctaaaagaaatagttatagtaaacttgtaaaaactactacaactattttatggaaaatgtcttaaagctgtttcaacttttatacacattactgcatttactattctgaaatcaatttttaattaaggtccttgtactataaggaatcctttaaataaatataaatattaacaataaaaaaatccaaaatttcagaatgcaatggtcttacaattacaataataatgtatttgattgtactaaaaatataccttaaatactcaccaattatcttttataatataatccacaaatttctggaagaggaaaaacaagtaaatgcaagtcacatttcacatttcaaattaccaactaccaactacaaactacttccgcgtctcaaattgaaccactaattaatcactactttatatgctcatcattctttttctttcattacaattctagaataatgacttaaccaaaattcatacaaataaaacaatattttggcttccttcaccaggctaagaattttggtattgaaaatctaagtacttcataagaaactgttggaatcatttaaaatttgtgatcatatataaaaaaatttattcatctttatatttaagagtttaaaaactgcaacttttgtttttctttcactaagtcttatggccacagttaattaaaagcagatgaaaggtggtccaatggaaaaggagaatgtgattgggctagttgggagagttctgatgtctagtgttgggtacacgtgtccgtcagttacacatagcattaaatcagacggcatgtcattattcaaatctagttcacatagtacgactaatagctgataaattaatgattatacagcatatgaattatgaattcaaaaaaaaaaaaaaattgaaaatgttaaggagatgctatattttacaaaattcatcgcaatgctttctactaatttgctaagtggtcttctccagttagtcttgtcgattccaagcgatattattaaatcttgaagcatcgctcaaagcattatagcttaagataaccaaattgttattaaaaacacctagtgaaatttttaaattaaaacaattttgatatctttgtaatatctaatactactctttctgtgtctaaaaggattaattttcaaaaatttcacacatattaaaaaaaaaaaaaaattactagctaaacaattttcaataatcataaaacaatagtaacttaataatttttttttattttcaaaatagtccttcaagtttacaattcattttagtattataatcaacaaaatttgtattaaaaagttggaaaattaatctttgtggaacaaaaaaatctagaaatcattttttagaattagagagaggtttgataaaaaaaaataaaaaaaaatagagagaggtagtacatactaaacgatgtgatactactattgacaaaatcttaattctcagtttagtagaataaactagaaggaatgaatgaagtaaatgcgaatccaactactaacaaaccctacttagtcatcatattttcccatatgaaatccctatataaacccatcatcatctcccacttttttcatatccaacaacaaaaacataagctaagaaaacgaaactcaactaattttgttatcacccaaaaagaagttcaaacacaatg

SEQ ID NO: 32977 - DNA, 3000 bp, Unknown; identical to SEQ ID NO: 1708
  misc_feature (1)..( 3000): 2750-1469P.txt file - cDNA_ID_3063824; gDNA_ID_1620437; Annot_ID_157066

SEQ ID NO: 32978 - DNA, 3000 bp, Unknown; identical to SEQ ID NO: 1706
  misc_feature (1)..( 3000): 2750-1469P.txt file - cDNA_ID_3063827; gDNA_ID_1620437; Annot_ID_157064

SEQ ID NO: 32979 - DNA, 3000 bp, Unknown; identical to SEQ ID NO: 1710
  misc_feature (1)..( 3000): 2750-1469P.txt file - cDNA_ID_3063847; gDNA_ID_1620437; Annot_ID_157053

SEQ ID NO: 32980 - DNA, 3003 bp, Unknown
  misc_feature (1)..( 3003): 2750-1469P.txt file - cDNA_ID_3063859; gDNA_ID_1620437; Annot_ID_157047
ataatcatatacaacgggagaattttattttttttcgatgtggtaagtcaccatatttttggaatctataacgatagtaacatgttgtcagttccaataaaaaatatctcaaagagtacaacaaaccgacactaatgtgtgacttaggattggtatttgtggcatgggaagggtcgtcaggattgagagaggagtggtccaatagtttggggcctaaacgtgcttacgacttttggaacaatttggaggcagaagcaaccaacagcttcgtcttggataatgtgcctagacgatcttggtttagagaatgtgattgatatttgagagtgatgcaagtgttctgtttcgggcagttaatgatgaagcaagcctggcccatctctgcagagcctttacacgagatatcataggaaaagacaaagacaacgaaccagcacatgtgtgctgatttcattgcgaaaatagcactttcttttgtgtattatgccgttttagataagtgtatttccgatttgcttccaccaattattgagatgaatagtcacacacttttgtattctgtctaataaagtagagaaattttcaagggattcggcaccaaaccaaatcattattagaatagaatgttacaaagctttgataagttctttgcatataagtaactagtaacgcggacgccacaagaactttgatgttgcagttaaaaactaacagctagtaaagaagtacatgacttttccttagagctattcaatagttcttcttgaacccaatgcagatttatccttttgattcacacaagtcgaataagattcaacagcgttatccttttcattcttcaagtgtgaagatagttagcagccatcatcagctctagagtcagttcaggctcaatatgaaactctgtctctttgcctctgtcaaaagatggaacatatgcataacagtagttaaagactatacaactataaaaagagagaaagataggagtggaggagcggtaaaagaagaatccaattctagaaaacagtaacactttcaatacattggttcatagagataaactaatgagactaaacgcaggacagtgcaatgaggtaaagagttgcaatgtaactatatccccaaaggatgcgtatgcgttcattcttatcgactgatccactaaagtgaaacttggatagttacaaacagcgatgcgattctgaagaaaactaacagagactactacaatgccatgttctagagatcaatgtagagcaagaggtgaaaagcgagttagataatggaacctggagtattgaagagaccagtagaagtactggcaaatcttctctagtattgtggtgcttatatcagggaaagtcactacgccatctttcgattccgagaaaccacctaccataccaaataacaacagaattactaaatttagcatctacataatgaaattgagaatgatcttatgaatttggacttgcttctttattcaaattacgtaattgaatttccgattgagcataatctctcgctaaatttctctcaaattgaggccaattcacaactaaatcagattaagtatcacagaatccatcaaatccaagtaagatgactagatcagaatcttgattacgatcaccaactctacaacaaaagaggagaagaaacctggagaagtgagcatgcttcggatagtctgagaaaccatagcggcttctctgtcgatgacgaactcgaaaccttccatgcttatcaacttcaccgtctctctcatcttcgtcgtcgtcgtcggcttaagctttcctctctttctctctaccgcggcgtggtttcttaactcgcaaagaccgactaagttattggttgatcccaaactattatgggctcaatttcaaacgaggcccattatgaattatgatgtctacataatcttgttattagcccactaaaatcaccctattcggtcctttttagctgaaatttattccaatccttttttttatccgtttttaattgaaattcaaaagaactattttgagaaatgactaatttgtaaataatgcggttcagtataaattatgaaatttttgataattcaaaagaaccaaattctgacattttcaaagttatagaaaacaaacttaaagacgaaagaaaccttggaacatttatcaaaatcataaccagagctttacgggttggcgaaagatgtgattcacctaggaatcatacaaaatctttttgatcacaagtaaaacgagagatatgtattttactatttttctctaatcccaatcagttacacataaaccaaaaacttaataaggtttgagttactctttttcaaacttatcaccaaaaaagtgacgttgaaatctttagtctactagtataaatgtataatgatcaatcaaccaacagaaaacagatcatcaccaacacataattatttgatgacttggctctttataattggctggttacaatgttaacatgagagtcattaccgtatccgataataacttaagtcattatttcccataatacccttgaaacagccacttactttttgtcagctgcctaccatttacctgccacctcagcccccttttgtcattttctttaatgcggcgtcgttttattttccgtatcaacttgaaaagccagttatacaatacgaccatcatcttcatacgtataaacgtatttataagtaagaaataagaacattcaataacctctgacatttcctcaattccctgaaaaaatttcataattcaaagagtgttccttggagagaaaagtttcatcctttcaacagatctgaagagggtcaattgaaattcgttttcacgattcatccgccatttttccggggaaaaaacaaaaggtatgtactttgggactggggctaatttctttggatctgtctactttatgaagatcgcttgttgatttctgggggatatgtgtgtttataggtgagatcaaagaggaaaaatg

SEQ ID NO: 32981 - DNA, 1418 bp, Unknown; identical to SEQ ID NO: 1714
  misc_feature (1)..( 1418): 2750-1469P.txt file - cDNA_ID_3063866; gDNA_ID_1620438; Annot_ID_157099

SEQ ID NO: 32982 - DNA, 3003 bp, Unknown
  misc_feature (1)..( 3003): 2750-1469P.txt file - cDNA_ID_3063882; gDNA_ID_1620438; Annot_ID_157088
gtaaacacactcaaaagtgttgaaattataatattacatattttgctcaaaaagagctaaggctttttaaatgtacaaacaaattctcttttgttatatatttctagatttgtctactttaaacgtatgatgtgtttaacacttctttcaacaatatacgtgtatgaataaacatgttttcgacattccacttatgtcaatatcaacacataattttatggctaagcagtaaccaccagctgctgtgtaaaatcacactttaaaaaagtttctttagcctacatctctacgatcatgatgcattggcaataacaagatgacaacaaattttacaaaacaattctcataccatgtggcttaagagaaaaggccagcgaatttattcgaacccaacatatatagtgaagatgtctttttcaatctctttttttaacaagtatactttttttttttggtaaatttcttttagtgaatttactttcatcttgaatcattctttttattttcaattcagttttgttgataatagattttcatgaacgaacaaggttctaagagataataataataaagggggaaacaaaacacatgataataagaatctaataaacaagagaaaaaagagaggtgatgaataaatgtagaagtcgaatcatacaagaggtgcttgttggaaggtcgttggaccaacgcttattgtgatattcatgttcgtattctctatgtaggtttttctttatatcttcccagcatatacgtagttatttaagtttcttagaaaattactatacattgaatatctgaaacaattaatcatgatattatggaattttttttctttcaaaatttgtataaagaaaaaggaattttatagtgggggcattttagcatctcgtcgaagatatgaatgaatagagaattttgcaaagtgtaaagaaaacaaccgaccaaacccacttgttctctcacgtcctttttatgtgttaaattgtcatacacaaaaaaaatatttacaattataatttttctaaagtctttaatgtcaaaattatatgatctatttatatcagtaatacaaatgtaaatcgctatattttatatttttgttaaaaactaaataccataatttaaaagaaatattttctttttctttttatttgcgaagatattgtttagtcgtatggcattgtattagttacttacttagtagttttacagaacgaggtgaagaatgtcggaaaaaagaaagaggtgacgaagaattttgaccaatttgctactttgtaagggaaatataatacaaaaaaattgtatttagcatcattacaaacaatttctccattttgttttaacttttactatcaattttattatttttatacgaaacttataattaataacacgaggtaagcctgttttgttaaattgagtatgtcaattcatttcatgagataataaccttcaaataaagttcataagatagttgccccatatcggtaacttaggcttataaaacagtcttattattggtgatataaaacagtacttaactacttatatataagtacttacaacttattcttattattgttgatataaaacactaaagttgggttaaatcttaattccaattcagctgtttgatgttggtttaaaagtctgtttgcacctatgattctatgatataccgaaccgattcgattaaccagtagttacgagaagttatttgtttcaactaactatctattgatttgatgtaactagtttggtcctctgcgtataaaaggaacattacagaagagattaaatgataggcaattgataattgagacggttcaagaaaagatttagcaaccaacaaccttaacaaattttcatttacgtaactataattatagatcttgctatttttccattttatggcgtcttcttattacgaaactcatactattcagtcacataatctcatttactggactataatgggctttattgtaatgggctttattgtaagacatgagcccacaaatttggaaagtaataagcttcagctcagctaaagagagtctaaaaaccaaagggaaaaatgtcattaaaatccccaacttattgaaaaagttgatttaaatcctcaacttccaacgaaacgaaataaatatcaaacttttgttgattttccaaataaataccaaattttggttgactttccaaataaatatcaaacttttgttcgagtagccatattaagtatgacattaacagaccctgttattagagtccattttttgttaacagactcgttaattgaaaacgacaatattccctataacaataaaacaacgtcgttatgtcataaatgctcaattaaatcccaatttcaaatcatatgaagatttagggttagaattttgcttgatttggagatttaagattggatttgggaatttaattcggtcgttataataaaacgaggtcgctttcttgttataggaaacaataacgttttaaattaacggatctgttaacagaaaattaactccgtgaacgcaatatgttaatctacttaatattatacctaatatgaccatatatacgaaagtttggtatttatttggaaagtcaacaaaaatttgatatttatttcgtttagttggaagttgataatttaaatcaactttttcaataagttggagattttaatgacatttttcccaaaaatcaaggggagttttatggttttatctacttgacccgacagagaaatccggacccggataaaatccgacccgttcgaatgaactcatacggccgagatttttccaccaaactcgacggttaccactcgtttctttgtccaccatcttctctctctctctctctcaacccccgaaaatctccttttcccaaaattttccgattatctcacgccggattgtttttcaatcgccgtcttcataatctccggcgactgaaatcagtctggtaactatttgaattttcatg

SEQ ID NO: 32983 - DNA, 3003 bp, Unknown
  misc_feature (1)..( 3003): 2750-1469P.txt file - cDNA_ID_3063929; gDNA_ID_1620440; Annot_ID_157141
ggttttggagggaacgtggcagggaaaataaggaacatatggtagcgccattatgcggccaaattcgagtattggtggttggtgattcaggtaatattaacaaattctcgtttccatagatttggtaatggttctagctttttaagtagccatttaatggaactaaagaaagtttgtcgtagtgcacaaactcatccttaaagaaggagctaatgagaagatttctcatgatgattggatatgagtttctacttgtggaacctaataagagtcaagtttcgtaagtctactacatcttctccactattgagcaaagttttatctctggatatcaaattaggtgtgggaaaatcatctcttgtgcatctcattgtcaaaggctcctctattgttcgcccatctcaaactattggatgtacagttggtgtcaaggtaacttaagctgttctataaaaaaaattctcgatatggttaaagagagcatgggataagtttccctacttagtttctggaactctctttggtgcagcacttaacttacgcaagtcctgctagttcttcaagtatcattaaaggtgactcagagagagatttcttcgtcgaactttgggatgtttcaggtcatgaacgatacaaagattgccgctcactgttctattcacaaatcaatggtctgtctcaacaaatgtcatctctgtccctgttttgtcactgatgcgactgtttgattatgcaggagttatttttgttcatgatctttcgcaaaggactacaaaaactaatttgcagaaatgggcgggtgaagtttcagtaactggggagttttcagctcccctttcttctggtgggcctggtggtcttcccgtcccatacatcgttattggaaacaaagctgatattgctgccaaaggaggaacaaatggaagcagtggcaatcttgttgatgcagctcgtcattgggttgagaagcagggtctgcttccccatagtgatgaacttcctctctctgagagcttccctagcaatgttggtctcataatggtaaccacagactaaattacttgctttatttgaatttagtgttatgcggtatgtcatataattttggtaaaattatgcacaggctgccaaggaagctagatatgacaaagaagctctgaccaaaattttccatatggttggtgtcatttctgaccttgccatgttttacaatagctctctccctctctctctttctcttcaacctaatgaacgtttttcgttttcagttgataagaagaagatatttctcagacgaactaccgtcgccttcttcagcatggtctctttcccatgcaccttcccagcggttagatgagggcacaagtgatgaagatcagttctataaaagaacaaggtatatatatttatcatcctaaaaaaaatcggatttcttttctttatcgggttttggtcttttgaattttgcagcctaagggaaggagatgcttacaaatataacacattaccgcaacacaatctcatgcagtctcctacactctatccgcagcaaccacctgaccgttacaattacgctattccgagattctctctttccagtgtagaggaaaccagcaatggtaatggcaggtctaagcggatggatattaacgtctgaaagtaaaacacagatcaaatctcacattattttcctgtaatcttccaaacattatcttcttttatttgtcaacactccaaacataatctaagtattctttttttctaaataatacatgattcgtgtgataattatcttaatcatgtgaaaaaaacttgataagttttttttttttttttttttaagttggtaagtataagcttgatcagttagaatttagaatcccaaactaaatcggattgtaaacaactcagttccttataaatacactcgaatcataattgtaagacaaagaagaagaaaaaaaacaaagtgttgtatccaaacgatgaagacaacaaagattgagagtgaagccgtatgtaagcattggtttttgtatatagcggagttcatcaaagaaagactaagtgaagcgaaactcaaggaatacatggggttgatgaaacaatttaggtcccggcatatacaaggagatgaactcataaagtctcttcaaaatctgtttcaaggagacgtggttctttctcaaatgttcaacgcacttatgaaaacagagatccaagaactgcaaggtaacgaaaatccggaaacagtcgcaagaaaaagaacaaggagtgaagcagagaatgatgatgggattgaagaaggtgaaattcgagaggggcattgcgattgtcctcgttgcaagattggtcgggaagaagcagaaaggcgtagtatacccattaagaaaagaatttgtcgtgggttttagaagattttgttttgttcttaatatcacatgttattcagtttgtgcttttcaaatatttttccaaattctatgttactactcaatttatgttaaatcataaaataacttgggttttttttaatcaaattatattatgataaattttgttgttcttctctatttatcatcaattataaatatatttctaattaatcctgttatgatgatattcaatttcttgcagaatatatgattgtagtaaacaattttgatctttttttgctattaaatcaaaaatttataccaactttatcaaaatcattgcctattcaaacttgatgattattattcggtttatttcaatttttctctattactaacatagtaacatttatctaattaacctctcttccccaaaaaaaatctaattaacctccttggattttccttttttaattatagagtttgcttctttttttttatatataaccggtcaaagcttttgttttgtctcatattcatcactttcgttgttaagacggaaaaaaaaaaaaaagaggcagaaccaaaaaactttagggttcgatttcgctccttggtaatcaccatg

SEQ ID NO: 32984 - DNA, 3000 bp, Unknown
  misc_feature (1)..( 3000): 2750-1469P.txt file - cDNA_ID_3063933; gDNA_ID_1620440; Annot_ID_157137
tttgatagattcactgttgactcaaatattaaagctaaattgggtcattgcagatagtgatgtttgtatttagttcagtttattacttaacttagtttgattttcagtgtttcgttggttttacttttgctttgcgtgttttcttggtctagttacttcagacagaattagcttcacctttccatgtacaaaattatagttaaaagtaaggatacaaagtgataagtcaacatcactgattttttttttgtgaacttctccacttgcaggctgtgcaatccatggtgcagcaagcaatgcagtatatcgatcagacaccagacattgaaactcggatagagcttatcaagacgctgaacaatgtatctgctggaaaggtgcgaaactatgaaactgatggtgtattctttataataacttcatcattctgtgtaattgtttaccattgcattttacatgtatagatatatgttgaaatcgagagggcacgtctcaccaagaaacttgctaagattaaggaagaacagggtcagatagctgaagctgcagatcttatgcaagaagttgctgtaagattttgtgcatttggctattaaatctcctggaaattttcttcccttgttaacccctgcaatttgataaataattaacaggtggagacatttggtgctatggcaaaaactgagaaaattgcatttatccttgaacaagtaaggacttgtgtagttacgttgcaattaataatttgctggtgttttctttcattgtgataactatcaaactattgtggtcaaactttaaaggttcgcttgtgcttggatcgtcaagattttgttcgtgcacaaatcttatctaggaagatcaatcctagagtttttgacgcagatacaaaaaaagataagaagaaacctaaggaaggtgataacatggtagaagaggctcctgctgatataccaacccttttggagcttaagcgaatttactacgagcttatgattcggtacggccttcttgagcttctctatcacattgttcgtgatttgtatttccatcatttatcatggcattttaaattcttatatgactgtttaattatggacctctctctctgtctcttaaattctatcaatctgtgtggcttttgcttgctatggttttctcagagatgcatattacaactttttcctggaggacagtatcgaaatttggatgaatctccttttgtgtcaaatttatgactctcttttcatggccaacgattttggacatcaattgcattatgttatccactgaattctgacgtaccatgattgatttctgtggcattctcatcttttttattattaaccataaaaaatttcaactatgtaggtactattctcataacaatgagtacattgaaatctgccgtagctacaaggcgatatatgatatcccttcagtaaaagaaactccggagcagtggattccggtaagctcatgccgttgattggatgtatagttagtatacattctatagggttagtgtaataactttctttgatcttcaaaacattaggtcctgaggaagatctgctggttcttggtcttggcacctcatgacccaatgcaatcaagcttgctcaatgcaactctggaagacaagaatttatcagaaatccctgatttcaagtatattttattttctgataaattttgttatttcaataactgattcttttgtactcaaatgggttctcagtctttttttctttgtttgatatcacccgtttcaggatgcttctaaaacaggtagtgacaatggaggttattcaatggacatctctgtggaacaaatacaaggatgagttcgagaaagagaaaagcatgattggaggttctttgggtgacaaagctggtgaagatctgaaactgagaatcatcgaacatgtaagtctctcaatttgtctttaagcttgtttacataagttgattgatgctttaaagttattaatttattctgcagaatatcctcgttgtctcaaagtactacgcaaggataaccttaaagagacttgccgagcttttatgcctgagcatggaggtatgtttgatctaatctcactggctatatcaactatgcttctgcttgttataattgttggaaattgtgatttcaggaggcggagaagcatctatcggagatggtagtgtcaaaagcactgattgcaaaaatagacagaccatctggaattgtgtgcttccagatcgcaaaggacagcaacgagattctaaactcgtgggcagggaatttggagaagcttctagatcttgtggaaaagagttgccaccaaattcacaaggaaaccatggttcacaaagccgctctcagaccttgaaaacatgcggtcttcttcatgaaaacttttcaggatcttcttcgttgagttattagcatctttatgtggtaaaaactcgaatcagtgtttccttttaaaaattgtactatggatctgtacactaacgaagtgttttgccacttattggttatttcaagtgttggtggattagtttttggttaaattgttagaaaatttacatgaatttactgaacgagaagaataatctcgtgtgtgccccaggagatagatccaaaccttgcgctgacaaaaagtcagacgataaaaaattgcttcatcaaagattgcaagttaataataaaaactaaaattatgatggcactggcacatgtatagtcttccatactctaaaaaaaactaataaaatttgtttattgttgttaattaatgtgattaaatttaatagagaggagacagctttgccagttcatctctggtaaatagtccacgttctggcgtctttgggatttcaccaacaccgtgacagctccttagatctctcctcgattacttcctttttaatttccatggctctctaaaaatctctctctctttctctctctcttacttgtattgttacgatctctgcttgaagattatg

SEQ ID NO: 32985 - DNA, 3000 bp, Unknown; identical to SEQ ID NO: 1726
  misc_feature (1)..( 3000): 2750-1469P.txt file - cDNA_ID_3063937; gDNA_ID_1620440; Annot_ID_157136

SEQ ID NO: 32986 - DNA, 3000 bp, Unknown; identical to SEQ ID NO: 1727
  misc_feature (1)..( 3000): 2750-1469P.txt file - cDNA_ID_3063945; gDNA_ID_1620440; Annot_ID_157132

SEQ ID NO: 32987 - DNA, 3000 bp, Unknown
  misc_feature (1)..( 3000): 2750-1469P.txt file - cDNA_ID_3063949; gDNA_ID_1620440; Annot_ID_157130
tgaaccagaatcttcttcatcctctgagagtgatggttcatatactggaagctttttggtcgtcgggtgggtagttgttgtatcagaaactggaccaagttctgcgaatgccaagtccgaatcatcttcttttgacttggcatttggtgaaggagttgaaggaaagatgtatccagatgctattctcactccatgcatgactcgaatcagagactgcaggttgtcgtaaccgagcttgtcaaccgctaaatggtacccatactcctctaagaagtctttcctgaaacgaatcaggctatacccttcagggtgttcctctgttatcttctttatcatcttctgacaatccgctattgcattacttttgtatctttccagctctttccggtccacagaaccaacagaaactccagcatgagcaacgttcttgccgcttttctcaccattttgtttctgccactgtgattttgaagaatccgagaagattgagctcaaaccgtttgaagcatgacggtggccagggctagatcctttgatgattctgaatggtaaagaagaagatggggtttcttcaatccatttcttttctgatattagcaaagtaactaaatgaagcatgcttgattcatcgagcagtctgagacacgaaggcccttcctcctgcacatttttagccatcacctccctgaccaggttaagacggaacagcattagctgaatactcgtcccaaaaaagacaacaaatggctaatgcaagaaccaattgtaatagttctgaacctaagatagatttacatattaatcaatatctaatcaaagtcctgccaaatcaggagggaagagaatgtacgcaccttgtcctcgagtgagatactatagcaaagcctcttggagaattaatgaaagattcaatatcactccaaaaatactcttttgcaaatatgtcttgtacttgagaatcaacattgacaagctcctgattcccactagagtctttgctagactttgtattctttccccagaacttgaaactcttcaaaaggcgacctaaaaagcctggacttgcatctttatctttactgtctacgtcatcagctccaacttttacctcatcgaccgactcagcaacgaaagaaggtgagatttgagacatgggcacagttccctgactcgatgactttaagtccttatcctctttatgtttgtttccacttccctgacttgatgactttaagtcattatcctctctatgtgtgtctccacttccagaaacgctcttcatttctgggagatgctctaattccatctcaggtgaaccataccacagtctttttagcttttgaaaaaagccatcttccatggacgaatcactccacgcaacaagagcgacttgattcgtctcgacgggtttaacatttgccttaacatccttctggccgaccagaattgggtcttgagaactctctgatgattcttctttaacaattttatcactctccaataccttttcctgcttctttccaagtaagccatctcttcttctttcagcagcaagctctacatcgctaattagctttggtgatggagcattaacagtttccttatctttaatcttctgatcaacagcagtagacaaacgaggactagaatcaagccgcatcggaggcttcttttcggtaacagcccgaatcataaacaagccttcacttactgtagtaacctgtaagatatctggcatggataaaagaaacttcgaaaacttcttatgtccatagaaatctttatcaatagccaagttgctcttactcagctcagcacgtagttctgtaatggcagcccccttgggatataaactcactatcgaacgaatcttatcaacaacttcttttggaataggacgaaggttaacaacagcattcgaattcacagactcggatagttcttcgattttcacactagacgaagattgctcagtagtggtagcaatagcaaatggatcaagaagaggaatcctatagtgaccataccaagagttataaggaccatcaggaggctgattaaaatgcttaccagtaacacactctcctttaatcaaagcatcccaatcccacataatagaagcagcactacacaaaacaccaggagctgatgatttactcgcaagcaaaatgttgtaattgttcatcctcaatctatgtaacacacttgcaaactccttatcactagagattagcaaaagatgagctggtggtggattctgagaaacccaacacataagatctgtgattagagatctatcagcactgttcttaccaccgttaggaacatgagtgagactgattcctgtagcggagagagcgtcttggtttgatctggggagctgtaaaacgtcaccgaaggctgtgattgtgattggtcctttgattccgctgtttctgatagcggcggtgattgattgtgctactttgtagacattggtgtctacaggtaagttacagctcaggaagtcccaccagaccgaaaccctaacggatcgggactcttcgtcttgctgaggacgtcgagagggagaatggctggatccggagacgaaattggagccggaggtggttgtggtggagaatggagaggaatgaatgttagtgatgaaaagggtaattgttcgacggtgagattgggttgtggaggaagaagagaggcggaagagaagggatttggatggtaaagatccaaacttcatggtcggagagctatttttgctccgggaaatggagagactgagagggttttaggagtgaggaagacgaagtaaaggaaagcagagcttaaaccctagttattattttggaattgtcgataaccgaatggtatcccaattgaaccaaactaaaccgtactctcgctaaaccaaaaccaaatagcgtatggtttaatattctaattcaatgagtacagtaattagggatttcaatttttgtttgagagagagagagagagatg

SEQ ID NO: 32988 - DNA, 2509 bp, Unknown; identical to SEQ ID NO: 1721
  misc_feature (1)..( 2509): 2750-1469P.txt file - cDNA_ID_3063951; gDNA_ID_1620440; Annot_ID_157127

SEQ ID NO: 32989 - DNA, 3003 bp, Unknown
  misc_feature (1)..( 3003): 2750-1469P.txt file - cDNA_ID_3063951; gDNA_ID_1620440; Annot_ID_157128
acattatatattgatcttgatcgtatgatttcatttatatttagggactgaattatatattatattgtaacatttaacatacagtatatcatgtgttgctagttatgatttacatgcacttcgaaaatggtatctgattttttatatgatttagaacttatctggcacacatcattgaataggatctaacacattaaaacactgtctaacttatttgtttgtatgtgtgtgttaaatcatcattttagctaagatttttaaccataggcaaagaaatgactcaaatgagcaaacgagaaactgcagacagcaacatatatcaaactaactctaataggcccaatatagcccaataagaagtgtgaccgatggagggaagaatcgaatttaaatgatacagagtttttttgtttggagaggaatagactgatatgatagtccgtgaaaatattttcatcttgttttcaatgtggagatattttaaagtttgaaaccaatccaagttctaaaacatcaaaagcttttattctctgtttaaaccacttggttggtcttggtcttcttgaaatatacaaaccagacccaaacgataatcagtgaagatgactgcatcattgggtctttaagtttcctattgggccaaatcagcccaactatattattgttattatttcagtccattaaagattttcggcccgttttatcgttgggaattcatctatatttccccaatttgatgatacacagaacaatttcatgtgtatacgataagaggcaaattcaaaatttgcaatcaatgtaaagtggaaatgagaagcatggtggctcaaatcaacttatctttccttggaatacaaactacaaatgatgacggatttggcttccctttgaatttaccttttacctctctctttttttttttttataggtaatgttgttattggacaaaaatgttaagaaaataaaggtgaatgataaattagaagagtacccataactattttgattatttaagttgccaaccaagctagaccactttccaacttttatagacaaagtgtaagaacttagcacatgctttccaacaaggaatatgaaactttatttcaaaaagattattgttaaagcttttaatcattctaaaaggtgattaatatttgaattattggaagtaacttgttttggacatataccaaattaatcaatagtatcaatggacatataacatgttgtgagactatatcaatgttatattccaagccagttaaaccaatttataatgataccatttatagataaacaatacactttacacacattattttcttagaattgggtctcatatagaacactcacaaaggtgacttataaaaaatgcttcaaagatcctagtcttttagtgtgcattcctcaaaatcgtagttgatatgtatcttgctcctattcgggttttggtctagaattttggtttcaggaattttcaattaactcattaaaacatttataacataaaaagatatatcacgaaaaccgatcaatcatttaatatatttttattttattttattttttgtcacaataaaatctagacaatagtgtttaaacatttatcaaaaaattcaccttacgattaatttgttttatattttgtgatgatgcaatttaatctatataaattataaaacatatcgataatctgtgtttttctttttctacatataaaattcataaaaatgagagttttgaagctcttaaaatggactagtcaacaattggccaatctttgttctaaattgctaataaacgaccatttccgtcaattctccttggttgcaacagtctacccgtcaaatgtttactaatttataagtgtgaagtttgaattatgaaagacgaaatcgtattaaaaattcacaagaataaacaactccatagattttcaaaaaaacagtcacgagaaaaaaaccacagtccgtttgtctgctcttctagtttttattatttttctattaatagttttttgttatttcgagaataaaatttgaacgatgtccgaaccacaaaagccgagccgataaatcctaagccgagcctaactttagccgtaaccatcagtcacggctcccgggctaattcatttgaaccgaatcataatcaacggtttagatcaaactcaaaacaatctaacggcaacatagacgcgtcggtgagctaaaaagagtgtgaaagccaggtcaccatagcattgtctctcccagattttttatttgggaaataatagaagaaatagaaaaaaataaaagagtgagaaaaatcgtagagctatatattcgcacatgtactcgtttcgctttccttagtgttagctgctgccgctgttgtttctcctccatttctctatctttctctctcgctgcttctcgaatcttctgtatcatcttcttcttcttcaaggtgagtctctagatccgttcgcttgattttgctgctcgttagtcgttattgttgattctctatgccgatttcgctagatctgtttagcatgcgttgtggttttatgagaaaatctttgttttgggggttgcttgttatgtgattcgatccgtgcttgttggatcgatctgagctaattcttaaggtttatgtgttagatctatggagtttgaggattcttctcgcttctgtcgatctctcgctgttatttttgtttttttcagtgaagtgaagttgtttagttcgaaatgacttcgtgtatgctcgattgatctggttttaatcttcgatctgttaggtgttgatgtttacaagtgaattctagtgttttctctttgagatctgtgaagtttgaacctagttttctcaataatcaacatatgaagcgatgtttgagtttcaataaacgctgctaatcttcgaaactaagttgtgatctgattcgtgtttacttcatgagcttatccaattcatttcggtttcattttactttttttttagtgaaaaatg

SEQ ID NO: 32990 - DNA, 3003 bp, Unknown
  misc_feature (1)..( 3003): 2750-1469P.txt file - cDNA_ID_3063986; gDNA_ID_1620441; Annot_ID_157179
ataccacaggtttctgaacctgtaacaagtcagtagtaaatcaccatgagaacttaattaggcacaagaagctctacttacacccgtcctgaaagttattcatattttagtaattggagtcttttgaggatattactatacttcagtatacgattagttaaggatttgggttccgatcttatctaaggttttcatataactttcctctttcgtaattcaggatgttaggtaaagggatatgttcagacaaaagcatttcagctgaaaaaaggtcaaacataccgcattggtggcatcaaactttccacctaatccaacctccaatatagcagcatctacctgcataaagaagcaaaaagcagaaccccttatatcaataaagagaacatgatgttagtttatctatcatgtcactgagtaagaaaaatagtcagccaaggtaaagactggtatcaaacctcttctgcagcaaatattttaaaagctagcaatgcaaggaagcggaaatatgtaggcattggtatctcctcgttagttctctcctgcaaatcaaatagtcggcaaccttgtattttgagtaaaaaactaaagcatgtatcttaatttgcaactatgcacaccattgtaaattcttatgagttcatatcatgaaatactcagaccgcaaaacaaaaggtgacttcaacaagatacagggaagacactatacatgagctctaccgcatcaccaccccctcgatgaaaatagttccaataatacaatttctctaagtaccaaaacttcagtactgaacaccatggttttaagctaaaatggaaaaacaaaataagtgttcatgaaaaagggtgttttacatgtttatcacattctatatggctttcatcactaagattccaagtttacagaacgttactaacaactagtctactagtcaatcgagataaccaaactacagatattgagttcaaaacaaatgaatcaaatagctgaaccttcttttctcacgaacataccttgagcctgttatagcaccaccagaaatatcccaaaaatttctcttcacttatgtccacactgcagcaataaatagaacatatcagattaagcgaatataagcatttctcagtaaagaagagtgaaaaacaggattatgctagcgaagtattgttggttcctgattatatgagggccggtaactatatatttattttctcaaaattttcagcaaacttagaaaaacttacccatccaaacgaaatctttcccggacatcaatgaggtgaggtgaagtgaagagtccagttcgaaagccatagtttcgaataatagactctgtaaaggtacatgtggatcccttcatgccacataagaaacaaaaaggaatactgttaggtgctggatcagatagtaatcagccatgctaacaatgaaccactttcatcaaacaagttcactgaaggtttgaatcaaaaagtaagcaagtactagtttcataacaatttcctttgtgctatcccaaatctactatcacataagtgatatgagtcaagattaaagtagcaacttttgcaaaactgacactccatcagatgaaaccatacgcatctccaagcatgcaaggatctcaaaaccaatgttcttctcgcactcactcaaattggaaaaaagctcaagatgactcagtccagaaacgtatctctaatccccacagagcaaaaaccttaggcttcttctgacaaagcagtcataaggacgtaacggtcacaactagtgtagaagctgacacgaattcagaagatatctaactaactaactaaagtaacaaaaccaactcctaatattgacaatagatgatttagtatcatttattgagctttaccagaaaaagtaaagttgttgttgttaccttgcctttggtaccagcgacatgaataacattcatctttaaaatgtcttcttccaggtcaagtagctgccaaattaattacaagaagcgtattcaatcagaaaataaaacaaaaggtgcaataaatattcaaaactctacgagaatccaatcgaaaagagaaaccttgagataatcaaagactaactcaaagcgatcccctttattgctcttatcagcacgacttcgtttcgtgatcaaagacgacaaagcagccaacgcttcctcatatgaatcacctcctgtcaccaacaaaaacaaacaagtgaactcgattcgattactgttatcatcaagtgaggaagagctagagaagaataagaaaatcaataacaaaccttgagctgccatgtcgatctgctttcttaacgaatgaatctgaaacacgaataagagagaatatcagagatgccgaaactccgagattctcggaatatgagagacagagagcgaaagagaaagggaaacctgaaaagagagaggagatggtaggtgaggctggtggtgttggtagtgatggtggagccgaagagtgagaggaatcgagagttgacagagaaaggcagagctcaaacggcacgatgtggttcgaggtactatcgaaactgcaaacattctcttgtcactaacattgctacacttcttttgctttttgtttactctttttcggcaatttgttgacgaaagcggcgcatcacaaagacgaaaaaaaaaaaaaaaaaaaacagagcgcatcacaattttgttaagcttccttattaaatacaaacttaattgaattaataaaaagtctgggtggtgtagtcggttatcacgctagtctcacacactagaggtccccggttcgaacccgggctcagacatttttttactcttttttttgggattttttagtttgcacgtggggactcactcgcacacgtgtgtactaatctccatttcttaggcaaaagcaaaccggagaaccaaacaatcacgaatcgtgtaatcaaactcatcggagtctctcgaattcgtctttgaagaggaagagaagagaagaggcgagggagatatg

SEQ ID NO: 32991 - DNA, 3000 bp, Unknown; identical to SEQ ID NO: 1732
  misc_feature (1)..( 3000): 2750-1469P.txt file - cDNA_ID_3063988; gDNA_ID_1620441; Annot_ID_157178

SEQ ID NO: 32992 - DNA, 3003 bp, Unknown
  misc_feature (1)..( 3003): 2750-1469P.txt file - cDNA_ID_3063992; gDNA_ID_1620441; Annot_ID_157172
aagaaaaaaaagtcaaatatattctctttctactcgtgactgaggaagagaaacagagagcataactttatatccagccgattttttttcaaatttcttaccttttgctctcactaaagccatgttcttacctttatagtgagtgttatctaaactcttttgggtcttttgcaaaagaaaccagttttcaaagttcaaaattttgtttttaaaaatggagaatttagtgaagagctgcgcagggatcgagaagaaaagaagcaatttgactccatcgatggaagatatacttacagagtcaaaggagagaagcagcactagcggagcgagctacgaaagctcctccaccaccaccgtcgcttcgtcttctccaccaccaccaccgtcgcagattctgggttggccgattagaaaagcttcatttcggaaaaattcgaaggagagtgttaattttgatcataagaaattaacccttcacgatgattctgggtttaaagcgaaagagatgaattctgcaggttagtgagaaaaaatcaaaaattgaaacttttttactcagccctaagatctcatgtgttttctttgttgttgttgttaatctgattgtggattagatgtggagatgatgaaggagagatttgcaaagttgttacttggtgaagatatgtcaggttctggtaaaggtgtgtgtacggctttagctatctccaacgccataacaaatctctgtggtaagtcttaaaaaaagacgaagctatcttgtgtttgttaaaatgcttgaaccaaagtgttgaatttgatgtttcttcttttagctacgattttcgggcaactatggagattagagccactttcaagcgaaaagaaggagatgtggagaagggaaatggagtggattcttagtgttagtgatcacatcgtcgagttaacaccttcaacacaaacttatccagacggcaacaagtttgaggtaagctcttgattttttaagattgttgcaactgcaattactggagtttgaattgtgaatcttcttcaggtcatgacttgtcgaccaagatttgatcttttcatcaacctccctgctctccgtaaactagacaatatgcttctcgtgagtttcacttaactttcttatacgatgatcctctcaagtgaaacctgttttgatctctgatgtaattttcttttgcattaggatatattggcgagtttcaagaaaactgagttctggtatgttgatcaagggatcgttgcttcggaaaacgatggctcagcttctttccgcagaaagattcagcgccaagaggagaaatggtggttgcctgttcctcgtttagcaccgaatggtcttactgaagaagcaagaacagaattgaatcataagagggaatgtgcgacgcagatacttaaagctgcaatggctattaacagccttgctttaaccgaaatggatgttcctaaatcataccttgaaacccttccaaaggtctacatctttaactcaaaacatccctataaaaaccattgtaaggttttttttttgttctgacattaaacttttggtacagaacggtaggtcctgccttggggatgttatctacaggtatgtaacatctgacaaattttctgcggagtctcttctcgattgccttgatctgtcctctgagcatattgctcttgatatcgcaaaccgtgtggaagcttcgatatatgtttggaggagaagagttcaaacaaaacttggagtcaacaataatacttcaagcactactccaaagttaacatgggaaatggtcaaagaactaatggctgctggtgacaaaaggggattgcttgtggagagatcggaaactctcttacgttgcttgaagcagcggtttccttctctaacgcagacttctctagacataagcaagattcaatggaacaaggtccagacacacaaatcctctaaatacattacagtacaaaatggctttgcttgttcttatatattcagtcctttgaaaatttcaggatattgggaaatcaatcctcgaaagctactcaagggctttggagagcttagcatcaaacatcatagcacgaatcgatgatttactctacgtggacgacttaacaaagcaatcagatgataacaatcttttgtcaagtccagcggtcagcagcattatagctcacaagaaagtagtaccactcccttatctaatatctgcatcaggaactccatatagaacaagcttctcaacaacaccaggcttctctccttcaatgattagccccaagaaaggagagaggagaacaccttactccagcaaggacactaacaaaatcattgagaaaggtcttccttctcgaggatatggagtgagaagagtcttgaacaattatcttggcatggaatcaaaactgaaaatatgcgttaatccgtcagataatgcagatacagcagtgattaaccaaatcagcaaagacgtggaagaagagaagaaaagaaactcaacatcagtccatcaaaagggtcctccaaagtacactgtctcttaaaagctaatagaagaaactcaatagagtgtataattaatgcagacatggattgatttgtttgatatttacttgtagtttctgtcttatttggaatggtaaagtgtctatctttgcaaaccaaatcagatcacaaaatagacaaaaatgagagtggttgtaacaaatattctcatcaaatttgttctggtttggtttactagctttatttatttggtaaacaatcaccaataacgtgtataatttaaagttatgattataatgtttctttttgtaacccactacaaaatgtcgttgtagtatagtggtaagtattcccgcctgtcacgcgggtgacccgggttcgatccccggcaacggcgattttttttttttttaaatctcttcctccttttttatttcctttctgaacgaagctctctctctgattggccggatctgccggagagaaaaatg

SEQ ID NO: 32993 - DNA, 3003 bp, Unknown
  misc_feature (1)..( 3003): 2750-1469P.txt file - cDNA_ID_3063996; gDNA_ID_1620441; Annot_ID_157171
gatgtgactcaacccaatcaaaaccccaacatctaaaatcgagaaatctgtgatcaagttccttacgattgatgtaccaatcgattggaaggggagagaagaaggacatacctttgattaagatgcaagggagatgattggcgagagagattatgggatctgcagctcaatgaggacgatgagttttctaattactactcaattttcctgggaaaatgaaaaaggtttggaatttggataaaggagacgggagctgtatcttcacgtttctcgtgttttcatttgtttttttgctcttgggatagcgacgaatcctgagattattctaatttcaatcttttcttcttcttcttcttattcttgtcttcttcttattcatccttcaatagttttcttaccaaataaatagcagcaacaataaaacccctttcaaataagttggaacgtgattttttcacgttctcaattacttgaaaacgtgatttatatcaatatttcaccgttcagatttcagaagataaaatcgtttaccactttaacgttttcacgtttccaaacatgattctgattttgattttgtgcaaaatgtattttattagtctaaactataaaacagtttatgaatattctagaaaaaaaccctctattcagctataatatttgtttgattcaataattttatgagattttaactatcaatctcacatataccaatttgtcttcttatgaactttatggttgtatttattatgattagtgagtatatattttctagggttgaggttggcaattggcatatggctaaacaaccctattgcttaaggcttagtttatgtaggttaaacttgtacttagatctaagatatctatatgcgggcagcacaacatgctttcaaccatgtttagatagtttcaattgcaaacttaagcaatgattcattactactgagtatatgagaattgaagcaaggtttagtcgtttagatagtttccttagttttcttagcttagatctcaacaccgaccaaacataatcatttatttggactataagaactctcacgatatcttggtttgatttttacttgttggatcaagggtttgagggcaatagtttatatttacctaacttgaatggagcattcgtccctgaattgcattttgcacctatagaaggtgagagagttcatgctcgggtataagaagtaatggacttgaacaagagggcgccaaaacttttgtctaatctccattgatactgtaattaaaaaaaatatcttcataaccaaataaagagtctatagactatatataggtcagtcgttttcctttaaattcaaacctcttatgagattttttaaagaaatatcgtaagaaagaaaattttcaatcatgaagtctataaaagttgtatatgccaaacataaaaagtttgaagacaaagggtttgaaaaccgagattgaatgtagaaggcgggacacataacaaaaaaagtttgtaagagtcattaagagagtagtaagtatatcaagttatcaatatagatcgatatcaataccttttttaaaaaaataaaaataaagttacaacatttgggaaaagtaaaatttaggtgagtgctgtgtcgaaaaagtcaaaaactgtcactttaataaaagtactataccttatacatataagttcatttgaatttttgtaaaacacatccgtttaacaattcgaatttagacagtccataacctttcactttattttgactagtaatcaatagtattgctttatcgaagttcaaattttagaattgttagatgtgatggacaaatggacatgagtcgttatgacgtaacaaaatcctaaaaatacagatgtttgttctttgttttttttaacgcaatggaaactatacatttttttgaaaaacctaacaaattttgtttataaaggatatcaaattgttatcgtagaaactagaaagtaggaaaactaatttaaattagataattaagctctcaaagtcattaagctacgcctaattgtgggaggttaggcccttaaacggctacgaacttcaaacgaaatcgatatgggaccatgcgtttgaattaaaacctcagattactatattgcacactacagacatccatattaacgaaaatgccactcacttacccattgcattatttcctgacaacaaacaaaaagatggctgcattaaatccacttaatcctttttaaactcctaattattacttatttactttaatattggcggcctatgtcacattaaattttggtactcttcaagaagaatgtctccactttcttttgtatgaacatttttccggtctactctgcattcaataatattcagaaagtggttttgttgatatttgttgccatttttcgttcaataaaatcttataaactgaaattcaaacttatcttagacccaatgttaaaaaataaaaaaaaacttatcttagaccctgaatacagctatattcgtgtttaactaaaacaataaaacttatatttgaagttattacttccaaacaattaaacgtacttacatcttgtaagatttctttagttaacatgtcaattttggaaattcacctgtctcatttacgtaactaattattgccttgtaattaataaaccacaccgagtcaccaattgctatttgtggtaaaatactaaattcttgatttaaaacatgggcagaaccgtaatatccacaccattcaagaaatttgtccgccaaaaagataatttaatattttgaaagaaaaaaaagtcaaatatattctctttctactcgtgactgaggaagagaaacagagagcataactttatatccagccgattttttttcaaatttcttaccttttgctctcactaaagccatgttcttacctttatagtgagtgttatctaaactcttttgggtcttttgcaaaagaaaccagttttcaaagttcaaaattttgtttttaaaaatg

SEQ ID NO: 32994 - DNA, 3000 bp, Unknown
  misc_feature (1)..( 3000): 2750-1469P.txt file - cDNA_ID_3064003; gDNA_ID_1620441; Annot_ID_157168
taaatgagacaggtgaatttccaaaattgacatgttaactaaagaaatcttacaagatgtaagtacgtttaattgtttggaagtaataacttcaaatataagttttattgttttagttaaacacgaatatagctgtattcagggtctaagataagtttttttttattttttaacattgggtctaagataagtttgaatttcagtttataagattttattgaacgaaaaatggcaacaaatatcaacaaaaccactttctgaatattattgaatgcagagtagaccggaaaaatgttcatacaaaagaaagtggagacattcttcttgaagagtaccaaaatttaatgtgacataggccgccaatattaaagtaaataagtaataattaggagtttaaaaaggattaagtggatttaatgcagccatctttttgtttgttgtcaggaaataatgcaatgggtaagtgagtggcattttcgttaatatggatgtctgtagtgtgcaatatagtaatctgaggttttaattcaaacgcatggtcccatatcgatttcgtttgaagttcgtagccgtttaagggcctaacctcccacaattaggcgtagcttaatgactttgagagcttaattatctaatttaaattagttttcctactttctagtttctacgataacaatttgatatcctttataaacaaaatttgttaggtttttcaaaaaaatgtatagtttccattgcgttaaaaaaaacaaagaacaaacatctgtatttttaggattttgttacgtcataacgactcatgtccatttgtccatcacatctaacaattctaaaatttgaacttcgataaagcaatactattgattactagtcaaaataaagtgaaaggttatggactgtctaaattcgaattgttaaacggatgtgttttacaaaaattcaaatgaacttatatgtataaggtatagtacttttattaaagtgacagtttttgactttttcgacacagcactcacctaaattttacttttcccaaatgttgtaactttatttttatttttttaaaaaaggtattgatatcgatctatattgataacttgatatacttactactctcttaatgactcttacaaactttttttgttatgtgtcccgccttctacattcaatctcggttttcaaaccctttgtcttcaaactttttatgtttggcatatacaacttttatagacttcatgattgaaaattttctttcttacgatatttctttaaaaaatctcataagaggtttgaatttaaaggaaaacgactgacctatatatagtctatagactctttatttggttatgaagatattttttttaattacagtatcaatggagattagacaaaagttttggcgccctcttgttcaagtccattacttcttatacccgagcatgaactctctcaccttctataggtgcaaaatgcaattcagggacgaatgctccattcaagttaggtaaatataaactattgccctcaaacccttgatccaacaagtaaaaatcaaaccaagatatcgtgagagttcttatagtccaaataaatgattatgtttggtcggtgttgagatctaagctaagaaaactaaggaaactatctaaacgactaaaccttgcttcaattctcatatactcagtagtaatgaatcattgcttaagtttgcaattgaaactatctaaacatggttgaaagcatgttgtgctgcccgcatatagatatcttagatctaagtacaagtttaacctacataaactaagccttaagcaatagggttgtttagccatatgccaattgccaacctcaaccctagaaaatatatactcactaatcataataaatacaaccataaagttcataagaagacaaattggtatatgtgagattgatagttaaaatctcataaaattattgaatcaaacaaatattatagctgaatagagggtttttttctagaatattcataaactgttttatagtttagactaataaaatacattttgcacaaaatcaaaatcagaatcatgtttggaaacgtgaaaacgttaaagtggtaaacgattttatcttctgaaatctgaacggtgaaatattgatataaatcacgttttcaagtaattgagaacgtgaaaaaatcacgttccaacttatttgaaaggggttttattgttgctgctatttatttggtaagaaaactattgaaggatgaataagaagaagacaagaataagaagaagaagaagaaaagattgaaattagaataatctcaggattcgtcgctatcccaagagcaaaaaaacaaatgaaaacacgagaaacgtgaagatacagctcccgtctcctttatccaaattccaaacctttttcattttcccaggaaaattgagtagtaattagaaaactcatcgtcctcattgagctgcagatcccataatctctctcgccaatcatctcccttgcatcttaatcaaaggtatgtccttcttctctccccttccaatcgattggtacatcaatcgtaaggaacttgatcacagatttctcgattttagatgttggggttttgattgggttgagtcacatctgaatttcagcgtcattggttggcaactgcgagactttctggtgccactgagattttaacaaaattggggttttcgattcaaaaagtcttttctttttgggtacttttcgttgaacccttttaggtagagtttctgttttcgaagaaaaagtcatggttttaaggggtttaggtttgaggtagcttcagtttcggaatttagctttgactggttaaggaatttgagctttatgagtttattcgtcttcctatcttgatgattcttccgttgtgttgcatattcaggtgtattatatccgcaacaagatcattagagaaggctgttacaagtttgttttatgaccgcgtaacagctcacttggtaattgatg

SEQ ID NO: 32995 - DNA, 3000 bp, Unknown; identical to SEQ ID NO: 1748
  misc_feature (1)..( 3000): 2750-1469P.txt file - cDNA_ID_3064019; gDNA_ID_1620442; Annot_ID_157199

SEQ ID NO: 32996 - DNA, 3003 bp, Unknown
  misc_feature (1)..( 3003): 2750-1469P.txt file - cDNA_ID_3064026; gDNA_ID_1620442; Annot_ID_157215
actataaacataacaatgtcattacaaataaaaactctaaagatgaactctacgttcactcatatcttggaatcgttttatcacgattcgtttgtaacagtgttaagtacttgcttttcaataaaacaaacaagacaatcacttaagaacacatcactgatacggttacgcaatgtagtcttcacaaaattcatcgcggaaaaacatctttcgacagttgccgttgcaacaggaagaatcaaagatagctttagaagacgatataccaaaggatgtgaaagatgcttttttgtctctaccatcacacgagcaagatcaccaagacactttaaatctgtaaacttttcatcgtttttcacattatcaaggtagatctcaagttgatgatcaagagatctacgctccacaaaactaaagtcatctggataaaactcgatcaatctcacgagcatggacttatcaaactaacgaaaagaatctatcggactcacagaatctatggtccataactaaaccacatacttctttttaaaagggcctgtctgtttattttttattttcttagatctttttgtaattggtccatgatgactgagtaagaccccaaaagccgtaaaaagtaaaaaaagatggaatctttatagtttaaaaacaaaaggctagtactaaaatatctagttacggttacgtgtgccgccatagaaaaacaaatcttctgctcagtcttggattgagaggtaagagatccccaaaacttcgcttttcaatctctgaagctgcttttgaattctcatgttgatttctttgaatttgcatcgatcaagtttaggttttttggatttgggtttctcctaaatatcttctttgaccagtgtgtgtgtggtttggatttatccttttggatctttgtttctccagaataagtacagaaattgtaatctttgtcaaattttgtttattttgagtttcttagtgaactcagttggataacagtgacacatatgagatttgagatgaatttattttctggtaaatgcatagagattattaatgtttcttactgatttgagaattgcaaggcattgtcctttgagtttggtgttaaagttagcaaattggtgactatctctattgagtttacatgttttcttggttgttattgtgaggatttaagatttgcctgcttttgtatttctctttggtcttgtaatgtcagaattgtttctttcttaaagttgatttctttgtcaatctttaaacagagatcgaggtgtttttgacgcaatagaagatcgttctgcgtgttattatccaagaactgctttagtgttataaacatttgagcagagatgcatttgtggccatcgttgaaacttcgaaactctttcaagagcactagccagaagagatatcaaaggatgaacagtgggaaacaaagtcaaagcaatcagcagaaactccttgacggcgacaaagaatctggaagccccgagatttcgtctggtggtgggtttgctgttgtttgtagagatgttgccatggttctttcttgctgctactgctgtttctgctgtggaggtaaataaaccttctcgacacttttccccttagctagtatctgtgtgatctctggaccaatgttttcgtatgacctttgagcattatatgcaagcaccatggcacattctcatcacatattaacttagttggtatcagtttagaatctagattaaaccatgatttttatcttttagcagatatacaatggttttcctttagtgattattcgttcttcttcatcaatttctccgattctgattctgattcctctgatttgttcagcttgcattgatgaggaggagatttgatgcaatcatgtaagctcctggtggaggagttaagtgaaagattttagccttagaaaacatcaatctctcaaaatgtaattagaaatgttgtttataattaatctgaattctttttccacctttcccaaatcaaatttatatattatgattgaaattcacgatattgactttatcaaatagataagcatggttaaatgatttcaaatgattttctatttaacacaaactaaacttaaacagacacaacttttgttcatgtagaattttaactattcatggcatttaggatttgaactgttgaatttccgtttaaaattaaatgtcatttttaatgcattattttaaaaattatttacatttttatgactttaatttaaatgtattttaataagaaaatttataaaatatattaataaatagtaaaaaataggtttttcatatgtatgtcaaattttaaaattgttttttttatataaacgatatttatttataaacggaaggaatataattttatgagttttttttctttttttttttgtcatccaaaattaattaaaactcaaacgagccaatctcgagggatattgtttacacatgtgatatgatgcggttcggtacggattttccgcgccaaattattcgcttttacattagcacttcgagaaattaaagataaagaaaaatttgtgagttcttccttgtcgctttgcaattcctccaaatacacagaaaatgccggccattcggttggacaattttatgaattatgagttagaaatttagaatataattctctatttaggaatttagaagattgttagaagagcaaaagtcaaaattactaagtgagagtatttactcgactcagccaaccaataataatccgacacgtcatataaaagttccagaaaggtcaaaaaaaatcacacacattaaagtgctttgaatacaaaagcagactccactatccaattaaattacgaaaataccacttcggttaactccactcttttcatcttcttctctgccgtcgtcgctcggagctcgcgaagctctctcatcagaaatcaaaaaccctaaaaaaagtcctttctgattcatctatacagacacatactgtattctcaaaacaatg

SEQ ID NO: 32997 - DNA, 1306 bp, Unknown; identical to SEQ ID NO: 1743
  misc_feature (1)..( 1306): 2750-1469P.txt file - cDNA_ID_3064036; gDNA_ID_1620442; Annot_ID_157194

SEQ ID NO: 32998 - DNA, 3003 bp, Unknown
  misc_feature (1)..( 3003): 2750-1469P.txt file - cDNA_ID_3064040; gDNA_ID_1620443; Annot_ID_157232
aaactatgtttatattttgaagaaattaattaatctgttttcttcacttttacaaaattaggtgagagaggtgaaataagggagttaagtgcttttgctaaggttttataaggaaggattaagttgtcattaaagataaaattaataaatgaaattaatattttacaaaactatatgtttatattttgatgaaatcaataatctatttttttcagttttacaaaattaggtgaagaggggtgaaataaggagttaagtgtttgtgctaaagcctaagattaaattgttgctaaagataaaatttctatggatttttgattcgattaaaagatttttaaagatatcttatacttgttcaccaatttttttcttatattttctaacctaaaacaagaccaatttctaaaatcaatataaatacactctcaccaagcaccaaactatttttacttttatcacaagcaaacaaaacttaccacccgaaatgactgcttcatttgcttacttgagagacattcgtccttacaagacggcttggggagttcatgtcaatttgcttcactcttgacatgagcaaatatacctgacgagacacttgagttggtagttggtatcagagccgtgccaatgagttttaagaacataggcaaaataaaagtttatatttcaaattattttattagaaatatatcataaaaaatatcttttagtgtttatttatttttataataaataaaaacgaattataagtaattgcataattttttagagtacaaatcaaacaagtgtgaattatttagtgaatggtaagaatataacaaaacttggtatataaatgggatattcaataaaaaatgtatttttcaaattttaaacatatactataaagtataaataaaaataaatttgatattatttaacatgccccctctccataagaaaaagaagaagaaatgaaagaagattggaatcaatcagaagagagaaaagtagaggaagaattatatatatgaaagaagactaactctcttccacaacttgacacattagcacatgagagtttgccacctagacttcataaaataagtaatacataattagtaattaattcaacataacaattaaaatagaaaaatataattaatgagaacttgaaccatcactctttctacattttttaattcaatatatcctctttaattttgagatccacttaagtggctaaagtgatgataaaatccaaagatttacacatattcctggcctaaaaattagacgattattatgaaagaaactaaatgaatatgcagattaaatatatctaagcttttcaagatttatgctaagaaaacaagtaatttgaaagatatttgaggagctatctttataactaatacgtaagatataagattatgacaagaatttaactaaactttccaagaacatcaagttgaatatgcttagattaaatatgcagagacatgattaataaagacatgttatatttttagtgtaagaaataaattttctaaaatttcaccgtctcacaatctatacatataattaaaaaagcaaggatatataaattcaaaaaaaaaactaaaaatctaaaacaacaataaaaaacaactcaagcacattcttttttcagatgaactaatatagttgggcttttcaaaaacaattacaaatcatatttatgtttcaaaacctatgcatttaactttactttatatgaacatgcattatataaaacaatttataaatagtaatacgtaaacccgcacgtagtgcgggtactcatctagttattattaatacagtttttgttcaatccgattcaaaccgatttaacccaatttcaatggcgtcaataaaaacatactcacgacgcactctagagctatagagagagagaaagagaaagagagaaattttggtagagagataggaagacaaggcttttcgggtgtgcaaaaagaagaagatttgtctgtatttatatatttatactctttgtaagaattattacataattggttattttcttttttctctttttcaatattaaaaagctttttatttttgcgtatgtaagagaaaatccgtacagtataaatacaaacacaaaatgcacaaaatttatgaagaaattaacttgattttgatatgagttatgtaaaaatttggaaatttgaatatcgtaggcgaatgtttcattttctttcaagtaggcacggttctgcatagtatttagtaaccataaggtttgtaataaaattagagaaaataagaaaaatcataacagaagatgctcgagaggtattgaaaatatatatggtgttgagtatgtgataacaatttacaaatgtcttgtgtattacaaaagtctatgacctctcaattacctataattttttgttcacgatatatgatcaagtaaatatccctaaagagcaaattcttgctgcttaaacaacataaaaaccataaaaaccgttgatgtgtgacttctaattgtacttagttatcttgtaccatcaacttttttgtaatacttttgtcaccaatcgcagtttctaattgcacataggtaaagtcttatgctggattttaaaaaatttaaaactctagggaccaagcttttaaagactcgaaaaaatcccaaaagctttctttctctcccgagcacctgaaaaatcaaaaccgcatcggcgcgtgaacaacactctcctcaggaaatgctaaaacgacagcgaatcttccctcgccaccaataaatttctgccacgtaaccgtcgtttccctcgattttcttcccctttccataaacccctctaaaaacccttcttttagggtttcaatctcatccatctacaacctctagctcttcgatttcacgtcactcttcactcaataaaaaagctactgcttcaaagctggctacttcttcaatttactctcattcgtttgcgttgatgtagcaaaacaaaaaccaaaatg

SEQ ID NO: 32999 - DNA, 3003 bp, Unknown
  misc_feature (1)..( 3003): 2750-1469P.txt file - cDNA_ID_3064070; gDNA_ID_1620444; Annot_ID_157254
catattgataaaccaaaaaaaatgatcaagaagaaaaataaattatattcatagagaaatggtttcttcatatcgattcttgtaaatatagcaatcaactaaaaaactaacttcaatataaactcttgtagaacaccaaacaagtcttatccaatcttttccttagaaactgatctcacgtctctcggcgaagaactttccggtgatagcttgatcaggaagcaatgcaagccagactccagtgtcagctccatcttctgctgaaacgttccctgcatagcctgtcattgcggttttcacccaaccgggacaaaaacagtttgcatatatcttctctccctctggtctctcggatagttctttagctagtactcttgtgtatgcgttcaccgccattttggagacagagtagtctgtgaaggaatgtggccaacctccagattcccatgttccttcttccacttgtttcaaaaactctgatactgttttgtcaacgatttcttcagttagagagtccacatccataagcttggctctcacgtcttcattctcaagtttctgttgaagagaactaggtcaaaattcgttgctgccataatttttaaggaagatgaatcgagttagagagatatatagatatatgtacactgtgtcggccttttaatctaccgagccttgaagtgacattgacaatacgagctccttgacaagcatgtctcattagtggaatcatggcgttgattatgttcttggtgccatagtagttggtagatataaccatatgcgagaattcaacagagttatctgatccaacattgtagtttactcctgcattattaatctgcatgacaaaaatatttcacatcataactcatcaagagaaaagcctttagtatcaaagtctttcaaatgaaaagctcatttggttatgtgaattaatgaacaaaaggaaccaaacttactaaaacatcaataaatccatatttttctttaatccattcgcaaaactcttggattgaggaagagtccaagatatcgaggcggtggaaatcaacattgaatccaccttcttgaaggatcttggcggcttcgacgcctacattctcgtctcttgatgttagaataactgttagtccatgtccagccaattgtctcaccatctcaaatcctattcctctattcgcacctgttaccaccgccacggtttcagaggtccaccacctaaacaatcccccattcaagaaataaaaaccaatatgacacttagttatcagcaagacaacaaaaaaaaaagatcgaatgaatctcatatataagaaaccaaaaacttatttaaacgtccaacaaaattgttttcagtttgagatatcgatggaacacagaatttcataattgcatctcgtggacgataagcttgtaccaagtaaactagtttatatgttttgactagacctaaatgtaattcttcctactgagtaagggatatatacaaacatttattataatcaaaatttcatagatatgaagacataaaaatttagaatgggaatattgatacctctggtgatcagaatagggaatagtacgaaggagggagatctcttggagtctcttatctcgtttctctttcgatttttctttgcttcctaccatctttcttcttattttctctcttctacgatcctaagtatgtttattttcacgataagaggaggcaagaaagaacacagagcttcgtcgtcgttctcatctccctctcacataattttctcatcctttttgtgggtcaaaaggtgcaatcccccactttctgcgtaatttttttgtggcctctcatttcaaattcatctgattcctatttttagttatagcatctgttatgggaacataaattagctggggcctagctagggtgtgggctctcaatacgaaccaaagttttgttcattctgttttagttcctattaataattcgaccatttcttaacaaaaaaaaataataattcgaccatttggttttgtggcggtttaaaattgagaaaacaatcttatttaagagtctctcgtgttacacactctcactacgaatctatgatccacatgaccacatgcatgtcacgttgcatcctctcacattttgataaaatttatttgggacattttcggtatatagctcaaggctcacaatctctcatataacagctaagataacgttcttattctggtttagatatatataatgaagaaattaattagtttcaatgtgtcatatccacaattattctaatttttcttatttattatatatttaattctaatatctttttttgccaaacactattaattccatatactaattatttttatcaactaaactttttttaattgtggtatatttatttttggtatattattttttataggtaaaattatgttatatttattatttttatcaaaagtaaataaatatattttgaatagataagataagatattttttctttcacatatttttgggattaatattagattaaaatatagttaaaatcgagtaagtttggttaaattctggataaatagaaaatattgtctatttactgatcgattcaattagaaacatagttttaagaataaatccaaaaatacatataattttattagttgcaattagtcaaccctaaaaacaattgacaaaaaacaattaaactaaatatcctactacagtttttaactctggcataatattgaatcaacaatcaaatcatctaaaagaatatgtagttctctattcctcaagattttatgtctactttcggctcgtcatatcaatttgtactgttgtacatatctaagccaaaaagaataaaaattagttataatcatatgtgatcaagagaaggccacgacaagtataggcccattaatgggtccataagtacccactttcattacagaacaacactttcctgccgaaaagagagagagaaaacaaaacaaaaaatg

SEQ ID NO: 33000 - DNA, 3000 bp, Unknown
  misc_feature (1)..( 3000): 2750-1469P.txt file - cDNA_ID_3064072; gDNA_ID_1620444; Annot_ID_157252
tttacttttgataaaaataataaatataacataattttacctataaaaaataatataccaaaaataaatataccacaattaaaaaaagtttagttgataaaaataattagtatatggaattaatagtgtttggcaaaaaaagatattagaattaaatatataataaataagaaaaattagaataattgtggatatgacacattgaaactaattaatttcttcattatatatatctaaaccagaataagaacgttatcttagctgttatatgagagattgtgagccttgagctatataccgaaaatgtcccaaataaattttatcaaaatgtgagaggatgcaacgtgacatgcatgtggtcatgtggatcatagattcgtagtgagagtgtgtaacacgagagactcttaaataagattgttttctcaattttaaaccgccacaaaaccaaatggtcgaattattatttttttttgttaagaaatggtcgaattattaataggaactaaaacagaatgaacaaaactttggttcgtattgagagcccacaccctagctaggccccagctaatttatgttcccataacagatgctataactaaaaataggaatcagatgaatttgaaatgagaggccacaaaaaaattacgcagaaagtgggggattgcaccttttgacccacaaaaaggatgagaaaattatgtgagagggagatgagaacgacgacgaagctctgtgttctttcttgcctcctcttatcgtgaaaataaacatacttaggatcgtagaagagagaaaataagaagaaagatggtaggaagcaaagaaaaatcgaaagagaaacgagataagagactccaagagatctccctccttcgtactattccctattctgatcaccagaggtatcaatattcccattctaaatttttatgtcttcatatctatgaaattttgattataataaatgtttgtatatatcccttactcagtaggaagaattacatttaggtctagtcaaaacatataaactagtttacttggtacaagcttatcgtccacgagatgcaattatgaaattctgtgttccatcgatatctcaaactgaaaacaattttgttggacgtttaaataagtttttggtttcttatatatgagattcattcgatcttttttttttgttgtcttgctgataactaagtgtcatattggtttttatttcttgaatgggggattgtttaggtggtggacctctgaaaccgtggcggtggtaacaggtgcgaatagaggaataggatttgagatggtgagacaattggctggacatggactaacagttattctaacatcaagagacgagaatgtaggcgtcgaagccgccaagatccttcaagaaggtggattcaatgttgatttccaccgcctcgatatcttggactcttcctcaatccaagagttttgcgaatggattaaagaaaaatatggatttattgatgttttagtaagtttggttccttttgttcattaattcacataaccaaatgagcttttcatttgaaagactttgatactaaaggcttttctcttgatgagttatgatgtgaaatatttttgtcatgcagattaataatgcaggagtaaactacaatgttggatcagataactctgttgaattctcgcatatggttatatctaccaactactatggcaccaagaacataatcaacgccatgattccactaatgagacatgcttgtcaaggagctcgtattgtcaatgtcacttcaaggctcggtagattaaaaggccgacacagtgtacatatatctatatatctctctaactcgattcatcttccttaaaaattatggcagcaacgaattttgacctagttctcttcaacagaaacttgagaatgaagacgtgagagccaagcttatggatgtggactctctaactgaagaaatcgttgacaaaacagtatcagagtttttgaaacaagtggaagaaggaacatgggaatctggaggttggccacattccttcacagactactctgtctccaaaatggcggtgaacgcatacacaagagtactagctaaagaactatccgagagaccagagggagagaagatatatgcaaactgtttttgtcccggttgggtgaaaaccgcaatgacaggctatgcagggaacgtttcagcagaagatggagctgacactggagtctggcttgcattgcttcctgatcaagctatcaccggaaagttcttcgccgagagacgtgagatcagtttctaaggaaaagattggataagacttgtttggtgttctacaagagtttatattgaagttagttttttagttgattgctatatttacaagaatcgatatgaagaaaccatttctctatgaatataatttatttttcttcttgatcattttttttggtttatcaatatgttcgtagtgatataattgtcattaacttttttttcttttaactgagaaaatatatctcaaaaaatttctcatttatattttatctagacatttaatatccaaaattctttggttggaaaaaaaattatacagttaaattgcgcaatttaattccaaacaaaatacaaaaaaattgttatttttgtactcacaatctcataacaaaaataaattcaaatttactcaaatcatctcaatttataattatttctaaataatttttattaatatttcgtttttattaccaattgttttaagaaatttaaataaaaattagaagaataacaattttcattttcaatccactaaaagaattaaaaaacgattacacgtggcaaacaatctcaccactggttcggcgaggcgaaaacgtcgatcgtcacaaccttactcctcctcctcttcctctttctctaatcggcaaaattttctgctcctgagaaacaagtagagatactaaagatggaatctttgaactaaattcgaaaccttttaatg

SEQ ID NO: 33001 - DNA, 3003 bp, Unknown
  misc_feature (1)..( 3003): 2750-1469P.txt file - cDNA_ID_3064076; gDNA_ID_1620444; Annot_ID_157247
tcttttcacaaggacgtcacacatatggagctctttaaaaaatcaccgttggaagtggtcttatctaaggataaagattccaaaaagatgtctagtacactgagaaaggagaaagaaaatatacatcataacatggctctatagaagtatagttacatgtgtctatctgtcatctatatttgtttttctatttgaattattgtgtagtgaaataactatggttttgctaattgtggtcgacgttgtatttgtgcatgctaagacgaaaacataattattcgctcttttgaaacagcattactgtgtttcgggttacgcacatgcatgtgttgttgccctttgatttgtactatcatcgcttagccgcttacgatgatagcttatgctttatattttagtaaatatttcataaaaaataggttttcttttcctatgaattgtaatgttatcctgttaacgtttgtgaatatttctcaaattaaaattgtcacgtcttcgtatcggctttttactttatgttcatgttggtgtagacgttggccttctgacggttcatgaaattgttaagcatgtaatgtgactttttaaattgctttcagaaagaaaaataaaaattaaagacttgaagcatgctatatttcacgctataataattgaggtcccgatagtcatgtgaggtctatcctaatacccttatagtagaaagagccttttttaaaaagttttcaaaaaatattataatctgatttgggcaatactttgcattacatatggatgaactaataagagagaaggtttttaattagtagacttttgtcacttcaattctaatcatgaaaaaacttacaacatattttcattctttaatatagtttacaatctaggattggttagaaagaaacaactgagagaagtcaccaccggatgcttttggctagtggtttatcatgttgttctcgtagttgaaaccttggtgagagctagggatgcacattacgtcatatcataaagtattagcaaaggctataataccgagccatgggaggaacactgcctcggccgggccctctcctagttaacaagaaaagaaaaaaacctaaggaaatctgagttgggtcttaatttcctaggttgtcaagtagaatctgacaaatgtacaaaacagagggtacgtgatcgtttaggataagggaagacaaagtaaatggactgaatacacctgaaaatgttagacaattaaatattgaatagacttgaaaattacaagtcgttacaaaggcttcacaaatttgcgatgtatcaatctttttatttattttaataattggaataaaggaaaactattgaatggaagataaatagttcatacagctatatgattatgatcattatgatggcaggacacggaaggcaaaagagatacaatcagtttcacaacaataaatcacgtgtaaaattttatagattctgaaagggacaaagggttacgtaacccatcttctttaaggtggcaagtagcatcaaattcattggttggcaagcattttgtttatgcacgtgtggataaggttttaaatgataacattgacgtggcctattatggttggttaatatctaatgttatgtggaagaagaatttactcaaaatgaatcttgtcctagttattgcagaggtatagaaacaactaccgaatgtgtttaatgatggtctccaggtaatgaatcttccgccttggaacgatttcctgtcaatatgaattttgaaaggacttcaaattacgaatctttggagcagttgcaatagcatgatagagacagtcctgtgagcttggataaccaaagttgagctggacagtctcttaactgctcccaagagagattagtgtttgaagattcaaagaaactctccttaggtcaagaaagattagtgttagaagatttacgtggtggcaatagttactgtttaaggtgttgaaattacgtttttatatatataaaaagcaaattaccccgcgtattgggatattgagggcatatatttaattaatctgtttcataagaaaactaaagacacattttaaaaaaaaattaaagaaccatcataagaaaatataattaaggaaacaccataagtggaaatgacttgtgaggttttgtagagagactgagtagactttagaactgtagttgttacaagaagttgtttccaaccaacaaaggtgtttttgggtttgtgtatacttgtgttaaagtttttcgttcttttttgatcaaaaaaagacttgtgttgagggtttttttttttttttttgataagtttaacgttgtaatgttgcttaaaaaattatactagtaaactttggagttggggtgcactaaagttctgttatatctgaaagtatctctgcatgggttttacatacatctatatagaattgccatgattgtttttgtagtgatatttatattagctaggcctatattttctttcttgttcctatagatgcaatacgtaaatattatagaaatgtttttagaacaagtagtaagacatttcaatcagttcacacaaaatgattgaatgaaaaaataataatataaacagctatctgattgtgattgcaagatattgggggcagacaattaagagagtacaatcagttccacaacaataaatcacatgcaaacaagcttttatagatttttatagacccacacttcttctcaggtggctctacacattcatacgtgtagataagagtttgaataataagttgaagtggttaattctgattggttgatatttaaatctcgaagaataattttattacttaaaaaaaaaaaaatgaaacttgtctcttcagtttcatcactagcctcgtgctccaccattagacaaagacattttagaactccgaaaatgtcaataaaatggatgatgattatgagaaaaacttacacgtttaataggcccgaagttgctatctagcagttgtagccatg

SEQ ID NO: 33002 - DNA, 3000 bp, Unknown; identical to SEQ ID NO: 1752
  misc_feature (1)..( 3000): 2750-1469P.txt file - cDNA_ID_3064087; gDNA_ID_1620444; Annot_ID_157242

SEQ ID NO: 33003 - DNA, 3000 bp, Unknown; identical to SEQ ID NO: 1762
  misc_feature (1)..( 3000): 2750-1469P.txt file - cDNA_ID_3064113; gDNA_ID_1620445; Annot_ID_157293

SEQ ID NO: 33004 - DNA, 3000 bp, Unknown
  misc_feature (1)..( 3000): 2750-1469P.txt file - cDNA_ID_3064131; gDNA_ID_1620445; Annot_ID_157284
atggcagatcagtcgacgttcatgccatctcattttcctcaaacatacagttccatgtctctctcagatcctcccgaagagatgtggtaaattggtaccatagccacaaatcacgttatgtcataactaggtaccctacaatttgttttctattcgaacactactttttaattacttgcttgtaatggatcatctactcatactactcatttcagtcatggtattcttccccctcttttaaataaccttttttttttttcggtcatttttttttttttttggttttccgatttgtaagtaacaataattataccattgagtttgactcatttgttttcatattaaggatagtaacactaggacccgactatgtagctaaaagatgtaagcatcttcaaaaaaaaaaaaaaaaaaaaaagaacactaaaaccaaacttcaccacttcttttcataattcttctagagtggtaaaagtatttccggatacgaaaacaataaggttttggatttgttgtatgttaagggaccgagtcgaatgacaatatagaacaacctcactatcaacgatccaatgtagcctccaataaccatattcccggaaacacgatgtcataactcagattgactaaaggtgtatccgtgtatgcacgctttgaacagaagagccctaagtaactttcccattctttctgcaatgctatgtcctcatggggcgtttggagaaccggcaacaataaaccagcttttgttcgcttgcgaaaatgctaaaagcttgcttgagaatgtctgtcttctgtagggatccatccaatgaaatttttgtttctaacatcccaatttggagcattgtggggaaaatgatgttcagactcagttgaatgaactaaggcgtacaaccccatatgatgccggaagctcaggctgctacagttagatgcagaatgtaatctttcactctcaacgccgtctgcaacgtcttgatttggttccattgtaacaaaacttgtactcaactcacaactaaaacacccgtttatgttcttcaaccacaggacaatcagagtcgtatccagatatcaaattattgtccaactcttcttcttcgtctgaccaaaccggataacttgtcttgatattgttcttctccaaatcagcctcaacagatttttgatacagtccccgacttctatccagaaacccttcattcatcatgtttgcgaacttttccctgacttcaacaagagggtgcttttcgatgagatgccgcctatcatatgcttctctaaggatcactgtctgtgtatcacatttcatagaaatgtagaaaataccagggtgacgctcaaatactttggtgaacttctgcggaagtgcaaacggtttacgaagattgctaacgtttttcctctctgtcttttttccaattgttagatgaagaagttcgtgaaacactccaacatttctcttctctgataaatcagttcttggatccaaatgagatgcatcgacataaggtgatgtataaggaagtctttgccattcttggagccactcaatactcttcctcttcaatccaaaccctctcgtaaatttaaccgggaaagccatacgttcatcatttccaacgtcctctctcagttgcatttgcgaaacagcgaggtgttcatcccaatgtattaattttaaaccgtcaagatcactagacaacttcaccaaactgaacaaatccggatgcttagtaatcaacgaatctcgataatcatacggcaaacccaagtcccatctaagatgatcaatagaatgtagcgaaagtgttctttcacaagtaagcataagaagtttacacaacctcacaagaacatccctttcattcacccgtgaaacatcaacttcttcataataaagatcaatcgtctcacgagttaaaccaaagcaaggaacactagtacctgcactatcccaataacaatgctcaacaaaaatgttgggatacctccgaataaaagctgaaagcttaagctcttgaggcaaaccaagctgaccacggtgaggcaaaagcttaaagataggtagtctcaaatcaggagaagccgaaataacagaaacgagattacaaactgctctaagatgcttttcacgaaccacaacagcatcaagttctctatctttaacccatttcaactttacattaactaaaccacatctctgctgataaaaaaaatcaaacctttctctgcatttacacaaactagtagacaaactaacccttctctgtagcaaccagtgcattgtagcgaaaccctaataacaatagcctgcgtacaatagctagaaaacttaaagtttcgaaatttacagctaaattgctcaaagttctcatcattaatgttaaaattggagactttgtgaggtttttatggaaacaacgacaaaaggacgatgaacagttgaaattagatgattgagaagtataatttgtagaagttacctgaattcacaagtttccggtcatttctcgatcagaccaacacagtcgtaagcaacgacggcgaagttacagaggcgacggtaactatagttctgatgggtgggtcgggtcgggtcaattgggcgagttaaaaggaaagtgactgttgattggtaccggtcaatcgtgtggaatgacggcgagttacagagacgatggcaactatactgtagttctgtcttgcttttaatgggccattgggcccatttaagggttataagtcgatggtccgggtcgggtagatttgggtcggatatgatgggtggggttgagtaagaaaaggtcaaacccggtattgtgtggcgaacaacagaaattgcatcttctacacagttctgaagcaacaaaacagggttttggctagggttttaactttggctgctctgtctcaatccctcgagacttaaacccacttagtacaatctccatataatttgagtagaacctaaaagatcgaagcttgaggaaaatg

SEQ ID NO: 33005 - DNA, 3000 bp, Unknown; identical to SEQ ID NO: 1764
  misc_feature (1)..( 3000): 2750-1469P.txt file - cDNA_ID_3064138; gDNA_ID_1620445; Annot_ID_157280

SEQ ID NO: 33006 - DNA, 3003 bp, Unknown
  misc_feature (1)..( 3003): 2750-1469P.txt file - cDNA_ID_3064164; gDNA_ID_1620446; Annot_ID_157311
atgttattgtcaaatttcaaagtctactcccattttggttattatggcgaatcttgaaatgcagaaatgatctagtatttaatcgcaaaatgatcgaagtaacggaagctgtagaacaagccgttattgacacaagagaatggattgaaaacattgctacttcggaacaaggtcataacgacattcaccatcaccgatctcctagagtgaaatgaaaaacaccacaaagaggctgggtaaaatgtaactatgattcatctcaccataaaggaaccagtgggtctggattagggtggataatccgcaactcacatgggactttcatggaatgcggtatgagtaaattccaaggtagggcaccggttgaagaatcggaatgtacggctctgatatgggcactccaatcatcatggaacctaggttacataaagatcgagtttgatggggacaacctctctatcatccggctaatcaacggcaaagctgtaaatcctcgacttcgacattacctttgatgaaatcagtcattggcattgcatgttcacggaggtgaagttcactttccatcatagagagcagaacaaatgtgcggatatactagcaagacaagctctcactggtccaattcactacacataatagttgttgattcttctaattcgaatacatttttatccaaacaaaattattaatcggaaaactaatcttcttctttttcgttttaataactttagatttatattgtaaatacactagtgtcgcactttaagtgttcactaagatgaacaaacgattacatatataactaaactccaactttgtagttgtatatattttttgtatatatgttaaagtgtcaaacgaaaaaaactccaacttagtagttgcgtatatatgtgaaaattgataaaataattgcatgcaaaatgtaggatcaaataatttgatttgactacgatggccaaacacgttagatagttgggcagtcgctacaactaagcagccacacttattttacttccatttatcatcaataatttgtattatagttatttttgtttaatatccaagagagattcataactctttgtttgactttgattaaactatagggtagttagccactccacattggcttctaaactatatttgtcagcctttaaaattaggttaggtggccaaacgaaaactttttaattatttttcttttattgtgagacatactaagttagaagaagaaaaaaatcagttacttttcaaaaaggtaaatattggcttaaaaagccaaactatctacgtttatattttttactcaggatttgattgtatgttgataaatattttttttctttttctttgttaaacaatttcttgttggtacatttaatattttccaaaattattacgtctacgaagaaacctttttttttttgtaaaataaatctatacgtacggaagctttagaacgctagtatatatactttatagtaacgtaaataatttgttcaagtgagatatatttttacaccaaacaaccactatatttacaaaacattatattatctttcttttattgcttgttaccttttataattatttttagttcaaaataagtagattcataaattatttgcacatttataaaattaaatcctaatagtgtccatttttagagtcattttaactatttccaaatttatggatatgttctatatagtctccattgtataagccataatgaaggttcttaaaatttatgcatatataaggagataaatataacaaccttataaaaaggagattcttaataagagataaatactaaaaattatttccatgatctaaaaaaataactatattctgaataccaaaaatatattaaagaagaaaaaaaaaacgcttatagagagaaagagagtgcgcgaccaggtcgtagtcgtgctctcgttttgcaattcacgtttcctctctgagtttcttcgtcttcttcctctcgtctctctttctctgattctctcgtacgttattcctcttcacgagtttctctcatacttcgttattaacatcgcccgttttataccccaaaccttcttttaacgccttcctctgtttctctcgtcttctcacaattctcaggtgcacaaatctctctctctctctttctccatgtgttgtttctaatctgatcatgatcatcatattcatattcatcatcatcatcaccaatcttctacataggtttttaactctgtttttactgattaggaccattttgtgatttttcctatttttataaaattgaatcgaaatcggaatcggaatttggatcaaaatgttttcttgaaactgatcggcgttttagtcaattttgatgactattgttacattttcaagactctttctgccactttttgttttactctgttctgttctttttcctaatgcaactttttttgactaaagtattttgttataatcttttcattatttttatataatatatttataatttatcagttgaatgtaaaagtaactccctatattctcacttttacataaatggtttcataaaattcaactttttctaactgattaaggtcccacttgcaacatatattattatctctctgttttctccatgcatataaaaatgtatgcagaatttggtagctttgaccttttatatttctgttagcaataattttatttttttggtaaattcttcctttgttttgcagcaatctccagcaacatgatcttcattgttgctagatactgatttttttttgtgggattttctatgttgctttggtctcaagtctatgtttcaattctaagaccagaacaaatttgaggtttttttcaatgctaaattcgtctggagtaagaactcaacgaagaagcccaagacctttgtctctaggaggtagaaagattattactccaacaaaatttgcttatgatcatcataatcctgataaagttttggattttgtagaaatg

SEQ ID NO: 33007 - DNA, 3003 bp, Unknown
  misc_feature (1)..( 3003): 2750-1469P.txt file - cDNA_ID_3064174; gDNA_ID_1620447; Annot_ID_157341
taccaaacacaatgttagaacatatatctccgctctttgcttccaccggtgtaaccatttccactattatcagttttccattttcttcgagacttttccaacagtttttaagaattgctacgcattgttcgtccgtccaatcatgtagtatccactgttatgatacgaggttatgatgatttaatatatagctttgatattccattttattttatttattggttgagataaatatagaacttaccttcatgaaaatggcatccccctttggaatcttgatgaacatatcaccagccacatggttcacacctgaaaccagtagtaaaattaaaaccgtcgtaagtttaatgaaacgtatggatgtcatgttttactattagcaccatcattatccataaagtatgaaaaagatcattacattcacaaaataaaaaataaaaaaaaatacttcaatcatataatgaaatgaaactattagttttgataaccgtctattggcttttataaaaaattgctgattttctatttttaaaatacatattgtattattgtgttaataatttaatataataatttaacattacattcaaaaaaaaaaaaaaattatcgcatggttcataccgggataagaatgagcattggctaacaccggagctaaatcgaaattgataccaataagatgaggatacttggaagtgatgagacctagtgtgttgccaagtcctccccctacatccaccaaagtcttcacatctttgaatccttcataaaatttaagaaccttctccgtaaccatggtggaagattccaacatagcccggttaaacactttaccaaatcgctcatcggcttggatgtattcgaatagtttcatcccatgggcagaactaaatgcatctcttccttctaatatcacatcttcgagatgtgtcctatgaaacaaaaaaaatcattaaatggtcacttcgtgtacaaacgtaaacattaaggtttaattagtgagatggttaatgataactaatagagtgtgtatatagatagtccggtttagccggttaacttactatgtaattggtttattcggtttagagtagagtatataaacttcatacatgtacattctgttatttgagaaagatagaaaacgattcacaaatctctttgattcatgttctctatcatggtatcagagcattttttgcgtttttccagttgatttcatcttcaatcttcaattcttgctcagtttcttcgattattcactcctcttggtgtcgattgttcttccgcgcattcgattttggtgaaaatggtgaagaaaggtgggaaaatgaagaatctcaatgttactcctgacgatggtggttctgttgctagatctactcgaaactcgatgatcgctgaagatcttgaagttgcgagagctcaacaacaactcaatcgaagattcgaagcttctgaggtccgtggatcgatgttgaagaacactgattcgttcgacaatccattggttctccattcatcggatcatccaggtttaacaattgtatctcatattcttgatggaactaattacaacagttggtcgattgcgatgaagattagcttagatgcaaagaacaagctaggtttagttgatggatcgttattgagaccttctgaggatgatttgagtttccgcatatggagtagatgcaatagtatggtgaaatcgtggattcttaaaccaacaaggattctttgattcatgttctctatcaataaccggtttaatgtatttgaagagttaactacagtattgtttttgtgttatatgcaaataagtaccatgtcttgataaatacgtcgctgaggtcaagcataaagagcgatgcaaaagaacccgagacgtcgtcacttttgttcaagagatatttgcagaccggttcagctgcatataccctctcaacttttccggtttgaccgttctcttctattacagtacggcattttaagaccgaatggctgacgagaaatcgaagcatacggtctagcaaagccggagcttccaggttgcatggtttggttgggagtcttagtgctatttcagaaggtgagagccacaaatcgccacctcctactgtggtgatggtgtcgatcacgccgagctccaaggcggctttgagaaccataggtgatgcggctgcattcgcgagccttctcgctagcaatcttgcctcttcttcaacctcttgttcttctttaactcgatccggtttggttaaggggacttggagatggtttgccattgttcttgtttgaaaaaataatattagaggagtgatgctaaatatgaggataggtttcaactttcatactttgtgccattttatagagtcatatctcaatatagtgttacatagatttgattagctgaccccaagatttgatatacatccaacattaggtctttcttttctcttcaacacactatgtctactgttttttttatttgttatggtggccatgcaagaacatgttcgttcaattagccagtttcattaaagttatatttaggtaaacatattagcaaaacatcaattgtagagactaggtgaacaaaatcgaccgcaccctaatcgttagaaaacatcaaaactaagtattcttacataatatagtagatgtcgattcaaagaaaatcattttcctaaaagcaaaaagaattacaagaagtgaagatgctaatattagcacatttggaactagtctacaacggaatttgcttgtctcgtggtcaaaacctccctattcaaccggagagtactaatctaacaacgtcacgtttcaaatactaaactgacacccaatcacaaaattccacgtgtacgtaactacaaggttccccacaagtatataaacatctacccataatgctctttcatcacacaactcataattacaaaagctaaacagttctctaaaatcaaagtaacttttttccgaagagaagattagaaaatg

SEQ ID NO: 33008 - DNA, 3000 bp, Unknown
  misc_feature (1)..( 3000): 2750-1469P.txt file - cDNA_ID_3064185; gDNA_ID_1620447; Annot_ID_157340
tctagaaagaaaaagcaaaaactaccttccaattaccaatttatgtacgatcaatttcagagtataaaataatggaaactgtaattttctaatttctatatatataaacacatttatactagtaatggaaactgaaatgaagtcattttcactaagaaatttaaatatatgtttttttagggatgagaagaaatgactattaatctctctttatataaaattgatattatctacaacaacccacacttctgccacaactaaataccaattatggtgacattggtgagaatgtagcaacggttgtggtggtgatggtggtggtgacataacactggtggtggtgacataacactggtgtaattttttttttgtctttaactcaaaacatattcactattctttgaatttagaatatgatacggttgcgacactaatacaaatatgtaagttacataatcccattttctagtagtacattatgttgcattaagatttcaagtttttgtattatgtccaaggttagtttgtagtatctatcatattaaggggtattttgcattttcttgtatctatccttcttgaattattttgtacttctaaagatttcaacttataggcacccacttgttttcttacctaaaaaggaatattaatatcaatatcggttagttatagcgtgtatgaataagcataaagaaatttttgacaagacgttgtactcaatgatttatatttcaatttgtatgagagtaatatgtatagcataaaggtcaaattttgaaaagatgttgtactaaaagtttttattaatatcaagctaccaatagaaaatgcagtacaaatattctctaacataattaaaaataaaaatattgaacttatatatcttagtgcgaataggttctcctttattgagagtttactactaacaacaacatttacacaaatcagtgtgagcacatgaggaaacaagattaaaatggagatagtatccaattctgttttttttgttctttaaattattttagtattaatggaaaaacaacaaaaactaagaagccaaaaaaagaaaaaaagaatacgataaaggtaaaaattgtggggactcgaattccaattggtgtaaaaatgtcgtccctccatgagggatcaaattctttcaaacttcaaatcattagtgtcttctagaacccaagtggttaaagattccctcttattgcataaacatgcaaagcgagcatattatatgtcgatcttattatataaaaaaaacttaatggcaactaattcttcacgaaataaaactacttataagacctattatcggtaaatagtaatatacatatcacaatgatcaaaagtgcatgcaccagatgatattcgtatcgtactcgacatttacatgcatatatatatacacacatacatgagtatgaaaaacggaataataaaacaaaacaatcagttgcttcacaacaatgtgtgttctttttttcctctgaaatgataggttccaccattttcactatttaacatgtcactaatcgaaactataatccaacttgtctagtcatggtaacaaagagaataaatttagccgcaatcattgcttatataaaataaaaaatttaagctatagtttcatgtaatcatgtcatttatttaaatattatagaaataactgcatggctacaaattatcaatagacaagagtcaaaaactcttagatatatagatatatagaaaaaaaacatagaaaagcaaaagtaattgcctaaatggcttcgatcgaaatccatattcttggatttagatagacatatctatctaattatttttctggtagaataaaaacgaaaactgaaaacataaattattattagaacgtgcttctcatttgctgatgccggtcttttccttaatggtctcactcgcaccttgtgccttctgcttcagctgctgtccaccctatattttgtttttccaaattattaaattttctgaattctcaaattatttcacaaaaatatactattaaagaataagaaaagaaaataaacctcttggatagattccttagcagattgggcagcattggaggccttgtctatcaagttgcttgccttctcctataacaaattttagttaccttctaatgaatactccattaactcaaaaataacaatggatattaaagtttctaaaaaacgatcgtttaacaaaacctgagtttggcctttagcttggccagcgttgaagctcatgctctgactgttgttagacattttctaatcttctcttcggaaaaaagttactttgattttagagaactgtttagcttttgtaattatgagttgtgtgatgaaagagcattatgggtagatgtttatatacttgtggggaaccttgtagttacgtacacgtggaattttgtgattgggtgtcagtttagtatttgaaacgtgacgttgttagattagtactctccggttgaatagggaggttttgaccacgagacaagcaaattccgttgtagactagttccaaatgtgctaatattagcatcttcacttcttgtaattctttttgcttttaggaaaatgattttctttgaatcgacatctactatattatgtaagaatacttagttttgatgttttctaacgattagggtgcggtcgattttgttcacctagtctctacaattgatgttttgctaatatgtttacctaaatataactttaatgaaactggctaattgaacgaacatgttcttgcatggccaccataacaaataaaaaaaacagtagacatagtgtgttgaagagaaaagaaagacctaatgttggatgtatatcaaatcttggggtcagctaatcaaatctatgtaacactatattgagatatgactctataaaatggcacaaagtatgaaagttgaaacctatcctcatatttagcatcactcctctaatattattttttcaaacaagaacaatg

SEQ ID NO: 33009 - DNA, 3003 bp, Unknown
  misc_feature (1)..( 3003): 2750-1469P.txt file - cDNA_ID_3064189; gDNA_ID_1620447; Annot_ID_157339
aaaggaatccaaattatcatcgatttcttttatagcaaagtatcagccagtatctacaaatcgtgtactcgggtttgattagcctttgacacaaccggcactgatgtgaaactgttctaggagattacggaaaaataaagctaagtgtaaaataatatatataaaacagtaaccttttttacggttaacaagactcctatgtcacgcatttaactcttgaacacaatcatattggccaatcaatacacacattattctctatatattccactcacaacagctttatatctttgccatagtcccatcttgttcatatccatatcgaatccgtatcatgccacataaacaataccatgcataaccataaatatgcatttatcaatcaaattaacaacaacaaaatcgtgtaaataaccatatatatgcatgtgcaatcgtctggatacgggcaaggaacattcaaatgttaaaaatcaatgtgttttgagaagggacgagaaagtgttggttatcgcatatatatgcaatagcacacataaactaacattccgatccattttcgatgcgataaccaacactttctcgtcccttctcaaaacgaatatagacattacaaatgcgtaatcttactaggctagccagacataacacagatatatgaacattaattaataattaagtaacgctagttaatatttcttcatgttgaaataaaaagcatgattgtaacatattatagtacgtacatgttttttcatatcacaaaattgatatatgtatgtatgtattattatagtacatgtttattttcttttttcttagaagttagcacacattttctgtaggtataatagactttagtacacattttatgtagtaacagaggttggctagctgagtaatttgagtagaatattctagaacattggtgtaaaagagaaagagtggctgatttagtaatcacaaccattacactaattaatagaccaaagagagcatgaatgagcatgattagagtaaaccgccatagaaattatcttttaattgataggctgaaattgggatagttaagtctatttcttgtttgatttttgtcttccttcagttttattggaaattttatgtacaaaaaaaaaagaaaggaatttgcaaagaaacgaagcttcgagattctttcctaaagacacctctaagtagaaagcgcgtaacttctaaagttagattatttttttaattaaccatagatttgagaaaataaaaataaaacaaagaaaataaaaagaagaaaatatgaattatggcagaaatatgaactttacgcgtacgtctgtcctaataaagggtctgaatattcgtgtgatgaactagctactactatacttttatagatttctccatgtaattttagtaattaaaacctttataaagttgcggtttatttcataagcagcattatagtgagtacaatgataaatgtttttatatatatcacttacaaggtagctcccaagggtcgaattgataaatgtttaaatcccctatagcttctactaggcatgaatttcctagcaacttgtttcttaggtaaaatcctaggagttcctctttcttctctgggacgaaactcatagccgacgatcgacatcattttttttttcttcttcttcttctgaaaataatgaatattctcaaggaagacgaagttctttttttttttgtatgtatgttcggaacatgtggcccagttttttttttttctcaataagtagcattattgtagtctccgttctaaaaatccccgcctagtctgattgtgtttataaggtcgtgatctcatgtgtttatgttttcactttcacattcacgtgttatatatataattttagacgtattgtccaagaaatatatcagatattagcaaaacaaaaataaagaaaaaagtaaatttttttatcaattttgaggaaaacataagcaaaacatgaacaaacatttttgaaaaaatccagtaactaacgaaaatgttgctgaaaaaaaattgacgttcaagttttgaatttatttactctgttattcagataactatgactaaaggctctgctgtacaagtgaatgatttccaaaaacttatagagaaaatttttattcatccctttttattctagcaaataaaaatatgtcatctattaaaaaaattattaataaaaaaaatatgtcacaatccttcctctttttcatgtaactctcactattttcttgaatttgatttcatcggtcgtttaaaaagattcgattttgagtttgtggattttgttacagcggaggatcaaatcgaacgatagtgtatactatagaggaagggaatgatttttcttatactcctaaatgatgatgatcattcttcatccaatttataggtataaactttaagttgataaatatgtaggaaatataaaattgtaagaaaagattaattttaattgtttatgggaaactttggagcatgtcccaaattcctgtttattaatataaataaaatataatatgaatttcgccttatacatctttattcaataatatttttgagatagttctttaaaaaattatcaaatataaaccaaaataaaaattaaaaaaaaaacaaaaaaagaaagtaacgataaaagtaataacacttcaaaaaaagtatagataactataatcatctgacatgtaaacatatagcaaataaaagaattagattaagaactatctaactatgacttgtataaaaagaaacaaataaacatcaacagtaacatatatatttactgatgagttacccgatcttcacctgcaaatgaacaggcctactagtcataactaatgggctttctaaaccacaatattcttacggcccaattaaatttaaattaatattattattcgcagtttcgcgaggcttttgttttttttatcacggcctagtttagttaagctctcgccggtgatttagcggagatg

SEQ ID NO: 33010 - DNA, 3003 bp, Unknown
  misc_feature (1)..( 3003): 2750-1469P.txt file - cDNA_ID_3064244; gDNA_ID_1620448; Annot_ID_157380
atatgaatgagaatttgtttggtaaaactgtttgagttattcttccatcaatttttttaactattgaaaatatttaaataactcatgaaaaaattagaagaatattatggaaatcttcatgttaaaattatataaactaacatgttataaactattctataattttaaaaatcgtaaagatttccaaatttcataagtttgaaatcaatttaatgcataaaccataaaagcccctaaatattttattaaaatgtatttttatacaagagataatttcaaagtcaaaataatttttttttttaaagtattttcgcaaacagccttacgaataatctaaaaggctctggaagtaaatcgtggacacagcttaaaccctaagaaccctttcgttgaataaacaaaaaatcaaacgccttcaaaaatcaaaatctcgatccagatctcatcttccgccacaagctatgaggagagtcaccggacttgccgcgcgcacaatctcatcctccgtcgccatcaattcacgtctcactcaatccatggcgattacaaccatttcatcctccgaacctatctcccgaagattcggtggtcttccagagattaaaactccgtctttcgccggcggagtcgctggggttgtgttcttctctgccgctgctgtatcgtctcttggtcaagaagttcacgctaaggaaatggctcagaagtttaatcctaaagaagttgttctgtatcagtacgaagcttgccctttctgtaacaaggttaaaggtaatcttatcacactaatctaaaaattgctggatctgatcagaatttgatcttctactcatcgattcttgctttagacttaggttgaattcagtaggattgacttgaatgtgatggatttgaatggagaatggttctcattgtctatgattcagtaagagattggtgattgaatgaggtatctattgttgctggtatgatatttgggcgattgtttattttgtttgtagcgtttttggattacaacaagattccatacaaggttgttgaagtgaatcctatcagtaagaaagaaatcaaatggtctgattataagaaggtgcctattcttactgtagatggtgaacaaatggttgattcttcaggtttgtctcatgttctgtttctgacttgtatttttctcttcagatcaaaaatgtgtattagcttagttgagtaatcttttgttttatggtgcagtgataatcgatagcttattccaaaagatgcaccctgaaatttccaagtccgaagatgatgaagagactaaatggcgcaagtacgattgattttaatttattgactactgatattgagttcgagatttgtgtcactacaggaccttaggctgataatgtatctatgtgttgtaggtgggtggacaaccaccttgtgcatcttttgtcaccaaacatatacaggaatacttcagaggctcttgagtcctttgaatatatcaccacacatggtatggttatcgtcgatttagcttcttacttttttccctttctttatactcattttgtttttataacctttggaagatatgtatgggttaacattttaactagatgagttcatgggagtcccagttttgggaacctttatacgtcattacacatctagagaaagcttctggaggaggatagtcttcttgtctaagtcatagtgttgtgctctgtgcagggaatttcagtttcactgaaagattagtggcaaagtatgcaggagcaacggcaatgtactttgtatcaaagaaattgaagaagaaatataacattacagatgaacgtgcggctctttacgatgctgcagagacatgggtcgatgccttgaaagagcgtccataccttggtatgtccaacttctaatctaatactgaatctagtccctgctttctggattggtccatgattgtagtttctaatatcaggtgggtcaaaaccaaacttgggcgatctcgctgtattcggtgttctgaggccaataaggtaccttcgatcgggtaaggatatggtggacaacacacgcataggtgaatggtattctcgaatggagaacacggtcggagaaccttctaggatcaaagaataaaggatcattggtcgtatctcttagtggaaatatgaattgcataatgaatcgctgatttcacgggcgtaacaatattttaagctttaggactagagaaggaaacaaagaaactaaaggaaataaacgtctcttctttgtgaatgaaggattttgaatactgtgagtctgtgacatgcttggtttggtcactgttgctattactaaaaagtcgtttctttggtttctttcacattttaaaagattcattgatcagcttgttctctgttttctattgactgatgtttatatgaaaggacaacaactcaggtggtccgattggtaatcgtatggtcgaacaatgataatatattggtggaatgaataaagttttgcaattcttttcttagaaaaatgagtttgaatggtttatatacatatgtatgacccaatgatagttgtaacgtggattttctttgtggaaagatattatctacatatgtatgatagcaacaattttggcgtctctaattttgaaccaacctatgagaaaattttatagattagtacatcatcgttatgaaattgaatgtcaaacacaagcattaggccaaataatcggcacaattagacggacaggcatgcaattagtgaacatgtggtagtgccaaaactttggcattctattttcgaaaaatctcctcactatataaacatgtttcatcattcaatctcctttgatttttgctcacaataaaataaaataaaaagaaaaaaaaacaaaaaaaaaacaaaaaaagaaaaagaaaaaagaatctataaatatactgttcaattttttttattttttttttattaatatcccaacggtcgtggggaagaaaatattctgattttgtaatg

SEQ ID NO: 33011 - DNA, 3003 bp, Unknown
  misc_feature (1)..( 3003): 2750-1469P.txt file - cDNA_ID_3064247; gDNA_ID_1620448; Annot_ID_157379
tttttacgacggaaacttctatattcgtgaaattgaaatggtgaacaaatatgtgatagattgtggaagctacccgtgtgtgtcgtttggttgttatggtcttgacgcataatactaaattttataatccaataaaaatctctgctctctctctctctctctctcgtgatgcccatttgtttatcttttcaaaagcaggatggaaaggtcgaaacaattcggtggtttactttcaaaaggaattaattcctttcagttgtctttcaaatctcaaatataaaaaggtatacttaagaattattattcaactattcattagataaatttttaaattttactaaccaaatatcatcgcagttagctgaaagtcataaccttctatggaatcattttcttaaataatgataaattcagaaaaggaggagaaatgaaataaaaaggaccatggaataaagaataaaaaaagattggtctaaagagtgttcgagaactactcttttctagagaacatatgcggttatgcacatcattgatcggactttacattacttgtatatattcactactttctcattaatatattatatatatatatataatatgtatatatactaaatgaaaagtttttggaagtgttttgatctttgttgtattacttttaaaaataattgttttaattggtaattcataagaatgtaattaaaagtagaaattctttctaattaatatcataactaaaagttaataattaatgagaagtaaacataaaacatctaatgattttgaaaaattaaaaaattctattaaaaagttgtgatgaaagatattatgttaatacgtgccgtgccaagattttaattaactttatagatgttgtaattcagtaattaactttgaagatatataaacgcatatgtgataagtgcttgtcgatagtggctcgtgggtagcctttaagcatgggccagtgtgcttgtgcctacgagctcgagtgatcgagcacacacattccaaactaaacacaaaacacaaaggaaaaaaagtaaataataaaggcatatatatatgctccattagaaagcaatatatatagaaggcagatagagtttgaaccaaagaaaaaaagagagagagagagagagagagacaacgaggaagatggggtggtttattaaggaaagaagaggaggttcatggaagcgaggatggttagaggaaacactcctaacatcatcagctcctcctcttacactactagctctccttgccatcatatctttactactcttcctctcttcatatccgcgttacaagtacgaggttgagaaaaccgctgctaatctcaagctcttcatgctattcctcccaattctctttgtattcgtcctcgtctctctaagcttcgtccatcgacttctcttcaaatcctcttactccgttagagcaaaccaggctaagtccctttttggagaaggaaactttccgtggggagttttgcttatgctaattcttctacttcttttggtttctaaacaatcttactttcactccttatggtaccccaatttatgagttatgatcttccaatcattcatatatagtcttcaaatgtaatatttagattgatcattgcttcttgtaatccataattccacacatgttaaaagacattttgagaataatgataaaaatttatgtaatatataaatctcgcatatttgttaagaccaaaagtctaaacatacatagctaatttgcgacaaatttacaaatttatatataacacaatttttgttttgtcccaaaattgagagaaagttatgggaacacatatactgtaaacaaatcagtagtggtcagttaatctatataaattcacttaacacacctccattaatctatatatataaatttgtatttcttgaaatttgttttttttaattggtgtgagatatgtatataatatgatattcgcaattgggaggatggattatgcaagatagtaaaggcacaactcaaggctgaagttcgactaaactacgatcttggtatactccgatggaagcagaagatgcagcgttgttgttttcaatgcaaaaaacatggcctaaagggtttatacacgtttgttttaaaggcgattgcaaggtgctaatcaacatcatgaacggatctaccaacaacgacattgctatagaaggcttgtgtaaattaagatatccattattgggcatcgaagttcagagaattaaatttctcctttactagtcattcttctaatcatataagcccatatattagctaagcaaggttgcatagatttcagcttttactcatatagcccatactatactctcactcgaaaaaatatacaacagtaatgacaaaatctgtaaatattttagaaaagaataaaaatggtgtacttatttaaatggggtaagaatctctgtaagtgtgacacattaccatgcaattttgctaataacatatgataataatgttattaagaatatttcaataataataataataagggatatgaatgagaatttgtttggtaaaactgtttgagttattcttccatcaatttttttaactattgaaaatatttaaataactcatgaaaaaattagaagaatattatggaaatcttcatgttaaaattatataaactaacatgttataaactattctataattttaaaaatcgtaaagatttccaaatttcataagtttgaaatcaatttaatgcataaaccataaaagcccctaaatattttattaaaatgtatttttatacaagagataatttcaaagtcaaaataatttttttttttaaagtattttcgcaaacagccttacgaataatctaaaaggctctggaagtaaatcgtggacacagcttaaaccctaagaaccctttcgttgaataaacaaaaaatcaaacgccttcaaaaatcaaaatctcgatccagatctcatcttccgccacaagctatg

SEQ ID NO: 33012 - DNA, 3003 bp, Unknown
  misc_feature (1)..( 3003): 2750-1469P.txt file - cDNA_ID_3064259; gDNA_ID_1620448; Annot_ID_157370
catcatcgatcttttgcaactgtaagacaaggggccttcgagtaacaatgcctacaaatagttaccgcaaatgcatattgtcattactcaaggaaataagcaatttcataattaaaactaagtaagaagtgttaacactgtatttaccagatccacggggtaaaaagtcctttcccacgatgctctccaggactgaagacttccctgagctctgtcaacacaataaggatacaacataaacttaatgccacatagaattatcaaagtacagaaacccctctccacaacaatcgtagcttaaattaaatggttcaagaccaactagtgaaaaaatatccaagtcaaagccaagtcaacattcctcaataccaattgcttgcaaagctagttcatagtagaagctattaaactataattcctcacgatccggatgttgataagcaaaaacaacgaagtttagggcaaatttatccgaatacctcagctcaatatcaattccgaatcgcaaaaaaaacgaacgaatcgtgagatagatcgtcaagcatataatggaaggggaaggagatcgagatgcaaacctgaccaccaacgacggcgatcgcaggcaaggaatcccaaagagtaggtaaagcgctggagtctccatggtctcctaaagccgtgcaagctctctgtatcttgttaaccagagagatcagattttccatcgtcctctactcctcgtttccccaatatcaaatgagaagcccaaaatacagtagctgctacaacagatcggcgagatctgatacctccgccggtaaaatttattgcggaaggagtagatctgcgatgcgacggtgagctatggaaccagagaaatagagatagagagagatgagtttttgaatttgagtcgatgaagaatttttgcttgctagtgttgggaaaaagtaaaggggaagaaagcggtttatataaaagccaatacagggtcttttcttttccaaagaaaatttgaaacggcatggtgtttatttcgagaattcaaagacgacgaggagttgaccaaaaacaaaataaaaacgacgaggtgtgtcgtatatattcaaccaatcccttaatattccacatctctctaaccaggtaaagtaatgataatactattgcatgcatgaccaaccatataaataaatataacaaggtcgattttcttgtaaaagaatgtaacgagttaaaattcgaataaaaaaactatcacttattagtagagtaaagtgatttcatgtggaccacgaacatcctcattacgattgcagttcaaacggtccatagattgaggattcaaaaaaaagataagagacgttaaggattatgattgtttattcaaaaggatgacactaaacaacaaaataactgtagttttgaaaatttgaatgtataaaataaagatcttttctagaacaaacccactaaatctgactagtaatgtcacatcgattttagatagcgtttgcattttggcaaatactatgtttggttggtgagatccaaacgctttttagaaatgtataaaacatagcactaacacatttttaaaccttatgtattgtttacgcaaatacacgttatttattttccagctaagtggtgaaaaaataaaccggttcacatttttttttttaaatgttactaatgttgtgtttgtctacacaatttttttaaaaaatgttactaatgttgtttgagacaaacacaacgtgtaactttgtatcctacatactcttgtatcaattgttagattttatgatgttcatacgttaacaaatatgtatcatgtgaccaacttctatccctcaaattagaattttgaagttagtgaaaacgtgatgtaaaataggtttaacatatgctttatgggaatatgttgagactaatatgaaatacaaatgaggttggagtgagacatgctatgtaatatatttaggtatgtagactgtatgtctccgtagcagctgcatgaatttagcttccaaaagcacatatacttgcacgggtcacacggtttatttgcagtgtaactttttcgaattgcgattcttgaacaaaatctctaagagtactcttctactactttctgatgtttttcgtcatatgtgagtggaagatgttggtttagtgtcgggttgtgtagagaggacaagagttagaccatagacactcaaacagtcaaaccaatctattataaatagataatatctctccggtttagtatttaagctttctttgtataccatttatgtttaatgaaggtttcgcgcttgttgatacaatctgaacgagatctaaagaaaccgtaaaaacatttagaaataatacatctccaaaaaaaagtcattcggaaaaacattttatgatttaaattgatggataatttgttctcaacttatacatccaatttccgaccaattcaaaacgaaattcatcaatactttaatttcttccttttttttttttttttttttttgtcaaccgatataaatttgaactcaaaagatccaatcccgagagatattgtttacatacgtgacatgatgcggtacggtacgaatctttcgtgccaacttatccgcttttacatttgcactacgagaaattaaagataaagagaaatttatgaattcttccctatcactctacaactccttcaaatacactggaaacgccggccattcggttggaatcggtgaattggtgaaatttttgtttctagaaatcaactaatccgtcaaagatggtttattcccttaatgatgaaggaaaatgggttctcttgttgctaataaaataatggtatttattttgtttcttagaaagaaaaaaaagactaatttaatttggttggtcacacacaaccgttttcatcggaagaagaacaagttggattgattttgctttggatctcacatctgagatcagattaatctctctgtgaagtcgaagaacgaaaccctagttcccatg

SEQ ID NO: 33013 - DNA, 3000 bp, Unknown
  misc_feature (1)..( 3000): 2750-1469P.txt file - cDNA_ID_3064264; gDNA_ID_1620448; Annot_ID_157364
ttgtacccatacttcttcatcgacgtgtaaacccctttgttgaaatctccgttaacggcgcttgacggtgagtaaccgttaacgttaacgttgactgagttgaatttccacgtgtcgttgaacggtgagttgaatttgtcgattgggtttaaatcgacggtggattttgaacccacaggtccgaatcctaaacccatgtcgttgtttgaaccagaagacttccagttccagttggaattgatgttgtcggaagttgtcttcttctgataatagtcgatctggttgttgttcttgtcggtggtggcggctatgtctaagtttcgacgctctttgaagacagagtttgtgctccagatcgagtcgttgagagacagattcgctagattcggtgtctgaactctcagctggtcgctgaactgccaaaaagattgctgattgttgttattatactccatctctaactctctgattgatctggaaaaatctgatttttcgatctgggtttatcgaaagttgaaatcttttttgcgatttttggtgagaattggggttggttttaagtggagagaaattggtgaaaaatgggtgagaaatataaagaaagatgaagaaaaagttgtaagcttttaattggagcaactgtgtcatctaagtagaaatttccacgaaagtcacaataccattctattttattttttcaaggttgcgtgtgaatctgacaaagttggatgattaagtgaaaagtaatttattaaataaggaatactaataaatacaagacacaagtacttctgtatttataaaattacacaccaattaattatgtcaaatttaccatttagtacttctgtctgagcttttttttttgtataaaaatttggttaagaagaaaattgcgatttgcgagtgaatgagcatgtagcagcagagacgcggaacaattgcaattatgacgtggcagacttttgagaggagatttatttgtgccgatagtaacaaatatctaattttaaaatattgtttttttcaaaactaattaattttatgttttgaaaatttgggttgatttgtcttagaggctaaggattgtggaccaaacaccaaaaacgcgttgacgagaaagacagtgagtgtgtcagcatcaagttttcgactctgtataacacgtattaaaattccccggaagcttctattgggttacattccccactttaagcccattcaattactgattcaacaggcccatgtacggcccaattagaaaaggcaatcttattcttcaattcttcttcttcctgaagccagtttgacagagaaaaattcatagagaaagagatggatccgcaactaatggaggtttcacagcagttcgagaggtttaaagctgcgtttataataaaagatttcgatacctgttccagtctcttgtctcagcttaaggtactgtttccttttagccctaattcaatgcggatcaatagataaaaccttgaatatatcaatgtcaaagtttaatatagatttgatttattaatgagtagagagcctaagttgaaccaattgatttagagttgtttgatcattatcttatatcactctcactgaatgcattgcttttgcttacgtgtgctctgttttttctatgtaccaggaatcgtattccgccatctccgcaagagaatctaatcatggggttgaacctactgagactgcttgttcagaacagaatagctgaattccacacagaactgggattactttcatctgcaaccttggagaatccttgcatcaagcatgcggtggagctcgagcaatccttcatggaaggtgcttataaccgtgtgttgagtgctagacaaaccgcacctgatgagacttacgtctatttcatggatctcttggcaaaaaccattaggtaaataggcttcatttgtcatttgaccctttctcttctttagctcattgccgtgacttaaaacatcattgtttatctgtagagatgaaatagctggatgcagtgagaaagcatacgatcatctctcaatcagtgaaggttgtaagatgttactcttctcgtctgatcaacaactgttaacatatgtgaacgaggagcacccggagtgggaagttaaagacgggttagttgtcttccaaaaaaccagagaaaccgcaccgtgcaaggagataccgtcacttcaactcatcaaccagactctcagttacaccagagagctcgagcgtatcttgtaaatcccattcaagtgttaccattgtttgacttacacgcctcagtcatcactagtattttcccaaacagttgatttgattcatcagataatttagctctgtcctttctttcttttgtcgtctggttataatgcaacttatatgttatggtcacatgaatgatttctggctcataaaggcaactccattaaatgagtccgtgattgaattttgattcttgtgtcccactgcttgtaaatatattatgtgtattattttttttattcaagaaagagggacaagaatatcaaaattgttgagaagttgttttctctttaattaacaaaatgttaaataattcttcttctctactttctgctccattaattttccaactacaaatctttcttccgattttttcttgacttgtgtatttaataattgatggaatcattaataacttataaattaatttcttaaaaagcattttgataattgaaaagtgtgctctaaatacaatattccgggtcattatgttttgatttgtcgactgcttttttcaatttttaaatcctcgtaataaatttaatatattatttttcagtctttaatgaaatgtaatttggtattattagttactaacatttaaaagaaaataattggcttgtaaagaacgtatggaatgtgtcgagtatgtgtgtatagtgtctccacttggatctttcttacttactccattatcttcttctctctctttccctcatctcattaatg

SEQ ID NO: 33014 - DNA, 3000 bp, Unknown; identical to SEQ ID NO: 1792
  misc_feature (1)..( 3000): 2750-1469P.txt file - cDNA_ID_3064275; gDNA_ID_1620448; Annot_ID_157358

SEQ ID NO: 33015 - DNA, 3003 bp, Unknown
  misc_feature (1)..( 3003): 2750-1469P.txt file - cDNA_ID_3064285; gDNA_ID_1620448; Annot_ID_157355
tttgtatttgtgtttcttcttttgcaattttgtcagatacataagctttttgttgctaaatctcttatcatcgaattcagaaatctgtttttgttgttataactctttctacaacccaagcaatgaagctattttgtttaagttctgcatcataaatatgcataccatgaagagttggatcgaataattgcagcctgatatgatcttttgtcttctggtccttattctaattcttggcatctcttggactgtttctgtatgtagtgatgaagtggttaagagtcttaggtcttctgatgtgtgatagaactccattgatactttcaattatttttaacatatatgaatataggacataacatgtaccatttagcctgtcttatttgttcaaagaaagctttttatcactacatttggtttggttttatgtaattttttttctttctaaacttactggacgaagttgctcattttctgctcatctacttcttcagaggaagcattggatcaccgtggtcactaaggagaagaaagcgagttcttcaacctaaacaatggaatgcttttttcacagaggaagggcgactcagtgatggaggtgtcaaatttctgaagaaagttcgtagtggggtatgttgctaaataagaaaaaaatctgctgtaatctgcagttgataaccttttgacactttgatatactaatttttatttttgtttcagggtgtacatccaagcatcagaccagaagtttggccgttccttcttggagtgtaagaatcagcatcttgtcacttttccttgttttttgtatacttttatgagttttatctttttcggctaccattgggggttttctgttcggccttatgttcatactcatgcatggtctattgatattagctttttctttggggatattgatgttatgtaggtttaaggttgaataaacagtgcatcagtaaagcattcattaactaggagatcagagagttgccttaatgtttttctatcaagagatttataagattagtcctagtttcgccataccaaactccaccagccgtcgccctacattccattaacttgataatgaaacctgtgcaagttatttgtagtctttatcatctcgacacattgtaaccttatgctacttacctctcacaggtatgacttaaagagcaacaaagaagaaagagactccattcgacagctgaaactgtatgtttgcttatacttattgagagtttaatggcttctcaactttctaccaaatgttacgtttcccatttatctctgttctcctaggtggcagctggttattaacttgctcaatgtgttgataaaactaggaataagaagtagtagtttggaactcctacactgagatttcgagtcagtttgtaagtaacgtcttttatatctgtaaatcctgcaggacggaatatgaaaacctgcggagacagtgtcgcgagattcatgaacgctatgaaaatgtctgcgactcaaaggagacagctcagagcagcaacactgaagacagtcaggttcttgaatcccatgatattgaggaagtcgagagttccacaagaaccatcaccgtagatgaatcagagaagttgaattctgaatcgattatgcaggatgagaactgtgaaaagagcgatgtcaccacagaagatgctgctggtaatgattcagactcaaccaatcctgaagaaaccgagacttcaccttttctagctaacgaagaagtagaaagccacaatactgttaaccaagaaaaagaaatttcgtctccatcatcaaagccaaaatctcaggcagcggacgaggatttcatgtcaacttggcagagaattatccgcctagatgctgtgagagcaaatgacgaatgggtgccctactcaccaactcaagctgctgtttctgagacaaaagcccggggaatagccattcaggttggtctcaatgactatgaccacttggaaccctgccggatatttcacgcagcccgcctggtcgggatccttgaagcctacgcagtctatgatccagaaattggttactgtcaaggaatgagcgacttactatctcctttaatcgcagtgatggaagacgacgtcttagcattctggtgctttgttggcttcatgagtaaagcacggcataatttccggttagacgaggttggaatcaggcggcaactctcaatggtatcgaaaatcataaaattcaaagacattcacttgtaccgacacttggagaaccttgaagcagaagactgcttctttgtataccgtatggttgtagttctgttcagacgagaactaacctttgagcagacgttgtgtctctgggaagtaatgtgggcggatcaagctgcaatacgaactgggattgcgaaggcgacatgggggagaatccggttacgagcaccaccgacagaagatttgttgctttacgcgatagctgcaagcgtgctgcagaggaggaagacgataatagagaaatacagtgggatggatgagataatgaaggaatgtaacagcatggctggtcatcttgatgtttggaaacttctagacgatgctcatgacttagtcgtcaatcttcacgacaagatctaagactacttatatctttcactcttgttctctctctttacttgtttgttgcattctttgttatttgttacataaaatgtgataaaaaccgttgtcctaaaacgcatgaaaatgtcttcactattgctaaaattaaatgtagaaaaacttagccaaacgagaacccgctgaggctaaaagaaggacttgactttatttggttttaagagcctctggttgagctagaggtgtataactgtaacaaactaactattcttcgttttcaatttccagatacatcagatctcttcttcatcttcttcctcttgggagacttgatttattttgtgatcagtctcggattgtaacatactgcgatcttttttcagcttctctaatg

SEQ ID NO: 33016 - DNA, 3003 bp, Unknown
  misc_feature (1)..( 3003): 2750-1469P.txt file - cDNA_ID_3064299; gDNA_ID_1620449; Annot_ID_157427
tgtaaaaattaagcctccatctagctggaaagtagcaagagaatgtctagtagttgttatgagaattatggataagaacaagctaagggaattagaacacgagcatgtttgatacgtatctaaattctcaattgattctgcatcaagtaggtgtagtagtagtagtagcctgttgatgaactctctcttcctctgtcttgcaggaaatatgccttcttagcaatgctaggtctggccgtttgcactactcatttgctattaccttacttcgcagctgagcctagcccctctttgtaagtttattgtttgatactttgattaatcttcactttgccatacatcgaggttgctgcttgatttgtggctcgacactttggttttgcaactttaaaactatagtttgtttttatgatttcgtaacatgtgtatactttcttcagataatgctttcaaaatgttgaatatcatagaatttgttaatctactcgctcaaactacaaattcacaaggtgatataacttttgattttggcgtgttacatcagtaagcattagtcctattctaaactaagttaaatttgccacttccattgacaaaataacctctcttgaaactcaaacaattaaaaatcatcaatctttgtaatagcatgattaattataaaataacaagaaaatactacgtatctaaattaatcttgaattatattaacacaatttttctttgctcaccacacaaaaaaatatatataaaaaatcgttttaccaaacaaggcaaataaaaaagatggatcagaaaataggcttggattttctcaaaaaagagaaatcaattcgctcagattgttcagcttcgatcatttggagaaataatcctcacttccatctaattatgtgaaactagttataaaattgattgtatataaataaataaaaaaagggatcagaaaattggcttggaatctctctgaaagagagaaacataaaatcgctccgtataatcagcttcgatcatctggggaaataatcatcacctcccaatcttttttccaataatataaaaactaatcagaacgaaaaaaaactaacatgcaaaaccaagaaaaaacaatttttgatacaaaaaaaacgattagggttcgtagaattaatgaaatgattaggtgatttatataggaacgttggtggctctgaccaaaaaaaagaaaaaacctacatcctccaagaataaaattagggtttatcaagtgggctgttctttgggcctattttgacctttttgcccagtaaaaaaataattgaagatggacctgaaccaacaaagtgtttttcaattttctgtagacgtacgagcctacgaggtggtctatagagaatgattcctcatcgtattactgatcagtgatcaatgtgacaaatgtgtataatgtatatgttataaataaaaggtaaatccaagaatgtataaaattaagtattgcattgtattatgttttttctcattatgtcgaaatgaagaatataacaatgtatgtttgatgactttttcaaacactccttgtataccagtaggggtgggcattggggtaagccgtttgtatttgggtaaaacccaatcggataccaatccttcggataaagaagtttaagatccaatagggtaaatctaaattatcagttcggtttcggttcggttccagtcgggttcagataagtttggtgtagaatttcaggctcttttggaaccgataccagaattttcgatttttaggtaaatatatggattttcgggtaaaattttgggtttcggataaaatttagattttcgaataaaatattcaggtattttcgggtagaggaatttaggacccaatagggtacatcttcgggttcagttttgggtccaattttttgggtcggttccggttcaggtaatcggatccagtttttttttccccagccctaataccattatcgtcaatgtttcctacttacttttggatccgctctcaagtgtgattcaagtaacttatagtttgaatatatatttaaacaatttttactattcagaatctaaatgtaaacattattaatggaagtctaaagattcaaattagtttaattgttgaagtattagagtatctccatcaaggagaaatccatttagtttctcaaacaaaaaaaaatattaatattttattataattttgttttatgattaaatttttattttagtaaaaaaattgaaccaattgaaagtaaagaaatattatgattgcatgtagagagtatctcatagtttctcacttgagaaactttctacattctctcttttttttaattattattttattagtgagaaactcaatattaagatactcctaatggagatggtcttattatctatgccggtttcactttttcgtttgcctaacattactcaaacaaaccaagaagcttaatccctaaataggtctatgcataattaggtttgctattgatagcctccacttagaaccacgtccgtcttcgtagattatcacgtgggttgtccagccaaagatatcactttaagatggttcacattgtatccatggtcaagtcttcatgaattacattagtcccttattatttttgttggtcatcaaaataaaagaaaatttgtaaggttatcatattacctcgagaaatttgagattttgcataattgtttgatatcaatcgatgcaagcaagatttagacgtttcttcaacataaaatttgtagacataaggtgaatttttagactgatgtagataatgctttcgttagcccctatgaatataaaattttaggcacaaatcgtagtcatgagtcaccaaatcaaatgtcggtactcggtacacttggtttgagatctctccctataaaatggaactaagtttacctgttgacaccatcctttctttccgactctacctttgttatccatcttattctattttctaaccaacgacaacaatg

SEQ ID NO: 33017 - DNA, 3003 bp, Unknown
  misc_feature (1)..( 3003): 2750-1469P.txt file - cDNA_ID_3064310; gDNA_ID_1620449; Annot_ID_157421
ttcttatggtgtcttgaattatgatcagctgccccacaaactccacaatgcatgattcttttcttaccttttggctgcttcttagtaggagactcattcacaccgttcttccttttcttctcagcctttgtcattttcttgtcttcttcgccttctgttggaggaggtacatacactctcagaccattactctcgggccagaacttagggcccctttgtggaaaaaggccatccgtgtaattcttcctccacattgctgtcctaaaccagcaacatacaaagttctctggttcaagcttcttgtggatgatgacgctatatgcatgctcacatgggatgccacaaatttgccactttatgcaggtacaagtgtaagcctgcaagtctacacggtgaagatctccaccatgcctcacttcatacatcccattggtacttggagacaccttcgcagcagcagcgactttgtgctcaccagctaagaactttgtaacataaggtgtacaaacacctacaaagtaagagaaatatatgctttaaagggagtcaaggctatatcacatgttaagaatctgcaaagaacaaggcttaatagagtagctaacctgtgtgagtatgggattcaacagatcttttagcaatcctcaccatagccattcttctgattgtctctaacatcgcaacaaatggcttctctcttgccttgttcaaagatccgttgaaagactccactgagttgttgtcaacgtcttcacagaagctgcctatcttctggaatgccctaacccaactccttggttttgtcttcatcacagactcatagactttagtgtcatagcaccgtatcttctccaaatgctgcttatactctttctcattgtaagaccaatccaaattccatagcagtggttttatcattgttttactgccataaatcttcttcgagttcccataaatgtgttgtacacacatccggtgctctatcttgggtaactcaagttgaaccgctgctattaaacctgaaacaataagacaaacatttttttttgggaatatctggaagttcaggcctaaaggccctacatctccgagaggcgggacccacaccaggttaaattcatctcctttggagaagagatccctccctacgtgcctcgaacccaacacctccacctggaagatttaccactaggccaacaacaccttggtaataagacaaacattagctaacactaaagagacacaaatgacactaagctaccttttgcctatctgatatcatgatgaagccttcaccatcacttaatctgaagtcttctttcagcagcttcataaaccacacccagttatctgtgttctctactttaacaaccccccaagctataggatatatgcgattgtttgcatccctaccttaggctacaagtaactgtcccttaaccttattctttagaaaacaaccatcaatgcctattagaggcctacaagactccttccatgtccttctaagactgtcaaagcatacatagaacctattgaacatgtctttaccatcatcactcgtgagacattcaacttcaacccgtgaatccttgtttgcttcaagtatctcagccgcataatcccttaatcttgcaaactgatcatcgtactccttctcaatccattgcaaagccttctttctagcagactgacattgattcctagtgacacttatcttccattgttccctaatgatttcttctatctttgtgggcatgtaaaattcaggactatccctaatcttatcaacaaataaccgagctatatgcggcaccttaaacatctcacattctccattagggatacagctatatgtatcaacaaacttcctaatcttccacatattatcactcgggagaattgccgcataaattttccactcacacttagctccaccttttttaccgtcacaaccaacacaaatgaacccaattttatctttatcatacctgtattgctttatattgcatccggttttgagagcgtaatcaacaaccgcctctttgaacgcaacccactgaaaaaactctgcttgtggtacaaataaccatcaccacgccttatatctgtgtcaaatctttcggttttttcttcatcatcactctccgggtacatatcgtggcgaattggtggttcgtcagtccactcctttagcagttcttccatgtgaaactcatctctttcttcagcttcggaatcgacatcaccaacaagatcagggtcgtgaaggactaatgacatcgatcaaagcttctagggtttgggaaaaatcgatttgggtttctagggttcgtcgtgagaaatttgggaatttttcgatttggtttcgatttgttttttggtcttaaacgggttgtaattcgggtttaggctggttctaattagatttatttggttaaatcatcggtttggtatacagtaaaccaattaaacccagagctatggggttttaaatctcgaacttacgattcatggacattaggctctcgaactttcaattagtggggaaataagcgtttaacttctgtttcatgggtatatagatagaggtcaaagatcggggtttatttagccagatatgatagttatcgtggggaaatagaccgtttttctgccaaaaagatataccgttatcggtctggtaacgttaaataacgtcgtgtggattttgacctgattatgattacgtgaaatgaccaatcaacaatttttacatgtatacgaagttcacgtattaaatgactactttttaaaagtttgcgtattaaacgatattttctcgttttttttcccagctctaaccatatatatctcacataaaattagggttacgaagtggaccttttataaatagaggataagagaccatcatcgaaaactcaaagaaaaaggagacactagctaagaaatttaccttgcacttttgatctgtgttctcagtagattattcgtaccaccatg

SEQ ID NO: 33018 - DNA, 3000 bp, Unknown; identical to SEQ ID NO: 1793
  misc_feature (1)..( 3000): 2750-1469P.txt file - cDNA_ID_3064319; gDNA_ID_1620449; Annot_ID_157409

SEQ ID NO: 33019 - DNA, 3003 bp, Unknown
  misc_feature (1)..( 3003): 2750-1469P.txt file - cDNA_ID_3064357; gDNA_ID_1620450; Annot_ID_157457
tctgtttcaagcaacatatatagtttaagattcctgactataaaacaatcaaacttgacatctaaaaaaatgtggagctccaagtcagaatttaccctgcgttcttcttgaagggcactcagttcatcagcagccctggatagtatcccttccacctagaaattaaacaaaaaggggagctgggagcgtcattgacatggaactcgaaaatgaaaaaaacaaagatcttaaacgccattgtataggcttattctccaccaaaaaatgagttaacggaaacaagatattcccaactgctaacaccagattgaagctagcaaagaaatactgatagggctccgatggcaatcttctcaatattcatcgaccaagtgactagcgaatagttattttgtcatgaatagaccagaagatttttaggttgttcaaagaaacaactaccccctaaaaatgaacagtttgtatcacaagatggttaagaggacttaccgtagataaactaccactttgggcctctggtggaatctcaaaatccagttcaggaatctgaatacatatattaatgcaaactactatcagtttccagcttcaaatcagtccagttttcatattataagaaggaaactaattcacagttttcagggagattaggggaagctgtttcttataaatatgctcggttaagaaaatactgaatccgaagatgcattgaatttcccagaatcagtaagagaactcaccttaatagtggctgattcagattttacaacttgccggtcaaatgtctgcattcagagagaaataagaaggtaaaattagcttagggagcaagagacaactaaagaaagataattcatgttttttcttataagaatggcaggctacatgctacctcataattgcatctccacatgaaaattataacaaacttctattgaaaagaacaaaactttagatttgaatcaatgcaccaaccttcacatcaccagctgaaacctctagatggtaagagcatcctcggggttgaatctcgccagcaaactgaacttcattattcctataaaatataccagagatcaagaaaaggcttatcttttttaattgagaaaatagacaatatatagtgtatctcaaatcaaatacttaaaagcatctcaaaatcataagaagttgtacctttctccgcaatgcggacattcaaatgcagatattaagacctgtaaccagaaatatgttagcaggaagcttctaagctaacacaaggtagagaaaattctaaataaaacgtcgaaccaacaaaacttagtggattgttagttttctagaatgtcgtctactcacattagctagaatattaaaaatctgaatctagaaaatgaacaaaattgggtactctttaaaacatacctttctgaagtgaggtattaaggtcaatagaaatctagttgttccctggaaaagaaataagaagctactttatgcacagaagaaggatcaagagaaagaccaagaaaatctcatacgttggactctttacaactgaaaaagatttcagccaaaaataaactagtagctgaaagttcacaatataaagcttcccaattgatttccacagaaccacatatgttaatatatttcattccatcaccaagacttagccaataaggtctgtttcatccccgctataatacacttcattacaatctcaagaaccattggactgtagaacgaactaatgttattaaagccaacatgtacaatttgggaacaagctcaaactaaaaagcaaagactaaagcgacgctagcctgtttcctagacctgtataacctttcctcctatgacaaaggataaggactacataacaacatcaggaatctcaataaaacttggtaaagttcctctaaatctcacaaatacttaagtttctctatttccaaccttctcccatctcaaatttgatgaagatgctccaaactggcaagatttcaaaggcattgagatggtttcacttctagtaaatttacaaagcaatgagaaaacaaatacagtcactgcaagctacgcgttcaaccaatttctccatccacaaaaagataagcttacacagaaaaattccaattgtaaaatcaattggaatatacacatagaccttacctacaaaccgagacacctaaccaaatgtaagtgtgtgagagagataaagagacatacattttcaccgcagcgcatacacatactctcaactacatagagaggagcaccaaaggaatgatcagccgaaactgcttcaactaccgagccaacatcgatttgttgatcattcccgttgtccatcacctccaaaaatttctccaaacaatcctatgaagttcaaaaacctattattagagaaaacaagctaaaaagcatgaaactttgtgctcattaacagctagacaaaacataaacttatatccaaaatttccaaacacaatccctatactaagaatttatataagagctctttcaaaggtcaaatcagagtgggacagagtgctcaagataagttcctagaaatcgagaaacagagttcaatttcgtcaatctcgagagaataataagaaaaaaggaacttactttgatatcaatttctgatgtgagaagcgaatatgtgtatcaaacaagaaaacttaccgagtaaaagagacaatgcttgaaattttactaaactcaggcaagaagcagaggacaccgaagagctctagaaacggcgagagagttgaagaagaacccacgtgagcatcacgtgtttgtcttttgtttattgtttatcttcgggtcgggtaaaccaatcctactcaccgccaagaattgttcttgtccggtctggtttagttaaactgttcaaaaccgaaacctaaacgacgtcgttttgtctgagtaaagaaaagggttttcgactggtgaattcttcttctgattctcgtcgccggtagttgtttccacgaaaaacaagtgatg

SEQ ID NO: 33020 - DNA, 3000 bp, Unknown; identical to SEQ ID NO: 1805
  misc_feature (1)..( 3000): 2750-1469P.txt file - cDNA_ID_3064363; gDNA_ID_1620450; Annot_ID_157455

SEQ ID NO: 33021 - DNA, 3003 bp, Unknown
  misc_feature (1)..( 3003): 2750-1469P.txt file - cDNA_ID_3064369; gDNA_ID_1620450; Annot_ID_157449
atcacaaatgatcagttccagtgtcattagacttgagcgttagggagtttttaagaggacaaaatctattctgtcttcccgaaaaccactatgaccgtgagggggaaacaacttcgggaagatggttaaagggacataccgttcatcggtggtctaatcgatctttttctcgcaggttattctcgagttctcgcacacataaaagtttttaatcgtatgaaagttcccgaaaatttgacaaaaacttaattttttacaattataaaatttcatttaaaaaaaaacttgtttataatttgctttcttcctattaatcctttgattcctagacttattttgctttcttgctcctaaattaattgagttgctctcttggttcgatttaaattgtttgatcgacatcgatctggagtgaatttggaggaagtgtagaccctaaaaggtcgtatctcaaactcgatgttggcatgtgatgcaagaatttgacttacaagtgggtgtagatcaagggttgatgttaatctactatccgatgtaattcgatacgttccattgatgtgaggaggggccaatgttcatgcttaagcctctagtgttatcaccgaactcaagacaattgaatgctgcaagattgtgtactaagagtatgcagactgattttacgtgtcaagactttccactgcgatttcaaccacagtgtacgtatgttttcagtgacaataatacggtattattaatacccgactctttcacaaactttggaaattagtttgagttcaattcaaaatcgcatttaaaaaaataataaaaaaattacatgaaacccacaatatttggtatgaaatttaatatggtagttagtaacctcgtaggtacaacattcatcttcttgctgccgacatcataattgttcataaatatttttgaacacgtacatataatgttcatggaccaaatctgatcagactcctaattagatgaattgtgtggtcgattttgagatgtactttttgaatcataattctttcaactactcgaaataaatttccctcaccatcccaagactactagaatagcatattcttaaatataaattattatataaccaaactattattctttttaagattatcactggatgttacgttgaagttataagacatgatatatatcactcaatttcagaaatgagtagagttcttagtgcatagtttttcttaaacctacaaggctacaatgaataaagcacgacaccatactgttctcaaaatatttgtatatagtggaactcggttgaaacatatatataccagtaaagttatttttgtttttgttaataaaagagtaactcgtgaacttgaaatcaaggagctaataaaaaattatttttgtttgaatttaactttttcaaaacctaacacgaaaatcagaaattctgaggggttagaatggttctcacttgtttacgtttctacgtccaaaatactcattgagttttcacattctcaagttttggaaaaattaacaatttcgtttataccactaacatgtttaaaactataattattctaaaactttaattatcaagttcatttcgtttagctaaaatttattctgttatatagttatttattggatataaaccctaaatttagtgttttgatgccacacgtaagctgattttcaaatcacaactttataaattccctcattaatttatcttctaatgcatctatcaacaataacgttatttatatatgttgtctatatctattaatctaaatttgttacaaacaatttaagtcagcacttatcggttttatgtctacatcatacattatgtaggttgtacgatgacgtgggttgtagctagttaggtataaaaatttacttttaaaagaaaaacataatctcctcatcaaaagcttttaattgaatttaatagccagggccaaatatgccaacaatatacaccaaaaaacatatttgtcgctagaacagtgctaattaagggactcacatactattagacattagtgcatgtcagccaataggcttattgtattttcaacatgttggcccatgtcagccaataggcttatagtatttgctaaaaataaaaatatatatatttgctcaagtgttggtgttgcatggttcaatatttatcaaaactcaaaagaattgttgactaactttacatattaacaagactaatcatttttctggtttgtccttaattttaaatatgtaaaccactcatttatgatttctccaatttagaaagagtgagatgtgaagtttctcccaaagaaagaaaaaaactacaggtaaataaagtgtatactgctttccaaaatatgtcgaattatcacaaaaataaaacgaatttataattaaacatctcgttatggattttgtatagaaatttattggcctacaactgttaatagacatattatttggcattgtacgtaatctagattagccaaactatatatagaacatcatgtttagctgatttttcaaaaaaaaaaaaaaaaaaatcatgcgtagacgaaatgcaagttttaatttaattttattgctttctctggttagctctagaggtctttaatccaccgatcttaaaaaaaaatccaactttctactttctctttctaaatgaaacaattccatatttttcatttcatttatacatcatacacttaattaatgatattctctttctagtaattagtacattaatttaaatttatcaagaaaatgctgttgaacatatataatcaattattatgaaatgaaatttataatgaaatgatttgtttgatagaaagaataaattataaactacttaagagaccgacgaagatagcaacgacaaaaccctaaccttataccaaccctcatttaataccaataaaaaaagagggacaaaaaaaatcaatgctatataatcgaagtatccactacaaaggttggagaatccttaaactgactatg

SEQ ID NO: 33022 - DNA, 3000 bp, Unknown
  misc_feature (1)..( 3000): 2750-1469P.txt file - cDNA_ID_3064411; gDNA_ID_1620451; Annot_ID_157480
atttatttattaggggaatgtaccttatgacccgaatgcacttttacccaaatccaccaaaaaaagtcttgcaaaaatactatagagataataaacgatagtcggttttgataggtataagattagcaaatatattagttagcttttattagttgaagaatacaaattgaaaaggtatattacactttattcaaatatagtatcaaaacttatataacacagagatttgataattttttaattgttgaatacttttttttgtgctaatttttctgtgattaagatttaattgatttcgtatataaaattattaaattgttttacgaacttctttgtttataatttggtaacagatagatattcaaatattcagtatattttgcttcagtttaggaaatctttgatgacccgtttttagatccaataagccctataatctagatattaacctgcagtataccgcatgtaggcttatattttagttaaactaaaaacttttactgtaaagatgatttaaaaatatatgatattattttatttgattttaaatgtatagtaaacagtgagttgtatatgttttgttgatattatctatattgtttagtgtttaagattatacacttgtagtttgattgttaatttaagagtttcacctgtagtataccatcttgtattaatatcgatctaaacccgtcaattctaggattttccagcttgtattaaaaattgaatcacatcatacacataaaaaaaatctaatatgttattaattattgtagtatataagattataaattttcaatataatatgtatgaaattgaatataaatatttcaaattatgacctgttactcagtagaaagttttcttaaatctatttttcacccgttataatattttttcatgtattgaacaatttatattcgtttttaaaaattcaaattatggcatatgcgaaaaagtctaattctttttttataatgatgattttattttttcgaaaaaatagaatcatataaagatgagaagtgaactatactaattaataaaaaattaatatgataatttagatatcaaatctaatttgttgattttaattggttactttttcggaaattaataatgtatttcgtttttctaattaaattaaattaattgaaatttatacatcaaatcttatatgttgattttgattggttattatttttggaaattaataatgtattttattttttaattaaatttaattaattaaattagtatttgactttttaatccttaaagagataaattaatttactctttaattttttgtttttaatggcatacctatgtaattacttacaaaaattaaggttacatttaaaatgtacttcccaaataatatagtaggatttttcttttttcaatttagtagcagaaatctttccaccaatttaacacaaaatcctctcccttctctatatgtccatgatcatgtccaccattgacaccctataactaatttcgggatgtaagaaaattgagttaaaataaaaaaaaaaagttatgtttaaattcatatattcttttacaaatattaggatgcataggttgtaataacctaacagaaatatctcacttgaaccatgcatctgatttacagtgagtgcactggtagaactgctatgaatgtttaggaacgtttaagttcaaaaccggttggaaccgcataactcaatatcctaacaagaaacttaactccaacgcttaaaaagtaatttatgcgatctaagataggtgtttagaggttaaacaacttcttatactgctttttaaagtattgaaagaattatctattatagttgtctatatataacaatatattggtaattataacaaaataataatgtatttttttctgtaaactttttcatttctcaaatacaatgttttgttattcaaaaattagaacctggaaaatcgaaaattctgttaggtaaattgaatcatttttctttaaaaatcaaagccaaaagatgtgagaggaagcaaaaagaagtactattatcttatttatttaaagaagaaagaagagagacaagaaaatggaaaaaaaaaaaattatataccaaaataaatatatcatagttgtgtatattatatagaagatcatatgaccaatttaaaacatatgaccacacccttaatttaaaatatttgccattggatctaatttttcaataatataattgagccatacctgctgaacggttgtcctccagcacaatgataactccaaccaacttttcatttttgtgataaatactataaaattaacttatctaaatcagtttaagaacttgctcttaagctacgagcttgtattaaattaaactaaaacatatactaaagcatgggttgtcttgattttgacgctatttgatcttacgaaaatccacttttttcatattttaactcttcatattcaatttttttttttttctttttgttttaatttataatattttcttataaataataaatatttgctttttcctcggtaatgaaatgaatcgtccaaaaaagtggaagctgatgaaagtagtttgacccctccacatctcccaacttggtacttagcgtcgcacacaccacatgctctctctctctctctctctctctctctctttcttctcctttctctttgtatctcttctctcttatgctaagccaaaaatggaagctttactctattgaagacgagatccttctctaatttacaggtacccatcttttatttctgaataatagattttggttcttgcaaatcttatagcttaaagttgagatttttggtatttacttagcaacaaaaaaagtttgtgataatattaccataaatggtgagacatccatttgcggctgagattttgctactttactcttttctctctctctatttccatttgtattgtcactcactcacatacaaaaataacatcataatcagagataatg

SEQ ID NO: 33023 - DNA, 3000 bp, Unknown
  misc_feature (1)..( 3000): 2750-1469P.txt file - cDNA_ID_3064431; gDNA_ID_1620451; Annot_ID_157470
ccatattccataagcatatatacattcacaaggcaatgttatcaattcctagagatgaataaagatggtaccttgacttcaacaagtgaaaccagtgatgatacaagcacaacgccatggtcttcctgcaataacaagcactttacttttcaaatttcttgaaatgtatatgaatctaaagctagggccttttcaaacagaacctaaatggtaagcaacaagcacttttcgttttagatttccttgaaataagaatcgaaagctgatgcttttctaagtagaaacctaaatggtaatcaaaaaccactttctttttagactcctttccaagcagaaactaccaatatccaaagtcaattcaaagagtgtaaagggagaagagaaagatgacgtaccggcgaaccaatttaagtaaactcggtttgactttcgtttatctctaaaaatttaaatttgattggattaccggtttggttgggttcggaacctccaaaacgattagtttcagtaaaataggttctttttttatcatactaaaagtttctctacgaaatcaaaattccgaaattattgagtttactgaaatagaaaaaaaaaattcttaaaatcaaaaattttattaaaaaaaaaaaccaaattttggttcagtttgtgatatcaaagactgtagtgagtaagtgaccgaaccaaaattttatacttttgaaccaaacattagtttttttcttgactgaaaccaaacagaagttttgttcgattttaattggcaaaaaaaaaaaaaatggatttaaaccaagaacaaaaggacaaaattcctgaattttttatccaaactatcccaaaaatattggaaagtgtccatacctaggtttaaattttaatagattgtctgctattttttaaacttatcatttttcaaaacaacttgctatagttgacaagaaaataatgttaaaaggataattttgtatatgtgaatcacttgatgtaatacgtgcacgtcacttgtgagttcaagaatcgaatggaaggagctaatgcaccttgcatagagactatatgtgatggagcgttttacacacatctatcaaatttatatttacttaaagcattatgatacgtatggtctttcaaagatacacatatggtgttttataggaaggccttgcatgcatatggttcatgttgtatatcgatatgtggatggtggtggcgcattcaagaccatgctttttgttaaacggtatttgtattcacatacgaatattgcacaaggtgtagagaaatcttgttttatatatttcaaaaggtattgaagactgaggaaaatgatagccttcgagaaccagatctcacatcaccgaaaaataaaataaatcaccccaagatagacttcaacacaagagaagtttattgaatataaataaatgaaaattgaaaagagtgaaagagtgaagaaatagttttgtgtcaatgcatttttattattgtagtaatctaaaattatttttgggaaatgtagcacatcacatcattaattttggtataatatatatatatatatgtaacattaactttggtattatttatttttgaattttgtattgtattttattcaaataatcgttagacggtaattcggcattcggtaagacctaacaccaagataaataataataaaaaatgataaataaatttaggtctacgcacttagaaatttttattttctatttttgcaaaataagttgaaccatatccatcaaatctaatattaagaccctagttaaatttttagtgggtcaaaaagattttcgacctggtttatctttaaaattgattagacgaatttaatcggatatatgatttgactaagtcctactcataaacctccaattcgatgtttgatttgaattaatccaaaattatcaaaactcacttaaaaaaccaaaaaaaaaaagtgttttgaatatccgagtgagctatattttttgttgagcaaatggtgagctacatataagtaataaaacacatgcgtaggcgtcggtgccataagagtagccgagtagacgagcgggtaagatcttatcccaccggtcctactcatttattactaggattgttacatcaccaatccaaatagaacttttgtaaaagatagaaccatattaaattctaaagtcaaaaagtggtcctaagattaatctcatcttcgtaatcaactgttccagtttgattaattgataactatcatctataaataaaatgtgcatatattatatatgtgtaattgtatagtattttcccacttgattttatgatactcgggaataagtcaacaaccacttggtttggtagttgtactgcccaatacgtgaatttgagcaccgtcctcatttaagttttcggttttgtttattctgtttcaaataatgcataactgaattttttctctggtttgatttggattatatacggggtttttttttgtcaaggattatatacggttttaaataaataaaagagaaatttgttatttgtattaatattttttcttatatgcctttaagtatcattaatgaatgatgaaaatggtttgtagtatattcatttattttaatacatataacacacatattgagccaaaacaaatatcatccaaagtttttggtgattgtgcccattgagtatgcctgcttttaagaaatgcattaaccaagctagaattttggttcaaatcaattatctatatatatatatatatatatatatatacatatttcattttaaatatataactaagtcattttgactaaattatttaattgtaagataattaaagtattagaactgaaacttctaattttttatccggtttaattcgattttacgctaattctggtttcgaattaatttcgatttgaattaccgttaataaaaaaaaatgtcattgtttcaaaaaagtaaaattaatactgtgtttgaccaaaacaataaccgatg

SEQ ID NO: 33024 - DNA, 3003 bp, Unknown
  misc_feature (1)..( 3003): 2750-1469P.txt file - cDNA_ID_3064495; gDNA_ID_1620452; Annot_ID_157527
tctatattgtttaacactacaccaatgcttctgctgctttggatgacgagatagttttttttttactcgacacatcatacaagaccttcgtaagtatctgtaatacacgaatcattaatacataacacgaataatgcattactatagttttgagaatctcattctcatacttctgtctctcttgttgtcgaagaatatcacacttaacatataaaaagaacaacatgtcagtacacaaaggtaaagcccaccaaagagagaaaagaaaacaagacttaactataacaataaatttaatgtcgctctcaaaactcatttttttcatatgaattttctaacacaaacaattttccttggaaatctccgccttgtatctcttatataactcatctctctatactccgaacatgtccctctccgttaaccttaacggccatgtcagccgccgcagctgaaaccgacgtctctctccgtcgcagatctaactctcttaacggaaaccacactaacggcgtcgccattgacggaaccctagacaacaacaaccgtcgcgtcggagatacaaacactcacatggatatatctgctaagaaaactgacaacggctacgccaatggtgtcggaggaggaggatggagaagcaaagcgtcgttcacgacgtggacggcgcgtgatatcgtctacgtggtgagataccattggataccgtgcatgttcgctgccggacttctgttcttcatgggcgtggagtacacgcttcagatgattcccgcgagatctgagccgttcgatcttgggtttgtggtcacgcgctctttgaatcgcgtattagcatcttcaccggatcttaacactgttttagccgcactaaacacggtatgtcgtgtgagttaatttaggtaaaatatatatttaatgattatcttcaaattcttattgcctcctttcacctaataatttgtttttttcttcgtcattcataaatcctaatattttagtcaaataaaagtggggtagagatggaaacaaacctcagattattttcccgtgttatttaattctccagctggaattttgctgtcaatggtaacaagcaatgaaatatcctaagtatagtgagagaaaattagcaaaagattaatcctaaaatggtcataaaagattaagaccagttagtggataaaatggtcttaatcggattagttagtggacgaaaacatagttaatactacaaactctttgttttagttatgtgatcttctttttaacaactgcttttttgtttgtttgtacaacacttaattaatatagatcgcttttaactttagaaaagccaataaaaaatgacacatggtgaagaatgagttggagacacgatcacatgcaacacagagagattggttacttaaatctaagttttgtacttttaaactaatataattgggtggggacaggtgttcgtagggatgcaaacaacgtatattgtatggacatggttagtggaaggacgagcacgagccaccatcgcggctttattcatgttcacttgtcgcggcattctcggctactctactcagcttcctctccctcaggttccaatccacatatctctccctctttaaggataaaccaaatattattacattagtaacttcattttctttttataatattagtaatgatctaccagtatatatagatgtaacgtcctgtttactggttggtccatatcagcagaagtcgaacattttggacgtgtgatttcccttagccactaccgtatagaaaacagtttataaaggctccaaataatttgttaatctacaactctcattcaaagtatatttgattataatagtcttcaaatgattttatgttttctacctctaaaaaattttcatttaattttctataaaacgtacctctaagaaaactaattggctacgtatttctgttaaaattgactatagttttaacatagacaattagatattttctagttacagtttacattaaaactctaaagatattttaaaaaacaaaatcctctaaatgaccatatattagtgtgaagtgaaaggagtgatagattgtatatattttggtcgggagtgatagattgtgtctaacgcttttaagttttaacttgccgggtttaggttaattttcatcatcttagtgatttttcttcaattatcaggcatcactgttttccatctttcaaaatagttccacgatttgattgaatggacataaatatcagattgtcactcatatacattctacggtttctagtgactcatctatttactttctttctcgtgatgtagcatcggtacatggatttatgtgtcgttttcttatactattgacatgttcaagaaaaaaagtaatatcttaggttaattatctctagttcgtgatcaagataatttaatcccgggtattacataactcttttgcaggactttctaggatcaggggttgattttccggtgggaaatgtctctttcttcctcttcttctctggccatgtcgccggctcgatgatcgcatcattggacatgagaagaatgcagaggttgagacttgcaatggtctttgacatcctcaatgtattacagtcgatcagactgctcggtacaagaggacattacacaatcgaccttgcggttggagttggcgctgggattctcttcgactcattggccggaaagtacgaagagatgatgagcaagagacatttaggcactggttttagtttgatttcgaaagactctctagtcaattaaatttgttttctatcagaatgtttagttgagttgaatctagcgtaatgaatttttttgtttttctttgaaatggttctacttgactaccgttatttgaacctaactaagtgtgatcaatcttatgttaaggggtattacatagtctatttgaaattcataggatctacactatatattcatatatgttcccattagtatagtgaaaaaaatg

SEQ ID NO: 33025 - DNA, 3003 bp, Unknown
  misc_feature (1)..( 3003): 2750-1469P.txt file - cDNA_ID_3064500; gDNA_ID_1620452; Annot_ID_157526
gcgtctactttgcgtttgatctcagccacagtacatttcttcgtgtcgtatatgagacagcttcgttgcgagaagtctccatcgataatgtactcttctcctgttccgtcgtaaacttctacttccatcgtacaccgtccgattatcgacgatctacggacgctgaatatcggtttctgaccttccgatctctcgccgagaaaaccttcccatctttggtgtagagttggtctctgttcatcagaaaaataaacaacgagttgactcagtatcatctttagaactactatataacaaataaaggacactataaattgtgttagcaactgagtcgatgactcggaattaggcttatacaaaaagttgattaaaattttcagctcaaaacaatttcttcagatctcgtttctaacaatgatttttatcgattctagccaagtcattatttgtttaccaatacaaaaaacttatcaagattttcttgacaaaaaaaagaggttagcaaaagattcttgaattctgatggatgctcaccaatgaaattcattttttaaaccaaacccatctaatcaaattcagcacaagaagttgagcatcaaaatttattataatcacctagctagtcaccctcacgactagactcttactcatcccaacataattttaagaagaaaaaaaggatgaattaagtttacctttcgtttaacggtaaggagacacttcccggtcgcgtccatgaggacaatctcatcgttatctcttgtgtcaggtccataagaatcaaccctgaagatgatatcaccacggcagtcataggcggcgaagccatcgccggtgtagaagagagaagtcttgcagacggtgagtggtttgtcttcttggtaaagataagctttgtcgaccacaattctttctcccatctttttcccttcttttggaatggtctcttcaactaattccatttttatttttattttcttgtgtatgtgtgttttgtgtgtggaagttagattttgtggtttgattaacgaatgatttttaatctatgatatggacactcttctcttccttcctttgtctctctatttatatgtggttgatatatacgtacacacgcttgacgcgtatgtaatgaattaatatctttaagtctgcttcaaaaaagtcgtaacatatattattgttatttcctattggctaataataccaaagtcacatgcataaataattaaataacatgctataacttaaaaatgttagtttaatctgttttattaggctttattctaaactatttttagactgtttacacgccgcttttatatccaagttgcaaaagaagaaacaggtaggaagattgtttgaagtttttatggtattttaacattttaggtggtattattagtttgggatttaaataaagttttaatgacttaaaatattattgagaatatattgttatttaatcaaattttttaaaaagtttggtattattaatttaaattttttataaatttagaattattgaattcatacttttataaagtcattcaaagttttgtgttattcaactaaaacaaaaaaatctttgaatatttatgaattaaatttttgtgttattggtttataactttctacacgttttttacaaaataaaattataaaagtctcattaaaatagagagattgtttgagaaattttacaaaattgctaaaaactaattaataaaattatagaaaacactttagttataatttagaatcttttatttttttaccacctataattttatcaaaatcttcaaatttattgataaattagaaaccaatatatatcacttctttaatgtatttttatgtcgacaaatgttttatgttttatttatccacacggccactttatacttattgtaaatttataactttgtaaaagatgtctaactactaccctatacgtgattacgtgttacaagtttttttttttttttttaaattataataataagtatgaagaaaagaggaaataggaaattttgtacgtcgatttttttttttgtaaaagttgagtaaaagtgaactaaacatcaacgatgtcccaaatcatagccttgactagtagacaaacacgtctaattgggtgacgattagacagaccagtccaattatgtgaaaactaacaaaatcactacctcttgatttacatttacatttaaatgattacattcataccaccttttgagtgtgattgtatgaaatttacattctttggtacaactaaattcagatttctttctataatctcttaaatgtctactataaatttacaaataaaaaataaaatggttctaaatatatttaaaatctcaaaatatatgttggcatgcaaggaaattcaaaccaagataatcaagaaaacaggtatagcgtttcttctacgtcagatatcaaatccgtgatcgagtgaacaatgtcaatatgacaatattctacaaagaagaaattttgtttcattcatatttcttggtaatgtatcgattgatcattttgtttcttcctgtttttgtttctatattgtttaacactacaccaatgcttctgctgctttggatgacgagatagttttttttttactcgacacatcatacaagaccttcgtaagtatctgtaatacacgaatcattaatacataacacgaataatgcattactatagttttgagaatctcattctcatacttctgtctctcttgttgtcgaagaatatcacacttaacatataaaaagaacaacatgtcagtacacaaaggtaaagcccaccaaagagagaaaagaaaacaagacttaactataacaataaatttaatgtcgctctcaaaactcatttttttcatatgaattttctaacacaaacaattttccttggaaatctccgccttgtatctcttatataactcatctctctatactccgaacatgtccctctccgttaaccttaacggccatg

SEQ ID NO: 33026 - DNA, 3003 bp, Unknown
  misc_feature (1)..( 3003): 2750-1469P.txt file - cDNA_ID_3064511; gDNA_ID_1620452; Annot_ID_157522
agtcaggtaagagacaatgaaagtagtttttgttttaaccgacgaattattctaaattcctaattagagtttttttcttattagaaaagagttgtctacaaatccaatacatattgaccaaaaaaaagtcttattctaattaaacttggtctacatattatttttttccttctcccactaggacatgtgagtaacgaagcatcaaaatccatatcgcaatctttttctaaattttaatatatagcttttcattaaataaaaaaaaacttgtataaatataggagagagtcaagaaaagagttccaaccataaaaatttcaacagttgttaagttacaagtctcttcaaaaacacacacacacgtctctcttcacagccaatcatcgatcacagctcgatttttctttattgttccgttggttttcttgagaatttttctttcttggtatcatcaaactcgtcggtaaggaaacttcacgcacgtatcttcaatgttgagctgttctaatggtaccgtcgtgatcgcaaccgccatggtttgctcaagcaccgctctgtttctcgccatggctcgtcaattccatggaaatcatcaaaatcctaaggttcttgatcagactctacgacccattctccgttcttgtctatcttcaggtacgatctttatctctatggctcggatgtttttgataaattttcccgggaaaatttaaaggttttcttgggatgcagaggaaacgaagaaacaggggaagaagataaagaaagtgcggttcgcggataatgtgaaagatacgaaaggtaacggggaagagtaccggaggagggaattgaaccggaaaagcgtaccgaagccagtgactaaaccgggaaagaccggttctatgtgtagaatctctaccatgccagcgaaccggatggctctgtacaatgggattcttagagaccgagatcacagagttcaatattcttattgactttttcttcttgattagtcaatagatttaggttttgtaaatctttcttttgtttttcggtactattagattttttcttggaaatttcagatattgtagactttgtagttgggtggtcttctttttctccctttttgtgtctcatagtagtaggtggttttcttatgctccacttatctacttacttgttttaaatcaagtgatgatgtaaataattgacatgtaagtagtcattagaaatttgaaaaggcaaatgaaagaatataaatttgtaaaaacatagtgtgcctattgtacatataaactctcttttgttggggatatctatggaatttatattgattgtgttgaaatcagtgaccacgtctagaagagaaaaaaaaaagagtctttaaatctttaacaaaacaaactttggagcaagaaccggaaaaattaggttttggtatttccatagaaattttggataatttgaccccccaaaaaaaaaaaaatccttccatacattttatgaaccatatcctagagttttattttatactaatagatagatatagccaacacaaacagcacatgtcatggctctggatcacgagtttaatacgccaatcaaagatttttcaaccaagtttgaagaagcagaggcgccttgttttgttaaaataagatatgtgtaattatgtattgaccagaaaatgatgaagatatgaatcttttgctctttactaaaagctaggagtaaaatttaaaattcaacacaacttacacaattttgatgtttattaaattttaaaggtaaagcccgaggtcattctttattgaagatatgtatttggtgtgttaaaatattctttaaagttatacataaaaaacaccctctcctttctattatttacattgtatattaaaaattcaaagaagaacaatataagaaaatcgacatatgtttttttttttgttttaataagaaaattagaaaatggacataagttccaattgcacattttatcggttatctttataaattacataatttgactgtgtattaaccatgaagccagagatcaatttcaaagcgaaactttctaagatccaaatctaatcacaatcatctccaaaacaagtgccgcttggtggatgggagaaaacaaaagctttccaatatgaacagaacaaataacaaaccaatggtccaaattgcacgtagttaattatttcgattctttgaataagttatttcttgtcctaacatttctttaaaagggttataatttgcttatggctcacgtaatcataagtttttaattattacatatatgaccaccaaaaacaccacctaacttttatcaccataccgctttgaattttcaaactttattgtgattttatttacaagaaacgaatttagaattttagtggatatgtttgtttcaatgccaatggatatcgccatattggtataagattctccattacaaaaaaaaaaatacactagtataatagcatgtaacatttatacaacataacaaagtagaatctacaagatcaacataatttttatcacccttgggtttaacctccgattagttttttctttataagaaacaaattaacctataagaacgaatatacattattgtcttcaattatggcaaaacgaggaaggatctaaaaaaccgaacacagtcgaaaggagccaaagcagtcaaaagtggataaggtaagtgtagggtccaaagccttataactccacacgaccactacactctctacacatggctcgtcgtcgttttggggctatacgtggggtcgggcacttcttctttcaagtttcttcgaaatgaagtatccgaaacttccagatacacgcaaaacccagaaaagagaaaaaagaaatcgtctttccttttacttctcttcttccgattgggtctttgatcatttccccaatcgattgataagttttgttgggttgctttcgattcttcgtttgatgatctaagaaagtctctgtctttccacgatg

SEQ ID NO: 33027 - DNA, 3000 bp, Unknown; identical to SEQ ID NO: 1821
  misc_feature (1)..( 3000): 2750-1469P.txt file - cDNA_ID_3064514; gDNA_ID_1620452; Annot_ID_157515

SEQ ID NO: 33028 - DNA, 3000 bp, Unknown; identical to SEQ ID NO: 1823
  misc_feature (1)..( 3000): 2750-1469P.txt file - cDNA_ID_3064537; gDNA_ID_1620452; Annot_ID_157506

SEQ ID NO: 33029 - DNA, 3000 bp, Unknown
  misc_feature (1)..( 3000): 2750-1469P.txt file - cDNA_ID_3064544; gDNA_ID_1620452; Annot_ID_157501
aaaaccaatatatgattcaaccccaagctagtgcttgattgaaggaaatatactaattacattattcacaaaaaaaaataaaaatccagaaatatgaccagtgtaatatcaagatgatttagctccaaaacgacataacaaagtgattgctgcatgatatagtaatcctgctaaagcaatattatgaaccatagcaaagaatgcaagttgatcgatataagtcagtaaaccagctggactcatattagttttgaagaagcaataagtttcaagatacatacttattctagttaattgagatcattgaaacagctacatttatcataaagccattcataatactcgagctaagttaagtgtccttggtttgtttcacgtatgcccgtgtgttagtgatgaacataagaactatatcatgcctagaaacactgatgactttgcagtaaaaaacaaggttaagatattcaaagaggagtcacgacatatctctggtaaaagaaacttatctaaccttagttccaaaaggaccttcagggaagtcaatatcatccagcctccttccctatcacaagaaaacaatgaaaaagtcaaaatcaaattttcctcaactgaagtgtattatcaagcagaaatatacactccattggcattgctataccagaaaattatcgagaagtgaagtcatgatcacaaacacaattgtaatcatactcagatcttaaaattgcaatacataaagtaaacataagcaatcacctcaagttcagcttcaagctcttccttctcgtgtccagtcgcaatgggcattacatcctccaccttcttcgtcgcaggagtctctactgcaaaatacaatccgtaataaacaatcattcaccttccaattgagaagatgaaaacaaaattgcagcaacaccaatctaagagaccaacacagatttaagtctatcctctaatatgcgatgaagaaaacatagtgaatcgaatctaattccagcgcaggtaagagtcctgagccgagatctgaaaatgcgtaaactatagcaacgatgaatcacctgaatcggagctgaaacgacgagggataacgaaagaagatgcggaaatggctgatcgattggcggcgagatagaaaccgacaggtctggtggtggcggctatcgatcgacgaggagaagcagcgacgacatcggcggctagggttttgagctgagaggagacgattcttctccacatggtgatgatgatgagtcaaaggaatttcgagtgagattgttttgtgttgtgattctcaggtcacaccttgaaggattagcgaagaaactccccaaatgttttattcttcctcagtgatgattcttctttgggaagagattagagagattcttaatttagaattggtcacttttttacttggaatctcgatattaaccggtacgtgtgaaactacatagtacacacgtgtcaggggaccctatattgtgtgacatttcaagtggaattagtgatacaagtggaaataatgatacaatgatgcatatactacaaaatgaaattatgatgaaatggacatgtaaggattattttttcctcagtccagttatgcacacaggcacaagcaagttgctttagttagcaaccaaattcatgttcctcgaacctcgttgagaattccacaattcaaaacttcaaatgtaatacctgatggttttggttttctttctacttctgtctgtagctagaggtaatgttagcataaaaaaaatcgtggtatagtagtttgtgtgtagaatgtatatatatgtccattgaacaaaacatatgaacgataaagacgtacacaattaatagtttctttcattattatcttatactcatatcctcaataaaattctagatgaattatttttctcatagataaaaaaaatctactcgatgtctccaaatatgaagttttccgttagtacgacactagcgtgaaaagtttgcatcctcatctttttggttcaacatttgggttttttcttatgcgggcttgcttcaccaattgggtcttttgggctttataacgttttatcttctcttgcaactaaaacagaaatccctagtgttgctaatgtgatacgaatctgccaaataggaaaaagcccaaaaattgaattcaaaataacgaaggaaatcagtcaatcacttagctctaattattttagttattacttattagatacaataaaatatataatcaatgttttgttagttagtttttctctgcacattatttatggctgatgaaacatgcaataatagtataataccatgagtcttaaaagacttatatgcgttcagcattcgtaaatctaacaaaaactcctattccatgcaaatgatcacatcatatacatgcatttacctttacattttgccgtttgataaaagaagactgacattttgttacgagttcgaaatacgttgaaagagatatagtcaaatatcaccgacgattattcctgatttaagaatattccataatagttgaactctattttccaatgagtacacgtcattttggatattgtcaaagcgacaagtcacacaagcaatgtaaaatccaaacaaaaatatcctaatcaacaaataattaaagcgaaaagtgaagacgaagacatttgacaattggcaacgctgctccacgccttcaatcttatccatctcctaaatttttttataatccagtgctctcatctccaccgtacttatcgtagtgcacaacgcatttaccgttgcacactctttccgaaaatacccttacgttgataaaaaccagtgaaacgaacattccacactataaaaaaccacaccgcatagcagctgattccacctaaatatctacatatccattttcttttcttaatccaaaaatttacaaatccttaatctttctcttcttcctaaaaacagctttgagctttctctcagataaccacattttacctaacaatg

SEQ ID NO: 33030 - DNA, 3000 bp, Unknown; identical to SEQ ID NO: 1812
  misc_feature (1)..( 3000): 2750-1469P.txt file - cDNA_ID_3064547; gDNA_ID_1620452; Annot_ID_157499

SEQ ID NO: 33031 - DNA, 3003 bp, Unknown
  misc_feature (1)..( 3003): 2750-1469P.txt file - cDNA_ID_3064581; gDNA_ID_1620453; Annot_ID_157570
ctaatttggacagaatgttatgtaagcgaatgttgaatatatatagtgatgatgaactcatttgtaattatttattgttctactggttatgaccattacagcaagtttctattcatataaaaattaggtggttattttcttatctaataaatctttagatgtttacatatatcttttgattgttctggaaaaatgaaattttctagagaaacatcacggttgggaaaagatggcacatgatacatctactttaggttagactcctaacgttttgagaacaattgtttggagcggtgcacatttctattgtgtactaaaaaccattcggttagacttgtattcagaattcggtattgttaatatagggagtgagcaatttggtttatgattcgggttggttatttttacggtttgacagaaatataaatcatctaaaaccattcgtaattcggtttagtaagaaatttatgtaaatactgattatgattttcaatatataaaagattaaatataagattcaatgaatttttattttgttcgattcagtttagtttgattacaccaaaattggtttcagttcagttttggttacagaatatttcgaattttaagataacgaaacaaacgttttataagaaacgtccacgatgcatttgatgaaaccaatgttgcgttgatccagttatgtttctagtgttaatggtttattctcaactctaagctgcatagatacatagctatatctcacactgtctgtcacacgtatgacgtatctatggtcaaacttaattatatcaaaagagtatttttggtataagaaaatactatgaaaagagtaatttgattacttaataaaaacgtgtatggattcataagaagttggccaactgacgtcataagaagtcaaaatgtagttaggtttatattgtttgattaactcgttatttatttacaacttgctgtaagaaacctagattctttaaaataaagataaaacctaacgatagagtgattagactaattcccaaaaggaaaaaacaaagtagctaggtagtcccttgattggaatcttgccttgtgacttgtgagactaccactagcaacaaaaacagacctgatcaattgtagtcgagcctaattaaaaaaggttcaactgagctctaaaatatgcaagtgggggtgaacgagaaattttcataaattgaatctttcctaaacggcttactcgactcaatggtcagcaacaaataaagaaacgtgacacaacacaaagaggaaatagggttaggggagaaatcatggcaacgcctctagtcgaactgaccatacacaaccattgtttttattccaaattttcaaaattgcactattctcacggttcttattgcgagatcgactatctggttgggtaagacatgacatttacgtatctactaagtattacaatatgcctcttaccatattaaagaagaatccaataaagagtggcatgcattaagaatgtaaacgaagaggaaaacattcattacaagggagattttcgagaatgaaatgtgggctcgcttcagactcacaaattgtgaagattatacaaacttgaagtataaaggagtagtaccaacaagagtttcaaaggattaccaaataagggagtacaaaaataaggaaataccaactagagtttcaagtcctctagaataaatttggggatggaagcaaaatgcattggtcgtcacaactgtagtatggacccatgggctactgcacctctctccaccctatttgggccaggcctagttcttatcccttccaaatattttgatatcttaatcactaatatctatatgaaactttctttgtataaacatttcttggaacgagaagaatccattttaaccggttcctagtttaccaattttacattactagaactgaattttcattattcataaccaacaatgcaatttgtctacacatatcaatttgtcaattttactaatatcagtttatagtaataattatagacaaatcaacaaaacatatttacacaccttaagagtttttataactcattcagacaaaaacaattaattaaaatacccttaaaaatagttaaaaatattttcactttttaaaaaatcaatgggaggggatcaaagattttcacaatttacaagatttgtgtaaactaatactcttcatttttatttgatttttgtaggaaaaaaaatgttttttaaacattaattttttaggttttatatgcagtattattgatgtattttaaacttcaataaaaataattgaatattctttatgatcagatttaatatatattttaaatattttttttttagaaaattaattaaaaataacaaaaggagtaaataaataaaacggaataaagttgggcgtttttttattacaaaacatgggaaaatggacaagttcttcaattcttgctttttgggcttcttgcctgtctctgtctcgaaacacccagaaagagagataatctcgcttatctgtctttatacttagctggtttcttcttcttctttatcccttttggctcttattacaacttttttttttccatgtatttcctcaaattttaatattttttctttactgtatattcatcaaatctcaagttctctaatttcccattcgacctcgaaatttgaccaatttctcttgtctcaaatttcagattctcttcctctgaaaaaaatcaaaaaccaagtcttctaattccatctcctctctgtacccatctcctaaaaatctcaactttgagtcaaaattttgtcttctctcaaaccaattcatagttctaaaaatctcacctttatctcaaatttttaatctttcatctgatttctgaaacccaaattctctaatctcatctttgagccaaaaagtttcaatctttcctctgatttctgaaaccaaaaatctctaatttcaaaaaaaaaaaatctcacctttgggtcaaaaatg

SEQ ID NO: 33032 - DNA, 3000 bp, Unknown
  misc_feature (1)..( 3000): 2750-1469P.txt file - cDNA_ID_3064590; gDNA_ID_1620453; Annot_ID_157568
ttggaattcaattcaagaacgaagaagctattaatagatctcaacaaacgcctccccggagctaaattctctttcgcagacacttatcccgccgttctcgatctcatcaacaatcccactcactacggtaaaaagagagaactaatcaatattcagactttgcataattgcatttgcgttacgggtctttatatcgtaacataccataacgtgtcgaaaacatatacaatttagtttacgttttgactattttacaaacaaaaaaacgcaggatttaagatagcaaacacgtcatgttgcaatgtggacacaagtgttggaggtctttgtcttcccaattccaagatgtgtaaaaaccgtcaagactttgtcttctgggacgcatttcatccgtccgattcggctaatcaaatcctagccgatcatcttttctcttctcttctttcttcctcttctccttctcctgctcctaaaccacgtcaatagtttagcatttacaaaaataaaaacagttaaccaatttttgttaaattggacctacttgctatatacatgtgtaactaattttatgttcttgatgtaaccatcaggacaaatatgtgtgttttgttacacaagtattatatattataagataattatggtttgtatgtatcatgaacacattgttatatatacacatatattcgtgtttagtgtttctagacatgtgttataaataaacatctacaccaattttggtcttcagattgcttttgcagcataacttcttgttttttctccaaaatgctctataatcttcaaatacattttaaacgtgtaaaaacctgaaaaaaattctaaaaataacaaaaagcctcttaaaattataccaaaatcatagccaaactcgataaaattcaaggtatatcaatgaactaataacgcatcattcatcccatcacgtaagttattagactcaaagaaatctaatacaaaccgaattaccgaaggcccaacagtaccccaacattcatggtaaaagatgggctaataactgtctggacctgtaatttgaatttaaccattttccttatcgaccctaacttttccacttcatgtccagaaaaaggtttagtaagcgtcaataactcatcccatggtaaacctgcaaaatcctcttgcagcaaagcttccaccttttcatcaacatcttccatagaatagagactattatagtagttcgccgcaaaattcacctttcatattcggaacctataaattctcatcatttttcaacatttcaatctgatttctccttcttcttgtaattgttgaagaaaaactctactcgaccaagaactcactagtaccaaaacacttgtattcacttattattccttgtattcactatatcaagatcaatttaatcatttagttaaattcaatattactctcaaagctttattgaaaatctagcgcccttttttttataaaacctaaatatacaaatctgttgtgtgaattttatcacatgcaaatatccaacttataatatatgtagaacaccatatgaaatttttttgttgcaagaatactacatgattcaatatttttttggattccgattttcccgttttgctgtagtaagggcccgtcaacaatggcactataattgctgaaaaagactttacaaatgtgatgaaaatatgtttggtttcatggagtgatgcagagaagctatacgattgtttctcgacggccgttacaaaaaataggagaaatcgaaaactaaaaatatatcatgaattacattgaaatcgataaacaagtatgtgtattttttctagcaacacaaaaaaatgtagtatatattaaattaattgagtatttttaagagatttttttttgtttgggtcttgtgatagcaaatcaaattgttttatttttttctgaaaaacagaacaaatcaaattgtatgtgttaattcttgtttgaaaaaaaaaacaaaaaaaaaacaaaacaaatgatggataagaaaagggtgatttagctgaataaccatatttgataaacaaattaagaatatagcaccatatatatagaaattaagaaaatagcatgcaaggagaaggaaaagacaattttagtgttgaattggaagtgagatgatttagtaacacttagtttagttttcacctatttatttttttttgctataaatcttttccaaaaaatagatttcaattataaaatttattagaaaaaaacataggtttttttctacatacaaaatagtttgaatttttaaaatcgaatttgaatttataaaatagtaagtagtgtttgtaagtaaagacttgtactattttggatagaaataaaatgttgtattatactattttggatgtatagaaaactataccctaagatacaactttggcaacccaagcaatcagataacataagtggtatctgaaaaatctagtttgttcttttcgtttgtttgttgtgttatacagaaaaaaaaaagagaagagattgagagaaaaaaaaaaaaaaagatgaaaaagagaggagagaaggaggaacttagaataaggtagagagaaagaggtaaatatgccattattatatataatatagagaatatagctgttttttttttcttgtattacttttttaatttataaatttttgttagttattctttgcaaatttcccataaaagaaataaaaggaacacacaaaaaaaaaaagaatggtgacatctaaaattctaaaagcaacaatagcgtgacaccaagagtgaaggaagagacaccgttttcacaaactgacaaattctattaccttaagtaaggtccagattcttccctgttcctcttcctctctgtttctctcattacccatctagcaaaattcaagaatcgaactagggctacgaaatatttcgattttgaatctccaaatccagaactcgagtgttaaatcttcgaaaagatcaaatctttggagatg

SEQ ID NO: 33033 - DNA, 3000 bp, Unknown; identical to SEQ ID NO: 1830
  misc_feature (1)..( 3000): 2750-1469P.txt file - cDNA_ID_3064613; gDNA_ID_1620453; Annot_ID_157556

SEQ ID NO: 33034 - DNA, 3000 bp, Unknown
  misc_feature (1)..( 3000): 2750-1469P.txt file - cDNA_ID_3064632; gDNA_ID_1620454; Annot_ID_157599
tggataagaacatattatattttcaacatactgtacctaggaacagacagctcagaaatttatgagaaagaggacgaaaaatccagcatttgcttagaggtaggtgtttaagtttatgtagtattgtttttaactaaatggtaaaagacacagaaaagatttaacacaaaatgcaccaccaagtttagatatgttccgactatgtgttacatagagcagaattgactgacctgataataataggcagggtaaaactcaaactcagtcaaagatatttccgcagttccttggtttgaggatgttaagctctgaccagttgctgagcttgtctccagcaactcagcaaagacaagaaactgcctactcatccagtcccaatggagaaaaataaattctgtggatccgacaaccttttcatatgatgttttatgttgatgaaaccatgtcactgcttctatgagttttccaccatgcaacaaaagcgttgatatcttgaaatgcaattgctcagctatgattttgatctcgaccaagcgttgtattgcaggcaacctagtcgatgtcccgatcatctgtttgcataaacaaaattgctcgtcgaaattgaatgtgtggaaaccgcaggcaaagatatgtaataataagaaagcaatgaccatatatgcatcaaaaggaacttcttgactagaagcagaatacatattagcgtgacagatgggttgggaaaaaacaaaatacttagagataataaagacctcgtgcaaggaatggtatgcgtcttcataaaacttcagtgcttcaccccaatctctacgaaactctgcatatacagcgacctagcagtcatggcatgaatgagccttccttttcccagatactttggaacaaaatgattagacttagcagaggtaacgagaaaagcttactttaaaacagtagcgaacattcaaatcaagagaattggaactccttttctcaattcggcttttgattctccgtccttcttctctgtaataagaaagtgccaactctgcaaaagcagaagcgagtctgcaaacataccgtgttgagatgcattgaaggaaaagcctcttgttctaggtgcaaagtaaaagaggagagaaacatacctggagagagagagcgtgagttcagagactatgctggaattgaagaagagcacgtacttagaatctaattctgcccgctttcgcaatgccaccagacgatcgtcgctaatgtcctctaaaaacaagtcgggaaggagtaagtcaccagtagttccgagaggaaaatgaaaagaataatcggataaaatgcgctaccgtggggagaagactggaccacgacaaccaccagtttgatgtttttgggacggattacggatctagcaagcaattgagatcgcagtgttaatttgagggtttgaaacaaaggaggggaaacaaggaaacaaatataaagggagatgaggaaatacttgaggctgtcgagatcggagcagacctgtagccattgagttggatcgccgaagatgtgatgtgagggaaagaaggcggcgacaagtgcagggaccttggtgcgatgcttaagcaaccagtcccgtttcaaaataccgccgcatctggaaggaatgggagaagcagaatcggagacgctgagaggatctctgaaggaggaggttcggctgatctgatcatcatgagcaaggaggagagagatttgagagaagtcggggaaggccagagcgttgatgggaggctgctgggagtggagatacttagtaatggacgcgtgtagctccgcgtatccgaagagagccaccagacttaccggtggcgtcctgagctcttccgggtattcctccatctcgccggggagtgtctgagactcggacgcgttgaatcgagcaaggaaggatctgacacattcattttacgtgggcttttaacgggcctttggataagggaatggacttgtatagctgtcagattgttcatctggcccagaatatgatgtgaaatacttaatgggttttcaacgggcctttaatctttaagggtatgaaccactgcagttgtcagatctgatttaaactaatgtggtttctaaggatgtagtatcatcaggcccattataagcccacttcttaaagatgcatcgactcgtcaaaaaaataaaataatacaaagaattcgaattggttgcatatacagaaacattggattttacaaaatggaagaaagaattattggaagagaatgagaagctgtcaagcggaggagcggttgatgaagtcaatgcagtctgcaattgcatcggcgtagaaagagttagagcgacgtatagatgtgtaatcaagaccgtcttctctgaccagcggaggccttctgcagcaccagctcctgagaagcctgaaaaagcttctcactctcgcacgcagtctctttgtcttctgcctcagcctaattcctcttccactcggccatcgtatccttgctctttccatctttcaactctgttgcatatgcgtcagattgttgagttttcatgtatatgcaaattatctatatatcgagaggcgagggctttcatgtctgacttttagaagtggttgttgagaatttttgaagacttttttaatgattgatctggtgcccacgtgtcattttatgctagagggaggtgttggttagttggaaaactagcttcctaacaaaaaaaacacatgtctaacgtactcgataaaaacatataatcttctcattcatcaagcatgttgcaagagggctttgaaattgagtttgaaaagcaaagttccatttgctctattaacaaaataaagcccattattaaaaccaacagattactataaggcccaatatcaacttcctaaactaagcgggtgaagattttgttagccattagtggtaatttctgatcccattgctgctcctctctccggagatacaaaggcgaatctgaccagtaagaaagatg

SEQ ID NO: 33035 - DNA, 3000 bp, Unknown; identical to SEQ ID NO: 1832
  misc_feature (1)..( 3000): 2750-1469P.txt file - cDNA_ID_3064643; gDNA_ID_1620454; Annot_ID_157584

SEQ ID NO: 33036 - DNA, 3000 bp, Unknown; identical to SEQ ID NO: 1839
  misc_feature (1)..( 3000): 2750-1469P.txt file - cDNA_ID_3064666; gDNA_ID_1620455; Annot_ID_157628

SEQ ID NO: 33037 - DNA, 3003 bp, Unknown
  misc_feature (1)..( 3003): 2750-1469P.txt file - cDNA_ID_3064683; gDNA_ID_1620455; Annot_ID_157616
catgaagaccattcattcttacaaccgattatccgaaaaagttagagaagcaaatagagaatttagaagttgaaagaccttattgttttttttcttctttgaccgtgacttcttctcctcctcgagtaaaagataagctgctgctatatctgacttggcgttggattccatattcacaatttcattctagataataagatacatactaacatataagaaacaattcaaaggccaaatcagatggtaaacaaaagctctctatatataaccgaagtttcagaccaaccagtaagaaaggtttcagcagtcgaaggatataagtgcggttgtcaaaagcagaaagcctggtgaggttggttagcaaagtaatccttgaattatcaatcagcaaaatcttagaatcgattagtagaacctgcgagtcatatagatatttttagatgggctattctatgttattatgttgtaatgaatattaacatcaaacaaaccttgtgggtgaccactgatttcaggtggtgtatggacttcaacgctatatcatcgccgagacttttacgctgacgtataagattcatgcaatcttctgaatcgaggaaatcaaatgtcggatgcgatgctccttggagaacatctcgtactgcccacaagaaaaaatttgcagtgatggaattttcggagactctctcttcacagctatcgcatagaagagatgcatatttattccactgatcttccagaagattctttctcctttcatcttcactcatacacaagttctcaacgacagtaagagctgcatcataatctaagaccagatatttctttgcatatttttttcccaaaaacgaaaatgtgaactgaacagctttcagaacagccacccagataccaaaattgtgttccctgataggtctgggaaagatcgtatctactgaattgtagtcagttaaccaggatatgatatcatctccctgagctggtgccttggcgtagtgagcattgggatcaaaaacattgattgtcccttcatcatcgaatggaacatctttgcattttagcagtcttttatccagaagcagaaatgaaaactgagggtcaaagtcgatcttttctttgactcgagtatgatccaagaaactgttcactgctctgcaaaccagatctgtaccatcattccttttacacttgatggtttttagaaagtctaggatttgattgagttcatgactttcaagaaaacagatactctgaggtgttcccactaggtgagaatcaataagactctgttcggaaacatcaagttttgcaagatgttgaaccggaaaacgcatcagccactctcgaatgctagaaggaagaattttatggtcacaaagtgacacaaggagcaatttgatttccttgagtaacttactgcgatcttcatctgcagctaaaggccactcttcggaccatccattcttaggtgcaaacgctttcacatctgcgagccgattcttgatcatttcaacggcagctactgtatccactggttcccaagctccaaccgatatcttacgagcccagtcctttcctatcctctggaccatatcctttttcgaagcatttttaaaatctgcatcatgttgttgttcaaaatgattcttacattcttcagcactagaaagcttcttcaaacatttacttctacacatccaaaacgtccattttctatctgccttagcagaagtgagaactttctcaaaaacatctcgtccctctctgttatgtactccctcgacaaaacttttaagctttgcaatgcttactttcataaagtctcttttgatcttaatatccaatcccatccaataagacctcaattcttgaatctcgtcgtcaacaaggtctgaacttttctttggctcccaaactttagactcagagcttaaaggggaagtcttggctccagcgatcatgcgctctgcatctctgattaaagtattgaattctttgttcatatctttttttagctcttgcaacattgatcgagcaacaggactcgtgttttctgggtaagtaactgataaatcttgttttgatttcttcacgcattgcttgtaatacgatactgacccaagctgtttggccaaattgtagaatcccattgcacaaagtcgtgataatatcacatcttgagaatagcattgtacagaagccaccaagtatgcgaaacccacgtctggattctctgttatgtcctctagtttcacgaacattgtaccttgtttgatatgaagaaaccatgagtccttgtctttcttgtggtcaaaaatcaaatcttcaagtatctccaaggccttgcagtgatttcctttaacgaattcttctctagatttcgtgatgagttttatgacctcaacatcttccaggaaagatggcttcatcatagtaacgactctcaagattcttgcgttttcttgctctccaaggtttcctttgcttcggagagaaatttgtcagaatgtagaaaacaacagcaacagtgagctggcttttctcacgtgagagccacgtgaaaagggttgatacaaaaaaaaaaccaattatgagcactgaggaattctgtcgaaccccttgtaagcaatatccgtttgggattttcacggagtagcaaaccaaaacaaatcccaaaaattgtgtgaatcttcgattttgggttaagacccaaatgtagaacgatcttcatgttggtgttacacaaaattcgtggaaatgtttggacttgaaaatcaacaatctcaatcttcttcgtcggatctctaataagtgttttgagttttactgttaaagaagacacattagctattctactgttattaagttctcgtttcaaacgccatgccgtttgttatatttaaaaacggcagcgcatcgctctatcccctactaaaccctgagcatttttaagttaaactcagaggtcctctgtcacaagccgcaagaagaagcagagcaatg

SEQ ID NO: 33038 - DNA, 843 bp, Unknown; identical to SEQ ID NO: 1836
  misc_feature (1)..( 843): 2750-1469P.txt file - cDNA_ID_3064703; gDNA_ID_1620455; Annot_ID_157606

SEQ ID NO: 33039 - DNA, 3000 bp, Unknown; identical to SEQ ID NO: 1846
  misc_feature (1)..( 3000): 2750-1469P.txt file - cDNA_ID_3064722; gDNA_ID_1620456; Annot_ID_157647

SEQ ID NO: 33040 - DNA, 3000 bp, Unknown; identical to SEQ ID NO: 1847
  misc_feature (1)..( 3000): 2750-1469P.txt file - cDNA_ID_3064726; gDNA_ID_1620456; Annot_ID_157646

SEQ ID NO: 33041 - DNA, 3000 bp, Unknown; identical to SEQ ID NO: 1845
  misc_feature (1)..( 3000): 2750-1469P.txt file - cDNA_ID_3064730; gDNA_ID_1620456; Annot_ID_157645

SEQ ID NO: 33042 - DNA, 3003 bp, Unknown
  misc_feature (1)..( 3003): 2750-1469P.txt file - cDNA_ID_3064745; gDNA_ID_1620457; Annot_ID_157661
atcaatatctactccacctctttcagaagcagcctgcgtgctgacaggaccagtattcttctcttgcttcattttccagccatcaactctctccttccaagctacattcccgagtccaacaggatccacaatccttctatttgctgcagcgtgaatgacaacaacagattttattgtttagagttttgacataaaagagaagcctaggtacaaatatatgtgttggcgagagagttagaaataaaggatatttacgtgattgattgacatctgatgaatagggaaggcgctttcccccagcgatagtagaagatacagagaggcgttcaggtgaggcagcagaaaactctcctgaagtctgtaaataagcaaatgacaaaatcagattccaaaactaaattgcgtgaggatgcgaatgcttaagagggaagaatgaacagcaatgccttacatcttgtctgctcgtgagacgaggaagatgattgtgagagacctctttatcatactggggttcccccatttcctctcccttcccacgagtaagatgccaaccaagcatccgctctgaaattttctccttctgagggtagttgaactcaacagtaccttcatcagctaagccatcctcgtctttatcaccaggaatagcaggactacctagaatcagaaattagcaaattgctataaataccaatctgatccaaaattcaaaacatactgataaactatcgatgaacaatgaagacagtatacttcagaaggatcaaaagagaacctttgagcctcttgtatctggttttgcactgaggacaagattgattcccatctttcctctcatactcgtagcaaggccgacaaactgggaatgaacaaatatcacaagccacaaaacgatctccatcaacagtcttgccaacattgtcactacagatctggcaagtctgcggaacaatgttcttcatcggctttccctacaaatcaagtcgaatcaatgaagccaaaattagaaacctcaacagaaaatttgaaatcagatctctccaatacacaattcaacacccaaatcaatcaatttcagtacatataattcctgatttcgataaaggtaagtataatgatgaagcaagagtcaaaaaagcataccgcggtttctccttcggattccatttgtcacttagttgcttccaacaccgaaacgtcggaatagttcaaatctgatcggaattatcaaaaacagaaactacgattagatctgaggagatccgagtaaaggaagtcaaatctgagaatggatcatgagtgtaagaagagttaaaagctttaccatgagatctgaagatggagtgtggtgatgtgactctctgaatctctctcaatctggatccaagctttcttctctacagagagatagtttataaggaagacgaagaggagaatcttgggatggctaagaagatgcaaagagcaagctatttgtctcctctactcgtcactcttccagatttttaaaatattaatatatttgtcacaaatcataatccaaccaagcaacaaccaccaccaccaccgacaacttccacagtcgatttttttctagttacagttttacagtggctgtaaaaaaagtgaaaaaacggccgataaacctttaaaatatccttagaaatatattatcatcgaattagtgactaaatcaaaatagtaattgatatttgatagtgatataactaaaatagaagtgtgaagaacacaacaaatcacaagtagtggggtaaaggatattcatcgtcactaactttcttacagataaaacttaaaaagtatttgccgacaaaaataaaacttcaaaatattaattaatcaacggattagtccaatgaataaatcaaaatatattgatagtgatgctttacttactagtatatcaaaataggctaaaaccagcgggctgaaaaaataaaggtccaactctagtatcatcaagcccaacagaatcgagaaaatgggtttgttggactttgcagacaaaattggtatatgttcggtttacgttatttacgagagaaaattgaatcgaaccgaacccaataattaataggtcaaactttgataactggtggtgcatgtggagatgtgtggccactagtgcagcaaagaacagactgtcagatagacaaaagaagaaaatggcaaacatttgaatcccaaagagcgccactttctcttcgctatccgacaaatcttccctcctctttgtcgtccctttaaacctttccaccttctgcttcgtaactctcgtaccctagcaatcctctacttaaaccttcctttgtttctccttcacttttcctgtaaatctgctcttttgttccctcgatcatatcaattttcaaggtcagtgaaatctcatgtttatttggtcctatgtgaatcagatttcagggtttgatatttgtttgttccgttgatgtgttttgtagatcttatgatctgagttacttgctctgtttttctgagatttatggagggtctttgtctatgtttcttcaccgttgcaaatgagttataatttctgtttacatgtagtgaaaaaagttcagttctgtgacataagaaagtcttaaaatttacgcaaccctagtttttttattttctaagatttcaattaaagaacattagcttgtctcttcatgatagttttccactgattattatcacaacttttttttttgttagatatttttaatcgaaattattgtagagataaatataaatacgttttttttttttttggtcaaaaaatataaatacgtttagttatagctaaatcttaggagtataaaaaaaaaaaaagtaaataaaaatcttaccagtttttatatctcgtatatcttctgtatttttagggtttttctgttacatcattctatgtttacgtttctttgatttttttttgcttgatcatttttaagttgattcgctttttgttgtttaagtgtaatg

SEQ ID NO: 33043 - DNA, 3003 bp, Unknown
  misc_feature (1)..( 3003): 2750-1469P.txt file - cDNA_ID_3064755; gDNA_ID_1620458; Annot_ID_157685
gttcggacatccttaacgagtttgtacggatgaaacacgtagttcctgatctgctgtccccattcagctttcactgcatctcctcttatttccttgatttcagtagcacgttgctcctccgcaatcaccatcagtttcgcttttagtctgatcagagctctcgtcttgttcgccagttgacttctctcctctgcaacatccaacgcgatcttaatcaactaccatagtcagttctgatgcattgataacacgatcttacgggacattcaggttgtaacattagtggggaggaaatacaaacctgtgcaacgaacagcaacaccagtagggatatgagtaatccgtacagcagtttcaaccttgttaacattctgtcctcctttcccacctgccctcgtgaaactaatgtcaaggtcctcttctggtatttcgattcccaccgcttcctcaggcaaaagcggcatcacttccacaccagaaaagcttgtctgcatgcaataccaatataaatccatagcacacaaccacatatgctttttgagctcatagaccttatttttacctggcgaagacctttcgaattgaaaggcgattgtcggacaatcctatgagttcctttctcccctgaaatgtaaccatatgcataacgcccttcaatttcaagagtcgctgacttaatccctgcctcttctccattagacatttcaacaactttcgtcttgtaccgctgcttctctccccatctcatatacatcctaagcaacatatcagcccaatcctgcactgaaagttatcattgttttaaaagaacctcaattcacatcacaaacacacacaaacctctaagagagtataataataacctgtgcatctgttcctccagctccagctgtaatgtaaacaacagcaccttctttgtcataaggtcctgataaaagctgagtaagctcaaatttatctaaagatttattcaactctttaatgattcccatggcttcttcaagtaaactaacatcagtagagtccatctcttctgttagtttaacaatcgtttcggcatcttcaacctatacctcaagcaacaacacattatctcaaagcctcaacatcataaacatataaaccttagatatgtaacaataccatcgttttgaactcagagagtaaccgcatacgatctttaagatcatttaaagacgataaagtttcttgagctttagtacgatcatcccaaaacgatgtatcagtagcttttgattccagatttgtaatctcttgttctagttgttgtaaattagcagaagctctaatctcttcaacacgagctgatgctatttctacatcttttctcaatgtataaaaatctaatcaccaatgaaacaaaagaaatcaaaaccctaagaattcagattcactgggaaatatgttgatagatcaatggtgataagaaggtaccttgcatcagccactcactggtttcgttttcgttggatacactcaagttactctcctgtgcagcgaatactactgaaacgaaattcggaagaaattggtttacacaaatttgaaatctaaaattgaagttggagcgagagggagagaagaacttactgggcgaattaaaacgagaggacgaagagaaattgggaagagaaagcgggagtgagagacggagaagagggaggtttgttggtcgaagaagcagaagtttaggttttccggcgattgcgaaactccgaccggcgaggggtccgagaacggtgagctccatggacatgtttctgctcaaagcttttcttcagatttctgacctttgccaagttatccatacaaagctagcagccacgtcatcagttttaagtataaaagttaaattgtggaatatatttaaaaattgggtttttaatggattaaagaaaagagattgacgaagatagtaatgaaaaaaataatttttcaaaaagtagtatatcttttaaaaaattccacaaatagtactacaagtttttattaaatactaaatataaataattaatttaattaaataaacaaaaaaaatatttttcgtcaaaacttttttaaaaaagtttccaccaaaacatttcccatcaaaaatattcttttttttttttggtcaaaacccaccaaaaatattcataaatattttttcaccaaaaaatatacatcaaatttttacaaaattcgagaatgatttgacagaattcaggaagaatttcggaaaaaaaattacgtgaaacccttcctgaatttagtgaaatccttcctaaatttcagaaaatgattatttgaatgattcgccaaaattcataaaaaaaaatctacaaatttcagggaagggtttcatgaaattcaggaaggattacagacaaaaaaaaattctaaatttcgtgaaaccttcctgaattgcttaaaatcattcctaaattttgtaaaacctttcttgaatttcttttttttggtggaaaaattttgacgaaattgtttttggcggaaaaatattgtcggaattttttttgaattttttctttaaggatttttttattaaaattagattaaaatttaatatgtttttttacacaagatttgggttactctagttttacagtttgattgagagttatttgagttattcttgttaggttttgagtcaatctgatataatttagataaaataattaagcaaatctcttgaaaccatacgagtccaaaacaaatcaaattattggattggttagttggtctttttttgtgtggacttttttgttttttgctgctttaaaaattgatccagatcattgaagatactctggttgcgttttgaatcaaatacaattatagagcaaaagattaatagtatataattatttttctatgatcgcaaaatgcgatgacgattatttagtaattttgtagtccgtttctaatagttatatagagttgagccttaaagacattgctaatcagaatctgaaatacgaaatg

SEQ ID NO: 33044 - DNA, 3000 bp, Unknown; identical to SEQ ID NO: 1855
  misc_feature (1)..( 3000): 2750-1469P.txt file - cDNA_ID_3064774; gDNA_ID_1620458; Annot_ID_157675

SEQ ID NO: 33045 - DNA, 3003 bp, Unknown
  misc_feature (1)..( 3003): 2750-1469P.txt file - cDNA_ID_3064810; gDNA_ID_1620459; Annot_ID_157715
ataaataactaaaagacggtgatctagtggcaatacaaggggttaattctatatgtctggatttaacttttcttggatataattttaaaaaaatagaaatagagtaaataataactctggatactaaaagagattatagaccaaaaattcagaattttctcagtttaaccaaacataaataaaaaataatgagataaggaaattaatcatgtcttacttacaacgttatattaattgtattgtagactgtactataatttttataattataataaaattatgatatttgatcaatttgtggagatatttataaaaaaaaatatattgtttgatttgcagaaattgtttgattaataagaaaaattataaaaaaaatattggttatatattggtttaaaaaaatattttttattaatcagaaaatattgtttgattaataaaaattttataaaaataataaattttgtggagatattaattgatcaaaaataaatcagaaaattgattttttaatatattattagtttatagaaatattgaatcaaacaattaaatgtgtagaagtttgattatatatcattacgcacatgcgaatcctacaccgttcacattatagagttactcttattatattttaagtacaattggcacataattcaaaactaacaacatgatttctagctgtttaatttgcaagttttgctgtcaatatatactattgcaagagttttgactgaagttaataaaagaccaactcggtttacatcatttataagtcatttgccaactgtaacaaataataatgacaagttgacaacaaaggataaaataatctttgtaagcgtattaaattttacactggtgaagctgtattgtctagttttagtgtcattgattaagatggtactgcatactttttcctcgatcagatacgtgcaacagcatcttcatgtgttgtctgtcatctttttgaaaacttggaatggtgatgttgttgaaatgaatttcgagcactaattatccttaacaaacttcttaatgtgtatattaattaagttgagccatatatttcgataatattgggccaccatattgggccatacatatttgaattcggaccgtaactttcgctatacatctataatctattttgattaacaatatattttaataaatgatttttacaataaagaatagtaatagtttgaagttcgttcttatatagtttcataaacttattaaaaaaataaattaataatattagtactaatccaaaatataattttaaacaaaacaaaaacagtgacaaataaaagaaaacaaaaacaccaatccaagctaaatggagactgtctagattcttttgattatttttctaactcattataatttttatttccttcacattatttcaaaaatatttagatgtttttgcataaaaatttgagcttacaagcaaaaagaaagtgttgtaaataaaatttcatggggaattgtccaaaatccttgattcaccgtgattcacattgccttccaaaatctctaactccactctaagattcgatttctccttcctaatctcattaagcgtcaaattaggccgtgtatcatttgtcaaccaaagcctagaactttaacacaacttctcctcatctctaacctagctttccatccgatcacattttctcattctgattctcgcatcagttttatttcaaaagataaatcatttttttttttaccaaaaaacgttataaatcgtactctactgacaagtaagtagtgttcaaacaatagctgaaggagtggatccgctactagaaatttgtaggatcatagcttgggttttcccaagtgggttaatctataaatgtgatccgaacaaaacgctcaaagtaaaataccatgtgtgtttattcatagagaaaaaaaaaaaaattgataagaaatagggtatcagcgaggacagtttacagtgttctcagtttatgttatcttaaatcatgaacgtatctgcataaatatatgttaactcaatacatgtcagaaacgatgatgtccaacttgatcatgcactcgttcacattgccccactaaaacttaatccaattttatcatataatttaagtttttgttgttgcaagtttatatataattttataaaaagtcaaaaatgtaaatcaaactcatgaagttatattattttttattttattttgaaattgaagttatattaatttacaatataacttgttgacactattgctaagtttattaaattattattttaaatttttaaaatgaagcatttacataaggccggctcaacattactaatttactatggtctctaggattttttttttgagccctaattattatttttaattgtttttgttatgaaaactatttttttgtgtaatttgacaacaaataattgttaaaaaaacaaaaaaatacagataaattcttctaaattcttttgaacatttttcaatatcatatataaaattttttaaaatatttttgaatattaaaatagtatgaaacttcgatatacacgcttataatgaatagtccaattgtcattttaagaattagacactttaatatgtgactgtaaaaactctttaaatatgtatattattggttagatttaattacatgagtttgatatatatatatatatatatttgcaaattgaaaataaatttaaagaaaattgttatttagaattttaatttcttacgagaaaaatcctataatttaattttagcgcctggctcaccccgtctggctaggaaaagaaatataaatacgcatgtgattattagaagaaatgatgttaaaagagagagaaagatacgagagaaaatggagagaaagtgagagagagagagagagataaagcagaggttgacttcgctttgctgagaaggcaaagagctcgaaagagagaagactaactctcatcagcgacgaatgtctgatccgttgaagatg

SEQ ID NO: 33046 - DNA, 3003 bp, Unknown
  misc_feature (1)..( 3003): 2750-1469P.txt file - cDNA_ID_3064824; gDNA_ID_1620459; Annot_ID_157695
ttgtggtccggttgatggcaactttagaggctcctatctcaccatgttgagctctggcggcgctgtcttcggtctcatcaacattgtcggaaacttcggcactgtcttcgtagataatgtaagatgatttctctacagtgaagtattttagtttaattctcttttggttttcgttttagttttagtttttggcattttgccataggattttaatatgaaataccatttgatgagtttttggtttttgcatatattttttttaaaaagtggatggattattaatttagtcgtaaataaatcatgataaactctggatgggatggattccttaaacaaaaagttgaaatagttattttacggattatgtaccaatattcacagttaaatgttaaatgttttgtagggttattgggtgagtgcaatagctgctcggccttcgtcgacccacaaagggtatttgcttggtggactcgtgtggttcgctgtaccgttctctctagctacctcgttaggtctcggcgcactagcccttgacttgcctatatctaaggacgaggctgaccgaggtttggttccacctgccacagccattgctctcatgggtaaatcaggatccttgcttctactcactatgctatttatgtaagtacactctctctagatcatatatatataaataagttttggcataacaaagtttatgggtagatgttttggttctttttttgctttatttagttctttcaattgatttttaagaatcattttaacgcattactggtttagtttaacaaaatttgggtctgaaatttaatcagtaaccaactagtcaatttgattcgggttgattcaattatttcaattcaaattggttcgttcagttcaaatacgcatactacatataatgcatgaatcgtatgagttgtgatcataagccctctttctttacaagcaagaatttgtttataagctgtcttggttacttcttacacaagaaacctagttagcatacaaaatatacgcttattccaaatcatgatgtattacggtatttgttgatcattagggctgtaacatcggctggttcttccgagctaattgcagtctcatcgctctttacatatgacatctaccgaacatacataaaccctagagcaaccggtagacaaatcttgaaaatctcaagatgcgctgttcttggatttggttgtttcatggggattcttgcagtggtcttgaacaaagctggtgtttcacttggatggatgtatctcgcaatgggagtactcattggttctgcggtcattcccattgctttcatgctcttgtggagtaaagccaatgcctttggtgcaattcttggagcgacctcgggttgtgtttttgggatcattacttggctaactaccgcaaagacacagtacggacgcgttgatcttgatagcaccgggaaaaatggccctatgttagctggtaacctcgttgcgattctaacaggtcagattcctatagtttactcaataaattatggtttaaaccataaacaaagacctaatcttggtttgttttggtccgtccatgtaaataacatataggggggttgatccatgcggtgtgtagtctagtccggccacagaattacgattggtcgacgacgagggagatcaaagtagtggaagcgtatgcttcaggggacgaagatgttgatgttcctgccgaagagctaagagaagagaagctgagaagagccaaagcttggattgtgaaatggggtcttgtcttcactatcctcattgttgtcatttggccagttctctctctcccagctcgtaagtcttcccatacaaatgaaaataaagcttaaatactaacaaaacttagaatttatccgaaccatattttctatttttttttttttgaatagaaaaataaaatgataaaattaattaattaactcttaaacaacactagtttcgtcgttttctaaaagtaaaacagtctaaaataaaattttggttactaatatataatagcccttaattaatgatcatgaacatcaattaaaaatttgcaggcgtatttagcagaggatatttctggttttgggcaattgtggcaatagcttggggaactataggatccatcgtgatcattggtttgccattggtggaaagttgggacacgatcaagagtgtttgtatgggaatgttcacaaacgatagggtgatgaaaaagcttgacgacttgaaccataggcttcgagctttaaccatggctgtgccagaagctgagaagatatatttgcttgaacttgagaagaccaagaaaaatgatgaagaaggttgaagaaatatcatattgggtacacaaaaggttgatactctatttttgtttgtatgctttgtttggttgtcttttcttgttaatttgtgtgaaatcgcatcaaagctatctccgtttgtacaatgtgttcaacatctttgataagtgtatgtattatacaaacaacagacagtgaaagtttgaaaccatgattaatttagtaggtgtggttagttatggatttggctattttattcggtttggtttaattcgtttgattggttcaacagacagtgaaagtgtgaaacaattaacacgttttttcctccgtctaattaaggtgtagtaaaattgcgaacacttgttgaattcaattgatttagttttgtgcaatttgacatgattatatttgtaaatttgtacaataggcatttaaatggtttggtttggtttggggtgctttcgtcggattcaattcggcctggttcgcatgccaaataggccagggcccaataaaccgtaacttggattaggtagaccaattaagaataataacccgacccgtttcaattaagggtcggatcactcactcccgtgtttcttctttcttcttccaaaggtgtttgttttatcaaatccacatttccccaaatttctttcttcttcttcgcttcagccatg

SEQ ID NO: 33047 - DNA, 3003 bp, Unknown
  misc_feature (1)..( 3003): 2750-1469P.txt file - cDNA_ID_3064832; gDNA_ID_1620460; Annot_ID_157735
taaatccgaaatactttaatctaacatccatataataaattagaccgtttacatacaaaacatgttaaaggaaaatattacataggtcataacaatgaagtataaaggtcatccaaacatgtcagaaaatttacacaaataatttatttgttccattgctattttcttaattgctcttctaaattttatcattggttgcaaatactatgatcttaaaaaacatgaaataattagttgaattattagcaaaataaaataaaatatagttgacacttgacaataagagtggacatcactaaaactaatcgtatatattgggttcgatgtatatgtataatgtaataagaaaataggtgtttaacaaaaataaagtaagaaagggtgtgtgtgtttttttggtgaaatgaaaggaggtgtgtagccaaaaacaaaagaagagaagaggtgcattatttctaaataaattttgatcaaataattgtgcttatgtaatgattgttgaggacatatcacacttgacttgcaatcattccgtcgacatttttctgtattatacatttcgtcaacaaccaatccacaaaaccccaacctatgataactaaatcacaaaagtacatttggttttatgggttgatacaaacttgagatcaagctaggtataaattaatctcaaaagtaatcgcaattaataggattcattcgttagttaatcgatcatatcctgtataaattttgttgtaacaaccatgcaattttctctaggatttaagctattgtcaaatttcctttcaaaataattatcgaaaatttttagttcgaaaaatttaacgtataacatcacttttaattttcattattcgtatacgctatacttacatttaaaccatttatttatttatttataaagtttatatatgtatatagagaacttaccaggttttgttatcccaattgtccaattgataattaaagtataccgacttctagttataggacttctaggtgcatgcatgatacatacatgatgcattatgcatatacatgaattcttctaaaatggatacataattaattagcacacacactatcttggcttcttcgtttcttggacgtcttggctttttttggtcgacccacattagcttattttatatacacgataagagacatacattttcattcgccaggcctgatcttatatatttatgtatagccgtatagggatatttgtatgcatgcgtattcaagtgcttcttcttttccgatctgaattggtccttctcttttcatattttcttcactttttctttcaattttctattatttttatactttctttgtacacatactatatgaagcatatctgtatacactgaaatctaatcaggaaatacgtaaagtatcgttacaagaaatacgtaaaataatgcttgccaatgattgattatcttatctaatcattggtataatctatatacgcacttgctaccaaatattgcacttatatggaatatgaagcatatatatgtttatggaaacaataatgccttggtatcatcatcacttatatatatcattttaattttgtaagtgcacttggattagaaaggatatataattatatatcaactactttgtttggtatatcttttaggtcttaatttcgttggatgattaaagttgtagctgaccaatactatgctaagtcgctaaatattttaattataggaaatataagatctataatacaaccacaagagttatccaacaaacaacaaccttttttgtgaatggtatctatattcgttgaaaatgacggtataattttaaatagaaattgattacagttttttcttttctttgttatgcactatagaaacttttttttttttttggattcaagcatgtggctcaaccatcagggtatgtcaaattttttgaatgaacacatcaactaattaaaagaacgtaaaagttaataactatttttcagaaatgtaaacagtaaaatcaagacgttaacagttaaattcaatcaagcaaaatgacagtacacatgtcggatttgctcagatcctcaatagttctgatgttcttgtaagtttgtatcccaaaactttctgaaatttagtttaaacaatatatttaagtggtccaaagacttcacaaacattttttttttacggaataataaaacgtggaaaggtcaaaggtaaataaataatactaatagcttactaattaaggtttatcattagttttaaataaataatactaatagcttactaattaaggtttatcattagtttctttataaaatggttcggactcctgagggtatatggctgtaccttaatttaaatacatgaaagtattggtttactatcatttgattttctttcattgttaaattatctcatatattcttaagttacataataaaagagtattttttcatgacaaattatcgcttttatattttacatacttactgaaccgtatcatatcacatatataaacaatattatatactaatggctcgtttaatttttttctttttaataaattagttgacaaaaattataaattagttttttaaaatttaatagaaaatacgttatgctgtcaaaattaaaaataagatagaaaatatgttgtatatttagttatttactaaaagcaattgaatggagtaaaatttgccacggtcagagttattctttcttaagttcactattttaggtcctcaattaattgaggccaatttgtctttttgtaatctcattatattcatcttctttctctttctcatcgcaccaaaaatgccttttgcccctctctctctatatccaacccatgtctcctctttatctctctaactttccccttagagagattcctctttctctcaaactagggtttcctctctgaaaacaacaaaaatatcccaataattgcaaaatctacttgaagatttttcattctcctttcttataattaatg

SEQ ID NO: 33048 - DNA, 3003 bp, Unknown
  misc_feature (1)..( 3003): 2750-1469P.txt file - cDNA_ID_3064835; gDNA_ID_1620460; Annot_ID_157739
tgacgctaatgcaaggctaagctcacagcaaattgcgcaaagcgagagagataaagcaccaatgcttgtgaaagtgatgcattacatttgtgtagccttcagagatcatttgcctcttgagaaacagcttagacttgcttctatggacatgtcttaattccttaaaacctattgtatagtttttatatttaggagtattttgttgtatttttaatttttagcgggaatttcattgcccacactgttgtatttttgaaagatatataagaaagtgaatatgaaggttgaatacaaatttcaaatgaggtacatcgacatagtagccaactttatcataattaaagatgtctatgattgctgattaggagaaaactaattgaagaagttaatgagtatgaaagcaataactcgtgttttcccgtatcttattatgtatctaaacaatgtactatttccagatggggtttcagaagtgttgtctttcatttaaaaccatggctttcgaataataacttaaaagttgttaagaaaaatgaatgctgcctttttttcattggtcaacaacatagcgaataagagcttcatattttcgtattttttttttatcatttaagatgtgagtttttttgttctgattatttttgttgatgctattattatgaaattttcatatatgtcttttcggaaagaattcatcaaaccaaattatgatatcattttcttatatatttatatgaaccagaataatatttttatttatcatgggtggcattggcaatcgcaattcccaagcaaagccaataataaccaataagaatcgtaagaccatccttattgatgagttcttagtagaattcttaacattttggatagacaaaataatatttaaatattaaatagttcttaataagaagagaaagtgtatcaataatctcttatttaagagccaattttatttttctaaaaacccttttctattttttatttgtattttattttatataatattttaagagtttttctaaagtttttaagaacctattgataatgatgctctaaaaacatctttaatggaaggttttaagatgaatggattcttaaacaaagtaataaaaaaataaaaatttgaatgaaagaagaaaaagaatgaagaaaggcttttagctaaaagcatcaagaagaatttttgatactcaactaaacccatttaaatgacttgtctctcatacattggttcactttttttctaaaattaaaattttagttatataataaaattacaataaaataattatttttgttgttgttaagagtctcttagaaatgcttattgtcgaggatggtctaaaatagagttggattaaaacactaccgtcttgctcgctgacatgcccatattccacagccacaaaatcttcaactgacacgtggcataactaaagcctctacatatctcaggcacgtgaatctactttgtgaaaacactgaatccaatgtttccagtgtgtgcatagagttttatttttagatgtcaagatgtttaacttggttggtataagatatccttctgtattagttcttactaatagcaaatatgagatcttacaagtaaagatatcttaaatagtcttattaggtatacataaatctatcagaaatggattaaaaagaaaaaaggataaaatcaagtaacatttgtggaaaatcaaagataataaaaatagaatttaaaaatagaatttctttttgataatatcttatatatatataattaatttaacaaatagtttttgttacattttgttgatgatgcttacccatataaatgttttatttataaataataatacaacttttttattctctaatagctcgttaaattttttaatttatccaatcatatactttattcatatcaaccgacttttttaagccaccttctttctttaaatagattccatcttctctcgctctccaatcccaatcagctccattatcataagcagtatattgtttaaatgcggtaaaattttgataatgtctatagtttggtctttgtttcaaagtacacatgaaacgagtcgtaccccaaatgttagcgcgaaaactattcacgtaatcatatcccactggtattatttttggacctattacatcatttttggaataacacctcatccataagtttttatgagatttgagttcgttcacgattctaattccggtgccggatacatgaccaaaaatgtaaatactaaaaacaaatagaaaaactgaaaggattttcatttattttttttttgtttagggtagatgtttagatgttttgttttgttaccttgatttttgtgtttctctggtactatatatacaaacacatatctgtattactattatttgcacgatatatctttctttattagttctaagttataacaaatatgatatcttacatataaagatatcttataataaacgtactagagtactaggtatacataaatctatcggaattgaattttgaagaaaaaaagataaacattacgttggcttactttatatgaaattcaatgaaaatcacttagccaaagaaagatagaaaaaaatcttatgatatactctttgtgtacgtaatataactttgtttataattatttatcaacgcaatagcaagcattgccactaaaccaataagagagtgatcatgagcatgttgggaacaacactatccacttgttcgcttacgtggacatttttcactgccacgagatcttccactcccacgctgcataaccacaatctctacatatcttctacacgtgaatctagtttgtggaaatctaaaaccaaccaatctacactcgctgacgtgtctatatgttaatcttcccacaaaatggagtaatgaacactttactatataaacggcgtctccaattcaacaacatctcattctcacttacttcttttctttttttgtgttcttgtttagaagaagcaatg

SEQ ID NO: 33049 - DNA, 3003 bp, Unknown
  misc_feature (1)..( 3003): 2750-1469P.txt file - cDNA_ID_3064839; gDNA_ID_1620460; Annot_ID_157752
gattttttttagtgtctttaaaaacacgagttcaagtttagataatagagaacattttgatagagtatttatactagaattttcacacatatgaaaacgaatataattttggaaattttaaattttctcttttcaaaaacaaattaacagaagatgttagtttgtaatatgttggtaattgtgattttcaaagttttaaattctggaattttcaattacaattttctacttggtgtacataaagcttgtagtaaatttgttaattcggaagttaatggattttttgtaacaagaaaataaaaatgattagtacttgagagttgacattagccagtagggaagtgcatataacgcgcttaagagggaagtaattaagaaaagagtcgtttccacttaattaaatcgtagccacaaataatggggtttcttaaaaatggcttaagtgtacttaaacttttgtatgatacgccaaattatgtgccctttcaaatatggaaactatttagttatgctttaacgagtaggttttcaatcactcataacccttgctataaaatctaaaatatatcatttttattttattttgcaaatatgaaaatctaatggtcttattagctccatagatcattcacctcctcaaagataacatagttattattattttttaaagttacttatcaaataaaagtgcaccaattcagatgtttggtatacgggtccggtaccatggacttggcccttgggtctacccatattcgactcgtacccaaacgtttattttgttcttttcaattgaactaacaaactaagcatcttaagtataaaaaaatcgttaattgtaatgtaaaagccaaaaaccaacagacaaatattgatttttgcgtttgtgcttaacataattatttaatgaaaaaattatatgttttaattttataactcaaaacctatttcttaaactgatgttgaattgtcgaaaaactaaattaataatgttggcagatatatatggtcacgtcaaagtctatctaatcaggacttttgtttttaatcttgataaacgcatgttatcgcattaaaaatgaaaagagatgggatgtggcaacaaaagcaagtatttgctacttgaagtgtgaaggaccatacatttgattaattttggatgtgtttttggttaggaattagtcacttttcactttaagataatggatttcgaatttggttgggattagagtgagataactttttagagtgtcaagatcgtcgcgtctccatcttaatttgtactttctttgtcatgttcttaatttgtttactaatagagtataataagttcagttacctacaattaattaagttaatttggcgtcattatttattactataaagtagtaaactaatgtacttttatcgatttctttatgagacatgccctactacaaaagcatataaagatcattgagttgttgaagtacatagcaaatttattctaccaatttaattaccatccaatctttttttcgtcaactatgacttgaatatatggacaatatggttgactaaagaaacgacaaggagtctcatgccgaaaacttagtacgtcgaggcttgtgtgtggtaacgatggaagaaatagattgagaaaaaaaagtgaaacggcaagcagtctgtttatgaagtctttggatctcttaaaccgggctttgtccaaaattagaatggaaaaaaaaaaagaaggatcccttaaaccggtaagcaacccgattaaattcaatatgtgtacagaaacttaatttgatttttttataaaatttaaatcaagactaatatggagacttacaaaagttaattatatgaattgtatgttacagattgagtgcgaaaggatgttccacgttcaatccactagcgaaacaaaaaaatcatttatttaactgattgtcttcgtaagtttacttagtaatatcatgttgaaacattaaatctgatatatgtgccactatgtaaatcatttagttaacttataattgaaacaagaaatgttatgtgtgccactatgtaacttttattagtacatatataaaggaaatagcgtttaataaatcgactgctaatctaaaactaacaagataattaattatgatcactaagcttcattctaacaaatcagtttatagaggacaagaaagcttataattactccaccttcttttgtctttttgtttgtgaaagagaaatatctgatggtaaaaaagcccaagaagacctcctctctacacctttaaagtttatgcaaatttagaaacaaacaaaacggaccactatagctaattatcttatatagataagatatgtagaaggagggatatacatatgtataataacaatcttgatatataacttccatcatccatggttaagattgtaacaccatgagttggtgcgaggataattcatatatacaaaccaaaaatcacgcgtatgtatgttattgcatgcatgtcttgcatcatccatgcatgaatgcatcaaagagtctccagtctttaatatacatatctacatggatggatgaaagtcatgaaaccatgttattaaaaccctttttcaaaacaaataataatgaaaccatgttgttataattggttaggtttgaagagatatacatagatagtccccatgcatgtgttattagtagtgtttaggatgaaaataacccctaatacataaattaattttatgattaattaacactctaagattaaggtaaaacataattaattaagactttagattaattaagggttagtaatcacgcggtgaatttagtctctataaaagcagtacctcaccttccacaaccttcaatatcaactcacccacatctttctctcttattctctcactcttttttttttatattcctctctctctaaatctataaaatatatttaaaaacttgatcgtatataataaagtaaataaagaataataacaaaaaaaatg

SEQ ID NO: 33050 - DNA, 3000 bp, Unknown
  misc_feature (1)..( 3000): 2750-1469P.txt file - cDNA_ID_3064881; gDNA_ID_1620461; Annot_ID_157766
tatccttttaaaacctatctatcaattgcaatgtttcagcctataagagtcatatttctaagattgaataaaattgcttccaacattggacttgtaagtaaactaataagaattagaaaggagcgacataacataccaactcaggcacatactctactcctggtttaactttcaggctcataatcttaaacttaaccttgctcttctgattcaacggctgcttttcattgttctctggatgttccacaaacttgaacactgcacttaaacatatacatacaagaagcaatactcagaggctgtataaactagttagggtacacaaaaccaaagaagacatcattcttttccagaatctcattaccagtagcaaaaacactctctcctggagccaaaacacctccgggaggacgcatataacaactcttaggtgccgttgtttggaactaaacaagaagatacagagtgacatagatgaataagtacatactaaagtcaacaaagagtcaacttctctgcaatttcttaactagttctcaaataagtatcagaaatgcgagaatcaatagccaaaattgatgtgaatgatacacataactccattaccttaaatgcagtatgagatttgctagtgttcttaagctttattgcgctgcgaacttgttttccaggttcatctgaaacaaacacaaatccacaaattctaacttcgttctctaacaatggaaatccaaatcaatcacttccagagagcctatgttaatcacttcgattctctaatcagaatccataaccaaatcaatcaatttccagagaactatgactatttctgaatcaagctaaatcgacggcagaaacttaaataaagaagacgtacaagggaaatacagataactagaaggatctagtcggagacgacggcgagctggaagaagtgatctggcgacggaagacatagtcaacggaggcttagagacggcggaaatatctgtattccgatttccatggcggctacggtagttttggtttggattctgtgttgaagatgaagaagtggtgcttctcctctgccaaaacggacatagcctgaagaggttcttcttcttctccacactcggattctgacggtcacctattggcatcggaaataatcaattttccggtgaccggatgatactttcccgagtttcgaataatcttttgtttctctaggaagagagacaaattggtgtgaatttcaaaggaggacgacgaagaatcgacaaaaaatggcgttttgttttggcgttttacttctgcgtctgcgagagggtcacgtgtttttctttaaaatcggatttagatgaatttataaattttagtagtttataagttttctgttaagtccgtgtgaaaacgtgttttgacaaataaaagtccaatggatgtttctttcggggttggaatttatataatggaattgaaaatcagtgattattggttagttggtttggttggtcgtgaatttatctttggattctttcttgtctttgcatttggttggtaggcttatatatatcacatctcaacacaagtcatcatgtaaacttttggatttgttcaaaagtgttttttggtatatggattttttttctttttttctacgcatataaatatcattattaggttttacagacttgctaaatattggagataagtagtactagtgggctgcgtttgtatattgggcttagccgacttagaacttacttggtcggtaagtctcgtctagggttttggggttaagtcatgtgtacaaatacgttgtacagccgttcattgtaaagcaagcaattgaataacaatcactttcttttcttacactaaacctaaacaattgaagttttggcaaaaatcaaaattaaagcaaagaattcagtaaaatctgagagaagcttttggtagaatttaacgcagccaaagtgtcattaatttgcggaaatgaccgttcttctttctcgatgtgatgatgtttctgatgtcgcggtcaatgcatattcttgatattcagaacaatgatgttcttgatgtcgcgaattttatgcatgtatgttattactaataatagaataattatgcgaatttaaagatttgaaatcaatcacataacgttatactcagtattaaaaatgtcagtttatatggtgtttgtattgatattccttgaaacttcacgtcaaaactagtttgaattcttcttcgaattgtattaaaaacagttttaaacatattaaaaaaaaaaaaaaaaagagtttgtaactgaggaagtttgggctttaaaagtccatacatcattttggcctggggacaaaacattttatacaatctttcctttcaagccagactcaaacatgattgtgtgactaattgtgcgtctacagattttggattcgtaaatttcgttatgttcgtaaaataactgtaattatggtaactaactaacgttcgaacataactttctttcccttctaaattaccaaaatgttgaacacattttaaaaagggaaagtaagattgttaaactcatctagaaacggaagctttaatgtaataagattcttcaaatcatatgattttatattactgtatgttatatgaaccaatgcaagatcttacaaaaacatatgttaccattttcccaaggaggaaacacatgtgacatacttatcttataattaacacatgtcgtaaccttattattagacaacataacacaggtttattcatcaagtcttagggtttttattagcctatacaaattcgtgataagcaagaaaaacaaaaacctctgtttgactcttccccaagtttttttttaaaacctcttcttcaagtaaattttgattattatataagtcaaccgattaaactatagttcaaaaaaaaaaagatttaagaggtttttctctggatttcctcttctccacgttctcagagttagttacacagctttcaacgatg

SEQ ID NO: 33051 - DNA, 3000 bp, Unknown; identical to SEQ ID NO: 1884
  misc_feature (1)..( 3000): 2750-1469P.txt file - cDNA_ID_3064926; gDNA_ID_1620462; Annot_ID_157783

SEQ ID NO: 33052 - DNA, 3000 bp, Unknown
  misc_feature (1)..( 3000): 2750-1469P.txt file - cDNA_ID_3064930; gDNA_ID_1620462; Annot_ID_157782
aaattttgtataggtctgtattagccgactggttgaagaactggatggagcctaaaactaagaaactacttaatgtgaaggtttttgctcaatcttctcccaacgacaaccttctgcttgtccaagcactgaagaaaagaggccatatagttgcagccactggaatgggaatacatgatccaaaaacactacgcgaggtccgtagttatcttattaaaactctaaaaactcatcgcactatttcaaagagaatatgaattgtaaatatagaaagacatatttatcatcactacaacctatgattcgtgttttccttgcacaggctgatgttagccttgcaatgggagttggagggaccgcagcagcaaaagagaattccgatttcattatactagatgataattttgctacgattgtcaaggttggtttattatatgcatggttgaaatggcgaacttgggcagtagcagtttatagaatgcatacaaaaatgatgagcaaacgttgaccttttggcagtttaaatcattttgataagatactagaggcttgtttggataatgcagtgtatcatatggtctcgatctctgtacaacaatgtccagaaatctatcctattccgcctcactgtcagtgtatcagcattggctgtctgtgtggttgaggttgtagtttatgatgcatttccccttaacgccgtgcaggttcaaaatgttatccctttgttacttcatcatcttgttatccagcttttccaagattggaaaccttttccctaacccagtttttgctttttcctgatgcagtttctgttggttaatctaattatcgacatcttaggagcattagctttggcatacagaccaagatctgatcaccacctaatgggaaagccaccggttggtataaggtacaaattctgaataggatcaaggataagatttgattattaagtcaatatagagttggcttagaaagagacattaatgtattgatgctgaaggttttgaagaaactgttggttttgcaattcttgttaaaacacactatctgttctaggtgaatatacacaaactgatagtacatatgcatgtgtacattttttgtttttcagagatcctcttataaccaagacgatgtggtccaagatgataattcaggtatgtagggtaaaatcctcgattgatcatgtgtggacgttaatgtcagattaagtatttcacaccttcatagtttccaaggagcaaatacaattccttggtgatattaaactaattaattatttagattagagacaaacacactggtttggagacctctaataatgcttgtgtcatgaaataccttcctccaggtattttacctagtgctctcgctggtactcataaattctgagaagctactgaagctgaagcatggtcagacgggcaatgccgaaaaaatgatgaacacattgatattcaattcctttgtcttctacctggtaatatctgattttttcccactcttctaattagagttcatatgttgatcatctctctatctttctaaaataacgcaggtttttaatgagtttgaaatccaaagtgtagaccaaaccttcaaagaagtccttagagagaatatgtttctcgttacaataacctcaactatcatatctcaggtaagtcctctttacaagtgaacacaacatttgtcttttcttatatatccctaaaccatatatactctctttctgttctttcatatcagataatcgtgatcaagttcgcaggcattttcattgacttgaaaaaatgggtgacgacaagtcttttggggttactcaggttctgctcataaacatcctcaactactttctttaattttttactcttcacattttttctcaatacgtaaatttaaccttttttcagccaagtcgccactcgctacccttacccagccatccaatatcatcgtaactgagatttctcttgccgtatggctcaattctcgtaagaagtaagaaccattcactcccaaagtctcctaatgaatcgcatatgactatcttattttagatctggcaagtagtttctctcaacttgcagttctcatctcaggtcaacttttgaagcatccctctagctttggtcgcttaggaggctgttgttctctgcgcgggtgtgcgtgagagattaaataatgcggattattgtgctgtgtatatagcatactacagtttattcagtcaattcattttcctcttgaagatatgtcgagtgaaatgcgtgaaagtcaaacatttaagttctgtatccatttccctttcaagctatgtagactgtaatgggtgacagtcatatatagtatatatagtaagctctgttcaatcaatgcacctcttcgttttcgattcatgaattgtttgttggatgttcctaaatctttggatccagctgattcaccgcgattgaggtggctttagttatcggtatccaccattccttactgctataggtcgatcgaatcaataacactacgacaattcgggctgcttagacagcgggtgcgatactagtttattcatactcctactcgtacaaaaatcaagaaaatttcatctccattcaaattaagaaaaaaaacagtaaacattcatataccatagccacaatcacattcgtggcggttttacactacacccgccgcacctgatctttgacttgatatttttatacaactgagtcggtttttgacttttgaggttgtggacagatctaacggctaatagaattcgagttatctacttcacctgacgcggcaaaatctcaaccgtcccttataaagctcttcgcggttaacattttctctcctctgtctgtgtgtactcgtggtaaattagtcagatttcgatttggaaccctaaaaaaattcaaaagacgatcctcttctcgaagaaactcgattcttgtggattcgatttcattaaggaattttgaattgttgcctgtgatg

SEQ ID NO: 33053 - DNA, 3003 bp, Unknown
  misc_feature (1)..( 3003): 2750-1469P.txt file - cDNA_ID_3064934; gDNA_ID_1620462; Annot_ID_157777
gatcgaagttcatatcctttaaccgcgtcgatggcgcgtttgagagagacgagtgtagggttaggaaggtcaaatgaaagcggagaagatgaaattgagagtgacgagagctttgaggatgataagagagaagaaagagaagaaaagaagaatttgaaagagaagagagaagcagataaaggaggaaataagagaagcttctcggcggcggagatcacgacggctaggtattgctccgaattgggtttgatcagaagcggattaagatctatcaaaagcacaaaacgctgcgttttggcgtataacaaatctccagccattgaaatgaagcagagagagagaagattcgattttggttttgaggttgaagaagagaggagggagtgagctacgaggttatgtttttggcgggaaacatattgccacgtcattagattgtcaatttattgggtcttgcttactactacatcataaggccattaatggcccaacaagagttttaatttggtgacgtggcaaaattgaagatagaacaaagattacgaaaacttcctccgcttcagatttttcctttctgcaagaattttcctgggaaaatcaggaattttctcggagaaaattctcgtaatcatgaactgtgtttctgcatttgaatttgttccttcaagtgctctatttccatgtgcacaatcatcaatccctgcgaaatttcttcacattttgagctcaaaagcctcgatttctcccagatgtcgtagtttcgcttcttcttcttcttccacaattcggaggaagcctctaactctagtatcttcaaaatcttcagacgcggaggaggtgtcagatacggaggacgaatggctgaagaagctaccagagaagaacaagccactgtattcgcatagcttaccttgtatcgaagcgtggctgaggaaattagggttttaccaaagtaaagacgatagagctgtttggttgattcagaaacctgattggcatgctcaactatctcttgatgtcactgatctctgcattaggtatgaagctgattgcttttgtagtttcattgagttcctgaagttctcagctctgagatgttgttgataaattcctgtttttagtatcctaaatgaatgatttcttaactagtttaagtgtttgtgattgtgtagttaaagctagttgtgttaacaatgaggatattgatgttgagaagaagagtttgtttttagcttggataagtataaaagtatagcatagtgtgatgaattaacctcttgaagatgattgtgaagtgaatcctagttcagtatttgtagtgcggaaccgattgttatgcggttggttgcatccgctgttggtgctatctaatcttgatgttttagtccaaggagttgagaattagaagctaatttaatgtctctgtgtatcaatccaacagaccaaataagttgatgcattgccatgttctctgatcatttcctttggagtttctctatgtgtaatcccgccaagttggactaactagattgcttgttatgtaggtacatgaaaagtgggccgggaaatctagagagagacatggaaagaaggtttagctatgcgttgagtagagaagataccgagaatgccatacttggaggaccttaaagaataaaaagagtttgtttgagtatctttgttcttaaactttgctttttcagtagtttctcgttatatgatgcatttgcttgtttgatccgaaaaccatttttatcacaattctttagcaggtacggtctttcaaaacttgaacaatgaatgtgaaaattatacgcatttggaaccagtaggtagataatcttactgcatcccacatgaagaacctatgcattatctaagctattactaatatgtgaaatttggtgtgtaggcatcggtgactttatttactgatgcataactttcacatcttctgtttcaaacctttagcaagactacatttacgttagtcaactcaaagtaatgagagaaaattaatacatcaaacttaaacatgagttacatattgaacacagaattaaaagtgatatgttactcttgatttatcaaataaagccttgtttcctgatactataaattctaagtttcttccgatatccaaaaccatcccaagcatctaagtctaacataaaaccaaaaagaaagaaagaaatacgtagaaaaaggattaacaagaaagatggcaaccaaaacttttctctcaatctctttaatggtttccctttgtgctgccatttttgtctctcaaggagtagctcatatgcaaacaccaccaacggttccaggacttctcctacctggcttacctattgatcttgtaaaatgttggtcgtctctcttcaatgttgaaggatgtgtgctcgagatcgccaaatcaattttctctggaaaattcgaaaatgtcgaagccgcatgttgcaaggcgttttcaaccttagatgctaactgttggccccatatgtttccgttgaatccatttttccctcctctcctcaaggacaactgcgctcgcattgtccccaactcccctacacacaactaagaacaagaattattgctggtctacgcttttaaattagtcattagctccaaagtctaataagtttcaatgtttattttgttagcaaaatgtgaactatatcttggaagagttctctttttatagtttttctcaatgacataaaatttcaatattttccttttatataataactcttataaatgtgttttgttggttgcacaaaagaaaaacattggaaccgaccaaaaaaaaaaaacattggaaccgaccaaaaaaaaaaacattggaaaatcgtacctcaaaatgcaataaccaaacaaaccttctcatatggatcctatagtatggttatttccggtttagttggttcggttctgtaccgaaattatatcgagcgttttaacgttatccagaacgaagcagagtaacgaagagtcatg

SEQ ID NO: 33054 - DNA, 3003 bp, Unknown
  misc_feature (1)..( 3003): 2750-1469P.txt file - cDNA_ID_3064981; gDNA_ID_1620463; Annot_ID_157826
ggctaataatattcatgccaattgttaatttctggtggagggttaacacttgtacataaatacttaatttttctttttgcagtttttgtatagatatccatccttatataaatagaaaaatataaggaaattgtaatgatttagcataagacaattggataatcacaaatgcattaaacctattaactagtctatatagaaagagttattagttacagctatactatttgtggtggcattaatatatagtaacttatttaagatatatgtcataatgttaaaaagaaatcacagagaaagctgttattttttttaatcctaaatttaaaactttggatattgagattagcctgtaatacatctttttccaaaaaatttatacaaaaatggccattaataattaatagtaatagctagttggacttcttagttcaaagtaattcaacattttttctaaaataaatcttctaataatagaacacgttggattgactaattaagtcaaatatgaaatatggaaaaggaaaaaaatccaccaacgatacaccaaataatttccgatttttatatatataaataaacatactaagagcaaaagaaaaacaaactgaaaataaaaaaaataaataaataaaaaaaaaaatccggccagataaatcgaatttatgtaataaatccgaccagataaactgatattattgtctttcttccgctcctttgtctctctatctctttctcacaattagattctgtgcttcttctgcgatcaactaagatccgatccgcgagcgtttcagacttcgatcagatccgattaagagaagcaaatcgggtcgggtatgactcgtcgatgttctcactgcaatcacaatggccacaactctcggacttgtcccaatcgcggcgtgaagctctttggtgttcggctcaccgaaggttcgatccggaaaagtgcaagtatgggtaatcttagccattacacgggttctggatcgggtgggcatggaaccgggtccaacactccgggttctccgggtgatgtccctgaccatgtcgctggtgatggttacgcttctgaggatttcgttgctggctcttcctctagccgcgagagaaagaaaggtatcttcgtttgatttctgagattaaattttttatcaaattccaaatttttgtaattgagtttattttgcatcaaagtcgttgattgcattatgtaacaagtggtgatctggtttatgtaacaagattttgatgtgtgtttgatattggttttgttgtaggaactccatggacagaggaagaacacaggatgttcttattaggtttacagaagctgggtaaaggtgattggagaggtatctcaagaaactatgtgaccactaggacacctacacaagttgctagccatgctcagaagtatttcatcagacaatccaatgtctctcgtcgcaaaagacgttctagtctctttgatatggttcctgatgaggtttgttccttcttcattcaaaaacaccatttttatttatattggagtggttacaaaatgtgttgagatactgatttaaaggattcagaagcttattaggtggattggtttgccttctacatttcaatatgaaaagttgaagtctgttggggttctaattgatatgcttgaggatatcattttgtagccaatcctgcttaagcattttggtcttctcatgggaatgtgatcttgaaatgtaattctctttctttattctgcttatgctgtgtgatttgtccttgtaggttggagatattcccatggatttgcaagaaccagaggaagataatattcctgtggaaactgaaatgcaaggtgctgactctattcatcagacacttgctcctagctcacttcacgcaccgtcaatcttggaaatcgaagaatgtgaatcaatggactccacaaactctaccaccggggaaccaaccgcaactgccgctgctgcttcttcttcttccagactagaagaaaccacacaactgcaatcacaactgcaaccgcagccgcaactacctggctcattccccatactatatccgacctacttttcaccatattacccgtttccattcccaatatggcctgctggttatgttcctgaaccacccaagaaagaggaaactcatgaaattctcagaccaactgctgtgcactcgaaagctcctatcaatgttgacgagcttcttggtatgtctaagctcagccttgcagagtccaacaaacatggagaatccgatcagtctctttcattgaagctaggtggcgggtcatcttcaagacaatcagcatttcacccgaatcctagctctgatagttcagacatcaaaagcgtgatacacgctttataaaagacctgaggaagtgatggtctaaaatgggatctggtttggggtttacaggttagttgttggtcacagtaacttaaataagtttttctttgttaggttgtttaacttgggtaggatgttttagttcagctttgatcattagggaaaagaaaaaagaaaaaaaaaagggagaaaaacaaattattattttttgcttacatttctttatatttgtatgcttttattttgactctaggatgcgttaattttcgtttaatctgtactaaaaattagaatttattagttttgaataaataaaatcacagtttgtttatcctctgaccaaaaactataactggattgaaaacggaaattaaaccaagacgaaccggatttaaccggactccagtgttgtaagagaaagtaaacaagttcccaagcgtttcgtaagtaaaaaaacgaatgggctaaacaattagtctaaatgggccttaaaagagtgaataacgtgtcataatcaggagcgttaaatttagggcgatgagtgtcgagagtgttcccgcgttcaccgattcactccactctttggttaaaaagtccactgtcatggaaaattaatcgcggtgatttacacagatg

SEQ ID NO: 33055 - DNA, 3003 bp, Unknown
  misc_feature (1)..( 3003): 2750-1469P.txt file - cDNA_ID_3064989; gDNA_ID_1620463; Annot_ID_157821
tgtgtattcttgctatataagacgtgcaaagtgactacttatttttgttttatatagcatgaacaagatgatgtatttggtttgatctgattcttgttttttttttggtaatggaatccagagaaattggaaatggagtaataaattcaatgttcttgccacttacacaacaagcagaaatagcatgtgagaatgtgaaggaaatgaaagagttgagtcaaggatacaacattgttggaagatctcaggttcttgatacactttcttgaaaaccctaaaataggttttttgatcactataacacgtttcagtttcatggatgtttgatgaatgatggaacaggggaacctagtggctcgaggcttgatcgagttctgcgacggtggacctcctgttttcaactatatatccttagctggtcctcatgctggcatttcttctcttcctaggggtctttgtggtgtaagctttttttatttttcctcaaattatctaaaacttttatctgtaatttaattttaatcaatcaaggtaacaacaacgattgttttgttttgtttcttttcttttaagttaacgtccgatccagcatgtaagaaatttaatgagttgatcaagggagctctctatagcgagaccattcaagtatatatatctctttctctatatatatcatgattaaagactcaattagaaaataataaaaaatcttcaatgactctgcaggatcatcttgctcctagtggttactacaaaatccctaatgtaagtccattcaccatttgtttataagaaaacttgcaaaatcaacaaataagtgattgatgatcaaaacaacaacataaagttttaacaaaatctttgtttttcttttatttattctcaggatatgaaacagtacttggaaagatctaagtatctacctaagcttaacaacgagataccaaaccaaagaaaccaaacttacaaagaccgtttcaccagtttacacaacctggttcttgtcaaggtttggtctcatcaaaaccatctagacttttcaactatcttctcattcctttcttgatgactctgttttttttttttacagtttcaggacgatgaggttattactccaaatgattcaacttggtttgggttttatccggatggtgagttcgaaactcttctctctgctaaccagacaaagctctatacagaggattggatcggtctgaaaacattggatgatgctggaaaagtgaagtttgtgagtgtacccggtggacatgtcagaatggcagaagaagatgtcgtcaaatacgttgtaccttatctccagaaccaacagcctgccgcacaaagcttcaaccgcaagaccaaggagcccttgcatccttaaaacagagcaaaaacctcaattgttatacttatacttagcaaaaaaaaattgttatacttgttcatgcaatatcgaaaaagcctagtgatgactttgtagaacaagaatccttattattgatatattgatatatacatacctatatgaattgtcgaattaatccgttgagaaacgacgaatgaggtcttcatcaccagttttcttcaagacttcaatgattatctcaacatgagaaacttccaactaatctcattttcttatcaagcatcggtttcacaagcttatagctagcagcttcccaagaaagcccatttataaattaactttggccaatcttttgcaacatcttcaatatacataaactaaccaatataatgcatcttctcgatgcttgttgaagcagtattgatcagagtcatcaataacttatattgtctgcttacagaagtgagtcaatgtgtccattgtaagtattatttctatctaaaaaatatttagagattttattctttacagaaggagcaaatttatttgtatatttagttgtcaaattaaaatttagtctatacattatacaaggcgcaagtttgtggatttaagaattatataaaaacttgaaatatatagtttttatgcattctcctcttgtgtaatacataaaccaaatatgagataggttaatctgtatttcagataatattaaattccaaacaatatttttacttgttataagaaggcaattaatatctctctgttaatggcaagtggtaccaagtagtattaaactattaatgcaatggaagagtactgttggaaattataatcctctatcacacattcaaacagatctcctgaaatcttctcttccaaacttgtacttctctgatccaaatgtaggctccaaaatatagacatttaccatttactaagtccacaactcctttcttgtctccttcaaaaatgactcttgtgtaaccatcatatgactccgacagttcggcattgccatgatgagagcttaaaaattcaccttcctgagcatttcaagtcttcactcccttagcttgacctgaaccaagataaaatgcctttgtcgtcccgtaatatccatcctgctttggacggcatcatagttacattcgatccatcctatttacaatgttattttagtattaaaaacatgacaataaatttgttgttaaacatattcaaatacaatatgattggatttataagtaattgtaatatgaaatgtccttagtaatatgttaaaaaatacatagatacacacacgtactaaaagaggcaacgcgggagatgtcattagaggaagaactaggaagcagagcgttcatgcaaaatgctaccaaaaacgttaatgcaatatctcaactaatcagcacagtccatttcatactgagaatgtaaaaaccaatcagcatcgtccattttttcatctaattatttgttaactcttaattggccacaacttccaaccacatgacgctctttctattccctttatatattcccatctcaaatgttcttggagacacaaaatatcataaacatataaacataaacgccaatcgcagcttttgtacttttggcggtttacaatg

SEQ ID NO: 33056 - DNA, 3003 bp, Unknown
  misc_feature (1)..( 3003): 2750-1469P.txt file - cDNA_ID_3064993; gDNA_ID_1620463; Annot_ID_157820
ctagaaatgtgattggctaacgaaagaagcacaataagttaacaagtgacagtgacaatttatccctcgacaacaacacacattcacatatatctttttattttattatttttctgtgtgtctttaaagtttacagcacaagtagtttctaaatcttataatcaattttcattgataaacagaaatttaaaatatttaaatagacaaataaatgatcaaatctatatttctatacaagagttaattcacaaaaatttgttgtgaaacaaactctttctatatttctatacaagagttaacatatttctatataagttattgtaaagatcaaaatatgaaaattatggtataaatgcatagacacatatatacgtgccctattaaaagaggcagcgagaagataatataggaggaagaggaagaagaagaagatggtgaagaagagagttaatgcaactgcaagaagatagtaactaatcagcaccgtccatttttgtcatctaattctttcttacttggccgcaacttccaaccacatcacacactctttctattcccttatatattcccatctcaaaagttcttggagacacataaacattaaaaaaagaaaaagaaaaaaactataaacataaacgccaatcgcaactttcttgtctttcaatgggagagaaaggtttgaagcggtctggtgttgcggtggtggttgcattactagccatggttcatgtctctgtttcagttccgttcataatgcttcatgggatctcagctcaatgttctaatgctagggatgctaacttcacacagcttctcactaacctctctggctctcctggcttttgcttgtaagtcaatccacaaaatagtttatgcgttttgataaccaaaagatcgggacatgtagaagaagagttatgtattcttgctatctataagacgataacgtccaaagtggctcaactatgttgatggatttgttctaatgaatccagagaaattggaaatggagttgccgattcatggttaatgccgcttacacgacaagcggaaatagcgtgtgagaaggtgaagcaaatgaaagagttgagtcaaggatacaacattgttggaagatctcaggttcttgatacactttcttgaaaatcctaaaataggttcttgatcattatttacatagtgtttaagtttcatggatgttgattaataatggaacaggggaacctagtggctcgaggcttgatcgagttctgtgacggtggccctccggtttacaactatatatccttggccggtcctcatgctggcatctcctctgttcctatgtgtggtgtaagttttttttataaatcttttttctctaaatattttttctatgattttaatttaatcaatcaatcacagtaacaacattgtctttttcttgttaaagtctggtttattctgtaagttagcagatgagctaatcaagggagatatctatagcgacttcattcaagtataaatctctttctgtcttttttaggattaaatcctcagtagttacaaattaattaacatatatctttaataaccctgcaggatcatcttgctcctagtggttatctcaaaattcctactgtatgtctactcaccaaatatattttgatgataaaaaaactacttcaaaatttgagatatcacaaaatctttgtttttgatttatcaggatatgacaaagtacttgggaagctctaagtatttacctaagcttaacaatgagataccagaccaaagaaaccaaacttacaaagaccgtttcaccagtttacataacttggttcttatcaaggtttggtctcctaaaaaccatctagacttttcaattatcttttgattcctctcttgatgattcggtttttgtttgttttacagtttcagggcgacaaggttatagttccaaaagattcatcttggttcgggttttatccggatggtgaattcgaacctcttctctctgctcaacagacaaagctctatacagaggattggatcggtctgaaaacattggatgatgcgggaaaagtgaagtttgtgagtgtagccggtgaacatatcagaatggtagatgaagatgtcgtcaaacacgttgtaccttatctccaggaccaaccgtcttcggtgcaaagcttcaaccgcaagacgaagcagcccttgcatgcttaaaaatagcaaataccacaatagttatacttattcatgcaatatatgtcgaaaaagcttagtgatgattttgtagaatccttattcttatagaaatatatacatacttatctgaaaaatcgaattaatcagtagagaaacgactcatgagatcttcatcaccacatttgtatcaaggcttcaatggttttctcaacatgagaaacttccaatctcatttttttttgtttttgttgttgtagaagtctcccaaaatgactcgaagttttttcctttttggttctttagtctcaccaaattacatattatttttaaataatctaacaattctccaaatatcctaaaaactaattcatatctctccaaatctaaaatttcctaaattccaccaaattttctaaaatcatgaatccaatacactccctgattcaaatctctccaaatctaaaatttcctaagttccaccagataatgaatccaatacacacccctaagagaggcaacgcggagatgtcattagaggaggaactaggaagcagagcgttaatgcaaaatgttaccaaaaacgttaatgcaagatatcaactgatcagcaccgtccatttcaaactgagaatgtaaaaaccaatcacaatcgtacattttttcatctagttcttcgttcttggccacaacgtccaaccacatgacgctctttctactcactttatatattcccatctcaaaagttcttggagacacaaaatatcataaacatataaacgccaattagaacttttttacttgtggcggtttacaatg

SEQ ID NO: 33057 - DNA, 3003 bp, Unknown
  misc_feature (1)..( 3003): 2750-1469P.txt file - cDNA_ID_3064997; gDNA_ID_1620463; Annot_ID_157818
gcattgtccctttcccttttcgtatccgccggaaaaaaataacgtctttttttttttcttccaatctctctgtctctctccccaattcccagattctcatgtaagctctctccaaggatttgatttctgtataatgtttgcgaattgagactaagagccctctcgatttcgatttttgttcgtctggatcctttgcgttaggttttttcttctcgtataattagggcttccgatttgtttacccttagttcattttctctaaattttggtttttgattgatgggttttcttgatttagcaatttttaagatttacttgaaagattccgtaattttgttctgattcggattctttgatctgtgctcactagctctctaccaaagcagcttccttttctgatccctagtgttcaattatgtgaacagattgtttactttagcttctcttccttttcattctagttttgcagagattttaggaggaacatgattgtttgaattgggagagacattggttcgtgtaaaatgcgggtgcttggtttgagctcaagcttatgctctggtgaggataaggaagaagaagagattaatggagaaggctctctcacgcctgtttatctcaacgtctatgatctaactcctgtcaacaattatctctattggttcggccttggcatatttcactctggcattgagggtaattgtggcttcttctctattacttacttgacctaactaaatttttctttgtcattgctttctatttgctttcatccatatctggtttatcatgttatcaaagtacttctagccttgaataggaacaatgatattcctcaattgttctccacaagttgtgatttattattcattaggtgaaaatggtgtttattatattagctatggaatacattattagaaggaaaaagtggaacaagttttgaggaatctagaatggaatgctttttcaaatcctgccttattgtctgaagcattctctttcaataattagaacttgcctgatgagttatataactgtacttctgctgaaactgttattgttgctaaatgttcatctaatgtggagttttttttcactttgccatgtgtactactagctcatggtttcgaatatggatatggagctcatgagtattcgagcagtggggtatttgaggttgaacctaggagctgtccaggtttcatctttaggcgctcagttttgttgggaaccaccagcatgtctcgctctgatttccgctccttcatggagaagctttcgagaaagtatcatggggacacataccatttgattgccaaaaactgtaaccatttcactgaagaagtatgcttgcaggtaacaggaaagcctattcctggatggattaataggatggctcgagttggtaagataactttcttattccagcttattatttctttactggttcttgttgtttggcatatctttttacatggttgcttgttcttgaattttttcaggttcgttctgtaactgtatccttccagaaagcatacagctctcatcggttaatcatcctgaagccctcgagttctctggtaagttaatcatgttcgctcttcttcacctaaaaaaaactgcaataggcatttggatttcggataaaccagttgtgtttcatctccattgtagatgataacgatggatcagaagaatcagttgcatcttctgtgtcatacgaaacagatggagaaggatcggatcatcatctcataacagcaccaaacagcgatattgcgtatctacaggacagaccagtgagacttgcccgtgagctcctccaagaaccaaccgatgatacatctccgcagtacttgttgaagcggtcctgatcatcacaagcatcaacaacttgtgttgtctgtaaacagtgaggcaatgggtccatatattgagtattctttggatctataagtgtaaaaaaagatttaagatttaaatcagaacccatctgagatgttggattgtagtgtaagatttagagacaaatggtgtgacaaaaattgtgccttcttcttctcccaatgtgagttcacatttcagtgtcataattcgtaagatttgcgagactaataattagttttgatttttctattcaatttacagacagttaatggttatggattttcagacattctttgttcttcggttcactcttcgcagctatattttattggaggcggtaacataacttattgggctagcctgggaaaataattatacattgggcccattattttaaataaccttcatcggcccagtttgtgtgtaaacagttatgatcagatccagaccgtccaaaaatagggaggggtgactctcgaacacgatgctctgaagactgaaaaaggcgtaaacttttttcacctggctagggttcttggtcgtcgttaactggtacgtttcaatggtctctctgtactatcatttctgcgaaatgggtcttctctttggaggctaatcgacgttgtgcttaatctaattgctcttttaggttgtttagaggaatatatcacaggttttcaattagattgatctgcttagttttgtaatcagtgtaggttaccagtgaatcatgaacttccgttagggttataagctctctgtttcttttcctgacttatcaatgtcactaatttagatttgatgcgtagtttagcttttgaagatcagggaactgaatatatctggtttaaggaagctttgaattttctgcttgccatggacattcgacttatcagtatttttgtacattttggttaatgtttatcgaattggtttgatcagtctgtggattttaactttacaagttaagatgctattcttttaggtctagttgataggtcatggatttgttgttatatggagtctagacattttgccactgctttagtgttcttagcttctaagggtttcgttgatatattgtactgggtttatcgtttccaggcatctagtatg

SEQ ID NO: 33058 - DNA, 3003 bp, Unknown
  misc_feature (1)..( 3003): 2750-1469P.txt file - cDNA_ID_3065005; gDNA_ID_1620463; Annot_ID_157811
gaagacggaacagagcgttgacgttaacggtggagagacgtttccgtttgtaacgtcgaatttaacggaattatgtgactgggatttaacggggtttcttaactttccgcttctgtcgccgttatctcctcatccaccgtttggttattcccagttgaccgttgtttgattagttttttttgagtttttgaacgatgtgtatgctgacgtggacgtacacgtaggtgcatgcgatgaaaaaaacatctatttgttcatatttttgcgtttttctatttgttcattctttttcacaattcacaatacattatttcagttaatgattacggataatttagctttacgttaatttattatgagtactagaagaaatcggagtaattcaacatatagattatactagtataaatgtcaattgcattgacattaattgaggaattatagtagaacctagtataaaaagaatgattcaaacatgagatattgaccggcgttatgtgaagttgttcagacaataaatgcataaccgtgattctgtctgaacaagtcgattcttaggataaaaaatggataaacttagtcaaaatatttcccacgtggttagacttttgcttagttacatgacgaatgtgaaagccatccatgcatgtatccagaagaatatatcttgcacggcgaattctctacgtattttagtattttagatttgacgacatctaattttcttttggtatttcgggtttgacatctaatctgctaagaaccttttcttataatcgaagaattttgttgggtcgtcttgtaagatattattttcagtacacactatctaatcattcatcaaggtcactaatgggccttgtggtctaaactttgaatatatactttcacctatgaaatccagaagttctggctgggtaagttctaaaccaacctatcttatacatcgaaacacaaaagataattggaactacaaacaaactttacccaaaaattattagtttgtttttatctccgtagatgaaattgggttttctaaatcgttttcgaagatgaacgctaatcaaacaaaagtggtataacacagtttgttacgaaattttgttaggaaaataaatgaagtatgtgttttgcgtcgacctcaaaataaaatacatattaaatcttgcatgctaatattattgtatagaataccaatcaggtaagaatcgctcgtcatcatacgactattcaatatccaaacatatttatttggaaaacccgaccacgaataatggttagctttacatcattatccacacatactcaaatggttaaattttctagaattgtaatggaagacacaatgttatcacgaatgaggatcatcatgcacttcaggttacctaattatcctacgtggacaatacctaatccttccatgattttcaattattgcagataatttttctgaacgtcatcatttcccataacgaataatcatttcctcaatcaacgcaaacctaactatctatgtcatttacatgtttatgtggtaaaaatctgcttagaataagtaaaccttcacatatatattgtaacaaaataattgaggttaatgttattcaatgcgaaaaaatgtaaacacttgctaatgagtcgtaataaccctatattatttttccaaaacatgtttctattgaagttacaaattaagtttccactctatttggatggagcgtactagtcgtagacacggagagcttccaagtccatcggatcaacttatcaaacttatcgaccttttggtccacaacaagatatcttttgtccatcttcatcatggctctcgcaagaggatgggttacatatatggtttgctttattgcttaatagggattaatttctctaatacttttgattagcttttcgcaaacatttttcagcataaggacgcatctgacgtacaaattaaaaatccaaatgaactaaaatacttttaaacagaaaggacaaggaatctaagccatcaaggcccatctccacgtagctccagcaacgacaagatgctttattatcccattctcgtggatacttgtgtgagatacacgcttcagataaatcaacggacgaaattgtaaaaagcgtgaggaagagagagcctctttccaaaggagagggattggatcattgagatatatccgtttatccatccttgaactcctgaagattccttcgcacagacaactctctcgaacatgttaaagattctctgatacctaactattgattcctttttccctgcatttttcgttcactatttttgcttataactttttgtactaaaattaaaaatcatgccaccatcctgtatttcatatccaaaagctttggattattttataatatatcattggcttgatgtgattgatatttaccaaaaatctattctagtttctttttgtaacaccaaatgttatttaaaatttgtattggaaaaatgattcatttatataagttattatatccctcttaaaaattgtataaaatctctaagacattattaattgtaaaagatagacacaacacgtagctatatgtctatatccaaaaataaaacacgtagctatatgtaatattataaaaatgtacatatattattagggttgtaatatttggtcggttgaaaattgaaatcgcagctcaattggaaattcacgtgtattttgtctttgattgtaagatattaaaactgttcttcgctttccttttctcatttctcacttaaccactcgatccactttaaaccacacattataagtgtgcctcaaaaaaatctaacattactctctcaacacatctctctttcttctccatttccttcttctctttcattctcttatttaagatttaaatctgctcaaatgcttgtaaacaaatttcaagttctttaaacgatttccttttcaagaaaaatccttctccttcttctttttaccacatagatcttcttgatctacaatg

SEQ ID NO: 33059 - DNA, 3003 bp, Unknown
  misc_feature (1)..( 3003): 2750-1469P.txt file - cDNA_ID_3065013; gDNA_ID_1620463; Annot_ID_157805
agatcaaaacaatcaacattgatttacttttcttaaattactgttactgtaaattacatgaaaagaaatgaaatccaaaagacgaaacaaacaaacaattattacaagagaaaagagagtagctagctacctttggagattgaagacaacacaagacaagactggtgttgggtttggtgatcatttaaaagttgagagacgaggaagtttgtccctcagatagtaaagtcttgctcttctcactttcctgtgacttaccacttttatctcctttatgttgggagagtatctgttaaattcaaaacacacatcacatcagatacatattctaaaccaagatcaaaacatattacttgattgtgtagattagtatctgttcaagatcaaaacatatcagttacatattacttcattgtagaatcagccaatagtactggaaagttcatagggactagtatgttatgataacggctagactctagagtgattaagattaaaggttggtgcgcgtttctgtagtaaataagcacaaagcttggtgacctataatgctaagacttccagcatttatgtactagttcctatagtatcatacttggagtagcaattatttccttttttcgtgaagaaagctaatacatatgatcagatatagaattgtaaatctcttaagttctcaagaagcgaagactatgactgttcacgataaaagaagctaattccggtttgttttagagttcctaaaatctctctcaaagccaaaagactccttaacaaggtcaaagacccttaactctgactatctaatactatttacatttatacttatcaatatacccgagtaagtgtgtgataataggatagttaaggaagaataaacttacatgggaaagacgatttcaacaccaatgcctgcaataatcctccggatacggatagtagtgtggatgcctgcattttgtctagacatcacaatacctttgtagatagatagcctacgtttgttctcaggaacttcctgtaaaatcaaacccaccatgtcgtatcaaaatcttgcagttaaatgcataaattgcataagattatacggggacaatgagttttaccagtttgatttctacaatatccccagtcctaagtccaggaaccggtcttacagtctctgcaacctcaatagctttcttgttcagtagctacagaaacaaaaagcaaatcaacatttcatttctccaatgcctaaaagataactgatgatttaagaacaggagccaaaacaactacagtatcagacatgtataatcagattcagagccaaaacaaaacactagacaatctcatagaatcacattggataatgaactaacccccatgatatctccgagcttgactctcgtcttccacggaggtttagcttcctccgccgcaacagtggcttctccttctccttccgcttcagtttcaacagcattctccacaacagcctcagtttcaccttcagtactctcttcagctttagcgataaactcttttctcttcttggaatcgatggcgaaaccaaaattggagctcgaatgattgagaaaaaccctagaaactgatagtcttgagttcactgatgatgctcgtggtagaattgaagaaacccctaaattcttcgacgagaaagaaggggttctcggtatcatatgcaatgcctggttccataaatggtagataaatacagaattcaaagaagcataagtatgaaaatgtgattgagcgtgagagagtgaagaagaagaacctgaggaagaagatgagagctcgtcgccatgtttgcacaacccaaactcgaaaccagagtaaagaagagccttatcgcttatccgctccgtgtatttcaatttatgggccatttactaattttatgggcctagacatttaggcccatattcaattgatataacaagaaacccattaccaaagctggttctaccagtctaccaccacgaaccaaggcttgtccaagtacactaatgtagaaccaaaaatggtttaaataaagagtttctgttacaaacaaatgtatgtttatgtgtccttaaattgatagctctaaataatctactttgggccttttaaaagttatgattgacgaataaatttctgctggagttgaaatattattctatgtgactatgttgtatattcaagtcgtctacatgttcacgttacattgacttacaccgcaagcgatgaaaagctattatatgttagtttaatcagaataccaaaaagataataatcaaaatattccatcttctttctttgtgaaacgaatatatattctcttacaggtggtttaattaaaagcttgacaacagtacgtaatattagcatacatataaaaagttacattaattggatacgaaattttaatctcctaaagatagttattctccgattgtatagaatcaaaaaagaaaagaacaaaaatcgacaaagaagaagaaaaaagattgattgattcttttgtcctccacgcatctctctgagttggctcggccacgtcagcattcaaacatcaaaaccaaaacgcatttaaatgtcgaaaagagtgggtccctttttttcttttttcttaaccgtgtcattgacaaaaagagcacttaataagccaaagccacatagaagaaaaaaaaaagaacattcacgtctctctcgtttttttggccgacgacgatcgctgaattgactgccggagattcctttaatcgtcagattctcgttgagggataatgaatcctgaatagtaagaaacttgtcttctcgttgtttcatgtatctattgtttcggatcgatccgcgttttttattttttgatgtgtttggtgatttggtttttgttcgattttgctttggatctttgttggttgttaggtttgtgaattgaatctacctaattttgctcgtttaaggtattttgtattagaattttgtatagatttggattttcgttccatg

SEQ ID NO: 33060 - DNA, 3003 bp, Unknown
  misc_feature (1)..( 3003): 2750-1469P.txt file - cDNA_ID_3065047; gDNA_ID_1620464; Annot_ID_157851
tttatgtagtgtaattgtaaatgttagatatgtaaatggggtttggagaagttcactaaactaaaatacttgttaattattgatgatataatactagtttggtagatcgaccctattttgtcaaaaaaaaaaacggtttggtttgtttgaattgaagtacctgtgcaatgtgtttggcagatataagctcaaccataacaaaggaagcatgccatccttgctttaacccaaagatctcaagtagtccatcatcggcttgtgcctccacaaaacctctctgttacgtacaacacaagcaaccgttaataagaaggagaattgataagtagatttgtgaagtgacgaaaaaatgagctttgttttactttttcaagataatcttgtttgagatttccccaagggtttcttccacttccatagctatgtagattcaatgcaacaactgctcttacactgtcccaaaaacaagcaaacacacatctttcattagaaacccaattatgagatttaaaagtgttctgtctcatttgtgttcttgtttctattctgtagataccttttgggaactggtactttctcccactcggatgagtccaacttttttatatgcaatgtcataatgttcttgagacccctaaaaccagataattacaaacgtgttaagaccacaatttgaggttgtaagttgtaacatttgttgtcttggtgttagtatataccttaaacctgggtcatttatgcagtgagtgaggaaccaaccctgagagcaaccatatcccgagtatataatctgcaacaacaaaatgttagctttctttcttgatataaaaaaaaaagtcttagagaaaattatcattctcaagagaatttggtaaaaccttattggcgatagggccatttgcaaggtaaggcttttcgttgcgcaaatggtgaaaaccgtaagccacttgagcatccatacctatactaaagtaattgtagaagactccttcatagccattcgtcgatggagggatctctccctctatctccaaattctgcaacacaaaaattaactcattaaaaccaaagactaataatcacaaaagaatttcaattttgtgtactaatgaaattataaacctggtcaatgtaacattcttgtgtagcctttaaagaataaggaggatccacaatttcaccagaaggcattgtaatcagaatattccaactacatcaagatttcaacatcaaaagattaagcagagagctcaagaaacaaagtgttcatatcacgctttttcgcggtactaattttacctatctaaacggcttataggagcaacacttgctctatgaagtgttcgttttatcgcagatttccacgcaaatgggaatgaacctccctaagaaaaccaacataaaccctaattagaacagagtattttataagattaaagatacaaaaaaagacaataagatctctttttcacccatccgaaacttcttgaaagatcgtttcccgttccgagtggcattatcgaaaccggaggaacgggtaaccggttttgtaaattaagttcaccgagacatcctagaacccaaccaacggttccatctccacctgcaacctgtaatgagtgatcaaaccagtggcaataacaaaaaaaaaaacacattttcaaatctttgattgtagatcaagcaatggaaaaaagtaccacaattctcatcttttcacgaatctctttagcacattcgtctcctcgagacgcaaatgcctctaagcatcccaatccatatcgaataaactcattaggcttcacttccgttaaatcatacacctgttcttcgctaataagattctggagacgttctttaatgagtggaccttgacgaccaccgcttttgggattaacgaagaccatcaaaggaacttcaggcgtcaacgcgttgttttctaacggtggtgctacagaggaggaagcgtcgaaggaatcgtctttacgaagaatgcaatcgcgtattgcaatgcggagatattgaggaagcataactctttgacgaagctctgctttagagactcttatgctcgcgagattgaccaataaagagactttcattgctccgaatgagtcgagagatgaatgtcgtggaatcatcctcgccgtcaatgaatcaccaatcgacggtgattccatctctttctctctctctctcgctctgccaaaaaagatcgaaactttttatcttcctgaagaatcagtatatgaaaaacagaacaaattgggaattctgggttctttgtgaaaagataagaatctttgttgttgttttttgatgaaagaaagaataaaatctgaaaacgaaaaattcgttagaggagaaaaaggaaaccaaaaattgaaaccgatccgagaggaagagatttgttctgatttttctgtttgttttgtttttttcgaccgttgagcttattttcaggacaaataaaaaccgttcccttctcattaactaccaactttttgttatttatataagcccattgggcttttataggcctgttgtctgtttataaaagcctgtagagttaaatctgcaaatcacaaaggaaaacgttaatggtggatctgagcactgtcaatgtcatcaccaccgaagtagagttgactccactcaacagaaactgaaactggaaagtttgagacttttaaggtaagctcatcttgtattcattgtctatgttttgcattttttcaaaggttaagtttttagggttttgcaaacttgaattctcggaaagacgaaaacttgtaactccgattactatagacttttttctgggaatccgatttggggaaacttgaatgtttacccaatttgacttctttgtaagctaatatggtattgtcttagatcagagcaatgcacatgtgatgttatatctgagatcatggaatttaaagaagaaactttgtatcatgagtaatgttgatatgtttagtgatgaaaagttctcagatg

SEQ ID NO: 33061 - DNA, 3003 bp, Unknown
  misc_feature (1)..( 3003): 2750-1469P.txt file - cDNA_ID_3065059; gDNA_ID_1620464; Annot_ID_157845
gcatgctcatcatattatttatcaacgatacattctttctttatattaatattggctagcttaaaacttataatacttgttgagagttacatattagttatcctagagaaacaactcaccaaatgtgcctttggattatacattctctttatctattttatacatttttcgaaattggaattattatggagacattagacatatatgaatattttgagttatacttattttatattttttataagtagagttacacttatttaacaggttagcattacgagttcaaaaagaagaatttagttttgctgaaataaaagcttgtgtttatgtctttaatagctcgcacaccacctaaatgggatttaaacttagccatacaacgatgataacacttacaaaagatcatttatatatacgagacggatcccgccagtagtatcgggaggaacgcgagaactgtttatgacattgcgacctacacttgtttaaacatcagataacatatgattaatagtctaaactcaacggtttattgaaacagttagtgaaataggccgaatttaacgtgaaaaatacgtaacagaacgttgattaatagttatatatatgtggccgacgcaaagcatgacgttttctgcacgagctgtcacgcaaggtgacgacgtttttaatcaaagtgtttagggactataaacgtataaattaatctgttcgatgttaatagttctgatgccaagatgcggttcggttttctaaaccggatcgaaagtgataatttttaaaaacttaaaccctaactggctaactctttcactgacgacatacataacacatttcactgactaaacttattttgattagtgtaataaaagagtaaagaactccagtattggcgtattgcttacactgattctgtcatctccacattatttatgtcaagcggatatgttgggttcctattatttcccttttatctagtttataaaactgttatgttattattgttatgatgtactatataacatcctcgtttgcggtctcaaaaaaaaaaaagacaacatcctcgattgtggtggaatctgttccgatatattattggttaatttttgattgaggcgaactaattatgtaataagtactcttcttttctaaactttgaatcatatatagtcaaatattgaaaataataaaaaagaagatacagaaaatttattcgcacatgattttaaaattgacgataaaatcttgagatggggtcaaaatacagtgcattttagtgcccaaaacagcaaaacaattttgcgtggatctcatgtcggaagataacaataaagataaatatcattggctatgtaatatatatagatagaactgtgatataaaaatctatcgcaatatttctattgtacaaatatgtttcctctaactctttcgtatacgtggatagataaggattttgatagtgttgccttatatcttttcttttcactctctttttaagtaccaaccgttgcgtttactttgttcttccttttggaactagaccctaggtcaaacgggcctgtgtaaatttttggattatacagtttttagccggtaaacgaaaaagaatgtattttactacctaagaagaacatatcagaaagcaaacattataaaagaaaatatcgtataagtatacttcatcatttaagattattgattagtaaaatatatatcagaaagcaaacattatatcagaaagcaaacattagaaagatttaatattttgagagaaaagataaattataaggtatgatcttatgagaattgaatctcgaacacgttgctttataacacactacaaaatgtatatttttattgataatatattaccgaatcttcattactaaaaccgcaaaaagaaatcttaagtaaagctataccttatgatttctcgaagtcaaagtttctgtaattagaaagaaaaatcaaatttgctttcatgccgaactgtagataaagatttctaaatcatgccgaccatactgtccattttttcaatattatttaaaattccatgaatatccatcctcaaagggccctgtctagaatacgatacaactagtatataataagtctacaactacgtaacggagttatcattctaaaagataatacatatttgacaaaataaatagaaaattaaagtttttaaaaaaatatttgtaaaatttatgaacatagtggtcatttggtcgagaaagaagattttttttttcttttaagatgaaaaaattgtatgggtcattaatatcatcttattatttaaagatgtacaagctttagcttatctcatttaaggatgtacaagttatatgcatacacacgcaaaaataaaaataaatcaaagtttaatatttagtttggtgagaagaatttgagtcattgacataataaattttgaaatcatgtttgaaaaggagactataagctagtatcggtccctagacgaaatgatgcctcaagaacatacgaagtttattaattaaactttatttctattcattaacaaataaaacagccaaaacaaaactaattcaataccgacatgatagataaaatccattcaaaacctcaaacaaatttgttttggagttaacagaaataaaatattttgaatttgtagatactcctacatgaaagaaaaatgaattacgatatcaaggaccagcctaattattttattttgttagcctaattttcatttctacaaaacatatctccatcacgattttattaaaacaaatcccataattcgattttattatgtggatgtcatgtttacacgtgtcatattacaattcgttaaaatacagtgtctcttctctgtccgactgggcatgacagatcatccaagcaaatcaaatacccaactctcacacgttctcaaacaaaaacttcaaagagagagagagagagagttttgtgaactcaagaaaataaaaaaagttatagttaatg

SEQ ID NO: 33062 - DNA, 3003 bp, Unknown
  misc_feature (1)..( 3003): 2750-1469P.txt file - cDNA_ID_3065076; gDNA_ID_1620465; Annot_ID_157892
catattgtatgaatgtaattactatgatttaagggcactgcttttctgttttcacgttgttttcgaaattgctattgcgtgtgatatctgtgttggaccaattattgaaaaggacaaggctgactctggtttttaatgagtagtccccatgggagttatgttcatttaccacacatttttttgtatagtatagtatgagtttttatttgatatcttttatcttcggaaaataaatggttcaaattgtttgtctaaaaatgcacacatgaatatcttgtggtctcacacaattgtaggaaacaaattaatatttgttgcgaaaataatgttattattttatcatacgaaatcctagagaaaatggtggcaaaagaggcaaagactaaactaatgaatttaaaatatgaaaatgatggaatgactggtttaccaatattacagtatattgtaattttataaaaacgaatcctgaagaagagggcaaaccccaagaccacgcaaatcagtctacaaatatgaaaatttccaataactagaaaaacatgtgcatttatctttttccatcattcggatttttacaatggaaattttgaccactgagcgcaagtgttatagtattttattattatccaatattaatatcattattcggatccatgcattctatataactatgtccaccatcttacttgtgtctatgttgcaacttcaacgtcgtatatatatagggattgttgtcacgaatacaatgctaattaaggaagattgtgacttctcggaaaatttagaactaattaagagtggaactaaaatgccaatgaaaatagcctaaatcaaaggagaaccacaaatataaattggaagaccttaaaaaacaattaaacgaggacgaaacaaattttggaatcatcaattatacgaaaaaaagaagaaagaaaaaagaggtttcatgaatcacagtagtgctgacaatcttcgaaccatttgtgggtttcatacaatcgatcaccaatagaacaaaagagaaacagaggaacagaaagaatagaaggagtgggaagtgtatgaggaagctgtgtccgaacatagacaaagacgatggtctggagacggtgttggaagttccgataccggaggagatgttttccggtatgggcaacaacgttgcacttaggtggcaaaatatgatgacgtggatgaaagctcaaacgtctgataaatggtcgcaaccgcttatcgccgctcgtatcaacgagctccggttccttctctacctcgttggctcgcctcttatacctctccaggttcaagtcggtcactctgttcataagcccgtcaaagattgctccattgtaagtcattcaaaatcaatccttatgaaaacataacaaagatgttgaaaatatgattcctcttttttttttctttttttcttttatgatcaaaacccaaaaaagtcattaccctgcttcgtaagtattcaacataaagttgttaatccatgtgttgtactctgcaagtctgcattacattattcatcgtacacagagtcatcaacttcagtttcattgtttttttgcttatgaattacgattgcagcaagcttcaacggcgaaatacattgtacagcagtacatagcagcgacgggaggaccacaggcgttaaacgccgtgaacagcatgtgcgtcacgggacaagtgaagatgacggcgtcggagtttcatcaaggagatgattcgggcgttaatctaaagagcaacgacgaaatgggtggtttcgttttatggcaaaaggatccagatctttggtgtttggagctcgtcgtctccggttgcaaagtgatatgtggaagcaacggtcggctttcatggcgacattcctctaaccagcaaactccggcgtctaccggaacgccaagacctctccgccggtttttacaggtccaatccggttattgattttttttttgatgtaatgtccggttctcaaaatgttgaaccggtggtttatttattgtttgagcaggggttagatcctcgttcgacggcgaatctgtttcttgacgcaacgtgtatcggagagaagataatcaacggtgaggattgctttatcttgaaactggagacgagtccggcggttcgagaagctcaaagcggtccgaattttgagataattcatcacacgatatggggttattttagtcaaagatcgggacttttgattcagttcgaagattcgcggcttttgagaatgaggaccaaggaagacgaagatgtcttctgggagactagtgctgagtcggtgatggatgattaccgatacgttgacaatgtgaacatcgctcacggcgggaaaacatcggtcacggttttccggtacggtgaagcgtcggcgaatcatcggagacagatgacggagaagtggaggatagaagaagttgattttaatgtttggggtctctccgttgatcattttcttcctccggccaatttgcagatcgaaaaatgatttagctttttattaaaaatattgttattcgtttttagccgatatcataactttttgagatacattatcaacacactcgtgcaactgagatattcttgacacaatttttgcatttgaaattggcaattttgtactactcatatagtttgaagcttcaattcactacaaaggttattactaattgtgtcgacaaatccagcagatttaataatgcccattccattaaatgttttttagtttaataataggatgatcatatgaccaaaatcgtaaataagggttaggggtaaacctgtcatttcaagcttcccgcccatgggcgctactcccaatttaataaaaaataagaaaataggcgtaaatatgagagtgtgttttttcaatataccctcggttttgaatttgctctcaaaagcgacggagacgactgtttggctcggtgatttctcccgccgtttgggtttttcttaccggaatttccttctccttcgatg

SEQ ID NO: 33063 - DNA, 3000 bp, Unknown; identical to SEQ ID NO: 1907
  misc_feature (1)..( 3000): 2750-1469P.txt file - cDNA_ID_3065081; gDNA_ID_1620465; Annot_ID_157889

SEQ ID NO: 33064 - DNA, 3003 bp, Unknown
  misc_feature (1)..( 3003): 2750-1469P.txt file - cDNA_ID_3065085; gDNA_ID_1620465; Annot_ID_157885
ctttaattggtaaaaaagaagaagataaaaaacagttcatataatacattatcaaatacgaagtcagaacaagattaagatcgtatcacgtaagacggagatcgactttcttcgttccagccttgacttaccatataacaagttaaatatatttgtctcattagaatcacgggattaatgttacgtaactacggagatagcgtgataagaaatttggttacaaaacattgtatataaaaaaactaaatagagctagttaagtttcaaatctaattttattttttgattaatttgatgatttccttccatagaaccataaataaaattcaatcatttcctctattatgaaatttaattatatattttgttttattagagagcaggaagaatatattacgtaatatcaagaaaatttagtcataagaccatatcataataagcggaattttcaacaacaaacatccaattttgatttactattaactgattattttctctgaccggagtgaccgccattatttagaataatgttctttgaatgaatcaaattttatggcacccaaaagacagaagccacggcatccgtttggcattttatagtgatcttgcattttataattttgatttgtattttcttataaccgctattataagtttaacgtttaaagctctgtatgttcacctgacaaaaatgataagtaaaaaaaaacaataattttcgtgaatctcaatattttcattggtggtcgtaaagccatgtgatggaatagttaccaacgtgagtcgtgatatatgggattagaaaatgtgaccaattggttaccagcaatcaaacaaacgataatccatggttgatgaagaaagtagggttaggtttgtaaaaaaaagaaatggttgtgtggtgatctaataatacatgggctataagtttataattgcattcctgcttattaaggtactttcatcatagaatcaaaacagttactatctttcttttctcctcactttttgtttttcttcttcctttttcgatagaatgtctgaatgtgtatacaattcttttcaccattggaatatgtgctggtcaatattaattactgatttacataaaatataatatcgggcatgtgatccaccatctccaacgtgagcccgatcatgtggtgattaattggtcatttttctatagattcctcagaagatattttatgaaatacatgatcataatattgagttgtatacgacaattgagggggtagctagctcttacgatggaccaatcatctctaagaaaactatatatataattaaagtaaaccaattaattacgattactaaatactaacaaacaaaaccatatatatagggaacgcgaaaaaaatattagatatatatttgattggtttaactttgaatttttaattataacccaaaaaatactcatagttaatttcttttttggtgatatctgtttactttttactctacttcacgttttttttttcttttactctacttcacgttaagttagacaaactcttgttccatttttcattttatacaaaataatataattacattactaatatatgtatcgttatgctgctatgttactcaaaatgtaaacaaaaaaaagagactcggactggtctttacgccagatctaaatagggtcaaccatcgtgctatgcactctgctcaatctgttaaaaaaatacagtctacatacaccgacaataaggtttgtataatatacattatctcaaaaatcaaaaacaggaaacttgggcaaaatctttgaaattttaattatgtatcgttcctacaagttttttttttttaaatggattcaatatgtaacatgttagtcgagtcttaaaaaaatatcatataggtaacagggaaacgatttaacgataataggttccacaaattatataagtttcagctaagttaaataaatcattatgccttttcataattactttatttagtttctgattctaaaagcaacttcattaggggtgtgagaaaggatatctaattctcaaaacaaataaaaattggtttttactaaacaagtttaagaaccatctttcacttgggagattttcagaatcattgagtctcttccttattggttctaattttttattaatcaaaaaatattacttttgttttagctaaaattactattatattgtttagatacttaaccaatggatgctcaaaattagatgagtttctcaatttaatttaaactaaacataatattattctagtaattatacttagtgggtatctaaactaataaagatgctctaatatactatatactaaaacaatatcgacttctacaaacattgatcccataattcaactataaataatgtacagtaatttcttgaccaaacagtatagtgtacctctagaatattgctcaagcatctctgcatatataatattactaatcgccatttagtgtcttcgtaacaccatgtgcacccttagcagacaaaaaaatacaactcacacgcaaaccaaacaagcggttaaactgtataatcgcaattggtatcacttattctagaatgtttccacaccacttctttaacttaattagttttttaaaaaaactaatcaagttttaactacttatttagaaaattacaaaactttaaactaaatatatataattcaatgaagattcagatatgttattgcttttgtctcaatacttaaatttgcctaaaatacaaggtaagaatattagattacatatacagtataattactttatttcattgtttgtctttcaaataatatacaactattaaactacaatttatagtctatatcaatatttttatttataaatgttataaatctgcctataaataagtaagtaacccatatacaacgaccatagaaacacatcattaacaaaacaaagcctctctaaataaaaacaaaaagctaactgaataagaagaagtagtgatg

SEQ ID NO: 33065 - DNA, 3000 bp, Unknown; identical to SEQ ID NO: 1912
  misc_feature (1)..( 3000): 2750-1469P.txt file - cDNA_ID_3065116; gDNA_ID_1620467; Annot_ID_157919

SEQ ID NO: 33066 - DNA, 3003 bp, Unknown
  misc_feature (1)..( 3003): 2750-1469P.txt file - cDNA_ID_3065174; gDNA_ID_1620468; Annot_ID_157955
ttcttgtctggtgttcatggccttcaaggcgagatttgcataaaaccaaacactgattttcctgatttacgtttctctaaggtattcaaaggatagaaatttgaagaaagtttgtgttttttttcttctcttttcttgaaaaacaaatatgtataatttgacatttttttttaccattggcttgattgtttcattagcctggtagaagatggttaaaacaacaattgttgggacaagataagattgatgaggttgaattagtcgaaggaagacctcatcctgcgcagaagagttggattcttaagtttcgagggttggacgatgttgatcaggtagtgtagtgatccatgggagattttaaaagacacatttgaaaatgatttgttacatttgatggggtttccgtttccttcaggtgagacaactcgttggtgcaactctgcttgctgaggacgatgatcgtcctgagcttgatgaaggagaattttactctcgagatcttgtaggcatgagagttcttctcaaggtatatttgggtttttgccttttgtataatatatcgaaaatgggaaagtctggggtctaaatcagttatcatatacaggagaccggtcaacttgttggaactgttgctaatattttcgacaatggaggaaatgatcttctacatgttttgcttgactcatccatggaagtctgcaatgggaatgcaaagaccaatcagcttgtttggataccttttgtagatgcaattgttcctgatgttgatttggaaagaaaggagatgtatataactccaccgaagggactcctcgaggtgaatatgcgagcagatgatcggtccaagaaagaaaggcggcagcttgtgaggcatattcttcttcgctcttcatattgaccagtctttatagactttccagattgatctttcttggtctcttaaactctacgctctggtcatttcaggaatggaaagaaagaaaaaaacagcagaagcgccttattgctgctaaaaagaagttatgtgaaatggagcaaaagcatgtgtttgatggattaaggtttggagaaaagtctcaaaggaatttacttgctgatcatatccttaacgtaaactccacactacttcagaaagctttgcaaagtattgacacctcatcgaagaggtaaattaacttcaagaaatttcccaaccattgcgagaagtgtgtcttctcatttttcatttaaattatgatgaattagatggaatgtaactgaggaaatcaatgcactgagagctagagtatcggaatgtaatctgagtgtgtcacgagaatgccttagttttgatgcaagcaaagagaacatgggtgataacttcagtttccttcaacaagggcaaaatctgttctctgagggtaaagtttctatttgtttggttctcaatgatcacgagaatgaagaaccagaaggtgagaatggtgtagtctcgtaccttcacgcactacttgatgaggagcagaggttcataaaggttagctgatgcatacttaaaagctatgagattttcttgtcatttagttatgattttacaggataactgttgggttatgtgcaggaagaagatcgcgcttgcgtgccacttgtcatagtttcccctgaacataccattgaagctctgcagaagctatttcaggataatgatcattttggatttgagtcagaaaaggttaaggcttgaattcatccaagaatagttttgcatttcggctatcagattctcacaaagtatatgtctttactaatatatagatctggattctcaaagaagaaacgcttccagtagtttgcagctcaccagaggaaccgaaaaagcacaaaattttgatgaaatctccatgggagatacttgagtccccggttggctctggaggagtcttgagcatccttgcttcacatggaactacagactctctttccaccctgggaatcaattatcttcaggtatcgatatctaaagatcatcgcttaatctctttgaacttgactcatatccagaaattgttcctttctggttctctccttcaaatttggtaaaaggcattaagctttacgatgttggcatttttctataggtacacagtattgaaacaaaaccacaaccgtcacaacattacatcaatcccatgcttgttggtttcgtgagcgcaagaggagcagagattgggatccaagtgaccgaagaatctgaactcaagaacttggaaatgacattctcaatgaagtttctgaagagattaaagggaaaaatcgagtttgaagctgtcatgaagatgaattcacatgttcagaatgttgaaaaggagtgggttgagtcagtaccatcagaaccaaactcgtttgagtttcgttctgatatttacagagtcttgagtgaatgttcttcatcagctaagatttgtttgatgaacattaccgtttagaacttgtacattttgctacttagttgtttgtcctcacatctaaaaagcttctagagacgcaatttatgcccgaacacattactcaagcaagagagaacatcattgtagcttttgacaaatcgatgataacaaaaacccaaaccaaagctattgctctttcatagcacaaaaaaatatattttttatcaaatttcaaaaatatatccctctttttgggaaacttaagatccaactgttgatttgcagccaaaaaagatcgaaccgttgattctattgaccaatctctgatctttaacaaaattacatttttgaccatcacacagagaaccctaatttatatatttataagaaacttcagtcttccgaaaaacatcctttcacattgcggcggaggaagctctaatcaccgtaagcttctctctttcactctctctgaatctcatctttctgttagtttatgtatatatatctactgaaatcgatgcttcgtctcacgcataccttttgttgattttgttgaggaagaggagtaaaaatg

SEQ ID NO: 33067 - DNA, 3003 bp, Unknown
  misc_feature (1)..( 3003): 2750-1469P.txt file - cDNA_ID_3065190; gDNA_ID_1620469; Annot_ID_157984
tcttatgactttgttttgtctttcaaataacatccctaagtattaggagatagactagcatttcagttccgtttatttagcagtctgttgcattcttgttatctttgtaacttgatctatttaagatctctatcgtctatgagaataacacacaagttacacatttgttctctgagtcactagttcgtttacaacaattgtaacttagaaacttagtcaacgctgggatatatcctcctttcgagtatcatcaatcttggacaataaagccaaaacaaaacgaggtgaattcttaccaatatgctctgcatcaacaaaactaagtgttctagtataatgcaagtaatcaaagagagctttttgagcttcattcttcatagctctcgaaacccgattcccgaaaacccgtgtaggtgactgagaccaatgtcgtaaagaagatttatccccacagacaaatctaccactctgaaaacatctcactgcactataaacatgacaaagcttcgaccttgaaatgtggttttgatgagcaatggagaagatattgaattgagcaatcctttctagtttttccagaaatcttgagaacatcactgaaaccctaaacactaaggcaaagagaggaatcaaacaccaaccctaaaacccaaggacaaaatgcaaagctatgtaagattcatcaaaaataatttctttccttgagaactcatcaaaataattgatatttaccagagaattaaggactataaggcgattgaatcctccatcttcacctaattttctaaggtttcatcgcacataatttctctgtgccctttgctaaaacctccatctcatggctctttacttctccgactgtgatcttttcactttccaggcaaccccgagatgcaatttactaataggcccctgaattcttccttgtcatattaatgtgaccatatcttttcttcctacttatcagtatttgaaaaaatggtctaattggtcgtatatcggaaacctaaaaagtttctcaaacaaaaaaattattaatatttacttaattaaatttttattttagtgaaaaaattgaaccatttaaaataagagaaatgttatgatgacttgtatagattatctcatagtttttcacttgaaaatttttttacactctctctcttctcttttcattttctaaattattttagtagtgagaaactatcttgaaaatttttttacactctctctcttctcttttcattttctaaattattttagtagtgagaaactatcttgagagactactaatggaaatggtcttagattctgactatacgttcatgtgacgtataaattattactttgaccgcttataataataaaaatattttatgctataatctgttatgttggctaatgcatctttcattggaaaaattctgttaactaaatattttttccttacatgatatagagattctaaaatgagctaattgacatggtacgctctgctcatcattttctaagacgaattcagtttcaaattcagagtctagtagagatgcttcaatcaggagactaaccctagtatgatgacgattcgctgctataggtctaacataaaaattattcccatacctagaatcactaagacaatgaaaaatacccttcagaaagtacgtcatggtaaacttcaaatcctctaaatcctaaaagattatcctagaacgctccttgacactctacatttcttattcgacaattcttaatttgttttcaataaatagttgagttaaattgaactgattggaggtgttgttctagtaaattaaaaaaaaaactaaacaatgttttgagcataaaaaattattacgttgataagatttaacatataacttctaattgtaaaaaatatagtacatgaaaactatacgaaatatctaaaaataataatttatgtcacgtttgtgattagtaattatcaaaagtaatatactttacacagtatcaatacgaggtttccattcaaaactagcattttcgttttttgtattttatataatatccattcaggcccggcttagaggcagtgctggcagtgctaaagcactgggtccaccatttttttctaatttttacaaggttttaagatataaattttttggtggagcggcttacgtgtgaagctccacaaaaatacattttaattggacaacatgcaaaatgatatactactgagtacaatatctatggtgcactcattggtacgtcataaagaaaataatattatctatataattttctgcaactctttatataattggttacatttttaaattaaaaaatgtgatagtttttgaagataaaaaaacttataatatgtttttcgaccaatatatcatatattttaaaacagaaaagcaatatatatttccgaaaattttattttttacactacaacgtataacttactagtgtgtattagtttatgtcatttccttatcatccaaattcaaacttgcataaaatatcctaaatataatcacataatatcaaactatcataataagttttaggttcgcaaaattaactttattccagtgatgattgatgaagtgcggtccattttatgaaaaatgacgtaacttaaaatatcacatggaaaagtacatataaagcttaattagtttaccaacattagttaaatagttaattaactccatttttgattcgctttttccataggtgtttgattccactaagtcgtagtatccgtgtagtaggaattggttataaaacgatcaaatatattaaaagtaaaaaagtttaccaacattttttaaatactaattcttcttccttaattagaaagcacagcaaaattgtttgaataagagttttgaaaccctcgttcatgtctataaataccggaactaacttcacactaaacatatacaaaatcaaacctttcattttacatttgttttctttttcattatctttgtaagctaagcgatg

SEQ ID NO: 33068 - DNA, 3003 bp, Unknown
  misc_feature (1)..( 3003): 2750-1469P.txt file - cDNA_ID_3065206; gDNA_ID_1620470; Annot_ID_157994
cttcacgaatcaaatcataaccggtccttaaccagctccagttgagatcacaaatatattttattttctgttctttgaaagtttgaaacaaatacatcataccaaactacaaaatttattttatatttatcgtatttgttcatcaaataaacaaataagaatggaccggagcaaatcataatgataatcacattcatgagcgcaaacattacaaaaaatgttataccactgacctgttgattttcttaagtaaacaatcaaaagtaatatcaaaagcatctcgaaacttttcaaacttagcattggagtctccatataccaatccaggcaaaagctgttgaactatgtaacttttcatatcctttttctcctttagagtctttgccttcaatatctccaccacatttactctcttttccttcacatcttgttcgcttatatacactgagtacttccgatgatcctcaggaagatgccacgcgtactggtaataagctgtgtacggagtaaagatcaccggaatgcagccggagattagtgaatcaaatactgatctccttgttgcactatctccaggcggctgcagacaaaactctgaatcttgaaacaaatcaaggacattcttgggattcgtgcagctttcgtttgtacaatttaagaaccgacattggttggaagatatgcattgctcgattagcgttgatcggatgttattagggttatcgggtcttgcacctcccgcgaagcttactagattccggcgaagtttactcatgatcttgatctgccagcgggtgatatcatcatctgttcgcggatggaaataagttgggtgaggaatggcgatgtcgttgacctgccatggctgtctttctatgagtagcttggtagggttttgcatttcttgtagctcaaggaaccttgagccccaagggtccttatctctcctaaaatcccaagttatttttcctagaacgaacacatgatctttcccggcgtttctcctccatgattcctttgaattaagccattttaaaacctcgatccccaaacggtccttcacatcttcagaaacattcctatagtgccatctcaaaacatcatacccgccatagtaagggacaaagaagagcttagcttgggtctcgttgtaaaccctacaaggatgcttcaaaaccctagagtgtaagatgggctcaagagaatacatgtgtgtagcaaaccaacctttgccaagattcttaatagcttctccaaagccttcattcttgaagtagctacacaagttaacccctggaagtatatcgttgcatcctaccaacaaatcgctgttgaattttgacggtaaatcataaacgtaaactcctttaccttcacacgatcgcggtttattgaggttttcatctcccggagatagccatgatctttgtaggtaaagatacttgatggctgcccttaacgcatatccctcatcttcactcgtaggtttgatgtatttgctgtattcttcctcggcttttagttcaatgagtgaattgagatcaaccttgttctttgttttgtgttcttgaacaggaactgaattaagaatcttgttgtgatccttagaaactctatctcctgcgatctctccggcgaaagttacattttcttcagaaattatttggaaaccgggtttagaaccagccgtgttacaataagggtcgttgaactttcgagagaagatacacatatggaagttgttgtaggagattccggtggtgaaagataaacaaagataaagaagaaagaagaagagaaataatgcaggaagagtatagtacaagaatctgaagaagacagaacatagatggatacaagaatcttctatagtctttgaagttcttgactttctctttgaaaccatttttctgacttggtcctttacttcttcactttggatatttataaaaactcatttggttacctatgggatttatattgtttactttattttaaccaaaaaatatattttctctactaaaaatagcatagaaaattaatgaatagataaatttaagtattaaattttctaagaaagtagctgaaaatattttcctatctatgtaattttaatattttaactaggggaaaacttactgtttattttatttttatttctattttttcctttcctttcctcttatgttaaatgatgaatttatgttgtataatcagaagagttagaatgaaaatggaaatatatagtgtacaaaattatactaaaacaggtcagttttgttaatatacattatacttttaaacatagaaatatatagtgcacaaaaaaataagggactatattacttttcaaatgcaatagtatacaatgctatttatgatatgtatgccatcaatatatattttagtctagctacatttattgaaatttgcataacttatgtgctacagtacttgaaagaaatatattctcagaaaattatatattcaacatattcagttttataaacttgtgagtaattccaaaactaattaattttgctattagcaaatatgagttgtttctttagaattttcttttttgacacactgttgagttgacttggatactctgctttgctgtgttcattttggatattaaaaaagatcagaactttattttgttaacaaaaaaaaagaagaattatctggcaaagtgtttaatttccgagaaagttgaagcagagaagcagaaagtttcagaattctcttttctccaagtttaacgcttttttagctcaaagctcacacacacgaccactctattcctcctttaacctttgtgtttgtcaatttgtgtttcctcttttgtcgactcatttctcgattcaatctcgattttttttttttttttttttatggaaatctaatgaactttttttatggatttgatctgttaaagtttcgattaagaagatagtggtttaggtttacggttttgtaattgatttattatctgtaatg

SEQ ID NO: 33069 - DNA, 3000 bp, Unknown
  misc_feature (1)..( 3000): 2750-1469P.txt file - cDNA_ID_3065210; gDNA_ID_1620470; Annot_ID_157992
aggaggaatagagtggtcgtgtgtgtgagctttgagctaaaaaagcgttaaacttggagaaaagagaattctgaaactttctgcttctctgcttcaactttctcggaaattaaacactttgccagataattcttctttttttttgttaacaaaataaagttctgatcttttttaatatccaaaatgaacacagcaaagcagagtatccaagtcaactcaacagtgtgtcaaaaaagaaaattctaaagaaacaactcatatttgctaatagcaaaattaattagttttggaattactcacaagtttataaaactgaatatgttgaatatataattttctgagaatatatttctttcaagtactgtagcacataagttatgcaaatttcaataaatgtagctagactaaaatatatattgatggcatacatatcataaatagcattgtatactattgcatttgaaaagtaatatagtcccttatttttttgtgcactatatatttctatgtttaaaagtataatgtatattaacaaaactgacctgttttagtataattttgtacactatatatttccattttcattctaactcttctgattatacaacataaattcatcatttaacataagaggaaaggaaaggaaaaaatagaaataaaaataaaataaacagtaagttttcccctagttaaaatattaaaattacatagataggaaaatattttcagctactttcttagaaaatttaatacttaaatttatctattcattaattttctatgctatttttagtagagaaaatatattttttggttaaaataaagtaaacaatataaatcccataggtaaccaaatgagtttttataaatatccaaagtgaagaagtaaaggaccaagtcagaaaaatggtttcaaagagaaagtcaagaacttcaaagactatagaagattcttgtatccatctatgttctgtcttcttcagattcttgtactatactcttcctgcattatttctcttcttctttcttctttatctttgtttatctttcaccaccggaatctcctacaacaacttccatatgtgtatcttctctcgaaagttcaacgacccttattgtaacacggctggttctaaacccggtttccaaataatttctgaagaaaatgtaactttcgccggagagatcgcaggagatagagtttctaaggatcacaacaagattcttaattcagttcctgttcaagaacacaaaacaaagaacaaggttgatctcaattcactcattgaactaaaagccgaggaagaatacagcaaatacatcaaacctacgagtgaagatgagggatatgcgttaagggcagccatcaagtatctttacctacaaagatcatggctatctccgggagatgaaaacctcaataaaccgcgatcgtgtgaaggtaaaggagtttacgtttatgatttaccgtcaaaattcaacagcgatttgttggtaggatgcaacgatatacttccaggggttaacttgtgtagctacttcaagaatgaaggctttggagaagctattaagaatcttggcaaaggttggtttgctacacacatgtattctcttgagcccatcttacactctagggttttgaagcatccttgtagggtttacaacgagacccaagctaagctcttctttgtcccttactatggcgggtatgatgttttgagatggcactataggaatgtttctgaagatgtgaaggaccgtttggggatcgaggttttaaaatggcttaattcaaaggaatcatggaggagaaacgccgggaaagatcatgtgttcgttctaggaaaaataacttgggattttaggagagataaggacccttggggctcaaggttccttgagctacaagaaatgcaaaaccctaccaagctactcatagaaagacagccatggcaggtcaacgacatcgccattcctcacccaacttatttccatccgcgaacagatgatgatatcacccgctggcagatcaagatcatgagtaaacttcgccggaatctagtaagcttcgcgggaggtgcaagacccgataaccctaataacatccgatcaacgctaatcgagcaatgcatatcttccaaccaatgtcggttcttaaattgtacaaacgaaagctgcacgaatcccaagaatgtccttgatttgtttcaagattcagagttttgtctgcagccgcctggagatagtgcaacaaggagatcagtatttgattcactaatctccggctgcattccggtgatctttactccgtacacagcttattaccagtacgcgtggcatcttcctgaggatcatcggaagtactcagtgtatataagcgaacaagatgtgaaggaaaagagagtaaatgtggtggagatattgaaggcaaagactctaaaggagaaaaaggatatgaaaagttacatagttcaacagcttttgcctggattggtatatggagactccaatgctaagtttgaaaagtttcgagatgcttttgatattacttttgattgtttacttaagaaaatcaacaggtcagtggtataacattttttgtaatgtttgcgctcatgaatgtgattatcattatgatttgctccggtccattcttatttgtttatttgatgaacaaatacgataaatataaaataaattttgtagtttggtatgatgtatttgtttcaaactttcaaagaacagaaaataaaatatatttgtgatctcaactggagctggttaaggaccggttatgatttgattcgtgaagactgaagaaggagcatttggtctaaccagccggttaagagaagtctagaaaaacggcacggcgttttagtctctattgtggaaacagcaaagctaatttggttcttccccagattatcaccgttctgtttgttcatcagtgttctgaaaactttttccgatacacaaaatcggaggaagaagaagatg

SEQ ID NO: 33070 - DNA, 3000 bp, Unknown
  misc_feature (1)..( 3000): 2750-1469P.txt file - cDNA_ID_3065214; gDNA_ID_1620470; Annot_ID_157991
agcagctgctgaagctgagaacatactaacaaactctctgtccactctagagactttttggcttaagggcagtgccaagtttttactcgggggcaagcaaccatctatagctgatctcagccttgtatgtgaacttatgcagctgcaggtacgcaaaaaaatcatcttctttaccaacttttatttgttttattaagtcatcgaaataccaatgtaactaaccatatcaaacattatggagcaaaaaagttgcttccttatctcggttatgacttttgattgtaaaatttattctattttataggttttggatgacaaagatcgtcttagattgcttagccctcataagaaagttgaacaatggattgagagtacgagaaaagcgacaatgcctcactctgatgaggtccatgaggtccttttcagagccaaagatagatttcagaagcagcgagagatggcaaccgcatctaaaccgggtcctcaatctaagatgtaagaacaaaaaacttgaccactttcatcagggtctctatatgagagactccttccccctaaagataagtcattcgagatccaaacactccgtttaatttctcatccagtttcatggatcttccataatacagtatccaatttagtagtattggtgggacgagtgatggtccaaacctcgttcaagacacaaccgatcgtaaagctcgaagacgcaaatggagtccacctgacgatgtcattctcattagtgcttggttaaatactagtaaggatcgtaaagttgtcgtttatgatgaacaacaagcacatactttttggaagagaattggtgcacatgtttcaaatagcgcttcacttgcaaatctaccaaagcgagagtggaatcactgcaggcaaagatggaggaaaattaacgactacgtctgcaaatttgttggatgttatgatcaagctttgaatcaaagagctagtggtcaatctgaagatgatgttttccaagttgcataccaattgtactacaacaattacatgagtaatttcaaacttgagcatgcatggcgggagctccgacacaataaaaaatggtgtagtacatacacctctgaaaattctaaggggggtggaagctcaaagagaacaaagttgaatggaggtggtgtatattcttcaagctgtaatccggagagtgtgcctatagctctagatggagaggagcaagttatggatcgccctcttggtgtgaagtcgtcaaagcaaaaagagaagaaagttgctactaaaacaatgcttgaagaaagggaggccgattctagatcaagacttgagaacttgtgggtactagatgaagaggagcaagttatggatcttcctcttggtgtgaagtcatcgaagcagaaagagaggaaagttgctactaaaacaatgattgaagaaagggaggcagccaattttcgatcaagacttgggaacttgtggctactaaaggagaaagaagaaagggaggcagattcccgatcaagacttgagaacttgtgggcactgaaggagaaagacatagaagagcaaaagaaactaacaaggatggaagtccttaaaagtcttcttggaagaagaacaggtgaaacttctgaaaaggaagaaactttgaagaacaagctcattgatgagatgctctaatctctatgttctcgttgtatttatctctttattttctctatgtttatctcactatcaacttagtgacaggctatagacggcttttctagaaatagatactaactgaatcttccttaactatgttcaacgtttgtttcactctccagttcaggtaggaaacacgttccctctttgtttctccgtaagaagtcgaacattgtaacttcacactctcgctctgtttctctgtaaggtcactgttccctctctgtttcactttaacttaaggtaggaaacttgaaactgtctccttttatcatcacttccctttgatttctctcatgtctcccttttaccatcccctttgatttctatcaaatctctctctttcgtttcttaaactcttcaaacgaacatatgcctaaaaccctctcaataatgttagctggcaagtcaagatgatgaaaaaacctcgcaagaatctaataagttttgctagaggttcaagacctggtaatcctaatagcatccggtcaacgctaatcgaacaatgcacatcattttctgaacatagtcggttcttaaactgtactaacggaagttgcgagaagcctgagaatgtcatagagctatttcaagacttagagtactgtctacaaccgtgaggagatagtccaacgaaaaaatcggtcggttttcgattcactaactcctgttgcattccagtgatatttaattcatacacaacttattatcaatacgcttggcactaaccggagaatcatcaaaaatacttaagtgtatataagccaagaagatgtgaaggtaaagactctaaaggagaaagaggatattagaagttacatagttcatcagcttttgcctggtttggtatatggagactctaatgctaagtttcaaagattttgagatgcttttgatattacttttgatagtttacttgagattttttgtaatgttggctctcatggatgtgattatcattatgatttgctccggtccatgtttatttgttcattagataaaaaaaaatacgataaatataaaacattttgtagtttggtatattgcatgtgtttcatagaaagaaaaatattgtgatttcaactcttctggttaaggaccggttatgatttgttacttcattaatttgatggtgaaggagcatttagcccaaccggccggtttagatgttttactctctattgtggaaacagcaatctaatttggttctgtgagatcactacttgtcttcttcgccagattatcgccgttcgttcagagaaaactttttccgatacacaaaatcggaggaagaagaagatg

SEQ ID NO: 33071 - DNA, 3003 bp, Unknown
  misc_feature (1)..( 3003): 2750-1469P.txt file - cDNA_ID_3065233; gDNA_ID_1620471; Annot_ID_158027
aatccaaaggtttgcatatatgtataggaaaaaaatcaaaaaaaatgatattaattaccaaatcaagtttcacattcagacatttattcctaatatcctaaatttggaagatttttttttggtaaattaaattaaagattaagatacatggttaagaataaattgatatgggaatatgtaatttgtagaaagacagagagagtgaggaaaaactgacgaggaagctgaaaccggtgacggaggcgaaagaggtggcgatggatgcggcggagagaggaagagagccaagatggccaacgaacatgacggagataacttgtagacaaaactgaagaagactcacggcgatgagtgggcctgaaagccatagctgcttcttcacttcttccttgacactacttttctctccgatcaaaggccatgacaaatcaccctctcctctttctctgtcgtccctcatttttttttgagaaatagcaaagctatgacaaagtatcttcctatctttaagggctttgtgtttggtccggtctctctcttctctctcgctttgtccctattgatgtgtgatttgtggtgtgtagggattagtacttttttattttgtcaactttataaatagagtgaatcattacttggctaataatgaaaaatcaaatggattttattccttttaaaatatttattggcagtcgcatacaagagcgggttgaatccagaaaacattggcaaatctattattaataaaatttaaaaatataggaatttgataaaatttcgttttattcggttcggttttctttgtaacactaaaattgcaaaaaaaaactatcatttcaattttataaaaaaaatttcaggtttgtgttctataacttcaaaggtaaaatctaaaattgtcgaagttggtatgtagtattcaattccctcataaatttgtatttttcttccagattctcgatgggcccggcaatggtaaaatgttatgcatcaaagaaacaatgtgtccaatatgttcaaagaagttagaatatgttcccatatagatgtggttttgcaccaaatggtaagagaatatacattcttcatttaaacacaagcgtagacgttgttgaaactctaggcatagactttaagaccgtttctatcacctctctctcttcaagatggaaggttgatatctctctcttcaagattgaagattgaaaatgttcccatatagatgtgactgtcactttctttaaacactttgcattagcaaaaatgtatcttatgagctgtgtctcttcttcgtttcctctatatccatgccacacaaactcctcatctaaatgagccgacaagcatctgggaacagtaccttggttggtaccatgacaatgggagatttccgggtcgatatccacttacctggatgcaagtacataaaaatctatgaggtggaatcaaagaatcagtttatacaacaaggagattgcgttgttacttgttacttacagaagtgatagcaagaaatcttagtttaggagagttgttgagaattagtggaattatatccaaccagagatggccatgtggacatatcactaattttccaagtcgagtgaaggtaaagccacgaaaatccagagccttcaatgactaaatcaaaagccaatataaatcaatgtgatcaaacctaacagccaagaagaaaaaaaacaataataataaaaaggatagataccattggatcttccaaaggtaacacaagatacgtgaccaaggaaatagctttgagaaacttgtcatcagtatgacatacaacgtcgatatgtggcttttcaaggcgaagcttatgcaccttcgcgaaacggtagtcccggttatcactgatggcgaggcccactttcgatcgggcaagaactgagcaacttgatataagcctctctagagaattttcatctttgaacaccacataaaaaaggcgtaatatgttgagtgacgggaggcaaaccgaagaaggaacatccactataatcttgtccgaaagagtcaattccacaagtgttttgcatgtgtaaagactcttaggcaagctggtaggctctgccgtccagtggagctctaactctagcttgcgcacaaagcgatcaactgcatttgcaactaatttcccaacatctacctcaatagaaaatttttaccgagttggatgcacaaagtttctagaaaaggtgccttgtgaagttccaataacttttcaagaaacttccacacgctttcgcattcatcaccaggatcactgtactcgagtttaggcaacaacgtccagacataacgccatcgttttgacaatatcattgtcccaactgcatctttgatcggtacaagcaacaaaatctggataagcaaatcgtcgggcaacgaactgatctcgtctctagaagcaacaacctcttcatcaattctttgacaacgttcggccattagtgatgtaatagctagctgagtttgtgataaagatttcaaatataggtaagcagagacgaggaggagcaagtcgaaccctaaaaactttagatgatcgagaaccttagatatattcgtaatttctctatgagaaattgagaataagtgaataactaactcttcttgtctcacaaaaataaaaccctaacttatcttttccgtgagacataaacaaacccactttgggccaataaaatcggcccattattatcttgacccaatccggatcaaacccaactccatactttggagtttggacccatcgttaccaatgtagtagactaatgtagttaagatatatataatagaagggcctatttataaaatacaagaaatgttaccaaagcataaaccctaaaagccctaaaatcttaatatataaaccaactcacagagactctaaaatcagccaccaccgcacatctctctcctttgccctcgttttttttcggttctcgtctttcgttcttcacttttagacaagcaaatatg

SEQ ID NO: 33072 - DNA, 3003 bp, Unknown
  misc_feature (1)..( 3003): 2750-1469P.txt file - cDNA_ID_3065266; gDNA_ID_1620471; Annot_ID_158005
aagctttcctttagatatgctgagtaacttaagtttatcttctgataaattctctgattcatccttcacaagagttaaatagctcttcacaaattccccaacaagagcctgaatattttctgaagggcgcacactgtgaagtatcatttcctctgtcttcgggtttgggtgcataccaccagatctacatgaagccttcgagtcaatagacatacatttatggttggtagtcttagcagcttcgactctagactcgagattatcttcaatcacagccttcttcggatccatgaaaaaggttaagtcatcaaaagcagacattgatttgaacaacagcgtagccttcttagcattatcatccactgcacaatcccttgctcctgttttttggaaagggttttccaataacccatgcgaagtattaacaggagcatgctcatcaaggttagatataccatagaaaggttcagtgcatttctctacaagtggctcgcagaaagcatcttcagagaaaatgaaatcataaacccatttgtctccttctgaagcttcccagttataatcaatgttgaatgtaactatttcttcaaacggataatcacaatggttgtggtttctttcctcaagaaggttccacggcaagtatatgtcatttgaggcagacaaggattgaggcttgatctttgacaaaacatcctcataaatgagctccagagatcttgtcatctcataatcatgtaaaataggagtaggcaaagacttgaaggcatcatctgtgaaggcaagttcggaactgacaactaattcatcgaaatccttgaagttcatctctttactgaacataccgtaacagatttctggttcaatggctttttgaagacaaaggaagatatcaaaaacatcagagatatccacatccaggatctggaattcctcataagttactggtacagccacctttccctgaaattcctcagcatttgatatttccaggatagtcactatatccatttcagaaaattcatcctctggtaccacatcagattggccactcttgttcaaatagcaatccgtagagagtacatccaatagatcataatcctttgagcctataagctccttagaattgataatgagagaactccctgcattagtgtcttggggttcaatcgtctcaagaacagtaaatactttatcaagcacagataagcttgatagttcgctcaagtttacttcatccacttctagaaggggaaatctggcatctttgaaccatggttgaatcttgcggaagcattcattttctgctacagaagtgttgttctctgtaaagtaatcagaaggaatgtaatcaacagaataaatctgctcttgaatgtcctttgagttctgcaggataatatctgacccctcatatttaacctgcaataagaagactagctaaaatcagatgatgccaagaacaggaaccagctctaccactctacagcaaaagcaaaaactactgttgtgtgtgccaactaaaatcaactcagggatttaccgggtcatttttgatctctagaacttcagagaaacattggagatgatcctcactcgtgcataagagcttgttctcctgtatatcaaaagatgctttatctcgcaatgaaaaagaaaaagctgaactagttcaattagtacaatgcttacacagcttgagcaataccatctcaaaatccaactctggagtctccaactcaataattttaggtgtagctttatccgcaatggcatctccgtcatccttctgcaaatagatcataacttcggttttcaaactccggtaagattcgcttaagctaccaaaatttccaacccaagtatgaatataagatctaagcaacaatcagaaatggaaactgagaaaacacaccacaaatttcgaaaaatctacaaccaatctcactataagaaacaaaggaccgttgacagaaacagtcagcgagactcaggaaattcgaaatttcacctccaggaactgataatatctagatcgaaggaactttacctcgtctgagtaataaactccgagcgaagagtcgtcgatttcaaaaactcgatagtccacactgacgcggtcgggaaccacgtcggaaaggaacttcgacaaagcagcttcaataggcaaatttccgatagggatactaacattttcgatcgagccaaatcggagacggtcttcttctccgttgtagacgatgggtgccgggaaattatcaggagccggaagattgaggaagcctagggtttcaaatacgtgagaaggtggagtagagaagtaatcgatgttgagaaatcgagttcgcatcgtaattttctagatccgtcttgggagctcagactgtatcagtgatgatgatgatgatgaagaagagaacgaattttgaaattggcggttttgaatttttaagaaattaaaaaatatcccccgtcgatttcaagagggagatggagataccaaagcaactctcgccacttgtcgtcttttaattttaattgagtacgttatgccgttttaaatgttcaaaacagcacacagttgatagctgaattgattttttcttttgccgttttgttatatttaaacaacacacagtgcatttgccaaataactacatgatgggccaataaacgtggaccgactaaaactaaataatagaagatacatcgataggcttctctaaagatcggataaaagataatgtcgcatagccacgtagagagcaactggctgagacgtggcaggacgaaacggacgcatcgtacgtgtcagaatcctacagaagtaaagagacagaagccagagagaggtggttcggccatatgtcatcgttctctctataaactttatggaactttgttctgattttctcagagacacgaaaagaaagaaaacaacactagaacaaagagggtttgattgattcacttgaaaaagagaaaacacagctttggaaaatg

SEQ ID NO: 33073 - DNA, 3003 bp, Unknown
  misc_feature (1)..( 3003): 2750-1469P.txt file - cDNA_ID_3065281; gDNA_ID_1620472; Annot_ID_158043
tatctccttgtttcggcaggctaagaattacatatgaactacaactcgagatttatgctttacaattcttctgcttggactgtacaatgttctacagaagtataaacatgaagctcaagtgcttaaccatataatttgtctcatctctaagaatttttccgagtcaagtgtacagccttatccttgttgttattggttgtctgcatagtgggcatgttgtgataacaactccgcattccttgcatgtctttatttgaaataaaaagtatcggagatgtcacaaaatcgatctagaagcagtacagttcatagaacaagtaagagtataattgttcctttgaaattttcacataccgtgtgaccgcagctaaaagccatgtcctttggattcgtcaagcaaatcgggcatacctttttgaaaaacaaaaggaatgtaaatctcagtatcagagaaactgagtatactcattgacaaaagaacagaaacaaaggcagaaataatagagtatttaccggcactgtggaaggagcgagtctgtcacttttctctgcagtttctgtcatctgatttggcaccgatctaacagcattgtcacgctctataacctctggtggtggcgggagtggcttgtggtgctgatgggaactgcgcactggttttctactgttcataagcacaatcaaaggttggtttagttggcaaagaatctaatgcaataagaccataaacagtgagtgatacaagtagtttccaacggtaaattttttattgcatttacttgagacttaatgtagccttgtattgaaaagggatctccatgagagctgcgagtgcgaaagcagcctccttcttagccgcatctttgtgctctgacattatcttcgtgaagtttacaaactgtggaacaaaacacagtttttcatgattcatgtttcaggaacaaaacagagctattcagggttttattatattacctggaagttatcgaattcacggtgaggaatattgtcatcgaattgtttcattgtgtcccatggtccatctcctactccaaccaagactatcgacaatgggtaatggctggaaaatttatatcaaacatcattagtatacatatgaagtctgatcatgaatatgagcttattgaatagttttacctcgctgccattatcgagttcatagtagcttcttcctgtggactaagtcgaccaagcggcacatctggatttcttgtgacctgaccatctgcgataatgacgagaacatggtattgcatattgttctgctcaactatgttgatggcagcatcaataaccggtgcaaacgaggtaggacctgtgagggaagaatacactgattaatctttacgataagagagaacaaaactgctccatttttgaaagttcaaaaataccggacaacttcaaatgtgggacaatctctctatatcttttaactgcgttttccaatccgtcgcagcttttgttctcgggataaaagctgaatacatattgatctcgcgttgttactgcaggaagaagaaaacataaaaccattaagaactttggtttatcttattcattcatcttgaaagcaagaaataagaaactaaccatcgccaaaaccgaaacaaggtataagatcatcttcatcaaagggagacaaagtacgaccaataatcgatattgctttctcatatggattctgtcttttaccaatggcatgaaggctttttctattgaatgaatatctccctgcaatgaaaattcagaacattaaccaaaaccattgaatcttttcgtaaacatgtgtagcattttttatcaaatcaaataattacctgtccactcattgctcttggtaaagtcaattcctagaatcagatttgaagattcaagtccagcttctctcagagaagttatcacctaaaaagcaaagttcacaagaaattcatcactatgaaagagactaaaatcaagaaataactaagtaagtttatgagacctgatccaaactgctgaaatgatcagcaatatacgaaggttgctgattacgtttattgctcatgttcattgaaaaaaccctgcagcacaagaaccttcagaaatccaatctttggagaagaaaccaatcaaaatcaagaataaaagatacagttacacaagtggcaagtatatatcaacctggagtttgttgaaaacacaaaagacttctcggaatctttcttgtaagaaaaaacttttgttggagattatcttctgtaggaagattaaattattaaaaagatggcacaaaagagaaatatgaacatataaaaatactttagcagaaaaaaatgaacatataaaactatagaaagtgggttttgttgaatcttgaaagttagtggaacgtgaccctttgcttgcgccggcaaataatcaaaacgtattttgctctctcacacgccatcatcaatctagaaatcttttttagtcttgtctctgcgtcattaatgatttatccataacccaaaatcatagaccaaatttcaacatgattcatgtggacaacgtggcaaagctgtagctcttgtctgaagaaaattatttgggcttttgattccctcaaaatatattaacccagaaccgtttttattgggcttcttcattcatcaagaagcctttttgtatcttcaccacctataaattcacttatgtttcaaccacaacatccacgtgcgattagcccaaaactcaacaaccaatctacgaagatcactaaagttttttatttttatgattttcaccgtttgtacttgttctttcaattggtgccacatggacccctaaaccaacagagcaaatatggcctttcttgatctaaaataaagtttagggtttaagttcagagaataaataagtacactggtgtaaatgggaaattcaaaaaagtaataataattgtctctgcaatcagaaaatgtgaagacatatatttatcttcttgaaaagcgaatgatg

SEQ ID NO: 33074 - DNA, 3000 bp, Unknown
  misc_feature (1)..( 3000): 2750-1469P.txt file - cDNA_ID_3065320; gDNA_ID_1620473; Annot_ID_158080
atcatattactttgacaactctttaatttgttcggtcgcttttggattattggcacccttttgattcttttcccacatattaccacccttgtatactgttatactgtgtcaagaaaagaaaaaagagtaatgttatacataagctatgctataagtaggcctaattacattattgttatgttggtgatatatatatgtagtaacacccatatatatatatatatatatatatatatatataaagaaataaactgtttgaaattgatattacgatatacatgacattaaaatgactggagagaaagaagtggtctaatagggtttgtgttgataagtcgtgatttgataacatgtcgtgttttacccaggtcccacaattctcctcgctctcttctacttaattattaatcttttaccaatatgttccattaattagtctagtggtacgtacgtgtaggagaactttcgattctaatgggattaattcccgacggaaagtatcgtcacggccggtgaacacttttggtctgtatatgagtttaatatacatcatcattcagatgttattgcgagtttgcgacacgccgacacgttaattaattagaatcgaattcgaaacacatcaaaaccaacaaagaaaagtacatacaatatactaagtagcaaattaagagagactaaacaggtttagagtttgccgagatttaaagaatgtttctctaccaatatacatgttgttttccaaagccataatatcccatgttaccactatgggctcaagtcactctaaattatcaaacacagaaaaaaagtcactcaatcctaaaaaagtggacctcacttcattgaaattgaaaagaaaaaataattaacaaactcgatcgatcaactaacagaattaaaacaaacactccagcaaaagttaataatcaaacaaaagtggacctcgattaatctcaaacaaaaacccttcacgtaaattaaatactatatatatatatatatatatatatatatatatatatatatatgcgtggttcaacttttcaacaatccacgtgagataattttatcttttttgtttgttcttatacatttgattgaagtaattgggagagagctagaatgcaaattgtaagtgatagacaactccacctagtaatagttcgtttgttaacctctcaccatcagttttttttttttttcctttcatgttaaaagaaatctacttttatttccccaacctttgaaaattcaactttttactttttgcaagacaaacgcactgtttttcctctgtgacttaataaaaaattcgaggtgtttatcttgaatttgagttgtaggacgtagataattgattttgtcacgagtatatatgatcaacgatgatattattcgtttttagtggcctagtttctcatctgataaacttttcaaacaacatgtcatatagttgttgcgccataatcagtaattctttctctatcggtgggtgtgggaaccacaaacggatcaaacttataagttatattaattagagtctgaacgaaaaaaatcgcgtaggttatatattatttccattctctaacggttaatttagtggcggccggtgttagacatgtttttgttttctagggttggcaagtacaataacaatacatgttctggagtgaagtgaagtagttgtcaaatagaattttagttttgaacaaattaatccttgatacttttttatgtaactattaattatatgatataaataatgaaaggtgatcaagggctgggaatgtcgtggttgcatgcatggaacttggaaggtcagctgcttctgccaaacttattccccgctcccccagtgatatgacctatctgccctcacattctttcaatcagatcctctatgtccacaattattgtatcaaacaaaactgttgccagatggaaaaccgagattgatcgagcagaatcactaaccgagatatatcaatcaacgttgtagaaagtcctagcagacattgtagatgtaggtagttttgaatatattggttatatttctagctaatgaatgcattttgtaacttcatatttacaagagttcaatacaattattccacaagtcctttcgtattcttagtctcatcaacttatcaatatatcatatccttaacacatgctcatgatgaatttggttttacccaaaaaccggtctagttaatctgatccgaaattaatttgatccatccatcaccttaagagaacacatattagaaatcctacactgaaaacagaatgagaccaaggtaatttatcaatggatatggatcaaacccacttaccagcaataggttttgataggaaacccttcaaatttagcatgtaaaactttagatcgaaccactttggattcaaattagatggcacatattctactactttaatatcatgtaaagattcatttgctttcaaatcaaaaccaatgtgtggattgattagttattttattatcacaactttgaattataattactgtcatctatctataacataaactaaaataataatgtacattactatatatgtttattatatagtatatcgcaaatcttgatatggttatggatatatcaagtttaataatgtatgctcaccttaaaacgtatatactcccgacgaataatgaacattagagttttaatttgtataataagatatgcttggtagaaaacaaaaaagggaaatgtgctgaaaaaagggaaatgtaaacatgcatgaatatggtaaaggtggcgtaattaaggagtaaggacccagtaatatagtggatattcgagaaaaacttttctacgtgaacaaaaataacctacgtgtaagttatcctctctataaagccctcatcaagtctctgagtccttcaacgactcataactcatagctatatcttgtcttaaaaagaagaagcaaagagaattagtggagtacgataagcagagaagtatg

SEQ ID NO: 33075 - DNA, 3000 bp, Unknown; identical to SEQ ID NO: 1961
  misc_feature (1)..( 3000): 2750-1469P.txt file - cDNA_ID_3065332; gDNA_ID_1620473; Annot_ID_158072

SEQ ID NO: 33076 - DNA, 3003 bp, Unknown
  misc_feature (1)..( 3003): 2750-1469P.txt file - cDNA_ID_3065336; gDNA_ID_1620473; Annot_ID_158071
tgtgtagctcaagtgcctgaggtacgacccaccatggatgatgttgttagaatgattgaagagatacgagtttcagactctgagaccactcggccatcttcagatgacaatagcaaacccaaggactccaacgtccaagtttaaatcaccccttggatctcattccctttttatctatgtttttgagtttgtatgtcttataaggctttatgttgattgtttgaacaccactcgcctgagtaataccgcagttggaggcgcggtaacatttacatagcaattattattgtaggctcctttttctgtatctcataatatatatgaatatgattcagttttatgcaagctaagtaagtatccaaaagatggatttaaaagagttccagagagacataaatatcagggagaaagagatgaggctgcttgaaggaggaattgatagagttcttgaggttgggagaaaaaagcagagtggtcactgtccggaagaaggaaggtgtgagcaggaggccacagggccaacattacctcttgaagaactggttcgaacaaatggtccttgcctgtcttcacgtacactcttgggattttgtcagtctctggagctcccggaatatccattatgcctatgaatgccatgacaggggccggacgcagaagtgtggttgccagtgtgtaatcctgatcagaatgaataaatgaatgatgatgattctctacaaaaaaaattgaggcagagatgagaacagagttggtaataaaggacacacctccatggggctctcgttgtaaaacttgtcccgaacatactcaggtttcatcatgatgcttgttgggagattttgtggtccatttccgaaagtaaagtcccatatcttctcagtttcctcctctatcaatcctgaacatatcttcattacatttttgagtctttcaggaatcaaggtaccaggtttgaccatggctgctgcgacgtaaaccgccaaggaaactttggaaggaaagaggcacatggcagccgtcatgctccctcctccaacgctgtggctcacaagaatgaccttttgatcgttgggaagttgggagaggaaggcatagagaggctcgtcgtagtcatccaaagaagagacagtgtttggatcagttgggttgataccagcacccttgaggtctatacatgtagccttatgtccattatccctcagtgaattagccagcttgtaccaacaccatcctccatgccctgcaccatgcacaaacacaaaatgatgctcactcatctttaatcctcttctcgtacatcacattccttgcactatcttttgtagttagtgtgatatttctgtatggctgtaatgttttcatgatcatgatcatgttctttaaatgaacgatgtaaacggcagctttgtccaaaactcacaaagattacatctaaaagactgccattaccagtctttgatgtgtactgggtcaactttgaaggcccaaacacatattctatagtgaggcccaaatcaagatagataccgtcttcttctttttttaatttcttaagaaaatatgtaccgtacatgttttttgtttttttgaattgagatttactccttcaactaatgagtccacaccactgacacttcttattttctacgctataagttttttttattgagatttctagttttcaaaaattacataagaagaatagacagtgaaactgaaataaagactcttacatgttgcatctatagatttccttttaaatataaaatatagattttaatatgaaaacttgatagttacaaatctacttaattttaattatatgattctaactagaagatattgagatttgcaagataatattctctatttgtgtgtatgaaataaaacagatttttaattatatttattcaaaaagtctaatagctctaataacatttgttgaacaatgtctgtttggtgaaaaagaaattaaaatcaggtgttgacaacttcatgaaaaagaaatgtaatctaaaatctagtcgcttacacattggcagaataattttctttgtgtttacatcatcttcatatatcttagagatatctctttataaaaagttatagtatatatattttgtttggtcaacatacgtaattttatatcaataattaatgatatagaatgacattttaaatgcattaaatttgaaatgaaatgaaaaagctagagaagtggagcgccacaaattgaaaaggtgatagaaagtgttggcctctcgagactaattaataacgtggattactccaaaacccttaaaagtattacatttaggaaggagaaaagccatttcaagttttcaatgactgtataaatctgatcttttgactgcatgagccttcaagtattcaaatggcaacagaattaaaacgagagagaaatagtcacgacggccattaatcttgtgaatggtcggttttgattagtggagaaggagaggtcaatgactctctataatacgattctctcaccacgtggacacagcggaattagtcccttaattacatattttaattacagagagacaacctaatcacttggccacgttgaaattgctaggtactagttaagacttgttccgcaatatctgtcttaaaggtaagtgtataaattcatttgactatattttattttcacggtttttcttcattctaaaaagtagtttcatcttcttccctcatccatcatcattcatcatcatatcttctacttcttcttcttctcaggttctcttttttgtcctcttttgtgtaaatacgttttgtcatgattctctgtgaacagtaccgatcgtttttttttgggattagcgaaaaataaaaataaccgacgttttttgtattatttgtctgacagacagaatctgtattattttgtcatcttttttcaatagtctcatgattgtctcttgtgtgtttccagctttcccatagggtccattgatttttgcagccatg

SEQ ID NO: 33077 - DNA, 3003 bp, Unknown
  misc_feature (1)..( 3003): 2750-1469P.txt file - cDNA_ID_3065340; gDNA_ID_1620473; Annot_ID_158069
tgttacgagcacaagaagaggtcaaacgaattcaatccgtgcctttggtgataggtcagttcatggagatggtagatcagaacaacggcatcgtcggatctactactggctccaattactatgtcagaattctcagcacaatcaatagagaactcttaaagccttctgcttccgtcgctcttcaccgtcactccaacgcccttgttgatgttttgcctccggaggctgattctagcatctcccttctcagccaatctgagaagcctgacgtctcctacaatgtaatgtttccttttttccaaatctcgactctgttttctgaattaaagttagggtttttgaaacgatctttggtttcttatgtggtgctttatctttttgtgtaggatattggaggatgcgatattcagaaacaggaaattcgtgaggctgttgaattgcctcttacccaccacgagctttacaaacagattggtattgacccacctcgtggagtcttgctctatggacctcctggtactggaaagactatgttggctaaggctgttgccaatcacacaactgctgccttcattagggttgttggatccgagtttgtgcaaaagtatctcggcgaggtattaaaaatcatagctttattgaaggtttaggtcctattgagcgattctatttggtgactaactggttttttaattgcagggacctcgtatggttcgtgatgtcttccgtcttgccaaggaaaatgctccagctatcatcttcattgatgaggtagatgccatcgctactgctaggtttgatgctcaaacaggagccgatagggaagttcagcgtattctcatggagcttcttaatcaggtgagaacaaataatgaattttagttgtaattcagatcttatgttgtagaataatggattttagttgtgtccttaacttattgtgttgaattcgatgtagatggatggatttgaccagaccgtgaatgtcaaggtcataatggcaacaaacagggcagacactctagatcctgctctcttacgtcctggaagacttgatcgtaagattgagttcccccttcctgatagacgtcaaaagaggcttgttttccaggtaagttaattactacaagcacttaaataactagttaaagagatatgaaaccaaatgttttctcaaaagaaagttttgactgatatcttagtttctgtcttattgattggtttttccttgtgtaggtatgcacctccaaaatgaaccttagcgatgaggttgacttggaagactatgtttcacggcctgataaaattagcgctgctgaggttagtttattttgcttaccattctattcttcccgctatagtttacttttaccatgatatatcctccagtgtttctgggtcaccacctaatgatgttcttcaaaatatgcacttgagcataatcatactgtttcaagcattatgtatgaatgttagctgagtcgtttgttaatcattgtcctgaactgaattgttgagaaatcaattgttggcagtaatatggtttgattttatcatgtacatgggaattgttcctaaaaagattgcatgtaatgatgatagttattaatgacactattttgattttatgttgaacaatgcagatagcagcaatttgccaggaagctggtatgcatgcggtgcgaaagaacagatatgtgatactacctaaggatttcgagaagggctaccgcgcaaatgttaagaagccagacacggactttgagttttacaagtgaagagaaagcagaagtggaaccagattatggctgttgttaaaattccagtgtgttttgagaattattaaggacatggaatcaaatttgcagttaaattaagaactaagttgcatctcctaatttctgtaactcgagttcacatttgtttttagtctatcagctttttacagtttaatgtataagaaaaactggggatggtgtccttagaattgccagagcatggtaataattatgtctcctctgattaaaaagacaacaaaaatagtgatgatattaggagcacgctgcactgctcaatgttcatagaaaacttcagacttcaataatgcctaaatgtgttggatcttgttttggagttggtgatagatgatgaaatgaccagtattactattacatagtatccgcaaatcaagaatgatgcaaatcaagagaaaacagtagcaagagtggttggacaggtaagaactattaccatatctaaatgattactttaaaaataacaacttggatcaagatggtttttgttttcatgtatttgtcattttgctatctcataagaatcttaagcttggtcagtctctgggtctctctacattagcgtttgttgcggtgtttacacaccaatatgatttgatctaaagactccttttgaagactgtcttacccttaacgaatacgcctcttttgtttaacttcaccacactctctctctctttcttcttcttcttcttcttcttcttcttcttcttcttcttcttctccactagtccccacatacattgccttttcttctttcttctctttcaccatttcaagattgtgttatagtccgctcaatgcagtagagtgcagaggtctgagcgctccatctgcataagttcttcttcctctattgctgagttcttcagtgcccacaattttcttacttcgctagcttacctctctactcccaggttctctttctctcttcttcttctttttggtttttgtatttttccttttaactttctgtaattgtctgtctctcattgttgggaattatacttaaaaatcgccattttctccggctaggtgggtaggaaactttcaagactttagatacaggctagtgacgtggtatattagttccaattcgctggctacacgttgtttgttcaacaactccgataaaaatcagacactcaaaactcatctttatttacttagtgacattgtccacatgatg

SEQ ID NO: 33078 - DNA, 3000 bp, Unknown
  misc_feature (1)..( 3000): 2750-1469P.txt file - cDNA_ID_3065346; gDNA_ID_1620473; Annot_ID_158062
ctgatgtaattggagaaaccattatgaagacgataatcagagcgaagactgtaggaaaaagatgggattttgggttgaggttgaagattaacgcgacagagtaagagcccaggagccctaacgaatcgagatcctctcgacatcccttcttctccgaaagtttcacagactgaattttgctccggcgagctagctaacaatgtcacgacgttcggcggtgcttaatgggcctaataaataaagcccaatacattttaagcccattaatgtctatccctttgtggagtgagtcgtcgtttctccaccattctttcatcatcatcgtcgtcaagcaatgtttattatgagctacttccacaagaagtcattgttagtaaagaaatgggaagccgtgcaatatgtatacaacgtgtggcaccaccgtgttttgaagcctcgcaagtgaagaagatcaaaacagttggttcctttttggtgaatactaggagtaagagaagaagaagcactggtgtgaaatgtagcagcatagctgactacatcggaggtgacttggtgaagccggacatcggacaatggcttcaagacgtggaagaacacaaggcaatcgccatttacgctcctcatgagggtggttacgaaggtcgttatcttaaccgtctcaaaatgcagggctactactttcttgacatctctgctcgtggccttggtgaccctgagactacccttctcaagaactaccctgtttgccctgtatgtctactttcatccatcttctactttaatcttgtttcaatataattttgtgtgaaccatgtatcttctcttcttttaggctcatcttgggaaacaacctatagcaagatggtattatccaccagaagttgattacaggctcgctgctcttccccctagtgccaagggtcttgttgtatgggtcctcgaagcaaaggtttgagtttctctcatttgatctgttctcccacatgctctttctcatatttccatttcactcaggtcctctcaaaatcggagcttcaatttctcgctttacttccctctcttcgtcctaacgtcagggttattgctgaatgtggcaactggtgagtatatcattccttaccatacacactaatcatctatgtttgcaatttgcatgaccattaccaattcccctgcaggagaaagttcgtgtggaagcctctagcagaaattgcaaatctagctgcacaagagtaacttaatggcacaagtggagctaccagtgtatagtttttcatgaatgcatctcccgcaagtgtagcaatactcatcccatagtaaaagttaaaatctgtatttgtaacttggtagtatattcccatggagtagttaaagataatttctgactctgctttgtcacaaataaaagtatgtataatcagtaagattgataggacacgcttagatacagactacagagcaatccagaagtacaacatagaacacttgattcagcagaaacatgtgcaacttactttgatcaactccagtcactagacctaacgagtaacaacatgttccgagtccacaaatcgttttgaaaaccaaaaaattcagatcttttgcaaagttcttcagcgagtaggcatattgccctcctgtgactagacaacttaatacctagagctttaactgaaggttcttgccaatattctcgtgagaaatcaacaaatatggtcacccttaagactttgatggagctaaatgtgaggatgctttttgttgtctagttctatgcttaaccttgagtcagtgacgtatcaaacaggcaactttgagtaatagaagctacactaggaaagatatagacttggataatgagctcagtagtacaaaactttgaagcactaagacaaagctgagattggagaatgcaaaaacaagacaaaaagcaaagttctatactgcagattcttgggttactttaggcaagaaggtatcccaccatccaggttcatacttggggtatggcgccacccaatttttaggcttatcgaactcaagagtggtaggattggaggccaaagcttcatcaagagaggtagcttcaaaggaatcatacagaacacgatccaatcttaacttcataaacctgccataaaacaacaaattgcaaaacacaaatgcgttagataaggagggagtgaggaacgtaattttgaaaagagagagattgggattagggttctaacgtgatccaggtgccattggtggaaacaagagcaacagcaggacgacgaagtctttgagtaattttggggaaattgtcaaggaatttaggctcaatgacaagccagaagtcttgcactaattcacgctcaccgaagtaacggagacgttcaaacaattgctcctggaagtgctcctcttcgtcaagcatgaatttagcgtttgctaccaggaaatggtacttggtgctctctccctgcaatcatccagaaaacgtaagctgtttggtttgattggtcaagaggaaaagagagagagagaaagaaaagagaaaccttgttaacagaagactgttgctcgatggaggtagctgcggttttgaaagaggaggagaaatgtgatgatggtagagacagagaaggcgaagagagatggagtttctttgtctgcttgggaaaggaagaggagatgagaaagggtttcgtacggcaagcggcggcggtaggcggcaccgccacagtcaatgctccggtgacgctccacatttgctgctgattagagtctgttgatcgaggcagaatctgtaaaaatcttatcttttttgccgggggtcatccattattatcatcactctctctctccctttctcaactcaatttttaattgattttaatgttatttgggcttcagtaatggcccaataaggtgttatgggtttcttcaagcccgtaagaaagaaaagggaaaggcgttaactgtgactttcatggcgacggaggcggagctgagatg

SEQ ID NO: 33079 - DNA, 3003 bp, Unknown
  misc_feature (1)..( 3003): 2750-1469P.txt file - cDNA_ID_3065350; gDNA_ID_1620473; Annot_ID_158061
gctttggtggagtcctttgtcaacgagtaattctttctccatcgattagttttcccatattctgtagaggttcacatgtcaactagatagcaatatgtgcagctgtatgaatctcaaggtcctgaacataggtactgtttgtttgcagatacagagcaactaatgctggtagattcccttcattggatgctactcacaagcaagtgggaggctcttattacattgtcagggacatctttcaagagctgaaactcaaaccaaaagcacatatgccaatcgtagctaaagccctctcagaagtctcttcttctgtaccaggtgatgcttcctcacactcctctccagcacctgtgccaaccgttgaagctaaagccctctcagaagtctctccttctgtaccagctgatgcttcctcacacttgtctccatcacctgtgccaatcgtagaagctaaagccctctcagaagtctctccttccgtaccagctgatacttcctcgcacttctctccagcacctgtgccaatcgtagaagcagaagccctctcagtagtctctccttctgtaccagctgatacttcctcacacttctctccagcacctgtgccaatcgtagaagctaaaaccctctcagaagtctctccctctgtaccagatgatgcttcctcacacttctctcctgtggttgttgaacctgagtttcaagtaaagaaaaaatcttgctttggtgtgatcagtttaatttccttaggcttcagttatcaattggcttagttatccttgtttctgtttcacaggctggcagtgtggatattgagataggaagtgagcagaggccggatataatagatacttctcactctaattctgatgatgaaagtaatttccagggcaacaaccttgtcattactgcaaaagatgacaaaagagaaacagaggcaactcagggaatagaaaactcggagactgatgaagagaggaacttgacgcacttaggcaatcaagagtcaaaagcagaccatcttgaaggagctgatgtttcagcagatgttgtgcctactgagaccaggtatcaaatgcatacaactaggtctcttctttactggtccgatccttatattaggataatttacttcattgatggatctcttgtttttgagtaatagaaaaagtcattcaagttgatcatattggcaccacttcagtttgaattcttatatcttttgtttttacagacaaatttcagagacaggagccggtgaggtgaaagagacggaaactggtgaggtgaaagaaaggtcaagttcgtggagcaacataatgtcatttgcgaaagaatttgcgaacttttggagatgagggtagatatagccagggagctttagacacgctcaggaagggtaggtagaggtgtgtaaagtataccagtagaagctgttttgttttgacattttgcgcaaaggtttggaatcgaccaagatgtcttaatctagactattattgtcctgctggctatgagtctagattaaaacacacaacagttttagaggcttgttttgtgatcgaccattttgtacaaaggtatagaatctcccaagatgtttaacatggtaatctatactatcgttgtcctactcacaatgagtctagatcaaagctcgtattttcgctaattcattgtttgttctacagaactacaaatccaaataaatactcgaatagacattatttcatagcaatttttatacatgtcgaataaagacttcatttcatagcaattttgatacatgttcccgtagtggtacaaccaaaacaaaatgtgttggaaagttggtgccgcagacagcagtagcatagctctagctcccacggtatgtggagaaagaaaaaggtgcaagcaacagtgggacatggaaatgctcccatttctgtgattctgtaacctgaaatacaatggaaacatagggaaagaagcagcctggggaatactttgcagtgtcgaagctaatcctatatgtccctggattcaaagcgtcaaccaaatccatcagtggcccactgcgcccatctctatcagtagctgatgtgcccacactggaccagaccccaccacctccatgaacaaaggaaggaccggtagtaccactccacacttctaagtgcacttcaacacctgcagctggagcaccacgtgagacgtctaagacatgagtcgtgatcggtggcctacttctcttgggagcttttgcttcagctgcaacattcaaatgccctccaatgattctcagacgatcttacaaagcgagaaagtagaaaaggtcacacagataacaaagatagccataagggtaaatccttgtattccaaaagacacatacttgatatcatactgaatcctaacaggttcaaacccacacagtcaaacacaaaactttgacaaggaaaagatttggtaaatcatcaatataccttgaggttttgttgaaacaggagagctagagctgtcagtttctgatataactttagccttatcggagaacagctttgccattcgtagctctgttattttcatttgttccatagcagcaatctcaagctccactattggcctattttcatacctttcctgaaaaagagacgatttgatgaatatgtaactttctcattcactcacactcaacaaaaactgatttggaaatgcaaaagttgacctttaacgcatggagcatctcagcgtgagtcctgccagaagcgcaaataatgaagataaagccaaacttctttttgtaaagtacattccattcggcaagctcctaagaaattgaaaacaattgatcatcagaagaagaaatcactgaagagatgaaggaaaaaaaaagtgaagatccatcacctgtaaagcagaagcagaagttgtggcaaaggcggttgactgttctgatacgctccgacgagcaaaatcggagttgatagaaggtgaaggagtattcccaatctgaggatg

SEQ ID NO: 33080 - DNA, 3003 bp, Unknown
  misc_feature (1)..( 3003): 2750-1469P.txt file - cDNA_ID_3065358; gDNA_ID_1620473; Annot_ID_158058
ttctgacgagatatgttgacttctctcgcaggggaaagaccagtgatggctgataatggcgtccaacaggtaatttaattcaatcttcttcttcttcttcttctattttgaattattgtaaaaccaccatcctaggtttaaaatgcgttgttcctttcaccaccagcaggtttctcacgacgatggaaggaacattgtttcttcgtcttatagttcttccgtggttccttctcctgatcccgctccttattataacgttcttcaaacccctaccaatctctatcactacgattgggatatcgcaaattctggtaattttttgtcttcttctctcttctaataaatcaaacaaaatctgtaagtgctcattgcattgttgtgttttctctaggctatgcacaaggcatcaatacttgggatggatatccacgatatgctactactacccctgaagccatgcatgtgccaccggttagtatgacttgccctatttatgttctatcttcctcttgctacttaattaacttagttattctttatcctcaggttgtctacaatgacaattcatctcttatgtaccaatatcctggttatggatttaacccttatccttctgtaatgttggagggacaaattccagtctccccagcttattacccacaaccttttggtgcaccttctgcaatgcattatttaccctcagatattgacccaacatctgctgcttatatgattccttacgggcaatatggtggagggaattattccggaaatcaaggggacatctctttaacatctcatataccttatcctcaaacgatgggtatacttgggccatacgaccataatgcttcacaggttaatactcttccctctttagttttaactattatgggcttatgtacataacctttatttggtttggttcggtaaacatttgcttactaggaataaaactgcataaaagtgccactggttattagtatcactagttttttgtgagtccatctctttagctttgtcgtgcaagataatgaatacatgctgacacactggaagagccatgatattttctcatatatgattgaactttcagttttgttcttccctgtaatggttttggggaatagaggtgtctttggcatacgccttggattcaaatcagttcactgttttattggcttatcacatttctttggcaccttttatcaggtagcgttgcatgggagcggggttgcttcaagctcttctttgggaggttattatcatgtaggatcttaccagaatcctagctctaccccctcatattatggagttgataatcgagtcagattaacccctgacataggtaaaagacgagagaaggatcagggctctatatctagcaccagtgatctgtatggtaatcgaggaccacgggcatcaagcagggtaaagagcaagaacagctccaaaccttgctctactattggtgattcagcaagcgattcaagtacagctggaccaaatcccagtttgtacaaccatccagaatttgtgacagattataagaatgccaaattctttatcgtcaagtcatttagtgaagacaatgtccacagaagtatcaagtacaatgtctgggccagtacaccgcatggcaacaaaaaattagacactgcttatcgggatgctgagaagatgggaggaaagtgtccaatctttctgttcttttcggtatggcttttccactgtccaatctctctgttttctttctgtatggttttttttcgatgtagtagtatatataattcctgggaataaccaaaagcgtaattgataagctgcttcaatgaaacagtaagcttaaccaaagtttaaaatcttgcaggtaaatgctagtggacaattctgtggggtgtcagaaatggttggacctgtagattttgaaaaggatgctggttactggcagcaagacaggtggagtgggcagttcccagtgaaatggcatattgtgaaagatataccgaataaccgattttgtcatattcttttacaaaacaatgacaacaagccggtaacgcacagccgagattctcaggaggtgggcattacttatttttttgtcttatgatcattgattcaatgctctcttggttgcggtgccatagtgatatttgtcttggtgtcactgtgttaggttttatgtggacaagtcttgggcaatttcacattatcatgtatgactaggtgtatatacccagtaatagggaaatccttgcatatgtgtattaggtcaaacgttaatagttggtatagggatttggaagctacttaattatgaggtacttgaaagttatactttatagtctcccagggaattaaagcttgcactttttgcgttgggttttcttgagtgggatattaagcaaaaaatggaacatagaagagtaagtttttgtggtagggagagagatttggaacgcattaattggatgttgcatggatttataactaaattgattgatgaactgtaacaggtgaagctacgccaggggattgagatgcttagaattttcaaagaatacgaggcacacacatcaatccttgatgatttcggctactatgatgagttagaggggcaaaaggtgggagaagatggaacaaggaaaaaagctggggaagaagagacctccgtggagcaattatcagagcgccttcaagctgtcaaagtagaagatgggaaggaggaggaaaaaaaagagttaatagctgattgatacagtaatagtcagtagaaggagacattcttttggtaacaataagcaatggggttctcttttttctatttgggtggggatgtatactagaatggtcgggacaaaaaaaatccaattccttgtaggcttgtaagcaattattgcttttgtagcattgtatcgtaaaacggcaacgtttcgccttttaacaagagactcgggttatataacaaaaaataaatataagtcttcttcttctccaatg

SEQ ID NO: 33081 - DNA, 3000 bp, Unknown; identical to SEQ ID NO: 1971
  misc_feature (1)..( 3000): 2750-1469P.txt file - cDNA_ID_3065366; gDNA_ID_1620473; Annot_ID_158055

SEQ ID NO: 33082 - DNA, 3000 bp, Unknown
  misc_feature (1)..( 3000): 2750-1469P.txt file - cDNA_ID_3065370; gDNA_ID_1620473; Annot_ID_158052
ttgtttcaacctcggacattgaagacaatttgaactttgcactattttcaattgctgcatgcttcataatatcatggatacttttagggcttaacccttgtagtcttgggcttgaattaccatctagtccttcttggacagcatttgcaatggctaactgctgaaacatattgcgtgtggcatctgtctgatcaacccaatcaacttgattgaagaactcatgaactttggaaaaaacttctattggaagaccatctttctcttccaaggaagaaaaattcatcaagtcaacagaagaggcagcatccatatctgagaagagaagcttcacacagaaagtactctttgtgagtactaagttacaatggagtagctatatgtaccatgtaaagagaatatgagctccatgagtacatacctcaactctgaacccctttgggaattcttttatatgccataatgtgtcgacttcatcacggttaagcatcaaaatgtttgatctaataaaagcagtgttaaaaaccactcgaaacatcatgacctctctttccatgtcatcgttcaaactaaggcactcgatcacgatatcaccttgcacatgacaattaatgtcaatcttgactagttcacattctgcctgcaaaacacaaagagttgagtaaacaacatcgaaaagccattaaatcatattgcaaacaaggaaaaagaaagctaagaagcacaagaaacagaaaaccaacagggctaatcagtgatcaaatatatttctttttctaagaccttcagatgcaatgtaacacaggctgagtcagaggtcataattataagaacgctatgaatattctgagaaatacctgcttgtagaccctcaggtgtttccctttcttgggagtagtgtacaaaagcttaggctttttatcatcaacaaaaaagggatcctgaccatatattcgaaacatagggcgaaagcctccttgtccactaacatcaggaataaatctcaaaataacacaatccatggtgagagccctatccaatggaggccattcagagaccaaattccttcttgacacgtactgtagataacgaagctgagaaggaattgggttcaagggcgagaacaaacgcagaagctcacgcggagcctgcttgtagatcatgtccaaagtcttagactcaccactatactgcttcctgtatataaggagggcagctagcataaaagctaaaacaggccaagccccactttcacaatgcattagtaacaagttatttggcccaagcgagagccaactttcacttgaccggagaaaatgatgcatcacttccacaggtaacaatgagcagccttcgtagtgccgaggataatccattatagtcaagccatgttcagataagacatcagccatcacacttcgagtacccacttcacggaaattaaacacaagagaagatgcttcagggaaatgctcttgtagttgattgactactcctgccatataaactttgtagttttcttcttcccatgaatcggtagagaagcagcaatcgaacactgcaacacacacagaagaaacttttttcagttcaatgtgttttttgccaatcatgataaaatgaaatttcatatcttgatttgtaaaactcccaaatttcagacaaattagcgtaaaaagtcccaacttttcagacactcaatcccagaagaccgaacaagtacaatgagctaaggaaaaatagataaatgaagcagagaattgggagagaaacagaccgaaaactctgtcgcatatctcgagcaaaccatctggaggcttgcggtagaacaatttgcgaaacaatgccattttatcaaagtcttaaaacctctcttcgaatttcaaaaatcgacaacttttgagttttcgtttgattacagaatttgtagcgaaagatgctcctttttggtatgaatctgttaaggtgatgttgattgatcttcgaacagaggaaaaggtcagctggcgcgttgtatgacgtggatcccacgatcagccgccaactctctacccgacctgacacgtgtcttctcatctacggacgaaccggcatttatctctcggcccatttaattcctcttaatgggcttttccttttcggcgcacaagttgtgatatctcgactctgttttgctagcattgtttcttcattctctctaattgcaagtttcagtctttgaatccgatgaaactcagatagctattggagctctgttttagcataagattgcttaaaatagtgagtggctatttttatccagaaaatgagctatgaatctgatgagttggtttaaactacattgatggctcttgtttttattttctcttatttgcggacattaaggcgccagtttaggggctaatcagaggaatgaatgattctcaatttccaaggtatctgtgacagagtcaaaaaagtgtgaaaacccctaaaaaagtgaatttttacattaataaccaaaacactactgaaatgagaaaccacaacaaccacccactcctccactcaccaaatccattgacaactttgggatttggaaaaattcacaaaaggtctgagacagattccatttatcatatttttcttataactcactagcgaaatactttacctaattataatctccacatatccctttttttgactttcaacgactctctcttctcttcccactttctccagtgtccatatacgatacaaccaaaaactcaactctcaactccggaactcccccaaactattcaactcttatcttcttcttctgaaatttcatagctttctgactaaaagttctgattttttttgaagctgtgcacgtgaaagggatttcaatgtattctaaactatcatcacctctatgccccgtgattccattatgtcttttcttcttttcacacagtctgtcttctttctgagctttcccatccaactttctccagtcccagacaccaccaagttatg

SEQ ID NO: 33083 - DNA, 3003 bp, Unknown
  misc_feature (1)..( 3003): 2750-1469P.txt file - cDNA_ID_3065378; gDNA_ID_1620474; Annot_ID_158106
ttggtggaagaagctggaatatgtcatagatctgaaaaaacccagaaaccagtgagattcaagttaaactataacgagaatggaattgaaacactgagaaatatttgcatacctggtccttgaaaccacgggagagcatttcatcagcttcatcgagaacaaacatcttgatgttgtcagcacgaagagactgcctcttcaacatgtcaaagacacgccctggagttccaacaacaacatggacaccagcttggaggatgcgctgatcctcacggacactggttccaccaacacaggcgtgaaccttgacaccaaggtaatcaccaagggccctcatgaccttctcaatttgctgagcaagctctctagttggagctagaaccaaagcctgacactggataagggagaagtccagctgctgcaagacaccagagcagaaagttgctgttttcccagtaccagactgagcctgttgaatcacatcaagacccttacagaaggggacgattcctctttgctgaatagcagaaggcttctcaaaacctaagaaaaaacagaagcacgcatgagataatgttctaatctaagacataaatcacaaaagatagctttttcaagttcctacacacataccataagcataaatacccctgagaaggttctcttgaagacccatggcatcaaagctctcatgaacatcatcataggatgtgaagaactcatcttgtccctcaagtctgtatcaatacagtacaattagcagctagagcatgcggagagaacacactcaagaatgaaaaaacagaagtaaaaagactcacacttcattgagtttctggtcaaactgacgtgcatcaaactgtgtgccttctggtgcagatcctgccatgctacataaaaagaacaaaaacaatcagatttcatatcaaaaggaagagagacaacacctattttgatatcgttaataatatgattgcaaaggaggaaatgtgacaagaaagccaaactcgaagtccataaagagaggaaaacaagcattaatatctgcctcagatgatgtgcggagaaaatgtataaaggcacatatggttatctattaaacatagacaccactcaacctatttctccaaattacaaaaaaaaacattcaatcagacaaaaccaagtgagtgttaagacaagaacatctgagctttgaagacgattcatttcattctattgagagactaacctagccgtaacaaaatctacaaacccatcaacaaatctacagatgtgtagatcctaaatttaataatcgtcatcatcagcagctcagaatctaataaagagaacaaaaacgaaagcacttccacagcaaaaaaaacgatcttgaagtaacgaaaaatcaaaacttccaaatcaactcaacaaagttgaaaccaaatctatcggaaaacacaaaaaaacaaatcagaacaatccaaaagtaaagaaacaatcatgaatcgtaaaagttacatcgagataatagatagacaatccgataggatgcgaacctggagcaaagttggtaagcgagagtaaagggcttttttcagggagcttgaatctcccaaactcggatctgaaccgcgttgagagagagagagcaaagagaagagcgaagattgcgagagactggtggaatatccgaaagaggctgagagaaaacgcgttaccttgtttatatactccgtctttagggttttctcctttggaaatcttctccttttctttttcggatttccggttttacccctttattccctttctttttactcttttggctcggacaaggttttccaacacttagctcattgtcttaacttgattttggcaaaaataaataaacaaatatctagtgggaaattaggaacataaattcttcatttattttgtgactagcaaagaaaatattcttcatttattttattttcttttccaaagctttctttctcctgcaacttttattgctttttgacgttacaaagcattttcccgattacaacgaggatattagaagaataaagtgactgataagaacgttttatctgaaaatgtctttacttattaacacatctatctctctatgttgaatgtttaatcatgtaattgttccacaagtgatatgaagaatccttgaaacgaagcaaaacacattgagtaagaagaaggtaactagctagtatgaagaagcagcaagttgctatctatcttcaacaaaaaatgctttgattttagcctcaagagactttcttagaatctgttgccattgaagaaaaagctggagagggcaaaacataatcatgatgcttaggataagcaaaaaatatgtatttagcttgtgtaggtagaggaagagctaggagttttttgtgtgacaggaatcgagggaaaacgatgggccaaagattaggcccattaataagtttgactaatccctgccgttcattagatgcctacgtaatcactaacgcacctgatgatctctgtcttttggtgagacgcaaaagctcagagaataataatagggcccaatataataaagtacaaaccgaaatttgtgaagcttaattagtcggtttaaatacttttatatcggttatggtagaattggtgttggtacgatacaatctggtacatgtaaggcagcattttgccatttctgaaaaacctaaacacaaaactatcttcatcatcatcatcaaatcccagctttcttccaagtgatccttcactctctatactgcgatttaccgttcttctgactcttggtgagttctagatcgaatcctatcttccatccacatatttactgtttcaaaattggattgagtacaagtcaaattcatcgatctcgatctctgatatagttgccgagggaaaaaggagaaaccccctaacaaacattcccaccattttttttgttatttgcagttgcgaattcggatcggctgacgcagctccgattgcacaacaatg

SEQ ID NO: 33084 - DNA, 3003 bp, Unknown
  misc_feature (1)..( 3003): 2750-1469P.txt file - cDNA_ID_3065410; gDNA_ID_1620474; Annot_ID_158118
gtgtgtgtttttactaattatgggtcgttgggtctgatcaggaattcaaactcaatccaaaggctaagagtttcaaaccattgcagtcagctgctgcaccacctcaatctccaatcgcagatgcctcattctactaccctggtcctagtcatgttcctgttcagcagatgcctggaatgccgcctgttaattacggagtaagttccgtttgttatatattatataaacccaaccgagttatgttttcaaaactcaccatgtgaaaattggcagctcccgccatatcctggcaaccaaccacagatgatgtatcatcctcaagcctattatcatccaaatggacaacctcaggtttgacagtaacacacaagccctattgaattactattcccacacacatacacaaaaaaaaaaaaaaaacatcaaaagtctaatggtgattggaattggaattgtgatgtagtacccacagcagcaaatgatacctggtcagcagcagcagcaaatgatacctggtcagcagcatcctaggccagtttattacatgcatcctcctccttacccgcaggttattatttttgctaatagtagattccctctttttgttctttttttatttttcttttacatagtcgaagagttaaaacttttggatgctgaaatctcatctctgtatgtgtgtgttttgcaggacatgccatatcataataaaggacgagagtaataactactactacccgatggtgatgatgttttttttttttgtgaaggaagtgtacgaacccctctctggttttatccactctcccttacccaatcactgaaaccattttcttctcttttttagattcgcctactgattttggtatttcgtgttgaaaacaaaaagaaagaaaaaaagaaagaaaaaaaacgatctatctgaagtctgtagtactgagtgcactctctccttttttttggctgtatcagagatataaaatttagagtgtaggttgctctcatgcgtcttttacttcgtcgtctgcatatttttttgtgtgtgttgtgctaaatttctgggtgattttgttatctaaaatccaaaaaggatgcggtttagatgaaaagaatagaagagtaacaacgatttcaaagcaggcagaactagtcatttttggtgttgttgtagggcatgcttttttcaataagtcgttaaacgttactataagtagttgtctcgcgattattatcatgatgatcgatatgactcggtgtatatgatttggtgggcaacacattcatgttttaagattccacaagaaaaaaataaaatggaatcaaacctagttttaccagtcgcatatattattaggttaggtgactgcattgagttgtttattttttacttttttacgagtctctctcaacatttattgtttttgctttaaagtggagattttaaccgtggcttgagcttgacacttacgaatgatgttgggtcaccaatcttcatctagaatttaccttataatcacttagttcaattgcgaatcatgttttcgatgtattttcaacaacttttcacgaaaccaactaacatattttacggtcatccgctatgatagaaaaaccgatgaatttgctaagtttgtttctttcttttcagtatggataccgaaatgagacaagaaaacaacgaatattcaactacaataccttacttgtaattgtaatgctctttaagaatctatcaaaactcatcgttatgcaattactgatttatttcatgcgagaaaaaccaaaagtccggtcaaacaaaaaggcaagtgtgtccttatgttgtgacgacgtggtttcatcatccaaacaccggacgtgaatatcacgcgcgcgtggatttcggaacagcgatgtggcggctgtgaatacaaagatatcaagcaaggtacacagaatgtgtgtctctgtttgtttctttaatgggacattttcacttcatcagaatctgatctcaccgtaagcctttatacatagttgtacccactttttctgttttaatcttaaagtttactattttttctagttgataaaatggagtactcattatttgttactagtagtaattaataaggacagaaaaaaaaaaaggaagaagacaagagtggttcacaatcataatgtaaacaacgaataataataattaatgtccaggtaaaaaggtagtgttcatggtgaattagtggtggcaaaaaagttggtactactgggagaaaaaaaaaaaaaggttaggtgaagctttttagccatagccaataatactactcaattttgcagagacagtgaaatgctgaaattgataaagagagaaaaaaagaagaagaaagaagccatgttttgaggaaggagacatgcatcatctcatccttttatgatttttttctacatcttcaccaaatccatagattctctctccctctgattttttggtaaatttggtcgctatatttgactacttgtactctgctttgagaagaaaaataaaaccatttttgggtgataggtgagaaaaaaatctaaatactttttttgtttcttcttttttagttatgttctgttttctcgcttgttgtttggatcaatactgttccaaggttggttttattttcccttctcaagttagtggaattgcatgtttgtgctttctctgttttttttatatctaatttgtaatcaaatccgttaattctcaaagtctgaatctttactttctattttagtatggtaataattggatctgctctatggtttctttctcttagatctgttgtttgttgctttttctttgtggatcaagaatggtttttgattccttccaagtgaataatgcaatatcaatatatcatgactggtttttttacttgattggaattacaggtgactgaataaacatctcttgtctcttgatggatctactatggtctggagattagttcgtttattgaactaatgttttagacaatg

SEQ ID NO: 33085 - DNA, 3003 bp, Unknown
  misc_feature (1)..( 3003): 2750-1469P.txt file - cDNA_ID_3065414; gDNA_ID_1620474; Annot_ID_158117
agagcaaaaaatggtccttttctcatttgtgtttttttttcgtgaaagtgacacagaggaagaatgtttatctctacctgtgacgtcagggacttaatctgcttagacctgggtgtttcaataactctgtcttcttcttcttcatcctcttcttgtttcttagatccaccattgttggtgtttagctgcttcgtacaagctatgcatgtcagcatctctatcactcactaaagagtttcaatttcgacctgagaatttagaagaatgaaacccaagtcacttcctccaccaaaaataatcaaatctaagaaatgagaacccaaaaaggctcataatttgtacctttttttgcaacagtagttacgcacttcaacttctaccttccaatatataaactcaacactcactaaagtcgattgcttttctctcaaccacagagattcagatgtaaaaccccaccggtgaaatgacggcgaagggaaggaggagaccgttgcggcaggggaaaattagggtaccaggatctgtagatcagacctagaaacgacttcgcattaaagactcttctttttttttaaactctctgggtcggtttacttgtggcttgaaagctcttatcagagagattgagtgagatacactcttaaatctcaacactttatgaaatccaaagccgaatgcagaagcaaaatgcaaaaaagctacgaatttttggggagagatagagagagagaagagctttgatatttgggctttgagatcgtcggacactgtgaaagtttgcgcacaagtgtggtgttgtgttcctcctccttcctaattcctatattaaacaaaaaagctctactcttttctttttcttcagagaaaaaaaaacagtaatggctattttcagattcgtctttaagtttgatacttatggattattatgaccaaaaccaaaaaaaaacaaaaacgtaacacagtttttactaacatagattaaccaattgaatagttctacagctttattgctattttttaatatccgcattttgtcaacttttgatttattatttatattaaattacttagttttgaatcgtcttgtatttcatttgctaacataactagtagtatattcttcaattttactgctttgagagtgaagaaatcggaccaagaaaatttcaaatgttattctcttctttatttcctagttttttttctttattctcttttcccttttcttgcttttttttaaaaaaaagaacaaataaaactattttcatagaaataatgaagccgtgcaaaatatccatggtgtggccacatattgacacgtgcatttttaaatgattttggctgtctaattttgcacccaaataaaggaaaagaaaaaggaaaccaaataactaatccattttgttatctgtcaattttctcaataacgagtatttcataatttaagacagtgactctgggaaatgtgacagaatgttactagttggtaattactcctaatttattcaaacatttagaggcaactagtcgtttaaattattttaaatcaactgcattcaaatatgaatgcaaaaacctaaaaaggaatatttacgagtctatataatgtcagatttggtcacaggagcgccgtgaagcaacgggcgagaattaactacactctgtggagtttcttaccatacactattttacaattcgtagttaatgtttttagttttttttttggcttgctttctctatttttttcactaatacagctgaaacatttttttaaattaggacaaaagaaaacagtttttatagcaatgaatgatcagatccgatactgcaaaatataaattaatttaatttttaccataccacgtgaatgatctgtgttttcttgtttgatattgttctttctctttccattttaatgttagctcgtatcttatagctataactatgacctatccgttacaaataatactttatgatgatctctctttcaccccatgttaaattgaacataatactcgtatagtcttaagatttctgtcttatctttttcaagtgtatgttccaaccaggtatcgtggtctggtggtaaaggaacctcgactgagacgtccgacacccggattcgatttctggtcaccagagaattaacatgcggatttgctctagcgcctcagaccaccagttccagggagccattaagtagatgtttaaaaattcctggtcgcgggcttaaacccagtggactagtcagatcactgtgtggtctggacactaagttgtcaaaaaaaaaaaaaaaaagtgtatgttccattgctaattagagaggtacaactttgaaaagtgtaatgtttcatacatgtaactcttatactttttattggccacaccagtttttttgtatttcatcattttaataatatttcagaattctccaactaatccatgtttaagtaattttggagtatttttctagtgatgcttttctgattatatatttaatttgatcaattatgatcattagtatttatgcctagctttatggtgacaaatagcatattgcaccttagaaactgaaaaaaggtataaagtgattttatcaaaaataaaaacaagtgatgatgagacatgcaaatgaagcatgtaatatttagattcaagcttgttattattaaataatcatttaaactttatagagttgtttttccaactaagcctattaatgctttttcccccaaccttttctgtctccttcaaggcttaagcactttcattataacccattttgaaagtcaagttaacattatccccatcattaagcaaaccatacccttttaaaagttcatttcgaatttgaagtatcctttgcttcaggttacttgcttttacaaaaactctttattcttgctgatttctttccacaaatgaaataaaggtaaattacaatcgaaggcttgatcctttatgttttatgtgtgttaaaagatttagaagttcttaatg

SEQ ID NO: 33086 - DNA, 3003 bp, Unknown
  misc_feature (1)..( 3003): 2750-1469P.txt file - cDNA_ID_3065439; gDNA_ID_1620475; Annot_ID_158154
agcctatttacgaagaggaaccgcaagagaaatgttaggcgattgcaagggagccatagaaggtaagctttaaagaacataatctgattgttttttcgccttgtagaatctggcagaatataacataaactctgcagatttcagatacgcacttgtgctggaaccaaacaacaaacgagcgtctctctcagcagagagactgagaaaattccagtgagcttcttttgtccgtacctcaccgatcattgagaaaacgtttgttccttagaatttgtccaagagtataggccaattttgtcaacacttgtcttttgcgtctgatatttaggcattttatctagagataccttttgcaagtccgccgagaatggaaaattataatatccgatgtttattttaaacgttctctaaaattggatatcaaaaagtaatgttaatcttaaacaccggataccggcattcccggtcgacttctagtcagcgtagcgtcaaaaataaggtcatgtctttaactatcttgtctttatcattttcttttctcgcacgttatctcctccccacgactcaaaaaaaataaacagaaaaaaagaggagtagaaaccaaagagacctgccctaatatttagcgatgatagtttgaacggaacgaaatctgacgaaagaaactaaagagacctttgaattatcttcacgggtgagttggttcgtttaaccttttttctttatctcggttgtgcttttccccgagaattaaacgtgtgttggttgcagcgttaacaaaaaaaaagggttgtagaaagtgagtaaggaagaaataatcaggaacattaataaaggaaatgacaacggcgtgtccggcgaggacaagctcactaatggacgatctcttgggcctccttagaatccgtatcaaacgtggcgtcaatttagccgtccgtgacatcagtagcagcgatccttacgtcgtcgtcaagatgggcaaacaggttaatccattcatcattttacaacttcacatgcaatttcattacatcaaaaacattctcaaattatcatattaaatcttacagaaattgaagactcgtgtcattaacaaagatgttaatccagaatggaatgaagatttgactctctccgtcacagactccaatcttaccgtcctcttggtactttttacttactaaaacatacattaatttccttatcataagatgtttatattgataaaactataatgttatatgtagacggtgtatgatcacgacatgtttagcaaagacgacaagatgggcgatgctgagttcgagataaagccctatattgaggctttgaggatgcaactcgatggacttcctagtggaaccattgtgaccacggttaagccaagtcgtcgtaactgtctagccgaggagtcacgtgtcacctgggtcgacggcaagctcgtccaggatctcgttctcagattgcgacatgtggaatgcggagaggtcgaggctcagcttcaatggattgacctccctggctccaagggtctatgaatcttttttcttttcttatttaccgttactttgagttgttttctttcaaattgaactaaaccaagtaacagcatggaaaaaaacaagtaatttcaatcttgaaggatatagtgaactagaaacacgtattaatccatggaaatataaggattaagaacgttgagggaagttttgttcccatatggtgatcgagtccaagtcgagtcgtggtggtggatatgtaaatgtggtgtattgttgatgtgtatgtatatttgggctagctatgccttaaataaggcatttacacgaacaactaatacagatattttatttatttaattatcgttccatatacttatgaatggtagattgttttaacacatgtgatgtactaatgtttataggtaaaaagtgaaaaaaagaccagcatattaccatttaccatcgacatcgataggccttttttaaaccattgacattggaggttttatgtgtacgttactgaagcacaacttatgtaatttttgtgaacaagatttacttgtacattagcgctaattaaggtcataaagaataatgatgaagaaagaataaaatatcgaagggaaaaagccagaagccacaaaagggatggtaggtgaagagaatccagatgtacactaatgagtgaagcaccatggttttataacgacaaaacacgtgagccataattgtcctttactatgagtggcacggcgactttacaataatgtgtcaaacgaccgtgacaagagtgaagtgtagtactagtatgtgatatttttctctatttaataaagtaaaagattcgactgtagtatgatagtattgagatatattctaaattatgtataaagtttgatagatcccaagggacccaaatctcgttccccaatgagcgatctagagattcctcttccaccaactccccaaagtagtcaacatttttttaccaaaacaacgatttatttgtagaataaaatctgtcaacatatatattgcatataaatgcaattgcaaatgtagttaaaaatatatataaaccataacttaaaatgagtgacagcacaacattaactaaaatacgcttattattattaccggttttgaccaaaacaaaaaaaatggagatatttgtttaattaccgactgatttgattttacagtctgtaaaaaaggccgaagtcgaaggtaacgccaccgttttccacctataaaaaagggcgcgcaggcaacatcacactctcacactcttttcgctctcagatctgaaaccttatctgaattacatttccccgattcgacgttgtgcgaattgatgcagcagagaggacgatccgtcaaccgcagatcacgaagcttctctagatccagactcgccgtcgaaggccactgaattactctctcccctctcttggcagatcttcttcttcgttttttcccgacaaacgacatttccgaaatg

SEQ ID NO: 33087 - DNA, 3003 bp, Unknown
  misc_feature (1)..( 3003): 2750-1469P.txt file - cDNA_ID_3065443; gDNA_ID_1620475; Annot_ID_158152
ttcccttcaaataagaaaaacaaagacgataatcagaggattaggatttggagacaaaacagagatcatcattgaaaggaggaagaagagaacaaaccgttcttgtcgggaacagacaaagaggtgatggtggtgccgtagtttgagatcttgacctgcatggtgccattgttgagctcgaagatctctggagtgtttttgctctgatccgccattagagggctcgaagactaaattaaaggctttaagattagaagcgaagtgattgggattgagatttttgattggggagaaacaaaacagagggtgaagtgattagctttggttaaaagagttataaaatcgtaatctcgtaactgatcaatgttgacgtcatccacatcccaaactatttatcatttttaccccccaaacaaaaaactatttatcttgggggtttttgtttttcgttttttacactttaatgcatttctaaactttttgaaaatcaaattactacccaaaagttaccaaatttactttcaggaattcaaaagttaccaactaaaatccaaaactatagagattagagaaaagaacaaatgtagaatttggatctaattttctaattatcaataatattttaagtaaaaaaatatttgattagtcagttataaaataaaaaatttgataagtcggattatatgcttttgacaataagagaaagacaaagatatcatcagataacaagaaaataaataaaatatactctaaacatattcagtttgaccccaaaaaaaaactctatacatgatcgtaacagagtattcgcgtgaatttagatgtagtttctctaccctttttcaggtatcctatgaaaaaatcaatagtacctataaaagcttactttgttgtaatttatcctcttttcgtaaattttaatttgctaccatccaacatgtctcagcttttacccaaagtttacaaaaaaaatgtctctgtaaaggattttgattattcccataactagaaacaattaaatcaaatttatcaaaaatatcaaagctctctgagacatggaaagaaatagtgtaacagatggccaagaggactttagcttaaagaagcacaatcatttcaaaaagcaaatcatttgtcactttcttcttcttcacctatccatccacaaaaacactttccttttcctctcatcaagaaactccctaatccgacgtcgttcgttttaattcagtgacacaatctcccacatcttcaaaccctttgaaaccagcgattacagagatgcaagatcctcatgtcccatcttctccaactatctcctccgtctcttcctccgatcttgatactgaggtcagttcctgcaatcttatacttaatagataatctaattaaagatcaagctcttcatgtgttttctaagctacccataaagctttatgctataaagtatcaacctttaattagaaaactagtttaaagttccaaaggttatgttttcagaactgcccagaaacatatatatgtacttgttagaacttgatttggtttttttattggtgatgtgaggatttagtcaacaggatcgttcttccatgacagaagcatcacacttggaacgcttatgggatttagtttcactgcaactatgccgatgccatttagagcctcttcacgccgccacgtgtcaccttccgtcgcaatctcacgagcttctagctccaatgcaagacgcaaccaccagagaaagcgtcctccttcaaattcggctgagcctgagccgcatcgccgccgtaaatggtggcggttttgccgagatgacgatgacgacgccgccggaaatggaatccaccgtggaacaggagattcaaagcggtcatcgctcggggagtatctagaggtggaacggaggtttggagatgaagccgtttacaactccgccgaggcagagctagaggatgcggtggtggcacggtaccaagatcagcagccggtgatgggggagcgggcattgttcgctgacggaagggttcttcctccggcttcagctgaagtggttaccggagaaggaacgccggtagccacgtccctttgtagatttccggtatctttaaccggtatatgcagcggtggtggaggatgaatacgtcggttcatgtgtgtgtcttttatttgtatttagacttaaatttttgtattttgttcgtcgaatcggaatcattgtttgtggaaaatataacatgttgaatgtagtcattgtcaaagtaattatttgagaaataataatgattgataaggagaattatgaaggagattaattacaatggcaatagtaaaagataagcatatagaatggcacacatgcacagcttttggtgtaaaatggagttgttcacttgattagagtttttatttaaaatgctaaacgttgttctatcatattgagtttttgcttcaaattatttcatcaatacgtctttatactagtcagtctttggacaataatttgaccaaatcagattttgaggcaaacacaatatgattctggccaggagtgtgccacattcgtggttaattttccactagtatttctgaaagtaaaacaattaaccacaaatcatcctcataacataagaggagaagattcctaacgacgaagcaaaattatcgaacaagtggacacacacaagaaaccgaaaatacggcaaaatgtttgttatgtgtatccatattttataccaattgaattaataaaataaactgtaaaaacaagaaacaattaataaaattaattttttgttttacaacgtgaataaaaaactgttgacaaaacgaaaataaaataaaccctcgagtgatgttaaaaaaaggaagaaggaaaaagaataaaaactcaaagggaacgcaacacactaaacaaaaactctttggcgtccttctccttagggtctatctctcttatcttaagcagcagcagcagcagctagaacaaaaacgtcaccgatg

SEQ ID NO: 33088 - DNA, 3003 bp, Unknown
  misc_feature (1)..( 3003): 2750-1469P.txt file - cDNA_ID_3065451; gDNA_ID_1620475; Annot_ID_158146
ttagatgacagatcagatcagttgaataagaagagttaagagagcagagatactttaagtggtagtttgctacgctatcggttggatataacaggatgaaccaagtaaaaaaaacagaggccatgttgagaaactaacaattgtcgagacacaaattaaaaactgaaaatgggaaaagataaaacagtaaataaacgacaaatacaagttgatagagggtggtgcagcttgcttgatttgtacagagcttggaacaatctacgtctatagactcgccaagatccacttttttgaagtatcccttctttccaatgataaaagctatgttgcgagtagggcgaggtatatacctgtctttatcaagtaccacagcgaccttcttcttctcgtcaacgaagaaactcccacctctaaccagaaactgaaaaccaagaccggtgattggtttcatatcaacctttaagaacaacttgttccacgataccgcattgggctcaatcctgctactaatccatatcttcaccgtataaccaccacattgttgaaatagcaccgcaagatgcttttctctaacactagaaagagtcacaggcagaggcagacgcggtccaaatctctctgttttagaatcaaaacatagtaagaaatcagggatatctcccacttggaaacaataatatttttgccagaactaaagctaactgatttgtccattaacctaattgatttacggccttataatgatgtaaatgggctcaacatttggcccaacaaaagagcagtttcctaatttcatctgattttggcagcaaactgatcgtaacttggattctgtctgtgattaagtaggtagtcattcataaatctggagcttcgaaaatctctctggtttaggtaattactgtcgcatataatgatttattgctctaaatccaacttttgaaattttccaattacgaccaattctctataaatttctcagcaaaaatcacggcgggaatatgaggcggctaccaccgtggatgctcggtggcgcgtcaaccggtgaagcagctgcacgcaatggttcacaacccgaagctcccaaaacaaaggctgaaaaacgaccaaaaagagtccaaaaaaccaaagagaaagacttaaatctcaagtcagatgaacctaaacgagttcccaggaagattagggaagaagctaagcgtagcccggaggtgattcaatcagtgactgttcctgaagatgatgatctcacagttgatgacttattaagctttgctaatgaggtaatgtaatacttcagttccacagtttttactattaaggatttgtgaatttacttaacaatgaatctcagtatgtccaacgtgatgaggaaggaacaagaaaggagcgtgaaagaagcttgtcagtgtctgaaactacgctagttctcgatgaaaccaatatgactacatcatctcaaggaggaaccaaagattcaacagcagaagacatgttacaattgctaatgggtcctttttacaagaaacgttagaattgaagcacaactgagttttcaagtgcttcaacatttcttttttacttttgttactgttttgaattctgttccagagatccaacatctttataaagctttgtgtttttttctccaggaccaaaaatattatagaatgtaggagctactgagttcataagcccatagaaagagcaaacgaaagcattgtgctcgtgaaaattagatttccttgattttggcagctaaaaggaccgaaagcaccactttttcaagcgcatcagtgacgtgctgccttaactaactcaatcacaaacctaaagataaaaacttcaaagagcttaagaatcaaagacactgactaacttgaatattcccacagttacgatggctattattggttaagagtggggatgggtgtatatatagtgacggccacatgtagaaaaccctagttgatcacggactaatgggctgagtttgttatttcctttattgggcttgtaagaataaatcacttggtcttagtagtttgtaagttagtggttacctccactaaatgaatatctttgtaattgttggctaactttaatgaatgtgaagcatgcttaagaaaacaaggcaaaatgtaaaatgagaagaagagaatcaataaagacatttaccctcctaatcaatctttcataaactgtatatgaattttttttagggggttttctgaccccaacataatttaaagtaaaataaatttgatcatatgaaagtttaaggaataattaaacaggttgtatcgccggaggtgtttccgtttacctctctcacacctatttctcttcttctatctgacattcgaaagctctctctctctatctctcttttttaccgcgcttgctacacattgtggcagacatcaactcctacctaaatctggtagcagcccattttcagatcgaattgaccccaaggagatcacatcaggtataagaatctcaagttagctcgtatcgtcttctttagctttcactgcgtttcccgttgcttaaacatgttcaatttcgatttattcgagtgtgatctggatcggcttcgttatcattttcgtttttttcccttctctgagtttggatccagtcaagtgatttagatgcgataaagctgggattgttgagagagaagatcaattctggttaatattgactatatttggctcttctgtgatttgcagtttttgggggttttgaggaatgaatttcttgcttcgatctgcttcttccgctactcatcggcctccggtgatcgaaccaccagctacgccgcctcaacctccccctgaaacagcgaagcccggagttactttggaagggctgattgctgaagagcatttcccacaatatccatcagtagatgaagatctcgatcgtgtgggtgatggatctggagaccttgatggtaatggagagtcaaatgctaagtctggtggctctggtatg

SEQ ID NO: 33089 - DNA, 3003 bp, Unknown
  misc_feature (1)..( 3003): 2750-1469P.txt file - cDNA_ID_3065457; gDNA_ID_1620475; Annot_ID_158144
taggtagaaagattaaatatactcaaaagagtgagttggattagtttataagatgattaacttcttgattgtgtgagttggattagtttatgagattattaaaatattgattgtgtatttgtgttgtgtgttgattaagcggaacttgcgttagaatattgttcaaggtacaatgtggaaataatagttttctcaccacgaggaatataattatttcaactttgttttcttatcagccaaaacgtgccacaccataaaagtagtgcatcaacatgtggtgtggtgtggtggggttaaagtttgaatctctctttaatttaaactattaaaacaaacttaaattattggagtttcgtacaatgactttcaatcaaatgttttagaattagacacggttttcgaaagtggttttccctcgttgaatttgtcaacagtatcagattctacattgttggttactaatcttttccttgaagtaggtgttgaattaatcctctgttgtttatgtaaggagatctcgagacatttatggttaacagttaacactacatgtttgactttaaactgattatcttttattctttttcttttgtagctcccaacagaggaatgaactggtctttctcaaacaaagtatcagcttcttcttctcagtttctatccttcaggccaactcaagaagatagacatagaaagtctggaaattatcatcttcctcactctggttccttcatgccatcatcagtagctgatgtttatgattcaacccgcaaagctccttacagttctgtacaggtatttgtcatcaaaacctatgttaaccaagacccttgtgttttttttatccttcgcaagatagctttaaaagtgagccctgttttatgagcatatagtaattggttttgagtctagtttagcacaagttcatggcaattagtttgtggatctaatcttggtttaatactgattcattttaagtgtaagctaagcttctcatttttgataagttagttcatacaatgcctcacacctactttatggcttgttactctcagggagtgaggatgttccctaattccaatcaacacgaagaaactaacgcagtttccatgtcgatgccgggtttccagtctcatcattatgcaccaggaggaagaagcttcatgaacaataacaataactcacaacctttggtaggagttcctatcatggcacctccaatttcaatccttcctcctccaggttccattgtagggactactgatattaggtacccactagtcatcatatcatacagaaactctttctacattttcatagttgactaaagacttatttttgtcagatcttcttccaagccaataggttcacctgcgcagttgacgatcttttatgccggttcagtttgtgtttacgatgacatatctcctgaaaaggtatctcaatcattttcttccatatatgcatctcttttactcgtaaggtatggtactcatttgctttctttcatttctcaggcaaaggcgataatgttgctagctgggaacggttcctctatgcctcaagtcttttcgccgcctcaaactcatcaacaagtggtccatcatactcgtgcctctgtcgattcttcagctatgcctcctagcttcatgcctacaatatcttatcttagccctgaagctggaagtagcacaaacggactcggagccacaaaagcgacaagaggcttgacgtcaacatatcacaacaaccaagctaatggatccaatattaactgcccagtaccagtttcttgttctaccaatgtaatggctccaacaggtaaaaaacaaagtcagagacctgatactacattcgccatctaacttactagtattttcatggatgtaacttcattctcgttctgtttcttatgcagtggcattacctctggctcgcaaagcatccctggctaggtttttagagaaacgcaaagaaaggtacgcaacacttctttagaatacaccattcaatagtttcttgggctaactctctttctcgctgtgggtttctcagggtcacgagcgtatccccatattgcttagacaagaagtcatcgacagattgtcgcagatcaatgtctgaatgcattagttcttctctcagctctgcaacctaatttcatctacagtaagaaggttgctttagaccactccacatccatatttgcatttcaatggcggtcttttcaatgtctcagttaatttttcctcactcgccacactgagtttctccttagctttatatatacgatagtgtatactttgtttacatgttttttggtggaatggaacttatgagagcatatcagatatgtacttgggaaaattagtagaaactgtttgtttctttttttttaactctgttcttttgtatatatcactgaagctcgcatatgtataattcatgtaatggaattgcatcgcttctgtttccctaagttatttctctaatcaattttctattcaaatatggggatttttttaataggatttgctaatttgtactctggttaacaataagcttgatacattaccagttaccaactcgaattcacaaaagaagtcatcattatatatggagaaaatggaacatcttttagaatttgctttaattcgttttggctaattatttttcggtcttcgttttggctgtgagtttctttgtaacatcctaatttcaatatgtgggccattttgtgttgtagcccatcaaggcccaatgtcttattgcacaacgaaaagggatgttgcaaaagatgataaaccggatatgaattcagtcgcggttaagttaacgcgaagacaaaaccggttggacatgttcggttttcggcgatgattatttcaacgtttttcagtctaatcaaaaccaatacgagcagacacagctccgtacgatcacaaggattcactgatttctaagcttttcatagaaagaagaagaaaaaggcggaattcgatg

SEQ ID NO: 33090 - DNA, 3003 bp, Unknown
  misc_feature (1)..( 3003): 2750-1469P.txt file - cDNA_ID_3065461; gDNA_ID_1620475; Annot_ID_158143
catgtcaagggagaagagtcaggcaaaacgatcatacaagtcacaagagataaagatggttcaagatgagttcgatctacttctctttattttcagatcaacagttttgtaactattttttatttatttttcagtaattttgctagctaaatattaaatgatgtgttcacgttacgtctatatctcaattaataacattactttctgcttttcaattatcgaatagattgaatccaaatttttttatgacgaaataaattactataatggtatgcatcatgagtgtactattgtattcttgcatgtgatttttgatcaacatggtgtttttgtcattactatcaaaagacttccatcgctgcgatattggattgtcagaactcggaaaaaaacaaattatgtcgtagctcaattccacgaaaaagtctaaaacaataattagcagctctatatagataatcgaaggcaaaggtaattgtttataattttgcaaaagcacgacatataggataacgtgcactcttcaaaagctatttagcaatgcaatcacggtggaatttgtgcatgtaatctcttagcctaacataaccaaaacctatggtgacatcttctagacagattggggaaacttcttcttcgtctttccctaaactccccttgttcttctccaccatgcacagccctctctaacttccatgaaattccaagacgtggagatacattttggcccctgaatcttctcagctttatacgtacacctccatcgtaaattattgcggaggcgtaaacggtgaaggcgccgtaaacaagggtcgaaattaggcaaacaagtcggcatacgatgtcaagagcccacgaaagactaattgcttctggatgtccataattactagcaaataagtctatatcaaaataaaaactaaaatgtaagtattaacaggtgagaaatgaccagatcattaagtagggaggctcttctctggatctggctcgacgtcgacgagaagcaggatgagccatcaaaggatccactaaagcaccaaactcaaaaaaaagagagccaaatattgcaactactcaagtcagtctaaatatagttaaatgctgcgctatatatcatgcatatacatatgtcatttgattttctctttgccattatttactctcattcgattttaatacaaaattatttaagttgttgttgtaaacagacgttgctgttgctgttgagtttgatttagaatagttaagtttggttttggttggagaaaagttttcgttgttaagccaactcgtgatcatttaatctgttctttttttggtagggggtgatcattgaatcttttgttttgagttttgtatgtctatatagagtctaataccattaaaacaaaaaaaatgtcgtggtaaccagaattaaatgatgtaaaaacagaaaacaagaattaaatgtcggatgtaaaaacagaattaaatttcggatgttttatgtggatcatagcgtgagagatgcgtttatggcatcttttgatataatcttcgctttgtaggtccacttttgatctgatctgatctattatctatatggaatgttgtgtatataataaactgcagtgtagtattttcttaataatgtgatattaatatctaaattctaggctggagaaaatgacgtgtgctgcatatcccccagactcgaaataacgatgttatcgtgggagatgatcgtcaattttttttttgtttagagatcgtcaagttgttgtgatcattgactcctttccattttttctatagatttgaattttaaatattcattttcataaaaaaatgaaaactttattattatatttgtgagataattagatatgttttaaaacattagtaaatttagtatagtattagtttttactaaattaagaagaaagtgacgcacgaaatggcgtaatttcctcccccggaccacatgcatcttataaatacacaaaaacgatgtcaacgagtgattttagtaatatgtacattaaagtaatattttctttttggtaccaataattaccttaattaatacaagtatagtttaagcaacaagcaacattctttaataattcgcgaaaaatattaataaaagtacaatgacagaaaaaataattaaaaattggattaaaaaaaataatattagagtgatgacataatcacatgaggatttagatttagcttaataatgtttagttgtggaactaaatttccgcaacaattattttgttgtatttaaatcattttatgaaagtctaatctttacaattactttatagtaccatccgattaatcaaagattaaaaatatagtactaaaatacaaattaatatattttgccaaaaaaatgcaacgtgcaaatgtttatcttggtcaagagaacgtgcacgaaagtagtgtaactaattttactattttagattgagcggtgagacaaaaagggggttagactcacgcgctacacttagcgcgtcagccgacaaaaaaaagtgttgtcattgaataaaaaaataaattaaaactgccgcttcgcatctcgtgaatcattcacgttaaaatagcgcacgtgcctcgccacgcgtctcaccacaaaaagaaacgccacacactgcacgacgatgcacgtgcctttttaaccgactatatccggtgacgtaaccgggacaacctgtagctggtttttgcgccaataggatatgagaaaaaagaatcttttttttcttgttatagttataaattaatggtacgattcacatgtcgcatgcgatttgttaataaaactagaaattgcggtgaattaacttcattccacgttttttcattttctccctcaaaagtctctgttttttttcctttttccggcgaagctctatttagcttgattccggcgtttaacacgcgttttaatcgaaacagacatttgagatcgaattaattttgtagcgggctgtgtctttattatagatg

SEQ ID NO: 33091 - DNA, 3003 bp, Unknown
  misc_feature (1)..( 3003): 2750-1469P.txt file - cDNA_ID_3065467; gDNA_ID_1620475; Annot_ID_158140
aactccattaaacagtgtagtagttgtgatggtaaaggacgtgtgatgaattctcagagaacaccctttggaatcatgtctcaggtaattcattatacccgaatactgtattgatcacttgctattactaaaatgaaatttttcatttcccttgatgcttgctatagatgataatatgtgtcatataggtgtccacttgctccaaatgtggtggtgaaggaaaaactatcactgataagtgtcgaaagtgcattggcaacgggagactacgggctaggaaaaagatggatgttgtagtccctcctggtgtcagcgatagagccacaatgcgaattcaaggagaaggtaacatggacaagagaaggtacaggagaatctgctatgatcttttctgatattaactgctctggcgattggttcttttcaacatggtttctgttttccgtagtggaagagctggtgacttgttcatcgtacttcaagttgatgagaagcgtggaattcggcgggaagggcttaatttatactccaatatcaacatagatttcacagatgctatacttggggcgaccacaaaggtggttataaaattgtttattcctggtgacgttattcggaagtatgaatcttgtaggcacatgacatctttctttgtcaggtagaaacggttgagggatcaatggatcttcggattccgccaggaactcaacctggcgacaccgtaaaattacctaggaaaggagttccagacacggatagaccttcaatccggggagaccattgctttgtagtgaaaatttcgatccccaaaaaactgaggtttgtctcacatcacttcccttttttttccctttatgtcgttattctatactaaaaaactgcttgaaacatcgaatatggtagcgagagggagcgcaagttggtagaggaattctcgtcgctcagaagatctagtagtagtactggacctactggtacaatgctatcccaatctaattgaaactcataattttcaatacacaatgttaaaatcttataatccccacttgtagaaactcgtcaagaggagcagagttttggctcagagcccagaaaagaaccatctttgtggcataaaatgaagaatttcataaggtaatctcatagaaacctttttctcagtagttcatcaaaagacacaacattgttgtcttggtctgatacatagtttttaatgtcacgtgttatatagaccagaagattcaagaacgaaatttgggactatgagcttaaacccatcattaccattacgaagaatgaaagtgtcagagacttcaattgctttttcagtcttggctctgtgcgttataacctcggctgttgcattggtacagaagaagggtaatcgcttgaaacaaaagaaagaaacttaatttcgtcaaaaaccctgaaaccccacaggtagaagtttaatttcaagtaacagagagctttttacaagatttaaaaggccctcggtcatacaattctagtttctagagattgtttgtcacgcagaagagatatgatcttgtatgtatgttttatcatttatatatggttaagagcctagttgtgatatacaacgaaaggaatgttattacttgaacaaatgtttatgtatgctagaccagcttaaaccgtgacagaactatgctttgaactcaattcagtcctcttatttactttgtttgtccctctctcattagaggaacctttttaggcaatcaagaaaaggtttcccataatcccatatctattagtatagtcttttattgcttagtgggtctcaacacacagctactatacttagtatttacattatgatgactaacgtctttatcttccaaagtaaaacaatagtaaagccagctagatagttaaaaacacaactcaatagtataccttttgttaaatggcttaaaaacaactcaatattccaactaccaaactgtttatccacatgtgcgatcgaaaatagatccattaaattactacacttcatatagttttactcttttcttctaaaatgtaacgcccaaccacatatcaatgtaaccgtcgtgaatcttttttcatcttttattgtaaattatccaaaatatgaatcacaataatattacctttgtggaccatgaaataatttattcgatggatagaaaaattggtaagatagtaagattaatgggaccctttagattgatgccgttgatatgcagagagtggagacaataaaaaaacagagaatgcgttacttgtaaataaaagagcctactttgaatgctgttaaattattgttgttggcttttttacatgtttatggtcctacctttctctgcatacccatgttcatttttttcttttcttttacaaccatgcattatcatactactatagtaagaaaaaatcaattttattattaaagaagcaaaacaaaaaaaaatacatagaattaagtgttatcttgagaagagtgattccactttactcagatgcagggaatttcataatcaaaacctttgtattccatttctccataaacacacacacccacttgctaattttcttgttaatccgattgattattaaactctaagtttttgtaatccagttaataatctttagcagttggaatttagataagacaacacagcttagtggtacgaatgattcacataagattctataatatcaataagttaaaacataaaaaccaataatagaaattaaaaaaaaaaaaatacaaatatttttgtcgaagcatataaagacatacgtcactgttgtatagaaattgtcgtttttgtcacatttagattttaatttgaaaaaatttcaaaactcgaaaaaaacaaaaagtggagaaaaagagaaagagagagtgttaagagtgttgactagcttcactctttctctgtaaaccacacacacagcttcttcactgagagcttttttctagggtttctctctttgtttcttacaatg

SEQ ID NO: 33092 - DNA, 3000 bp, Unknown; identical to SEQ ID NO: 1997
  misc_feature (1)..( 3000): 2750-1469P.txt file - cDNA_ID_3065483; gDNA_ID_1620476; Annot_ID_158172

SEQ ID NO: 33093 - DNA, 3000 bp, Unknown; identical to SEQ ID NO: 2006
  misc_feature (1)..( 3000): 2750-1469P.txt file - cDNA_ID_3065519; gDNA_ID_1620477; Annot_ID_158207

SEQ ID NO: 33094 - DNA, 3000 bp, Unknown
  misc_feature (1)..( 3000): 2750-1469P.txt file - cDNA_ID_3065527; gDNA_ID_1620477; Annot_ID_158204
tgttctttccacctatgtgtgtgtgtctctgtgatgtttataaaaaaaaacaataaatttttttagaaaatatctggatgttccaggtttgttattcgattcagagcaaaacgattaagtgtttaaatggatttagatttacagtaaatatccagatagagagaaagaaggataaggagagaagaaaacgattactttcttctattcttgttcattacaaccttataatctcaacatttgttttttttcttttgttctctctttcttacatatttcttttggatttcgttgtcttttttttttctctcttttcttctcctctctctcgctcgatttcaatttgggcgagaaaggagcggtcttttgtctttcctgggtttatcagctagatccctcttgcctaaagtttgtaactttcttagggttttcttctgatttcctctctctcggggttaattctgctcaaaaatgtaagcccttctccttttatttcgtttgttagattttgttttgcttgatctgattctgttatgtaattttgggttcagggtttgattcagaggcaaatctggttttgtttagacaataaagttcgggactttttgacatactcacagctggtttttagctttggttcttatagagagtaatagtagtgaagggtttgtgccaatagttagaaatgatcaaacagatatttgggaaattacctagaaagccttccaaatcattgcagaatgactccaatggtgaaggaggtgttaataattcttattatgcttcgaattcgagtactactagtatctctaaaccttcttcaacatcttcgaaatcatcatcagcctcgggttcgcgtgtagctaatggaactcttgctcctaactcaatgagctctaataggaatactaatcaagggaagaaaccattgggaggagatgctgttgtacaagctggaccgtttccgtcttctggtggggtttatgaggctttgcctagctttagagatgttcctatatcggagaaaccgaatctctttatcgggaagttgagtatgtgctgtgttgtttttgactttagtgatccgtctaagaaccttaaggagaaagagattaagaggcagacattgcttgagcttgttgattatgttgcatcagttggttttaagtttaacgatgtttcgatgcaagagttaacgaagatggtagcggttaatctgtttagaacttttccttctgcgaatcacgagagtaaaattcttgaaatacatgatatggatgatgaagaaccttctttggagccagcttggcctcatgttcaagttgtgtatgagattcttctcagattcgtggcttctcccatgactgatgcaaagcttgccaagagatatattgaccattcttttgtcttgaagctcttagacttgtttgattctgaagatcaaagagagagggaatatctaaaaactattctgcatcgggtgtacgggaagttcatggtgcatcgaccttacatcagaaaggcgataaacaatatcttctacagattcatatccgagactgaaaagcataatggcattgcggagttgctagagattcttggaagtataattaatggttttgctttgcctttaaaagaagagcacaagctcttccttttgcgagccttgattcctctccacaagcctaaatgttcatcagtctatcaccaacagctttcgtattgcattgttcagtttgtagaaaaggacttcaagctcgctgataccgttattagaggtcttttaaaatattggcctgtgactaacagctcaaaggaagttatgtttcttggagagttagaagaagtcttggaagcaactcaagccgctgagtttcaacgttgtatggttccattatcccgacaaattgctcgatgcctcaacagttcacatttccaggttcgagtctttgactatcatcacaacttcatatctatctctcttgataaagtcttgtacctatatatgaagttgtactttttgtttgtcaggttgctgaaagagcattgtttctatggaacaacgatcacataagaaacctgatcactcagaaccataaagtgataatgcctatagtcttcccagctcttgagagaaacacgcgtggacattggaaccaagcagttcaaagtctgactataaacgtgaggaaagtattatgcgagattgaccaagttcttttcgacgagtgtttagccaaattccaagtagaagaagtgaataaaacagaggttaaagcgaaacgggaaaggacatggcaacggttagaagatttagctacttcaaagaccgttgtaaccaacgaggcagtactggttccaagatttgtgtcctcagtcaatcttactacaagcagctctgagtccacagggtcgtagtaggctctcgtaggttactatgtacttgtaacaaatatttgtggtcactatagaaatggttcttgagagacgactgtataattatttttttaaattataatcttttgggtcaaattgagaatatttgatattattttactgaattataataaacgccgttaaaactctcgttagttaacggctgactctgaagtgaaaactgaaaagtcgaagggtctctttatattttcagaatcaaaatctgaaatttatctctcggtcgatccagtcttcgtgagtgacttcgacgacgacgacgagtcacactactcttgagcttctcatacttcgtaagttcactctcctcttctctaaattgacaaactttttcttcgttttctgctattattgacgacgagacttgattttgttttgaaatgaaatggttcaagtagctgacttcgactatgttcttttgggtttttgtcattgaatcttacttgtctgatttggtcgatgtttaatcaattcaacacttaaagattcaatttttggattgacacttgcacatttttattcagacccaggttgatttgggaaataatg

SEQ ID NO: 33095 - DNA, 3000 bp, Unknown
  misc_feature (1)..( 3000): 2750-1469P.txt file - cDNA_ID_3065531; gDNA_ID_1620477; Annot_ID_158199
tttcagttacgtttatcaatgtatgatcgatggaaacccccaaaaacaagctcagtttttatatttagattctctacataatgtggactcatcagctatagtttgtaatgtatcaatgagctactcaaaatgtcataagctctacaaagtatgttaagttttatgacaatgactgtattgattatgtcttctcgagatgatgacaatatttatttaacctttgttcaaatacatttttttaatattttataggaaaactaatacaacttattacatgtcaaaactagtgtaaccaattacacaagtagtccgatttggtataagtacaatatgaaaaactggtcaaattaaaacaattagtttttatttgacgccctcttcctaattacatttcaatctgttaatgtcgatggaaataatatgaacgatttgattgcgtagaactaattctatttgtcaactattgaaacaaaacatataaaactcaattttgggggaatataattcatcagagaagaataacacacttgggattatgtataacataccttaggagaatgatatcacaaaacaccaatgtaaactctacaaaaaccagttaaacaagcaacttgatgaagtcttggaaaacataacacgtatggtcaaatttagaagttgtttctatagatgaaatcatatattaagaaaaggtattctctcatcttctgttgaaacaacttgctagttatacaactagaaaattttacttattcttcactaccaagctatatgatcatattttatggtcttacatttttgttggttattaatatgatcaaatggtaagtgtttacgtcattaccttcgatcatccaacattatataggaacgagcctcacatataaaccaaacttaaaagtactactgtactaagaaagaagacacaatgtccacatcaacccaagaaaaccaatctgcccaagcggtgaacgaagaagttttgttggagaatcccgattacggagtccaaatcgtcgataaatccgaactgttggagctagccttgagtttcttaggggaagacggagaaatcatggaaaaccctgagtttcttggagatatcatgggggagaaatcttcaagtacttcaggtaagaacaacaatgaaattgattggaaaaagtttgcaccgaaggctgaagactacaaaaatggtgtagccaaggccatcgcggtaggaacagggcatatcatcaagggaatcttcacttgtagcaattcttactctaagaaggtctcatacatataagtccctctcatgatgcttatgagtgttaatagatgattgtgatttgaatcgaaatatttgttgtagtaaagaatcatgaacttccaattcaaacccaacttgtggaacgacttatgtgttttatttactagtatagatcatcttatttttgtgttggatttttaaaaacttttatatgaacatggagatgtaagacgcacatattgtagtattttttattattaatatcgttttattttcttacaacaaaaacagattcacgaggaaggaacgattgctgaagaggatgaggaaagaagtggtgacatatcacaaattgatggaggtggcaacaatgaaactaataagaagaataaactcaacaaaaatcttcaaaggtattcatattttaatctctatcccacaaaatagtatatattataccaaacaataaaatcttggttcttgttccttcttataatgaaccaaatcttggttattttgttggatgtaacatatacatagagcggagaagctgtggaaggtgagcgaggctataggaatggcggccttagaaggtggagatttggtgagcagttcgatgatagctccggtggttaagtcgaagttagggaaggcattgttatccactgctccaggagaggttatcttggcatcacttgattcttttcgtaagttacatagaatagctccattaattgtcaatctatactcatattcatttattttgaagtttttgagatcaaaatttaaataaaacagataaacactttgatgtggtcaatagataatataattggtgctgctgaagcggcagaaatacaaactcattatgccacatccatggctgctactagacttgtgagtaagaggtaaaaagctcactttgtgatcctcaattttgagaatgaattatgtttctatagtaacacaccggtatttgaatcaaaagaatgattatatcggtagaaaataaaatcgaagttggtagaattattgtatagcgtgcatacaatctaataattaattaccaaatagttttgaggggtagctaatgatttttagagataggttatcatttttatttgttaggattgtttagatgagttatataacatgtttacatgaccatcgaattttacaattttatacatttattgagttgagtgtaacacatattcacatttttgtgatgaccgcaccaaagttttggagagaaagccggaaaaaccaccggaataatactggaaacaacgggcagcttaggccgaaccgcctggaatattcaaaaagctctcgagccaactttttccatcacctcaaaaattgtcaaaaatgctcctaggcagtaatatgttatctatcttaaaagctaagttacattttcatatgctgtattgtatcaaattacttaatcttggttttggtgtggctatgactctacgagaaaagatttatacaaaaagagtgtgagaaaatccaaaacgagtctatatatacatcaaattcgaacaagaaccgaaatccaaattttggtatactttgacttttgttattatgagaagttgagaaccacagtcaacgtccgacaaaaccaacaagtacaacagtttaacacttgacagtttacagtatctctctctctaccaagtacagaatttcccgctctagggcatatgtctgatccaatccgaaattgaaaactcatg

SEQ ID NO: 33096 - DNA, 3000 bp, Unknown; identical to SEQ ID NO: 2013
  misc_feature (1)..( 3000): 2750-1469P.txt file - cDNA_ID_3065544; gDNA_ID_1620477; Annot_ID_158190

SEQ ID NO: 33097 - DNA, 3003 bp, Unknown
  misc_feature (1)..( 3003): 2750-1469P.txt file - cDNA_ID_3065548; gDNA_ID_1620477; Annot_ID_158187
gtaaagcattttggatgtttgatacatctcttgggacgctccgggaaattgaaagaagcttacagattggtaaaagaaatgcatgtgaaaccgaacgatacagtattgggagctttgcttggtgcatgtaaggttcatatggatacagaaatggctgaacaagtgatgaagatcatcgagactgctggaagcatcactaacagttacagcgagaaccatcttgcatcgatatcgaacttgtatgcacacaccgaaagatggcaaacagctgaagcgttgagagtagaaatggagaaaagaggtcttgagaaatccccagggcttagctcactagttttgacctgagtctataccacttagctttatttgaagaagtaaaatacttagtgattatgaaattgcctttataaacagtgtttatacaaaaaatcctaaaatgggatttgatgattgttatctgcttgatattgcaaagtgcagacatattcccattagtggttggagaaaaggcaaaaaaatatggtcatctcaagattcgaacttgttggtacccatttcaacctatacaaattacataccactggaccaaacgcaaacttattaaaagtttcatttctgcttctacctctagttggtatctttttcacggctttgttcatgtggtctccattctagttgtgttctactcttaggtgctatgtccttatataaaatctatgtgttcacaagcgatcatcttggtgtcagtcctgtcaaaattgttgataattttgtggtccacagataaaactaggaataccttactatctagctatatcttaagattttatgatcacaggaataccttactatctagctatatctaggcatatatttcttactagaaccatatttgttaaagaataaatattctttgtttttatatatcatttgttgattttttttaaaaaaaatttaccacatgatccgttagattgatattcactaaataagatgttggagaaaaaattatttctactgaaaagtaaaacaatctatacatttaaattagggtcaatttaacttttaggcacaatttggtaagaatattttttttttgtttgacctataaatagaatagactcgacaatcgatattgtttcgacgacaaaggttttgcactataaacatcaaattcactttggaatgtgtcgttcaacctatcattcctcccattctaggaggtggtatcaacatcgtgattcctccgaatgtagatatagacctgagtgtaactacggtggacaaagaaaacgcgtattgggatttcaacttggtttgataagaccgggaaaaacctttgtcaaagttgttatagaagttggaaaagaagtcattctaaacatacgcacaacgccaaaagacgcacgcttcccgaagacttacaaaaataagccacctacttcgtatcttgtgcttcaaccaaagagatctcaacattatccggatttttggaagataaattggtcaagtactcgtcaccaccccacactggccgcagagacagttctaggtcaagagatactgaagcaacaaatcctcaataggctgaggtatcttacatttaatgctgatggagagttagttggtttgtaataacaaatgttgctctttctcctttaagaaacttaacgtatgtgttgttatcagagtttgtgcttttcaatcagagcaacaaatataaatgtggttccaaggttatacatcgtgattcctccgaatgtagatatagacctgagtgtaactacggtggacaaagaaaacgtgtattgtgacatgtctggtatatgtattgagttagattgatattcattaaataagatgttggagaaaaattatttctactaaaaagtaaaacaatctatacatttaaattagggtcaatttaacttttaggcgcaatttggtaagaataatttttctttgtttgacctataaatagaatagactcgacaatagatattgttccgacgacaaaggttttgcaccataaacatcgaattcagtttggaatgtgtcgctcaacctatcattcctcccattctaggaggtggtatcaacatcgtgattcctccgaatgtagatatagacctgagtgtaactaccgtggacaaagaaaacgcgtagtggtgataatggtgaaatcgtgggaggtgaaagtctttttagttagggtttgttcttgtaaatcgtaaaatgtatgtggaatatgaatttcttatattaattttagagttgcttattgtgatcggtctggtctatgtattgaggtagagtcattatgtgcacttgtcatcatttaaatagtttgattgatgttaacttgtgtgttttgacctgagtatgtacaacttaaaaaaatgatcaaaataaacatgattaagcgagttctatgcttttttatacacaaatatcgataccatgtatattcaaatcaagaaaatattcaaactaactatttgaactacaaatttttagtggaaaaaaatatattgacctaaacggatggatgctggtacaaactaaaataatttattatgacgatgatgttagagtttgttaaacaaaatagttatattgaaggaatgggttttgatcccaataaacaattttaaaaaagaagaaggggcgttccgagaattgaactcgggacctctcgcaccctaagcgagaatcataccactagaccaaacgccctttttgttaaattgttacaacagtaactttatatattatctattgtttatttccctccagatattaggtagttcacgctccccgcgaaccctaacgagaccactttactgtcttttgcgcgcctaaaattccccgtgtcggctttcttcttcttcttcttcttcttcttcttcacttttggatctacattgaaatcgcctctagagaaatcaaacccggcgaattggactatcgttgtcggagtttgtcagtggatgaattgccatg

SEQ ID NO: 33098 - DNA, 3003 bp, Unknown
  misc_feature (1)..( 3003): 2750-1469P.txt file - cDNA_ID_3065572; gDNA_ID_1620478; Annot_ID_158236
gaattatttacataaagagccctcatagcttttctccatgatatatgatgaaatgaaacgtatgtacttggaaagcaggtcctttctagtattgtgggtttgtgtttcagtttaatttgaattgagacaaataccccattttgattgttatacttatacatgtagtaatacaacaagtaatcagataaaatcaacaaaatttcctcaaaaatagtgggaatcaacagttaagtagtaagctcttaagcagagccttattttacctaccaacttttacagtttgggttttgaaacagctgaagcaaaagagaaggaaaaaaaaagtcagagctttatggcagagtgaatggcgacaactccaccaacaaggttctcgtactccaccttctcaaatcctgcatctgcgatcattgatgcaaatcgctcctgcactcatttcatgcatctagtgattacaaaacatgcttccgactaaaaaaacgtcttatagactagacatcacctgatcacacacacgatgctcatataatcatagctatcataacttaaaactgatcttcttacaggaatctaacacaaccttaagctatggtattgatcacggcaagttgttgttactaatggttttgacgaagtccacaagttaaaacttaaaagttatcttacatgaatctaacacaaccttcaattgaaagattcggccatgacatttattactaatggtcttgaagaagccatgcagcaaaatcacgaaaacacaggaaaactaatctaaaaattgtgtatattgtataccaaattttcaacaaaggtaacaaaaggttgaatgtttgaacctgagggggaaaccgacgaacgctctcaaccaagtactgataagattccctgtccccggcgattagttcccctaagtttggaatgacctggaaagaatacaaatcgtatctgcaacacaagaaacaaagtgagattatcatcgaaacaaaaaagacttagggacttacttccacaacatgtctaatcatcaaaacttacagatttttgaaaaccggaatttctacatggctgagctcaaggcacaaaaatcttcctccccgtttgagtaccctaacaatgggaagagttttagaatactatacacaaaacgctgacacatgaaaatatacccgaatagaagagggtgtaagtaatttgtaataggtacctataagcctcagctagagccttttcgatgtgtgtgacattccttattccaaatgcaatggtgtatccatccattgaattgtcatcgaaactcaaggcctctgcatctccttcgacccatacgagtgacttgttatctcttagacctattcaagatagtaaatgaagcctgagctcacacatacatagaaaaaaaacataaaggaataacagaggatacaaatttgttgcacaaacaaacatctgatctttcacctctctcagcagctcgttgtttcccaacgtttaacatgttaggattaatgtcacatacgtatatctgagtttcctcaagagaagcctcatcaactttctgcaatgctcttcgtttgacactgtaaacagcatcatagatcctaaaagcaacatcacctgcatattacaaccaatatctataacaaagagcctaaaacattttcaataataacatgtatggactcatgatcagagacagcaaaattccatgtttaaaattgatttgactaacctgttcctccggccacatcaagatgcttcatccctgcaaatggacttagcttcccaacgagtctgaaatcacaagaccaacaaaagtgtcaatttttacacaagagcaattcataacactagtgataaacgtgtcacggagtctaacctttccttccatagcctatgcaaaccaccactcatcacatcattcataatatcataactcgaagctacattggtgaatacattaccaaccaatttgcttttctcttcttcctttacttcttgaaaccctgaaattaaaacattgaagttaaactcacacagtagaaactcaagaagaagccatataatagaaaacaaagcatttcgtatagcatcaaaacagatgatcttgaattgtgaaagtcatccacaagaatgttaccgaaacttgtggcatgagagtgaagcgaagcaacaaaggaacgttgattcaaaattctgctcccgagcctcctgcttactgatcgtagtgccatagctctcaatagaaacagaaattatagtcgtctactccaaactctgttcctacaaccaaatccccacaaattttagatggttagaccacttcatcacctactaaagattaaaacagagaagacaaaaaatgttccaatcacatcaaaattttcagaaaataaaaattatttcgttgagattcaaagtttttttttttctaactacaggaatcatgaaactgaagaagaatcttttgagctgttctatgaatccaccgactcaccggaaaggaaaccgagaccctaatttaatctacccttaaaacttaagctcgaagaatgaagtagtaaactccagaattaacgaaagccataacaatgaggaatagtatagttttaaaacccaaattttatcgactcacagctctgagatcgagtgatgtatcacacgtgttgttcttgccagacacgtcggtgccgggaaccgaccaaaaagtttgacggaggacgaaggaacggtgagtttttttgttattgttctctcctctctccacatagtacgaattgggcttttaattcagtgctgaaaaggcccattatgttatgatcccggttcatattaattttgggttggtttgcttatccgataaattgaattttgagtgggtccaattttaaaactcatcgggaaagtagaaattgacaaattgtgatgatcggaaaaaattagaatccaaaggatcctaaactctgatgtctgatcagataacataaacaaaaccctaattcgatg

SEQ ID NO: 33099 - DNA, 3000 bp, Unknown; identical to SEQ ID NO: 2016
  misc_feature (1)..( 3000): 2750-1469P.txt file - cDNA_ID_3065576; gDNA_ID_1620478; Annot_ID_158235

SEQ ID NO: 33100 - DNA, 3000 bp, Unknown; identical to SEQ ID NO: 2015
  misc_feature (1)..( 3000): 2750-1469P.txt file - cDNA_ID_3065595; gDNA_ID_1620478; Annot_ID_158225

SEQ ID NO: 33101 - DNA, 3000 bp, Unknown; identical to SEQ ID NO: 2028
  misc_feature (1)..( 3000): 2750-1469P.txt file - cDNA_ID_3065635; gDNA_ID_1620480; Annot_ID_158280

SEQ ID NO: 33102 - DNA, 3003 bp, Unknown
  misc_feature (1)..( 3003): 2750-1469P.txt file - cDNA_ID_3065639; gDNA_ID_1620480; Annot_ID_158276
cttcttcttcatctgaaaaagctcattttttttttttttggaatcagagtttggtgaatttcaggagcagagtatttaagtaattttggggaattagtgagaaaatggaggagaaaggtgaaataagtccaagtggggtcgtcacagttaagggagatgaagctttggttccaagaacagagtttcaacaaaaccctagttttctccaattcgtgagtcccacaacggtagtgactcctctccctcctccaccagctccgtcttcggctccggtaccaaccaccgtgactcctggctcagccacagcatcaaccggatcagatccgacgaaaaagaagagaggaagaccgaggaagtacgcaccagacggaagcctgaaccctaggtttttgcgaccaactctgtctccaactccaatctcatcttcgattccattgtctggagattatcaatggaaacgaggcaaagctcagcagcagcatcagcctcttgagttcgtcaagaaatctcacaaattcgagtatggaagcccaggtaattaaaagttgagatatttgtgtttgaactgtttgcattggtttcagtgagacaagatctgatctgggtttcgagtgattttatgttgttgtgtggatttttgagatgttgggaagtgggaccaacataactggattttgctgggtacacttttgtctgaagaagctattacactcagaccagttagagacagagaaagggaatctgctgatgctgaccaaacaaaaacagaaataaaaagaagattttgtctttaaaaaaaaaaatacaaagacagaataatctctgtctcttcctttttatcttagaagataagtatgtctagttgtgattataagttgtttagcagatcttacgatttctcattatctgttttaattactgtgtgaataaaaagagatttagattattagttggtctttgttttgaatcatggagttagttgcttgaggattaggattaattaattagctgattagactaatgcaaactctgttttactatctcttgcagctcctactcctcctcttcctgggctctcatgctatgtgggtgcaaattttacgacccatcaatttactgtcaatggcggtgaggtaataaatttcccacagaggattcttttgttttctttcttcaacacggtgcttgtaactcaagctttggtattaaattctatcagtctttgtttgagaatttcttgttttgatcaggatgtgacaatgaaggttatgccgtattcgcaacaaggatctcgagctatctgcattctttctgcaactggttcgatctctaatgtcactcttggtcaacctaccaatgcaggtggcactcttacatatgaggtaacaaaacattgaatcaaatttcgttagtacctcgttttgaaatatatatcgagtaaaactgttatgtgttttttcttttctaagggtcggtttgagatactatcgctatctggttcctttatgcctactgaaaatggaggaacaaaaggtcgggctggtgggatgagcatttctttagccggaccaaatggcaatatatttggtggtggccttgccggtatgcttatagcagctggtcctgttcaggtgacacgatttgattacatgaatgaaacatatttacagattcaggagtatagaaaactctaaagtcttataatatgtgacaggtggtaatgggaagtttcattgtgatgcatcaagcagaacaaaatcagaagaagaaacctagagttatggaggcttttgctccaccacaaccacaagcaccaccacaactgcaacaacaacaacctcctacttttaccataacaaccgtgaattcaacttctccttcggtgaacaccgtagaggagcagaaaccacaagcttatggtggtggtatagtgagaccgatggctcaaatgccttcttctttccaaaacgacaattcaactatgaacaatttcacaccggcctatcatggatacgggaatatgaacactggtactactcacaaagaagaacatgaagacgaagatggtggtgatgatgatgatgattcaggcgatactaggagccaatctcatagtggttgagcaattctctgatcaaagtcagaaagttttcttgtgtagaaaggaagggagcttaaaggagtgcttttttttagagggttgttttagttgtgtgagggttttcttcttttgtgtgcttttctaatttctagggttattcttctttgtgatcggtttagatttaatcatgtcgaagtcatagactaaacgatgttcttattgttgaggtcattgggattcaaatttagtaagacttttgtgatatggttcatattcttgcaaagtccattcataagattcactacaaacaaatgtttttgatgtataatacaaagtaggagtactataaaatcctacctgtgattcatcattatttgtctatgtcattaaaacattcatcagtttaaaaattgcttcaagtctagatcgtgcgtaattgcaaaagtctatataatttctgttccacatacacagactcatcagtggattctgggtttaaattgtaacaaataaaaagtcaagatacaaaaggaagtgagcataactaaagcaaaacaactataaggtgatatttaaaataaataaagaaatataggggttaaaacataaatacaaactcttcgctaattctcaaaacccttccctttcctttatcgcagtcgtaactggcctccgttggtctctatcgtgactcccttcacgccattaattccgattaatcggagcttcgacttctcatcttccttgggtaactcgctctaccttatcttcatgtaatcaaaattcgaactttttgtctgtgtgttttagttgtttattgggtaagttactagatcttctctttcgattttgtttcagcgttcgtgcgattcaacgtttgatttgaagaatcagtagcaatg

SEQ ID NO: 33103 - DNA, 3000 bp, Unknown
  misc_feature (1)..( 3000): 2750-1469P.txt file - cDNA_ID_3065643; gDNA_ID_1620480; Annot_ID_158268
gctccgtctacatctaccgttccggtaccgacggctggatcccggagaccgtcgagatatacaaggaaggttccaaatccgtgaaattcgatttcaacaagaacgtccctgaaaacatttggtacggaaacaactattgtaacaacaccgatttgccaccgccttccccggatttccctccgttttctccatccatcccaccgccttcaccaccttattttcctcctgaaccaccttcaatcccgccgccaccaccaccatcaccgccgtctgctgcctctggacgtggaagtggtcagagtttggttgttgcgtttgctgcgtttgtgtttgcgtttgcggctgtggttgtttgagttattttgttaagaattaagagttgtctcaataagtaacgagtatcgtgtaatccctctgttttgtctttgactctttgtagttgaacattgacaatttcatattgtggtaacattaattagttaactaatgtatgagttcgagtttttaacgtactattccttataaattctgcatcaatgttttgtatgtgataaatctatgaatattagattacacaactatacaaccacacaccatgaaaatacaatttgataatgacatttatgtacttcgaaataccaagtactcttaaaactctaaactttttacataaatctagagctatagagtaaacaaatgattctaaaatgttgactttagtttattatagaaattccagtatatcaagatgttgtaaatttacttagtgcatgatcacattcagtttctgtggatggtaaaatgatgatacatgacaaaaatttaatatcagtgtgcaagttttgtattgatttgtatacaacatttttttttcaaagcttaaagtggttacttgattaagaatcatctagaaaagcacataacctacagttacatgtcgaatctctaatcaatttcttctatacaaaacattaattacattttctcctctacctaaatattatgacactgacaagagatgtgtggcctgtaacttgggcgcgtcgccatttatttcagttcttataccgaaattgaatttgtttgaatttgacccggtctaatccggtttatcctcaactggttcgagactttatcttctcaattactctttcgttttctcttcgcttgtgtatctgcgagcgatttctcgaagcacgaaaatggcgtccgtacgactcttcttcactttaatctccttcgtcttcattatatccacctctgtttacgaatcaaaagtattggatcctcctcacgtcgctgaatcattcaacgttagcctcatccaggttcgtctctctttccccgtttgaactttccttcatcgtctttgggtagaaacttttcccgagaaacttatgattttccttgtatgcgtgtaaatttatatctatgatgcagaaattggggaatacttgtgcttacacagtgatcatctcgacgagctgttcgtcgactaggtacacgcgcgatcagatcagcgtcgctttcggcgatggctatggtaaccaggttagatttcttcgctgagtgagattttgatttcttcagaacatttgattttgatttggtaacactttggtttatcgattatgcttagggttccaattgaatgtttcattccaaaatacacatctgttttcgcacatatctgattcttcgtaattgagctttgttacaatggactttctcagattttgagctcatctttggtttcattagatttttagtatgttcaggtccagttctagttagctactgaatatgcataacattgtcactcctatggaagaattctagctaccaaaagtttgcaaatgcttagctctggttgctctggttgatctgaacatttgagttttagagaaatatacacatctttggaatagatgaaagtttcaatggattggttttgattgtaactagtgtctaatctgttcatgcatctatcactaataaactaataaactgtaaggatgttcgcttcggttcgatgttcaatgaaatttcgctgctcaagttttgtttatttgaatcagatatacgcaccaaggcttgatgatccatctacaaaaacgtttgagcaatgttcatcagatacatttcagataaacggaccatgtacataccagatatgctatgtatatctctacaggtctggtccagatggttggatcccaaacactgtaaagatatatagccatggctctaaagcggtcaccttcccatataacacatatgttcctgagagtgtatggtatggtttcaattactgcaacagcgcctcagattctaatgtccttgccattggtctcagaaggagcgtgatcatactcctaggttttgttgtcgccggtaccacattgctcttgtaagctgttatgtttccggttttgtataaacatattaggacttgtgaagaataaatgtgtaccgttttggggaaatgggtctcagaactgtattaagtattaaccataaatctatgatgaagttacttactcctaattacagagtctgtaaatcttatgagcagtgtgtatccattttagaaatttgtgacagttcatcaactatatatgtgatagaaaacgaattgattatgtttgagctttggttttatcatatcgtcgaaaaatgaagaaagttactattttaatagaaaagccaacaaagaagatatttttgagtctttgattaaaaaaaggaaagatagatatttttgagtgtttgacctagaaacgacacgcattctcttatcagaataaataaacggcagattagagattgcacattagagtaaattagggtttctctaaaatctcaaaactatataaaaagagaggtaaaccctagcaattgtcgtcctcttttgtcgtctctccctgctttcgcacttcatagcctcaatctctcaacaagcagaagagattcgattctccattatcttccttctaaatg

SEQ ID NO: 33104 - DNA, 3000 bp, Unknown
  misc_feature (1)..( 3000): 2750-1469P.txt file - cDNA_ID_3065685; gDNA_ID_1620481; Annot_ID_158314
cacaattagtttctttaaaatataataaatctaatgaattggttggtaataaattaataatttaatgactcaacctctgagaaaacattgatcataaattagtaatcagtattttttgacatttaattgatcattttcaatgatttaaattatttgttaaaatatgttgactcaaaagttctcttcaaatatacatatcaccaccgaaaataaccacatttaagataatttaaccacagtgacaatatcgttttcacgcaaaaagaaaaaagcgaatgcgttgagtcaactcgttcgtgttacaccaacaatttcaccttttcatctatacttacaagtttcttcaatctcttcctactcgatagctacgataaacacataataaaaacgtgttagtaatgttctctcttctctattcacaagagcttcaatcatctctctttcttagattcttgtctcaaagaatcctcggtttcttcagtactccggtcaatcccgaaacacttaagaaatgcagatccagccagcctaaacaaagtacatggatgatgcaaactatgacttgaatctttctccaacgaaccttctccttcctctgttactgttgtgactctccttgttacagctggtgttatctctccttttatgctttgagagcttccaacctgtgattacaaaaaccgatgagttcattaccaaaggatgaatctaagaaacaagtcagtggttaagcatattcacaaatcacaacagatgcaacatcaatgcacttcacgatgattccagtcaacagataaaccacacaaacttgaagagaactgtttggttctaaccattttccggatcataatctaaatgtctgaaacgcaacttagatttataggttctttttttaagaatccaagaatctctgagtcatgtagcactagacatctctgaaagaaaggctagtgaggaatctaatattgttgcttaaagacaaaacaagacatatctcttgtgaaaactaagcaagcaaatagctttaaaacaaaggaaagaccatcctcggttcgttacctaaagaaagctaaactaccaaccaaatttagaaagagacatttcaaagaattcaagaatatctaaacatagattgagagatcatcacacatctaaaccctgatggttatggccttactgtcaaaaacctagaacaaagagtattaacaataacgatatgattcagaaaccatacttaggatgattacttttgctatgtttagataacttttcactatttcctaatttcagaacccagaacattgaaaaaaacccatcatttcaacttttagctaactctaacaatcaaaagtggctactttccagctaattatggctgccactttctcccattaattcttaattgcaatctaaaccccttaagttccacaaaacccctggaaattccccattacttttgtttcccgttcccagaagccacaatgaagaaactgaacgaacatcgatctagctgaaatcgtctcagtctactaattatctaattcagcattcaaaaatcaattccaaccacaagagatctcagtttaggaacagtaagtcaacgtagagcaggtacgactaaatccatgattcgtcgacgaaattgaaagagacagatagtattagagttacctgatgagactgtacgagacttgaattgacggaaaaccccaaaccatggtgactgatcggaatcggatttccagaaagaaatcgcttagagagagatgaaccagaggtagaaggaacagaatcagaagacgagtagctgttatctacgatatcaaaggagaatattccgatgacgcaaagaaggagtaagaggaggacgaagaccaacatttggatccaaattagccatgggatattattgtagctatctaaaaccaaaaactctttcccagaatccaccattttttgtagagagataagagtttttcccgggaagagagatttgaggtaacgattgaggaggaggaagaagaagaaagacgacaatcaaacgaagacgacgaaggagttgggtgaaggggaaaagataaaacgacgaagctgtgatattcaggtcaccgcgagaaaataacggcaaaaatcttgctttttgttgatagtccacgtgtaacacattaattggttaaataggtgaaaacacttgatatttatgtaatttgttatagtgtttattaaatattttaattcgattttttataaattatttatattttaattagtcattactgtttattcattaaattagctaatgtattcttcgtttatgatagagacaaaaaaaaaaaaaaaaatccagatgtatttaaatttctaaatcaacgacaaacgtataaaattagctataaatgtgtaaatatagtagttttttttctttaggtaaattcagtagttaaaataaaaaaaacctaaaaatatagctataatattttttcggaagcattaaatttccatattgaatttacatgctatgttgtatatacatgcccgaaatttcttggatgtttcacgtgtatccaccatatattatagcttacaaataaataaagttaaagataaacataaaaacaacatctaaactataaaaaatatgcatgtatttatcattacataaaaaaataaattatgtagatatgtatcaaaatacaagatttccacataattttgttatcaattatattatcttttaacattcaaatttagccaaaacagttatagaattttgtaaataaccgcgtttcaatgaaatttcgtagaaagtagaaaagaatataaaagcttaattcaagagaatattttttttttatttttttttattttttatttacgcgtattaaaaacttgtatataagttaaatcctttcttatgatcctctccacaaacaaacttgtactagaaaaatccctaaatctcaacaaaaccctaatttcaaggaagacgaagaaagaatg

SEQ ID NO: 33105 - DNA, 3003 bp, Unknown
  misc_feature (1)..( 3003): 2750-1469P.txt file - cDNA_ID_3065692; gDNA_ID_1620481; Annot_ID_158332
taaagctggcagagaagttgctgactatcttggaacacgccaccacgagtttcagtttacagttcaggtataaaatttccttgatatagtcatacagatccattatcattcatggttttcaaaatagacgacttaacatcttcctctaatgataattccaggacgggatagacgcgatagaggaagtcatttaccatattgagacttatgacgttactacaataagagctagcaccccaatgtttcttatgtccagaaaaattaaatctttaggtgtaaagatggttctttctggggaaggttctgatgaaatactggggggatacttgtacttccataaggctcccaacaagaaagaatttcatgaagaaacatgccgaaaggtatttccttgtcaacttactttgctgatctgcttttgtcccctcactgaatcttgtttatgcttttctttacatacagatcaaagctctccaccaatttgattgtttgagagctaacaaatcaacttctgcgtggggtgtcgaagctcgtgtgcctttcctagataaagaatttttaaatgttgcaatgagcatcgatccagagtggaagttgatcaagcctgatctcggaaggatcgagaagtgggtgctacgcaatgcctttgatgatgaagaacgaccttatctaccaaaggtttgtttacaaataactaaagctgtttttgtgcctctctgcagtttttttcgataaactctgtaatttcactaataatgttctaacaaaatttctcatcttctggtgaattcagcacattctatatagacagaaagaacagtttagtgatggagttgggtatagctggatagatggtctgaaagatcatgcaaataaacatgtaagaaatgtcttttattaaggcaatttcccgataaatgttggaagttttttgacataaacttccatttttcttggtaaaggtctctgatactatgctgtcaaacgcaagctttgtcttcccggataacacacctctgacaaaagaagcgtactactacagaaccatcttcgagaagttcttcccgaaggtaataaaatgccataaattttcaaaatctcacataaacgtctctgctttgctgatttgttttgttgtatttcctgagcagagtgctgctagagcgactgtaccaggaggtccaagtatagcttgcagtaccgcgaaagctgtagaatgggatgcaacttggtcaaagaatcttgatccgtcaggccgtgcggctcttggagttcatgttgcagcttatgaagaggataaagcagctgctgctgctaaggctggatcggatttagtagatcctcttcctaagaatggaacataagagaacaacactacaggcattgaggatataagcaaatgttttattcttctacacagagagatcgttatcttctagagggatcaatgaataaaagcttcgtccatttctagctggagattccatggatctccagttagtgcaagtgatacacgttgtctacatttgtacctaagtttctgcattttttgtcgttcttttgtgttagacaagtcttggaccctagatgatacttcagtttcttagacgttaaatttgatgaatccgaacttgtttgatttcaaagcctggcctttctgcaatgtgtttttgtgcatgttctggcttgtttgttgttactcaacgcaggatttgttataatatgtacaatatatctagtacacacataagtcaagcaagtaagactccgtggcccaatggataaggcgctggtctacgaaaccagagattctgggttcgatccccagcggagtcgctcttcatctactatttttatttttcttacgcgcattgcttataaaagttttttaatgaacgtgggataaaagttttcagattcgtatttattatttcaaaaagacagatgacctaacctcattactcgtgtatggacttttttttccttcaaattatattttatgaaatttgagtagacgaagtaactgctccccttcagatttagctaaagagccaaccacgtgaagtcgtgaatcctctctgtcgttttcgtattaacaaacataagaaattaagaaatgaaaatctcgttttcttatgtataattgttttatatcgatcaccggtttctctaggtctaggtatagctgttccaatatcatgatttttaagtttagttttcaacatcattaagtaaaagtgtgaactcattatcatcatcgctttccctttagaatttttgcaaacacacgaaaataaataaattgtttggacatattattgagaaacatagtcaaatgagcccgttcacattctgaatcatataagttacagtcccaaacccacgttttattaaaaatgtactactagtcaataatttatgttgagtcatatttatttattttgacacagttggttttcgcagtttcttgtttattagtttcaaattgcacttattagttttaaaaacaatttaatttgatatttggtataatatctcttttgaattatttacaaactttattacagcctggttttgaaaaaaaaaaaatactttgcataattgctactttgctaggattactttataaactttttcagctttgattcatttaacattaaacccaattaaaatattttattcattttagcataaaaggggaaaaaaaagaaatatatatatatatatatatatatatttcctcttttcaattaaatcagctgttaaaagtggaaaaaatcaaagagatatcaaaatattgattagaagaatatgtccatattcaattattttatattatctttattaaatgctttaccttacaacaataacttaaataaatttttgggattcccgttacattacttaagtaggacgacgtgcgtctgcttcgtctcattacaaagcagaagaaacacaaacagaggcagagatcttaagagttaaagactaatcccaacaatg

SEQ ID NO: 33106 - DNA, 3003 bp, Unknown
  misc_feature (1)..( 3003): 2750-1469P.txt file - cDNA_ID_3065711; gDNA_ID_1620481; Annot_ID_158315
agtggtatcatctaccatcctcgcagtttcatcgactggtcaatatattattcaataaacatgcagcttccgtatatgatacttttctgctaaaaagaggaatttgcagttcacagagaggtggtgaggaccactcttaaagatattccgatatgaggaacaaataattggagcatggtcccttgagccctgcctgatgcattacaaaaagtagcatcataataaagtggtaggtgttgttgaactatttatccgatggtgacagaatttatgtagatataataatatcattccttgattatccatctggaaggtacatccatctccacaattgcattcaactattgaagcaatcatgtgttgataatccccttctgtttattttagtagaccaccactaaacatgttatttatattagtgtatcaagagagaagaaaggtatcttcaacacgcaataataaatctgacatttgaaaaaggaaaaacacatccttatcgaaatcactagtcgaagtcgcatttgtcagatactattgttttaacttcaaactctaacttccaagttctataacataagaaaaagaaaacaaaccccaacagctaaaagtataattaaagaagcaacatttgagatctcaacctctgtgttgttgagcatgaagtgattgtttgggctcagcaccacgcaatgtaccaatccaagctggtggctgcatccctgtctgctcataaaccgtatcaagaaccggtggtaacatcttgtagagtccagcaatatcgttcatcgtagctttaccaccaccgttcatcccctgctcagcaccaccatggttccacacgctgatcttaggctgcaggtccctgatcgcaacagcattggtcttggcaatatcctgataaatgccattgttgatcatcaagaagtctctcatggctgagtaatcattgttaactgcgcctaagagggtcttgaggtaagtcccctgagcatcggccattgcgacaagtccctctgcatctttctgttttgaatagaaggcagcatcagctgcagctttcgtcgcttccgcttgcttctgcttctcgtaaagaacagcttctgcttgcttttgcttattgtacaactcccagttcgcttcttgcaccttagtttcatactcaacactggctttactgaggaactcagctttaagcttctctgtccgagtcaatgcattcatcttctctactttagtctgaagctcagcttccctcaaagcaacagccttggctgcttcaacctcagccacacgagagttttgggacaaagcagccttttgaatcgcaagtgctgcatcagccttagcaacaagagcctctttctcattctgaaacactttgacttcagtcttcaccttgatctcctcttttgtcccttctcctagcctttgagtagagatgatctttgactcagcgtcaatcttggctgcattctggattgtgagtccagtcctttctttggcaccaacctctcccttcatctttgcctctgctacatcgatcttggcttggtttgctgcttccatctgagtcttctggcccaagtaagagaagtactcatgtccaggcacatcaacaagctgcttcacattggcgttgtagatcacaagaccaaactggtttagctctagctgaaccttgtcaaacacttccttcttaaactcctttgttcctacaattccacaattcaaacacagttcaaacaattatattaaaacagaactcagaaataaagaagataatcaaaaagggtatgtttggttacctttgaagacctcttccatagtcatggaagcaacaagaacacgagtctctccttcgataacaccctgaacaagctcattgacgtgattcgagtgcttatcgtgttgagacataagcatggcatacaacaagagagcgtgaggatcatcaacgcgaggaccgattgtgaaaacagcaggaataacaaagggaagtttctcggaactcatagcttgaacctcgaacgtgtagttcaccggagaaacgtcgaagacggtgcaagactgccatggaaacacccaagacttctttgcaagcttgatgtctgtgatcccaccaccggtgatcgcaagatactgcgatgctttagcgactctgtaactcattctttcttcgtcttccttgaaattagggttttgttgagatttagggatttttctagtacaagtttgtttgtggagaggatcataagaaaggatttaacttatatacaagtttttaatacgcgtaaataaaaaataaaaaaaaataaaaaaaaaatattctcttgaattaagcttttatattcttttctactttctacgaaatttcattgaaacgcggttatttacaaaattctataactgttttggctaaatttgaatgttaaaagataatataattgataacaaaattatgtggaaatcttgtattttgatacatatctacataatttatttttttatgtaatgataaatacatgcatattttttatagtttagatgttgtttttatgtttatctttaactttatttatttgtaagctataatatatggtggatacacgtgaaacatccaagaaatttcgggcatgtatatacaacatagcatgtaaattcaatatggaaatttaatgcttccgaaaaaatattatagctatatttttaggttttttttattttaactactgaatttacctaaagaaaaaaaactactatatttacacatttatagctaattttatacgtttgtcgttgatttagaaatttaaatacatctggatttttttttttttttttgtctctatcataaacgaagaatacattagctaatttaatgaataaacagtaatgactaattaaaatataaataatttataaaaaatcgaattaaaatatttaataaacactataacaaattacataaatatcaagtgttttcacctatttaaccaattaatg

SEQ ID NO: 33107 - DNA, 3003 bp, Unknown
  misc_feature (1)..( 3003): 2750-1469P.txt file - cDNA_ID_3065718; gDNA_ID_1620481; Annot_ID_158311
ccctcaaatgtcctggacacacccatctcagtttccacaattttagtacataactgatcaagaaaggctctgtcatgtgaaataataaccataggcacatcttgcttttgcaaataaccttcaagccactcaatagtatcaagatccaaatgatttgtcggctcatcaagtagcagcaaatctggatcctactcgcaaagaaacacacaattcattcacattagctttgagttcaaactcattgaaaggataaaactttaagtaaacaatcattcatatacctgaagcaaaatctttccaagtgacattctcatttgccatccaccactaaacgaagccacaagcctatcagcatcctcaggagcaaaccctaattccggcatcaacttactaatcttagcatcaacggaatctaaattcacagcctgagctcgtctctgcaacaaatcaaattcatctaataaccttcccataagatccaaatcatcaacagatccctcaatagccttctgaactttctcaagcttctcagtaatctccatctcttccttgaaagcagtcatgaactcttccctcacagtcttactcatcgaaacctcaaattcctggctcaagaaagctactttcatattgggtttggccttgattacgttaccagaatcaggctcttcttgaccagtgataatcctgagctgagtcgtcttcccagctccgttcacaccaactaaccctactttctcacctctcttcacttcccatgtcacatctttaagcacagtcacgcctttgtagcttttccttatgttctctagcttcacacctgaagatatcccagaagctccgtttttggaactcttcccgtttcgtttccgatcggagtcttgctgagagggttgcttcgagaaaagagattcgatttcgtcttgacgctgtttaacggaggtctcgaggctgatggtggagacttgggctctgatggtggagatatcgcgtctagggttggaaatggaagagattttgatgaaattggaagggattggagatgtacgtagaccggtgaagaaagttgaacggaggtcgaggctatggagattcgttgataaacccatggttatatgtagcgatagagagcgcgagagaatctcgctctactgaagaagaagaagaagcagcagagtaagaaaccctcgagagagaaatcaaaagctttgataagagtttctctctatcgttttgagcgtgagccaccagattttatttgatttttttattagtttgtatttttttctctatattcgaaaatatatcattatcaattatcaataaataaaatcaatacttagaaaataaattaatattattgacgaccaaaaaagaaaaacccaataaaattatcttcagttatcacaaaaaattggaatgaaaatagtgaaaaatcgaaatatgtatggagcatgaaatatgtatggagtactattttacaataaaaaatgtatttggttgcaatgtttgtaagtactaatggtagttgtattgcaactttctatgaatgacaagtaaatgcattctacgattgtataattctagtttttgaagaccatattttgatataatgccaaaggaaagaagtgatacaaatcggagtattcatttttactaactttgagttctctgccacatgcaatgcaatgttcttacaaagtcaataaatggatatgaaataaagacaaatataacacacacaaaaaacaaacgaaagaatctaattttgtggtgaggaagaaggagaagagagggtagaagtcttgaagagataacaaatccggtgaagttacctcttttgtggttcacatagctcctttgaaaaacagacacttctcatactctgccacgtgtctaactatatcatcaaccacgtcagtttctctgtggatctcttcacgccacatcgtcacgcaacttgatttctttttaaatttatagttttattaagtttttggtcgttatgtatatggttttagtaagttgaattcgtaattacaattttaaatgaatatgcgtcaacttattcacccgttaattttaaattggctgttcatggaacttaaaacgtacgagcacacatcttttttctcaaatatgactgaaatagtgaaattggaaatgaaaattaagaatcaacatgtatatatatcatgtaacggctcgcatcattaaacatgaatttatgttaatcgcctccatgactaaatagttcgggattgttaatagcagtcatacagttgacgaagcaaagtcgtacttatttatatcttattgtggacttttttgttgctgtagatgatatttaagtggatacagattcactaacgtcggctaggtttgattttatctaacaaaatacacaaaatgatgtgagtttttttttttgggttcttagtggagtcagtgtgtgtattcattcagtgttcactaaccgctctaggaacaaaaaagataaatgaaaatgaactaatcaactccaaacaaattttgcttaagctattggaaaaacatatcactataaatttaataaaatcagttgccggccttcaaatcttcaccaataaacttatgttttaatatcataacttaaaggttagaccattaatcgacagtatactaaacgacgtcatttaacaggaaatgagagcaaagctgacgcggattaagcgtgtgtgcgtgtccgaacgaatggcagtatcgtaattaatgcacaaaagctaaccttttcccgaagcagaaaaaaacaaaataaaacaaaaatatttttgatatgttgtgtacagtatagttgtatcaccaccaatcgacctgttactttgctgtattaaattttggtatactttttctttcgcttataaattgctctgtatcacccatcttcctcctaagatcatctttaacttattataaaaaaaaaaaacaggattcactgctagctacagaagctttgatcacatg

SEQ ID NO: 33108 - DNA, 3003 bp, Unknown
  misc_feature (1)..( 3003): 2750-1469P.txt file - cDNA_ID_3065727; gDNA_ID_1620481; Annot_ID_158305
attattaatatgctgttttagtaagggttaaaacttcagttttttaacaattgtctcatggattcgttgtatagcgttacttaataacaattataaactgtaaaatataaatattttataaaaataaaatttgcaagttttaatatatattaactttaaaaaataaattataccgcagtataccgcgggttaaaatctagtttatatatatttcacttaattttgtctatgttcactatacatatgtaaactcaagagtcaagactattcaattatatcatcatttcgcaaacttataataacaaattatataatatagtgataagtgaagttttgcttactatttatcaaagatttcatcttattttcaacaattctttcaatttgtaatgttatcagtaaaaaaattgtagtatataatctgctagttaataatacgaaaatatttgttattattgtacgaaattatcaattatgataattgtgtagtcatatcaatgtaatgaatgctgctgaccattctatttcttctctccttattcccctttgctcctccttacttttactaaaattccctcaactcttacgataagagcagagagaagaagaagaagaagaaagtaatcgtgatttgagagagagattcaaacatacttttttcgatatctatgttaattttatcttcacgatatgcaatgaaacgagatgttttaatcattgtaatctttacagtgttagtattaatcattatctcccgttcaagttcgatccaagctggaagattcatgactacaggaagaaatcgtaatttgagcgttgctcgatcactatactacaagaatcatcacaaggttgtgatcacggagatgtcaaattttaataaagttagacgaagatcgtctagatttcggagaaagacggacggcgacgaggaagaagaagagaaacgatctatccccacaggtccaaatcctttgcacaacaagtagagtactgactactgagaaagatgcaacatacttcgacttcgtaaattgttcgtttggtgtatatatgtatcgttataagttagtttacttttcaagattaatagtctttaattaggttgggttggaaactctaaaatagtatgagataaatttcaattgtttctagcatttaaattttgtatgctcaaagttgctggaacgatatggcaaacagaaataatggaatcgaaaaaatatcgtgatatgttagaataaactgagtaaaagtacgtttttgtgaattttcttttgtcattgtaatttgttttaacaaaatacagtattattcttttttacgtactaataaggtatattgttgtatatataaaggtcagtaacttgtaactcatcttttttttttgtttttttttctgttttagctgataggtggttggtgttcattaataaatgtccatatatcactttcaaagcaattcactaaaatatagatatgtaattattttttattttttcagattttccccttgaaaaaggggttctttcaattagaaccccacactaacacactccttcacttttggccagccgcccttctttttcagtctttcagtttatattttagcctcttttttaaaaaatactatattttattgctttttcttcttcttaattactttagttaatcatagttaaaacacatttttttgtgcaaacgtttaagttttaacactatctgattttaaacttttaatcatttgcatgtaaaatcactcaaataggtaatatttatatgattccagtcatgtgtttcttaaaaacagagccacactacatgtttctgtgtttattctcagttaattagtttttatgtttgttttaacacaatacagagagaatattattgtagttacaaaaacaattaagagtggcaccaagaaatttcgtcttaccttttaagacaagattaaaagaccactttgaaattttgaatcgttgacttaagaatagacttagcaaaaaaacttggtcatacatatatgatatatgtgtgggtcaacgattcatatatgtatgatgatacattgcaatgtgccaaaacttctggaagaacaaaaaacgactaataagaaaaaataaaatatataaaatgttgccaacattaaaaaacgcatttgctgtttcccatcaatattggagtatagtttatataagatttttaacaatattataagctagttaattaatagagttaatctttggtaaaaaaacagacggaattttataactttcgaaatcatattgatctgcatatatatatatatatatatatatatatatatatgtggattcaccagaccagatgagataaccattttgaaggatttgctaaataaaagttaggccaaaaagaaatcaataaagtttgtgacaatatctttaatagtataatttacatttacataattcaataagtcaaatcttattgtgtcttggtgtgcactgtaaagtaaagtcctgtctgcttcaaacgcagcataagcaaacttacaacttaaatcctcagccgttgatccaaagaccaaaatccaattatcaacgttacctaatgtagacgataaaatctcttaaaatgggcccgtaaagcccaagcaaaaaaacaattactttaagtggaagctcacttttcgccacccttattaacgtctgtccatacgtcataacagatgacgtcatcatcatattccttttttcacacgtggcattgaagcaccttcctagtatctaccctgaaattgcttgacataagtagtagttgtttaataatctttatctcttaattatcctcttttcttaacaaaaacttgttacaataattttcatttttatataaataactgaccattataactctttctcttctcttcttcacttgctctagttcttggatgctttaaacctctctctctctctctctcaattatttttttttctatttcaaaaacaaaaaaaaatg

SEQ ID NO: 33109 - DNA, 68 bp, Unknown; identical to SEQ ID NO: 2040
  misc_feature (1)..( 68): 2750-1469P.txt file - cDNA_ID_3065731; gDNA_ID_1620481; Annot_ID_158304

SEQ ID NO: 33110 - DNA, 3003 bp, Unknown
  misc_feature (1)..( 3003): 2750-1469P.txt file - cDNA_ID_3065757; gDNA_ID_1620482; Annot_ID_158367
aatgtctatattataatatccaaaagcattagatattagataattacccaactaagtgatattaatgttttccatgtaaaaccgaaaaattttaaaccaaacaaaatacatgaaaatgattattttaagttcactaaatatcatagaaaatttaaacctttctttgttttttaaatggcaattgtttttttttagtcttatttccacaaatattgtttcataaactctaaatatacttgaatgctaagagatttgcatatcgaaacttaatctagtctatatatttattatatacctcgtaaatgaaggtgcctccatgagaagatgcatttgtatactcttcttgtgatcctgtttcagattgttcattggtcgatgactgtaaccagtttctccagtaacgctccaacgtttcttcctatataatttcaatgtctagattatatctaaaagctttataccttttaaagaaaaatattagataatagataattaattactcaattaagtgacattcaatgttttcccacgcaaaaacagaaaatttaaaaccaaacaagatacgagggaaatgattacgtaaaatcacggaatgtcaaaacaaatcaaaatcctttttttttttctttcaaatgtcaataatattggatcttatttcctccaatattgattcataaactcttgaaatatatttgaaatgctaagagatttgcatatcaaaagttaatctagtctagatttatactatacctcgttagtgaaggtgtttccatgagaagatacatctgtatactctactactgatgttgtttcagattgttcatcgttccatgattgtaacgagtcctgctcgaacgttgtttcctaaacaattttcatgtctatattatatccaaataaattatttctcttaaaaaaaacattagataatagataattacccaactaattgtcctcagaagggaaccgggctctattgccggaccatcaccgttcacatcaagcgttggatctggtgagatgtcatcagcatcaactggtgagtaagtgtcccatagatcccagtcgtctccaaatagtagccacatgaagctaaaaggactatccggtatctcagaattgtcttcgtttggatccatacttttggagaaacatattacctgactcaaaattttttttcaaggggctagattaagctgaatttatatagataattaacactttcaagtatcatcaccatttaactcttccattcaaatgcaaatacttgagtggacaggatagtcttaatattgataaagtaatagaaaaaataaagacgttatgaacaaagaaaaaccactaaatatattgtagctcagttaaaggaaaaatatatataccaaattaaggcttaaacgataaataatgcatataacccacttttcagtgcctccatggataaaaggatttagcaactttaaggaaaaaaggtttataccaaaaaaaagttcaaggagaaaaagaccactgatttacaattgttgggtagtttgaagtcccaaaatgttaaaaattcaattaaaaaaattgtgacagctaataaaaatggaactttagctggattcggaagatttattttattgaaaataaggattctgttttaattatagctctaatacagttgaattggttttttatagaaaaacatttctttattgaattttcttcaatggaaaaatatcattttagagtgaataagtacaaaaaataataaatgttgctttcaacaaaaaaaggaaggaaattttatgttttggctttgtatatttgctttcaacgtcattaaaacgctttttaaaccggagatatgcatcttgttttcctcatttacaagttcacaagatgattaattacattacttgggtcatgggcttaaaaagagagagtttgggtccaactaaaaaggctcagtaaaatacgtaaatgggcctagcgttatagcgagaggcagagagagaatttacacgacgacgacgtcatactcaatggacgtaaatgtccaaactacaaaagtttttttttttttttgtgtattaaaaaaaaaatctcaagttaaaaacacatcaagagtatattacagcaacttgtgtgttaaatcaccaattgtgaataaatcggttatggaaatcaatcatttttttttttggtttaatggaaattaatcatttgatcgttaagagtgtcactaattcgatacgtcacttgctgacgaatctgcagatgaaataggcatggtatgataaatctcgttaagaataaaatttcacctagatgtttgagtaatttttgtaagatgatgaaaattgtaacatttttcattgaaagaagcaaagagacaagcaacaagacaagagtgtccccacgcatgtgagcaccgttaaccataatagaaaaaagatatcttcatctaataataggtgaaaaaatcttataactgagcaaattttagagaatgaaaatagtgatctgtgaaataattttttttttttttatgatagacctcacctaacaactagaagaaataatataaaaccattattacttatattgataaactcttacaagatcactgtttccataaatcttgacaaaaatgtcactccatatgtttggtgtacaagactagaaactgtagttttgagttatgttattataatgttaaactgtattatgctcaaaattgaactccttttgaaaggtggtttatcttctttactaatcgtttcttcattttctctctaggagctaggtgggaaaaagattcaaccttgtcttagaaaaagaaaaccaaagctaatctttttcttttgtacctctctttcaaggattaacaaaacaaatcgatgaagcccgggttttagtacctaaacatctctttgtctcgtctttgaaaacccccccaagtagatccaacatcattcatatctctctctctatctctgcataagctacggagcgatg

SEQ ID NO: 33111 - DNA, 3000 bp, Unknown
  misc_feature (1)..( 3000): 2750-1469P.txt file - cDNA_ID_3065759; gDNA_ID_1620482; Annot_ID_158365
ctagactagattaacttttgatatgcaaatctcttagcatttcaaatatatttcaagagtttatgaatcaatattggaggaaataagatccaatattattgacatttgaaagaaaaaaaaaaaggattttgatttgttttgacattccgtgattttacgtaatcatttccctcgtatcttgtttggttttaaattttctgtttttgcgtgggaaaacattgaatgtcacttaattgagtaattaattatctattatctaatatttttctttaaaaggtataaagcttttagatataatctagacattgaaattatataggaagaaacgttggagcgttactggagaaactggttacagtcatcgaccaatgaacaatctgaaacaggatcacaagaagagtatacaaatgcatcttctcatggaggcaccttcatttacgaggtatataataaatatatagactagattaagtttcgatatgcaaatctcttagcattcaagtatatttagagtttatgaaacaatatttgtggaaataagactaaaaaaaaacaattgccatttaaaaaacaaagaaaggtttaaattttctatgatatttagtgaacttaaaataatcattttcatgtattttgtttggtttaaaatttttcggttttacatggaaaacattaatatcacttagttgggtaattatctaatatctaatgcttttggatattataatatagacattgaaattgtataggaagaaacgttggagcagtattggagaaactggttacagtcatcgacaaatgaacaatttgaaacagagtcactagaagagtatacaaatccatcttctcatggagacatcttcacttacgaggtatattatatatgttataactagactagattaagttttgatatgcaaatatcttcaaaaactactaaagtgtttacatcacatttgaaagccttcaccattttttcatttgttatgaacattgtatcttagaagttagcactttagagttttttgcaagataacattgaaaatttaatgcttccagtattggttaactagtcggttgcatgtgtagttttcaaagaagtgcatttgaatcctagatgtagaagagattaggactctctttaataaaaattatatgtaccattttggtttcttgattctagagttgtataagctgcagagtttagatatcgataattttatgaatgaatctttttttttctaggaattattgagcatcactgacgaaacaggagatgaacgcactggtttaagcgaggaagtgattgatgagaatctaataagaaggaaatatgaaaagcgtagcgacgatgaaacgaagagatgtgtgatctgtcagcagaaattgaaggacaatgaagaagtttcgaaactgggatgtgggcatgactttcacttcggatgcatcaagaattggctaatggtcacgaacaagtgtcctctttgcaaccgagaagtcgtttaaatgttttatcaagtttgaaagattccgtttatctcgttggatttcagtttttttgtttctttcttttgctatgaaccataattaccaatatttccctttttatcaagttagaaagattccatttatttagatggcaagttggattttgatttgatttctgattttgattattatcatctatatatatatttttgcagccactttgtgaaataaattctggagttgggatttatttacagcggctgtcattggcatttaataattgtttttgataattagaaagaaaatcttctaattaaatatttgacatttaacaatctttccaaaatctctctaccttaactacacgattaattactaaaataaaacttctaaaatatttaatatcatttaattactacaaaattatcatttttgatattgcttttctgcatgattataatcatcaaaccgtagagatatttgataacatttaattactacaaaattacaaaatatttagacaataattcataaacatatcataaataagatcacattcataaaataaatgagtttttttagaggacgggttggcgggacgggtttggcaggacgttacttaataacaattgtaaactatacaataaaaatattttatagatagatacaatttacaaacttttatatatattaatttaaaaaataaattgttttcgcggtataccgcgggttaaaatctagttattcttatttttgctatgaaccataattattttaattactatattatatatatttccctttggatgcattaaaaaaaggctaatgatcaaggacatgttatcgtctttgtattgaccattataatatctgaattttattttgtgttaaataatctctcgaataaataatctttcgaaatgcatgcagttttattcacactttatctgtggacaacaacaacaacaaaaaagaaggaaaaaatagatttttgtaatttgtcaaaaatggtgaaactgttgcgagaccttacttttcaagtaattgtccattttcatgtttagtcataataataattaaatagtctatcaatgctctatcttatcaatactcttattttttcaaccgtttcatttactgattttcataatttcatcccctcctctcaatttaacttatcacattgaaaaaaacaataaaaatgtatgttttttatttacttggtggtccaaaaatgcttttttccttttttttattaggtaaaaaatataatattattaaataaaattgctacaaaaggaaactgttcacacacagagtgatgtgagacaccagattctgtctatagggattcgacacgccactcgcctcttttagaacctccacgcgcttctctgaagaacgtgatctcacgcgtcctacctcccccgcctataagctttactacgaaaaagccacagtgataatttttacacacagagtagagcagagagagagagagagagagagatg

SEQ ID NO: 33112 - DNA, 3000 bp, Unknown; identical to SEQ ID NO: 2061
  misc_feature (1)..( 3000): 2750-1469P.txt file - cDNA_ID_3065770; gDNA_ID_1620483; Annot_ID_158406

SEQ ID NO: 33113 - DNA, 3003 bp, Unknown
  misc_feature (1)..( 3003): 2750-1469P.txt file - cDNA_ID_3065774; gDNA_ID_1620483; Annot_ID_158400
agtaacaaaataaaatctaataaatgtctacacatttcggaaggttagtatgaaactcggattttgaaattctttagatttaaatattatagactacatgttatggtctatcacatattcaaaattttcagattatttaaatacaaacatcatgtgttcaaataaatgtaacaaagtcgtgactcaaaagtcaaagtcaaaacctatatgctctctctgtattatttagtacttgtattattaaacgcgttttggttttggaaatatataacataattctcattttttctgtttagagaaaaaacaaagaattttaaaaattggtaaattgtaatcgacagatcttccaggccactttccttatccctttctcctcctagtcccacggaccctaccttcctcttacatcatttggtaatgatctttcccaaattcatttatttttatagttagacatactacatcaagattcatactaattacagacttatcaactatacattaatcaatatgagataatttttctcttttcttgaagtagtccgctaaaattatagtaataaatactaatatacctatagacatagacagataattgtaatatccaaacaattttaaataagtttgatgttcttttgatcataaatctaccttcataatgaaacatcctccaccagcatatcataaatggttttttgacgtatattgaaaaattcaccatgttggtacgtaaatttccattttattttaattggttatgagatacacacaaccttctcaatgacaagaatatatggttcttctatatataaagaatctttttaattgaggataaagaacgccgattcaaggattatagtaagctacttaataatttgacttctgcaccgaaacaatatcaatcattttttacaaaaatataatgaagagatataaatctgtttaacttctaccctaatattcatttgtggagaaagaaggtaaaaaattaaagtaatgattcatttattcaagttattgaatacattatgaagacgaggaagacaaaaagtcagaataatgtaagtaaattagcattaggtcttaaactctcggcattccgcattaacttgattcggtgcatttggaggaggaccgacacaataccacacgtggcaaattaatttccttttgcagaaataattcaatgtcatgtaatttcaaattttaaaagttttgaagacaaaaatcatctcatgagccgaattgatatggacactagtacagcagcttccttagattccatccagacataacttttgatttcgatataggtcatcgctattgtaccaactactacgtataaaagaaatactgcatcctcataataaatcataaaactttataataaactaaacaaaaatagaattcatttttctgtttatttattgtaatattcttatgtgaaactattaataaattgaacaaaatacttaaaggaattagattatatacgatatgtgaatactggtcatattactacgaaggtagttttcttgagagtctttaacgttgaattctcgtgacctggcaaatacatgaaagtaacaataaaacttttatatttatttttattaaatgaagcaaaaaagaaaaagaaaaaaaaaaggttttctttcgacgtgtggtattctgtatccatctatataacagagaggacatcaatggctttctttgaacttgtaaaccttactctcgaagagtcctctgttactcatttttacattgtaaaaaaaaacttcttttcttctctacgtgaataagaatctgaagagtcattttctcaaggtaaatcttcttcgtctcttttcctaaaaatgaagtctctattagaatttgtttaaatgaagtttctgttattatttctttgatagtttccagttctttcatattgatctacgagttaaaactcagattttcttactcaaccatagcttattagatatgttttgaaaactagatatgttaattgtgagtcatttcttggatttaaccaagtaactattagtagagaaacaattacggtcatataatcgtgatggaaaagatcttgcaatgttttgatttcaatcctatttttggcattttttttcttccaagaagtggtttaattttattttcccccaattagttggcggtccaataatccacttacaacaaattgcaatgtttggtttcaacaaaattgtttttgaatttaaaatgatataagtcgtaatctcatcatatgcatggttctcattttggccctcccgacgccatgaattgcggtctgtttaagtttggtctagaagggtattttcggatacactcacattttaattcattcattgttcatagagctaccattgtaccatctaaatagcatttaatacaaatatatagggacgaaagattactaattgaatattgcaacttatccttctaatagttgttcgtgtcttcactgattataactatgagtaagtcgttgttcctaatatgattaatattgaagggaatttatttatatatttcgtatttatagtaataatattataaattatttttcggtggattacatcaatcgaggaaaatactaatgcacacacatggactggtcattttgtttccccaactttttgaatggaccaatggtgatattttcaatatagaatatattttctcaattcattaagttcttactttgatacagaaacaacaaaagataagctttatattaaaaccatgtgcaagttacacataacacatgtacgattacttgagatccgaacacatcgcttgatctcaaagctttttgttagagtcaatcctctacattatttgggagataattaacattctattcgattttgtcattatagccataataaattatgtttggttcggacaagttcatttttactaatttgtgagttataactttttttcttttgttatagaatgacgtggctaaaacaaatg

SEQ ID NO: 33114 - DNA, 3003 bp, Unknown
  misc_feature (1)..( 3003): 2750-1469P.txt file - cDNA_ID_3065801; gDNA_ID_1620484; Annot_ID_158430
gttgatcccactccctccaatgtggctccgccactgatttgacccatcaaaacagtgtcacgttttatggccattagaaaacactcaccctacaaaattagtcatgtggtaaaaacccgagtcacacgctaattataaaacaaaattaagttgaagcgaacacttggaggatgaacgaaacaattgttattgcaacttgcaagttagtaataaattcaatatttcttttgtgtgtttgtgtctgttactctcatttgacttcaaatccagtctccaaaactatcttagaagaggtgaatgttacagtttgttaccatcgcaaggttcttgaggaaatcgtggagtggtcattcacttctttgaaacaagttcattttaaccactaactcatacattacgaccaaccaacaccacacaataacatcatttcatgtactcattatgtgaatatgaccaaataaatatgtctcatttgagatttaatcataatcatacatccaatatccattcttcagttttaaaatgcagtggtggtcaccatgactcacctatgacagttagtgtatccaaactaaaccgaagactgaaccaatgtgcaagacggaattatcagtttaccactggaaccttaaccggcctattcaatcaaaccaaccacccaattaagtcaatcaatcaataattcatgaaccaattagaattctagttaaccggtctagcttacatgttctcgaatttgattcaaactttaaacagatttaatgaagcaatttaaacagatttggaaaaaaatctcaaaactattcaaaccacagtaaaatatatttataaaatcacaattaaaaatatagcattaatcaactaagctagctagcgccatgcacttataattttacagagtttctaaaatatcctgactcttttttaaaattaatactttgttaacaatgaccaagtctaaaacttatctaaaaacgtgtcaaataagaaaaaaaaattagcaatttgaataattcaagatccctttaactcggaactaaagaaggtaattatttttaaatagatatgttctgtgtgaaaaaatctaatatcttctatatatatacataacctttcttcttttcagttttaaaaccatcaattcattttaatcatcgatcggtgatgaagaaaatctttcaactgtcatttactgtttttattattttcatcagtcttgtgctaggttagtctatacatttagaattatattaatatattacatatactcgttctacaacaaactgattttggatatcatactattattgtataacatcagttacactaagttatgtaaaattatagcaagagttttcactataaaattacacaatatcatatttagcattcttatgtctgtttcacaaaaaaaaaaaaaaaagcattataatgtctaattcattttagatttagacaattgagttgctagacctaaaaaccaatttcgaaatgtatatgaaaaataaaacaaatttccacctattttggttaattattttaattattaaaaattcgtcctgatatattgtaagagttattgtagtataaatttatacggcatatttcccttgttttatttcatcttcgattctttatgttcgtggtgcaaagatagatatgtattttgcctcataaatgttatgctccatagtttttgatataaattcatatgatatccttgaataaattttacgtaatctgtttttagttacaatatacaaagaactctctaaacatttttctagattagaaatatttttctctagtttttattaccaaactgacattttatattttaaatattatgaaaacaggagtggtggggaatgtacaacaaaaaagaagtaatcgatgtatcgactttccagttaacccaaaaactggattgtgtgttctcaaagattgtgagtctgtgtgtaagaagacaagtaaagggttagagggtatttgctggaagtttaatgccaaaggaaaagatcctaagcaatgcaaatgttgtggtttatggcctccactttactaatgttgctacccatttatttttaataaatattcgtattacaaagtaataaaatatttttatgaggtttgggacctattattttttacttgtattcacttgaaaaaagtaacatgaagctcagaattgtgggtgtaaattgcggatcgaatctactccttctcgcctataaaaagaacacctcctcctctcattttcttcattagtttttgctcagagctaaacgaaattctctcctatttttctctttctttttaaagtaggtctcaagagtatatgatttatttaaaattcgaagattctactatcgagtattgcgataccgatcttattgtgattgtattctttctttttatttttaaatcaggatttcgtgattttaccgttgggtggataaaatcgaatagcggagcgaagttagataattttttttcatatgaagtaaatcgaggtttgaatacattagatgaggaaaaatcatattataagcatagtgtaaataccaaccatcactaaacacccacaaaccttaattcatttgttatccgtaattgcttagcacaagaaataatcaaatattatttaaatagaaaattaaaaaatggcaattttgtatagcaaaatatgttattcttttgaaaattccatctgttacacattcctctaattctatcgattggaaaaatagtattagttacaattcccttctaaagcatccaatggccataatttttttatgattgttaatgaagagaaaacagtggacagtgtcatcacatggaattggttgtggataaaacaaaacaccccactccatacatgatccactcttctcctctcaatcttcatcctcactaatgaattaataatacatttaaatataaaattattgaattcattatttgctcgattcggaaaatcgtaattgaattcagataatg

SEQ ID NO: 33115 - DNA, 3003 bp, Unknown
  misc_feature (1)..( 3003): 2750-1469P.txt file - cDNA_ID_3065806; gDNA_ID_1620484; Annot_ID_158426
aacatgtggaaacaattactctttcagagatgaaacatgaagagttagaagcttttgttgagtttatatgcagtgatggctcaatgctttctgccaacgtgaaacaacatgctcgctcactctatcttgcggctgataagtatgagattctgcatctacgagacctatgcagaaccgagcttatatcttctctgagtttgttgaattctcttgacctccttgtgctcgctcaaatcccttttgacaaagtcctcaacgatgaaagtttcagttatataaaaaataatataagtacgattgctagctctgatgagttcaagttgttcgtcgccggtaacccaaatcttgccgtggagataatgaaggtttctctcattactcttactttacgctgttcctcctgtggttcaaaccatagtcttcaaggtatgtactgttgtaattgttgtcgctacggtactcttcgtttgatctagagaatcacaatgtattttaatttctgtcgtatcacttcgataaatctcatgttcacattttaaaagaattggatttcttcgttttctaaaacttatatagcaaatctcatattaaaataattggcttgtatatctatttatatctaataatatcttcttactatgcaaaaacaagacaaatgttaagaaaacagatcgattttatataaaccaagcgtattgtgtaactttattaatcatctcaaaggtacccgcgcacttggactagcaagcctttattaaagtggaatgtgttgttgattgtttcgtgattcctaatgagagaattggtgattgatattgatcatacagttattctactatgaatgatgaaggttgtgaatgatgaagaatctctctgaaggacaaattcgaaaacgagttactcaacatattgaaagttctcttaacggcctcacactttaagatatttcctttttaagtatgatatctcggtttgtagtgaattcaatattttttgtggtttttgaacccaattcctgctatggagataaatgtaggctactctgactccaacgattaatccatatagttcctactagcaaatctgtctagtatatgaattctatctcaataccactcgatctctagaatccattcactgctttaacttagggccataatgcaagcttaatctcacttaccccgcggcagagcttatatgacaaaagcagacaatcactaggtgaaaacaagtcacaaccaaattcgttgagggaccaatattcagagcatgacacaatcttcttcaacttcttcattttctctcggcaagatcaagtcaacttgaactcaaaggccaaacttagattatttatattagaatgacatataaaacatggaaaaaaaatatagtaaattattataaaataatgtcttacaaaaaaataatgtcttacaaaaaaaataatgtcttacaaaatgttttccaatgtacaacgacaaatagaattttcacaatgaggtatattcttctttttctcaatacaatgaaatgcacattgttggcaaaagataattttcatgtcatcgggaaaatgtccaatatgttcgtatgctggatcaatagtagagcttaatgaagggatagaaaactgagtttttccttctaaaatagattttgtcatgatatttgatgtacctagaaatagtttttttgaaaactttttaaattaaaatataaatataaattgatcaagaatgaacttacatgatgaaaccaaaactgcaatagttagaaagaaaaaaagtgtcttcattttcgttaaaatgttcaatattttaacaaaaacaaaaatggaatatatttgtgttttgagttttggttgtgatgttttaaagtcaagatagtagcatatttatatgtgcttttactaatgttacatagtactagtagttaatgttttatcaaacatattttcttagaaatcatagtcaaagaaactataaactttaatttacagtttttaatttaaagtatttcacccgtttcacaaaaagtgttgtttaattttttttttttttttttatgttttaaatcaaatctctgtgatgtagtttttaaaatcaaatctctgttttatctatgtgttttcaacttattaattaaaaataaagtgtaaaagaaaaatttagatgtttttattaatttgtgtgaaaaatggtacagttgttaataggctagaaactatttacctgttgttacatgtatattggcggtctaagcattaggcttaagttggtcgttttgctcttttatatgaatcacaagttataggctagaaactatttagggttcttggtgtgagtgaatagagtgtttaacatatctattgttttggttgtggggttgagaagattaggaattggtgactgactaattgtattaatgttgtaaatctgattaaagagaaaaagttcaattaacgttgtaaatttgattaagtgatttttcaattgcgtctacatttacataataacataattttctatcgttcgatccaaaaagaagttgatctcttccctcaaaacattattctgcttcttgagggtcacgttctcttgtagcatcgattctttttccttctccaaatttatggcatcagtttggaaactagctatggtctggtcatatagtcttatactatttttctaaggtgaataatctctttttatcgtcaaaatcatgatttaggcccatcaaccatatatgcataattgcattcaaacaaaataaataaagaaatacttactttacatagtgaaatatagacgtcgtatggaaaatggaaacaacatcaacaaaaaaaaatcaaaaatcaaaactcttcacaacctatctattgaaaacgaatgcttattgttttttacataactttcaaaattgaattagaggcaataacgacagtgagaatttcaaatttcatttctgaggcaatcgcataattcccaccggcgatcggagatg

SEQ ID NO: 33116 - DNA, 3003 bp, Unknown
  misc_feature (1)..( 3003): 2750-1469P.txt file - cDNA_ID_3065816; gDNA_ID_1620484; Annot_ID_158419
gtatgcaacaaagttgttgtagctgctttaagaaacgcagatgagtttttaacaccgcttccgattattgcgtttacatgcgcttgaagattcagataaatctgcaaatcaaatcaaattgcaattttcatcaccagaaacacaaagatctgtagattttttagagagacgatgatactaacccttaagtaaaactcgaaatcgacttcatcattcaaattcggatgaaaattttggatcaaagtcgctcgttcttcgttgcttagattctgatctccaactacttttgatttccccatccttgacgcgaggtctgatactgttagcttcccgctctctctcttcatgctcgtgaactatagaatttggaaattgacagaatcagatcgaaaatttcaatgagaaacaaacgaaatatcaaaaagcttatggagattttcttcaatttcaatggatctgacgtacgtacgtgagatttcaaactccgaagctccacttgcgtgaattggttctgtaaccatggatccgataccaaaatcccgacgaatcctgacatttttctctactccgaatctccgatcgatctcttaagcgaacttgaagaagaagaagaagtagagaagctctaaagcagagctggcagtgaaagaaaaaattcaaatttatgacgaaactaccccttttagctttttcgattttaaatttcgcaatcaacttttttattagtgttggcaataaaactgtgacctgtggaggggtccatgactccgtattgtcgtttgagattttgtgaatttccgattctaccctttacctttaatgacttctcgtgacattcgagagggtaaatagggtatttatgaagttacggctaataaactagttggagctgaatgtaacggtcgttttgagtaatttggttattcatcctataaggtggattcattttaaaagttcaaactttattgacttaaagtttttgaacaaaaaaagatgactagtttttctcaatatttgtttcttactatttttctgttaattagtttttatatgaaaagcccaaacaaaatttgatgtaaaacttatttataactaaaaaagaagagccaaaaatagcatttaaataagagacatatcctaaataacctagatatttagttattttcattaaaatttaacatatttttgcaaagtttagccaaaatttagtaaaattaaactaatttttatttaaattgaacaattttttagtgttttctcccaaaaatcgagcctatctgaactgtagatttataaaatcctaacaaataataaattctcttaaccgaattatctgaatccaaataaatatgaatcgaatccaaaccgtaattccaatgtttaggcctagatagtcgtatgtctttttggcctaatcaacgcattctcatatttcgaaccgcagattaacgtttagttcatgtataaaatggtcacatgtgaagttgatgtataaaacggctataatttaaaagttggagtattaaatgacatgttttccatttcgattatggtgaaacgacgtcgtttgggaactaacgaagactagttaatagttgttatcgggtctattaacgccaaataacatcgggtagattttagtgtggttaataattaagtttatatgaaatgaccgatcaataatttttacatgtattaaatacccatatacgaatttcacgtattaaataactatattttaaaagttcgcatattaaacgaacatttttcatctaaaatatttcacttgacaaatatttttcgtgtcaatatttttcgatcaaagcattctgaagtaattgcaatgctttgatctacacacataaaactcgttgacaaatctccattatgttttagaaaattgagtcagcaaaaagtgcatgagttgtagttaaaggttgatccgattatactacaaaatataactttattgctcatcttattctactcttaagtctataactattaataatcatgtataaaccactgttataggtaacgtctataatgttataagcatggacaaaatatttgatagcaatagtgtactaaaaagctactcctaaaagaggattaggaaataaagcatgtgccagacatagtgaatgagaaagaaagagagattttgtaataattgagaaaatatgaagcaatcctttgccatgcctactttatctatagcttcctcacttcaattaaattaaattatatttgtaattaagcgattatgtttatatatatacacatttatacattgtttctcattttaccatttgataaaaatattgatataaataaattgagatctttatatggcattataaataggatcgctcaactttgtctaagtaggcaatgaacttaataagaatcataaaacaccattatatcatttggacccctccatgcttcctccacatggttgctgatctcaactaggaagatttccataattgaaacctgattttgtgtatcaaactaagaatattaatgataaaaactgtagtttaataacttttaacaaaaaaaaaaaaagcttaataggttttatccttttgtgccatttacctagcttaaagctgcaagttaagtagtgttataaaaataaccaatattgataaccggtattatttgacaaaccaatcaatcattacaaacttattatgtaaagaattcttgaaatggtttgtttttgttgtaatttgggtatattattttgagataaaattttaaactttacataataagcaccaagccttcttagctcagtggtagagcgcgtggcttttaaccacgtggtcgtgggttcgatccccacagacggcgcatatatttcctaaatttttgtcgaattatttttttccaatttatccccgtcgtcttcttcgattctttatctttttttcctttgcataaacccaaaacctcaaactttttgaatccgaaacgagaaaacaaactatg

SEQ ID NO: 33117 - DNA, 3000 bp, Unknown; identical to SEQ ID NO: 2074
  misc_feature (1)..( 3000): 2750-1469P.txt file - cDNA_ID_3065820; gDNA_ID_1620484; Annot_ID_158417

SEQ ID NO: 33118 - DNA, 3003 bp, Unknown
  misc_feature (1)..( 3003): 2750-1469P.txt file - cDNA_ID_3065827; gDNA_ID_1620484; Annot_ID_158413
agtagcagcaaacagagacaattatagagccagattacaaaaactaacctacccatcatcataaatccactaaattccacaaaatgtgtaaaatctctatgaactacagcaacaaaatcaagggttctcttcgatgagcatcaaaatcctgtaagcaaataaaaaaaaatcaaaactttattagcaacaacgaaaattggattatcgccagcgaatcaaaaagactaaagcgatctttaaaattgaagttgacttagaaaaatttacaacaacttacgaatcaaaatcagaaacacaaaacgaaagctttggtctttgtagtcgtcgttgtcgtggtggtggtgctcttgttcataagtgttgaagagcacaatgaagaaggagaagaaaatcgcatctgtggctaagtggttatgaatgatgatgatgatgatgatgaagaaaggagttgggaataatttaataaaggagtcgtctttgtgagtgagttgactgggactttggatcgtcgtcgtcgtctagtgaaagttcgtgaagaatggggcaaagaaaagagagacactgatgatgagaacgcaatgactcccaacaaaaaccaaatcggtctttgcgcgttaaatgttttttttttctttcttctctttttgacttttcaacatcatcatatatattatcttgtttgttaggagatggacaaatttttcttccatttggtatttttcgcttttcattcgtttttagataattctggatattttgtaaatggttttggtgttttgaccaaatcaaagaatggaatatgacatttacaagaaatgttttcttggtattagtttttgacaaataccaatgcataataatttgtatcacaaaaattgaatatcatgtcacatatttaaatacttattaggagtagtacttattttgttgttgttggaatctttaaattatgggttgacagttatatatatatatatatatataaaaagcttgttcatttagcagatgtacccgccaaccacggttcagcaaacaccccaaaatgttaattcgtgttgtttatgtattgtcagtttgtaacataacgattttagaaattttacagagtgtttatatacagagactctaataccatgtagactaagagtatatcgaatatatgaaacaagatgattacagagtgtttatatacaaagactagaaagctactgaaggaaacttaatattgtatacaatgattatgagcaattaacgtgattgacgatattgattctcttcattatcttgattgatatgattatccttgatagtcagtttgtaacataacgattttagagaggagataaaccacgaatcacaacctctagtctctcccaagccaaatccgccattcgtgacctgaaccaacttcgaaattcatttgatatttgtaatgttttgtaccaaatcattcaccatatataatacaattgtagaattccaacaatttgggaagttgtaagatttatttactcttggtttagtctttcctctttgacaaataccaatgtataaccaaactatattttcattgttgctcttattaagaaaacaatcatatataaattttgcattcaaaaaaattagacacatagtttcatccttggagacaatttatatgatcgaaacatccgatgaagaatatcagtctatgaaagattgtgcaatctagttttttccccattataacatagccttaagcatgaagccaaagcttcgtcaacaggttaaaaagattgggtgtttggtaaaaaaagttaaggaatttaaagagtgattgatacacatagatggtgaatataccaattaatagaaaaaaaggaggaaagagtaaattacaagttcccggcagtttcagacaaactcacgtgacgcaaactttaaagggtttgactagagccacataagctgtctggtccgaaccagatatgatagtgaagaacgagccattaaaccacaccagtctctctcacgtgccaactaagtaaaattgggtgtgcttaataaagtgtctgttataaatcgctttgcttccttttattttgcctctcttctactttcctctttcctttttagggatttcactttcctcttctctctctctctctctctgcctaacctcgatttctctcgatcgctcttcaccatggatctacgatcatgtggtccttcttgaagttttttgatctcttcttcttacgggtttttacttcgtttgattttcctggtaaagttgctttttttttatcttctcttgaggtatatactttttttttgttttgagttcatgttcgtgttctcttcactgtagctagggtttgttgatttctccacaatatagctcaaaatttctgctatgaccttgaattttggtcgtgaagtttgtttatgtgatggattaagctgggatttcatagaatcactgaatcagcttgcttgtttctactctcatttcgtcatctactcttctcttaatctgtatttgtattatttcagctaatttttttataagtacgtctgattagttcttgaggttgaattatctttgtgactaaaaaatagtgtgaatttttcttgaatggattcatttttttgggggtttcttgttcatttgtctttacttgccttgtaggccattttcttacatagttgtccactatgacttgtacggtcttgttacagagctaatttgtttttatctttaacgagtgatattgtcattggatagttttgactgatctttgtttatctgttcttgatgatttttttttttgtagttgtttgttgttcaaggatcgagatttcgtggagctctctattcgcagcttggagattggacttgtttgaattggtaacaatattgtgtctggcctctaatgtcgttgtactcatgtttgtttttatttgttcgggactttttaatcattacttaaatttccgttttatttaggctcttttgtgatg

SEQ ID NO: 33119 - DNA, 3003 bp, Unknown
  misc_feature (1)..( 3003): 2750-1469P.txt file - cDNA_ID_3065846; gDNA_ID_1620485; Annot_ID_158466
ggttatatctagctgagctttcaaaatgctcaacctcaaatcattctatttcatcctcacaaaaagctctcaggtccttaaagttgatcccagccgctgcaagaaaaagccttcctgtcttggtcaatcactgtggattactactctgcataccagtatgtgaaatcaccattttaaatcatttgttttgtcggatttaactataagaccatacattgattctcgtctctgtgttttcaggctattggcttcagttattgttcatgccttgaggcatctgcagtgtttcttccaagaataccactcggaggcggtcatagctcatttctctagtctagccatatcatgttgcattcattcaatactaacagacatttattcacttgtactgaattctcgtgaaacgaaataatatttgattcaagaatctgtatcctaggcaacttccgttattgaaaatcgccaattacactcgtttttgttttcattcaaagtttatgacagggaaaacgatcatactccgccttggccacctcgttcttttaatggttgaaatgatgaagtaaaccattgcttccaagctgcgtccttctgttgctcgacccatgagaggaaggcactgtctactaggcaaaagatgttgacgtaaagcaactggtattgcacgggaacatatctgaagtttgcaatctgaagaagtggccatgctccgccttcaagagctagagccggaagaaaatctctcttgagtccttctttcacttcagctgtgttctttcctgtggcgaatcccatgtatgtgaagaacaccagtagatctacaggtccaaagataagaccatccattgcaacttttgcagctacaaaacgtgttgactttggtacatatcgaagcttcagttttatgaatttatccaagccttcgtacctgtgcaaccgcaaatagaacaatatcaggtttatcaatctaccatagacaattctttatcagtatctgattcagtgtcactagtttatgtgagcggtaacacgaggaaaagctataacgaaatgatctgagatcagaaggaaacaaaccagaagtggccaacaggtccgacaaaaccaaatccaaacatgctcgtgatagctactcgcttccagttgactttgaattctgcatcttgcttccacttgaccttaatttctgcatctgcgtcagcatctttatttgtttcctgttatattgaacatggttttagtgcttgagccaaggtaagtcaataaaatctcaatatatagcctaaactcagaaacaatataccatgacctctaaaggcaaatgaattttaaggattgtctcacagcagaagatgttataagtaaagaagtatcgcataatttcataaaaggtaagcagtagactagagctgctaatccataacggcatgaacatgtatcaccaatggaccaaagggcgatttatattgcaatgttaacatgaaaataccacaccaacaacatagagagtcacaaaacacattgtctccattagtatcttttacgtattggtatcaccataccatataagctctcttctgaactgttcaaactttgaaaagaactctgaagctgtagtagcccacagttctggcttaagcattaaaatgtcttcgattgttggaaaaaatagccattaggaaatcatggaatctcagcaaacaagtaaatggacgttatactacaagaaatttcacacagccatagagagagcctagaaaagaatccgagtgctattgctcaattacaacttaggcaacacaacctaaagttccagtatctatctaatagagaccataagctaacaagaaatcacagaaaactgtaaacggagaagacgaactcaaatccttgaaagatttagcagcaagaaggtgagaacaacgggaaaatattccaagtatcaaagaaaaactccagaaacagcatcaaggtctaaggaagaactacataaatcaacacattgatgaagcattaccacattcactgaaatgtcgcgaatatactgatgcacaagaaccaattgacgcagatatatcacgaaacccagagatacatagatgcaaattcaaaaacctaaaactaatttcatcaatccgcacgaatcggagagaaactccaatttgaaacttcaatcgaaggtgagagagagagaaggagatcggaaaatgactaacggtgagacgaagaagacgacgtttcgcagtggaatgagtgatgtattgagcggtgacatcgccaaatccccaaagaaatccagaactgatgacctgagttttcacaggatgaaccgtcaggcatcgctggtaccatctccaaagcttcaacattatgtaccagccgtattcgccgtcgccgcgagagagagagattgggacctgtcacctgtgacggagagccgccgtggaagaaggcgattgtgattggttagaagaaagaggttgatacagtgcttaagctttcttcttaaacgtcttcttctctttttaattttttaatcacttctttttttcgagtcaacagtcaacactacaaaaaggctgttgcaatatcattgggcttttaccaatcaacattttctttccggcccattaacatttaacattctaatttaatttgttttttgtgttgacgatgaagaaaattgggtcaaatgagaaacctctcattttaacctctctattttttaggattttaaacccccaaaatttccctatacactctatcttgcggcggaagaaatctgtaatcacaaaggaaaaggttaatagttttttttctttctcttttttaaatattttgttttgtcgtcatcgaatcttttcgtttagggttatctgatgttacatcaaggttaaagaaaaccgataatcacagaagcatatagaaatcgtttttgaaggtacatcgatcatcgttgagacttactacgttacaacgatcatcgttgagacttaaacaatg

SEQ ID NO: 33120 - DNA, 3003 bp, Unknown
  misc_feature (1)..( 3003): 2750-1469P.txt file - cDNA_ID_3065892; gDNA_ID_1620487; Annot_ID_158504
tcattatatacaaaattgactggtaatgttagtccattttattaaatgttggatttaattttgtacctaaataagcatatatatatatatatacatatatataactgaaagtatttcttgagctaatggatacaaaatctacacaatacggttcggtttgattcaatagccaacactatttgatttttctaaaccaacgataaaatcggtctactgaaattactaccgagtttatcagttcaacatctttcggtcggaacgtatatgtatatgttggttgacctaataaagcaaatagactttggttcggttaagttcggttaaataaagaaaaagcagattctgagctttgtttgtgagattcagtttccaatatcagagaatctctgtgtcgcctgaagtgataacattctcattattcacccaaggagagagatcggagctaaaaagccatctctcgccggaaaatttctcagttttcttattaccttagccacagacaacaagacgacagaggaatctaatcttagccccctttcctctctgtctctctctatatctctgtctttaggctttgagatatcttcaacacgaagctttttgcttcttttttttatctctttaaaaaattccagccaatggttcgaatccaatagtagcttcaaaggtcatggatttagtcaggtgtgttctaaattctgatctccttatgtattcctttctctcgctattggtttctagttccgtagggttttagatacgtttgcaactgaggacaattaggtttcttttaatccacatcacgattgattcaaagttcattgtgtttctgtaggggtttgtggaggaaacatagaaggaagattttggtgacgacgacttgtttgggaagtgggtatttgctctataaactatacaatgcccatactcgtaagctcgctgatttggaacgagagcttgctaatgagcgtgaaaacgacgagatcatcaaaacccagttgagtttttgtaacctctcgtctttattttttgcttgtttatcgatttctagtccttattggttttgttctctctatgctctatgttagaatgaaggcacatttcgataacattcagatgattgctgatactactacattgcctcacgcaattcatcacttgagtagtcgtgtagttgaagagattgatgtctcgagtattatggataagctaagcaaaggcaaaggaatattgattccttctgagaagcttcaactctggaatgagctcaaaattttgagtgcgttgttgttcccttacttgtacttctcgtgctctgtggcaacattggatcttctcattaatcaatctttttaaatgtgtttccttgtgttcaggtttcacgagaatggtcttgtccctttggtcggtcactatgcttagtttgtacattagggttcaagtcaatattttgggcagacatttatatatcgacactgctagaggtcttgggagctcccatttacttgtaagacattttacttttctctttttattgtcttaagaatcattgttaagctacttctagcaaattggtcattctgataaaattttgtgtactttcattctacttgttgcattgtatcttgagatatcaaaatttcaaattgagatttcaaggggtagaagttgatattttgcatcttttcctttcaaaattatcgaaattagtgtattcattggtcttagatataactcttggctggattaccacaatctttaccaacgtcatttccttgatatgtttttttctcaggacgaactagatctcatagagagagatgatgaacaaaagtttttgacaagcgctgattttcttgcgaccagtggcatgccgagtttgatttctaacatgcagaacgcagtgaaagaagttctcaaggggtaatttacattacaaacctacttatcaaagatgtctcccttgtttctcatccttgaagattgattttatggtgcctcaaactcaaatgcctatgaagaatcactatacttttatgaacgtatagcgaaatctaactatgtgtgtttaattgcagaaagcagttaaaggatgtgttaaccacaagtgctcttcgagaaactgtgatgcggattctcgatgtgtttatgagcacaggaagtccacaccactgggtagattatctaatgatgtcccaagacgcaaccactgatgtttcctcttctgatgcaactgttaccaagtttcatctactcataaccgagacacgggaagtactcacaaggtaaaaaaaatctctgctctttaacccgcaaaagacgaacaatttcacttctttaaagccttgtcctcgtttctgcttcaatgctcaaagcaagaatgttgcaatgtagcctgttaaacatttcttggtcttgttttcatgttgcagcaatgatttttcaaatgtagcagagatctcactcaagtgttgtgccgttgcgttagtagaggagatggaaacgcagaccggtctggccacagggatgcaattggcaaagctattaccacagattgagaaaaccatgccggagatttcagctgagccggagaagaaccggttcttgcaactcatccgagatttgcctgaagttaaactcttttttactcttttatacgcaaatatgcctcagtagcattattaaaccccattgccaaaaattgtttcctgatcactttttatcatatgtttcgatttacttcaaaatagtaaaaccaaacatctctagaataattgttcaatatctatatcaaatcatttactaatatagtaatattgcagcaacaaaaaaggacaccgtgtattacatatctttcagtttttagggccctagaagcccaaggcccaataaaaccgggtcggtgatattaacttcttcttttttattaacttgggtctctccatctttctcagttctcactatctggacactttcgatttctgaagttgagagacgactatg

SEQ ID NO: 33121 - DNA, 3003 bp, Unknown
  misc_feature (1)..( 3003): 2750-1469P.txt file - cDNA_ID_3065896; gDNA_ID_1620487; Annot_ID_158503
ctgacagacataacggctgagactccttggaagcttttagagacggcaacaatggcggctacgaaagctctggaatttgttttgccgacgggcttcttcatccagccgtcattgaaccgtcgcggaggagttaggctctccgtcgtcaagtgttccatttcttcagtcacctctacaggcaccgcatctggtaacgctcgccgatttccccatttccgtattttcacagcttgattttttcccagaactttagattcgaattggctttcgattcaaatgttatgtatatatatgattttttcagattacttgtaggctcttgattcgtgccttaatcatcgttttggttattgtttcttttagtttggatgagctgaaaatgtgtgtgaatgttgaaatgtgattcaaacaagagtaaagaggggagttaatgtgtgttaagacacatttgtcagttttggttttacaataaatttgggggtttttatttttatgtttgtaggacataatgagtccatgggtttaatgggtgcagatacatttcttttctatataagcatgtagtctcatttgtgagaaattatcagagatatcagagacatctgaaagtcattcacagaattaagtatcattcagctaaacagttcttaacctctgttctatcatctctgtttctaacagtgaattccttgttttaccggttttgtaggttttttagagaaaccatggagctcatacaatgctaggctagtgttagaagatggctctgtttggtcagctaagtcttttggtgcttctggaacccgtgttgctgaattggtatttaacacctctttgacagggtcagattcttttttagattctaatttagatttctagatattataactgggtttagaacattactcattttaatcctaccagatgatcttgacacacgggcaataacccgtcgattaagagaaagcggcagtcttaacggtgtgcttagcactgatggatccaaaaccgacgaggaacttttgcatatgtcccgctcttgggatatagtaggtctgaattctttcactgccctccttaaaatatgatcagcgtggaatatgtgattgagctctgtctatctgcttggttgaatattttaggccttgatctaataagcgatgtttcctgtaaatctccctacgaatgggttgaaaaaacaaatcctgaatgggagtttaagacaacctcctcacgtcacagggaatcctacagagtgagttgtactttctcttctctaatttacattctcatcgatttcctcactagcttctaactctgttttcatacttccacttcaaaaggttattgcatatgatttcgggatcaagcaaaacattctaagacgggatttcctcactagcttctaactctgttttcatacttccacttcaaaaggttattgcatatgatttcggcatcatacggttgtgaaatcacagttgtcccatcgacatggccagctgcagaggcgcttaaaatgaaaccagacgggattctattcagcaacggtccaggagatccttctgcagtgccttatgcagttgagacggttaaagagcttctaggaaaagttcctgtctatggaatctgtatgggtcatcagttacttggacaagctcttggaggtaaaacctttaagatgaaatttggtcatcatggaggaaaccatccagttcgtaacaacagaaccggccatgtcgagatcagtgctcaggtatgctccatttactatctatagattataaccacacaagattaaacagtctaatctttcagttctaatatagtttacaaatatgatgggaaaataaaaattattaatcaaaacttagttatatacttatatatgtaactctgagaacttgttgttacatggctgtcgagttcagcttctcacttcctagtacagtaaactaaaaaaaagacgtctctgttttgtgtctgctgaagattttgattgatattgtttgtgcggattttggcaaaaccataactatgcagtggacccagcttctcttcccaccggcgtggaagtgactcacgtcaatctcaacgacggaagttgcgccggtctctcttttccggcaatgcatgtcatgtctcttcagtatcaccctgaggcttctcctggacctcatgactccgacaacggtattaaaccattctttcttttcccttttgtctggtacctatcaaaacgtaaacgctactaaaacgctatgcattaatttttgcctaatcttttcatatatgcagcatttggagattttgtggagcttatgaaaagatttaaacgaagcacttgatctcggctaaatcagtgatctagcgaaggagttttgtttaggtggattgaagttggagttgcgaatttttttgtcgtgtgagaaataaaatagcataatgactgccgaaataagacaatttagttgagaaacttatgcaagtttgatatttatactaacatcaaaagtagcttgcttgccatttttgttaggaactggatctggtattttgctcaagtatggttttcttggcccatccacttctaatgtgttttgtaactaatgcaaaatgtgcattagaagtggattggtcaagggaagcgtacttgtgcaaaatgcggcagtccaattcctaacaagtttggcaagcaatccatttttggtggcttgtatgtaccgagctattacagactgacggttttgttttgtaactaaagaggagaaaaaaactctagtatatgatttcaatatctatggatcctccaatttagttttctggtttagatttttttcttccttatcttggattttctggtttattaggtttagaactaaataaaactgttatgtggttggtttgataagattttggtttcagttggaatatcaaaaaatatataatgggtcttcaaaacattaccattcgttgataataaaccctaagaaaatcaagatg

SEQ ID NO: 33122 - DNA, 3000 bp, Unknown
  misc_feature (1)..( 3000): 2750-1469P.txt file - cDNA_ID_3065900; gDNA_ID_1620487; Annot_ID_158501
aatccacttctaatgcacattttgcattagttacaaaacacattagaagtggatgggccaagaaaaccatacttgagcaaaataccagatccagttcctaacaaaaatggcaagcaagctacttttgatgttagtataaatatcaaacttgcataagtttctcaactaaattgtcttatttcggcagtcattatgctattttatttctcacacgacaaaaaaattcgcaactccaacttcaatccacctaaacaaaactccttcgctagatcactgatttagccgagatcaagtgcttcgtttaaatcttttcataagctccacaaaatctccaaatgctgcatatatgaaaagattaggcaaaaattaatgcatagcgttttagtagcgtttacgttttgataggtaccagacaaaagggaaaagaaagaatggtttaataccgttgtcggagtcatgaggtccaggagaagcctcagggtgatactgaagagacatgacatgcattgccggaaaagagagaccggcgcaacttccgtcgttgagattgacgtgagtcacttccacgccggtgggaagagaagctgggtccactgcatagttatggttttgccaaaatccgcacaaacaatatcaatcaaaatcttcagcagacacaaaacagagacgtcttttttttagtttactgtactaggaagtgagaagctgaactcgacagccatgtaacaacaagttctcagagttacatatataagtatataactaagttttgattaataatttttattttcccatcatatttgtaaactatattagaactgaaagattagactgtttaatcttgtgtggttataatctatagatagtaaatggagcatacctgagcactgatctcgacatggccggttctgttgttacgaactggatggtttcctccatgatgaccaaatttcatcttaaaggttttacctccaagagcttgtccaagtaactgatgacccatacagattccatagacaggaacttttcctagaagctctttaaccgtctcaactgcataaggcactgcagaaggatctcctggaccgttgctgaatagaatcccgtctggtttcattttaagcgcctctgcagctggccatgtcgatgggacaactgtgatttcacaaccgtatgatgccgaaatcatatgcaataaccttttgaagtggaagtatgaaaacagagttagaagctagtgaggaaatcccgtcttagaatgttttgcttgatcccgaaatcatatgcaataaccttttgaagtggaagtatgaaaacagagttagaagctagtgaggaaatcgatgagaatgtaaattagagaagagaaagtacaactcactctgtaggattccctgtgacgtgaggaggttgtcttaaactcccattcaggatttgttttttcaacccattcgtagggagatttacaggaaacatcgcttattagatcaaggcctaaaatattcaaccaagcagatagacagagctcaatcacatattccacgctgatcatattttaaggagggcagtgaaagaattcagacctactatatcccaagagcgggacatatgcaaaagttcctcgtcggttttggatccatcagtgctaagcacaccgttaagactgccgctttctcttaatcgacgggttattgcccgtgtgtcaagatcatctggtaggattaaaatgagtaatgttctaaacccagttataatatctagaaatctaaattagaatctaaaaaagaatctgaccctgtcaaagaggtgttaaataccaattcagcaacacgggttccagaagcaccaaaagacttagctgaccaaacagagccatcttctaacactagcctagcattgtatgagctccatggtttctctaaaaaacctacaaaaccggtaaaacaaggaattcactgttagaaacagagatgatagaacagaggttaagaactgtttagctgaatgatacttaattctgtgaatgactttcagatgtctctgatatctctgataatttctcacaaatgagactacatgcttatatagaaaagaaatgtatctgcacccattaaacccatggactcattatgtcctacaaacataaaaataaaaacccccaaatttattgtaaaaccaaaactgacaaatgtgtcttaacacacattaactcccctctttactcttgtttgaatcacatttcaacattcacacacattttcagctcatccaaactaaaagaaacaataaccaaaacgatgattaaggcacgaatcaagagcctacaagtaatctgaaaaaatcatatatatacataacatttgaatcgaaagccaattcgaatctaaagttctgggaaaaaatcaagctgtgaaaatacggaaatggggaaatcggcgagcgttaccagatgcggtgcctgtagaggtgactgaagaaatggaacacttgacgacggagagcctaactcctccgcgacggttcaatgacggctggatgaagaagcccgtcggcaaaacaaattccagagctttcgtagccgccattgttgccgtctctaaaagcttccaaggagtctcagccgttatgtctgtcagtgaagtagtgaacaaatagttgttctttatattttcttattacttttcataaataacaaaatagccctttacttattttcgtatatttaaataaaccccaatagatatatatttatactaaaacctccccgcgttaattaattatgagaaaagcttggtaaaaaccctatttttcttcttctcttcaatttacagttctctgcacctttttctttcccctgttttttgatcctcaatcaccaaaccctagcttgttcttctgttgattatttcgaaaagggggtttgtttgttttctgggaatcagcaaaaatcacgaaatggttggtttaatatttcaatcgggataaaatcgatcgaaaatg

SEQ ID NO: 33123 - DNA, 3000 bp, Unknown
  misc_feature (1)..( 3000): 2750-1469P.txt file - cDNA_ID_3065904; gDNA_ID_1620487; Annot_ID_158500
taacacacattaactcccctctttactcttgtttgaatcacatttcaacattcacacacattttcagctcatccaaactaaaagaaacaataaccaaaacgatgattaaggcacgaatcaagagcctacaagtaatctgaaaaaatcatatatatacataacatttgaatcgaaagccaattcgaatctaaagttctgggaaaaaatcaagctgtgaaaatacggaaatggggaaatcggcgagcgttaccagatgcggtgcctgtagaggtgactgaagaaatggaacacttgacgacggagagcctaactcctccgcgacggttcaatgacggctggatgaagaagcccgtcggcaaaacaaattccagagctttcgtagccgccattgttgccgtctctaaaagcttccaaggagtctcagccgttatgtctgtcagtgaagtagtgaacaaatagttgttctttatattttcttattacttttcataaataacaaaatagccctttacttattttcgtatatttaaataaaccccaatagatatatatttatactaaaacctccccgcgttaattaattatgagaaaagcttggtaaaaaccctatttttcttcttctcttcaatttacagttctctgcacctttttctttcccctgttttttgatcctcaatcaccaaaccctagcttgttcttctgttgattatttcgaaaagggggtttgtttgttttctgggaatcagcaaaaatcacgaaatggttggtttaatatttcaatcgggataaaatcgatcgaaaatgagtcagccttctgtgattcttgctacggctagctatgatcacaccatccgattctgggaagccgaaactggtcgctgttaccgtaccattcagtatcctgattcggtttgtttctctctctctctcccttgattttgtgaattctgagtaattaataaaactgagacaaattaatgtttgtaattgcagcatgtaaataggcttgagataaccccagataagcattatctagctgcagcttgcaatcctcatattcgactctttgatgtcaattccaatagtcctcaacctgtaaaactcctctctttttttctcaatgtggtgtttgcttccttctacctgcttgagtgatcttgatggagtcgtcgtgtgtattaggtgatgacttacgattcacacaccaacaatgttatggcagtaggatttcaatgtgatgcaaaatggatgtattcaggatcagaagatggcacagttaagatctgggacttaaggtatatcatgtcatcttcatctttagctaaaagtttatagatttattcaagtgtggattctgggaaaggataaggagatattgaatataaagttacgaaaaatactaagaacgttctaaattgtattcttgttgactcgtaaaccaaaatgcagggctccgggttgccaaaaggagtatgaaagtgttgcagcggttaatacagttgttttacacccaaatcaggtacatgaagtcatctgttattgttgtgctgtgggaatcagcttcgttttatgtttaagagagttgttgtattgctactgttgaaactgctgtgattttggtagttgtctcagctgttattatgaactatttccttagtctttattatgaactttgttttttttttttgtacagactgaattgatatctggagaccaaaatggaaatatacgtgtatgggatctcagagcaaattcgtgtagctgtgaactggtaattgcctttgacacgtcttcatttcatttctgaaaatccgtagataatcacttgaggttaactataggtaccagaagttgatacagctgtacggtctttaactgttatgtgggatgggacaatggtagtcgctgctaacaaccgtggaacatgttatgtatggcgcttgttgcgtggaaaacaggtagtgttcctgatatgcaaacctttcttttgtttaaccatgttgtagtcgcattactctaattgtccatgccatttaaaaattcaaaatcttttacagacaatgacagagtttgagccccttcataagctgcaagctcataatggccacatccttaaatgtctcctctctcctgcaaacaagtaacatgtttcttatactttctcttttaaccgttttcttcatcctctccttttcgaagctcttacatatttgttagcagatatctagcgactgcatcatctgataaaactgtcaaaatatggaacgtcgatggttttaaactagagaaagttttaacaggtatgttctccatgttactgtcaacagcattcattctccattatcgtctcttacactatcatcaaatcttatataacaggacatcaaagatgggtttgggactgcgtcttctcagtggatggagaatttcttgtaacaggtactaatctctgtcttaacttaaaccactgaaaaacatatcagaacaatctttaaacgggtttctatgatgttgtacagcatcatcggacatgacggctagattgtggtcgatgccagcaggcaaagaagtgaaagtgtaccaaggtcatcacaaagccactgtgtgctgtgcacttcacgattaaaaccttaataagaatcaaagctaaattatgaacaaactacgattgtgttatttgtgttttagtaaactcttgtacatttcaatcgaattcgttcaaattgctcttatgttccctctctgatcaaacatttctcaactatatcacaacaaaaatgctccaacaaaatttatttcagaagaggcccatttatacctgactcggaaactccggcccaaatgagccagtctcctcgcagaaaccacactaaaccctaatttgattcatttttagacctagagtataaataccaaacatttcaatcgacctcgtaatctctcgctctgttacgccattttcgtgagtaagaagaagaaacccgaaaacctcaaaccatg

SEQ ID NO: 33124 - DNA, 3003 bp, Unknown
  misc_feature (1)..( 3003): 2750-1469P.txt file - cDNA_ID_3065908; gDNA_ID_1620487; Annot_ID_158497
taaagtcaactggaaaggagttgcttattacaatagattgattgattacatggttcaaaaaggtatcaaaccataacgtttcttataaaacactgatttgattatagaatgaagtttaacaaatctaatttaatgcttagggattacaccttatgctaatctgtaccactacgatcttccattggctttggaaaacaagtataaaggcttgcttggtagacaagtagtgtaagcaccaatatgcaaagctcttttatgcattcctcaaaagttacaaactttgataatgcaaattttacaggaaagattttgcggattacgctgagttttgttacaagacatttggtgatagagtgaaaaattggatgacgttcaacgagccgcgtgtggtagctgctttaggttatgataatggtattttcgcaccgggtagatgctcaaaagcatttggaaattgcactgaaggaaactccgcgacagagccatacatagttactcatcaccttatcttggcccacgcagcagcagtccaaagataccgcaaatattaccaagtaaacaaataacttctaatacgttttcttgatcttcttgatgtgatatgatgaaataaacctatatatatggctcttttgccagtgtactactaatcttaatgaaaattttccaggcgaaacaaaagggaagggttgggatacttttagatttcgtttggtatgagccgcttactagaagtaaagcagataatcttgcagctcaaagagcaagagacttccatatcggatggtaaatgttaaaactttttaacaaataaaaactcatattttaccatcaagtcttggtgagcttatagaatatcttttgttttcgggtcatgcttgaaggtttattcacccattagtatatggagagtatccaaagacaatgcagaacattgtgaaagagaggcttccaaagttcacggagaaagaagtgaaaatggtgaaaggttccatagattttgtgggaataaaccaatacacgacttattacatgtccgaaccacatcccaccaccaaacctaaggatttgggttatcaacaagattggaatgtggaatttggctgtaagttattggaagattcataacgatatgtagattttggattttgtttacagtctttagattttgatcgtgacaattattaacttgcagttgctaagttggggaagccaataggtccaagggtgagatatacacttgattatatgtttttttttttccctaagcaatatatatacaagtgtctaagttattaaataaaccacttatcttataggcttactcgtcttggttatacaacgtaccatggggaatgtacaaggccttgatgtatatgaaggaacgttacggcaaccctactatgatcctctctgaaaacggtattaaagaaacaaattaaaatcttcaatcaagtttctttttgttttgttatatttctataagattattataaattttagagctttttataaatgtttgaacatattttataggtatggatgacccgggaaacgttactctagctcaaggactacatgacaccacgagaatcaagtattacaaagattacttaaccaaccttaagaaagctagggatgatggagccaatgtggttggatattttgcgtggtcattgctagataatttcgaatggttatcaggatatacttcaaggtacttaaaaatttataccaaatgtatgatatgtagaataaatcaaggttataattaatatctgtttttgtttattgtataggtttgggatcgtttatgttgattacaaaacattgaagaggtaccccaagatgtctgctcagtggtttaagcaacttctgaaacgaaacaacaaatgatctcaatgtatcaatgccgggtggatttagtttttaaaaaggttggaattgatgattgaagaaataatggggccggtttagtcactttgtttattataaggggggtgaattgtaacttgaactctctccttcttcagttctttgacttttcaacacaaataaaataaaagtttaagaataaatttgcactatgaaatatgaactcttgtccttttcaattttgtgagtttatatgcatttagaacataacggtctttgaacattatagatttataaagttgcaatttgcaagcataaagttggtaatcgaattgatgtaattacccttctttactttgtactaaacaaagcgcacttagccacttaacgctaaaacatcgtaaggacatacctgtcatttccacaagtgccactcgatttcgccactcctacagtcctactcgtcgactgctcgcttaaccattgaaaaagtgagccaagggttttgattattttcgacgtctacggcgaatctctccgcatcttcatcgatttcccggcgacgtttactaccgccgttttactcaatcgtgccagcttaagcaatcgaggtacccattttaggtgttacgctttgattctgcttttaagcattggacaattccggagaatatgctttagtttcctctcttttggagaatgattcggttctaggggaaagattgttgatttcgtgtttgtattcatcattgattgaaacatgcatgatgcattttcgtggttcatggtttttcacggcttcttatcattttctctgtcttttttttttttttttttttttttttttttgtttcagtgtgtattgaggtataccagagatagacataaatgagatggatgttgacgagatcgagtctgctgggcagatcaatatttctgagctaggagaaagttttctccagactttctgcaaaaaagctgcgacatctttctttgaagagtttggacttataagtcatcagcttaactcctacaacttcttcattgaacacgggcttcagaatgtgtttgagtcctttggtgacattcttgtggaaccgtcttttgatgtaataaagaagaaggatg

SEQ ID NO: 33125 - DNA, 3003 bp, Unknown
  misc_feature (1)..( 3003): 2750-1469P.txt file - cDNA_ID_3065912; gDNA_ID_1620487; Annot_ID_158496
gatctaactgacaaattcttctcaggagaaacaaaagggaagggttgggattctactggattttgtttggtttgagccacttacgagtagtcaagcagacaatgacgctgctcaaagagcaagagacttccatgttggatggtaacggttcaaacttttggactcatatttttccagttacattttggtgagcttataagaatatcttttgtgtggggataatgtttgaaggtttattcacccaatagtgtatggagagtacccaaatacgttgcaaaacatcgtgaaggagagacttccgaagttcaccgaggaagaagtgaaaatggtgaaaggttccatagacttcgtggggataaaccaatacacaacttatttcatgtctgatcctaaaatatctaccacacctaaagatttgggttatcaacaagattggaacgtcacttttaactgtaagtttttgttcatatgtacatttatccgttatgacttatgaatgaacttgatcttgcttagattatagaacatataactagctaagttagggtctgaatgtttcaaaagcaaatatgtcagtatgagaaaaattactctagacttggaccaaaagtaaggctggttcgtccttatgggatcggactgtggcaatataaatgtgcatgatattaatactgagaaatcttaatatgtgcagttgcaaagaatgggacaccaattggtccaagggtgagataaatatatgttttcttctgagttttgttaactctctctgatgattgcttagttgtctgattatgaattaatctaattttattcaggcacattcagaatggttatacaatgtcccatggggaatgtacaaagctttaatgtacattgaggaacgttatggcaacccaactatgattctctccgaaaacggtattcaatataaatttttgttccacatccaagatctctagagatgttaagtgtataatctttataggtatggatgatccgggcaacataactctaactcaaggactaaatgatacaacaagagtcaagtattatagagactatttagtgcagcttaaaaaagcagtagacgatggagccaatctaactggatattttgcgtggtcgttgctagataatttcgaatggttatcaggatatacttcaaggtgcggaattaactaatgaatacctattgggtatatgattatttctgagaaaatgtatattatatggtactcttctaatgatttttttctgcctaggtttggaatagtgtacgttgattacaaggacttgaagagataccccaagatgtctgctttatggtttaaacaacttttgaaacgggaccagaaatgatgtggtcaatgtgtctatgatttgggttgttaacgagaggtgaatgaatatgtcatatgtgtataacttaagaacttgtcttcctttgacatttcaacgcttacataaaacagcagcaagaaatttggttcttctatcatagaacttctacattcaacaatgtatgctatcatcctcatcctcatttttttttaatttctattcactttaccgtggctcagtttctatttatcaagtcattcaaaattagaaaaatattggatttaaaatggatgtgtaagttcttccaaatcacttgtatcaaaaagatagatgttgatgttatgtgacagggcaactaattattgcaagtgattggcaaaaaaggaatcttgatcaatggatattttgagatgctaaaatgcttgttagactcgacgactcaataatggatgtaatcattcctcttccactgaaaaatctcataacacgattcacatcacatatctttttagacaaaaaatctttagtttccgtaccgtttatcacatcaatggatattttaagcctaatgcatgcacgttctttgaaatgtgtggacttaaattgatttctttagtttctcttttgttgtcattcactactcactactcactagccgtttgtgctttcaagagttgaatgaagaagaactaaggaaaaatacgttttcacgtgaagatttgggagacaagtctaaggaagtggggcattcatggtccacgaggactgaacttaatggatcatgatttgaccagtttgcccttgtcggcttctgtgtgttcacgttttttcctttggcgctttacgattcgcgtgatgactttttctcaaaatgtgggccggacacgataattctgttccggccattacacataaatatagttgtttttatcttatgagaaaagttataaaaaagaatcatattccgatttgggtaaatttttttaagcaacattgtgactgattttcagatataatttggactctggacacagctacgtaaaaacttactgtgtttagaagatatgttttatggaataaatccatgcaatatttggcagtcaatcccgatatcataagagtatggatcagcttctacagattctctgagaattttatcatttggtaacaaatcaaattgttgcaattcggatttttacctctatataagatgatgtccttttgtgtcatctccctatgcataagcatcaatatactttctacttacgaagtcgttacaaatgttaaatgttagtaaaaaatcaattaaataaactcattatattataataaaaaaacaaagacaattactttctcacattcttttcaccaaaattctttacatagtttagaaaattatatgatatatagttttaaaatccgaatttggtgaaatatatctagttttatttagtattcaattttaaattcataatgcttacagccttatcctatttattaaaaaaaaatccaacctttccactaatgcactcccataacaatttaacatcgttggttcatgtattatttgttttgaaaacaaaaggcttttaaaagcctataaatatccacccaattgttatcctccccaaaccaaacggtcaaacctcactcaccatg

SEQ ID NO: 33126 - DNA, 3003 bp, Unknown
  misc_feature (1)..( 3003): 2750-1469P.txt file - cDNA_ID_3065920; gDNA_ID_1620487; Annot_ID_158492
cctaaaggatgatgattggaggtgggaaaatgaggaaaaggggtgaactgaggaggatgatgaggatcaccaagagatggatccatggatgtgagatttttgcagagcaaagagaagagaagatacagtaaaaaaaaaaaaaagaacaaaaaaaaaaaagacagaggtggaaggtgagatttagatttagggtttttttttctttttttttgttttttgctctgagagctcttttgatttttttgtttttgtgaaaataaaatttttgtgagagaaataaataaagttaggttggggagagagaggcggaggagtagagacgaaaggatgagaagaaagattactattaaatctaaccgttgatttgttttctatcgacggttttgacgaggatcgatgacgtgtcatatcattttgtcttttattttaaggattttgtgtttctttactttgatttttttcatttttgcctcttagaattttgctacattttcgctccaatgtaataaaaaatcaccaaaattttaaaaatggaccgccaaaattttaaattatttttctgaaaagaactcctcgctttcagtgtaaaacaattttgttgattttagaataacatcgaatgaagtatatagcaaacactgttacattaagtaacccatgtaacaaactccattaaagagtgtatgataagtaagagatgtattgagatgagtatggcaaaacaaatgcaattactaacttctatgtcctctgtttaggatttgaaatcgatacatttacataaaatttagtttcaaatttatattttctgtgaattttgttagagtatatatctatttgcgaccctttaacttaatcacaaaatgatacatcaaatatgtttttcattaaggaaaaattacaagacattaaaatatttttaaacagtaatgtatgatatttacatttgaattaaattttaactttagttgcattttaacaaaatatttgatatatatatatatatatatctatatatatatatataaatgtacgacgtaaaacaaaaataacaaataaatgtaaacctcttattatagatgatgaaagataactttatgaaaaaaataaaatatggaaaaatatatttaccaagtgctaaatacatttttcttttgtcttgtatcacaaataagcgtgatatatttaaaagaataattgaaatattaaatgatgaaagataagttttaaaattttcaaaatatggaaaaacatgcaattagtaagtattgattgcaaattttaatttgttttgtacaaagaagcgttatttatttaaacattataataaaaatgataaatagtgaacgatgaatttaagaaaatttaaaatatgaaaaactagaatttataattgtttaatgcaaaatttataacaaacaagcatttttaacgggtaatgtaaaggatacaaagtgagcgataattttaaagatatttagtggttttacatatagttaatgttttttttttttttttagaagaactttttttttcatttgacattttaatattgtttaatgaacttttgtgtattatatgtgtggattcaaaagggtagttggatagatttcaccatttgaattttgaagtagcaaatctcaaataaaatcaatgggactaagaacaattgataaatctatgggggaacaagtgtcacacctatctccttggtaaagccagcccatacatcacggtacccaaaaagaatcatccaacaagagaattgttggtacatattactgacattacaatacgatattataaagagtacagtacgtttatgcttatgcattaagcgcaagtaaaacccgatatatgctcatcattcaaactccaagtatcacctgagtcgtgtcgttttcatacaacaatttatgtatgctcattcttttaatactaatatatctgtgttgtgatgtgtgcatgcgtgtgctcgaatactttcaagcaagggtcaaacaaagtgcggctggtaatagacgatcagaagacacaatcaccagacaccaagtaagcagatgacaaaagacgatcaccacaccagaattccaacaaaacaaaagattatgatatgttttgtcgcctctgatatgtcacactacacagtacacacaacctcttataaacaacacttttaacgggccgaattatcagccttcaatataatgtttacttatgtgatggacctcaacattacatgggcctatctgttgcataattaacagttttaagacccttttatttttctctcgaatttgaaatgatttgtttatgttttttatttaaatgtttttgcatatttggttgggtcctctcgagtcacacacgaccggagacgtgcattagaagagttacagagcagacatttgctggcatcttacaattatctcaaacataaccttcttttattattaggctattggccctacccaccaccaccatttttattttctttttctcaaacacgctttttgaatttcaatattatatactgtccttatcaaaaaatagttatacgatttgttaattttgttagcctaatttttcctaatctggttatgtcacggacgcaagttaaattcatctgcggtgtttttaggtgttataaagccatgtgaatgaagttaattaaaaaaaaagcaatgtaaatagtcaaacatgccctttaagaaaaagagaaacacacgcttcacgtgagtcgcacgtgccaaacccacctttcatcttcttcttcttcttcttcttctatcttccgcatccttcggacaagagaaccaaaccagccaacaaaaaataatagtaatggagagtcgaattagaaagagagaagcacgccatacctgagagattcgtgcgtcgacgacgtgaaaatcattattatttactaataataattgttattgtcaatcgatgataattaaattaaaattagtttaaaagtggtggtggaggtgtttgatg

SEQ ID NO: 33127 - DNA, 3000 bp, Unknown; identical to SEQ ID NO: 2111
  misc_feature (1)..( 3000): 2750-1469P.txt file - cDNA_ID_3065965; gDNA_ID_1620489; Annot_ID_158552

SEQ ID NO: 33128 - DNA, 3000 bp, Unknown; identical to SEQ ID NO: 2107
  misc_feature (1)..( 3000): 2750-1469P.txt file - cDNA_ID_3065969; gDNA_ID_1620489; Annot_ID_158550

SEQ ID NO: 33129 - DNA, 3000 bp, Unknown; identical to SEQ ID NO: 2112
  misc_feature (1)..( 3000): 2750-1469P.txt file - cDNA_ID_3065977; gDNA_ID_1620489; Annot_ID_158548

SEQ ID NO: 33130 - DNA, 3000 bp, Unknown; identical to SEQ ID NO: 2114
  misc_feature (1)..( 3000): 2750-1469P.txt file - cDNA_ID_3065981; gDNA_ID_1620489; Annot_ID_158547

SEQ ID NO: 33131 - DNA, 3000 bp, Unknown; identical to SEQ ID NO: 2115
  misc_feature (1)..( 3000): 2750-1469P.txt file - cDNA_ID_3065985; gDNA_ID_1620489; Annot_ID_158546

SEQ ID NO: 33132 - DNA, 85 bp, Unknown; identical to SEQ ID NO: 2106
  misc_feature (1)..( 85): 2750-1469P.txt file - cDNA_ID_3065991; gDNA_ID_1620489; Annot_ID_158541

SEQ ID NO: 33133 - DNA, 3003 bp, Unknown
  misc_feature (1)..( 3003): 2750-1469P.txt file - cDNA_ID_3066002; gDNA_ID_1620490; Annot_ID_158585
aaaaacggtggtttcattgcttatgagcgtgagggagttaagtacagggatcccaatgttcgtcttaatgactggaacgaagtcatggaggaatcaaaacctggaccactccttacaactcagtcagctcgttgcatggattgtggaactccattctgccaccaggtatacatcctcagataaaatgccttttttctttccaagtattcttcttgcagcttgtcaaagactggttttgttgtttatatgtcaaggaaaaattgcaactaggtgtttcatgaatgaaatccttaacatttttgtttttgaaaatttacaggagaactctgggtgtcctctcggtaataagatccctgaattcaatgaacttgtctaccagaacagatggcaagaagccttgaatcgtctacttgagacaaacaactttccagaatttactgggcgagtatgccctgcaccatgtgaaggttcttgtgttcttggaataattgagaaccctgtttctatcaaaagcattgaatgtgctattatcgataaagcctttgaggaagggtggatggtaccaaggcctcctctcaagagaacagggtatactttctaagtctattccatattatcttatcttccactgttgtgaggctcacatacatcttgtcttccactgttgtgagtttacatttggctgatttatatgcttctgctgcttgtgtggtttgcaggaaaaaggttgctattatcggaagtggaccggctgggttagctgcggctgaccagctgaacaaaatgggccatttagtaaccgtgtatgagcgctcggacagaattggtgggctgatgatgtatggagtaccaaacatgaagactgacaaaattgacgtcgttcaacggcgggttgatcttatgaccaaagaaggtatcaactttgtggtcaatgccaatattggaaaggacccatcttactcccttgatggacttaaggaagagaatgatgcaatcgttcttgctgttggttccacaaaaccaaggtaatattttgtttcaaacaatgctgaattcctatttatgttaccagacgttcaaatggattatggtgaactaaccgagacattattggggtaattttgcagagatcttccagtgcctggtcgtgatctatctggtgttcactttgccatggagtttcttcatgcaaacaccaaaagtttacttgacagcaatcatgaggatggcaattacatttctgcaaaagggaaaaaggttgttgttattggtggaggtgataccggcacagattgcatcggaacatctatccgccatggatgtaccaacattgtaaacctagaacttcttcctcagccaccctcaacaagagctcctggaaacccttggccacaggtttgtttcagatcttctacactcaatccttttagcaacttcttcaagatttttgcatccattggattaaaaagagttgtgagcaaggttggatattgttgattttaatgagcttccgtgtgaatacagtggcctcgtgtattccgtattgactacggacatcaagaagctaccaccaaattcggaaaagaccctaggacctatgaggtcttaacgaagaggttcataggagatgacaatggaaacgtgaaggggcttgaacttgtgcgtgtgagttgggagaaggatgaaaccgggaggttccagttcaaggagatcgaaggctctgaggaaatcattgaagcagacctcgttttcttggccatgggtttccttggacctgagccagtaagtgattcccgttgtgtaccctcttcttatatattgtgggtcttgtggcaatgatttaaaaccaattgcttgtttttgtttttacagacacttgctgagaagctaggtctcgaatgtgacaacaggtcaaactttaaggccgagtatggccggttttccacaaccgtggaaggtgttttcgcagcaggtgattgtcggagaggccagtctttggttgtctgggctatctcagaaggacgtcaagctgcagatcaggtagacaaattcctcaccaaaacggatgatgacgaagacgccaagctacaacaagaccttaaccagatgaaacacaacactatcacaaactgaggtaaaagaaagccttactcatctgaagcaaaagtcgagagagaaagacaactgatgttactcttttagaggacacacaggcgtaaaggaccgacttatggcagagatgaaggaagagagttgcagaggaaaagtaccgaacttgatgatttagtagagagaagtaaaagtttaggtttgtttttgtttattatcgtccataaagtaataatgattcataagtacattctctttgtaggatttcagtagctttcttttgttaaagctttctgaaattgaaagccttttgttttttctctatggctgtttctaagtttgaattttaaggaattgtaatgcagttcctgcttcttgtttttgccctctttgtgttctttcatattatttatggtggtgtaaactgtaaacaatgttaggaatcataagacttgctcagtaaaatagtgaaaaaaatgatcttcaattacacagtgaagattgaggtatgtaaaaccggtatgtagtttgtctccaacaaatttcttcattttttctcggtcccaaccagttggtagatgaaaagcggtccaattaacaaacggattcgtcagttgtctctcgtcgcaaccattcaatcctacgtgtaattcctcagttgtctctggtcttcaacaaaagacaagcccacaaagagaaaacaaaaaaaaagtaaagaaaaagaaaattgtgaagcggtgaaaacaagagttccaaaaaggtggctcctttttgtttctggagatgcgttattgtgacccttctttgaaatttagggttcattttctcagatttcgagttcgttgtgtttgaatctctattgggtttactttcttattcgatttgggggaaatg

SEQ ID NO: 33134 - DNA, 3003 bp, Unknown
  misc_feature (1)..( 3003): 2750-1469P.txt file - cDNA_ID_3066011; gDNA_ID_1620490; Annot_ID_158581
cttaaagaaaaatcatacccattttcttcttgaaccactgaactggaaagttgacgctctggtcttgtcatatcaccatcaggctctactctgctactccttgagcccgtgattacgtcctgataatcctgataatctggagacctcctaccgtccctcctatccttataccgaccactttgatcatctagacgcgacacatcacgatcattatccctttcacggtcgcttttactccgtttcccatcatgataatagtcacgactacgatctttttctctgtcatgagtcctgtccctctcatgatcccggtcacgatctctactcctatcacggtcccaatcccggtcatggtaacgatcatgctcataatcccgtcgatcgcgatcacgttcccgatccctatctcgatcacggtccctatctcgctcataatcacgatcacgatccctagttctttcgcggtcccgttcatttcggtcactttctctatcatagtcccgattgcgttcacgttcatgatatccatcaagttcactgtcaggctcatgaccatggtcattatcctgaaatttagatttctttttactctcatctcgagtgagcttttcatcagacctcagatgttctttagtaggtcggtcatctctctgcttgtcacctttctgtttgatgtcttcttcttctttgtcttcccgatatttatctctgcttttctcccccttatgctttccatctttaatgtagtcatctccagaagtgagaaccctgtcaccaacgtcatcactgttatcgtgatgcttgtctccagtaccatgatcatccctcttacgccttgatcgcttctcagtataattttctgtacctggactccttgcatgatcctgagcttttgattctgaattcaaaagtaagagaataattagcataagaccctttgcagttttctagactatccaactaaatgtgagaaatctttcatcaaaatacacctatgttaaccagttaaacacagcctccaacataacagcaagtaaagcaacactacctccattaatcttagaaaaggcagtagaatagaacataacaacaagtaaagacgctaaatcggcatctaagttcatattctagtaagaactctgaaccaaaggaacagtctttcaaaacaacactaactaaaggcaatgtatccattttcaggttcctacaaatcaaccatttgatatcagatcaagatatcttaccagttttatcagaaccagctttggacttatgatgatcatcaccatcataaaacttgtcacttttcccttctttatacttcctatctttctccttatcaacatctttactctcccttctactagactctctatgcttcccatcacttttaccactactcttcttcgtctcctcaccatctccctcatctctcttcctactcttctcactcgaaaccttcgtcttcttcgaactctcacctttatcatcatctttaccattccacctatcactaccactctcaccactcttccctttcctacgcttcgacgaagaagaagtatactcctcataatactcaccattaacagaatcataatactcttttctcttatcaccagaaccagattccttcgaaaccctaacagtagtactactctcctctttactcttcttctccttcaaactcgtctctttctccgaatcggaatactccttcgtcgcatctttatgcttactcgatttatgcctcgtactccttggcatcttccacaatctctaacaatcgcaaaaccccccaaaaatatcgaattttcaaaccctaaatcgagattgaggtttttagggactttggtttgattgaatcttacagcggacttaaagattaaaaaaagactctcacggcggcggaagaatctagatcgccggcgatttgaaagccggcggcgagatttaattggagaaaattacaaaagaaccacggagcgggagatatagagaagatagagagagagagagaggaggcttaatgccctttcaatgttgaagaaaacgagaaactgttttttttcagacaagaggaagactaagggattatttgtttaatgactatcttatcctttaatcgtgggttttattacagttttttgccacgcacgttatcagatcggattttgctttcgtccggtttttgggaaagtagtggttcggttatttctcgctagcgtcgtgccacgtcacgccgcgactcaaaaactggaaacagctggagcccaataaaggcccattaagaagttattggcctagtaatgcccaatgagagtttttattagctaatgaccatattaaccagtgatcgtgggtattattacggtttatgccctgatcccctaacgttatcgctttcgtccggtttagtaaagcagtgcttcggtttattacgtcacgtaactcaaaactggagacagatgaagcccataaaaggaccattacgtaggtagtggcccaataaggcccaatgagagttgggatgagatatttgagaggcagaggttgacgtgggtcgacctcgaggcgcgatgcctcaggcgtacttcatcacgcaactatcacgagcctctctgtcgttatatacgactttcagtttttcttctgatttgggaaagaatcaaacttttgaatgtgaagttgcttctttcgtctcaagatctctctttatctctctatctgtttgattggtaagcttttgattcgagtgttgtaatgattgatgaaatgattgtctatttacggcattaagttgttcacgtagtctctcttcgattctcttgtgttaaaattagataaagattatgactttctggattatttggaagatcagtgttggtgaattgagtttcctttaatagtaatgtgaagtagctgtgtttgctttgtttgtgagtgatttgatataaaagttgattacttttgaatttgtatgtagagggtttttgttggatg

SEQ ID NO: 33135 - DNA, 3000 bp, Unknown; identical to SEQ ID NO: 2117
  misc_feature (1)..( 3000): 2750-1469P.txt file - cDNA_ID_3066015; gDNA_ID_1620490; Annot_ID_158580

SEQ ID NO: 33136 - DNA, 3003 bp, Unknown
  misc_feature (1)..( 3003): 2750-1469P.txt file - cDNA_ID_3066047; gDNA_ID_1620491; Annot_ID_158626
gattgagccagccgctaaaatctttaaatgcataaattttgttgtattatataaattggtaagagacgatctaattatgatagtttctatagtgaatttattgaaagtaaataaatagcatttttaaaacaaagacaacaatttaggtctcatgaaattaaacaaccgtatcactacgtactattgcatcaactatgagacatgcaaattctaagttttaaactcgtcgaccgaatcgcctctgcctttgctgataccaagtcaaggcctcaagatactcagcttcgccaaaatcaggccacaaaacagttggaaagtaaagctcagtgtaagcagattgccataaaaagaagttactgatcctttgctctccgcttgttctgatcaacaggtcagggtttgggaattcgctacactttgtcaacaactctttctccatcgccttctcgttaatgtcctccacttgaatcagcccgtctttcactttatttgcaagacttttgcatgcttgtaagatatcatatcttccactatagtctattgctataatgagattcttcccttcgtaactctttgtagcttcctctacctcttctatcaaacctagaagcgactcggggagttttgtacggttcccgataaccgagatcttgatcttatcactaaaaaataaaggggaaattagcatcaagacatataaggctttaaaagaggataaagaaaaaaacatcttggagtagataccttcggaggtaaggcatatcagacgctaagtatttctcaaacaaggccatcaagcacttaacttcatcctgatcaaagaaaaagaaaaaactgaatcaaaatgaattatataaaacacaaaagttttcaaggtcacaaattttaacctgcggtgagaagaaaatactaattagtaattaacatgcatgcaagttatattcgtaaggtccacaatttttattttttttggttttagtccataacttcttggttactcaaaagcagattaaaactcttggaacgttttgtgtaatcacctctggtctttcccaattttcggtggagaaagcaaagagtgagatagtgtttgtccccatagcgaaacaatccttagcattctccatgagccttctcgctccggcctcgtggccttccgatgtcccgagtcctcgtttttcagcccaacgtctgtttccgtccaatataaccgccacatgctttggcattatatttctccctcgtttctgtttctctcccattgtaccactacaaataagtaataagaacaaacaaagttagtatactttcataatagcaaaagatgcataaatacgtagaaactatgattagtaaaaaccaaactaccgtttctcgttcctttcttcctcatcatcgtatttagaagctatgattttgatgaatctgaggatatttgtcaacgacaaaggaacatttagtcgccgagagatgaagagaccagggatgagaaaaagagctagaaaagtaaaaacaacagagaataaagacaacatattttttctgtttttgtcttttgtttttcagtgtttgttcgaattggagcgctagctcgtcatgtacttaaagagcttcgggttcaaagacgcacatgatgatcaatggaacctactttctttctctcacttgctctctgtctactccttgatgctacgcaaagacagatcatacgtattaagttttaataagatcttacgacacttgaaaatcactaaatggtttggtcacgtgattttctcattaaacaaagacatttttgtaagttcagattttgactttttcgatcagtataacttgcttgattttaacattaatgtccaagccaatcgcatagacatagtcatgcactcatgctctcacggtttgtctacacgttactaaaaaaactgaacatagaaatatacggggctttggctgtaattaaggcccatgactacacttcagaaggagggtcattagctatgatcatattcatcctagtttttatccaactcaacacaattatcagtgtgtatagtctatttattttatcgcactacccactttaattattgctatgtacagtgggatcactaaattgtttgttggggacattgaccttatccacatattttttaattgatccatacctctatcttttattttactcacccactttttatctattgtttattgatcaatgttgaaaatctcttgacatgtggaaactcttgaggtgttgtggttttccaagatctttttaacgctcaattcagtaaataaaatcatatacgatctagcaaaagcaaaagaggaatgaacttaaacccgcaaaactcctttaaacattaaattgtttcaaacggttttgtaacacatttctccattaccttttcttgttgtgttttgttaatatcttttcaaattgtgtagtagtcttttgtaaaaaatagatacaaaatcacacaatacaagtcaaagtgagacggcgtgaaatactacagtactattttacaataacgtggtcgccaaattattatttccaagtggaaaaatcctttaatagaaactgccgaaaagccctggttaggccaaaaaccccagtattggaacaagggtatatccgtcattgcacgcataaatttcgggacttttcttgaaaaagcagcttcgagaatcgtaactgatgaatcgctaaagagaggtttatcgagaaaaatccaagatttactaaaaaaccactatctctctgctcttcctctgtctacattaatgtaattttgatcatcggattgggtgaaagaaacatcaaactcctaaaagagaagcctttaaagtttttttttaatcaaaaacaaaaggaagaaaattttcctttttgttttagatggcatgaatcatcatcatcgctttgctttcttgattctctatttcgtttgatgggatttgtttttctgggaatttattcattcacctgctgccatg

SEQ ID NO: 33137 - DNA, 3000 bp, Unknown
  misc_feature (1)..( 3000): 2750-1469P.txt file - cDNA_ID_3066051; gDNA_ID_1620491; Annot_ID_158624
ttctcgaagctgctttttcaagaaaagtcccgaaatttatgcgtgcaatgacggatatacccttgttccaatactggggtttttggcctaaccagggcttttcggcagtttctattaaaggatttttccacttggaaataataatttggcgaccacgttattgtaaaatagtactgtagtatttcacgccgtctcactttgacttgtattgtgtgattttgtatctattttttacaaaagactactacacaatttgaaaagatattaacaaaacacaacaagaaaaggtaatggagaaatgtgttacaaaaccgtttgaaacaatttaatgtttaaaggagttttgcgggtttaagttcattcctcttttgcttttgctagatcgtatatgattttatttactgaattgagcgttaaaaagatcttggaaaaccacaacacctcaagagtttccacatgtcaagagattttcaacattgatcaataaacaatagataaaaagtgggtgagtaaaataaaagatagaggtatggatcaattaaaaaatatgtggataaggtcaatgtccccaacaaacaatttagtgatcccactgtacatagcaataattaaagtgggtagtgcgataaaataaatagactatacacactgataattgtgttgagttggataaaaactaggatgaatatgatcatagctaatgaccctccttctgaagtgtagtcatgggccttaattacagccaaagccccgtatatttctatgttcagtttttttagtaacgtgtagacaaaccgtgagagcatgagtgcatgactatgtctatgcgattggcttggacattaatgttaaaatcaagcaagttatactgatcgaaaaagtcaaaatctgaacttacaaaaatgtctttgtttaatgagaaaatcacgtgaccaaaccatttagtgattttcaagtgtcgtaagatcttattaaaacttaatacgtatgatctgtctttgcgtagcatcaaggagtagacagagagcaagtgagagaaagaaagtaggttccattgatcatcatgtgcgtctttgaacccgaagctctttaagtacatgacgagctagcgctccaattcgaacaaacactgaaaaacaaaagacaaaaacagaaaaaatatgttgtctttattctctgttgtttttacttttctagctctttttctcatccctggtctcttcatctctcggcgactaaatgttcctttgtcgttgacaaatatcctcagattcatcaaaatcatagcttctaaatacgatgatgaggaagaaaggaacgagaaacggtagtttggtttttactaatcatagtttctacgtatttatgcatcttttgctattatgaaagtatactaactttgtttgttcttattacttatttgtagtggtacaatgggagagaaacagaaacgagggagaaatataatgccaaagcatgtggcggttatattggacggaaacagacgttgggctgaaaaacgaggactcgggacatcggaaggccacgaggccggagcgagaaggctcatggagaatgctaaggattgtttcgctatggggacaaacactatctcactctttgctttctccaccgaaaattgggaaagaccagaggtgattacacaaaacgttccaagagttttaatctgcttttgagtaaccaagaagttatggactaaaaccaaaaaaaataaaaattgtggaccttacgaatataacttgcatgcatgttaattactaattagtattttcttctcaccgcaggttaaaatttgtgaccttgaaaacttttgtgttttatataattcattttgattcagttttttctttttctttgatcaggatgaagttaagtgcttgatggccttgtttgagaaatacttagcgtctgatatgccttacctccgaaggtatctactccaagatgtttttttctttatcctcttttaaagccttatatgtcttgatgctaatttcccctttattttttagtgataagatcaagatctcggttatcgggaaccgtacaaaactccccgagtcgcttctaggtttgatagaagaggtagaggaagctacaaagagttacgaagggaagaatctcattatagcaatagactatagtggaagatatgatatcttacaagcatgcaaaagtcttgcaaataaagtgaaagacgggctgattcaagtggaggacattaacgagaaggcgatggagaaagagttgttgacaaagtgtagcgaattcccaaaccctgacctgttgatcagaacaagcggagagcaaaggatcagtaacttctttttatggcaatctgcttacactgagctttactttccaactgttttgtggcctgattttggcgaagctgagtatcttgaggccttgacttggtatcagcaaaggcagaggcgattcggtcgacgagtttaaaacttagaatttgcatgtctcatagttgatgcaatagtacgtagtgatacggttgtttaatttcatgagacctaaattgttgtctttgttttaaaaatgctatttatttactttcaataaattcactatagaaactatcataattagatcgtctcttaccaatttatataatacaacaaaatttatgcatttaaagattttagcggctggctcaatcaacacaaaatagtttgaatggtagataacacaatttataaccatactgactagttcattgattgagcatcatctacttaacagagagattattaatctttttacttactctgtttcaccgaataggcaaaataaaaatgtcaatgcttaactcgtgtttgtttagtgaaaaagtaactaagttaatttttggcaaggtttccaaaactgcgagagaaacaaccagagccagtcaataaaaactcaattatgaattttatgatccatgcaaatcacttgctagtactcttcacactctctacaatg

SEQ ID NO: 33138 - DNA, 3000 bp, Unknown; identical to SEQ ID NO: 2127
  misc_feature (1)..( 3000): 2750-1469P.txt file - cDNA_ID_3066055; gDNA_ID_1620491; Annot_ID_158621

SEQ ID NO: 33139 - DNA, 3000 bp, Unknown
  misc_feature (1)..( 3000): 2750-1469P.txt file - cDNA_ID_3066059; gDNA_ID_1620491; Annot_ID_158616
ccaaggagcttcatgggcggtattcgttctgactaaataaataatagtcccactcttgttgctataatagtatgtccattataacaaactcaaaagtcaccatgacttaaacaaaatgtctcatgtctcataaataaaccccctgactctctgtttctataactcgtaatggcaatcatataaatcgtctttcgtctctgtttagttgtccttttcttcccgacaacagaatcggagcatctactaaaagtccactgagccgccgtgcgcttcgaatcttgttttggtatgtgacagctttttcaaaaagaaattgtcttggataagtggaggagaataaggaattcgaacaaaataaaattggagaaaaatgatcatattctctattttattatttaacatcattttatttcggttacaaaaaaaaaaaggaggaaaattaggcgcgcgtcatctccctcgcgacacatatatcataagacagagagcagggaacgaatctcaagacgttacgtattagcttatagccattagttttgtctcttcttcttcttctcgttggtcggcttcttcgtcttactaattccatgattcttcttcttccttctgcttcactttctcgatgatcctctgcaccagccgcgatcatgacgttgaatcctcctccgtcgcagcaaacgtctcactcgccgcgtcggattcccaatcgccgcgttctcatcgtcggaaattattgccacgacgttttaatccaaaacggatccgtcgtagctgaaactctcggcggcgccgcctctttcatatctaatgtcttagattcttcctctgtctcctgcgatttggtctccaaagtaggacacgacttcagatacgaggtcacccactctccgatcgtggctccggagaaggaaacaacagttttcgaggcgtatttcgatctgggaatcgatgggatcggtcatgctgatcgggtgttgaaaagagtctctgcatgtgatccgattcttccttcggatatacccgattcgagatttgatttcggaatggccgttggagtcggcggcgagattttaccggagacgcttgagaaaatggtggagatctgtgacgttgttgctgtggatattcaagctttgattagggtttttgatcctgttgacggagctgtgaagcttgttgatttgaaagaaagtggattttatcacatcttgcatcgaattggattcttgaaagcttcgtcagacgaagctcttttcatggatgttgaacaaatgaagcacttgtgttgtgtggtggtgactaatggtgaaaaagggtgtaggatttatcataaggatgatgaaatgacggttcctccgttcttggcgaagcaggtggatcctaccggtgccggagacagctttctcggaggtttgattgttgggcttgttgaaggtttgactgttcctgatgctgcattgttagggaacctctttggttccatcactgtagagcatattggtcagccaaagttcgatttgatgatgcttcaggtttgttttttggtctcgtattagcttactgaattgcatgctgtgagagatttgcaaatctaatagacagtagtaagaacttttagagccgatgatagtgatatgcaaatgtctttaacataatcctagcaaaagaactctgttacatcttgcagcttactttcaatacagccaaacctatatcttgcgggtgaactagaatctgtatttgatgttgataggtttccaatctgaaaatgtgtcaaatcttcacagttgttgtttgagattctgtcgagtcacagctgctgagagagtcttttcttgttttacttcattgttaatctaggagcagtttcattcaacatagggtagatgcaggaaaaagtgttgtttaagcattcaccgaacaatgtggttaagcaattagagaattcaaaagtatggatctcttgatgtatttgcgagtgtttctgtgtatctcttgtagttgtatctgttgaaatgagggcgttattggataataattgaaccattggctagtgcaagtgaacattaagcaaattagaagatttatagcgtttgtgtttgcactgcacaaggattcatccctttcatcggttatttctatgtgacatatgtctttgtgatttgcagaaagtcaaggatgaggtacagagaaggaagaagcagtgtaacatatctagcagccataacaacgatcacaacgagttccatgagcgtctaagtccagctcggttttcatgcgtagactctcaacttcaaccaaagttattggtcaatggtcactcttgtgatgatcggtccctgtgaatacgaatcttgaatcaccttttttttactaacaaagctcttctgagttgtgtaagcttgcttcaacacgttgatgaattttggaaattttaatgtataaaacgcgttgaccagcgtcttcaaacgctctttctggtcgttcccgcaaagtttgtttatcaactccgcgtttcaaaattcgaaatgaagatgtcaaattttgttttaaaagttttggataagatgatttgctattcgcatgttgccacattatctagttaatataaaaaccaaaaacaaatctgagataaaattacgaaagtcaacgtgggagatctaattttgactggtgcatagttgaaccggttcaatatatgtacaatcaggaggaaaccgtgttcggtgtttgattcgtgcgcgtggatttaaaacgtggtcacgatcaggcgcgtggattgacgtggcgattccgattcccaatcaaaagtctggacgagcaaaaaatttcctctgatattggcatctccattactaactcctgatttacggttaaaacgcctcttccctctctccgacgcttctcgtcggaaatctgggtttaagtttcttctgcagatcggaagagattctattgaagcggcgttgacacgatttcatctataattgtacgataatg

SEQ ID NO: 33140 - DNA, 3000 bp, Unknown; identical to SEQ ID NO: 2130
  misc_feature (1)..( 3000): 2750-1469P.txt file - cDNA_ID_3066063; gDNA_ID_1620491; Annot_ID_158613

SEQ ID NO: 33141 - DNA, 2707 bp, Unknown
  misc_feature (1)..( 2707): 2750-1469P.txt file - cDNA_ID_3066073; gDNA_ID_1620491; Annot_ID_158593
gatcccaatgaaatatacaaatgggataatatggttgataccttcaaattaatctaagccaaaaatggtgttgtcaatggaagaagcttgatccttggatctgctgtagagatggagcgtctcggtgtggttagggtccaaacagagagcagcttcacagtcttgagtggccaatgacagattcccagtggcctcgtgaaatgctgctctgagatgcagcgtttgcagttctggtctgaaagctatcgcctttgacagctcttccactgcttctgtctctctctgatcatccatcagcactgccacacatacgatcacttctttaactactagaatttataagatgttaatacagaacaggaagagttagttaccggcagctcggtatctgtagggataagttcgcagagggtcgagtgttgtggccatgtcaagatcttctttggctttttcacgttcacagtactcagaccgtttctcgtaggctgctgctttgctacacgacttctcgatcagctttgtcatctcctcacaagcttctttacgttggttcttcaaaaaataaactcgcgccagcccttggcgtgcacgaatgtgtttgatctctatagcgttcttatatgcggtttcagcttgatctagcatccccaaattgatgtagatgctcccaaggttgttcagagcctgcagaaacataacaaaacgactaatcagattacagtgtgaataagagaaagagaaaggcgagacatcaaaatgccaacctgtcctttgcgtagcccatctgaaggacacttgagggcttcctctagaacctgaaccacacaagagatctcgtctgcatcgagattcttgtcagctagagcatatgctttgaggaaaaatgcttcaaaggatcgctgaatagagattgcctcctcagctttagtaagagtttcttccacataacccatgtcgtataaaagccacccttcgtagaccaacctttctgcctcagaagtagccaagttccatgccattcgcaaacacctcatcgcggctccttgacaattcaatctgttacagatcacaaaaaaatgtagcttccgtcaactcctgaagaattcaccaatcaggttgccagagaaacaaaagatattcttcttaccttaagagaagaagagattgtctaaacctcagaaagtttttgctgggatcattctgaagcatctgatgaacaacagccaacgacgcaacatcatccacagctgaccatctatcgaaaagcctcacccaacaatccgcttcactctctacttcaatacattgcgcggtcagagcctccaccaaatcatctctcattttcccaccaaacacaacataattgggctctaaagacagcactgctctaagatctctcaaacaactctcccggtcaccagtggctaaatacagccaagccctcagctcgagacattctggactaagcttgaactgaattaatctatcaatctcttggaaggcttctttaatctgcttctgttcgaatttcattacggctctgtacttgtacggaaaagacagtgtcgggtcaagttcagtggcggttgctaaatcttttagtttctcaactccaacattgtacagagacctctcctggtacatccatccatgtggcttgtgattagagatgagaaagttcatgagcctgtacgccgaatacctcttcccttgtttatattcagttcttgataccccagccaaagagtagacatgccctaagcttgaagctaatctgaaatgaaactgggctgctttgtaatcctttctctcaaacagaacacatcccatttgatgcaaagacaaagccttttgccagtttgtacgagcaaactctcgagttctctctagcaatatcagcatagtgtccgtcgtgagtttctcttccatgcctacttggctgaggaagtagtacaacaggaacacacactctgaacccagaaaagctaattgctcttttgcttcggaactgcagaagaatctcatcactttgggattgtgaagagactgaggaagctctctcagaaacacctgcaagcaagcagataagagaagcgttgtgcgttcctccaacgcgtactctacaaaggttaaagctttatcaaggtcagtgacagaagcagccaagcgagcctcacattcagacttcagatcatcgcaacagaatttgctggctaattgaagcagctcaaatacagtttccacacgaaacagatcaactcttttgattctactatatatgttgagtgccaacattgcctcaatagagatgccattttccgagaaatcaatctcagaagttgttgattccacgaaagaaccatacaacatggcctcaaaaggacgcgaaagcgctgcgattctcgacctaacacacttagccttctctgaacctacgcagaaggaaatatcgctaacctcatctagacccgaaaactcatcagccttagagattttaacgtcatcactaccaaattcatcctcacataccgtagaacattcacaaccctcgtcgtctacattcaaatcacaaccatgagtcaaactagtcttcggacattcagaagcaagcccattacaatccatagattcaactcccacaagttcatgttctctcctaaaaaatctcaaccaagcagagaaaacaaccttacaagggacatcaatg

SEQ ID NO: 33142 - DNA, 3000 bp, Unknown
  misc_feature (1)..( 3000): 2750-1469P.txt file - cDNA_ID_3066092; gDNA_ID_1620492; Annot_ID_158644
atgttgaacttggaacgtgttccacaactagagccgagaaggttttaaatgaataaaatatacaaagacaacccacaaaggcacaaatgacattacaaagtacattaaaaaagtgaaaatccatgtccattgaattgaattcataacaatttaccaaacttcaaatacattaaaatcactgttaaaaataaatcctatagcaccatatatacaattgacggatccatattcttgcttcatcttccacttcaagttttcagcaacaatggcagaactcatcatcgttgactttcaaaacatatctatcttcatcctcttatgtctcttctcattcctttgttacgctctcttcttcaagaaaccaaaaggctttgacctgcctccgagccctccttctctaccaatcatcggtcatcttcaccatcttctctcatcatctctaccacacaagtcctttcaaaaactctccttcaagtatggacctcttctccatctccgcatctttaatttccccatggtcctcgtctcatcagcctcaatggcctacgaggtcttcaggacaaacgacgtaaacgtctcgtatcgctttgtcccagtcaacaaagactctctagtgttcggatcttcaggattcgtaaccgctccttatggagattactggaagttcatgaagaagctcatatccacgaaactactccgaccacatgcactcgagctgtcgaaaggtaaccgtgcagaggagctacgtcggttttgccttgatctgcaaggtaaggcgaggaagaaggagagcgttgagatcggtaaagtagcactaaagctcactaacaacatcatatgtaggatgagcatgggaaggagttgttcagagaagaacggtgtagcggagagagcaagggaattggttaacaaatcctttgccttatcagtgaagctcttcttttcaaacatgttcagaaaagatataatgggagtttctcgtgaattcgacgagtttcttgagaggattctagtggaacacgaggagaaccttgagggggatcaagatagggacatgattgatcatttgttggaagcttatagaaacgaagaagcagaatataagatcactagaaaacagatcaagtctttaattgtggtaaagttaaatgtttttttttcggttgcttcatttataatctatgttttgagattaggtctgactatataaaaaaaactgtaggaaatttttcttggaggcactgacagctcggcgcagacgatacaatggactatggcggagatacttaacaaccccggcgttctcgagaaattaagagcagaaatcgattccgttgtggggggaaaaaggttgattcaagaatcagatcttccaaacctcccttatttgcaagctgttgttaaagaagggctaagattgcatccctcggctcctgtcttgttaagggtatttggagaaagttgcgaggtcaaagagttctacgtaccggagaaaacaacacttgttgttaatctctatgctgtgaatagagatcctgattcttgggaagatcctgatatgtttaagccagagaggtttttagtttcttcgatatcaggagatgaagaaaagataagagagcaagccgtgaagtatgttacttttggaggtggaaggaggacatgtcccgcggtaaaactagctcatatctttatggaaactgcgattggagcgatggtgcagtgttttgactggagaattaaaggagagaaagtatacatggaagaggctgtttcaggacttagtttgaaaatggctcatccgcttaagtgcactcctgttgttcggttcgaccctttcagcttttgatttacataatccaagttcggtgacttgttaagatcaaagacgttttactatgttagttgtgcttgttgtatttcaaagtcaagtatgtaagaatattttatgtttatatgtaagttatgtctaataaaataataaagatcacgttcatattagcgttaatgattctaaatttctaatataaaagaggacatcataaaataacattcggatgtattaataaccatcatcctttgcttggatgtactgcctatcgatgcgcaagcaggttttgcacaacagaatgtcgctgaaagcacttccaagactatgactatatgtgagtcttcaagcatctctcagtcacttggatgatgctcaaagcacctataaggttgtctatcagttttcaagcatctctgagtcaatcaaatgttacttaaagcacatttaatgttgtatgttggtccttattcctaagtcagccatgtattgctcaaaagtacctcacacatcttccatacaattgaatatacctcaagcatttctggagctatttgtcagatgctccagcaccttcttctatacgagcagtttttgcacacggcctttgcaagaccgttagtcggtcttcaaccaccctagtcaggtcattgcctaaagtacctcccatctttattgtcatttccgaaaacactttctagtcaatttgttaccactcaaggcacttctcatctcgtctttcactagttaaagcatttccaatgtaagtcgatgctcaaggcgtctctctatcagcccgacaacatccaagccgcctcctactaggaatcatggcaagctatctccatcatatgttgccaacaaaagtacactccacactccacactccaaaagtgttggtcttctactcttctttgctccttcgagaaatcaaataagttaatttcttcattatttcatggttgccgacatgactttccaaatacgtgtattaaccgcaataaataaatagttcttataaaaagtaagatgacgtgtcatgtattgctcatcaataaagtaacgctttttcattttatttccattgaccgacacaacaaacaacacgttctctctcatttttcttcttctccgatcaatctagggtttactctcaccggcgacgaacaatg

SEQ ID NO: 33143 - DNA, 3000 bp, Unknown; identical to SEQ ID NO: 2137
  misc_feature (1)..( 3000): 2750-1469P.txt file - cDNA_ID_3066096; gDNA_ID_1620492; Annot_ID_158643

SEQ ID NO: 33144 - DNA, 506 bp, Unknown; identical to SEQ ID NO: 2135
  misc_feature (1)..( 506): 2750-1469P.txt file - cDNA_ID_3066102; gDNA_ID_1620492; Annot_ID_158641

SEQ ID NO: 33145 - DNA, 3000 bp, Unknown; identical to SEQ ID NO: 2141
  misc_feature (1)..( 3000): 2750-1469P.txt file - cDNA_ID_3066132; gDNA_ID_1620493; Annot_ID_158666

SEQ ID NO: 33146 - DNA, 3000 bp, Unknown; identical to SEQ ID NO: 2140
  misc_feature (1)..( 3000): 2750-1469P.txt file - cDNA_ID_3066136; gDNA_ID_1620493; Annot_ID_158664

SEQ ID NO: 33147 - DNA, 3003 bp, Unknown
  misc_feature (1)..( 3003): 2750-1469P.txt file - cDNA_ID_3066144; gDNA_ID_1620493; Annot_ID_158657
ggtaaagtcaacgatccacggctttgctggatgttgccatgttggaatggagaagcgcatcatttgggcccatatttaaaagcccatactcaaaaagttggcccacatagaaaatcgttggcatcagttaaggcggtggaagacgtcgatccctaaagtcgaagcccttgttagggcttctatacatcaccggcgatattggtttacgcgtcggagagatggttggtgagtgttattgatgacacgagatttcaattctcggcggtgtaacgtgaagtcttaacaatttcattgtccaatggtggaatttacagagagagaggaccgagtttctttggaactcagcgaagaaattatacagagcatggaacctggcgccgttttcagagactatgtaatttttccttcccttctcgaagctttcttcttttgttcctgttattataatgggattttaaaggatggagcttttcttttcagaattgcaggatcagctcaattgactttcacaaaacttcgacttgtatggtgacagctagcgacgatgactcaattcgtctctatgatgttgccagcgccacgtgagttccaaaccccaaactctgtcttgagtattgctctataagacattccaactatattttcagtgttttctgttttcttgtttcagatgtctgaagacaattaatagcaaaaagtatggtgttgatcttgtttgcttcacttctcatcctactactgtcatctactcttccagaaacggatgggacggtgagcccaaattcatgtgcacattgcttttcctcattatctgatttgctttaactaacttttatatctggttggttagactctctgaggcttctctctttgcacgataataagtacttgcgctacttcaaaggacatcatgacaggtttgtttcttttctgattcttgtttgatcagcttatgttttccttcacaaaccggatgaacttaaccaatttatgctgtacacagagttgtttcgcttagcttgtgttctggtggggaatgcttcatctccggttcccttgatcgtactgttttgctttgggatcaaagggtcgagaaatgccaggtagattacctttctctaccctaggtgcttatggaggtcttacatctaataaaattgaccatttgggttaaccacagggtctcttacgagtccaaggaaggcctgctgcagcatatgatgatcaagggttaatttttgcaattgcctttggtggctacataagaatgtttgatgcccgtatgtacgaaaaggtttgttcttgacaaaagctaccaatgatcctgttatgtctctagcagcttgatggaccacctgtgctgtattcacattttcttatttacattgaacgtttatctttttctgatttggataagttgcttttatagggtccttttgaaatattttccgttggtggtgatctttctgaggcaaacgttgtgaaatttagtaatgatggaaggctcatgctgcttacaaccatggatggttttattcatgtgcttgactcgtttcgtggaactcttgtatgccttcagcctcccttgctcttcgctagttatggttttttcatttacacacacatgaccaataaataaactggtttatgtaactcttttgtggtacattgcagctgtccacatttagtgtgaaaccagtagctggagaatctacattggatgcagcctttagtcctgaagggatgtttgttgtttcaggtaaccttgagttttacctgattcggatgatgcatgcacacactcacacacttccttcatgtgaaataacttgttctgtttttgtcatggtttggtaggttcaggtgatggtagtacccatgcatggggtgtaaggagcggaaaacaggttggactagcaatacagccatagtttggtgtacatagtttgtcactggaaactttgcttttgtatagttttgagtgttgattggattattgtatgtgtaggtacatagttggatgggtttagggagtgagcccccagtcattaaatggggtccaggaagtcccatgtttgtgacaggctcttccgaacttgcttttgttatacccgacttatcgaaattgccagcttatgccattcggaaataggacgactatcacgtctgtgccatgtaaatgaggcctcatttggccttttggtttcagactttgttgtgggttatgccggtaacttatcccttgcactctgattaatatatatttgggtcttgtaacatgaagataaaccccaagtctttctaatgttgtaattcgtgtaatttacaagtttgactgtttctgactgattcttccgggaagcaatcgatctgactgagagcttgggtcgaagttaaaatggtgggccggcacaatatttaagtaaaagcccaataaggtccaaactctaactaatttatagcagttaagaaagttggtttagggaaactttatgccaaactaaatttattctccttggcgtcttgttgtgttaatcctcaagcaaacgacccgtttctgtcgccaagtcaacccgacccgacttcgttcccatcggttgatcggccgggacctgattgcgtttagcctcccgaaatctacgggcaaagttgatccctctgggtttgtcatttgatatcctcttttcccgtaccgcgcgtttatgattctgattacgttcttggttgtttgcgattgatccgtttaggattttctctgagtccatcgcttattgaatcgtcaaggctttttcttgtttgactttggaatatcgaatctgctcaatactccaccaaattatcaaacttggtgttctttgttgctcaatactccaccaaattatcaaaacttggatgttctttgtagctcaattaccaaattaataagttgcattcttctttgttgcttgttagccttttcatcgagtttcgtttctgcgatactattttgtttaggatagtatg

SEQ ID NO: 33148 - DNA, 2931 bp, Unknown
  misc_feature (1)..( 2931): 2750-1469P.txt file - cDNA_ID_3066148; gDNA_ID_1620493; Annot_ID_158656
ggagttagagaagagcccgagcattactcggtcattgcttctggactttagtgataaatcagaattatgggagagctcagactgctcatctgtggtgactcaaaacccagaggatgataactcgtcggtgtggtcgatgcaggccaatgcaagtgccaaagacgaagagtatgatgatgaagaggaagaagcctattcttacggtgaggaatatgatgaggaatactacgacgaggaagaggaggaagaagagggagggattgtggatgggttgtgtgagggaattaggaagatgagcgtagagactgactttgcagggaaacacactagatttgtgtatgacagtgaagatgaagagattgtggaggccaaagatcaatctccaggagtgttgcgtttgaaaggctttcctacaccgacaggaaaacatgtcagatttgccggtgatgaatgagttcagtttgaatctttcttcttggagttgtgacaaaaagcctcatatgtctcgactttttttttttttttttcttgttgttgcttgaagattcacaaatctgattcttgttattaccttgttgttatttttcaataactaaaagtgtaatcggaatatgactcttttcatttttatcttctcttgcttgttgtgaaaaaaggctttcaattgtagtctatcctaaacacttaaaaataaaaaccggacttaaccgatatcaagattagacatttgcattagaacataacagattagtgaaaagttgagtttcattggttcagccgacactacagctaaaataaagaaaaactatgtggttctctgttgttatcaacataaaccactgtacttggtcaattgatacatacaagatgaatctattgataaagaatttgatatccatgagctgtattttcgacatagacctggtctcaattaacaaatatatatctctttattaaaccatccaaatttgtctatatctagggtgatcatatccattatactattatgcatctctttcaattttggtattggccggtgagtcggctcaaatgttgtaacaaggcaatgaaatgtataaataaggtttaattgtgtatatacagatgctcgctaaaagttatgtgagattatattggtgaattcttgcacatgtgaccatgtgaaaatcatcaaacgaggtcagtaaagactgacccgcattctctattcattaagtatgcaacaaatccttaggacaagtcctttaactctgccccatcttgtaaatcctttcatagacacaactcttcccttgcccattctatataagtatcaagtatgcatatatctacttgtatatgtttttgtgactgttttattttctggaaaaatgagccacctaacaaataaaaatgctttaaatgggctatttgcatgcgaatgagaccatctccattgggagtatctcataagagtttctcacaattaaaaaaataaaaataatgaaaatgaaggagagagagtgtataaagtttctcacttgagaaactctgagatactctgtacaacccatcatgacaattctcatcttactattggttcaattttttaacaaaaatacttttttaatcaaataatcaaattataatataatattaatatttattttgttgagaaactttgtgggtttctcatggatggagatgcccttaaaatgtcccgaccatgttataaacacacacattaaatgtaccattcaccaaaacttaaacttgaccagccttaaaaggattttatatctttgatattggaacttgaaagtctcatcacttagagattgtactaataaaatatgcaaaagacaagactatttgacaataaaactgcgcctcccttggatcataattagattctcgtgtataaataaaacccccacatgcgacagctgaagaggaaggaaacacttaatcatcagagcagcttgtagatgaagaccaagaactctggcgccggatgtgtcccccgtgtaaaaaccaactccagagccactggtaatcgggagactagtgatctgaatctcctggaccgttttcgcgaagctgttctccgcctcatcatgatatctgctgtctccaagtccacatctcgccgtcataacagacagacgccaatccaaaagtactacaaccccactgatacttatcacagcgaagccgtggctgactgtatcgagtttatcagaaccaagaaggccatcatccaccaggaaaacgtcccctaacaccctcacttcttatattcttcattgtcacctcttgtttgattagcaaattataaattggtggaataaaagctaccctacgtgtatacgccttgcttaatatttttgggattatatattagtattaatcattttcttaagttactcttcagtcttcataagttgacatcaaaacaaatcattacaaatttacgaccaacctttttatagtatcctgtaccgtaaaaacgattactaaaagaagaatgaatgtatgttactgtattagttaccaatataatatgcatcgtgtaacttcaaatttggtatagtggtagttgtaaatattggttatcatgttcaattgtaataagtttgtaaccagttgatggtaaagtcaacgatccacggctttgctggatgttgccatgttggaatggagaagcgcatcatttgggcccatatttaaaagcccatactcaaaaagttggcccacatagaaaatcgttggcatcagttaaggcggtggaagacgtcgatccctaaagtcgaagcccttgttagggcttctatacatcaccggcgatattggtttacgcgtcggagagatggttggtgagtgttattgatgacacgagatttcaattctcggcggtgtaacgtgaagtcttaacaatttcattgtccaatg

SEQ ID NO: 33149 - DNA, 3003 bp, Unknown
  misc_feature (1)..( 3003): 2750-1469P.txt file - cDNA_ID_3066159; gDNA_ID_1620494; Annot_ID_158690
tctgtgaatgtattttacaaaaactgcagcttcttatctttgaattagtttatgtgatccatattaaatgttacttactatttatgtattctactctatagagtatataaatgtttacttgtttagcttaaagattcatcaagtgttttgtgttgggatctccgtcggacaatgcaatcttttattccattgaatttaagtacactgcctttagtattggatgaaacaaaaaccatttttgaaaatctgagatatatagaaaccggttggtcagaccttacgtcattttatacttccacttcgtaatgattctgtttggccttgtttggcttcattacaagtttcttttacacattttatagtagtatcatttaaataatgatcacattcaatcaaaaaatacttctgccattatttaactggagtaacgttttggtttccccctcgtaagcaacgtgtccaattccttcaatgaaggttttcatcataccagttcaagtcggtttaatccgattaaaatgctcggtaacccaccaatttagaatgttcggttaagctcatagggctaagtatggcaaaatttaacgagaattctcaaacaagatcgaaactgaattcaaatatttatattgtaaaacgaaaatttacttaaaaacaattagatcaatccaactagtcacaacattcatatttctagcttaaatttcttttggcaaatatcaagaagtggtgatctagtagtagatcatatatagtcctttttgaaaagggttgaaacattgtatttataatttgatatttgttttaaaaggattactttactgtaactttaatttccgtttaaaagattgtgtggactccattcaaaagatttcaaataacaaaaaattgcttcttttagttcgattatgcttgcttactaaataatacaactagacaattagttagaacgtaaatccaaacttattaggggcttaaggccaatccaaaaacgaaaaataatggaaattaacaaaataaaataaaagtggtccaataatgtttcttaaaatagttagagttagaaaatctcaagaacaggattagagaaaatttctattctagtattagtcggccaagccaagctgagctgacaaaaaataagccgagcgtgagagtggcgtgagagagagggtcactgtccgctattttaaatgctgggcgctgcgtgaaggattagaaaagcatttattcttaaaagatgctcttctcaacgtaatccacgtgtcaacttaccattagtttacacatcaaaagctgaccagcaaatcccaggatgggctgtgatcacctacttactcctccatctaaaatctctgtgcaccttttctcccacgagccgttggattcatccaaattacgtgtgcaacactcacttttaagacgatgttagccgtatttaaccgaacctaaccggcgctgaaccgtcttccagttttgctaatcaacaagcgagatttgattatataattaaaaagcctttgttatagacttagtagtgtcacgctggtctcacatgcctattgcctacatgcttggaagtttgaaaatctttaatcatttatttatatgatacttaagttaacatctaaagatattcaaaacttgagaatgaaatcattgctaagagaataatttattttctgaaatactattcttactatgttaaatattttaattctttcaagtacattgtaatgctactagatactttgcctagcaaaatagttttatattttatctgttgtaaattgtatcaatatacactaactttcattaagaattacagacataaataaacacaccaaattttagtttttgagagtcaaactatatatgaaatatcgctgcagtggaaattgtataatatttgatttaaccggcttgaatgattcagaactaataccatggaaatataaatagtataagagagacttcacgtgctaaatcttgaagaagacgattggacagaacaataagacagaagcaataaccaatggaattatggaacatcatataataaacttttttaataatcatttggataattaaacaaatagtattataatcatttttgaattatttggttgttaatatggtccacgcggtctcttctccagatcccgttatctgttctaagatttccgtcggtctatttatttattatctttaattttcagtatcaattaataccttaacataaattattattccatgctattttcctaatttctacaataattgataacaaatcttatggtttaaattaaagctgactttataattattacgtcaaatgtataaggtttaccaaccacttatctatatgtgttgaaaatattaaacagctaataagtctacggatatgtgtagtttttgcctttctagtattatcaaaggtggatatgtatagttttaagatgagtacatataagttcatataaatttatgtagttgtgtttttacatgattgtaaactttttgtatacttctaaacaatttttccaaaaaataagtatatcccaaaataaattcgttgcgcaaatggaaaataagcccgagaggctgacattaaatgggcctggtcctaagaggcccatatatacccagattaatctggacttgcttaccaaaaccccaaaacctcaaatttcttcgtcacccacccgtttcgtttctaagtctctcgtccttttcttttaaccacactccttgcttgagattcaatcgaaaactgaaattcgcaagcctccactgctcgccgtcgcactcatcggaatattccattggcaccgtactaccctgaaatcatctcatcagatcaaaagtatggaattagttgagctcaatttctattgtttggtttttatgaatccctcaatttaaatatcgcgtggtgatttatttttcttcttttggtgtgtttcttcagcgggagtttaactagaattgcgtggattaatg

SEQ ID NO: 33150 - DNA, 3000 bp, Unknown; identical to SEQ ID NO: 2144
  misc_feature (1)..( 3000): 2750-1469P.txt file - cDNA_ID_3066165; gDNA_ID_1620494; Annot_ID_158688

SEQ ID NO: 33151 - DNA, 3000 bp, Unknown
  misc_feature (1)..( 3000): 2750-1469P.txt file - cDNA_ID_3066181; gDNA_ID_1620495; Annot_ID_158696
aaagaaaagtgacaatctacaaacaaaagtacaaatagcataagggaagcacaagcgataacccaaacactaatattctaacttaatactgagatgaaataaacactgaaataaacagtggcgtcccgagatgaaacactgatatttaaaagcttgttgacttgtatttattatgttgattgtgtttaatgttgcttcagatgttcaaacttaatgccgttctatcgtttggttagtgcaaccgtggctaaatacgatgtggttcaacttgtgagaggtgatgtttggaagattgctcttggcactgcatcaacagcttccatagacgggagttaaaccttgtgaaggtgctgcaatagaatctggaaagaatcttcctgcggattagctcttcatgagatgagataattgaatccgatgaaggatcatccaccagctcattttgccccctctatattccttattatttcagttatgccctcttgtttcacattttttcatacaatgtggataatcctaagttttgttctttgtttagagaccttgttataagaatggtacgaaatctcgaggattttggaaagcattctttatctaatctggaagagttattttgcagttgcagtctatgaaactggaacagaggagagagcctatgataagaacttgacactaatctttatttgtgtttattaatacaagaaaaatggaaatctatgctaatacagttacaacatgccaatctcccgctcaatggaagatgatggctacagaatcagattcacaggtctgatcctgttttaacggtctgattctgtccctctagcaaacttatttgtcgcctcagtttcgcaatatgagcttgaacctatccaacaaagaaccaatccaaattcatcaaaacatagaccaacaaaaatagtctaaactgagtatcaaaaatttagaaaacacagttaaatgttttaaagttacctgttgacgagcagctgcaagctgtaataactcatctgcttcagagaaactcatgaaccattgtcccaaactatgatctttcgtatcacctctcttctttttcccggtatcttcgacttgcactagtcataagatttgttgtgtgagacgacattttaaggcaatgatcaacttaaactaaggaatgaaaaaagctttagataaggagatcatactaggagcaggcaagttgtaaccagagggtaatcttggaaaggtcaaagccggatgattctgaaccctagctaaaaaactttctgaaggatcaggaaagacaatctcgtcataagattccacaaccacaggcttcttcattgtcaaaggacctgattcatcttcagggtatagctttaaatgatgatatctgttgtatccacccaaaacaacaaataactcataagtaactcttccaattgctggcattttcctacttaacaacaatgctattgaaagggacttacaaactcaatggcttatcacagacatcactgtggaaatgcaatgtcattgcaatctcgaattctccccaaccagattccgatacctcgaatggaggctcctcgataactctagtcgggctattgaaactagaatgaagctgaaatacaactttctttactacaacactgatatcttcatttgttgcccctcgaacatatactgcccacttgtgagattgatacctgcaaatttaagtgaaatcttatgaacacaaaacacttttcttctttaagggtattgtcaaaatataaccttcctaagtttcttataagaactaaaactctaagtcgctagcaacaaaccaataaaacttaatggatatttatgtaaactgtctctcttattaagggtattgtcaaaatataaccttttccaacattcctataagaacttctcgtcattatccaaaagaactaaaacactaacaacaaccaataacctaaactgtctctccattattttaacggtattgtaaaaatggaaaatttaaaacttttgtgatgaaaataagaactttgcttcacaaaagaagttcaatttccaaaaaagtatacttactcactagccttcttgccaagccagaatgctacattaccatacacaattggaacgcttatttcaatgtctttaagcttcttctgctgtttaacccaaaaaaaggagagattttttttaagttggtgatgatgaccaatttattgaagaggttacagaacaaaataagtggacttgctcttttgagttcgattgaagaaagaaaaagacggaccttttcgtcggatttagtcatcttggttttgagagatttgagagtgggttcgctagtttctggctgatcttgagcttgtttcttcgatgacgagctgttcgtcattcttctttctgggaattttaagatttcattcagaaaaaattaaggtcatcttcttcttcttcgtacgatgttttttgcttatcaagagagacaaataacacgaattgatgaatctcggcttaacttcaacagatctgcttctagtttttttttccaatggagccagatccaaacggcgaattcaacaagacgatttcttttaggtttattagttttatctactcatgtgaaaggcccaatttatttagctacacaggcccaaatgtatcaaaatttgtctacgtagctaataagcataaacactagaatataaaaacatttggaaaaaaaaaaaaaaaaactaattttaatttaaaagtttaatacccaatatttttaaattagagtaaaaatacctcatttaattatttgtaatcacaaaatatctcagatataaattattagtggaatcaaactcaaccgttaacggacgttacagaatcatttaacggcgttaaattttacggaatcatctaacggtgtcaaattttaacggtgtcaaacccagctgttaacggacaccggaaagagtgcgagtttttctttggctagttgttcatcaggttattatg

SEQ ID NO: 33152 - DNA, 3 bp, Unknown
  misc_feature (1)..( 3): 2750-1469P.txt file - cDNA_ID_3066193; gDNA_ID_1620495; Annot_ID_158692
gga

SEQ ID NO: 33153 - DNA, 3000 bp, Unknown; identical to SEQ ID NO: 2152
  misc_feature (1)..( 3000): 2750-1469P.txt file - cDNA_ID_3066201; gDNA_ID_1620496; Annot_ID_158707

SEQ ID NO: 33154 - DNA, 3000 bp, Unknown; identical to SEQ ID NO: 2153
  misc_feature (1)..( 3000): 2750-1469P.txt file - cDNA_ID_3066205; gDNA_ID_1620496; Annot_ID_158706

SEQ ID NO: 33155 - DNA, 3003 bp, Unknown
  misc_feature (1)..( 3003): 2750-1469P.txt file - cDNA_ID_3066215; gDNA_ID_1620496; Annot_ID_158701
aactaatgttagttatattttaatatgcttgtaatatttagtacttttcgaaaacataaaaacgtgaaaattgactaatactataaatagtaagaatactggatcattttttcaaaccatgaaaaagtggtatacttttttttgtgtgcaaaatcttgtttccattcagtagatcaagtagttacagaaatgaatagtttagcaaattcaaagtttaaatcaacaatactaaacgcatttttgaacaacaataataaaggagataggatatatagaccgacggtaagatcaaatggtttccagacaataggtatgaaccaaattgtcacatgcaagccaaaaagtcgatataccatttatctttcctttttctttcaatcaaggtgtaatcatatatatcatatatgaagcaaatttggaaatggaaataacacataacagaatgggacatgacggcattttttgcccactccgaggaacaatgtattccattgatcaacttgaaaccccacttgattagctggttctagataaatgtttgttttctatttaggttgttacagatttcgtatagttaaattgagctacatgtacaccagataaaatcaagatgttgatataagaatcattagattcaatttgacttgaatgtggtgtgtcaattgtaaaaacaattgtgatagggtcatactctattttccctataactataatcttgttttgttggacactggagtaatatatatatataattctgcaacaacttaccaaaaatatttgaaatcatggatcatatgtcattttttttcttccaaaaatgattttgccatatgattaatgcattacgctcgtatgtttgataaatctggttcgtcacataaatatcacttcgaaaaaataacttttcatagttcattatcggtacatgtaaacgttaattcaattatagtatttcatatgttccaccatctcactattatattggtcatttgatatttcactactaaaccagataactattgttcttaccagatttcacacgtaatcattgtattttctagaacatcgaacgaatatagcctacaaatattatatgatttagtcaactcctgttgaatttcttctaaatattgagataaggtaaactaaataacatctgaaatcatggcaaaattcatgccttcacggaacttgggaaaagaacaagtcaaactttaaaatatttgtgtaattacttgtttattaacatttgtttcaaaatattgtactccaaatagtcaagttgatccataatgccgcttctgcattcattaatcaaactaaaagcaactggcttagccgatcataatttcaaataatagtagtgaagagtataacaagaagaaaatgataatctcctatgaaaaaaataataataattgataatctcctttatattttataaaatagaaatatagaagataacaagaaaacaagaactataaaaatataatttagtacaaaacaagagaatatacctcacagtatgagtggatattcctaatcaatagttgataaatctatttatttatcaatttgggtttcgttatattcttggaagaaaataagttgacgcgtataatttgagtactggttttaaaaagaaagaggtgctattatataatttggggaagatattaaagattatatatcgtacataaaagattcttctattttttttctttctatttcttggaactaccgttcttaattaaattacccatatattgttaaattttggattttgaacctgagatgtcgatgggcatcttatcttattatgttaaaaagttgaaacgaataaatggtctcaatgctagttgagaagtttatacttttagtgtgtatcttaaaaaaaaaaaaaagttcgtatctatgtgtatgatatattattgtttatcaaatgtgctaatacgtaaagtattattggaaattttcatgtatgtacgggaggaagcagaagaatgtataatctcctagatcacgaccaaacgaccattccaaccatgttctcgaatattatcggttcgttccaacgaacatggtcacaagttttctttatcaatttaatttgttaaaagctaaacggacaaatagaaaacacatactactaaaaccaaagaatattgaaacaaacaaattaatcaaaaccagctttagtggtgttagattgataggtctttagattcgtgcttcttacttattattgctaagatagtcgacacacacaaaaagaaaaatccattctcttttgttagaaaacatgaatacttgccactataccgattttgatttaaaaaaacaaaaagattgttaatggacaaattttgtctttctagtgcatatttacttaaaaattgaaattattaaaaaaaatttaaaacgtatggattatatttgactatttgttttggaatttaatccaaaacatatgaaaattttgaccgtttatgaaatgttgatttttattttactctttaactcacacacaaaccacatactttaaaattcgaattagagaattcactaggttaatgccctgattagttaagtttgttgtaaaatgtattgatatttgatttaatatatatatgatgatgtaacacataaaataaaataaaaacacgtaaaatgaattaaaaataaactaacaaataaaataaaaacccttggtatgatgggccttggaaagcccaaaaaaaaaggaagagtgcgcgtgaaaaccactctaatttctctggattccaagattccccaattcgtctcctccaacagttttcttcttctcttcttctttgggtgttccttccaccaacggcagaaatcgatttggcttaaatctccccctcctttcgatctctctgatcgccgccgggaacattcaatttcccgggagttcaacaaaaaaaaaactctccgtttttatttttccccctttttcaccggtggaagtttccggagatg

SEQ ID NO: 33156 - DNA, 107 bp, Unknown; identical to SEQ ID NO: 2150
  misc_feature (1)..( 107): 2750-1469P.txt file - cDNA_ID_3066219; gDNA_ID_1620496; Annot_ID_158700

SEQ ID NO: 33157 - DNA, 3003 bp, Unknown
  misc_feature (1)..( 3003): 2750-1469P.txt file - cDNA_ID_3066241; gDNA_ID_1620497; Annot_ID_158732
gatcctctttaccatgatcagtttgagtcgtcacagatatgtgagatcgatcttttcgctaacgatgatgaagatcatgtcgacatttcgattaaagggaagagaaacggtgatgatgggatattcttgagacttagaatatctgatgctgaaggtatagtttcaatctttttcgatagttttaaaatcatcggtcttaaaaacgtaacacgctttcgagttttgggtaatgtaggacggataaggaacatttacttcccgtttgagacggctattgatactgcatggagtgtagcggttgagatggtgtcagagctcgacataacgaatcaagatgttgcgaaaatcgcggagatgatcgatgcagagattgctgcattggtgcctgattggaaaaatgatacagaaagttcccaaaatgtaaacaacaacaagaacaacaacactgcaggattctgtggagagtgtgcttcaaacgggtatatacaagagactgtatcatcaggagaaaaatctcatcataatcatcatgagttcgatagttctgaagacaagagctgttcttcggttcacggtaggtttgcggatatgtggggtttgcgagaatcatattctgatgatggagaaaaacagagctcaaggaaggttagaagtggacggtggtcggagaatgagatgagacgagaactgagatggcttaaggcaaggcacaagattcaacttatgaaaatgagaggtcaaacgatctgcgagacaccgatagagatctctcttacaccgggaacttcagtttcgttacctcttctttacagggctatatcacttcctgtggatgccgtggatatgtgacattattgtaaagtctgatgatagttatcacttatatttgtatgtttcgacatttttaacttttgttaagttaaaagttaatgacatagtgtactttatttaaagagaagaagagtaaacgaaaaacataaattaggcattgtaaattgtggactaatcatctaggttttttccttgatggcacatatctcccatagactacatatgtctcttcatgtgcaataagtctagatatgttttcatcatcacatcgacgtttttctagactgctttcttgtttcctttggcatcctggaggttgcttgatttgcactaaacttggaacataagagcacacaaatagtggggaaaagtgtttgtcaacatcaacaggttgtcctagatgcagttctttaacgtttccagcctctcccacgatgtaaactgtctcgcgattcatcggtatatcaaaaatcatagcaactttctttacctcgtcaatgaaaaaactcccttccagaaggtcaacatacatattcactgtcaagaacttgctccacgaaatcttgtcagtctcaatcttagtcgtaatccatacctcaacagtagcattgttacaaaacaaaaccgcaagcttctcttctctaacacaagatagagtcacaaggcttccggacgtatatctaacaaacggcaaaggcataagcggaccaaatctctcacttgtaaaatcaaaacagattatgtgatcaagatcaacaaaccaattagtgtttgacttccttcttatagcacaccagtaagtgtttcccttgagagtaacaccacggttataacaaccacggggagggaaatttataaaccattgtggagtaacgtcaagagtcgtccacaaatcagagtcaaaatcgtagatttcataccaaaaagggaaatcgaatgcaccatctataaacctcaagattttgtgactacgactcttattattgtatccaagagcgtacacgtacatgtacctgccataacaattctgtatccgggaaaaatatctaggttcgatccaccttgtttgtccccaatacggattccaaacaacaagactacacttatcgtcttccaagacgcatagtaacaaaccctcgcagtgaaagacttgagatatcttgacttgttctgaatcgtcgtataggcaagtaagtttacctctttgctctgcagatggatcaatgtcaattccattgaagaagatgctcattgcaaacaggtttttatccatcaacacgatcatcctagactctccttcctttgctgctgcttcttctttcataaagctccggtttttgaataaagagtcccagtttttgcaagtcaatctcactgctctcgtagactttaatggtactctagagattatctcatctaataactccgttggaagatgagagattgtcgtcgtcatagtcattacaagttgcaacaaaggttttctcttccttagatctgttgttgcgcgcgcctataggaatcaaagacacataaaaggtaccacgtaaaccttttaatatcggtgagacatctaaatggtaaccgccttgtacaaaaaaaaaaaaaaaaagttctaaatggtaaccagaatctaactgattttttttgcttaattaatctagctcaagttttagtgatttttgttgaagataactgattttttattttttttcattggtaacacttaacagctgaattagttttactgattttaggcaaaatctagcaaaataattaagactttaactgaaaatatcttcaaataattatgaatattaataaaataactaaacaatatctaaataaaatagataaagttatccaatagtctaattaagtcttgtactaattaataaatactaatataaactaatattatataaattaattaattatctagtcaatgtatggtttggtcttagttgatgcatggttgatgtcttggaccggttataataaccaaactaaatcaaaatttcagttacttaaccgaaagtagtcaaattatttgtcggttataatgtaccggttcggttcggttataagtaagattctgcattagctcgagattccattagctcaaggagaatcaaagcgtcgtctcttgttccttccgctgccaacaaaatg

SEQ ID NO: 33158 - DNA, 3003 bp, Unknown
  misc_feature (1)..( 3003): 2750-1469P.txt file - cDNA_ID_3066252; gDNA_ID_1620497; Annot_ID_158723
tatggatatttaagctaaaagagtagcttcgacaaaaacaagatccgagccgacgaataagagataggagatcctccaggtggcattttagtaattaaccacgtggaaatagactgaaaccacgtggatattttagaattttgttgtgcacgcgctttgtaggcgcgtaacgttaaaaatgtgaaatctactggttagagttactccactgttattaattattagtaagagttatgaatcctgaccattgaccaaagattgttggtgttttcaaattcaattaattacacaaaatctatattttacgtggggcctaatccatgtcactatcattcttatatttaactataatcactaaatttatgtattattttaaataaatatagagtattaaacatttgaaaatactgttattgggttatgaagtaaaaatagaaatcctactgtattcctagtttccttttatattcccacgaacgattttgctgtatgtactcgtatgtatcttacgaagtgacgttttacaccatgtcagaatatgttaacagtggtattaaatagaaataaaactgtactttaatttagttatttttgttaattaaaatattaatatttaaatacaatatcctatattctaattagtttacaaaaaaagtcaaagttaacacttttgcttaactgtaattttatcttttcaatatgttaaaattattaaatggaaaccaaaataaaattcgaaaacaattttttttaaaaagtgaatagaaatacctaatatttagaaatatcaattcaaatttttacccatcagtaaccttggaaaatagcgaaacaagccaacttttatttttttttggcaacataccaacttcttcagaaatacttttcaaaagaaaaataatttataagtgggggtaattaaaaagagataagagcagtgaaagatgatttccacaaaaggaaaaaaaaaaaaagggaaaagagaggtgaaaaaaataaaaaataatgtaaaaagagcggtgaaaaaagtaataattgaaaagaaagaaaaaagatgataagagcaattccacattggcagctaactgtggaccccacacttctcggaagttccgtgaccgcgacttgagtgaataaggtcccacatgcatttccctctcttcccatctcagccgtttaatcttttctaaatcgaacggttcagatcaacgggtcgggtgccaactcaacgccttttttagtttttattttattttatgttttttttttggatgatgttttcttctgccaagtcagattgtttaaaaaccaaaaatagaagaaaataaaatactaatataatataaaacgatctaacggttgtgagagcatttagctaattggcaacaaatggtattggccgttgatttgtaattaatgagttaaattattttagactatggtaggacctgtttccttactttataggtttattgtttagcttaccttccctaatagaattaaaaaaatctaaaggatattatatggtttattactattttagaaatatccaaatatgaccagatttaattagttttatagaaatttatagttatgtcaatttgactaatctaacctaggaattatcaagatttaatttctcttttagattttttcattataaattaagaatgttgataaattagtaattaaaaatgtggtagatacttccaatattattctccatatattttcatttttaattattagattctaagaatttaaaagatcaattttgcaaacctggcatatttgaaaaggtaaatttaatttaacagcttttattgcatgcacgtaagaaatatcaaataaatcaataagaaggaaagtaaatatttgaatatttattttccatgagttgaagaaaaaaaaatagttagtggcaagtaaaaaactatttagccatttgatcttaatggagaaaagtaaaaaaaaaaaagatgaaggtagagaagtggaacctgatgtgattaatattaccggttggatcggtttgtataggtggtcacaaagattccattctgatcgtagattgcctttaccaaggtctctgtctaccggtaatagccggtgatacatcttctcaagacacattttgaattttaataattaaaataacatcatatttgtgcgtgtatatgtcagtatttttgttttcttttcacacgagtcatcgcgattagtggacaacagtacactaccccaggagcctttttattgcacaatatactattgatgattatttttagatttaaatattattatcttaatctttccgactttcaatatattttattgtttttttatttgtttgtttatttctagacagtgcaaagtcaataaaatattggtagcgataatatagacggaagcgtgtgatgtcaaactcttgacacgtggcagcttctgtttaataactggtaacagtccaaaataattttttcacatgaatccgactccgaaaataatattcttttaaaaccgaaaaattaaatgttatcaaatactaaaatatcataacaataagatatcatttttgagtgggtcctacctacggatgctgactaataaaataattaaagaatacgttttttaatttaataataaaataataatcggtggtaaaataattaataaaagaagaaatatcggttatttattattatatgcgagatctcttataacggagggccaagattttgtcacgctggtatatagcgtatcgtgaccgttggatgtattcacaccgacggtgaagattgagaaaatgttttacggcaggagatatgagccgtggatttattcgctactctgcttttatgaggagcacaaataaaggagataatgggaagcaagtagagagatagaggagagagagtttgataaagagagagaaaaaggggttgcgatttgggagaagagaaatagagaggagaagcattagagaagaagaagaagaagatg

SEQ ID NO: 33159 - DNA, 3003 bp, Unknown
  misc_feature (1)..( 3003): 2750-1469P.txt file - cDNA_ID_3066256; gDNA_ID_1620497; Annot_ID_158721
gtctatagaaaaaagattattactacaagcttttacttaaaaaatgtccacagtttttgagcataaacttgcggattagtttgtcttttcgtgtgctacaagtcttttagtcaaattagacgaattttacgctttcttgtatacattgatcctagagttccgtaattgctataaatagatgtcagtttaggagttaccaaatgcaaaaaaacaaaaaaaaaacactatcattaatcaagttccactgttcattttcgatctgcataatgatgatgagtcgtcgctatggagccaagctaatggaaactgctgtgactcacagccatcttttgaatcctagggttcctctcgtgacggaaaatattagggttccggcgatgggagtcgtgagagttttcagcaagatgacatttgagaagaagaaaactacggaggagaaaggatctagcggtggcaaggctgatcaaggtaacaaaggggagcaattaatcgttagctactggggagtgaagccgatgaagatcaccaaagaagatggaactgaatggaaatggagttgctttagggtacattacatctttggtattatattagaactctgtggtcgatttatatgtatgatttgagtttttgtgtggaataactgtagccatgggagacatataaatcagatctgactatagatttgaagaagcatcatgttccatcgactttaccggacaaactagcttattggaccgtgaaatctcttcgatggcctaccgatcttttcttccaggtgacagtcttagctttctatggttttgtcatttcaaatgctttgtatgtttggactaatcttgccaacgagttaaccgcagaggcggtacggatgcagagcaatgatgctagaaacggttgcagcggttccaggaatggttggagggatgttagtacactgcaaatcgcttcgacggtttgaacaaagcggtggttggatcaaagccctacttgaagaagcagagaacgagagaatgcatttaatgacattcatggaagtcgcgaaacctaattggtacgaacgagctcttgtgattgccgttcaaggcattttcttcaatgcttatttccttggatacctaatttctcccaaatttgctcatcgtatggttggataccttgaggaagaagcaatccactcttacactgagtttcttaaagaactcgataatggtaacatcgaaaatgtgcctgcaccggctattgccattgattactggagacttgaagctgatgcgacgcttcgtgatgtcgtcatggtggtccgtgctgatgaagcgcatcaccgtgatgttaaccactatgcatccgtaagtagtgtgaattgtattataggaaacttacttatgtttaaaagatgattagattgttttcatggttttaataaaaattgcaggatattcattaccaaggtcgtgagctaaaagaagctccagctcccattggatatcattgaatctgaagagcttctagctttgttttgtcgttttgatacggtccagttttgttttccttgttcctaaatgggctttaatgggtatttgttaaaatttagtgggccttagagtaagcttatttgtgcttgctttctttttgcttcataaaagagtgttttgtttgttttcattctcctaataaatcagtgcttacatgatatgtttacatatacacttaggctagaaataaaactttacaaacccaaggctttgaagtttgaatataaccatagatatgtccattaaaccccactaaaatgaagtaggcttgaatccatcatatataaatgttaaattaataggggtgggaaaaaaaacgaaaaccgaaaaaccgaaccgtaccaaaccaaaacaaatggtttggtttggttatggttttgtataaaaacccatttgattgtaatttttatttaagttttggtttaggtttggtttgattaaaaaccgtaaaaccgaacgttttttttgtttttgatttaaattaaaaataattgtatatatatatatataatgttcatttgataacatgatatctatcaaactatcgaaaaacaaaaccctaactgtaacctaaactaaaattctatataaattacatgccgtcatttaggatttgagtttacaaattagattttgattttatttatgcatcacacttataattttttttggtaaaaacatgaaaaaaccggaaccaaaccggaaccgatccgaaccaaaatacatatggtttttaaatggttttaattttttaaaaccaaaaactgtaaaactgttaaaaccgaaccgtaaccaaaccgaattttatatggtttttatatggttttacttttcttaaaatcgaaaaaccgtaaaacctaaaaccgaaacgaaaccaaaccgaaaaactgaacacccagcccttaaatataatgaaaatcgaataaatttgtttgaaagaatcgaacaaaattgacaataaaatctaattaggactattttcgtctaattttgacttagttgaaacagaatattagcaaaaatactaaaacaccacaacgcgtaataatacccacacacgatatcattaaatttgaccaataagaatctagctcttggcgaccacgcaagtatcttccatcttgctctccaagaaaaatctacaccggctttaaatttacataaacaccctcagtcaaagaaaagtcgtaaacatagtctctctcatgaccacaagggtaacacagtcatcctaaatataaaccacacaagaaaactgttatactttatacacgtgtcatagtctcattacatctacgtgaagagtttcgatcatcaaccgttcgttttcttactatataaaccttgctcgagacctgcgtgtgaagcgtataaagacgacaaagtaaaccaaaaaaaaaaagagttctcctacaattttcctaaattcttggatttgagatttcactttttccgatttgaaacaatg

SEQ ID NO: 33160 - DNA, 3000 bp, Unknown; identical to SEQ ID NO: 2163
  misc_feature (1)..( 3000): 2750-1469P.txt file - cDNA_ID_3066268; gDNA_ID_1620497; Annot_ID_158716

SEQ ID NO: 33161 - DNA, 3003 bp, Unknown
  misc_feature (1)..( 3003): 2750-1469P.txt file - cDNA_ID_3066272; gDNA_ID_1620498; Annot_ID_158745
tattgaatttgtccttttgtcgttatttaaagttgcttttcatctgttatataagactcataattgttttttcccgttatcttgttgcaggctatgtttgaagggattcttgttgatataccatttgcaacgtttttcctcagcaaactgaaacaaaagtatgtaaatttaatttctacctcaatttcctgtcacttcattcgttttttaagcccgcatagactttttgaacatgttgtgaaacttctattgttctttggctaggtacaactatttgaacgatttgccttctctggatcctgagttgtataggcaccttatatttctgaaggtgagttttgctgaacattctatttaattgttgctttgtagaacggggagatagttgctagcatagatgtgcgagaatgctgaaatctgtttgtttgtttttgtttcgaaactgaaatttgtttgtttacctacctacgataattttggctcttttttttttttttttttttgcttcttagctttatacacctttttatgtattcattatgatatttgcagcgttataagggtgatatctcagacttggagctttactttgttattttgaataatgaatatggagagaggacagaggaagagctacttccagggggccaagacatgcgagttacaaatgagaatgttataactttcattcatctggtttccaatcatcggttaaattttcaggtactggggaaccacttacctctcatttatcttggcatacctgaggtcaccctgtaaatcaacagctattgatatcatctcatttgcagatacgccagcagagttctcatttcttgagggggtttcagcaactcattccgaaagaatggatcgacatgttcaatgaacatgagcttcaggtgccaattaagtgtataattatacttgctttgttagttgttccctcgaggagcatgaagagagaaattttacctttgtgggctttggttgcaggttctcatatctggttcagttgatagtttggatatagacgacttgcgaaacaacactaattatgctggaggctaccacgcggtgagtggttcttcactgttagccgaaatgccattgtgaattagtgtagggacacttttggagtattgttatatatgattatatcgctatgttgttgacacttgacagggacattatgtgatcgatatgttctgggaagttatgaaaagcttctcaactgaaaaccagaagaagttcttaaagtaagcaaactttgcagttactactacagtctgtgtacgcaatgatttaccggagtctatgaattttctaagggaactaagaggtacctctatttttcaatttcaggtttgtgacaggctgctcacgaggaccactgctgggtttcaaatacttggaacctgcattctgcatacagaggtaatatacacagactcacaatcgttttgacttttgatgggccctggacaatagaatcataaaatatccatcctcgatggaatgtgtatcagggctgccggtagtgcgagtaatgaatcagttgatagactaccgacatcagccacttgtatgaatcttcttaagcttccgccctatcaaaggtttgtcctctcataacacaaactctttggttttgcttagctaagagacttgttttgttgccaaatagcttctcttggtgttgtaattggaaaaagcaaataaagcatgtcttgttgttaatgatgcagcaaagagctacttgagaccaaattgatgtacgccataagcgcagaagcgggttttgatctgagctgatggaatagcttcctgccttaaacacagacttcaatggccccaaattgacacccttttttctagcattcctcgttatggtataaaccgggtaacctgtagactgaggcaggcttgttggctctaagcatctaagagacggatctagaaggagaacatgtagtagagattacttgactaatgggtttcatttgcagctctcgggtattcgctttcaaaaagtgtgacaaaaaaaaaaaagtgattacagggaagtctttatttggaagctcctgagagttagtcttgggttaaaaattcaataaaagaaatggtaaataagactggtctcaagaggaacttaaatgctgtaaattattttgcttaattaatgcatgttacacagaacatagatgattattttgatacttatttgcatcataccatatatcttctataaaaagatgcattttagtgacttagtggtaagaatatccttttttttttttttttgtcatatgataattattaaaacagaaacaaaatgacagaaaaataacgagaaatacaaaatgaaatttaaactttactttccttagacacttgattgtgaagtcatgaaggctctccaagtgctaagtaaaacttagactgaaaccttctgtcttgaatcacactcccaagaaatggaacgcgcgatcagatttgcgtttgtggcaatatgacggaatgtacaagattcaaatgcactaacaatctcatggatttgtgttaaccaatttctatagaaaggctatttggacggctgcaaaacggcgttaagtgcggctggacagtccaactctattatcaccgtggtaagaatatctctatatacattttttgtcgcacttatcatgattaatcaagtaaacataattgttacaaacactttataaattaaaaaagcttcaattcaatttgcacagaaaagaaaaaaaaaagaagaagattcaatacagagtataccaggagcatctggtaatgtttatatctgaggacgttttatttaattttttggaacgaaaacaataatccgacgatcgtatttgcacgtcgcaaatccgctcttttaatcaaagatctcgaccgtccatttttagttaagactttagagagctgataagtggaatagtggagatttgcattcgcaggggataaggatcaaaaatg

SEQ ID NO: 33162 - DNA, 3000 bp, Unknown; identical to SEQ ID NO: 2170
  misc_feature (1)..( 3000): 2750-1469P.txt file - cDNA_ID_3066303; gDNA_ID_1620498; Annot_ID_158766

SEQ ID NO: 33163 - DNA, 3000 bp, Unknown; identical to SEQ ID NO: 2168
  misc_feature (1)..( 3000): 2750-1469P.txt file - cDNA_ID_3066313; gDNA_ID_1620498; Annot_ID_158763

SEQ ID NO: 33164 - DNA, 3000 bp, Unknown
  misc_feature (1)..( 3000): 2750-1469P.txt file - cDNA_ID_3066342; gDNA_ID_1620498; Annot_ID_158754
tgtgttctgatacagacacggaagatgaagataggagaagaatctacattgttggagaaggtgtagatgaattcgtctatgatgaagtttcaacggaaacatcccacaattggccatttctcgtcagttatgttccaaatctggttcacattgagaaagatgcacccatagtcgaagtgtaaaggaaaaggaaacggcaaaaggttagtcaaatgaattgccttagcttttatcttgctttttctttcggtcatgttcctttcaacgagattcgtcaatcattggtagggattgtttctatttagctgatagaacttacctttgtttctcttgtttgcttttgaaatatatcagcacaacaataccaatcaagctagaatcgacgaaagagaaacagaggaatgaggaagataaagtgaagatgggctcagaaacattacaaaggcccaaaacgattgaaaagaagcccacatatttcaagccccgacattcaacaaaagtcaagcttcactctcatggcaaaagcatatgttcaaggagacagccaaatgatactatctaaccgttatgaagctctcatggctctttgttgatgacaagattaacagctgtaaaaagagaaaccctataatgagtagtctatataaagtacctcagttgtaatcgaaattcactatcagataaagatcaataagaaaagcttttctacttacctttcccttatcccagttcttcttcaaaaaagacgatgatgacaacgattcccaatcttccagacgaattggaatcggaaatactctctagggttccggcgaagtctctagcgaaatggaagactatttgcaaacgatggtacgctttgttcagagatccgagattcgtgaagaagaacttgtgtaaatcagcgagggaagtgatgttactgatgaatgatagggttcactcaattagcgtcaatcgccatggaattgacgacagatttgaaccatctatggagttttcaggtaaactcaggagtctaattgattcgaaagacgtcaaagtatcaaaggaggcaaacttggcaagaagccttaacacaatgtacgcgaaactcaaatctaaccgcatatccaaattatgtggtggagtaatgaaccacttcaacatacgttagagctttacaagtcttactttggctatgaaaagtaaaagcaaacaaaaatcttttgtagttcatttgacttcaatgatacattccctaatagatatcgtattaatgcaaaaggaatataggtcaaacacccacattcaccgcatgtggaatttgcttttaaggttccttaaagaatgacagacatcacaaaatgcttgaatgaagtttctacagaatgcaaaaaatcttgtcttagaggtttgaaatctttcttgtagcagaaatattccttgacgactctgacagtgcattttcttgagtaatttcagaacattggtcaatcccagtgaagtcatgcaatgaaaactccgtaacgacgagaaactgaaagagaattcaacaaacgcaaatcaagaatcaaatgcaatttgagaaaccaaacgccctaaacttgattagcaagaaacctggacaagagagagtagacattgaacgcatagttgcacgcatagatccgatattcgtcaagaataactcgtcagttatgctccaaatttggttcacattcagaaagacacttccaaattaaaggccagaggaaaatgaaagcaaaaaaaggtaacacaaatcaacttactgtagtttctttcttggttttccttgtggtcaaacgaatcacataataggagctgtttctatttagttttgataagcagagtaactaaataaaacttccttttgttcacctactttgctttggtaattggatcggtgatctaatgaacttacccgaacatattttctatttggattgaatgcttattgagaacatcaaagcagtttcaagaccgtgtttgatctccagatcgtttttggattctagttccaggaatatgtttttaacaccatacatgatttctcttaccaatagaacagtttgcacttaagaaaaccctttaagcagagattttgagagaaatatcaacaaacgtaagtcaataatcattagaaaacctgagtaaatcattaattttaagcgtaaaaaaacaaacttgatcagcaagaaagctggacagacttttttctttgggaccattctcctcaatataattgacaaaattatttcaatcttctattttaaatgatttggatttatatctttaataaagtttttaaatgaatttaaaaccatgcgatttagatctttgtatttttaaactaagaaaaatttcaaaccaaattagtaaaaatccaatacttattcccaccaaaaaaaaaaattccaatactcaattgttttttctcgataaatatctcttacttttattttaatttctttttgtgctcaaacttttactttcatatttgtttatttttaactgttatcaaaactaattaaaaaccatgaaaagttaaagttgtctcattttgtctaatagaaaaataaaataaacatacatagattctcttctcctatataataaatatattgatcataaaaaatcttactccaaactctaacacatcaaatcataataaatatagggaaatatatagtttcttcttctttaaagtcattaaaatataatgtactgtttccaataagaatagatttaaaatacaacaaatcaatagtttaatcaattacactgaatattataactttgtaaaaattcataattgaataaatatgatttgttattttaaaataactttaaatgcttgattgcattacacagttatataccctctctatttattagacaagttgttaatgtaaaaacccttaattctatttgcagtcctgttgcaatcttcttcatagggaggtcagactagaaatcacaagagataaacaaacaatg

SEQ ID NO: 33165 - DNA, 3000 bp, Unknown; identical to SEQ ID NO: 2171
  misc_feature (1)..( 3000): 2750-1469P.txt file - cDNA_ID_3066354; gDNA_ID_1620498; Annot_ID_158751

SEQ ID NO: 33166 - DNA, 3000 bp, Unknown; identical to SEQ ID NO: 2178
  misc_feature (1)..( 3000): 2750-1469P.txt file - cDNA_ID_3066374; gDNA_ID_1620499; Annot_ID_158795

SEQ ID NO: 33167 - DNA, 3000 bp, Unknown; identical to SEQ ID NO: 2180
  misc_feature (1)..( 3000): 2750-1469P.txt file - cDNA_ID_3066376; gDNA_ID_1620499; Annot_ID_158793

SEQ ID NO: 33168 - DNA, 3000 bp, Unknown
  misc_feature (1)..( 3000): 2750-1469P.txt file - cDNA_ID_3066387; gDNA_ID_1620499; Annot_ID_158784
cacaaccattataccagtctcaagtagaaattttttctttttatagtttcctacttttgttttcttaaattacatttttctgggtacacttcccttgttgtttttcaagatcacacagatgagaacaaagaaaggaatgacgaaagttttctacaccattgcatcttgaaactcttatgggttccagtttctatacggtagatatacaataagtcaaggtaatcctcatcactcacttcgtgttgataccgttatttcataacgatatatataagtagtcccattagttcttagtcttaaaccgccgtagtttttactgtcagtccctgaacaatccttggttataattagtccctcgtctatacatagtactgtctcgataagatgtccgcaaagaaaataatcccaggttatgtgatttaagagacttaggagctttcattagatacacataacacaacagcttgcagaaattgtgtaatgattattgaaaaatcgcggtgataaagacaaaccgagatctatcctattcattgtaaactgccaaaaaccggtacgtaagctaaatggaaattatagaattgtcatcaaatgtcattttcaggaagggaatgatagtgaggacgactgttttcatcagttggcttcaacagcaagcagcttctcctgtgcctcaacagccacaaatcagtatttgtgggtatttatcaatctcttaaacgactctctctattattgataagtcgtatatgatatatgatattgatgtgatattttcttccactcagcctcttaattagtattaatatattgactcttggtattgtagaatcgtaccggtcatttggtcctagatttttattcatgcatcggtttgatttacttagtatacttactaattaaccttaggtaggcaaaaacattcatgtatgcgatcaacggttttaaaaacgtaaattttgtttttccaaaccgaatcaatcggtgagtttttgatgaataacaccggttaaggctgtaccggtcacggtttatgggaccttctgaatatgcaaaaaatcgaaattgattttttcaggtgtgaaagctataagctagattattagctcaattcaccaagtcaatattcgagataaaaaaaaatggtacaaaactatagacgtttttcattgcgtctttagctattgtttaatacttttcgtgttgcttcttgatatgatttaacaactttcgattattaaactctataatatatggtgagagatgcaaaatgttagatctgctcccttctttaacgtcatgcaacctaactcttaaacattctcgattttttgcttacagcttaaattatttatttgtatctacttattaatttacttcctcacgtctctgtttgcggcaactatgatggtacgctacgtcgacatctagtactagcctagtactcaaaagatcagattttgtaaaacgtcaccatgtatttttgggttattttatcctgttgtccgtaaaaaataaattgcatagtaaattaccactctgaattcgatcagaagatattacacgattacatctatcacaaataaatcatattatttctgaaaaagattcatagtgaagatatgggtaaatttaatgttccttgtaagcccttcttgccaaattataatcgtattatattggttctttgagcagtccaagaaaataatagagctagagatgaataaaatataacattaccggtagagatctgaggatgacatcatcaggataaaatgtcaactacacacacttattgccttgaattgttgaccctatcttcgtttttcactttcgtcgatagatttttctatttactcgtttaattaaatatcttgttgatcatttctttctgacgagttatgaatttttgctctgtagatagacattttttcttctacttatgcaacaccacccaaaacaaaagattctaatttttctaccaaaaatatctgaaagtatcttagcaagaaaatttcagaatacccaaattgacctctgtagtttcaaccaagatactaataaaaaaactaagcattatcattgtttttggtaaaaaatttaaaagatgtacaaaaaaagaagaagctgaaaaagcaacgaatcaaaaacgaaaaagacagagagaagaaaagtgtgaaaaaacattataaaggagagggctttcgattatataataaacactaccaaaattagcaaacaaaaaacattcactcgttaactcttctcctccatccaatttcactttctctcactcatttttattcgtcgtcgtcgtctcctctgatttgttcttttttctctaaattcgcttcgcttcttctcagttctacgaatcttcgattctctttggttttctccatccccgtatacgtttaaggtaaacccatttctctcatcatcaataacatccccaatgtctcgttccgataatctgttttatttaatcttttcaatttggtttgcgagttttgatttatcttatcaatggaatttttgatatatccatatattgttgtaatccatatagatatgaacacatgtcacggtgaatactttgatgataccaaatctataagtttctctgtgttttctgggtttttagttagtttatctctgtataaacattctatctgaaacatttcccaacaacttctgtggtctgcatttaatggcctcctatgaaaaatatcatttttttcttaactctcacgtttaacttatgtaactgttcgttaccttggccccatctatcttcactttcgatatgtgcttagactctcaccacgtattttgtctctaaggtcattaaagcagctaacttttttgaagtgtgaggtttttgtattagtcttaagatttcattaggattgttcaagttaaaaaaaggactaaactttatggttttgttgtggatttttgttgtttcagaacattgcaagaaagtgaagaaaaaaaatg

SEQ ID NO: 33169 - DNA, 3003 bp, Unknown
  misc_feature (1)..( 3003): 2750-1469P.txt file - cDNA_ID_3066403; gDNA_ID_2936567; Annot_ID_194660
tatatccgcagaaacgggccatatgtcggaagattgggttagaagctaccgaatcgaaagcccaacaagatatcgaaccaaaccctatagttttactttggcatactttaaacagattttctgtatctgacgccgttcatttgttttactttctccttaacatccgacgactattcttatgataaagaaataatatccaagttaaataaatatttactcgactaatgcgtccgctaaacactcgtgctttccttttatagcttgttgcctatttgtcggacaatgttttataattgttaaaaagtttattgaacattttaaaattgtatattttggagtcgagaagaatcaaaagttattactaatatttattaatgaaaatgactaacacaatttaaaaacggaaaagttattcgcaatctaaacgttacataaactataaactaaaacgttacagaacctatgaaatagcatacggcttagggctcactagttattgagagttctaaattttgacttaactaaaagtccttatgaatcaatatttttcattaacagtaaccatttcagtatttctacataggagagccttctttttctgtcatcacttattactgttgcctgaaactattccggtaaagattggtttttaatttcccttcatgcttaaccagatattcacctgattctcccagtacacatgtaatttatgtgctttacataaaacttaaaaaaatactgacaataattaaaatattcgtttgcagtttcataatttagtttatgctgcttatggacgtgggaacatgcttgtagtttaacttttatttggtcgtcaatttgattaaaaattataccttcattgattctttttgaaagatacgtattgtgaataatgtataaaggatttagaacataattatgatccttgagacttgtaatattttattaactaaccgaaaacataagcaagagaatcgtggataacgacctaacgtataagaaacatgagacatgtcacaatcactttaaaagttttcctatcaaaactcgagtagaagcacatgaaatttctggatattaaaaataaataaatcaaaatagccttatattattgctgtcaggaaataattctatttagactacctgaatttccagttgaacggcgtttttccaaattgcaagcatcatatattatgctcatcgtatcattagtgcataaataaactatggaccaatttcatggtgaaaaaggggcttcggatgaaatttttgatcaaattatatttgtttattgataaaacaaacgttttttttaaaggatgacagttgtgcgtttgagatgaaaaccaaacactgctcccactcaaaatttgtaaaaatggaatttataaatatttggtgctacaaatgtcgtttggtagcctttggaaacattaaaggtaaactagagatatgggagtatggaacttaatctctttatgtggttgtatttcatataatttcacgtggcccaacttgtttctgtcaatccattgatcaaagttggtagacaagagtgaacccacacacactcacacacatacacacggtcgatctttttttctattctcgtgtccctacgtcctctaaaccccatcattatacttcttgtgttttattggtatgctgagctagagatagttaacaactacccaacaatgcgggtctggcttagtttgaacctattcgaaactagttatactccgcttgaagtcattggttcgagactaactttggagatgagtatcataaacagctctaacttaagattacaatacatcctcttgttagtctaagttgagaggtgttgccattgactatatatttctttgggaatttggtttaccaggatgttgcaaagaagatttaaatagttataaattagtacaaattcaatccatatgatatgatattcaaaaaacaaaaaaaaaaaaaaactgatctaaaagtcgaaccaaattctaatttgattagagcatgtatataattgaatccctaagtaaaattcaacccaatacttgagaaggtagttatattcttataaattatggatatgatttgattaaaactcaaacctgaacccaaaacatactagaatatacgtttttactttgtaactatttgtcacattccaaaactaaactcggtactatatttgattctgatccatacaaattttgtatatctggtttatattctccatgtgagattaaagcggtgaccaatcaaaatcattgctggaatatcttactattaagctaaatgttgttagttatatacaagccaatccaaaaaaactgatgcaaagagagataaacgaacatatcccaaaatggtaggatttgatttaatattcccatcctcttattagaaatgcaaacaaatagactatagttttatttatttattttcactataaaataactaaataacatgaacttattgaagaaaaagtatactatagttgtgattctgtgatatactagttagaacaagaatctttacaaaaaaaaaacacatgggatgttaggagaaggagattcggattccaatgatccaacggtcagagaaaaatcagaagaaaatttcacaaccgtaggatctgttcccttaaccaccttgtaatgccggtctttattaattttgagaaaaaaataaaaacagcaccaaacttatgtctctcatgtgaccgaccaccgcatcctcagttgacctgtctctgcccccactttgtctccccacacaaactgaataacaagaagaagaagactttagatatcaaatgactccacgtgtcgatattggattggttttcattggttgtatcgtgtggaccaacgaagcaacatataaaaagcacgacgcggtgccattactacaataagagaagtgtaggagaagaaagttctcatttcataattgtatcaaattgtgagaggaaaaaaagaagttcaagaaatg

SEQ ID NO: 33170 - DNA, 3003 bp, Unknown; identical to SEQ ID NO: 33169
  misc_feature (1)..( 3003): 2750-1469P.txt file - cDNA_ID_3066403; gDNA_ID_1620500; Annot_ID_158863

SEQ ID NO: 33171 - DNA, 3003 bp, Unknown; identical to SEQ ID NO: 33169
  misc_feature (1)..( 3003): 2750-1469P.txt file - cDNA_ID_3066403; gDNA_ID_2936567; Annot_ID_143728

SEQ ID NO: 33172 - DNA, 3000 bp, Unknown; identical to SEQ ID NO: 2185
  misc_feature (1)..( 3000): 2750-1469P.txt file - cDNA_ID_3066411; gDNA_ID_1620500; Annot_ID_158858

SEQ ID NO: 33173 - DNA, 3003 bp, Unknown
  misc_feature (1)..( 3003): 2750-1469P.txt file - cDNA_ID_3066416; gDNA_ID_2936567; Annot_ID_194653
tttataaaaaaagttaaaaatgttggcaacaacatcatccgatccatatactcttatcaggaacggaaaacaaaaaggtcaataacaaataaaaaaatataattggccataagtagtgaatagtgattaaatatgatttatcctacaattattcgttaataactaactaaaaatatattttcttataccaaagaaaactatacaaactacttaaatcaaacttgtaagataagatatagttggatgaagtgggggtttgatctacgatggtcatcttcattgtttgattccccctttttcgtttctattctattttaagaatatgaaaagacgtataatatgcacaagttggagagaatatttatcagcttttcagagtttagtatactatatatgatcttatcgaaatttataccttttctatatatatatatatatattaaatcgaaactttctttgttatcagtagcttaatgtttagaaatattcttattatagtgtttgattaaatatgtttctagaatcgaaaaaaataaaaagaaatcattatattaaattacgataaaaaaagaaaaattaatttaataaaaaagggaaacattatttcatttaactagctagtattttaacaaacaactaaatagttgtaatttattgtcataatatatatattctgaataagaaaaatccacatatgtagcaaatgtattatacatgtgtatgacaaaagttttacaaaatggttgaacttaaaaaaaaaatatgtcttaaacatacgtaagactacacgtaatatcaaaattaacatgcttagacatagtaattataaagctttatgtaaagcaagactgattctattaattaattgatggatcaacacttttagcaattggggatattgtactatttactggattatgcttgtggagggagctcatggtgctccagattatcaaattttatatatggtagaaaaataattataccattacaatgtaaagcattcgagttcgaatttcattggcgcactttgattttatataggaagattgaggttaagttgtaataagtgtgatattcatattattattggaagtttattggtttagccatatggtttattcagcaaaccattaactaaactcacatgtcaaaagttgaaacttataccaccttgatatccacgtcatcaattcttaatacacttttgtattttgacccaaatttacggggttacacgttatgtaattatgatatatgcatgacatacacgttatgatatatgcatgacatcgctaaaatagcataatgttaattagttatctaaaactaaagacctgtgtgtggatattatcttccaacattaacaaaaaaatcccgaaaaggagaagaacaaaagcttttaaaaaaactttgatcaccccgttctataccaattgatgtatctttaatggaagagaaccattataaatagaaacgaattaacaccaaatgcaccgtgacacgaaagatattgagtgtaagaaaccccaaattccttgttatattcgcttagaattatttttacagcaccatgtacatgtgatcacaagatatcaattaaagttagctaattaactttatttttcattttttgggctactagtttgctaattaactttttaccgagaaaaaactatcagtagaaagccaaaaaattcaatgaataagaaaaaaaaaaaaaaagcctaaacttacatacatatatgatatatctacgataaatttgctgataaacgatctgacttctaactaagattcctgttttacctattttaaaaaaaaatcgagaaccatgaatcaaagctcaactatgttaatcatgattgaaatcacgtacgttctcgaatgcttaaataaatatgttaatcaataaaccgccataaattggttaaatataaatctacttgcaagaaaattgtaattgaactttattttcaattggtaaaatgttcctttttcacgtacacaaaaaagtgtttgaagagaagcgtgtttgtgttatacggacttacgaaaatcttgtgttcccatttctcaaccacaaaagcctaatttcttggtacctctgattgtatactatcgtttcacaattacagtttcatctgatttcaatcaaaaattacagtctcatatggatcaaatagaaaaataacgagagtctgcatcatcaactcgtgtttgttgtttgtccctctctctgatctttaacggcttttgacgaaagaaaaatatcccgcctaactcaaccaatagacacaagacatgtgtcggcttgtggtagttctatccgtatgaaaaacgctttccatgttaccatccagtgaactcatcccatcattcacttacacgtgttttttcttcttgacgaccaaaaaaaaacaatttggcacatacccattaaaaaaaaaatacttcttatttttcataatacttttcgtagattgtcactgttatgtaactcattcatagaaatttaccgcgtaaattgcatgaaaaatcactagtcttaagaatcacctaatttgtttttctgaacttacaaatattcgcaaattactttcagttaactccctaatacttgggaagaccattgacaatacaaaaaaaaaatcataagaggaggtacagtcacacacacaatattacaacattactaatataaataatcaactttatggtataggttcaaagaaccaaagggatcgcataaatcacgacgctctaattgatccacgtgtcatgataaacataaagtgggacccgtattgaggctgcacgttaacgaagattgggcggcggtgtaatattatattatatatatacatacacgagtagcagagcttcgaaatctttaatctcagaatacaaaaaagaaaatcaaagaagatagttttgtgattgttttctataaaaagtgcagatattttctttgtcctagagaaagaggtgataggaaaaatg

SEQ ID NO: 33174 - DNA, 3003 bp, Unknown; identical to SEQ ID NO: 33173
  misc_feature (1)..( 3003): 2750-1469P.txt file - cDNA_ID_3066416; gDNA_ID_1620500; Annot_ID_158851

SEQ ID NO: 33175 - DNA, 3003 bp, Unknown; identical to SEQ ID NO: 33173
  misc_feature (1)..( 3003): 2750-1469P.txt file - cDNA_ID_3066416; gDNA_ID_2936567; Annot_ID_143724

SEQ ID NO: 33176 - DNA, 3000 bp, Unknown; identical to SEQ ID NO: 2192
  misc_feature (1)..( 3000): 2750-1469P.txt file - cDNA_ID_3066428; gDNA_ID_2936567; Annot_ID_194640

SEQ ID NO: 33177 - DNA, 3000 bp, Unknown; identical to SEQ ID NO: 2192
  misc_feature (1)..( 3000): 2750-1469P.txt file - cDNA_ID_3066428; gDNA_ID_1620500; Annot_ID_158832

SEQ ID NO: 33178 - DNA, 3003 bp, Unknown
  misc_feature (1)..( 3003): 2750-1469P.txt file - cDNA_ID_3066444; gDNA_ID_1620501; Annot_ID_158908
gctctatcaatctccttcttgactgtatacgttttcatgagtttgatactgcaggacaacaaatgcatagcgattgattggcgtgcgactaaagtattggtgtctcttagaagtataacggatcttatattcttcattaacattctgcttcaggtgtgtctccattgctcctatctcatatctaaggaaattcattggctttaacgcttctttggtcttatgtgttgcagtttaggttggcctatgtagctcctgagtctagaatagttggtgccggccagttagttgatcatccaagaaaaattgctcgccattacttccgaggaaagtttctccttgacatgttcatagtctttcccattccacagataatgatattaaggataataccattacacttaggcacacgcagggaagaatctgagaaacagattttacgcgctacggttctttttcaatacattccaaagttatatagactcttacctcttcttgctggacaaacatctactggcttcatatttgagtcagcttgggctaattttgttattaatcttctcaccttcatgcttgctggtcacgctgttggctcttgctggtatctctctgctctgcaggtatatagtagaagatcagtgtctttaaagattctcttcatatctatcaagtgatttaaagattgtttttgttgtattgcttttttcagagagttaagaaatgcatgctgaatgcttggaatatttctgcggatgaacgtagaaatcttatcgattgtgctcgtggaagttatgcatcgaagtcacaacgagatctgtggagagataatgctagtgtcaatgcttgttttcaagaaaatggttatacctatgggatctatttgaaggcagtgaatcttaccaatgaatctagtttcttcacaagattcagttattctctgtattggggattccaagtaagttcatttcaggtttggttgatgttgcagctattagtctttgaatcactctttaactaatgttgaaatgttttcaactctgaaagcaaataagcacacttgctggaaacttatccccaagttactcagtgggtgaggttttctttacaatgggtatcattggactagggcttttgctttttgcgcggcttatcggtaacatgcacaacttccttcaatcacttgatcgaaggtaaatcacatttcatcaacaatgttctgaaaagggatggtgaatttcttggctaatgcatgttctgttttaggaggatggaaatgatgctgagaaagcgtgatgtggagcagtggatgagccatagacgtttgccagaagatataagaaagtctgtgcactgtggcatttgattttctcaggctgtgtaatgtgatattcataactaatcaactgttcaactttttcaggagggtgagagaggttgagcggtacacttgggctgcgacaagaggagttaacgaagaattgctatttgagaacatgcctgatgaccttcaaagagatataagaagacacctcttcaaatttctcaagaaggtaataagcaacagcctcatgacagcattagtcagtattcattttgtgtactcagactccacagtgttgcaaaaagctagttctgaatccaagtgttaatgagtttgcaggtgagaatattttcgttgatggatgaatcagttttagattcaatcagagagaggctgaaacagaggacttacataaggagtagcacggtgttgcatcacagaggtctagtagagaaaatggtattcatagtgagaggtgagatggagagcattggagaagacggttctgttcttcctttatcagaaggagacgtttgtggtgaagaacttctcacttggtgcctctcttctataaaccccggtactaataacatttgagtgttcataactcttaatgttttttggttagaaacttggaactttggagctgaatacgttttgaaacttgcagatgggacgaggataaagatgccaccaaagggattggttagcaacagaaatgttaggtgtgtgacaaacgtggaggcgttttcgctgagtgtagcagatcttgaagatgtaacaagcttgttttcaagattcttaagaagccatcgagtgcaaggagctataaggtacgagtctccttattggaggttacgagcagctatgcagatccaagtggcttggagataccgaaagagacaactccagagattaaacactgctcactccaattccaaccgttaaatttgatgatgatgtttggtttggtagattagtaattttattttgaagtataaagcttagtgattcactataaaagatgaatcgatgattcattcgttgtaatcaattcactcattagtgtttcttaagtatctttttgctgtttttccaatcatacggtataattttacttcaggtcactcggcttgagtaacttgggctcataatttcggcccattctaattgatcttaaattaataattaatcaagcctggataatgaatgatttttgccttttcggtacttctttactgtaagaagttaattaagacaaagaaacggaaacagccatgtagttaatgacattttgcctccaataattagggccaattaattagttacagttggtaatcaaataaaggaattttcgaattcgtgaatattcaaaaggaaataaatgttaaaaacacagaggagagagaagcctcacggacacgaaataataaacaatgtaataaaagtcagtgtttgacttttccagacatgagttttatttacaataatacacttccttgacctgggctacgaagaagaagacccctgacttggtcatcatctcctttcttatttcttcttcttcttatcaaaattactaaaactctctgcttcaacttccttctccgcctcaaattttccctttatgcctagattctagccttctagggtcttcttgaaaccgtgattttggtcaagaaatg

SEQ ID NO: 33179 - DNA, 3003 bp, Unknown
  misc_feature (1)..( 3003): 2750-1469P.txt file - cDNA_ID_3066448; gDNA_ID_1620501; Annot_ID_158907
tccacaatctgtgtatgctgtagagttaacttgcataacattatgctggtcacttttgtagttgaatactgttgaagaagagagacagacttagcaaggtaaatgctgttatgctggaaataacttatcatgttttcttactattgatatggaacagaagactgctgaagaacagaggcagaattgacataaatcatcgtcttttttggtgagatagtatgtatgggattgcaacattggttctgctgtatttaggcatcgtagtacaggagttagaaaaattacctaagacatcgccgacatgaaactctcttccctgtgtccagttggtatagtttgtaaagagttcccagccattgctgtcaccaactatatgctctgttccttcagattttagcatgagagaagataaagagaaaatggcatagagtataatcaagctagagaatcggcttccctgatgaagcattgctatctcttaacttcttgttttctcaatttcttttcagaaatacagtatatttataaagcagtaagcatttgtgggtaggaaggtcatgacattgttgtgttaaccagataagtgagtcatgaaaaccatacatatgtggatcaaggagccacagattgtatgcggggtacaacaaactgtgcatcagggcgatgcactgaaaagcattaaacctaataaggcgatagaacatacacagttatgtatgcattgttcatagtttactaatacagcaaaggattaagctaataaggcaagtcgaaagtgcagcatgatggagcagcagccgatgggttaaggctgcactttgtaaacaggttaatggtgttcagtttcttcaaccacttgaatccaggcttcttctcttcggttttgttctccttcttctttttggtcttatgcttatccaggccaaagcatccgtatgagaccttatcagagacgggctctgagttcctagatgcctgaagcgagtagatgcggttctggagaatgcagaccttgtgaaagtggtcatctctcatcttaagcacacacctagcaagcccaacagcttcgttcttcatgaacaatgcctcagtggctagctctctgttctcctccaagagagaagtgagtttgtagccaagattagcgttttcctccacagccacttctttctccatctccagcaacatgacaaacttcttcaacagctctatagtcttggaggcttcatgaaactgttggtccttgtgaagtaactcgtgtttcagaatctctttgtccaagcttgctgtcacaagttgggatacaagctcatcgactttctcagaaaccgcagtaggatctttcatctgttgaaaggataaggtgctctcaacttcagaactgacctcactaacggaatcaatgtccgaaatgcagtcatcatcatcttggagaagctggttcggaagagaagtagtgggtttaagtctggtctgatgagaagaacgacccaagagagtgacgtagccgttgtacaggtccagacaaagtgagagaagcaaaggtcgtccctggtaaaaccattcagctcgttgagcaaaggtatcatcatctccttggctttcttgaaaaccagactcacgcaggatttgcatccgagcttcaaggtctgtttccaacattttttcagacaagaagtgatgagagagaaagacaaacagagcaagagagagagagaaaaagggggtccactgtttctgtagcatgctttgtgatttgaaaatttgaaaatgtgaaaaagctccaaaaagagagagagagagtgagaagaaatttgaaaatggaaaatgaaagtaccagagagagatggcaactgtggagcttccatggatgctttgttcttcatcttcttcaacctgaaagatatacttgttttagttagtgattcgtatataaaattataaagggaaaatgggaataatggcatagatgatgaagacattgatggcttttccaagaagataataaatgttaagaaagggatattttagatcatcgagattaatgaaggatcggagtggggagaagaaagatacaaacccagaaatagtgagagagagaagatagctgacacgtttgttcagttgtatcagtgcagagcatataacaggcaaaatccgccaaagttacaagcatttgattttgttccactcatattttaacacgtggctttagtacttgggtttggtagttgcggcccattgtttgttgggcttaataactcaaagcctttaggtttttgagattctgacatcaaatttagaaagcaaaaagagggagagagcatattggttggtggtaaatgacaattttatatatccagaagagttcataaagttatgtcatcgaataatgttttcataaataaataaaaatgtgcgttttagaaaataatatttatttcatcgtctttttccataaacgcggatctctttattcacactcttaattattttatcatatgagacaattgcatataaaaaaaaaaaacctgaactgtgtgtttggtgagaattccagtttattctttttcactaatgctcagaaatcatcattcttatttggaaatatgcactaaataaaatacacaatggacaaagctcttggataaagttttcaaagtaacacaagaggcagcttcttgaggttttctctcttccaacttttttgctttacttactactgaggttttctattcctttggaagcttcgttgatgggttcaacacaagatctaaaatgtaacatttcttttcttaaatttcctgcaaagttcgatgtagttcatgtttttttttttccattcttttccttataaagtgtcgtccacatttgcttgacgggatacaaaacgaaacccaagtctctgtcttcgtctccttctttcttcttctctctgtcatcattttgcttttttttcttctcctacatgccctagattttgggtttctgaaataaaaaatg

SEQ ID NO: 33180 - DNA, 3003 bp, Unknown
  misc_feature (1)..( 3003): 2750-1469P.txt file - cDNA_ID_3066452; gDNA_ID_1620501; Annot_ID_158904
tgcctcttctggcattgccttcagcggtaaagaaactcatcttcacattgaaccagataattgagttagaaattgattgtgtattgccatacttttgcttgtgcgtgtgtttgtgacattctgatataaaagtacaaatccttagtcttttgtactcaaaactcaactgctttctctctctttctagttagttatgttaaggtttttgcttaataataaatgcatctacttgggcatatgaaaatatacaggaggttttgggacatacctctttggcatgagtgaacgaattgcgacccaatcaggagatgtatcccgtggcgtcaaggacccttctttgggttggattatcggtttcctctttgtcgtcagctttcttggcctcttctcagttgtccccctgcgaaaggttggtcgcagtttttgtttcctgctttctctcttatgaaccaaaaaggaacaatgagtttatgagatcttgcattgccaatttctgtgtgtttgcagataatggtaatagacttcaaactaacatacccaagtggtactgcaacagctcatcttatcaacagctttcacacccctcaaggcgccaagctagccaagtactaacctttcacttcactttatgcgcttttatgtctttagttctctgcttccttttgactcgatgctgctctctgcatcaggaaacaagtgagggtgttggggaaatttttctctttaagcttcttctggagtttcttccaatggttctttaccggaggagaaaattgtgggttctccaacttcccaacatttggactcaaagcttaccagtacaagtaagccaataaacaatatatgtaacttgaaattatagagcattggcttgaaccacaatctggcttattgttttgtcagtaatcccaatgctcgttcctttctggtgagagcctgatgtagaaacaggttctactttgatttttcagcaacatatgttggtgttggaatgatatgtccgtatataatcaacatctctgtcctattgggaggaatcctctcttgggggataatgtggcccctcattgaaaccaaaaagggagattggttccctgataatgtcccatccagcagcatgcatggtctccaagcttacaaggtaactaaactctccatagcattcctttgttaattatctctatggatcttcctgcttcaagttaatctctctgtactggaccaacttttttccctctttcaggtgtttatagctgttgctataatcctaggagatggcttatacaacttttgcaaggtgctgagccggactctttcaggattatttgtacagctccgaggccctactacatctatttcaagaacctccttcacacttgaagaagaccctcatgcttccccactaagcccaaagcaatcttatgatgaccaacgtcgtacaagattcttcctcaaagaccaaatccctacttggtttgctgttggaggttatatcacaatagctgcaacatctacagcgatactccctcacatgttccaccagctgagatggtattacattctggtcatctatatctgcgcgcctgtcttagctttctgtaacgcttatggagctggactcacagactggtccttggcttcaacttatggaaagttagccatattcacaattggagcttgggctggctctgagcacggtggtatgctggctggtctagcagcatgtggtgtcatgatgaacatagtctcgacagcttcggatctaacacaagacttcaagacaggctacctcactttatcatctccaaagtcaatgtttgtgagccaagtgattggaacagcaatgggttgtgtggtatctccttgcgtgttctggctattctacaaagcgtttgatgatttaggcctcccaaacactgaataccctgctccatttgctactgtatatcgaagcatggctaaactaggagtggaaggtgtcgcatctctaccgagagaatgtcttgttctatgctacgcgttcttcggtgtggcgattctcgtaaacatagtaaaagatagtctccatagcaattggggaaggttcattccacttcccatggcaatggctataccgtttttcttgggaccttacttcgcaattgacatgtgtgtgggaagtttgatactttttatctgggaaagagtagatgcagccaaggctgaagcttttgggacagcggtggcttctggtttgatatgcggagatggcatttggtctttgccgagctccgtgctcgctatagccggagttaatcctcctgtttgcatgaagtttctctcttctgcaaccaattcaaaggtcgacaacttcctgaaaggatccatttaaaactcaaataagtaacaacatctcaaccatgtgaaagtgtaatgatgcttcaattgttcttttaccattatgacgattttgaatgtaactcgtatataaagatcttagatatgaaagggctctgattgatgattgtcaaaacagtttaaaaccgcagacttacgtggggtaagaacacaaaaatagatttttgctgtaaccctttaggctcagacgagagaagatgctaacctgagctgaggaaaatgaaggtaaaggaggggtttttggtgattcgccgattgtgacgccggtgataggagcgattagcaccgagaagggatgaaaaaacgattctttcaattgggttatcgaaggaatcttcgtatgagcatagtgatcaagtcgggttttcgagagctagggatttgaatttattgctttgctttgactccatgttggattaaaaatagagagatgatgtgtcgcagtgacagatataaaagggtacgagaaaccgtcatttcttttctctcctctccttcaaatccgttcttccttgaaaccattttggctctctgtttacaaacttggtttgatttttcaattgcctctgtttctctctcattctctgattcatcttcatcagaatg

SEQ ID NO: 33181 - DNA, 3000 bp, Unknown; identical to SEQ ID NO: 2197
  misc_feature (1)..( 3000): 2750-1469P.txt file - cDNA_ID_3066459; gDNA_ID_1620501; Annot_ID_158896

SEQ ID NO: 33182 - DNA, 3000 bp, Unknown
  misc_feature (1)..( 3000): 2750-1469P.txt file - cDNA_ID_3066470; gDNA_ID_1620501; Annot_ID_158887
ttggttcaattcacgtggtacttcccactctcaaaaatctcattcttgtcttctcttcccttgccacgtcattaaatatgtgcttaatttctatatcaaggttttacaactttagaaaaatcgaaaccgtattaaattttgttattttctgaatggaccaaattatgttattacgatagccacttgaccaaccagaattggtattttaggtggacactacatatcgattttgcgtatctcaagccgtatatgtggtgcgcttatttaacatattatataatatgtttagatatatttggaacaatatcttctgatttggttttatatattactaaaaatatataagtttgttaacggaaatattaggttgtgatctttcgaacatatattgtcactgcataaatggtataagtttgttctagtcggattaataatatcgtaatatcattatgaaattattagactaatgcatgtagatgtttaaagacgatttttcatgtatattttgactacgcaccatttgcaatgtccaaacaactaagtagaagttaagatgtgttttcaattcttaaatgttatgagaatcagacaatctattggctagctatgagcattaacatgagttttggcacgaaatttgttatgaaaaaacaaaacttctccttttaaatacttcattaattgtttaccattaccattgttgatttggtacatatgatttctcgttccatcttgggttaatatctctttaattaatatgttttagggttattgggctcgtatatgtagtgagagactctacataggaagctagagttgtaacacgtagaatcaaaggctaatattaatgtttcttaatcaatggttaatatctctttagtttaacattaaaagagcacgagcaaaagaatataacaagagaaaattgtggtataaaatatttgcttgagaaagtttatataaccacgaacgagttactcttttatttatttaaatttatatatataacacacctagtcatctacacacaaaagagagagagagagaggttctgataacatagatcaatcaatatgttactcactgccggcagcaatactatcaccggccattttgacacgtttgagagactcgaataattttaattattggttttttctccttttctatatagtatctattcatttcagccacatcatttactaactacaaattttaataaaaaccttgggaaaaagatgtgtagagaaacatgtgacatatgaccttttcattaccaaaaatatgttgggacgactgacgagagctaagaaccactacattcttcaataatctatgtatccaataaaaagatataatatggagttttccaaattcaagagattagcctggtgcccaggccctggtttattgaaacttttggattctcaaaaacaatttatttattttaattaaatacacaaaccgcataagaaaaacaaatataaattgaatggttccatgtgatttaattaattgtgagccgacaaaggacgagacatgaaatatagtataaattaccatagttttttttaaaaaatattaactttaagtgtatcattaacgattgtgtttctaaacgcttgcctatattgcgaattaaaaatttgtaaaagtctacaactaatattattagtctacaaagacagaaacaatataaaactgaaagcaccatgtttatttccccccaaaccgaaagcactatcgtaaaaaagtgttttaaatctaattatcaattcatgcacgatatcgacgtatataaatggtttattaccaaattatctcttaaactgaaaatgccacgacaatgaagacctactgtctatgaaaccaagtcataagttcaaaatttccatagaaacgaatgggttatgaacgcgttgtttaatttgttgtagtgtgtatatataacttgatcttaagtttaggtctcttttgatctcctcttttataacaaaggtacaaaactaaactgtaactttaagaaatcatagttggacttcaacttttaagtaactccaacatgaaaacttggaaagtatgtgattccttgtgaacttttatgtgtatacaagtttgtttctacatttaagaactaaaatccgaaagccaaatcaaaactgctccagtaacaagaactataaaactgcaagcaccaatctttttgtagcgtttctttctgactttaaaccaaaagttcttatgaatatattttttcatctattattatttaatttcaacataaaactaatgcaacaaatgacgtgggcctattgatgcatacaagtacacacataaaatacacacatattcgcaatatacatcatatatagaattattctgataaatcaatatactctttgcgtatattttccatattttgattgttgacagaaataagatcctttttaaatttctccttataatgaacatagacataatttcatttgataggagttttatttgaccaataataataaatctcgataagtaccctactaaaaaaatcttatttcgataatatcaaatcttatatggtttgttagattaatctttttcttttgtgaagattaatatgtttctagttatccaataaaaatctggctaacaaaaaccaaaaaaaaatagttaacgaggaatatatatataaaaagaagtgaatataataagaagagaagaggaaacaaagagaagtagcgtcctctcttcaatttcaaccggcactttcttctcttcttcttcttcttcccaatcttcctcgtctctttacctacacctatatatatatatatatatatatctccttccctcacacacatacctgcacagctacaataatctacttcccctctttcaataacggaattaatagtaatctaatcggaagattcaagcgagaaatcgatttggttgtctgttaatttgttgggaaataaattgaaataggagattgattggatg

SEQ ID NO: 33183 - DNA, 3003 bp, Unknown
  misc_feature (1)..( 3003): 2750-1469P.txt file - cDNA_ID_3066474; gDNA_ID_1620502; Annot_ID_158939
tcaatggcggtttgatcagtcttgtccatcttttttttttggtgtttaaggatagagagatctttgtctttgtcttttataatgttaagtgtttaaagtcataaacgacaaaacagtcgctcaagcattcaatataatcatgtgattatatgacgtcaccagtctcaattttaggtgactctttttctctattttaatcatttttttttccaaatttggtattacgtaccagaagtaaagagatgtgattaggccttcgtaattaatgatataggttgtctgtttattcatttatgattttcgggtatggactattttctctcaatccttgttaagaaaattcattcacatgaatggtctaatactttttgcacatgttaggaaggaccgtctgcacaagcagagactcccatccatgttgacatctttacctaagttatttcaagaacattatgtacgcttaagtctactttataatagtaaatgacataggataggacgaccatataaatatttattttttgtttttttgacaaccgtcaagacagaacgaatagaatctgaatagttgaaatgtgaatagtattgaattcgtaacactagttatcgcatcaaaatgagatttttagtatcgacctttgcatattccacgcgtcacctctccaagcagcatacgagtatcaaactatagctacctcgtgactaaaatttatgggtattgagaaaataaaacaaagtaatactgttagatatatctcaactacttttgttagcagtacaccgtatatatacatgtttttgctaaagaataacaattgacgtactaattttacctcattaatatatatggtgaaataggtgattagtatatttacctaattcaccatatatgaatatggtggcaaactgagatataagagggaaggtgattttcatgcaaattttttttttatttttttttgaatgaatgcaaaatttattcaaaaaaaaaaaacctgggctacatcaagtacttcatttctgagtttttgaaaaatctaaagacaacaaaagactttacaatttaataaaaaaataataaaaatactttatcactctcaacgaaattgttgatttaataacgtatctcttggtaaaacagcgttttatttgacgaaattgttataaatgaataaaatgataatagaaactagtgtggtacgtaaaatacctctcatttggcaaaataacggttatgtatcatgagtattgcatacgacagcgtgcttaaatagtgtgctttcaggagaaaatatataccaagttatttgctgaaattaccacgcaaatctgaggttcgaatggcaaaataaaaaaccaatgtcatttccttaatgtattaaggtcatttaaataaaattgtacacttttttcacctgtaagcgttccaaagtgtagaatggataactagaagggtcaaaggtataatattaataagcgaactcactttttgcccaagtgatttcacttcttacatttgcttgatatagttacccaaaagtgtatatatattcccttatacaattgttctattttctggattataaggggaataagaaaaaagaaaagagagagtatataataatacttttataaagtgatgttagattctaatttgtaacgaaaagttcaaagtgaaagaaaaaacgaaaaagtttttctgttttgttttatatctatagccaagaaagtttctcagatttacaagaagttaactgagaaaaacaaaaaaaaaacttatgaagcatgaaagactaattaacgaggtgattaattttgagacaaattaaacatcgaattaaaagtaacatttggagggtttatatgttatatatgtgacatgataagtccgattcatgactaatgtatatctggaatctaacatggaagaatagagaacgaagcagagccaaggtcaacttgccagacacgaatcaacagattgtgaatgagaccaaatcaatggtcataaaccggttgggtttaaaccggcaagtcatccttggctcaattccattcgttattccttcatgcaagaccctctgatacaaccaaagactcccattacaatattctttcgatcacgagctacttattttcaaatgtgttacctctttcgtgactcttgtgttgtgtggtaaagcctagtcgagatgtgtcggtatatataggcatacatatacaaatgcgacaaaataagtatattatattgtttaatttctatattccatttctatatgcatggctgggatttttgaccaaaaccctaattcaagaatagaatccaaaagatgggatcaaagaatataatctaatgggctgaccacattttccgatttaattcgcatagttaatattctttccactactttatgccgcagaaatttgtaattaagtaagacaaagaaatacagatataagatggtcgtagaaaccagtagaggaatttcatttttcgtggataagtggaatattaataagagaatggtctttactctttacagtgggaaatgggaatagtagcccattataatttcatcagattctatatatgcatgtttgtataagctaaaataaatacgtttaagcattcttcaaaaaaatttacaagttctagagactctcttaacgtcggcaatttatattctactttacatgacactttcaggaaaagaaaactatactcactagcagatcattaaattttctttttctttttttgaatgaaccttagttgtggtttttatttttgttagctagaaacttcagtgttttttttccgccaatggtagtgctttgatgatggtccggcccaattcatagaaggccttgaaaatgggccagaccaattcagagacccaacaagctcgactgtatacacaaaattcacaaaaacagcttttgagaagttttcttcttcttcaccttattttcgggtatcaaagccacaaaaccctgagaatg

SEQ ID NO: 33184 - DNA, 3000 bp, Unknown; identical to SEQ ID NO: 2209
  misc_feature (1)..( 3000): 2750-1469P.txt file - cDNA_ID_3066477; gDNA_ID_1620502; Annot_ID_158929

SEQ ID NO: 33185 - DNA, 3003 bp, Unknown
  misc_feature (1)..( 3003): 2750-1469P.txt file - cDNA_ID_3066481; gDNA_ID_1620502; Annot_ID_158926
ggtctcttagccggtgtaaaaaatggggagctcaaggtggcaagagcaatgtcttctttgctaaaaccctggacgatcgatttatcatcaagcaagtcaccaagacagagttggaatcattcatcaaatttgcacctgcttactttaaatacttgtctgagtctatcagcacgaaaagcccaacctgcctggcaaaaatcttgggaatctatcaggtacgtaactgctaagatgagagatttcccgttcaggttagattcactcttgataaaaatatgtcttgtgttaataggtcgcaacaaagcaacttaagagcgggaaagaaacaaagatggatgttctgattatggagaatcttctgtttggaagaactgtgaaacggctttatgaccttaaaggatcttcgcgggcgcgctacaatcctgactctagtgggagcaacaaagtcttgttggatcaaaacttgattgaagcaatgccaacttctcccattttcgtcggtaacaaagcaaaacgattgttggaaagagctgtctggaacgatactgcttttcttgcagtgagttttattcttctgcaaaccatttactcttcactactctttgaaaaggtttattagcaataactatatttttcgtgtttgcagttgggtgatgtgatggattattcattgctagtaggcgtggatgaagaaaagaacgagctagttctcgggattatcgacttcttgaggcagtacacatgggacaagcatctagagtcttgggtgaaatttacaggaatcttaggaggaccaaagaatgaagcaccaacagtaatctctccaaagcaatataagagaagattcagaaaagcaatgacaacttacttcctcatggtccctgatcaatggtctccgcctaatgttgttgcaaataactccaagtctgatcaacctgaagaaacctctcaagccggtacacaagcagagtgatacaagaatcattataatgtaagtttattttttggtcttgtatagatttttggcatttgggaacacattattattcgttatttctttctttattggaaggttgggtttctgtcagatatcgattttgtttgcgtcttttagattttgggtcgttaaagtagagacttaggagattgtctgaaaaattcctcagaaagatagagagacatttctcttgtgtatagcttttgctttaatgtgacatgatttatgaaagattcttttgtttatatgttggatcctcgtacccttttttttggtgaaagattgaaatcaaaatctggacgtaagtttcttacaaaagagaaacaagaaagaagcaaatcgctgcttctttcatagccttttttctgtacattcttattcaagaggcctttttgaagagagaaccagattttgatgtttcgatgaagaaaaaagaaaggggatttagaggaagtcaaagctgctccatttgatcatcatgaactcttgttctgaagcaattatcggtctttgaccatccttgtttgaatcgctcagctcctgataacttctttgcagaagatcaagaatctccacctctctgtttttgataccaaatccatttataaaacaaactttgaaacaagatcgatctgattaagaatttaggttaggattaggaatatatcataccttgagtaagaagctaccattggactctgtgtgggacaacgaggaccttcatcgtatccttcacatataacctctccattatcatctgtgtaacagatgatcccttgtatcggatcttcaaaaacctgttccaagaaaaacaatttcaacattcatatttttaccaaatggttgtgtctgaattttcaagaaaattatgatccactctaaggagaaacaaaaagagagagatgatcttacaatgttcttggtggagtatctgatcggctgaggctgtgaaactgtggctttcttgactttaacatgaacttgactctgttgaagcatcaaagtctttgctcttactgtctttggaacaaaacatggtgttttaagaggaagataaagtttagttgaatatgccatagcttttgtgtttctttctttcttcaagaagaaactttgatctcttctttttggacaactcgtttggtttatagttctcagagaagaaaattataaattccgatgattgattgaatctgagtttaattaagatttttttttaagtcaattatatatagacgcaaggtgaagataaaataatagccaataagagtggcaatctcattaacaagtttggttgtctttttcgtggggtttggttagttcttctaatggtttcgtttttcttcttacgtttgatttttgatgaacgtcaatgtgaaatcgttgaatatatctacacatatacatgtgtatgtctagtcaggtgtatttttattacataaatttttataaaactattattgggatttcttactccgttaatgtttaaaaaatattactaagaaaactacttagattctgtaacacttatatttgagaaacaaaatgagttttataacccgattctttgacaaaataatatgagacaaaaacaaataattccccaactgaaatagtttatagacttaagacattttaccttccttctgacctaaaaaggtaaaaaagacatttgaccttccatcgaaacaattaatctgtcattacattaatttcaaaaacttgcgtgctattagttgcacttgcattcaaccaattttttcgttatgttgagataatattaatattagagtaaaagaaaaactaaacatcgagcaaattagttgttacagtgcttatctgccgtccaatgacgaattaactcctacttaattaaaccgtggcacgtgtcgatatatcaagcgtcatgataagcttttaggagcatttttaattgcaaaatgacaataattggtgttatattattgctatgatttagacaagagactaattgtaggctaaacatg

SEQ ID NO: 33186 - DNA, 3003 bp, Unknown
  misc_feature (1)..( 3003): 2750-1469P.txt file - cDNA_ID_3066485; gDNA_ID_1620502; Annot_ID_158924
tttgtgtttgttgtatataaggaaaccttgcatccaaaatcaaatcatgaagttaggctaactttttagctgtcaatgattgcaatttgctcctttgtttgccttctaacataatacggttgaccaaaggcgtgtttctgattttaaaacgatactatcataatatctccaccgtatttttaaacgattgtataacataatatctccaccgtatttttttgtataatttctaggtttgtcaccttccaccgaattatttttattttgtatttccaaatgtattaaaatcttaataaattcaatttgggttgatatgttcgacttgaaatagatactaattagtagtaaaataaaggttggttgaataaagaaactgccaacggaaacggaaatgactagtggatttttttgttaaaattttaactagtaatcgagaataagtaattaggagtgaaggaatgttctttgttgataacgttcttaaataaggccctgttcgtttgatcagtttgatggatcatctggatggagatgagttttgatgtttgtttggtgccaaaaacgggagtttgaaaatttagcctaaattttcaaattcatttggctgaactaaattggatcatttggatggaaatgattcagtcaaaaataacaaatgacaaaaatatcctaattatttcaattgattatttagatgtatttttagatacaaaaacaaatagactaaatcttcttttacaattattttttaaaaaatagaaaaattaattttttctctaaaactgcaaaatcaaaattttccgctaaaaccgtaaaattacatttttccgccaaaaccacaaaaatcatatttcccgcaaaaaccgtaaaatcgtgttttcccgccaaaaccgcaaaatcacgttttcccgccaaaaacgtaaaattttattttccgccaaaactacaaaattctattttcccgtcaaaaccgtaaaatcatgttttctcccaaaaccgcaaaattacgttttcccgtcaaaacctcaaattcacatttttccgtcaaaaccgcaaaaatcacgttttcccgctaaaaacgtaaaattttgttttccgccaaaaccataaaatcgagttttcttgtcaaaaccgtaaaattacgttttcccgctaaaaccgtaaaataaatttataaatgtaaaaaattattatttaaaatttatttacttttaaatatattttagattaagaattaaaattaatatgtttacaagtaataataaaaatataattagatgaaagtatgggtattttaggtatttggattattacaaatcatttggatggagagtagagataagcaaacgaataacatctcattcggatgatccaatcaaatgaaccgactaaaaataaaataaacaagagtcggatgaatcatccagatggacatgttgaatggatcagttggatggatctgtcaaatggaaatgactattggaattttttgttaaaattttaactagtaatcgagaataagtaattaggagtgaaggaatgttctttgttgataacgttcttaaataacttgtgaaggaagaaagacacataaacgtatttggttggcttatggaaacaagtaaagaagtcacgaaagaactaatcaaagaaagcaaatgccgtgtccgtctcatattcaaaaaataaattaaaataaaagagtgcatgtgattgcaatctattcgtattatcatgtagatctacgatagtatttttgtttttccattacaaaatttgatattagcgattccatgttttgggtgttagaattaataatagtattagtatgataacatctcaataaatgtaactagactgcacatatattgatgggatcagtttaataaagtttaacatatctatatttttttcaagaatttttgtaaaatgaaatatatctttcatatttaatttttccaaattttactcgattttctttctaagaacaaaagtttatgatttgatttgtatgtatttttagaaaacgcgtttataaattcacaattatggaatctctatagtattgttgggtccatataattcattccacgggccaaaaagacataagttacgcaaggggttaggattaggtacatgaaggtgtatgttaagatccgtgagacacagataattgacgtgacgatgtcgctttctctgccacagaaaaacatgaatatcatatcagtcaatacctccaaatttttgtttttttaatttttttcaaaaaacctgaaaatcaaagggggaaaaaaatccctcaaaattcgagtattgaagaacgacgacgacgatcttctgggtgactcaaaggtttcagctcaattcagatgattttttgggttgaagatatttgaaacgattcgccttcttttggaatttggaattttaaaggatttcgattttgatgtgaattttgcacatgatcagggactgataattattgggttttgcttgattttgattgttcatgaacaaaaattctggaaaagatctagcttgttcataaacaatttttttagaaaacagaacaaagttttctccgatcgctcctaaaattgtatatatacttttctgattcgtgttaatctggtgataattgaattagatcgtcataaaacacgtcttcttgttgacactgattttagcgtttaatttttattttttttcagtgagaggttaagctcaaggtctctggattgcttttgaatttgcatgctgttggaggatgatagaccatcggtatgtgcttgagttttctcgaggaaggatgaaccgatacgagccgtcttattgattaattatatatatgtagtggagtgcctgaaggagatatatatatatatagtagcagttggatattagggttttcatttgttaggtgtgagtttcttttgttgttgttaatttggattctagacttccatgaccatcgtagcatgatggttgggaaggttttagatg

SEQ ID NO: 33187 - DNA, 3000 bp, Unknown; identical to SEQ ID NO: 2199
  misc_feature (1)..( 3000): 2750-1469P.txt file - cDNA_ID_3066493; gDNA_ID_1620502; Annot_ID_158918

SEQ ID NO: 33188 - DNA, 3003 bp, Unknown
  misc_feature (1)..( 3003): 2750-1469P.txt file - cDNA_ID_3066520; gDNA_ID_1620503; Annot_ID_158957
atagtttctcgtttagtttagatatataaatacaaagacttgagacgacttctaatactccggcaacgatgattaataccgacgataacttattgatgatcgaagctctcttgacctccgatccgtcgccaccattacttccggcgaatctcagcctcgagactactctcccgaagcgtttacatgctgtgttgaatggaacccacgagccctggagttacgccattttctggaaaccgtcgtacgatgacttttccggtgaagcagttctcaaatggggcgacggagtttacactggtggcaacgaggaaaagacacgagggaggttgaggaggaagaagacgattctgtcgtctccggaggagaaagagcgtcggagtaatgttattcgggagcttaacttgatgatctccggcgaagcgtttccggtggttgaagacgacgtcagtgatgacgatgacgtggaagtgacggatatggagtggttcttcttggtttccatgacgtggagttttggtaacggatccgggttagcgggtaaggcgtttgctagctataacccggttttggttaccggttcggatctgatttacgggtcgggttgtgatcgggctaaacaaggaggggatgtagggttacagaccatcttgtgtattccttcacataacggagtgttggagcttgcatccacggaggagatccgaccaaattcggatctttttaataggatccggtttctttttggaggatccaaatatttttctggagccccgaattcgaactcggagcttttcccatttcagttagagagcagttgttcaagtactgtaaccggtaacccgaatcctagtccggtttatctacagaaccggtataatttgaacttctcgacgtcatcttccacattggcgagagctccatgcggcgatgtactgagttttggcgagaatgttaaacagagttttgaaaatcggaaccctaatacttattctgatcagattcaaaacgtcgtccctcacgcgacggtgatgctggagaagaagaagggaaaaaagcgcgggagaaaaccggcgcatggtagagacaagcctttgaaccacgtggaagcagagaggatgagacgtgagaagctaaaccacagattctacgcattacgagcggttgtaccaaacgtatcgaaaatggacaaaacgtcgttgctcgaagacgcggtttgttacataaacgagctgaaatcaaaagctgaaaacgttgaattggagaaacatgcgattgagattcagttcaatgaactcaaggagattgcaggacaacgaaacgcaattcctagcgtttgtaaatacgaggaaaaggcatcagagatgatgaagatcgaagtgaagattatggaaagtgatgatgcaatggttagagttgaatcaaggaaggatcatcatccaggagcgagattgatgaatgctttgatggatttggagttagaagtgaatcatgcgagcatttctgtgatgaacgatcttatgatacaacaagcgaacgtgaagatggggttgagaatctacaagcaggaagagcttagggatttgttgatgtcgaaaattagctgagagtttctgcggtgtgttttgagaaaattaatcatggggtcaaagtgtaattaagttttgttgattttctcataagttaatggccgttttattagattttggataatatacagttctaatcttgtgacccaaaattagggggacttattgcaaatggtcaaccctggaatgaacgagatgaacacaaacacaaatggtgcttgaattctttttttttttgtttcctcttgtttgttcatcttactaacatgaaaaagatgaatatttatattttgcactttcagcccaaatggtaaaaatttgggttgaatatatttttgagaaaaatccaaaaaaagattattgcacgtttaatatccaaacttttttggttggaaggaaaatatacatagtttaattaaaacatataatttaatttctacaattttactcaagatctaataacaaaagcaaaattctagttttactcttaccatctcaattaatttataattgacatggtatatttgatttgaataaaaattattttttgttgataggttgtttttattaaaattattttattttgactaccaaaataaaaattagaagaaaatctttttaaaaaaatcttcaactttccttttttaaaacacaccctttaatagataaaattagggtttttggaatgaaatgttgaagaagatcaaaaaatttagattttttctatcccaatttaagtgggtgagtaagacaatacatttcttgctatccttttgtttttaattttcaaagaagaaatttaaagcatacatgtatcttaggtttaaaactgatcttgttattatatatagtttcaaaatccaaaacacacatcacaagcgagatattcttcattaaaagaaagaacaaataaaatggagagtagaagatcttcctatgcttttgtttcggttttgatccttgtggtgctcttgttttcagggtcaaacttgttgttgcattagaggactatcatcatccacaaacacttaattgaacaactccgtaaggttccaatttgtatcattaatgtgtgatgtgtccaactcctaaactaaagtctcaataaaataatggagttatcttgcttactcgtacatgtatggaataatggtgtagtagtgactgatgagatttacaatgaatcaattctgaaaccaaaaagtgattcagcccaatgatgtgtgttttaaagcccaatgactaatgggcttatttaacccaaccaaataactaatgggctgaattcggatcatttaaacccgacccggtatcatctctatggcgctctctggttaaaacatacaaacttttagggtttcttcaatctctctctccctctttcttcctcttctctcattgaaatcgaacgaggatg

SEQ ID NO: 33189 - DNA, 3003 bp, Unknown
  misc_feature (1)..( 3003): 2750-1469P.txt file - cDNA_ID_3066605; gDNA_ID_1620508; Annot_ID_159045
aaaaaaaaacctaaattttataaaccataaatttgaatgaaaattacctcattttccttcctcacaatagagattatgagctggaactcctattccactaatataagctcttcacgatagatgcttatggaacattgtcgtcgtgaaagaaaaagaaagaaaaaagaagaaggtgatttaagacgacaaaaacgacgtcgttttacaaaaatttgtttgtctcttctttcatctaaaacgacgtcgtgtcatacgtggcatccacgtgagcaaccgttaacggtttcgtaacaccgtcacggcttaggcatgtattgacatgaatggtgtgagtttgggatttgaatttgaaaatttggtttgttaatgtatggatttgcacaacaacaaacgttgggtatgaattgaacatactactttagctggggtatgaaatgaccgtttttcctagcataattagtcctaaagatgaagataagataaaattgttagtattaatgaatagtcataactgataaataattgtatgcgataacaatttgctaacaattaattgtagttgaacacaagtaaactgacataagtataaattcgtttttttgttttaacattttacttgcaaaaaaaattatttatggtaacaatttgaactatgatacgtccttagctgccagtcggttgagcaattttttttttttttttaatatcaggaggttctgaggcgaaacctgtaatttccctaaacccaaaactaaagtatgtaatattaatttcatctcaggcgtcgcagtcggttaaacaattgatacgtcagtatttgattttgaggtggcagctttcatgcatctaagagcaacctcatcaatggtttctaaacttaagtttcttattttaaagagataaattttattataaaaaaatgtgtgagtttcttgattaacaagaaaccatctccaaaataccttatataaaaaaattttaagagaatttctaaaatatttaagaaacacacataattaaataatattatttttgttgtttcaatgttaagaaacttatatttagaaaccaccaatgaaattcctataaagatgcaatccctaaaatcttgatagatgtaatgttactcgatagttcccgtcatgtcaaaaatattggtggttcgtaactaaaaccacctgacatatatcttatcgtttgacttatcataggcatgaaaacattagaaaaaactcttggaaattataagttctcttatccattattgtctatgccacacatattaaatactcttaagagtttttgatgtgcggatcatttgattgattgaccaagaaacttaacacaacaagtttaaagagttcccgacctctatccggtacgtcgcatgagggtctctccccacaaaattcactatcaagcatggcccatgcttgcatgagggcttgaacatgcgacatagaaactagactgatcgcgtgactagcccccttatggtatgtaaaccatcactaaagtagtgtggtaggtaaatttcgatatatttttccttagttcatgcatctaaaacatttgaaacaattatttttacatcgtgaaatcaaaacgtagttattgtagaaatcggtacacattaattttaagtaagagaaaaagtcgaccaaattagcaaattctattaattattatcgttcaaaaccgcttcaaattcaaaaagttccatatgatgttacgtcattgtgtgggacaatgcaaatgtcaacaactcagagtgaacaagtcgccttcttcgccaacgcgctcacataatttgtgtaatattttatcttagtgtttctagaagcttgactcgctcgcatattgcaattctaccaaatcatatttttattttaatgaaatttctatgattttgacaactaattcttgattttgaccttactatatttcttgtagaattagatagggtgcaattctcatagaatgtttctttaaatttatttctaactaatattaaaaaaaactataatatattcggatttagtcttaagaagatttaccgttacttctaatgatatatttgaatatttgatggcaaatcgaattcaaataaccaacaagttgttggtccaataataaattttttagataaaggtattgagttttagacacgttgggagagatttcttcgtcaaataaaatgaatttattctagtgtgggtctcgcatgtaggaaatgtaggtcttttaattttgaatttccaaatattcaaaaaaaaaaaaaaaaaaatcgaattcaaataactgaaaattagtgtaaattatataatagactatctattagtttctttgaaaaacatatagtatagtaatagacattttgataaatcttcatcttttacatttctaagtatccaaatgcttttccaaaccatatgttttcgggcttttttttttttatcaattcggtaagaaacacattgacggcattaattaacataaaactaataaactacatgttttctatgtttttttgctaatttttcctaaagctaatccattagaaaattttactattctaactatcattgtatgaaaaaggtattatctaattgtattcacaattctataggaaaaaaggttaacatgtcattttcttctcctttttagccgtccactcacgactaagaacttattcgtctaaacatgaattacatgacaatgtcaaagcgtggttaaaacttcagaaagaagtataaacctacctcaagaagtcgtcgtcctctttctctaattaaactattatttcccataatagaaaacactaattttttgcctttttggtaaggaaagtaacatagttgttagtaaatatgaattaggaaataatatacaaagtcttggtcctcttctcatcgactttaaaatctctttctcccattacaaaccaaaaccattagaagatttcgaaaaagaaaaaaaaacacctccacaaacaaaacaatg

SEQ ID NO: 33190 - DNA, 3003 bp, Unknown
  misc_feature (1)..( 3003): 2750-1469P.txt file - cDNA_ID_3066632; gDNA_ID_1620509; Annot_ID_159058
tatacaagaaatgagatcttcctcgagaacaaatgactgttgaagtcagcccgcatggagcgtgttatggaagttattgtcactgggagctaaactttcttcatcatggcggggtaaatggtggatgacttgttcaaaaagaaacataagagaatgcttggggatccgcacaatatcgtattatgtttttaagaagaaagataattttgtttgtttgagctaagtgggattaatcgagagaatcactgtttttctattagctaggttggctggttatagaagacaagttatcatcgagcttacacttcagcttaatcactgcatgtacatggagcaacgaaagtatgattaaagagttttataatcttaaagtaccacaagtggtccaacctcgaagaaatatgaataacacatgaagtatgaaagaacatataagcaaagtgaaaaggtaaatttgggattttgcgattaaaatacttgaactggccaagtaagctaaaggctaactaaacaacaaggcaaacgaaccaactaaacaataaaaaaatgataaagataagcacaaaagattaatcaagatatatataacggagcatgggtaaggcaattgataaggattgattactagctagtcaatcccaaatgcttgaaccacacaattatcaaactcattcttaagattttataggatcataacatgaatcataatatttatatctgtactttgagtaattcatttgcatgcatagatattgggccttaatgggctataacatatatcaaacaagttggcccaaatgcaaattggctcacttaaaaagaagaattacgagctctatggtcagagtattaacaaaacccattctttaacatgttttttcttctttgtgtggcttttgttatttggttacgtcttgcatgagctccagttttcaagtatttgtgtatctccagttactaataattgcagggtgtttactggttgattattggtttttcagtattcatgtattttcgggatagatagctaatcatatattatatactccgatcaaattatgaatatcgaatttgtttataatattatcgataggattaaaatattaataaaggtaaaacagttttatgaatgtatatttttgttgcttagttactaattcgtttgtgtctctttttcctcatgcatggaagtttttggattagatatggaatatgaaatttttattgatggtggctcaaaattagcacttcaccaaagaactacgatttttcgcagttcctatttttccggtttatcatgctgttttttttatatatatccgtcgttttataacttttgttttccttattttatttatattatatcttatcggttgatccgatcagcttacaaagtagattacttttgatccaaatagaattgagcaaccacattgtttgatctgagtttggaatgtcttccgactaccaaataaattaattaggtcaaagtacaacttacagatttccaaaagtaattatgtttttgtttacaaagagaatcgaattcggatatgaaagtttcacctttcaccaaattttcctctaccaatagaccataaaagctttggccaaattattttgtaaccgagttcgaaaccttggattaatcaatgcccaaatatttgggttgtataccgttcttttaatattaatgcacctgttaaaatatataaaaaaattactatttttatctattaagagaatatatgacgattgtcaactcttataaaattttggtagagaatattttgaggattgtcacaacttttaatactttagttgatacataatttagatttttaataaggttatcaacgtcatcaaaaaacaaaagaccaagctcccgtaaaatcgttattctatatcaatctcaaacataaagaccaaacaaaagaccaacctctacactattaatcaatttgttagttattctatatctatctcaaaacaaaatatacaatccataaaatcatacactacaaagttaagtctttttgtttgtatttttttttcatttactaatagcaagttatcatttgtagatagagagtattgaattgtattgttaatttgttattgttgtattattgaatgaacgtcttttttcttctaagcaagttatcatttgtgaatagggagtattaaaccgtattgttattgttgtattattgaataaaagggtacagcttatatataagcatttcatattattgaatgaaagggtacaatttatatataagcatttcatattttgtccacataattggggtttagtggtggttgagaattagagaaatattgaaagaaactaaccctggtttaataaactttgaaacaaaaaaatacatgtacgagaagtttggatttgggccaaagatccaaacagtttacacggtaatcagtaacatgcgatctgactactttctaacgttactcagaaagtattccaaatttgggaaagacattatagtggtcttttaggcagaagtctactagacttttttcgcttatttaataaactctagactctccatatatagtcttcactaataaaactcttgcaaatatttaaagttttggacacgaataacgaatttaatatatatattttaatcaagttcaggaacgatatatatatttataaaccctgatatattttatatatttggttctccgattgtaatcagtatgttgaaagaacacaaagttctcaattcaaatgagtcttaagtcgacaatttttttgattgaaaataattttttatgtaagatgtgattctttggctttgcttatactccaacgagaagtaagagcatacaaaaagtaatgatcgaaagcgaatgaaagacaaacgaagcaacacctctttactcattctttatattaatacctctcaggcttcttcacctgttaacactttttcttcacttgcctacagcacctgagctctcttaaaaatg

SEQ ID NO: 33191 - DNA, 2600 bp, Unknown; identical to SEQ ID NO: 2241
  misc_feature (1)..( 2600): 2750-1469P.txt file - cDNA_ID_3066643; gDNA_ID_1620510; Annot_ID_159105

SEQ ID NO: 33192 - DNA, 3000 bp, Unknown; identical to SEQ ID NO: 2242
  misc_feature (1)..( 3000): 2750-1469P.txt file - cDNA_ID_3066654; gDNA_ID_1620510; Annot_ID_159099

SEQ ID NO: 33193 - DNA, 3000 bp, Unknown; identical to SEQ ID NO: 2243
  misc_feature (1)..( 3000): 2750-1469P.txt file - cDNA_ID_3066662; gDNA_ID_1620510; Annot_ID_159094

SEQ ID NO: 33194 - DNA, 3000 bp, Unknown
  misc_feature (1)..( 3000): 2750-1469P.txt file - cDNA_ID_3066666; gDNA_ID_1620510; Annot_ID_159093
tctaaacatgatgctgatgcttacccaaggttatttgtttttttagctaattctcggaatgtgatattcaaatcaaataagtttttttttttttttttgctttacagatacgagaagcagctagagaggttttgtggattcatggatcctcttttggattcaactccacctgaatctctgcaaagtgcctcttcttttaatgataagttgagcaacaaaatgtacaaatctgctttctgggctcgttgtctccggcaagcagtttctttggggcataaagatatggtgtatgatctcctttttcaaaaacaattaagctgatttgttttgttatctttcactgttttgtttacatgctctttgtttttatattgtgaagggcttttatggatcttttattggcaccagcttcaaaagttttgaacaactggtttgaggtgcttttcttatcttaacacatattggttatacaactagcattagcaagtagtctgatgttgtattgacacacgtttttgtgttggccttatgcttgtagtctgatgtcctgaaggcgagtcttgcaacagatgctgtgattggatctacggtaattgactttcttaatatcttactcgttctatattgggggattaatgtagtgatctgaacattaattcacaggccagtgtccatactccgggaagtggatatgttctcctacatcatgtgatgggagaaacagatggagagaaaggcatttggtcgtacgtatcttgattgttaatttgtattttcctcttgatattttgggaatgtagaaatagctgtgtatgttttacataagtgttgatgcataagcaattgaagaactatcttaccagatattagtaaacatgcatctctgtaaggtgtaaatgaagagcacaagactatctgtttaataaaacaaggcctggctatcgtgagtaactggtaagaaaataatatgcagttacgttgaaggtgggatgggctctgtctccatggctatagccaatgctgcaaaggaagctggtgctgagattttcacaaacgcagaggtattaaattctagatcattttgaggttatccctctttcctacgatattcagaacagtggagttctagtatcatttctctcatcagaaatcagagcagcttagtacattcatattttccaggtttctgaaatactaactgaagactctagcatcgtgaaaggggttagtttgtcttcaatgatttgtggatgaagtgaaaacgtgaatcaaactgatatgacattacctggtataaggttttgcttgctgatggtacacgggtggagtcatcggctatattgtccaatgcgaccccttacagaacttatgtggtaaatctttttaaatcataagttccaaactcccagtatatgtcagttaaaattttgttgtttgctaacaaatttacgtttgttctttctgtcttggataacaggagttggttccgaccaatgttcttcctgaaaatttcgtcagtgctattaagaactcagattacagctctgtaaggattccatgtcgtttaagtccctcactctctggatcaagagaagatagatttctctataggcggaattggttttttttttaattacaccatctagctaattatctggtgatttgttgtttaattgttgtgaacaggcaactaccaaaataaacttggctgttgacaagttaccacagttccagtgctgcaacacaaatcattcaggtccaggtccagagcattttggcactatacacattggtgcagagaggtatcattcgtgctaatttgttcctcattatatgtatctcgaagaacaaataataatacaaataaaagtgatcaatggctctgttctatcttctctctgtcagcatggacgaggttcactcagcatgtcatgattctgaaaatggcttaccatcgagaagaccagtgatcgaaatgactattccatccacactagacaacaccatttctcccccaggtacacattctcccccttttgcttgtttaggatttgaactctgaatgtgattttgtatgtagggaagcatgtaatcaacttgttcatccagtacactccttacaagccctcagatggaagctgggaagatcctacttaccgagttagtttgttatacacgcttggctaaacattcctttacactacaagacatgccaaacccatctggatttgcttttgcttgtgtaaaaatcaggaagcctttgcacaaaggtgtttcaaactgattgatgaatatgcacccgggtttagctcatccatcattagctacgacatgttgactcctccggacctggaacgggaaattggtctaacaggtatataaagtgaagtacttggagaaagatcccaagtacatgcgacatggccaaaccatattgacatgactgcccatttgtattctgcaggcggaaacatctttcacggtgccatgggattagactctctcttcctgatgcgccctgtgaaaggatggtacgtgactccgaagtactcaaaacagtctttacgatttatgattatgaaattcaaaactttgttggactgtgtgaaacaggtcaaattacagaagccctttgaaaggtctctacttgtgtggcagcggagctcatcctggaggcggagttatgggtgcacctggaagaaacgctgcacatgttgttcttcaagacttgaaaagaatctagcgagtataatctcagactgtgcaatgttaactctcatgtgtaagttgtttgttactgctctgaaaacctctgtcgtagggagaggcttacagacatggacaatagttgatatcaacgaataataagcctccacgtgtagcttaacctaaatatcactaattcaacaaatatggaaagtgccctaaacaacagaagagccattgtttatttgtctttgtctttgtctttgcgaaaagaagtaaatatcctcatcaatg

SEQ ID NO: 33195 - DNA, 3000 bp, Unknown; identical to SEQ ID NO: 2238
  misc_feature (1)..( 3000): 2750-1469P.txt file - cDNA_ID_3066681; gDNA_ID_1620510; Annot_ID_159081

SEQ ID NO: 33196 - DNA, 3000 bp, Unknown; identical to SEQ ID NO: 2247
  misc_feature (1)..( 3000): 2750-1469P.txt file - cDNA_ID_3066688; gDNA_ID_1620511; Annot_ID_159114

SEQ ID NO: 33197 - DNA, 3003 bp, Unknown
  misc_feature (1)..( 3003): 2750-1469P.txt file - cDNA_ID_3066714; gDNA_ID_1620512; Annot_ID_159143
gatctgtaattagaaaaataatttctttcttctaccaagtttatgtttactcaatttctcgaatttgtacttggaaattgcaaatttcatttggttttcttgaatcgttgttagatatttccgatcaaatcgtttttagataacactgtttcaaagtcaatgtcgtcatcatcatacaagaagaacgtatagtttttggtttatctttttgttgcttcttaagtcactctttctcgcatagtttttgaggtgacgaagttacgtatacggtgacgtagcaaaccaagcccataagcccaaattctaaacaagcctaagacaagtgagcaaggagtgggtaaaccaaaccataccaaaatgaaaccgacaaactcgtcgatatgtgccaggaccgggcttagagggtgtgctgagggtacatttgtacattgtccattactttttagtcagatttcttaaagcaattagggtcctatttctaaacaagcctaagacagcatcaagtgagcaaggaagtacttcatgttcatgcacaatttctaggaatgggaaagaccgtaccaaaatggaaaccgagaaactcgtcgagaccggctttgattagatagtctatcgaagtaaaatatcgaacttcgatggactatattgaagtagatttgtgctctactgccctcgaaaaaaacattaaagtagattactactacgtcataataacaaacagtctttaacaacaacatcatcatcactcgatacatctctgcctctgtacagttttgctgacatattcacaacaccgttgcctcagtttcagccaagtacactacttcttactaatccagggggcctaatagcaggaaaccaagcctacaaagcacaaatcccaaacacaaatttttgagtataatataaggactgagctaataagttaaaacatttctgatttttctgatagaaaggaaattttactatttggccctctttgaacacatccttccctctcctcctcctccttcccccaaaaaacctggagaaccatgcagttgcaatttcctctttaacccatttcaaagattcgtttttttttttttgtaaatctctttctcctttggcgaattcgtattccttcttttccaatgtaagttcttcttccttgataatcgaattcttcttttgatcttaaaccaatcactactccgtcgttgtaatcgtaattctcgattcaccgttgttcggttataagatcattcatcagaatcggattccattatttcggtgacctggattttgattttgattttgattcttgctgctatgatcacgatcttgatatgtaaactctcttcttcttttttctgattcgatgaaatcaggagttctagagacagaggatcaccttcttcttcttcgtcatcttcttcgttaccaggaatagaaaagtataatgaaaaggtgaagaatcagatacaagctcttgttcgtgttattaaagttgctcgtacctatagagacgacaatgtcccttcccttattgaacaggttactactactactaatactcataggttttttctaccaaccaaatgaccaatgattcattatcaaagatcaaaccttttgttgaatttgactttttcagggtctttatcttggatctgttgcagcagctagtaataagaatgttttgaaatcttacaatgttacacatattttgactgttgctagttcgttgagaccagctcatcctgatgactttgtttacaaggttgttcgaggtataaacttattaaaggtttcactttgttatctagttgaagagagaatatgtttttgattttgggatggaattgcttgtttgattgtttttctatgtgatagtcgtggataaggaagatacaaatctagaaatgtacttcgatgagtgtgttgatttcattgatgaagccaagagacaaggcggtagtgttcttgttcattgctttgttggcaaatcacggaggtcagttttgtttgcttccttcaatatctagcggttttcgccttgtttgctggatagtattcaaaactaagtacatatttagcctggatggtttgtcccttttacttgcagtgtcactatagttgttgcttacctcatgaagaaacacggtatgactttagctcaagcattgcaacatgttaaaagcaaaagacccgtggcaagtcctaatgctggtttcatcagacaattacaagacctcgagaagtctatgcaaggtatgccttactataatatcttgaggtctagactattaggttgagatctctgtggtgaatctaagttggagatactttgtctgtctgattcagtagtgagtgaccagtttttttccttttgaggatgaaaagcaagtggttgtggaggagaagacagttccatgtaaatatctcttacatgcatcttccttcttctctataaaacagggaagcaagttacgattgcacaatgtcaggcgtgaagatcattgatcgtaccattgggagaaacttgtaaatctcacacgaagcatcaatcaaaatgttttgttgtttcttctccttaacaactcgaataataacatggaaacgaatttggaatatgttcatgttctctattcgttttgtatagtttcatcatcatggatataaaagtgaacataaataaaaatttgtaaattttttgtaccgcaatgaaatgtcttttttgtgtgtaaaagttcatgggctgtcattgtttaatttgagcccgtatagtttaaacagttcatggaccttgtgaaacattgggttttatagtcaataaaaaactgtggggtgatttaggacagacttataaggttaggggtcatattagaattctcttaaagttgcttccaattgtgaggaggcactaaaaccctagactccatatcaatcaatcgaaaaacctttctctcttctttcggagccgtcgcttgtgaaactttccggcgatttaacagagtcatg

SEQ ID NO: 33198 - DNA, 3003 bp, Unknown
  misc_feature (1)..( 3003): 2750-1469P.txt file - cDNA_ID_3066718; gDNA_ID_1620512; Annot_ID_159142
aattttatgtcttaagggcgcttgcggacaaggttgcagcttctggattctatgttgtggttcctgattactttggtggagatccttataatccctctaaccaggacagacccatccctgtctggatcaaagaccatggctgtgttcgttcctcctcctctcctccttataataactgtcctatacattctcaacttctatttgaagttttgttaacaagtttgactcaatgtatgtgttattgttctgttattttgatagattccatctgaatcagttcatatcctcttttgtttttcaggataagggctttgaaaacacgaaaccagtacttgaaaccataaagaacaaaggcataactgccattggagccgcagggatgtgttggggtggtgagtttttgttagaaatctatgcctaagagatgtgacgctctctttttgtctaatggatagtacttttctctcttgtgttattcatcttcagcaaaagtagtggtggaactgtctaaagaagagcttattcaagcagctgtgttgcttcatccttcttttgtcaatgttgatgatatcaaaggttagtgactttgctacttccatcttgattcctcacatagaaccaaggaacattagttgtcatgccttgcctaatgcgttgtaacatttagagtcacctataggattgcgtaactgatctcgccatgattagatactatcattattactgtaaagaatactaattcacatttgcaaacataaaaaacactgtgattggtccggtttctttactttcaccggtctttgatgatccttatcaatttcacgggtttattgcaggtgggaaggctccaattgctatattaggagctgaaattgatcaaatgtccccaccagcactcttgaagcaatttgaggagattctatcttccaaacccgaggtaagctgctttatcaccgcaactcaacagtgtaatttaatcacctttatctaactttaaaacggatcctgtaggtgaatagttacgtgaagatacacccgaaagtgtcacacggatggacagttagatacaacatcgatgaaccagaggcggttaaagcagcagaagaagctcacaaggagatgcttgattggtttgtgacctacatcaaatgatttgagaaagaaagaaaggtattgtctattacttcatatatgcaaagaataaaaattaaagagagacaaagcaaaactcttggttggtgtttcaatttctactttctatagtcttttgaagcattctctgagattctgtgataccttttgttaatcattgttttatgatttttatatgttgacgatacgttacccttctcatcatcttcttgtggtaagcaaaaaaagttaccaaaacaaactttgattgaaatcaatgtcttcttcgactaaagaagtaaaaaagatattgtacatatatacagaaataatcaattcttcttcttcttgatgaatttgatagtcaaaacgcaaaattattgattgttgagacttgagaccttgagtaatttttttttttttgggtcaaatgagagtaatttataagagtcaaaatcattacatgaaaatgatttaagagagtttgtccacacacaaaaacctaaaaaaaagaaaactagtaattgacaaaattatacgataaatttattgtataagaaattgatccatatattatttatattgttgcttaaaaatcgtgcaaaaatgtggacagaaaaaaaaaacttgccaaaacaagaagatattgctcaagaaagtcactaggttctttagagaaatcaaataaaatctcaattcataatcaatgtagatttctcataattaaatttgtattacaaacttacaattatcaaaaacaaaatctgtaattacacaaaaaaaaaaaaggaaaatagaaacaaaaaaaaatccgcagaatatctccaaaaatcaattctactaacacaaaaacaataatactaataaatctatttttctattttcaaggaaaaggaaacaaacctttatagctcctctctatcgtctcgtctctataaataaacgagaagctcacaaattccacaaaaatccactctaactatgaaacaattagggttttgaaatttacctaaatctctccgtaatcatcgatcaaaacgatgctcgagtgtcaatcaatgatggagaaattatcaccgttcgtagacgtcgcctctctggaaatcgagtctctgcgaagaatcaaacgcccgaaacgcttctctgaagaagaatcagaagaaaccgagaatacgacgaattcatcaaacgcggtattcggattccctaacttaccagaagaaccgaatcgcgatatggatcaaagcgttttgtgcagaatctgcgttcgattaccagatgggagaagaatacagagaagtttcttaaagagtgaatctgttcagcttctttggtcgttttgttattcgcagattggtgatgaatcttctgagagaaagcggcgttttaaattgattcaagggtttcctggggattataagaatctttattttggatctaatactacttttgaacaatctgggcttgctaattccttggtttctgttacttggctctgaagaatcttctttcgatctgtaattagaaaaataatttctttcttctaccaagtttatgtttactcaatttctcgaatttgtacttggaaattgcaaatttcatttggttttcttgaatcgttgttagatatttccgatcaaatcgtttttagataacactgtttcaaagtcaatgtcgtcatcatcatacaagaagaacgtatagtttttggtttatctttttgttgcttcttaagtcactctttctcgcatagtttttgaggtgacgaagttacgtatacggtgacgtagcaaaccaagcccataagcccaaattctaaacaagcctaagacaagtgagcaaggagtgggtaaaccaaaccataccaaaatg

SEQ ID NO: 33199 - DNA, 3003 bp, Unknown
  misc_feature (1)..( 3003): 2750-1469P.txt file - cDNA_ID_3066720; gDNA_ID_1620512; Annot_ID_159140
gttgaacagacatgtttgatttatctatctttcttcgatgtacaggaacacactgttgaatatcttacaagattactatccccacccgttccagcagattattccagggctgaaaatcatttgattggttatgcctgcatgttgaatgttgttattgttgggataggatctgttgacagcattcaaattttctctttacatggcatggtatgtaaattgtacttccaagtttactagacttaatagtgaatttgctgaaagatgtaatgtacgattttgatggctactttttaggttccgcaacttgcttgctcactaatgccaatttgtgaagagtttggatcttacaccccgagtgtatcatggactcttccttctggagaagcaatatcagcatattctgttttctcaaatgcattcactcttcttttaaagctatggagattcaatcatcctcctattgagcatggtgtgggagatgttcccacagttggctcccaactcactcctgaacatcttctttcagtgcgtaattcttatcttgtttcgtcggagatccttgatagagaccgaaacagaaagagactttcagaagttgcaagggcagcatcttgccagcccgtgtttgtggactcgttccccaagctgaaagtctggtataggcagcaccaaagatgcatagcagccacattatctggacttacacatggatctcccgttcatcagacagttgaagcacttctcaacatgacgttcggaaaggtcagaggcagtcagactttaaatccagtaaattcgggcacaagcagttcatcaggagctgcaagtgaagatagcaatattagacctgagtttcctgcttgggatatcctcaaagccgttccatatgttgtcgatgctgctttaaccgcttgtactcatggaaggctttcgcctcgtcagttagctacaggtttgttttgttttgctggatcagattcctaattgtgttgtcatgtgcgataacatccgtctatatgacctttggcaactctgaatgccaatgagagatgtttgactgtgttgatcagttgttatatcagatgcatttcttacagtaaagtgaatttatttacagaataacaagtgtttttctttcagggctgaaagacttagcagattttctcccggcatcattagcaacgatagtaagctatttctcagctgaggtgagtagaggtgtttggaagccagtattcatgaacggcgtggattggccaagtccagctacaaatctatccactgttgaggaatatataacgaaaattcttgcaacaacaggcgtcgatatccctagccttgctccaggtaaaactattcaacgtgtttaaaatgccagtctgtttgtttggcttaccatctctgtagtctgtaccatcctctctttataataagctttttacctgtcctgatttgatgtgttaaagttaaagttgtcttttgaacttatggttgacttcttgctgtggtattgcaggagggagttctccggcaacgcttcctttacctctagccgcatttgttagtctaaccattacttacaaaattgacaaagcctcagagcggtttctcaacctggctggcccagctctggagtgcttggctgcaggctgcccttggccttgcatgcccattgtagcttcattatggacccaaaaggcgaaacgttggtttgacttccttgttttctctgcctctcgcaccgtcttccttcacaaccaagacgctgtgattcagctcctcagaaactgcttcagtgccactctgggtttgaatgctgcccccatgtcaaatgatggtggcgttggagctcttcttggccatggattcggctctcatttctatggagggatctctcctgtagcaccagggattctttatctccgtatgtatcgtgctctcagagatactgtctccgtatcggaagagattctctctctgctgatacattcggtggaggatatagcccagaacaggctctcaaaggagaagctggaaaagctgaagacagtgaagaacggatcaagatacggccaaagttctctagcaacagcaatgactcaagtgaagcttgctgcttcgctgagtgcctcgttggtatggctaaccggtggcttaggtgtggtccacgttctcatcaaagaaacgatcccatcttggtttctatcaactgacaaatcagaccgagaacaaggaccatcggatctagttgcagagctaagaggtcatgcccttgcctactttgtggtcctatgtggagcacttacttggggcgtggattcaagatcatctgcatccaaacgccgccgccaagcaatcttgggaagccacttggagttcatcgcgagtgccttagatgggaaaatatcagtgggatgtgaaacagcaacttggcgaacatatatttccggtttggtgagtctaatggtgagctgtttgccgctctgggtgacagagatcgatacagaagtgttaaagagtctaagcaatggactaagaaaatggggaaaagacgagctagcgattgtattactctccttgggaggtctcaaaacaatggattacgcagctgatttcatcattcatttgcgttcatagcttcttaaaaagttttgatcttctccagatttcagatagttgtttgatagatgtttttcttctagtgtttgcttccttgttgtgacttgtgttctctagctccagtgttgtgtgatgaaatcaatcacgcatatgtatagagagaaacagaaaaaaaaaaaaaaaaaaaaaaaaaaaaaatcttgtatagaaaatattagtgtactattctagaccgttagatggattagtgttctatttggaaccgttagatgactctccgttgattagttggtcacaagtcacaacaacatgttaaaagaaaacgaatgattgagtttggtttctttgtatcatctctctgtttttccgaagaactaacacatg

SEQ ID NO: 33200 - DNA, 3000 bp, Unknown; identical to SEQ ID NO: 2264
  misc_feature (1)..( 3000): 2750-1469P.txt file - cDNA_ID_3066722; gDNA_ID_1620512; Annot_ID_159135

SEQ ID NO: 33201 - DNA, 3000 bp, Unknown; identical to SEQ ID NO: 2265
  misc_feature (1)..( 3000): 2750-1469P.txt file - cDNA_ID_3066726; gDNA_ID_1620512; Annot_ID_159134

SEQ ID NO: 33202 - DNA, 3000 bp, Unknown
  misc_feature (1)..( 3000): 2750-1469P.txt file - cDNA_ID_3066749; gDNA_ID_1620513; Annot_ID_159191
gatgaaaccaaagcaaaaaattaaacgaacgaaatgaaatcatcttgcaaatgaagaagaaggggaatagtaaaaacagagtttcagatttgtggcagatctgcaatcgagtattcgaaatcaaagcttttcaataatcatttgcgtcctcactattcaccattaatgatattttgtttattggaagagaattccattcaaaaactaaaccctaatgattattgtaaagggaacccaagcaaaaaaaatcaaacgcacattgataagtttctgagatagaatctgatgataaagaggaagatcagagaaaagaaaaagaaactgagccatctctctcatgattcacggccgccgacgccgttcgttaccattgaaggagctcatcttaagggacacaaccaatcaactatcgtcaccggagctagccccgcttcaatcacgttgtaaaaaatcaattgatctgcagagagagaaagagatttgatggaaacggagacagatccagttgttaatggcgatgatgatggcgtcggtggttacgttggtgatgatgatgatgagggttgataacgacgacgacgacaacacaaaaaaatcatacaatttttatttgttttctctaaatgatgaatcaagggtaatagcgtcatttcaaataagtaaaagtacctgatttcgtaagccatcttaaaagtaccggattctataaatttttatgtttttgtggttttttagacaaataagtctctgtaatttctttgattatgcactggttgaacatatatatttggcaacttaaatataaaagaatcatataagggttttgaaaattttagagcatttatggagtggtatttcaaaattatcagctctgcgagaaaacaagacaatagcgttacgagtggatttttgttctgaaagtatctaatagaacagtggatgacaaactctatatgaaatatagaattttactataagtatactatttaacgagaagatatataaataaaatttcgccttataagtttgttaaagttgtacatggttcaatagatatgcagactaatccaaaagtcacccaatacctatagcaaacataaaaataataatatttataaaagaatgaaccaaaaacttataaaaagttaagaactatagaaattcgtgatgagatacatgtgaattaccaacgagagactcgattacatgagtttctcttaactagtttaacaaaacatggttcatcttatactacaaaaaataagccaatctagacatgattaaaaacaaattagtgttatattacaaaagtttccctcaaaaaaaacacattttgaggaagctaatcatgtctaaacaaagtaaattcattacatcacaaaattgtggaaaagagcaagatgtagtatatctgtaatcaaatatgttcaaacgagcatcaaaattcacctaaacaaccttctgaacactatgataatatcttcaatctgtttagtatatcttttacaatcgtgattattctttctttggttccccgctcgctccattgaataggactaatttatattgttcacattgcggattcacctactggaagtgtaagagttaatgcagccaacctcattttttccagagagattacataaagacctaaataaaaattggggaaacatatattcttttctttctttttgttaatatgttggcggaaagatttcaaaaggggatttccctaaatgatagctttacatttagaaaacgaactatgagcatgacaattcggtttaggtaaaagaccaacttgctctcattgcacttgtaaaaccctaagcaagagagttgaaaacagtaaacgtctaagcacctacttggttggtgacacgtcggaaaggccaaaattttggtccactagaatgtaccagaatggtacttgcaagatttttaaggttttagtgctcataagttgctgagctggatagatacccacccacattttaggttttagggttttgattattccccacaaattttatgagataagatttaggttaatttcgcatgccgacatcaatgtgcgcacaacatcattcattcgtttcatttgatgaacaaaaaaaaaaatggtgaaattacccttctcatcaaagatattattatagagtgaacattatgtgaattttcttgaaatggagagaattctattcctcacgatatatctagattatatatatatttttttaatatatatatctagaatatatatttcctatcaagagtcactgatttatattggtcacccaaaattgatcttacccaattcatacacaattacattattttgctaaaactttatacacgattcatgctaataaaacagtaatatatgactcgtattatgctatatagagtgaccactgaccatacattcttcttgaggaaactagtattcgagaaaacttagtcatgttcagatatgcagatctaaaagctcataaaaattaacggtttaaccatttacataaacacacaaaaaactatgtataaattgagtacatgagtcataaaatcgatagatgggtaagatcattatgcttaggtgaaagaaaaaaaagggaaccttccgaggcaatggggcatgaagtatacaactgtaaagtaagagataatgctctttgattcttttttccccactatacatcccattgagttcaaactcttctttctctctctctctctctctaggtctctcactcacagacgcattttgcaagttgatacacttttcttcctcctatataaatcactacacttctcaatcaaaaattgtatcatacattgaacataattctcagtatgatcctgtagagtttactcgttcattcacttgtattctctttcatagaggaagagagagggagagagtttctaattaattagaagatttttctttctttattttctaaacaagtattagactactttgagagagatataaaaatg

SEQ ID NO: 33203 - DNA, 3000 bp, Unknown
  misc_feature (1)..( 3000): 2750-1469P.txt file - cDNA_ID_3066768; gDNA_ID_1620513; Annot_ID_159166
aaaaaaggttttcaagattctcaatatccagtagggttcgtttagagtagaaattctttggttaccttttagagattaagaagaaaaaaagtctttgttcaaactatatttttcttgaaacaaagaaataaattaatgaaaacgccatttagaaaagattcatttctacaaacagcgattttgtatatggaaatcaaatgaaatcagaaacgaatattttgactgagggaatacagagaatataaaatttgtgaatatacaaaggaatggaatatttaccataaatagttttatgcatgttctattaatcctcactaccacatgtacttatcatcctataaattttatctcttgaagttttcactttaacgttaaagaagaaaaagataaaattgttctttctcatattaatcacccacaagtctgaaactgcttcttcactctcaaggcaaaggtatggtttacagaaaccacctttgatatatggctcgtgttatttactttgattttattatttaggaggcttcttttctgtatttcgttgggatatatatcagattttagagtacttttttttggtctctagcctgtgcctcgggcataagaaattaaatcatactaaagcgtttgatgaaaagttttcccactttctactttctgattatcaatctttttcttttgcaggatcaaaactaagagaccaaaagatattgtgtactattttaacagcgatcgaaaacgaccctaagcttgagaagaatctcggaggtgtttcatgatcacttgggtactaacttctcatcatcatcatcattaagatcatcagatcgtctcagcatgtgggcactattccgcgctttagcatgaagtgtgaatatccaatatatgcaaagatcacagcgttatgtgtgttccatgttggaagttttcaagcttttgagtatccggctccattgatgactagtgttgtttcatggacttcatgctaattcattgttcacaggagtaacacgagccatcgatggagctagacacacttcaaaagcttcaaatggcttgcaacaatgaacacaaataatcatgtggtctttaatttgcatctattatttatacattatgctacaagaacggcataatgaccataagctgcgaccatctgaggatgataatgatgatgaattagtacccaagaaataaggaaacaacacctccgaggctctcttctcagaagaataatttttatatttgccagttatgtttttccttcagtcaaaatacaaaagctcagtttgaaaataataataataacaaaatatcagtttgtagaaccgattcattttaactaggcgtttctatatttctctttctttcatgtaaacgatacattgaacattaattgtctctctttttttctctttcttagcctcgtttatatcaaatcaatagctggtgaataataaaagagaagaaagctgtaaacaaggttctagtgttaaaacctttttgaaaaaaaaaaggttctagggtttcaacagaacctaaaaggaagaaaatcctttatcaagacctagaaggaagcaaagacctacgagacttaggaaacaagataaagtctactaaaatgaaagtgtaagtcaaaataaaaataaaaattaagaaataaattttgtgaattgtacttggtttgttttcgttatctgaaaccctatttcctggtgagcaagaaactgtcgagtcttcttagcaggatatgtaacagttttaaactggagttacgacatgattgctctctatttaataagtctttacatctctcagaacaaaatagaggaacaatatcttataagctccacttctcattgcaaatcacataaaaactttgacataaatgatgataagaatttcaaaatgatataacatatgatcaaactctcattccaatcatatagccctgcttcgagatacattcatatttagccctgattagtgactcctctagtgactaccgagtagattatattcataccgacgactcttctggtgacaactctttagttatatcatagctcggaaactgactcagtctcgtgatttgttgctgcttagcataattctatcgattaaaaaggattatccatggagcaagtactcaattgctccaaagggcttgcgataatgagcacacataacataaccatttgatctttgcatctatttggatattcatcctgcattgatcaaaaaagatgaataaaatgtggtggttatgagtgtttcgagtcttccagatgtctaagacttcgacaaggatcagactcaagctttgttgagagaaaaccaagtttgggctacttatgatgattatggaatgccacagtggtatgcactggtccataagtttgtctctcaagaaccgttcaagatgtgcatttgttggcttaatggcaagaaaaatggatatgtgggttcaatgaagaagtggattgatttagggtattacaagacgagtggatgcttctcaattaggaaacatagcaacaatgattctctcaactcattctcacatagtgccttgtgaacaatatgtgagaaaggattgatgcacatataagcgacaaaaggcaatattttggctctttatgcaaattggtcacatgatattttaactccccaagaagttgtggacaagtatgaagtgcctcaagatttcaatgaaaaagaatattttaacctacggtgtctctcctttgattcacctacacatacggtggcgcagactccggggattagagcatttcagccgttggcccgagcggttcggtcatccctccgccgtaagaccaccgggatcgcttatctggtttcacgccgtctcttggattttaatctacttggcccccaaagctcgaaacattttctgcttagcccccgatataagaaaaatgtctttatctatttattttaattcagataaatgataaaagacaaaaaaatctgatg

SEQ ID NO: 33204 - DNA, 3003 bp, Unknown
  misc_feature (1)..( 3003): 2750-1469P.txt file - cDNA_ID_3066787; gDNA_ID_1620514; Annot_ID_159226
ttattttagttgatgtaataggtgacacaaacttattagcgtaataattttgatagtgatgtgttttaaatattgaactataaattaggttcgttgattttagaaggccaccaaacaaaacaagaaaaagttctgcttggcagagatatttcggctcttataatttacaccactttagaataaatccaaaatcaaagaaaagttatgtttcatgtggtcgattttgtcatctctactgtcttgattgttttaaacggtaaaaatagtaagtgaaaacaaatagaaaaaccgtaatttatgatcattctagtggatttctgttggtttagtttttttttttttttgggtgtgtttgttgttagtatatattatcagttagatttacagttaagtgatgttttttattggtttgcactttgcagctagtaaccaaaaaatatatatactataaactaattttcaattattgaagttgcttaatccgaactagaagaactccaaaaaggtatataatctgaatctgatcaaggtcaacaaaccggagagtcatattttatgttcaaaatttttgtgatacttgttgatacttcagcggtgacatattatattgagcaactcccaaacgtatgggaacattttgtgatacccgagttatataaaccaaaaatgtaagactaaatcagccattttttgtgcagtgacgtcgagacaccgaggttcacgttttggtaatacaacctattaacaaatacaaaatataaaagagacaattggagaagtttattatttaaaaagggtcaccggaacgaagaaagcgtgatggaaaatgaaagttcaactttagcttaaatgttaaattattatcacttatttgacaccttgccttacatttttattaatatatacaatttgtgtggcttacgagttgagattctttttcatctataatatgtaaataagtctttttcatgcttttagctaatggaccgactttatatctcacccatatgtttacaaaaatctaaacttgaagaattaaattattcatccaataaacttatatcaaagtctttaatattaaacttataataaaccatgagttaacgtaattacgtcaacaatataggctaaaaatgtgaatggcgaagttaaaatatagtacattttagtccaaccctaacagaaaacttagtctcttcgttttttttattatcaaattaattaattactcaaatacagtataaacaatcgatcatttgcataaatttgaccttgacatcgataataattaattttcacaagtaatattatacttattttgttatttatttatgttacacttgaaagagagcccaacgaagacttgcaagtaagttacaattttatttaccttgagcttaacgttgtagcggcaacaacagtaactaaggaaggtcgcagatcacttgcggatgtcattatcctattttgacacttaatcactactatacattatacaagaaaaaaaaactaaaaactcttttatcatactattaaatttgcgacatgtgtatatacatatataacacatgtgaaattaatgttaacgatgattaggtaagttttactgctatgtaaacttgtcggatttattatgttatcttatctttatcaaatttattgaaccattaataatgacagagatcaatttaatatgttatcttatctttatcaaatttattgaattaccatttataatgacagagatcaagctaataacgacttaactgctctgagatctacacttttggtaaagttagatagaaaatcaaaattaccaataaatattacataatgtatttttaagaaaatagtggttgaatttttatgagtgaaataatttgagggtgacacctaaaaatattgaaattgcaacatagaaatattttaaatagtaaaaccggtccatcggtagttgcctcacaacgggtcaatttcaaaaagatcaccgacagtggacctaacaaaactatcaaccctcagagttttattaaattacgaaattgccatatcattcctcgtgacctgtaccccgtacccaataagtaccacgaaaattgctaaatttaggaaaatcacttcttcttctttttttttttgaagaaacaacaaaattagaatacacggaaattaaaaagaaatcacattgcttataaaaacatttctcatcttcagatttttattttcctatccgtcttttctccgatcgctggatcttgaagatctctagattttctcatctctctctgttcacggactctgtgtagatagagttcgtctgtttttcggagttcttgtgagaatctagggtttttttcttaaatctcgatcgggttttggtttctgtgatttttttttaaaatttgtgattcgaagaattgccattttctttgattagtcatattttttaattgcgatctctacatagagatcatcgaggggtttttaaattgaattttttgaaattgacgaagacgatagagttgttgagcggtattgatcttttggtgtgaagacgatagagtttaaatttgatttgaagaggatgcaaaaaactcaggagaagaaggttggttgcttcttattcatcggaggaccttatgattcctttgttcttgacatacgatttttgataatttatttgctaatgctatgtttcagaacatgaaagagatggagtttttcactgagtatggtgatgctaatcgttatcggattcttgaagttattgggaaaggaagctatggagttgtatgtgcagctattgatacacaaacaggagagaaagttgctattaagaagattaatgatgtttttgagcatgtctctgatgctcttcgtattctccgtgaggttaagcttctacggcttcttaggcaccctgatatagttgaaatcaaaagtatcatgcttccgccttctaagagggagtttaaagatatatatgttgtttttgagctcatg

SEQ ID NO: 33205 - DNA, 3003 bp, Unknown
  misc_feature (1)..( 3003): 2750-1469P.txt file - cDNA_ID_3066793; gDNA_ID_1620514; Annot_ID_159222
tttatgttcctagaacttttagcaaattatctacctctatctttctctcttctttaagagaaaaaaaaatggagatatcagtttcttcggtaacattttcactagctgtagttgttgtgtcttggtgggtatggagaacgttaaagtgggtttggttcacaccaaagatgcttgagcgttccctgagaagacaaggtctttccggaacttcttacacgcctctaatcggcgattttaaaaagatgatcagcatgttcattgaggcaacatccaaacccatcaaaccaacagatgatatcacccctcgtgtcatgcctcatcccttgcaaatgctcaagactcatggtatccttccatagttcgcttcttgattcttctctgtttagaacttataacaaaactgttgcaaagtatctgatctatatataaacttttgtatctttattatgctcttggaacaggaaggactaacttaacatggtttggaccaataccaacaatcaccataatggatcctgagcaaatcaaggaagtgttcaacaaagtctatgacttccagaaggcgcatacgtttcctttaagcaaaatactaggcacgggactcgttagttatgatggcgataaatgggcgcaacaccgaagaatcatcaatccggctttccaccttgagaagatcaaggtttaaggctttatttctcagtcacatatcaagttgtattttttcatttggctcttctgacccaacttttgcgtggatctgcttctatctattatatatagaatatggtacatgtgttccacgaaagctgcagcgagcttgttggtgagtgggacaagttagtctcggataaagggtcctcatgtgaggtggacgtgtggcctgggcttacgagtatgactgcagatgtgatctcccgtactgcttttggtagcagctacagagaaggacacaggatatttgaactccaggcagaactagcacagctagtcatgcaagcttttcagaaattttttattcccggatatatgtaatgaaaaaactctacttgtctagctttaatatagtgcttttaaatctggattcttgatctttaacttttagtgctgcaatctattagagatatgacctgtgttgtcataatcatgtgcttattgtttgtgtagttatctcccaacaaagggtaatagaaggatgaaaacagcagccagagaaatccaagatatactgagagggatcattaacaaaagggaaagggcaagagaatctggagaagcaccaagcgaggatttgctaggtatacttcttgaatcaaacttggggcaaacggaagggaatggaatgagtaccgaggatatgatggaagaatgcaagttgttctatttggccgggcaagagacaacatcagtacttctggtttggacaatggttctgttgagccaacaccaagattggcaggctcgtgcacgagaggaagtgaagcaagtttttggcgataaacaacctgatacagaaggccttaaccaactcaaagttgtaagtataaaccaaattttttataaaacaaactttttcaaatgacttcactacttttgttgcattttgatgatttaagctgatccctcacagatgacgatgatattatatgaggtccttaggctttatcctcctgtagtccagctgacccgagccattcacaaagagatgaagctcggagatctgactttaccaggcggtgttcagatcagtctacctgttctgcttgtccatcgcgacacggagctgtggggaaacgatgcaggggagttcaagcctgagagattcaaagacggcctctcaaaagcaacaaagaaccaagtctccttctttccctttgcgtggggaccaaggatctgcattggccagaattttacattgcttgaggcaaagatggcaatgagtttgattctacagagattctccttcgagctttctccttcctatgttcacgcgccttacacaatcatcaccctttacccacagttcggagctcatcttatgctgcacaagctctaatcacataaccccttgttttgttatcaaataaactcattatctttttatgtatccaagtcagaactcgtgtcatagtttaataaaacccttcaagatgtgtcaaaccctggattgcaatataatcatcgactgttgcttgacacttcttttcaaacatcactaacaagagacaaactatgtctttattaactctgattcttcctccctaataattatgtgttgcaccaaaagatattagaccgaactcgtgtctctcaaactattatgaaaacttcccacattaacattaccaaaacacttggaattcatatctttatttgaaaagcaagacccgagatacagaaatgatcgaaatgaataatacagtctcacaacagaagaaactaaataaaacacttccagagatacagaacaaaaacaaagggaacagagagatatgtaacttttttttttattgaagtaaaatattataacaacccgttgaagaaatacagaacaaaaacaaagggaacagagagatttaaagtttactttttattttatgtcgacaaaacaaaatacttcaagttcaatgtttaggtaccaaaaaacccattgattggatggtggtggtaaatgacaaagacacgtcacaaagttgaagacgttcgtcccttgcccgccagtcaagttatgacttatgagagtcacataaccaatattaatatatctcctattttgtctacttttttttacagaagtccaaatttggttcttgcgccttcgtggcacgcaaaatatcgattacttcaaaagaattatatcaacacaaacactataaagtatataagacatcatcggtgatgtcatcaccacatccatatcttttccaaagttttcaaccttttattccccgaaattttttagcaaattctctacctctatctctctcttctctgggaggaaaaatg

SEQ ID NO: 33206 - DNA, 3003 bp, Unknown
  misc_feature (1)..( 3003): 2750-1469P.txt file - cDNA_ID_3066797; gDNA_ID_1620514; Annot_ID_159221
gagagttattttccctcctggtgtattcatcaacaagttgtacgctcgatctttccatataaaatatataatcaccttctccaccattgtatcctacaaaatcaatacaaaaacctctatcagatatactagttatactacaattctgggtaacacaagtataactagttatactacacatatctgtataatacagttataactaataatagtacatgtaaatgggtaatactactgtacctaagaaatactacatgtaaatggttaatactagtgcaactaagtcatactacatacatctggataaaactagagctacgggtaatactacatatatatttttcaattgaatcatgtgcaattctactcagttctaccagttgtatttcccgacaataactcaaatcgcatggtttcgggttcaaaactacaattcactctgattcagttgttgtaatccatttcttacccattttacagatctattcaacccaggcagtatgcataaacttccaatgtgcatacccaaacacaatttgcttaatctcaaatctaattgacaacaatctcctagttttctaggttcaaaacttcaatattaagctctatgcagctcgagtaagataccttttctttctatctcgacgcaactcgtcggagggagaggatacgacaacaatggcgactgaaatcaaatttcgatgatgagagcgatgagagctcgagcgagaagaagctgagaggagagagagaggagaggcaagagagagtcgagagagagtcgagagattttttttttcctgttttattttttttttcttttcaaaaactaaataatttaaaaatgaataaaataaagaaggagagggtaaattcgtcaactcacaattcattaatagagtgggggatatgaagacaaaaataggatacaagaggttagtgtttggcaaaaaaggagttataagattatttctcttataatttagactgaacgacgccgttcgaatagtttttttaatcattgtttttttccgttccaaactatgtcgtttgatcaaactcaatttgtgctaccaattattaatttgtgtcatacttatgctaagaccatgctaatcttcttcttttttcttttttgaagctaatgtactcggaggaacaatcgatatatccacttcaaaactgaagctatttctaggtgatttaagatttttaacatcgttaatgagtatttcatgggaagttcactataaattataaagtaaccctataattatggttattggtgagttaattatattcagtagcactttaaaaagaaatgtacgttcagtccagaacaattacagcttacgatcgaaatctgaaatcaaatcactctaactttaaaaaaaaaaaaaaaccttaaatgtgtaggtttttcttttggaatgaaaaagaataatccttgcgtaataagatagcaattgattgaaaaacaaaatagctcatgtcggcctatacactataatattctagacacgtccctttctgttggttgttaactaaaatagctcatggcggctattacaaaatgcaccacttgagatgactatgaaggtacaacaaaataaatatttgtcatatgtgagagcaaactaattggaaaaacaggatgagattgagatcataacaaatgagcaatactaaaatacactaaaccaggtttagtaaaccttatgtccttatcagagttttacgccattttatatagtttgtgtttttgagggagttgtatattatttctgacgttggagggatttagtagttttacttttcttttctttttttttgtcgttttacttttttttttgatatttctttatttcacgtttctatttaacttagagttttttttatatatttatgtttttagtttcttctctacatatataaaaattcttaagttatttgtaagatacgttttattatctaattaataaaagtaaagagttttttttctctaattggtagaatttcaagaatttcaatcctttcaagttcgacagtttgacataatacttgttattcctatcatagacataatgcttgttattcctagatattctaaatgtgtcaatttctcaaaacattgtaattctcaaatttaaatatgaaagtttttagttatttttcttttttgaaaaaaaactcttacggtgatcatcgacaattttgttacgatgatcgtaaaacaatattgttacgatgatcgacagtttttattcattatgatatattttagatattaataagaagcatatcctaagatctaagttaagaaaaatttagatattttatgtgattatttatcagttttaaatgaatatgttaaatttactttaatcagtgtttgtttagctaatgtgctgagaccggagagtgctaagatacaaggtctaaaagtaaaaaaataaaatatatagatattaatttatttttaataatagatattttaggtttttgtatatataacagcatttggtctataaaatatatgagcagggcctgactttaatgcaaaaacaacagtagcctatgtacatgtacaaaaaagtcgttttagtcaaatgtgaaaatcaaatgattttgtaattatttttgttttaaagaaatgtcaaaaagttgaagacgttcatgtcagagcatctttactggtgatatatccaatatggatgtctaaaacattttttatagttaacttattatatatttttttgtttggtcaacattatattatattttaatacgagtaactaagaaacaggatggagttaggcgagatgtcaaattttgtttattacggcttcgtggcaagggactgtgaaccacgacatcaggggtgatgtaatcaactaatcaccgcatccatatcttctccaaaagtttcaactttatgttcctagaacttttagcaaattatctacctctatctttctctcttctttaagagaaaaaaaaatg

SEQ ID NO: 33207 - DNA, 3003 bp, Unknown
  misc_feature (1)..( 3003): 2750-1469P.txt file - cDNA_ID_3066812; gDNA_ID_1620514; Annot_ID_159216
cctcttttcgtcgcttttcacacaaagtccaaatatgcttctgcgctttggtggcatgtgactgtgagggtccaagtaaagcaaaagatcaattaagcacaacaaaataattgtccaaaccaccaaaatataaaatataaaataatttgtgaccatcatcaccacatccatatcttctccgatattctaaaccctgagaatggtcacaaattctctaactctctctctctctctctagtagaaaacatggagatatcagttgcatcggtaacagtttctgtagctgtagttgttgtgtcgtggtgggtatggagaactttacagtgggtttggtttaaaccaaagatgcttgagagttacctgagaagacaaggtcttgctggaactccttacacgcctcttgtcggtgatttgaagaagaattttagcatgcgggctgaggcaagatccaaacccatcaacctaacggatgatatcacaccacgtatcgtaccttatccgttgcaaatgctcaagactcatggtatgcttccttgttggcatcttgattcctctttgtttagaactattgtagagtatctagaaaaggtttcaactttcgtatctctatgtggttgaaacagggaggactttctttacatggtttggagccataccaacaatcaccataatggatcctgagcaaatcacagaagtgctcaacaaagtttatgatttccagaaggcacatacgtttcctctgggcagattaatagccactggagtccttagttatgatggtgataaatgggcgaaacaccgaagaatcatcaacccggctttccaccttgagaagatcaaggtttaaaggctttatcttccatagtccccaatcagattagattgctttatgtatgtatgttcatttggctctgaaccaaattgtgccttctgcttctatgtatagaatatggtacctgcgttccaccagagctgcagcgagattgtttgcaaatgggacaagttagtgtcggataaagagtcatcatgtgaggtagatgtttggcctgggcttgtgagtatgactgcagatgtgatctcccgtactgcttttggcagcagctgcgtagaagggcagaggatatttgagctccaagcagaactagcacagctcatcattcaaacggttaggaaagctttcatccctggatataggtaatgaaaaactcaacttatctgatttaatataggtccttctgagcttgactcttgatcttaaaatgtcgcaatctattccttaaagatatgaaccgtgttaacattatctttctgccaatctttttctgtagttatctcccaacaaaaggtaacagaaggatgaaagcaaaagcaagagaaatccaagttatactgagagggatcgttaacaaaaggttaagggccagagaagctggtgaagcaccaaacgacgatttactgggaatacttcttgaatcgaatttggggcaaacgaaaggaaacggaatgagtaccgaggatctgatggaggagtgcaagttgttctatttcgtcgggcaagagacaacatcagtacttctggtttggacaatggttctgttaagtcaacaccaagattggcaggctcgtgcacgagaagaagtgaagcaagtgtttggcgataaagaacctgatgcagaaggactcaaccagctcaaagttgtaagtaaaagcaaatcataaacctcttggtgacttttgttgtgttttgatgatttttgatgaatgatttgatcccacgcagatgacgatgatattatatgaggtccttaggctatatcctccaatacctcagctgagcagagccattcacaaagagatggagcttggagatctgacactaccaggcggcgttctgatcaatctacctatccttctagtccaacgcgacacggagctgtggggaaacgatgcaggagagttcaagccagatagattcaaagacggtctctcaaaggcaacaaagaaccaagcctccttctttccttttgcgtggggatcgaggatctgcattggccagaattttgcattgcttgaggcaaagatggcaatggcattgatactccagagattctcctttgagctttctccttcctatgttcacgcaccttacacagtcttcaccattcacccacagttcggtgctcctcttatcatgcacaagctctaatcgttcgtagcaacccattttgttgttatcaaatatactttccattcacagatgaaacaattccatatcagtctacctataatgctagtccaacgcgacaccatgatgtgggaattcaagcctgagagattcaaagacggtctttcaaaggcaacaaagagccacgtctccttctttccatttgcatggggaccgaagatatgcatcggccagaattttgccatgttggaggcaaagatggcaatggcgttgattctacagagattctccttcgagctttctccttcctatgttcatgcgcctcaaatagtcgtcaccattcacccacagttcggtgcacatcttatcctgcgcaagctgtaattctagaatcccatgtgctcttgtcagataaacagaggaaaataaaccagatcatagtataaaactcaaatctttttattaattgaattcagaactttgtgctcacatatgtcttgacaaaccaaaatatttccaagaaaaagagtgaaacgcatggaccaatatatgtcttcctattttcgtcgcttttcacacgaagtccaaatttgcttcttgcgccttggtggcacgactgtgagggtccaagtaaagcaaaaattaattagtcattacaaaataattgcccaaaatatcaaaatataaagtatttaagacatcaggggtgatgtcatcaccacatccatatcttctccgaaattctaaacatttatacatcctgagaatggtcacaaattctctacctctctctctctctctctctggtagagaaaatg

SEQ ID NO: 33208 - DNA, 3003 bp, Unknown
  misc_feature (1)..( 3003): 2750-1469P.txt file - cDNA_ID_3066824; gDNA_ID_1620514; Annot_ID_159212
gtctgaacaaaacactggagttatcttcttttgaacatttttcaactttttttttgttctagatatgatacaatattaaggtgactcatctccaattttcgtcagtttccaaagttttgctgctttagtgtaatgttgcagaaagttcaaaactgtactatctcccactatcataaaccaatctgctttgtatgccaacgaccactaaactagcaacacttcattctcattcttgtatgaaactattctcgcaattccataaatgtcttcatctgcagtctggtttatgctacatgtccccggagctctcggcgtctgacacacacttcacccaaaaaggattgagagcagttcaattcatcatgctcagtggatcacttttcatgatttatcgattaaaaaaattgcaagtagacgagaacagatggaaaactcttacacgcaagtacacagaaaaagccccttttccggcaaaggatttggagtgtaacttgtataatcaaaactccagtgacagccaaaaagtctcaatctttataaagacccacaaaaacttgcggactccagagtgagtgtgagaatcggagatgtctttttcagtagtagcagctttaccggtgcttgtagcagtagtggtactgtggacatggcggatcgtgaagtgggtctggataaaaccaaagatgcttgagagttctttgaaaagacagggtcttaccggaactccttacactcctctcgtcggagatataaagaggaatgttgatatgatgatggaagcgagatctaaacccatcaatgtaacggatgatatcaccccacgtctccttcctcttgccttaaagatgctcaattctcacggtatagtgtcttttctttctttgtttcagcagagttgggaagtgaattgtgtagaatttagtttgacttgagatctctgttaggttgaattgttggtgcttgattgagttatgttggtggaacaggaaagactttcttcatatggattggaccacttccaacgattgtgataacgaatcctgagcagatcaaggaagtctttaataaagtcaacgactttgagaaagcttctacattccctttgatcagattgttagcaggtgggcttgcaagttacaagggagataaatgggcgagtcacaggaggatcatcaacccggcttttcacctcgaaaaaatcaaggttttggtttttttctgttgtttgaattacgttagactgtgcatatgtgtgtgtgatcgtttagtaaccttttgtttggtttacagaacatgatccctgcgttctaccattgttgcagcgaggttgtctgtcaatgggagaagctatttacagataaagaatcgcctcttgaagtcgatgtttggccttggcttgtgaatatgactgcggatgtcatctcacatactgcttttggaagtagctataaagaagggcagagaatatttcaactacaaggggaattggctgagcttatcgcacaagcttttaagaaatcttacatccctggatcgaggtaaaaccacgatctccattgtctctttgttctgttgcaaactaaagattttgagaatttgttgtttggtgtaggttttacccaacaaagagcaatagaaggatgaaagcaatagatagagaagtagacgtaatattgagaggtattgtgagcaaacgggagaaagcgagagaagctggagaaccagcaaacgatgatttgttggggatattgcttgaatccaattcagaggaatctcaaggaaatggaatgagcgtagaagatgtgatgaaagagtgcaagttgttttatttcgcgggacaagagacaacttcagtacttttggtgtggactatggttttattaagccatcaccaagactggcaagctcgcgcacgagaggaagtgatgcaagtactcggtgaaaataataaacctgatatggagtcccttaacaaccttaaagtcgtaagtgaagaaaacacaactttcaccattctcgtccatctaacaactgcgtttatagttaacaaagtcagttaaatttcaactgaaaggttgtctttgaatgttttttcaacagatgactatgatcttcaatgaggttttgaggctataccctccggtggctcagcttaaacgagttgtcaacaaagaaatgaagctcggagagttgacccttccagctggaattcaaatttacttaccaactattcttgtccagcgtgacaccgagctttggggcgatgatgcagcggattttaaacccgagcggttcagagacgggctctcaaaggcaacaaagaaccaggtctctttcttcccctttggatggggacctaggatttgcatcggtcagaattttgctatgttggaggcaaagatggcaatggctttgattctacaaaagttctccttcgagctctctccttcttatgttcacgcgcctcaaacagtcatgaccactcgtccccaattcggagctcatctaattctgcacaagctctgattttgtatatccatggatatgtcatcaaaagtctcatattatgtaacaaaaagatgtcatagaaagccctgtagccatatgttgtgaaattgtcaatatctttgtctgaaactagtcgctattctataaggtaaaagtcttcttcagtcaagtctaaggtcgttttctatcctggctgcattattaatcttgaaaagtctattccaagaagccaatttcaactctaccatctttagcatgtgttttagataagccaatcgttttttatgtcataggccagtggagaaagatttagcaaaaacataagtattttatggatttagataatctagaacattcgttgaattttcctctgcctcacactttaaaataacatcaaatctctatctatttatacaaacccttttcatctggcatcttcagttcagtaaaatagaagaaagcatctaacgaattttacaagtaagtgcgtttatg

SEQ ID NO: 33209 - DNA, 3003 bp, Unknown
  misc_feature (1)..( 3003): 2750-1469P.txt file - cDNA_ID_3066828; gDNA_ID_1620514; Annot_ID_159211
cttacaatttgacaaatgatttttttgcttagtattttgaacattgtggattcatttggaaacaaacatcagaatctcttatctcatctgccaaaatttctagctaaactgtagtttctcaaaaggattgtatcattattgcaacgtacacacaccacttggctgttctaaagctcgttttggttatctctagttttcatcaactatagtctttggtcgcaggttatgttgttaatggagtaagaccaacagaacacggtcgttgttgcggtatcggcattggctgggtattgtaagtgatctttatcatttatttttacctaacttctcttctcattacattcttgataatttttgagagttttttttggtttgatgtgtcttgaagattcatccttggtttcttcttcgctttgccctggtacatcggtttcttccttctattattctctaggaacccgcgtgagagaccaggatatatagcttgcgcagttggggtaagtccactactctatatatctctctcactcaacaagaaccatttctcttttctttatcacaaatataaatcaattctgactaacccttccttttcgcaggctgtttttgctaccattatcgtcatctttggaaccgtaagaggatcaggggtgtggtcatgaaggtgaagatgtcaacaatctgaatccgttgagattttgtttcagaagaagatcgatccataatgtttgtttacataatgtgtattgtctctagattacaaaacagtactgtatatgtttctttgaaaagttcttcttctgaaaacatactagtgtttgcattttcaaagaattttttttatataaaaaatttgcatttgtttagatgatacgaattcaaatgaatctgattataagctcatttagtaaatgtgtttgacctgaaccactgactcataaaaacacttgagctcatttgaccggcgacagtaaaaaagtaaatttaatttacccgatttacccgctgcaaatatttttgtaacgccaatgtaatgagaagaataattaaaggcccaagtaggaaaaagaaaagcccacagagacggcccctagggtttgtcctttagagaaacctcttttatagttttctcatgagcgccaccgtttagctcttttctctctgttttgctcttggctgattcgttggagcttgatctctccgtggaaatgggtggtttccgggtaagttacttctttagtctgtgtataggatacgtgattctgggtatttggacttctgaagatttgatttggagaatcatcaactgtgctcggtcggggatagtgtattataaggataaataggttctgattcgcttagaaagtatgaaactttttctatgtgcatccgttaaattaatatgaatttgaagtgtttatttccggatttggtttgttctgtatgaatctctaggatgattgttttagtgcttaatgtcttctaaaatgatcattgtgaatcattttaagcttcattagctatccttaggcccagagatcggtgttgtcttgtgactcactgagagagttgatatgatgtaaggattagggtctggtgctgtttaaggttttaccaaagctgatatttttgttggtttgtgattaattgattcaatgtacattgcagtttcaccagtatcaggtggttgggagagccctcccgacagagaacgatgagcaccctaagatctacaggatgaagctttggggtagaaatgaagtatgcgccaagtccaagttctggtgagccattcgatttgataccagtttgttaatgtaaactccattttgtcttgtttatttcctgatctaaaatggatttgctcgttgtatctaggtacttcatgaggaaactgaagaaggtgaagaaaagcaacggacagatgcttgccatcaatgaggtatggattgcattttacttagatatcttagatatgctgaaagatggctacttgtatctgatcttgttgttctactttattatagattttcgagaagaacccaacgaccatcaagaactacgggatctggttgcgttatcagagccgaactgggtaccacaacatgtacaaggagtaccgtgacacaacactcaatggtggagtggagcagatgtacactgagatggcttctcgtcatagagtgaggttcccttgcattcagatcatcaagactgcgactgtccctgcaaagctttgcaagagagagatcaccaagcagttccataactcgaagatcaagttccctcttgttttcaggaaggtcagaccaccaagcaggaagcttaagactacatacaaggcatcaaaacctaaccttttcatgtagaagcaaccgacatgattctcatcagaataggcttcttgttcctagtctgaacaaaacactggagttatcttcttttgaacatttttcaactttttttttgttctagatatgatacaatattaaggtgactcatctccaattttcgtcagtttccaaagttttgctgctttagtgtaatgttgcagaaagttcaaaactgtactatctcccactatcataaaccaatctgctttgtatgccaacgaccactaaactagcaacacttcattctcattcttgtatgaaactattctcgcaattccataaatgtcttcatctgcagtctggtttatgctacatgtccccggagctctcggcgtctgacacacacttcacccaaaaaggattgagagcagttcaattcatcatgctcagtggatcacttttcatgatttatcgattaaaaaaattgcaagtagacgagaacagatggaaaactcttacacgcaagtacacagaaaaagccccttttccggcaaaggatttggagtgtaacttgtataatcaaaactccagtgacagccaaaaagtctcaatctttataaagacccacaaaaacttgcggactccagagtgagtgtgagaatcggagatg

SEQ ID NO: 33210 - DNA, 3003 bp, Unknown
  misc_feature (1)..( 3003): 2750-1469P.txt file - cDNA_ID_3066832; gDNA_ID_1620514; Annot_ID_159210
agaagtgaacaacaaactagtccaaagattcttgcttttttttcttaaatccaaaggatcaaacaacaatctcatgaaacaaaaccatccgaaacgagtcgcacttcatgtgtgttggttaggaaaggacaaagaaacaagtaataagatgatttcagtttttgtttgttctcgtggattttgattagttagttcagagaaaaagacacagagacagaaccaaagaaaaaaaaaacatttcgatctaaatttactctgttttcttccgcgaagccaaagaaaaacgctgtcgttttttgaaaagcgaaacgcgtcaaccgcctgaaagagtgcaaacgtgtcagacacgtgtgaggagacaaggataaaggtcccactccaatgtcattgttcaattaatcgtgaattagacgatcctatccgttcatttttaaaagcattgatctgatggacggcttacaatttgacttgtttcatataatctcatctccatagaatatctacttttattagataacaatagctatctattctacattttatattaaaaataatgaaataattccactaaatggtcaacaaataatttaatattaaatgttattctaatctattgttatgtagaagaacaagtgggatatttttctatattcatctctctctttatctcttttattatataatcaaatatttttttgaacttgcataatcaaatattatgcatctcttatttgaacccaaaataaaaatgaaaatatgcaaattagaggtgcatgtcacttgttttaatagagaagaaaattgtcttttttaaaagtgaaaaattgaactaaaaagagtataatttataaggtgaataatagtggaaggtgcagtgtcaattgagaaagccattgcgactgtgacataaacattaaagccaatatgattaaacgatatatagttagagaatatagatacaagaaagaaattgaacaaaaaatttcatttccgtcggtgtttgtttttatatttaggaaaaaaaaagagaagcgaatgtttcccctgggattacgcaaatatcaaagattattataggaaaatctggttgaggaaagctgactaaccaccacataaaaagccacgtggcacatgcacttcccctagaaatacgaaactttaataagaagcatccagcaaaaccgaaatcttggttcaccaccgtctccagatcaaagaaaacagagaaacatctgtttttttgtttagtttgatctgttgagagatgacgagcggtggcgacgataaaaacagatctgtggtgacagatcatcaacatcaacaacagcctcctcctccgtttcaaggcgtctctaactatccaccgcagcagcagcctcccgccaccggttatcctcagcctgctcagccctacgcccaaggtttctttctttcctcatctctcattatatggacaacatcatcaaagctgtcgttttgttttgttttgtgttttgtttggtatagaagcttcattttattcttgatccattatatcgaagatcctttttgatcaactttttacctcatctaagatgctaagattcgcattggattaaaatttgattatttgaaaattcgagtgatccagtaattagagagaaattgtatattgcctcttctatgatataaatcaagatgctagattcacttgagaataatgacatgaagaaatgaatcttttttataaaaaaaaaaatcaggtttttgaaatagataatgcaaatagaaggttctcttttggcgtttacgtcttacaatttgacaaatgatttttttgcttagtattttgaacattgtggattcatttggaaacaaacatcagaatctcttatctcatctgccaaaatttctagctaaactgtagtttctcaaaaggattgtatcattattgcaacgtacacacaccacttggctgttctaaagctcgttttggttatctctagttttcatcaactatagtctttggtcgcaggttatgttgttaatggagtaagaccaacagaacacggtcgttgttgcggtatcggcattggctgggtattgtaagtgatctttatcatttatttttacctaacttctcttctcattacattcttgataatttttgagagttttttttggtttgatgtgtcttgaagattcatccttggtttcttcttcgctttgccctggtacatcggtttcttccttctattattctctaggaacccgcgtgagagaccaggatatatagcttgcgcagttggggtaagtccactactctatatatctctctcactcaacaagaaccatttctcttttctttatcacaaatataaatcaattctgactaacccttccttttcgcaggctgtttttgctaccattatcgtcatctttggaaccgtaagaggatcaggggtgtggtcatgaaggtgaagatgtcaacaatctgaatccgttgagattttgtttcagaagaagatcgatccataatgtttgtttacataatgtgtattgtctctagattacaaaacagtactgtatatgtttctttgaaaagttcttcttctgaaaacatactagtgtttgcattttcaaagaattttttttatataaaaaatttgcatttgtttagatgatacgaattcaaatgaatctgattataagctcatttagtaaatgtgtttgacctgaaccactgactcataaaaacacttgagctcatttgaccggcgacagtaaaaaagtaaatttaatttacccgatttacccgctgcaaatatttttgtaacgccaatgtaatgagaagaataattaaaggcccaagtaggaaaaagaaaagcccacagagacggcccctagggtttgtcctttagagaaacctcttttatagttttctcatgagcgccaccgtttagctcttttctctctgttttgctcttggctgattcgttggagcttgatctctccgtggaaatg

SEQ ID NO: 33211 - DNA, 3003 bp, Unknown
  misc_feature (1)..( 3003): 2750-1469P.txt file - cDNA_ID_3066837; gDNA_ID_1620514; Annot_ID_159206
gatttcgttgcaaaatgatgatgagatgatgaattggtgtacggaactttcttacatggatggtgtggtagatagtggtgttcttgagattgaaggtggtgattattattctcatattaactatgcactcacatttgaggaaccaactctttctctatggcaagagaataatgatgtagttatgtattgattgatttcgtgaagtcataatataacaaaggctgtttcgtaatccgttaacccccaaaaaaagaaggaataagaggctgtttcattaatctttaacaaattaaaaggaaagaagaaagggaggctgttttaatcagttatctaatcttttaaattttatgtatgtattcgtaaatgttatgtatgttgacgttacatgtttttatatatatatatatatattatgattgttgagaaagcaataccaatatacatagaattattttaaaagattctcgtgattatcaagactagcatgcatcaagatgtaactgtagcggccggatgcaaacatatgaaagttcaaatgttttttgttttttgtttttaatgattaatgtttttacaaagtatattttaaccataatataacttgatgtaaaaaaacatgatcgtgctaattacggtaacttttaggaagtttttttttctccctttctatccaatgaatacccgttgacgatagccagaactacaaatttgtacattttgttgaatagaaatagtcgaatatttaaatggtataaaattaaaagaaatttgaaacgacattagccattgaattcccaccaaaatatttattggattttgttattcatgaatcatgattacataatggatgcatattcgcataattaatttatgataaaaaggggtagactctagaggcatgtccactgtcatatcaaatgatagtaacataacttacataagtgatcaaatgggctggtttatttgagactcttggtgtggaatgaatgaatttggttatagaatcttgaacgtaatcataatttctgagtgaaaatcatgtttattttcatagcaaaaaaaaaaaatcatgtttattgactttagaaatatacataacaacttcttttttttttttttggtaatgagagctttttttttgtcggcaacatgaaatacgggagtttggattcagatcgtgacacataaacaatatccgtacatagtgctgattggaggtgaaagtttttttttaataaaattttaaaccataagatattaaaaatttattggataaagatgatttgaaaactaaaaagggttaaagcatagtatattgatttgcttataaactgcataacataacataaggcccactttaaccaaaacataaggcccataagatatgggcttttgattaaacatagtggtggatatactcaaaagtccatttctatatatcaggcacagacatcagctcatcacactaaatagtgatacacacttttggttagtagttcgtaactagcatcaattaagcttcactacaggcctatcacctttttttttttcgggaggcctatcacctatgcattcattatacaccggttaatgtatagaaattaaattattgtttccagtacatcaattatccataaatctagtggctatttttagaatataggttgttgaataaataacgtaggagtaattttaagacaaacaataaaaatacaaaaagaaaacttgagtttggtggtgttttttaaaaaaagaattggttttgatttgtacaccaagttatttttgtatagtcctttagtatattcttagtgactaagaaatagatacaaatgcacatcaagtatatgctttatattccaattcattagaaaaagatttggctgctttacagtgaataaactttttcaatgttttttcttttcccatgcacgttgatggtgtagattaacaaacacttttttttttcccatcaacaaaactagtaaaactacatgtgccaaaatgcctgtttctgcttatcttattaactttcactttaattaagtatgtaatttgtttgtttcggagaaaaaagcttacttaattaaaaagctaagctttccaactttaatctttctgacatttaagaccaattatgcaaactaattaacacttccctctattgattgatttaatataataaataataaatctcaactttcttctatatgaatatgacaatgatttcaaggatttaatcacatcatgtactaataaaaatttggacctactacttacaagttacaattaggaatccaaattacatttcttccaaaatcgaggtttattattattttattttgtttgtatgtgaattaattaacccaattagactaataaaaaaagccggtcaatatttatatttcttccaaatatactatatcacctatttataaattactaaaagagctctatgacgtaactttaaatagcaaaaggctacagtaaagtgaaaataaattgtttcacatatccaacgatgaaaaaaaatgacaaaaaaataatcatggtttttttaaaacaaaaattcgccgcaaattctattactgtaaatcaagaattttatcatctatctaactcctaaatttttttaaaaagaatattttctaaaagttttctctagttattaaaatacatattgttattgttactgagaaataaataaatccatataataaattaacctatagttttccctctcaaaaaagaacggccaactaaataaaagaaagcaaaaagccaaaaagaggaaatcgcacccattcatcattctctcttcaaaaaattccgccatggaaactaacctcactaagcaatttcctctttatataactccttccttctccactcctctcttccctccttccgatgcttccctccaaaaccccaccgacgacctaatccctagaacacgaatcagcttaattcgtctgattctgattgattttctcccaaaacatg

SEQ ID NO: 33212 - DNA, 3000 bp, Unknown; identical to SEQ ID NO: 2283
  misc_feature (1)..( 3000): 2750-1469P.txt file - cDNA_ID_3066879; gDNA_ID_1620515; Annot_ID_159243

SEQ ID NO: 33213 - DNA, 3000 bp, Unknown
  misc_feature (1)..( 3000): 2750-1469P.txt file - cDNA_ID_3066883; gDNA_ID_1620515; Annot_ID_159240
ggtgtcagtttccgaggttaaacctaaaaacctcggggttcgacctggggaagctctagccgtaaactttgcctttgtgcttcatcatatgccagacgaaagcgtgagcaccgagaatcaccggtatagtttttattattaaaatttgtttacacgtaggatgagtcttttgtttagtcctttgactaagttgaatataatttgcagcgaccggttattgagaatggtgaagagcttatctcccaaggtggtgactcttgtggaacaagagtcaaacacaaacacagccgctttcttcccgaggttcatggagacaatgaactactatgccgcgatgtttgagtcaattgatgtgactctaccaagagatcacaaacagaggattaatgtggagcaacattgtctagcaagagatgtcgtgaacatcatcgcatgtgaaggagctgatcgggtggagcgacacgagctcctaggaaaatggaggtcacggtttgggatggcgggtttcactccttacccgttgagtcccttggtgaattcaaccattaaaagtctgcttaggaactactcagacaagtacaggctagaagaaagagatggagctttgtatcttggttggatgcatcgagatttggttgcctcgtgtgcttggaaatgagacagtgacatttctctagtgtgatggcaattaatgtgtttctacttgtatgcaatttagtcgctcatttgaatcttcaaaacatttgaagaatcttatgtttactactagagaccaagagtgtgcacaattgctcaaatgtcaaagtcaactctttcctcaatcaaaatttaagtatgtagttcacacgaatggatctttgtaataatgtaatatatgaaatcaatctagtttcaataaaattacaaaatagtcttttcatacttttgtgacatcgcagcgacttcaataattttgagagagaacacgtgtaaatgtctctttcgcagtgtgtctgaatttaatttgacacctacttttaatcttttatatatcatcattaataataatcttcgacatatattgattagagggagtgaaaccaataaccctacgcgactaaagaaaagcatatatgaacacaacaatggtttcttatgagaaatattaaattcttataagaaaaggactacgtattgaactatacatacgaactagacctaaaatttcttcattaacataatcaaaaatataaaatatattcttagaatataatttaaattttgtaaaaatgttgtttgttgaatataattttacattcaattcaaaaagaaaaagaaaaagaaaaaatcttcaaaatttttattttttaattttcttataattgaatccttaccaattatgtaattttggttactcattgcgatcattccatattggtcgatctctaattcttgatctcatttggtcttctaccacctacgaaaaactcataaatgttaattttgacccttatagaatatagcgtgatctatgtatgcaacaacatttaggtaatctcatgataacattaagtttgacgcggctgtagattgatgccggaaaatcaatcccaataatttctctcacgctttggcttgcttgggacttgggagtcaaagtataaagttttgtcagtgtgttttgcgcctcagttctaaaccaaacttacaattagtcaaactgttgcacgtttttttgttacgcttgtctagtaaatcagaacaataactgtctcctcggggatatctccccaacttttccgattcttcacaaaaagtaagcttgaatgaggagaatagacgagtacgaagactatgtagtatgtcacgaagatataagagcaccaaccatgcatatcaatattttattttgtaaccacatgatttaagatacttatttccaaaaattaatattaatttctttttttttgataaaaggcttatataaataaatttctatataattaaatatttactttttgaaatgtatttcatcaacatatcagatttattggagtatatatatgtatgctataaaacttttaatcatgattataagattattatgttgttctaatttaatctaattttgataaacctttctcgtattttaatttatcatgttaataaaattatataaaatgattagatccttaagattctactcaagactcgttagatgtttttttcattgtagtagttaacctctagacattgagtttcaattaggagctatttgtttgtaacatccctaacgaatttttttaagtgtaccccaagccaatggaaacaaccatcagtccaatatagaactctctctcaatttacagttgccttctaatctctccaacctatttttatatagttatgactcctaacgtaaccagaaaaagagcttgcaacagaccacacatatactccacagatctcacaatcgatatttaggcctcattacgtctggaaatagtcttttttttttttcttctaaaaatgaaatccaaaaatatcgtttaaacaagctgaaaagtgaatggtggagaagaaagtggaactttcaaatctctctcctcctagatactatataatggtagcaaaacatagaaacaaaacataaaaaataaaaaatactgtaaaataaatagatagtcataactagtgtattacaaaaaaaaaataaagtaaataaaagtaatcactagctagtgactaaactaaatcccaattatgggtcgtgtacattttggtgtatcagcattctttgttttttgtttgttaggtttatcagctaatgcaaagatcttcaatattaattctcctccaggttctgatatcactaacgtcagttctaaaacctaacaacaatctcgtttatctatacattttcttcttgttctccaagtaatttttaatatctttacgatgtaggcattgttgaaagcattcaatgaggcatgccaattcccgacaaagagcaccgttatg

SEQ ID NO: 33214 - DNA, 3000 bp, Unknown; identical to SEQ ID NO: 2297
  misc_feature (1)..( 3000): 2750-1469P.txt file - cDNA_ID_3066909; gDNA_ID_1620516; Annot_ID_159283

SEQ ID NO: 33215 - DNA, 3003 bp, Unknown
  misc_feature (1)..( 3003): 2750-1469P.txt file - cDNA_ID_3066924; gDNA_ID_1620516; Annot_ID_159300
accactcaagatctaactcacactgatctcttcaagaacgcattaaacgaagtcatgcaattgatcaagatggtaaaataacatctctctttcactctcttacgcacgccttcaagctattctcttgattctcatttttttgtgctcatgaatttgaagaacttggtaagagattactggtcatccatctacttcatcaagttcaaagaagaagaaagctgccacgaggcaatgcataaggaaggatacagtttttcatctccaagactgagttcagttcaaggctctgatgatcctttctatcaagaacatatgtcaaagagttccagatgcagtagtcccggttaaggagtctaaaactggtactagaccagaacccaaaccaatgttcatagcaatccaatccatgtaatcttccttcacatttcttgtacatgtcattttctctcttgttatacctaactgtaagagaaaatgtccggttcggattttggtttagttttaaatgtgtataccggacaaaaactatggaaccatactaattaatatctcgaagaatttatacgtatatgccatctgtttcaccaagaataaaaaagcacctgcagattgatcttcatgtccttgcagagtgatgatgttgcatcacatgtttcatgatgtgatgacatatccattggcctcgctaaggcttttcatcaacattttgacataatgtttttttccaccactatattttgacgtgtacaacatctataacgagaaggtgggatggtcatcaaatatttcaattttagaatataatttgttactgaaaagagaaagttgaagaattttttaggtttatcatatgattaaatgatattaaaagttttaaatatctataaaatataaaattaaatattgttgagcagcaataaaatgtctttaggtaagtttttaaaaaaaaaaatcatctgttaccatttaagctctaaattattcagtaaaattctgcaagaaatgtcaattaaaccctaaattcagtaacttagccagatttattctgctgttaacatataaaaattaaatgttcaaaaaataaaacttatatgtgtaggtaagaagtcttgtcagcgaatgaaaaaaaagtttaaattaatgtttcattattatggtgaatctttcccaaatattagtggttctcatctcaccataaataaatattatttcccaaagaagttttttttattttatttttggctgtctaccatatggttttggtatatatatgggtagcaattattgggtgttgtcgatgttctctccaagatagtttataaaactaaaaggaatctttatcagtttatctttcaccaaattagttaatttcaatatatttttttggttaaattgtttagcttatggggaattctctaaatagtaattacatctattttctgttccaagactattatgaataaattttcgaaaatgctacaaattagttgtgataatgttatttccttttcattcttatatctcaatcttaatatcttcattctatctttgtttaaaactcaaactaaaatgaaaactctataacatctagacatgaaaactctcactaaaatgaatttaacaaaatttacttctattttcggtgaaaataatactccttataaacatgaaaaagaatgaggatgtcatcatagtggataactatgtaaggactcatgagtaatataatcaaattattagcagatattaataaactactataaagatccgttggatagatagatagataacttgttctaccactcaaaccaagttttggatgcacacgtctatatacacacataacacatgcatacatgtattgatcatcatgatgttatattccattacaatcaaacatatatgtgacatataatcacaaattttcttataatttgttatgttatttactgagaaagagatctgatcgctttataagtccgcataaagagacaccacaactttctttcttcttcattcacttctatcaacgccaaatttgcagactttcccaggaccaaaattatattaaaaaaaagttccttttttctgatcaaattgtgaaattcgcttgcttgctttcttcacagtcaattaattctctaacaaaacattcttcgatcgttcgttttcatcttctatgcttctctgatcagacacaagaacacaaccaaagaaactcactatagcttgtctgtagattctgatgttcgaattcttgttgttgatgatgattgaattgatgatgatgatggtttgatgcagatgggttttcaaaaatctcatcttttttcttaacaagtaatcatttttatccatctcaagtctctgttgaattttctatgattttgtctctgattgtgaatctgggtaatgatcaaactgtagtattagttactaacatttccccaaatggattgatctctctgatgtgtttgtttggtcaatcaaaattgatttctgggttttctgttgtgatcatggtaaggtcaaaagttttgagtttccgtgtgcagaggagaaggagtagtcctttgcgtgtgacaaactgttttcttattatcttccgtatcagatccaatctttctttaagattcctttttcatctttatagaataattcattgttgattcctacacttctcttccaagttttcttctttcattcttggttgatttgatttgattgattcacagattctttctctgttcttcattagtcaaaaggtttcaccttttctagtttctgtttataacaattgattatgatttggaaccttacttagtttctgtttcttatgtagatcaaaaagcttagaacttgttgaacaatactagagactagagaatttgcaggtaagtttttggggatcttgttctgtttgttttctcatatttcaggctaatcagagtgtgactttcttgtcttaatttgtggttttgtagataatctgtttcaaaaatg

SEQ ID NO: 33216 - DNA, 3003 bp, Unknown
  misc_feature (1)..( 3003): 2750-1469P.txt file - cDNA_ID_3066931; gDNA_ID_1620516; Annot_ID_159296
aagaagctaacaaagatttttcagttttcagtttctcagcgaaaccaccagatttggggataaaattagggtttttcgatctccagagaaaacaaaaaaaatgggagaatcaatttgtcttgtgagatctttctcgcaaccttcagagttttcatcgcgtgaaatcaacgaggttagtgcttaagatttctaaatctacaatcttggatttagggttttgataatagagattgattttgctagtgaaatttctgtgtatagtgtgttgtttgatgaatctgaagagaatttgagatttggtttttggtttttggcaggtggtaccgaatcgagtgcttacggaatcagtatcgtttggtagatatgcgaatgaaacactagcgtgggcgagatggtcagcttttactcagaatcgttacttggaagaggttgagaggtttactaaacctggttctgtagcagagaagaaagctttctttgaagctcatttcaagaaccgagcttcagggaaagcagcaacacagacgaagaagattgaacaagtaaaggttaaagatagtgttgagattgtttgtgatatacctaaggatattctcgttgattcagaagtaccactagcggtgaatagagaggtgtctagtaatgaggtggactctgttgttccatcaatttctgtaatagatgaaactggtaaagtggagaacttgaagtcagtggttgttcctgatgaggtaaatgcatttctgttacattgcaatttcctgtttttattttttctctctaaacgtccatggtgttttcagggcaattctacttctttgagcaaagaaagacctcctagttcttccggatcgaaggtctcaagctcaaaactggaatcttccgttgttatagaactggatcattcacttaagaacactaaaaaagagtcatcctcgagtagtacaaggtcacttagtgcatcgaagaaccgaagtagatcacctcctgagcccattcacatgtcaatcagctgtgtttcttctagtaataccgagaaaactattgtggggaggccccagaacggttctaggagtgcagtgaaagcagacaagaagaagagatcaggtccaagttcagttcacatgtcactcaattttgcttcttctactcttcgtacgaccaaagaagccccaaaaacactggcaagaaactccactacacagggaacaacttcaacaaatgctagaaacaaacttttcccaaagataaacgaaccaacgggagctttaaaaagctgcaagagaccattgtctcagacatccaaagacggttcaaccaatgtaattctcttcccaagtttctcttcttgcgtatatcccaagcatatttgctgagactgactcttacatatattgcaggcctctgctgtcacgttacccagacttcctcttctcagtaatctgctatcagaaaacaaaaggttactgatcaaaccatcttcaacaccaattcatcgctttatactattactttattattaactcaaccctataattaactttgcttcttctgatatacaggaaaaacatatctgtaaggagttcagtttcatgtagaatatccaacaatgagcaaagaaaaccttctgtcgggtaagcggtttaagtaccaacctcttagagaaatactatcttatgtcacttactgcaaatggcctgagttggttaattgaaagtgtttgtgttagttccctgatttatgtggacataagacgagatgtttttgtctaatgcattttgcagctgtgaaaatctgtcaactcatagcagaaccaaagcaaagtctttgactgtatcttctcccttcgtcttcagaagtgatgaaagggcagagaagaggaaagaggtagaactaaagaagatccttttactttatctttgagattatttgaggacttatagagccgtagtttaaaaaagatctcttttgttgtggatgtgtcttgtctgttagttcttcaagaaagtagaggaaaaaaacaagaaagagaaagaggataaattttcttgcggcttcaaggcaaatcaaaacactaacttagcatctgaagaacacaagaacccacaagttggtggttttcaggtatattcaactctcagactgtaacttgtcataaatttgggtattgaatctttgatgtatgacattataatcatgtgcaggtaacaccgatgaccctgacttcaccaagattccgcaggaaccaaactccaggaaaagagaacataaaaaaacctcatcaaactcctcataaagcttcctcaatgaagatcatcaacaccaaaaaagtagtcatggagaagcacaaaagcagcaagatccatccctcctccaaacagcagacaacaaaaagaactcaagaaaatatgtctcctaatattcttcagaactaaccagagacaaaccagatcaatcgattcctcttcttcaagtctctagatcatcgtaaagattcgacttttcactttgaagattccgaaagttttgtcccttcagctagtaatctcatctcaagcttatggtttaggtgactagcccttgattcagattgtgtaaccacaagcttttaaggagctgtgtagaatagatagaactcaagtctacttactcttcaaagtaactatgtactcaatagttctgtagtatcaatcttgtatcatttgtatacatagagatttgaaataaagaattatgtctacttttcaatttctcattgtgtttctttcttgaattagtatagacaggaacatggcaaagctttctgttttacatttgttttaaacgacgacgttttggtatgatgttgtgatgttgtgttgttgtggtgtgggcctctcgtttcagaggtgagagaaaaaatcttatctctgtggactgtgattgtgtgatgtttccatatcttcagcttttcttctactacatgctctaatcacgtccttgtagaggaaaagaaaaaaaatg

SEQ ID NO: 33217 - DNA, 3003 bp, Unknown
  misc_feature (1)..( 3003): 2750-1469P.txt file - cDNA_ID_3066933; gDNA_ID_1620516; Annot_ID_159294
cccataaggtcttgagaagagaagtcgcccataataaggtttggacaaaaaaaattaagtcattggagtcgtcgtctgtctttcccatattagggtcttcttcttccttttactcctttttttacgcttgaagcttcttctcttttcttcttttcttctcattgaagctttccttgttgcaggatttaatttaggattcacaattccaacacatacaaattgtttaaaaaatacaataagtcataaagtcagaatacgttaaacattgaaaatgtgaagtataatatttggttttctcttcttgttttttcacaagttaagaagtgtctgaaaaatagtcatggcttcttctcaaaaggtttctgattgggccttatgaggtattgagaaaagagaagtagcccattaaggtattgagaaaaagagaagtagcccattaggtcttgagcaaaaaaagaagttgagtcgagcaagcaagagtccctgactcagtcctcttttctcagctgtccagaaagtagaaaccctaaattcgaaaatggaaacacgaaatcgaaccatacatctcactgatgcgatatggacggagattctagcgaggttaccactgagaatcatcgctagattcaaatcggtaagcaaaacatggaaatcaacaatcgaatcagtctatttccgccgtctctttgtgtctgtgcaccgaaaatcctcaacctcgtggtcgctaatgtggtacggacaaaaagatctcgtaggtttccatggatgcgagacatggggtcttccaaagtctctatctttttacatcccatcgtctctttgtattatcgagggttcctcccatggattggttttgatttcagaaaatgatgatgattgttgctttgtgggtaatccagttttacaacagtggatcaaaatccctccacctccagttcactcttcagtgtttggtttggtgtctcgcgtcgacgatgatggctttgttttgggcttcaaagtcgttaagttagctgaagtaatagtgacgaataactatgtctcgtgttctttgagtgtgtttgtgtattcctctgagactgggatttggacttgtaagactattcactgcccttatcaaatcaccaactttggttctttcactttggatggtaccatttactttgaccatcttagtgaacctggagtgctcgtagcttatgatttctattctgaaatctccgatcagttttgggttatacctctcccggatcatccgaatcacggcttcaatagcgacttcaaaggtgctttgactacgtcccaaggatttgtcatgtatatcagaacattagctcaatcttcgtctaatgttttcaaggcttggaggttgaacaatgattcaacttggcaacttttgtggaaaatcggcctcccgtcacttatcggtgattatgtacctatggcaatgcatccatttgatagtgacattgtccatctttggagtcaagatcatcgtcatgtggtatcatggaacttgcggactcagaagaatagaatcctcggagctgaagataatgatgaagatcataaagattgttacttgaaccagcctgtttgtgaggagtgtatggatgagatatgcggctgtaaagcttctgtcaggttactacaacttgttctcccacggtggatggaatcggtgccttgtcctccccaagttgagatgatgaatacagcttcggtaatctcttacgttacttcaatgcaagagacaatgataaggaattggcttcatcaatgatttcaatatctgcttttttttcttttctcgtcttttggtttctttcttctatctagtaccatctatgtaatggaagacaaccatatccatatcatgcaatatttgcatcttcttatttttgtatcagttcaatgacatgttttgccatttcatctttctaagttgttacacaaattgtcacttcctttgaacaagagtttcttcaattgcagttttattccagccgcacgtagtttcttaaagatatgttattcgatagctttaccatatgtactagcaaaacgaactaaacgacggcgtacgtagcgtaaagtagtgcccgcttcaaaatttcgtaatcaaaaaacacaagaagacttggtagcccaatccacataattaaatactattttaaaacaaataaattaattaaaaaaataaagtagcaaaaaagtacgatcgatgaaactgagaccgttggatcaaacctatcgaattataaaaactagatcacgagaataataaaaagaaaaagaaaaaaataaagcagaaaattcatctccaaaaaaaaagaaagaaaaattcatacttccaaaggaaaggggaagaaaaacaaaaacaaaaaaatctcaagtcaacaaacaacaacgaaggtccgaagaactttgaatgttgttatcatcatcatcataatcagaatcatcaacatcatcgttgtattcttttctgggtattttctcttgttgaccttctaattatgccatctccgattatcgatttttgtagagcaatcgtattttatcgaagcccttgtttctggttttagtctcttgtctgaaatcaatctcaaaaaggttctgttttttcggggaaatgtgcagcttttgattgtttcattttccgattgtttcagaagaactggaatcgccgtaaagttcgaatttttttttgttagattgtacaaaagggtgttgtgattaaggaagaagaagaagaagaagataaaaaggttttttttttggctgttgttgtaatctgggaaagtttgggattttgtatcgatctcaggtttgtgatttgattctgtttctaaaatttattaggctgatctaggatttgagtttttttttatatggactttgctttttttctcagatggtgaaaagacgaagaagtgtgattgttttggggatatgattaaagaacctgaattgttctggtgttgagaataagaaactatg

SEQ ID NO: 33218 - DNA, 3000 bp, Unknown; identical to SEQ ID NO: 2295
  misc_feature (1)..( 3000): 2750-1469P.txt file - cDNA_ID_3066948; gDNA_ID_1620516; Annot_ID_159284

SEQ ID NO: 33219 - DNA, 3003 bp, Unknown
  misc_feature (1)..( 3003): 2750-1469P.txt file - cDNA_ID_3066958; gDNA_ID_1620516; Annot_ID_159277
gaattatggatatacattgaattgaacgtgcatattcattttgtttttgttttttcaacaaattaaaatgaattctaagatgtttttgtttttttgttaattgaattcttaagatgttgacagaaaataaattgaagtcttaagaataattgatttgagattttaagacttgtacttttctttggagattggagatttgacatgctcgaagtcgatgtatacaatttggttttttatcaagtgtcattctcattcgatggagctttttttttatcaaaaacgtggaaattagtgatttctaatgatctgaaataaaaattgggtttacttccatggtttttttttggacaaaggggtttacttacgatcaagcaatcaattacatagttattctggattagtcatttggtaatatttagcatcttatgaagaatcttaaacacgtccattatacaactaaatatgttgcaccatttgatggaaaaaaaatatgttgcaccaaaaaaatgatccaagatgttgaaacttgaaagaaaaaatcgaataataataacaaataggctttctggctttctatgttactgaaaggcccaatgcacgtaaacggagagcccacattacaaattaataatttttgttgggctagtgagaccataacgctatcatacgttgtaaatctgtacagcaagttaacaattacaataataatcagattttacactcttttatagataagtcatggtcaagactcaagagtcaagagtcaagaccaacaatcaatggcctagcttgtacaacaaaagacttaaggctatatagttttaatcaattagagtcacataattcacaaatatcaacgattatacaacggttgttattgagtagttaaaacatggttgatatagattagtgagaaaatattgattggttgacaatatatgaaagtgaaattatcaaaatgatattatacataagtttttaaaatatatccaaactcatttttattataattagaaactttttaaaaaatatagaccgtatgtgatctatttttatgaaacttaataacaaaatttatttgaaaatattagattgtaaaaaaataattattcattctgtagtttccggttaaaaaatgtgcagaaagatgagtttttagtttgtgggttcagtaacattataagctaatatttttttattagttgattacatattattcaaggattacatatgttgatgaatcctttaatttactcgtgttaacaataatccgtaattttttaagacgtgagggatacataggagagatttccatcgagatgcatggttgtttttgattccctcactcctgataagataaactagaatacgtttcgacgtcaaaatatttaaagatttgcttaactgaaaaataaagagaattttgtggaataggtcagaactatatttttaaattagctaaaggatatttttaatataattttgttaatggtcaaaaagacctaaaaaaaattcttaacaaaaaaaataaagagaatttggtaaaataggatagttttatgtttttcaataagtaaaatggactatttatgttttaaattatctaaacggtaatttatatagtttgaaagtagtataaaaaatattctgattcgttgctaatcgttctaaagtgctcaacaactacaacgaacgaccaagtccctttttccccgtttaggaaatgatgatgttaacttgtaaatatttttaaaatggttgaacaaatactgtataacctacttggattcaatgtgtcaattgttttactgcagaattcaaaaatgagtcaggattcgaacaaatgtaaatgataaaatatatggttgatattaaaatgttgcaatagcggcgaagccatgccacattgccacatatgctttgcttcaaagtcaagacacaagaaatgtgcatcgttgacccaccaaacaatattatgccggagagttgtagttcttttcaacattcaaagatcgaatagacaaattaaggcttccaatatatatatatatatatatatataaataaagacaaatatctcaaataaaggactcataattcttataaaaactatattataaacgtaagaaaaagaagaaggagaatgtgaaaagctctatttcgattagtattttgtaaactttataaacaaaatgatatgtttctctaacaaatactttaagaatgaactttgatagtttggctatgactttaagatatatatacctttcacatgactgaacgtatatagtagctttgaaaacaactaagaacaacttttttgcacatgttaatgttatcggtttctattaaattccataataaataaaaattgttttcttcatgcctgcatttacggctacatctttgccacacctgttaaatattcttggtcgataatatttgattcattttttgatccctttcatattttgtttccatgacgtctaaatacatatgtaatcgaacataagaaaattccatttcttaactataaaatcctttacatattttgtgtagctaatttagtaggtaaattaaaagttaatgtaggcatgtttaatatgttttcgattaaaaaataaacgtaagaaaattctattttatatgtttgacggtggaaaataaattgcgaaaaggcgaattaatttaatttattccgtcggcaaagttgaaattatgaataacatttaatatttacagattagagaaacgcgtcaacacaaaagattatattcggacgaaataatttaatttatttgacctttattgggcctaaaccgaagcccattatccaaacatataagtgtagagggaaacatgaagcatccgttgtatttttgatagggaagaaaaaaaaacacaaaagcggcgttgatttttttagattttccgacaagatttctcgtgagaagatttgtctgaatctttctttcgaagaggttttgagttaatttcaaaatg

SEQ ID NO: 33220 - DNA, 3000 bp, Unknown; identical to SEQ ID NO: 2298
  misc_feature (1)..( 3000): 2750-1469P.txt file - cDNA_ID_3066963; gDNA_ID_1620516; Annot_ID_159273

SEQ ID NO: 33221 - DNA, 3000 bp, Unknown; identical to SEQ ID NO: 2304
  misc_feature (1)..( 3000): 2750-1469P.txt file - cDNA_ID_3066988; gDNA_ID_1620517; Annot_ID_159327

SEQ ID NO: 33222 - DNA, 3003 bp, Unknown
  misc_feature (1)..( 3003): 2750-1469P.txt file - cDNA_ID_3066992; gDNA_ID_1620517; Annot_ID_159325
cggttggggtctagaactcacacaatctgatggcggagttgagactaaagctgccgtcagcggcggcggtatgccgggattctgcccaagcccggacgttgatacgaaagccgacaatttcattgccaggcttagagatgagtggaggctcgataagatcaattccgtgaatagaaagaggtaactgggctttttaaggcctattattaggcccattacgaaaacggcgtaggtttcaacctcttatgccctgcaaggctgtgcaatgcacaaggatctcatacgagaaacatcttcaagggaagtcggtaaaaattgttggagatattttatatttgattggcgaaattcgttgtgattttaagcaatgtgcagcaaggactcgagttcaaaagttacgggtaatattggcattattggtatagttattagtggtaaatggtttcaaactggctggttagttttttgggtttaaccggttgagggattttgctttggtgtgttttgattattcggtttgaactttggagtgtcagatgaaaactcaataacttcggtgttgaatgttttatattttggttggtacgcattgatgtatgtacaatgtatggcccattgatatgaaaatatagttgtgggctctgagttttgttgggcctacctcttgtgacctttccctctcccttacaagcaattcttcttcaagttggttgatgattgtcataatgactggttgtcgtatgtatctctaagaataaattcatttgtgtgttgagtgagattcttatagcttactagtaatatgtatatgatatgtcaactgaattcatgttttgcaaggatatcattaccagtaccgaatgatgtgacatatctgatgaggtttgaggtattgaactctcatgattgtcaagtgatggtcttgaagcttataaacgatcctcaaaaaagtgttttgatatttccataattctttagagtagcttgaccttattatataattcaaaactttggccttagataatgagattcaggcagggaggtgacgtgttactcacgcgcgagagctgcgcgttcaaatcataaaaagccgacttgctataaaagcaaacttgttgatgatggttcaaaatttcgaaaagcttttcaaatttctcttcatatcgcgcgctcagtcaaaaagcagagccaaagatgaagaaaccgtataaaggaaagttgccgacgggaactccgtctctggcaatgtcaacactcgtcgtcgttgcttcccttctcgccggagcctccgttgtccacaacatctacaaaccagatctcgtaagcttcaccttctctttctgtacatatgttagggttctcaaatgtattaggtttgctcactttcttcgttcttgataatgcccataagcgtgatcggtttaaaaccattcatttcgttctctggctctgtgatctctcttttattgtaatgcacataaggtgttcgatgaattgcccatgagagatttgtaatctgattgctttttacttttgtgcagagtttaccaccgttggaaagtagtgaagtggccaagaaggatgattctgtaaacaaagtttgaatctttcaatagtttcatcctgttttatcaggctacattcactttggttgttctctttcaattcatgagttaacaaaaaaacatggataaagtttaaaactgagatcacttattaaaggcttttattcttcttcctcttgtgaagatgtaaagaagaacaaactctttttaggtttcttgttggtcaattcaccgttttttttaaagagatataagaaatcgcgatgatcgtgtagatgacatagagaccaacgaattgatggagtctttgctacggattgtggaaaaccatgtcttcgatacatattggaacttcaaaagagattttagtgataatctagttagtatctccatcgttagatccataggtccattaggcccaaacgcccaatcacgtggcgtgataaatacgttaacaattgcaatatgaagaaaacacgacaattaaatatggaagagaggctaattattcatcggtccaattgccaatgtctttgactgtagttaataataaatcattaagagattttcgtttaaaaacaaaaatacaccgtttcaagattaaaagataagttaattacaattgtatttttcctgattaaaaatcagatgtttacagggaaccgcagatcgctcagaaagtgtagtaagatgctcgcaaaaaccatgtgcatgtccatcaaccttcgccgtctcaatagcttacacaaaaatcgtttttgttttcttattaatataaaacctaatctaaatttacaaatttgttttcttattaatataaaatctaatctaaatttacaaatttgtattacacgtacaagtggatccaagtatctgactctacagatattttgaatctaacatttgtgtaattataatttataatctctgaagcatttaattttacttacaaataatgttagaccacgagacagaaggtaaaccaatcttccttatcccaagataagattcttcaaattaaatataacggctttttgcagaagtaataaagatagaaggaatatctagtatcaacggaaaaaaagaaaaaatctagagcacttcgaaaaattatggaccaaagaagattcagactgaaattattactgtattagtatttgtccattcacaaaatgccgaggaagaaaaaaggcattttggtttatattttgtttatttgatattcaaatgtccaacgatcctctctagctaagcttagctataattcaatgtttgaacacgaatcccattattttaacacaaacaacattaattaaatatcgtctcaaggaacttcacttccttgtccataaatacgttatttcacaccacatatactcatctatatctctatttttcttcttcttctctctctcgccggaaaaagtaaatcaaaatg

SEQ ID NO: 33223 - DNA, 2271 bp, Unknown; identical to SEQ ID NO: 2299
  misc_feature (1)..( 2271): 2750-1469P.txt file - cDNA_ID_3066997; gDNA_ID_1620517; Annot_ID_159322

SEQ ID NO: 33224 - DNA, 3000 bp, Unknown
  misc_feature (1)..( 3000): 2750-1469P.txt file - cDNA_ID_3067002; gDNA_ID_1620518; Annot_ID_159355
tacttttcaagcactatgcacaaagtaaaaagtagaagcattataagaaaagagatacaacaatcgaaatcttaggcaacacaaataaataaaataaacttacgaattcaatggcgtctctttctttctccacttcctcaaacagcatctaagggcatgatacgagccagtaaagccaccaaaaagtagaccaatacgacatgcttcctccctaactatcaaatctttctctgaaacaagttgctgcaaccattgttcacgtgtgagtgaatcgcatatacaatgataagtcaataacacattggccatagtttcaaaacaaccgtatcaaatggaacactaaagcagagactcgtaagactctaaatctccagaaattgccacaaaaacaaattccaattcatcaattcctcaccttaagatcgagaagagacgaataagactgtcccctagcgagcttaaaagcgcgaagaagaatcccgatcccaactctaacaccataagagagaagaaagctctgacataaattcccaatggcattggcgacgcaagaaacgtcagcgtgatcacacaattccgcgtgagatccacgcgccgcagagcgttgtctacgctgaagctccgccatggcatcgcgtagcctctcctccgcttctcgaagccggcgctcagcctccgagctgtcttgagataaaggagaaatcggtggaggcgaagaagaaggatctaaatccggcttggagaacgaagaaggcatcgtcaattaaaaggaattgaaatcggaaagcttctcaagctcgtttgcttaaaggaaatgaaatgatgcaatcagagaaaaatgttgggagcagtgaggaagaagccgatggggatatgctatgacacgtcatttctttatgatttttgatttgtttcttattttcttttttggaaaataatccaaaagatttattttttaccataaagcagaaagtgtgcgggtgcggttgcggttgcgggagtttgcggaaacaggcggttgcggtttcaagcgttatcaagcgttttgaacgactggttgagcgtttgataataggtgcgtttacgggagttttatgactggtaaaccagcgggtgcgatagtaattaaataaaaaataaccaaaataaatataatatattaattttaaaagaaaaaaaatacaatatattattatgataaattgataatattagaaaattaaacatgcttaataattaaaaccataaacaaaacattaaattcaaaaataaataaattttgtaagaaaaagcttagtactttatgcatttggtacatcaccaaaaattgcatcaagtagtgtaataaactgtaaataatgttgaactcgtgggttttccggattgcctctatacatatgataaagttttaacaagaaacgggtcatctcgtctgaccaaataattttctaatcgagaaaacaaatcaaaacatgtattcaataaaaaaactcaaaaaaatataaaataaaaaaaatgacgatgccatgaaatactctgagaattacactagctaatgaatggatgaaaggatagatcatacttacgtttgattcttgattttgattttgattttcgttagtttgggtagatgccataattgagaaaatagggtttcaatatattgattagggttttctgataagaataagatatatacggtttgggtggaagacataattattttaattaattaaaaaaaaaaattaacctaactgctaccgcccgcaaccgcaaacgcttgcgggaaggagcttttgaaatctggcgatttcaagcggtatctagcggtttctatgattggtgtcaaacgctaacaaccgctaccatccgcaaacgcagcgtttgcgggtggcagagggagaaccaatcaaaacaaaatgcgactggtttcgtcgaaacccaaattgttggctatgtgtgaaattctgggacgcacatttgtgatattgttgtggcttgtgatagtagctaatcggatacgtagataacatttggtcagggcatttggtactagtcgttcgaaacgataacatacttggtatgcactatttggctttcaaggatccaacgcaaaaatggttgacatgaagtcgacccatgcatttgtaaaaagaagcatcgagcacgtttgcttcaacaaatttgatgttctgactcagttgtcatattttaaaagctatatagttgcgacaagccgacaaggtacctcgcatcacagttcacaaccaatgtaaacacacactatacaaaactcggtttcgtgtcttcgtgacctaggagatggagttgtgtatacggtttcaaccaggtataaatttatataagtacattttcactccttcaatatctagtaaatggagatggttatacggtttcaccgtttcaaaaacaattttggtgaagaaaatgtaatcttctacggatatttaaatgttgataaattacttatgcaaattgtaactagtgtatgttatgcaaattatacacacatctccttttttttcgttcttcgtccgttagaatctagtttgctcaaccgcattgtcagactcttgccagtcacaattatctcattttgattaaagcatcagaaagttgtcatgagaacaatcaaaattactgaaattaattgaacaaactgaaaaaaaaaaaaccgagattattcaaaaaccaaacttaccaaaatcctaaaatccaaaacccaaaccaaaccaaactgtctactacccaaatcgaattgaaccaaatgtatttcgttttaaattctataacatttcctcgtgtaatcaataaaccaaataccaaatcaaccgatcaaaaccaaaccggattaccaaacgtattacattaattttccggtttggtgtagcttaaaacatggttaaacccaaaccaatacgaatttgtttgaagtttagattgacagcgaccaccggctaagattaatctaaaaacatg

SEQ ID NO: 33225 - DNA, 3003 bp, Unknown
  misc_feature (1)..( 3003): 2750-1469P.txt file - cDNA_ID_3067006; gDNA_ID_1620518; Annot_ID_159353
tgtatagaggagaatgattttttttaaatcaaattataggaaaaaactatgattgtgttgaatagatagacactatatagtatactgcatgaaatttataggataaaaatatgggctatataatttaatgttttaattttaaaagttaagtttttagtaatttgggaaatagtaaatttaaatttgattaaattaatttatttgataaataagaaatctttctataagctaaatatttagaaatccgaaaatattatttttggatggtgtatttaatattaaaatatgtttggtttaaaaaataataaggataaggataaggatagtggaattaatagtgtttgacaatgagtatattatattcaataaatgaaaaataaaaatgatgagaacaattatgggcttgccacatcttttactatatagaggattccaaaaagttggaagaaaaacaattcctaaattgaaaagatttttttctttttcttgctatgaatgtaaataaaatctcaaaaaaaaaattaggagatgatatatatcaagatgaataaagacgaaagagacttaaaatttgttactgcttcccttctgtcatctttgtattatttcctatcatattgttaggaaagatttatttctttacatatgagaaatatgacagcatcaaattcaatgtgcatcaaacgttttgactatttttgattttcttccaaaattaaaacgacaaatttgattttgaaagcaacttttaaaaatacgtttcgccaaactaattacagtataaattggatctcatagccaataactttatctcatcaaacaaaactcaagtcatctatttctcttgttgcatagtcccccaaatattcatcatgtcgatcaagagtgttgtttctctcctagtagttgtatgcatcgcagcctccgttaatgctcagctaccgcagtttcccccaatcatgttcccgtttccaaatccgttcaaaccaagtcccggtatggcaggaagtcccgacttgagcaaatgttggtcaacagtgatggatttgccgggatgctttgaagagattcaacaagccgtaatgtccggcaaatttgaaggcgttggtcctgcttgttgtaaagctttccttgacgctgaagctaactgcttaccaaatcttccatccaacccgtttttccctcctatgatgaaacaccaatgctccaaaatggctagtcctccaaccaccaccgcctattagaatgcaaaaatgtagttgtgttttttcgaattttttgttagtcccagaatgttctagaagaagaaatgataataataatgtcttaatctaataataatgtctcatttcttatattgtgctccatatgattgatgttctttcttcttttgattgatgaatgaatctcaaagacatgttgcgtgatatctcttatgcggttatgacaatgctttctatataactcgacatgtagaccgatcacacacaatttagaatacatcacatacattacatactatcaaacaaaaatgttccaaaataatgaaaagaagatcacgcccaagctcttttcctaggggaaagatcagaagtcttgatatcatctattttagccgccattatgaaatcattcatgctcaaccctcctgcattattcatccaacaaaccgtcttaagaaaccatatattaaaactcaaactcgaacatcaaatatttgacataccgatagaagaggtaaatagttcagctcgaacttgggtaggactttccaagtgaagagaagggtaatgaccagaagcttcagcaaccttatggatcctgtttatgagttcaacaccgcacccaaaatccctcactttccacatacaccttattttcagaccacccgcttcattatccactatactccatcccaaaacctaaaacgtttacataataatcattgagattgatgtaccacatcattagagtggtaaccgtgaaccaaaacaccaacatgagccttatcaacactaatcatttcatttttttttaatctcgtaaccattgttcctaatatgtccctcatgatactaaaattttcattggcttttctatatttttgggtcacaattctatctttatagattagaaatctgttaaacgcagaatcaataacattttcacaatattttgatcaaccaacaaacttgtaaaatcaaaactcgaacatttttatactaagagagaaatagtataagtaccttgtggaggagagttctggcatcatcgccggacaaaggaggctgtgaagacgaaacaggggaacactgaagctgggagagagacaaaacagatgcgtttggtatcaaaatcttgtgctcagtgctttggcatcccaacactttatctccgaattgactcgctatctcctccgggtaagggtcacgagctccgaagtcaccaagaaaatcctgcgccagattagaccgggtcaccgttaaccggccgagtttacggttattcctacttacaggtggtaataaaccgaacactttaaggattgagcgagaaggttgacggaggaggagggaggacgcggagatgttacacggcggtgatgatgacgtggcggccatcgggagctgtgatttgctctgtaccgaagataagagttttggtttttagagagcgaaacgattttcagaccactggactgagttaaatgggtgaggtgccacgtaatcactaatgactaatgggaaccacaataaactttcgtgggaccgactttacacgtcacgttttaatctgagaagcccattgggtttgattgtacttttgtgtccacttttggtgaatctacttaagatttcataattccgaaagtatcctttttgggtatctttaattacaaacaaaccttcccttctttcccgatttcaagccctaaaattccgagacttctgtttctcgctttaacgacagtcgccgagtgagagatatagagagagaaagatg

SEQ ID NO: 33226 - DNA, 3000 bp, Unknown; identical to SEQ ID NO: 2306
  misc_feature (1)..( 3000): 2750-1469P.txt file - cDNA_ID_3067014; gDNA_ID_1620518; Annot_ID_159350

SEQ ID NO: 33227 - DNA, 1122 bp, Unknown; identical to SEQ ID NO: 2310
  misc_feature (1)..( 1122): 2750-1469P.txt file - cDNA_ID_3067034; gDNA_ID_1620518; Annot_ID_159373

SEQ ID NO: 33228 - DNA, 3000 bp, Unknown; identical to SEQ ID NO: 2324
  misc_feature (1)..( 3000): 2750-1469P.txt file - cDNA_ID_3067068; gDNA_ID_1620519; Annot_ID_159402

SEQ ID NO: 33229 - DNA, 3000 bp, Unknown; identical to SEQ ID NO: 2321
  misc_feature (1)..( 3000): 2750-1469P.txt file - cDNA_ID_3067072; gDNA_ID_1620519; Annot_ID_159397

SEQ ID NO: 33230 - DNA, 3000 bp, Unknown; identical to SEQ ID NO: 2325
  misc_feature (1)..( 3000): 2750-1469P.txt file - cDNA_ID_3067076; gDNA_ID_1620519; Annot_ID_159396

SEQ ID NO: 33231 - DNA, 3000 bp, Unknown; identical to SEQ ID NO: 2320
  misc_feature (1)..( 3000): 2750-1469P.txt file - cDNA_ID_3067079; gDNA_ID_1620519; Annot_ID_159395

SEQ ID NO: 33232 - DNA, 3000 bp, Unknown; identical to SEQ ID NO: 2319
  misc_feature (1)..( 3000): 2750-1469P.txt file - cDNA_ID_3067083; gDNA_ID_1620519; Annot_ID_159394

SEQ ID NO: 33233 - DNA, 3000 bp, Unknown
  misc_feature (1)..( 3000): 2750-1469P.txt file - cDNA_ID_3067087; gDNA_ID_1620519; Annot_ID_159388
atgttatcttagattgaacattctttgaagtagttgcatagcatgttgaataatactaaccacaaagtctagatccacgtatacattgcagaaacggaagatgtcttccatgttgttagcgttaatctggttgacaatatcttctgcaatatctcgaagagggtcaggacttgcatttttgtaatctgatgacgccacccagattccgtcctgtaaaagtttttagacgccgttgttaaagtttgaattacaacaaagtttcttctacttaattattgagaggaaatcagctaacataagagagaattgattgtcacaagaaactaaaagagcttgcgttttctacctccatgaaatcttccatttggagaacacggtcaactgcaacaacatataaactgtcttccttaacttcttcgccaaacttttccctccatgtagcactaagacgctacataaaaaacatggagacttcgattcaattcaagtaaaagcacatgaaaagggcaagaaacctagcatcttaaaatcactattataagaaataaccaactgttttccacaggatatctcctagaggcaaggaaacgcaacaccactatcttcaactacacacacaaacagctcttataatggaaatagaaaaaacgcctaaagtctactcaacaatagatatcaactagcaaatactagcacaaacacacacacagagaaaatgaatataaatgcaagtcttctttaccctaagaacttggggttctagtccaacataatagtagcacggacaaaaacagtaacaggccaatcaagaaaccttatcgtccatacaaaggttcatcataaccaatgtatatgagagattcaggattgagttctttggagtgagagattcattaaaaaatgatacctttagaacagtatcgtctccaggtcgaccaatgctaccttgtatcgtacactgaggagtcctcaatccacattgttctaactgattccataaacaaacacaattcatgattgttccttcaaaaagaagtaaactttgccattttttcaaagaagaaacagagtggaattagcaaatgaggacctgaacatgaagagcagacctcttgtcaggagagacagagcgattgaggcaaagaacaggagtgccatctttgtcaacggcgaagcgaactcctacgccgagaggccaaccgtcgtgggtcaaagtggagagagttccaacagatgaaagctccatgatactccttgaaacctccgccggaaagggcttgtgggtcgaagcggtcgccggagtatccaaagtcgtggaaacggaacatcggagtgaaattggacgagatgggtctcgttttagagagatgaattcacgtctctcgatgggtttggcgaaatttggagatggcagaagattgagagcgaaggattgggtttggagttgcattttggttgctctgatagagaggatcgctgtgtttgacgaaaacaagataaaccttccgaaagaacaaaccggaggatcggtacggtatcgatgttaaccgaaacaaattcaaaatttccccggttattcaaaatttccccggtttaatgggtctccgagactattttagcttgaaaataggatttcgttcattatttatttgttgcttatatgtgtttccaaaatcatatacaacgatagtatatgattgcgtagatagatatattgacgcctgcattgggtaaaaaaagaagaagaagagatttacatcaaaaagttatgaagtggtgtagtaattgcacacagcgttacgctaccattcaacaatcaatcaagtgctcattgtgatcccctcacaaacttagaagacacgaaaaaaaaaaaaaaacaggtcgactcatgcatggattataatcattgatcagcatgtgtgtttttcctcatgttccaccaattttctgggatatgactaatgtactactaatgattcggtacattgataattaaatgattagtaaacaatgtgtgattagcaaaaagttgaactcgtacgtgggctctctaacaaaaactatatgcaattatgcatcattacaattgcttttggggtagtataattactaaattagtctcatgtctaacattatgatatgtttaaaatgtgtttcaaaacctatctgtaatccagtgctttatcatttgcttataatttgtttgttaaataactatttttattatatataaaggggattttagtttatgtattgtgtcattaccaactcctctttttgatacggttagtgatgagtccgtgatttaaagttctttttcttttttcatcaaccacattttgaagtttaaaataatatttttatagttgctaatgtaacactaacaaatgtaaaaaccaattgaacgagctcaacaatttgtgagttcgaagttatataaattatttaacagcttaatttattgaattttacaattagtctagtttaaaacaaaaattttgactctcatgaattcttagtttggaactatagttcatttggttggagtgtaaggtctaataattctttacatagtataaagaactaaagtataaactgttaaactctaaaatgtaatgtaactgtaaagattaccaaaaataatttagaatgttgtattagtttgaccggtttagtgaaaccagccaccggttagtgtttataccaaaatccatgacagaagtgtcggtggctgttttgtgtgtaagatagcgtaagacttcaacttcaacaatcaacacactgacaataacactcccttaaaacaaaaaaaaaaagagcttttttgacaaaacattaattgaaagagaactgagatttcgtatttgaggaagatagcttgtctctatctgccccacaaacacctctctttgttggactctctttttctttcttcttcccttagtctattttaactcagaaacctctgtttttttttgttagagagaaaggtaagaaatg

SEQ ID NO: 33234 - DNA, 3003 bp, Unknown
  misc_feature (1)..( 3003): 2750-1469P.txt file - cDNA_ID_3067091; gDNA_ID_1620519; Annot_ID_159387
cagtcttaattaatgttatcttcctttggatgtaattggtaacaaattgcagaaaaaagaccatggatgatcttcatggaagaaatggtcgaatgcacattggtgtagcgcaaaatccaatgcatgtgcagtatgaagatcacggtttgcaccatatcgacaatgaaaacagtatgatggatgaccatgctgatggtgggatggatgaaggagtggagacagacattccttctcaccctggaaactcagctgataatcgtggtgaagttgtagaccgtggaattgaaaatggagatcaattgacattgtccttccagggacaagtttatgtttttgaccgtgtctcgcctgagaaggtaactttaagttaattttggttctttgatgttttagttttggatacatatggtcaacgtatccacctggttggttttgtttttcgcttattgaagtgctgctcaatattatgcaggttcaagctgtgcttttgttacttggtggaagggaagtaccacatacactcccaacaaccctaggatcacctcatcagaacaatagggtactggtaataaaagatttaataccatatgggaaatcagtttattccccagtttgttgctgactaataaatgaaccagggtctatctggtactcctcaacggcttagcgttccgcagcggttagcttctttgctcaggtttagggagaaacgaaaagggaggaactttgataagactattcgctatacagtcaggaaagaagtagccttgaggtacgtttatgtcaagtactagcttttgtgtatgtcgagcttttgagatacgtctgttttgcaattaaggttttgtttgttcatgcagaatgcagcgtaagaaaggtcagttcacgtcggctaaatcaagcaatgatgattctggatccactggatcggattgggggtcaaaccagagctgggccgtagaagggactgagactcagaagccagaggttttgtaagttgaaaatgctttaaatttcttacaacagttatattaactttagtgaactcgttataaaacctcaattaagtctaatacatggaaacaatttatttggtaaccatttaatgacgctcttttcacttccataaactttgtctatatacgtcaactctgaaatttatagttatacttatcatgatggcatcactcattcgatacctgcaactgataacttatacttgtgagaggataaaaataactgaaccgactatgttgttgcatgttaagtcattgtagttgatatgaacttatttatagcttggtatacttggaaagcttgtctctgttcttattcttcgtcaaatggttgtgaacatgttaagatgtcgacactgtggaacaagtgagaagtcaactccaatgatgcgacgtggacctgatgggccaagaacactttgtaatgcgtgtggactgatgtgggcaaacaaggtaagctaagagtttcttagttcacattgatcacctcgtctcgtatcacttttttgactcattgatcaggcctatatatccgagtatgaacctaacaataacattccctttgactttataatatcaggggactcttagagacctatccaaagtccctcctccgcaaacacctcagcatctatctctgaataagaatgaggtgagccgtgagcgcagtatttcatagagctggagttttgatttgcttattaagagaacatacattcattttttttttctcaatcacttttgttgcaggacgcaaatcttgaggctgatcaaatgatggaagtaactggtgacattagcaacacacagtgagaactgagaaaccattggaagcaagaaaggatctcaaacaaaaacagttgttatcatttcatttgatgatggaatcgaatctgagttgtgtttagggtttctctgggttaatctcagtctatgtgggcacattttagtcttctacaaattataagacactcttcacttatttagaagctcactcatcagaaaagaaaaaaaaaactttgctcagtctctcatctgtgtgtttgattatattttcaggcagaaaacttttttttgttcttgtatttgattacaattagttaaatatttaagacttagtagagataatgcaatctatgtataaaaatagaaacaatgattggttatgtcgtgcaacccaagtgaccttaatgtcgtacacacgttcatcaggttaaaacgaaatttctcagcaacttcactattctctctgtcacattgttttattcttttccattatctttattggaaacttgattagaaagaactgattaaggtatgaagataattagtgtaccattcttcacatgatacgaggtgaacaatagtatatcagaatactagaataattttataagttataaagatgaatggtataccacttattacaaaacgaaaacatagttagatctgagaagaaggaaagatttttgttttaaaaaatgagatggttagatatatgccatgttaagagatgccaccatgttcttcttcttcttcttacccggaaaaaactctttcttcttctctttcccataaaaagaaacaaaaaaaaactaacttcccacaaattttgccaaaccaaaccaaaaatagtaatgatctcattcaatttgaaccctctctccattttctttcatagtttttttttagggtaaatcaaaatattaatgttggttagaaactcaaaaattagtttctcttttttttctctgtgattgacagagaggtaagagaaaaaaaagagagaaagtgtttcggtttttgttgccttctctcgagttaggccttctctcttccgtcacaccatcattttttttctccataacgaccaaatcataaaaccggtcgttcctattttttctttctctgcgttttttgtttcgaattcttcaatagaattttaaaagaaagaagaaagctgggtgagacgaaggaaggaagaatg

SEQ ID NO: 33235 - DNA, 3003 bp, Unknown
  misc_feature (1)..( 3003): 2750-1469P.txt file - cDNA_ID_3067095; gDNA_ID_1620519; Annot_ID_159386
ctccttcctatatatataaatgatcttcccatatttatagagtaaatcaaagaaaaaaaaagaagaagattaaaaatcttgattctatcgtctctccatcttgattctttgaaaattggtttaatcacagtcgtgtgagagatgatgacgttcaacgaccttccggaggatttggtagtggagatactctctagagttccggctgtatttctagcacgattacgatcaacatccaaacgatggaacactttgatcaaagatgggaaactttctaagaagcactcttctaatgctccaaggcactctatggctctcgtgttgattgatcataaggtttattcagtgagatccaatctccgtggaattcacaatagcgttgctccatatgttaacataacatgtcattttagcctaaaagaacatctttctaataattattcaacagaagtcgatataggccacgtctttcactgcgatggcttattgctatgcaccaccaaggactatagactggtggtttggaatccgctttcaggtgaaacaaggtggattcaaccaagattttgctacaagaaagatgactgctatgctctcggtagatcctcttgcaacaagtacaaaatcttgaggcagggtcgtcttatcaatcctagcgaagaacgttacgtgtacaacatcgtgggggaggatcttgttatcaacaatagccaagaacgttacgagtacgaaatctatgactttaactctaattcgtggaggagtattggtgtgatcaccggcttgttcaatccaaatatcaccagtggcgtgtctgtaaatggaatcacttactggtttgatattagtgaacaattcttactaagttttgatttctcaacagagagatttggaagtgagtctctcccagagggtgatagtcatttggctttatcagtgactagacaagggaaacgactttgtatgttatctactaattacacatacgtaaccggaacaaacgttaacttatggatagcaacgaagactagtgagaacaccagagcaatgtcatggagcaagttcccaatactgcggggcggagttggtctacgctatcgttgtcattttagggaaggggtgagtttcttcgcataccaagttaaggagaagattgttgtagtttcttgtcatagacccaaccggcactccaaggacatcatacacattgtggaaaatgataaattcatagaattggatcatcatggtgcaaaacctacacatgaattatctcctaccccacgtctcctcatatatgttccaagtttggttcaaattcaacatggtatttagttctttggaggaggcaccaagtcagccagtgcatggccttgtaattgtcacactagtctatgcattatctaatctaactcttgatattttataagtaagatatatgtacgcatttctaagttataacttgttgctacccttttgctagtggataattcgaggcacatggcattttcataattggtcaattagttattaagtaccaaaattttgaaaaggaaaaaaattagaaatgcttagaacatattagagcaaaacatatgtaaattttgtgcaagaataagggaaaagcaaataaaatcaaaataaaattgtatattgtggaattaagaaatgaaagaggaacgcaatttagttttaaaatctgacatattagatatagttgagtcaattgttttccaccgaagaattggttgtggttccatctaacttaagatattttgtgttaagatggtttatttgtagagatatattataattatatatgatttctaaccaaaacaacaagaagtttttaaagatgggtacaaattgaattaactaatgtaattccacattgtcatttggtaaaagaaagatatcttgacaaaagagattaaaagaattatgtgaaaaaccttggcgaccttaaaccatctccaatgtctttatatctttggcatcattaagagtaaatgtgtatcttgatcaaacctgaaaccactaaagaaaaacatatgaactcaaatagaggccaattaaagatgaggtccaaagaatagggagtgtcaagcctttcacaaagacgacgccgtttggctaaaaaaggcccaagatcacaacgacgacgtttgctgaagaaaaatgaaaaatctttcactacaatcattagaccaaaaaagaaaaaaaaaatcaaaggagcttccttttttcgctctcgtctccgtttacccttttgggatttttccctaaacctttttctctctttgtataatcaaatcctctttatctttcattgtttcgcgtgaattagctctgcaaaggctcttcattcttctcgcttggattcctctgcacaaaaggtacccatttgatgtcaattttggtttattgttttgattgccctgtccaagtgacaagtctttgtatgtatgatataggtagtgggttctagtttgtagatgaacttgtcgaatttggagggtttttagttggaagcatttatatgtgggatttggaattgttctgtctatttgttcttagcttaaaggttgggacttagcttaggacttatgagcatgagagaaggagactttttttccaattcgaatctgattgatgaaactttttttactggatttgggtagatattgttacgttttaaggtagttgactgttgttagttgttgtttactcgagattagattattgtcatctactcttgttataaaagaagctcctttgtactatatcagtgctgataactattaatgaagttcctttcccttaggtggagatagtttctttgtatttgcaaactcaatttatgtgagaatatatccaccattattgagtttcttcaacctataccgtctctgacaatctcgctttttcgttattaagaacgttccagtcttaattaatgttatcttcctttggatgtaattggtaacaaattgcagaaaaaagaccatg

SEQ ID NO: 33236 - DNA, 3003 bp, Unknown
  misc_feature (1)..( 3003): 2750-1469P.txt file - cDNA_ID_3067119; gDNA_ID_1620520; Annot_ID_159428
aggcggttccaacccacagcgttgcggctggactaggatcgatagaaggagtagtgatggagatcatcatcaccttcgctttggtctacactgtctacgccaccgccgctgatcccaagaagggttctctcggaaccatcgctcctctcgccattggtcttatcgttggtgccaacatcctcgccgccggtccattctccggtggatccatgaacccagcacgttcctttggaccagctgttgctgccggagacttctctggtcactgggtctactgggttggaccactcatcggtggtggacttgccggacttatctacggaaatgtcttcatgggttcttccgaacatgttcctcttgcttctgctgatttctaaggaaacaagtgatgattcttgattcatgtttctgtgtttggttactttgcctcgatctttcttgttttgtttggagtttggtccggtttcgttgtaatttttatccaatttgtatgaatattatttaatggatggctgttttggttataaattaactaatggatgtatgaatatatagtttcacctaaataggtagttgtaatgttgtatagctaattatcgatccatatatataaaaaatagatcgttacaattttatgatatagtaacaactaacaacaatgacaaattaatggatggtttcaagtagaagtttcgagatcatcgtcattaggtatattcttagggatgttccactcatgagctttccactctggcaattgttgtatgacaacctatgcaataatttattaatatcaataaatcacatgcatgtatagaaaaaaatgaagattatatattatagacagagaaaaagagaggttatatattattaccaatccggtagaatctggatttcccacgttggtttgacaagctagtctccaattttttggtttctgtgaaaacattattcgattttactcccataaccaagatgatacaagattactaaatactataggataatttcttaaataaaactatacccttttgagtttctccttctcaatatcagttcgcggatttagaagctcctttccatttacaatctgaaaagaaatatccatcaatatctcataaaccatcatttgactgtttaatttagcttattgactatatataagagagagatatgtatacctcgaccatgcaagtagcgcaagttcctactcctgcgcagtttgacaaaggcttactctgcgaattaatgagacgttgacatatactccaaagtccaaactaactagattagattaagagaaaaaatcaaaccgagggagagaaaatatcatacataaggaccatagagttcgatgttagaatccaacattatgtctcttagtttctgtccaccgttcgctcttctccaatgtacgtccggtgtcccgtccggcaacaacaccgactaataatcaacattattaccaattaataaaatttattattaatccatccaaaattcacctcaacatttttaaacagcacaacgacttatttgattaaaaaccattattaatcaatatacaattttatctaatcactctagattacctacttttccacgattattattcatccttgttaccaatgtagctaatgataagagtgtagataatctgtcaagagtaaagatcccttacatggacgaacgcaaaatcgacagcaggaggttcgtcgggctcatcagcggctggaggctggctcgctggtgcggtgcttatggctcggacggttttggttcttgcggcattgtgttttgagcgaaagaagtacgaatttggcttattaagtttggtcttgtggctaaagctatgatttggaggtagagaagctactaggccggaaccactcaactgtacacttcccatagtcttgttcttcttttttaaacaataagatattaaacagaaccaaaaaaaaaggttgggtccttaattgggataatgttttatatgccatgaggtttctgtggaggcgagtggtgcctctttttatctcttatccaatgtgtgtatgcgccggtttagtctattgactaaccaaattaaattagttaatagaaacgttgaaacgttttcccccgtatataggaaaaatattggggttgaaccttcgtattcactcctttaatttaaatcaataattttgagaaaacaaaatttgtagatttttaattaaataaagttaattatctgtagaatttgaactttataatcaaacgaaattatatatcggttttgagtttatatatatgaattaggttttagattttacaattaaataaaattttatattggtttgggattacaaatgtggattagggttttgattttacaattaaataaaacttatgtcggtttaataagtgttatggcattagttacttggtctatgaccagaccaccctaatgttgtgtcctggcgacgatgaaactggaccggcttgcatctatattgtcacgggagattttttcaagaagattcaaattggttttggtttctggtgttttcattgtgtttattctcccagttttgtcctagttcctttaggttaagattgcaagtctaataattttatcacattttcttgaactttgttcatgtctctgttttcttagtcttaagtcagtttgtctaaaattttcttgatgataaaaatatagacttacgatctccaacattgttgatcaacacactttcactttgaacttaaccaaaaaggtttgtcaccattgagtaaaaatgttacaaaatatatacgtaagtaatgtaagagttgtgaataataaggtgtagttgacatttgatgggccggaaatgtaatacaaaggcccatgggctaaattgacaatttcattaaaaaaatcgatcctcgaaggagaagactctgagaaaaaaaaaacgggaagaagcttgagcttgtcactcactagcttgaggaaaaatgttaacttcatcaatg

SEQ ID NO: 33237 - DNA, 3003 bp, Unknown
  misc_feature (1)..( 3003): 2750-1469P.txt file - cDNA_ID_3067145; gDNA_ID_1620521; Annot_ID_159476
tatattcgtttacaacctaaaataaatttaactgtaagtaactaagtataataatattatagatgaaattaaatttatttaaatcatatcaaacaaaatatggatgtttgtaatcatgtatatgaaattaatatttataaataaatttatgtgatgtagttataaattggatgttaattttaatttataagttctatttgtattgtagttcaaggttggaaaacaaaatgtctatttgaatgattaatatatactgtatgttccgtggccattcagttgcttacgtgtagccttagagaccaacacaaatatctcttattggagagaacaaatcgtgtcgtttctaagcactcgttaaatctattaaaaacacacacaaagtccacaagtcaattagtcaaattcaatccacgtgtggtttgaacactgatattttatttaccaaatttggcttatagtttcaggttatgttatatgccgtttcaggataagttttggaccggtccgtttgtcagagacttgaacacaaaatttgacattccagaatcaaaaacagtgccgtttgtacgatcaataaacggcaagacacttaccgttgcaaatagtcaatcttgctttttgagctaaagactgtaatctgaagaaaggataagactttggacacagagaacacaaagagatcactgaaaagaagaaaaaaaaaatggcagctttgagttcttccatgaccatctcatatctacattcactttcttgcaacaaaagttgcttgcttacatctcaattttcaaaacccttgtttataaaccaaactcagaagaaactcagattctcgatttccttttgcctcaagcaaaacgaatctggtattgaacaagtcgaagaagaagaagaagaagaatttaccgttgtgacggccgtaaaaagcagatacaatgagattgttatagtggatacttttgcttctagatatcttcttcttgattccactagtgagaatttttaaaaccctaattcctctgtttttgatattagatcctctgtttataacctaagtttctcattatgtagggaatgtgcatagtgttatcaataaaggaggccagaattggactggagcttattgggtatgttacatttttacatcatcataaagttgcaaaaatcatagcttgagttgtttctctgttgataggtaaatgttgttattgtgtttaattttgaatcctatcaacatttttgtttgaaggacgagtctgcgtgtttgccgcctattatccctaatggtcccattgcaatctacggcttggtgagaaactacgtggtgaatcttataccgattgtctgagaagtacatgaacataggcatgcaatgagtcaatgatgtgtttaaatttttgttcatgtgtttgttagggtggtggaacagctgcaagattgattcttgagttgtggccttcaacggagcttgaaggttgggaaatcgatgaaattgtaagtaaactatcggattttcttgcggcattacgtttgcatattggaaaatcttgagttcacttgtgattttcttttatgaacagtagttgattgagaaagcaagagactatctcgggctgtctgagctagagataccgacatcaaaaggcggtagactttgtattcatgtagatgatgctctctctccttgtcaagatgattcaaaaagatatgctggtgagatttacaggttaatgtatgttgcttattcctttgttcttttatgaattcttgaattcttatgtcgatattttagggatcatcgttgatttgttcgcggatggaaaagtgcttgatcagctgcaagaggtactttaatttgttatggtgttagtattatatagtcaactttgtgacaccgagtattttgaattcgagtatgtacagattccaatgtggctagaactggctagtaggttaatgcctaacggtcgccttatggtgaattgtgcgggaatcgaaacagaagtaaagaatggaaaaccagagttggtgttagatgatttggcttggatgttgaattctactgtcaagatcttatcagaagcatttcctggacaagtaagtaacacatttcatcttcatatccttttgttaactacgcgtttaagataaaaagaaaaacatcgcgattatttattgttgcaggttagttggaagagaacaccagattcagaaggtctcaactttgtggcattaacaggaggcttacctgatcttagtgactggtctagtaaggttccagtccgtttaagcgaatcagtgaagctatggaagctttgcgagacggtccctttgcaactcggtgctttgaatgcatcttaacatcaagagttttgccaaaagatttgatcagaaactcacatgtggatagtgaaagttgtgtatgatttgttttgccaattgagtacagagatacacaaaaggacaaaaagaaggtacatatgaatttcacatttgaacttaagaatttttaaatccaaaattcgattatcataaaattttgaatttatacaagaaaccttttatgatactatgttatatatatgttactattagtcagacaaatgttttgaacaatttcttggttcagaccgatattagacaattgtttgacaatttaaccacttgacgaaacttgatatgttgctcgaactctaatacattgtccgcaggttaaaatctagtttcttactaaaaagcattttgatcgatattgttggcaacaaaggatcttattcaagagaacaaatcacgtcgtttcttctaaactcgtttgagctgttaaaacgtcaccaaagttttgactttctatatacacaaatcgtgccgttttcacagtcaataaacggcattacacttaccgttgcaagaagtcaattttgctgatgagactgtaaaactgaaggaagaagaaaggataagacattaaacgcaaagagatcactgaaacaaaccaaaaaaatg

SEQ ID NO: 33238 - DNA, 3000 bp, Unknown
  misc_feature (1)..( 3000): 2750-1469P.txt file - cDNA_ID_3067223; gDNA_ID_1620524; Annot_ID_159544
ttagcgtaccaccttcagggaaaattcatagattgttaagtaaatctgtcatgacaaagaaactcctactaggaagaagattggcgttcctgcttagtaaagaggccactaaccattttgtttgtttccgaatgctcacatgaatggctcgcttggaccattcaaactcttcccattcgcttgcccggccatcgtagtgaaacagcattatagagaagttatctgagaactgagaaatgtaaagtcaaggaatgagaaaaggaaggaaagaagaagaatatgtatgggaggcaaggcaggataccttcttcaacacagtgtctatatttttcctctgatcatagccaaccgtaaatgttactagataccgctgcttgactgttaaatcctgcatgccataccaacaaaatgtgccatgatcttgaagccattctcaaataaaagcaagtagattcaaatttatgaacctcattagggtcgccccacagtcgacggaggtaaaaatctgattcaggcgtgactatatctggtggtagcctctcagcaccacgggggttagtcgaaacccatatctgcaatagctcgaacgttctatcatcaacctttttatattaaaacattgaaaggtaaataagaagagaacaagagaatcacaaccttagtgtcattatagttatatggagggtcagggatgtcattcttgagtttgaggccttttgtcgaagaccaagaaccaaatagtctttgtcttgatatgtcagagtatttatcctcaatgtatgcaagatcaatcgagggaaacaatgtggatggaagattcatctaaccatttcaaaacaaaaaagatagaaaccatcaccgtgtaagcaatgacataatcaagtttgaaaatgaacgaaaaggtatagacatgttgcacgaagcaaagatttaaccttaccttagttaaagtcaaggttggaaaagtaatacccataaggaaaccaacaataacaccgaaaaaggatgttaatagaagcctcatcatttgactaggtcttctcatatttccactgtatatcataaagataaatgtacacaattccaaaagttaacacagataatgattcaaataaaaatggtatacaaatcacatagatatttgatataatcaatgtactgcctatattagagtatatacctacaggttgttatctgatatctatctacagtctatgcacgccaaagtcgtgatacgaagaactacaacgcactttcattccttcacttgcatcacattttcattcttcgatgcttctaactacaaaacacacacaaacatataaacagtaatagtaagaaatgagctttgttaaaagcctatactcaatacttaagcaatcacaaagtggaaaattcaatatccacaatagaatcacaaaattcaactgtacaattccaaatggattaacaattgttccttgtttcttgacaacaataaccaaatatcatgtgttccaaattaatcaaaaattacaccaaatcacttcaatcatatcaaaaaacaacaaatccattctaaattacacacctaaacctaaacgtaattagattttgctaactcctttccattactcaaaagtcagaatttcaattatgcattcaaaattctatatacggtaaaaacaataaacacgacaacataatcatgtacgacaatggaagaacatgcgatcatataccaaaatagaaagaaaaccagtttctgtcctgtctgactaattggcgacaacaccaaattcagaattcgataaacacaaaactcagaaagcgatcgatcaccattagtaaacggattctatcttcacaatgtttggatcttcttcagctttggaatccagaaatggtccacgctttctcgaaattactgcacgaaaacggcaaaatcggtagctcaaaagaataaagctcaaaaattttgtaactctctctgttgacgaaaattgtcattactacgttatcaaccaaggcccattacaggcctactttatctaaattgggcctttcattcagatacacatatcaggcaaggagttaggagtttattattaaacagcaaaaaagaaagaaaaaaaaactattaagctaaccacgtggcagcttaatagataatattatgataattactgatttttttgtctatgattatgaatatattatacctagattaaaaattaaccacacatcaacaagtgttcagtgcaatatatgttttttcttatcctatagtgttcttaaaaaaggaaacaaaaatgtaagttacaaaatagtattataaagtaaatttaaaaaaattagtataggttgtttcttattctataagtgttgccttataaataaaaaatttaagttttccaaaaatagtataaattaatcttataaggttttaattgtttgactcaagtgatgataaaatttatttttatttctcttaaagaattttgtcccaaaagaataaagctttgattaagtaaatatggttcatacaaactacaaagttacttaatttccataaccaagttttttaaatctgattttagtattttacagtaaaatttttacttatatctgtctaatctacatttaaattacacactcctaaagctcattaactacaaatatatctatttagaactatagaatatgctttggaaaactgtccctatatataaaacgaagtcgtactcatacttgatctgccaatcacaaattaacagaaaacacaactaaattgcgatttgaatttattaaatcgtaaaactgagatcttctctgagatttttctcctcctaaagtttgaaactttgaacataaaaattgtatttttttttttgaagtttccagcaaaaaaaaaattgaaactttcagtgattggaattttaatttgtgttttagtttggtgggtttctttatcgggatcgttgtcgtggatttttgtttgtagcagcttgaaagacgatg

SEQ ID NO: 33239 - DNA, 3003 bp, Unknown
  misc_feature (1)..( 3003): 2750-1469P.txt file - cDNA_ID_3067227; gDNA_ID_1620524; Annot_ID_159542
aatcattgcatagcatctggcagagatttcaacgataaggttatcgtcaaccttgatcaggcggtaagacacaatccgtagttaattgattctctggttccgatgagtattaatggaaaactaacagcatttcaaccaaactgtgttttcttcaggacaaggtcatgttatggagattgcatttctatgtaggagcagtcaagaggcccagaagctcgctccctagctaactttggctgtatatatatggactgggatgttgagatggtgtgatgggctaaaccggtttaatatatttcctactttttttgttttcctgattagtccggttaagccgtgtagtagttggtcttacatggacggttaacaaatgaaaatcggttctgatttggtaagactttgtccttcgtcccatgaagatttctctaacaaaaaatcattgaccacatcatgacatgaatccaaagaaaacacatagtttgctaatgtgtctgttagacgattaatctctttagatagtgtgtatcaatttcattatttttgttttaatcgtctgtcattgtatcagtttcggttagaaactaagatagggaaaatatttctcgtcctataagatgttttacctaagcacaaaaaatcattaaaacggtattcaagacttttaaataaatcaaacaaaaacaaattttgatttcaaagtaaaacgaaaaaaaaaatcgtaacatgaaaaaaaaagatatttttattttattttatttggaaataaaatctgaataattattttatgacagtcaataaaaagctatgaaatatttctagagctttactaatgggggaagtttgaactagctgcttgatattaatataataatttgattatcaacaaaaaagttatatttaagaattaagattgatatatgttaaacttttggtaattttgttctaaaaccaatattctttggttgacttgactattttattaatatattagtataaattgagaatgtgaatctcctttccaaactattcttataggttttctatatatataatttcctacatagcatctaacagatccccgaaaaaagatctcaactacatacaataccaacccacaacaaaaatttgctttttcgatcttctcaaaaatgaaactaaaacaaaccaaagtgatgtttttcttgttagtcctaatctctgcattaatattgcaacaatcgaaagctcagaaaaattattgttcgagaaccaacatagactatataccgggatgtttccatgcgttgcaattagcgtataacaaagattatagtctcctaacaagaaattgttgcagagcagtgttttcacttcctactacttgtgccttgcttgtctatcctggcaaaacttaccctattactacctttagattaatttgtatttatagcgatcctcttccagcaatgtctccattaagtctataagttttgtttatctcttaataataatataataataaaaatcatatttacattataattttttaactttgttcaagttacacataaaatccctaactctctatacgtgttgaatgtttgaggtctcatatttatcttactctttcggttttcaaaaggatatcaacataaatgtaaatatgtaatcattcctcatttgttggaaattaatttataaattttgatttcaaaaatcaactaatccatttgtaaactatgtaaaatatttatcaattatattattatttttgccaccttagaaatatatgttaacatttgtgtagttaaaagaaatccccaaattaaatcatgttttgactcacacttataatattatcggatttcataaataaatggataaaccatgtaaaagatgaaataacatacgataaaaaatgatcttagtcaaaacatatgaaagccgataataataatgacatttattggaaattcaagtctaaaaataaataataataataataacaacatacgagatgagatcgagataatatagtatataataaattaaatataaattactaataataatgacatttcttacaaattcaataagtgtttgtttttactcatgagtgtttttaacccatttatactcttatattttcataaataacctacttgttatcaccatattacaccagttaatatatttgtaaaattttgaaaaagattgtatatatcaatctctatacatgactcataaggttaacatttaacatcgtttaattgttttggaaggtagatttaaatccaccaacaattcaaggatgtgaagaatttttagatcaaatatatatttaaatgtacaagtgtttttttctaacaaaaaaaatttgaggtattgaacggatgggtaattttcgggtgtttttgccgtgttattgtagccgtcgattagttgggatgtatacttattgggcctaagaagcttaataccttaattgtacaatcggatggatatataaatgggctcaacaacaaggaaaaaggcccatttaaacctaagagttcaagctctatttgtagaaagaccaaagtatccctagatgtttaagtatgtcctctgtgtctctaaaggttaattggggaagaagaaaactctccttctttttgtaacttttgcttcacctctctcttcttctcttgttctattttttttcccgattcaagcaaaattcatcaaggtaaatttactcttcttctcaagctgagtttttttgaattgttggtatcttccttcatcactctcgcacttctcttcttgaagtctctcttgctcgattcgattctacggtttctctcgatccgagggtttttgattgaacttttattggtctctttgatattgaagaaattattcaaccctaatctcaaattgcttcagaagatttcgggaaactagtttattcttatgggtaatcgttttgatgctaaagtacttaactttttgtgattgtagacttgtcaatttgaaaaaatg

SEQ ID NO: 33240 - DNA, 3003 bp, Unknown
  misc_feature (1)..( 3003): 2750-1469P.txt file - cDNA_ID_3067231; gDNA_ID_1620524; Annot_ID_159535
ttaaaataattatagtcaaatttgttatcaaatttttaaaaaacaaaatattcaaaaatatttcgtataaaaattccgaataaatattaatatcttcgtttgcaatatccaaaaaaatatgttcctttgtaatttagtgtagagagatcatttgagtatatttgaagcaaaaagagctgttatgttttaatacaactggcactttattattaaaataaaatggagtttaatgattgcacacttgttgattctgtttgtgacaaaagaaaattgattcattatcaaatgattcttctttttgtcattttataatgttttgagacgagggaatgaatggttgttttataatgcttaaaatccatacggcagattaattcgttttatatacacaaatggcagaaattattacaactagctgtgtctcgtgttgtctagcaataatccgctgtgatattcgtctttttctatccaccatgcacggttgttattacttttaaattaatgataaaaaaaggagaagataaaataagattgttacgttcgcaataaaatgattgaaatttgtaaacctgtttattaatccgatatacataaaatctcaagctaatcatatttgaatactaagtgtcgcagtagtatttgatcacatatagtctgcagtgcgcaaggatgaaatatatggttaaaaccaagtattcatggtgtttaacttttatttcccaaaattaaattcaaaaaagtgtagtataatactatcgatgatcgtgtgaaatgttttcccataactgctggaggcccggttcatattttattttagctctatgctaaaattaaaacttaagcccatatatacttgatagattatctttaacaaatcacgtgatatcctgacatggcaaatggcactataaaccactattaattgcttccaataaataatagaaaaaaaatctagggttttcgcttagattcgcaatcgcatttgtatttgatttgcttcaatagtgcgacacaaataataacgtttgtgatctatgttttaaaacgaatagaaagaatattgcattttgtgtgtgtgtgtgtgtatgtgtgtctactgtgtcatatgtaacgaatagaaggaaatttgcatgtctagttcttatatctagtcatatgtaaggaatcatgttaattttgatcacaaaaacgccgatttattactttgacaacacgattgtggtgtggaaaaaaaagaaaagaaaaaccgtttgtgggtgggggcaaattttgggagaaaattttgtgaagtgttttctgaactttttatacccacccgactttagattttcggaatatttcggggagggtttcatctttcagttgtcatattatggggtcttattttcgatatccatcttcactattgagaaaacattgtggctcatcgaaaactcttcggggcagtagaaatacgtacataaaatttatgttaaagtaagagtagcaagccaatctagttcaaaagaatgatctaatttgaaaatggggatgtgattatatattaccaatcattgttttacttgtataatatgatttatgatcatttgagagacatgggagctacgccgcataagattgtgttgaatatctattcaggatatatgaagttgtcgtggaggtgatacggaatataaatatgattctagcttagtgtaccaaagtttttaaaactccaaatcacgaaccatataatctagaatatagacgtttggataatcatttcttgtcatgtggtttggcagagatttctcttttccgaaggcaaataggggtcataaatcaaatcattcatttggttgagatgaaaaatgaagaagagcatgtagtttttgtgaatggtcaaactattagtatcgaaaaaggaaacggttgaggaaaaagaatggcttcacgagatggacaaggtagaatctttataggctattagtgtggttccccaataatcaaagacgattcagaagtggtcacaaaggattgctaaaatagaaaagaaaagaaaaaatgcttttatgttttttcattgttggaaggtagatagaagaacaataacttggaatgtggagaaagcgtatcgaacggaacagatcaagcatatcaggcggatcaaacgtatcaggcggatcaagcagctttttagaaaagacgttaaatgatggaaaaaataaccaaaaaagattgtgaggaagctaatgaagaagtttattggagacataaagtatgacaaatggaaaaagactccaatttttttcattcagcttctaaaagacgtgaacaaaaaatcgaatatttggtttaacagaatcatggtaaaaatagagatgaatataatattatggtgttacaatatgtttaggatcatttcacaagcaaaacatatgatgtaatcataaaacatatgatgtcacaaacaaatagttccttggatctgaaaatgcaagaaaaacacaacagcaagaaacgacatcgttctcaatgtcaaaaaggttgacattaggcagtcacttttgactaccatgctcaatcaacggttagtaggtttaacttttacatagacattcatcatttcgtttaaacacacaaaaatggttatgtgattttgtatctttgaatgcacgtgaggaagaaaactgaaaaaactacgaaaacggcatcgttcgaggtcaataaggttgactttaagcaaatacttttgacaactaaacccaattaacggtttcacaacattaaccgtatgttaatcacctgaaattacgataatgtaggtcccatagtaaatttaataaaaactatataatatctcacaatactaatttaaaataaatcacgccttcactcccggaactctcctcttcctctttaaatactttccgacaatagcaagcttcaacaaaaaaaaaaacgaaccaaaaacttcctctctcttttataatatctttctctcaatctatgtttagaagaatg

SEQ ID NO: 33241 - DNA, 3003 bp, Unknown
  misc_feature (1)..( 3003): 2750-1469P.txt file - cDNA_ID_3067259; gDNA_ID_1620525; Annot_ID_159564
ttatgtaatttatgtttgagaatgaaataacattgctaccaatcagttttacttcatcctaccaataacattgcctacagtttttcaatctagtttctatatagatgctgaaaggaagtcgtcactctgtaattttattgatgtagaaagttcgacaaatcaaacagctaccggtggatctcaaggccctcatggatgggctttcttcgctgttgttaccttctcagaagcctttgttcagccagcatatgtatgcactgaaaggcttgatctttctaaccctctttgataaactgtatctcaaactatggttaaagcttgaaattagtagcttttcctggccccaaaaaagatagaaacgtatttattattcttaggtgatatttccccctctgattcttgtatgcaactccttgctatattgacgtgtcaataacaattgtgataggttaacactctctgaggatcctgcattggctatggctttttcagtggcacgaagggcagcagctgtccctctattacttgtcaatggaacttaccggaagactgttcgttcatatcttgattcatcaatcctccagtaccaattacagagggtgaacgatcacacttcccttaaaggttagctaacaacagtaaatctcgctctgttaagtagtttttaaaaaaaaactgtcaccattcatctcttttgttgtagcaccgttgtagtcatgaaagaagcctttccttgatgctaaactagaaagtagaaactatcttctaccagttttaagtgattttgtgttccttttgtctgctaaatttgtatattaatgtagagactatggctcacacatctatatagatgaataatgttgagaacttttctccgttttacatgtctttcaagttttcgtcctaaggtagtatgccgtggtaagaaaactgcataagttctgaactaccgtattatttactgtcctaaagtttgtgatatctttatactgttttcttcgtgtagacttgatccgtttgagcgattgcttttatcctactgctcagcatttcacttcagatgtctttattcacgtcctattcaaattttgtcaagttatttgctacttgatgtcatgcattggtgatgttgatataatatcatgattggcattaacgctgtaagtatccttgtatataactcaggaggtcatgcccacagcaggtccactcttgaaattcctatcttttggctcatcagtggtgatccgctactgattgacaagcattatcaagcaaaggcgctttcgaacatggttgttgttgttcagtcggaggcctcttcatgggagagccatttgcaatgcaacgggcgatcactattatgggatctgaggtaataacacgtatatgttagcagcttgttatgagcagaaattttatgatactttcctagttaaattttgctcgtcatgagggaattagagtagatgagtttttccttactccttcatttttataacataggagccccgtgaaagcagccatggcttctgttgctgaacatctagctggattgcttcctcttcatcttgtctacagtgtagctcatgaaagtgcaattgaggtatagaattatgcttagatgattctaaatagcactgctttgtagttccatgaatattatcctgttcctggtaactactgcaatcttgtgaatccagcacaaactctgattaaaactctccagataaagaagctgataatctgtcttaccatctcttaaaaattgtgtttcacaggactggacatggtcagtaggttgcaatcccttttccgtcacttctcaaggttggctcctttcacagtttcaatctgacacaattgcccggagctatatgattacagcgcttgaagaatcaatacaagctgtcaattctgggattcatcttttgcggctggagagaacgagtatccttgggagattttttatctctgttttatgcctacagaacagtagaggttttgaaatatgaagaaaatttattacctgctcatctttatttgctagtgttaatatccttgattcagaaacaagataaaaagacgtttaagctcttccaatcaagggaacgtgagctgatgaacaagtacaagtacgtggttagcctgtggagacgagtgagtacacacctctgttcctatagtttgatttatacggttatgaagcctatatgttactggaaggcttcaaatgatgtgtatactaaatgtttaacagctttcgaatgttgctggagaaacacgctatggggatgccatgagatttctgcataccttagaggaagctactagctcgtaagtacacacattttactcttgctacagtttttttaaaagaatgatttgctaatcaatcaggctttccattttatcagatttgtaagagaagtgaatgcaacagtgggtgttttgcacccaattcactgcacaaaagagaggaaggtgaaagtggaagtggacatgacaacaatacctgcctttatcatagtactgattttactttacgctgtcttaaggccaagagctcctaagccaaagatcaactgatgtcaaaagactcccccatacaaatttttttgtcactttctgagacagtaaagttcatcactcttctgtatctttacttgaacaagaattgttgtaatctaaacctgattcgttactgcaaattgcaactgtagaatttagcaaaagttagtacagtacttgaagagattaaaataagacaagaatgaaagaagctgtgtttgggtcaacagtgaacctgtgtttgggtcaacagtgggccctttaaagacaacaacatctttaagccacaaacaaagactcgaaagaaaataataaaataatttggatctgaggcaggaaacttccggagacatcggaggaaccctaaattgaatgagaagaggagagtgagacgggagagaaagccagagcgagcgatagagcaaagacatg

SEQ ID NO: 33242 - DNA, 3003 bp, Unknown
  misc_feature (1)..( 3003): 2750-1469P.txt file - cDNA_ID_3067263; gDNA_ID_1620525; Annot_ID_159558
ttgcttgtcgagtgtggaatttgtaagagcagacttgactacgtctacgactcctaagcctttcttcgaggctaaataagcagcattctgtcaacaaaaacagtgttagtggagcttccttgtgttagtcaaggagcatttggaagttaaatggcttgcctgaatgttgattaaaactccggtgactgcctttgctttgccgagctcaaggaagtccgcaagagtcgtgaacttcccggcgttcttgtttgcggggtttctctggaagcccgtggcagtgaaggggttttctatttgtgctgaagacaaagatatcccaatgctcagtgacttagttgagaataagattagtttaagaaatctatagaaaagaaatcagtttcttacgcttcacagactggatctcggcccatgtaagatcaaaagagaagattccgttggtaggctggatctcaggaacgctggtggctcgggacatgaaagtagtcctggcggtggtacttgctgagaggtctgcagcatcatggcagaaagcgattccgtctttggacatctgaacagagcagtcaattatgtctgctccatcgtcgattgctttctggtaagccagatcagtgcagcctggatagtctccgcttgctccattgtgagttataaccaatgcatgccctgctttggggagattgccgttttggtgagaaaagcaagctgcaagaaaacagacgctttagcttcttcttaataatcagctatctgaggaaacatatatagcaagtcatctcactgattgattgtgatgctgttggcgggaaatcggtgatgacaccatcaacagagaactggccattgtccacaaactggagatactcagcagagggatcatagctgtagttaaagctggtgcgcaagtcgttggcaaaccctgaagcatagacctctagaccggctttgtgagcatcagccacaaaagtggtggcgggcttaaggtacttagctgagtcaatgggccaaatgtagtctttgggcacaagaacgcctgaagcaaaggccttgatggctgcgaggttctgctgaatctcgctgtacttcttgttggtggtgggctcaactgcctcggggtctttgaactcaaatatgagctttgtcttggccctgcccgcgtccatcccgatgctcttcaagaaaccaatctctggagatgagatgacattaatgccgcggaatcgcaagcttctcaggtactcggctgggctcagcttgtgttccatgtagaaggcatcgtactgcacatttgcattgtttgttgttttgatgaatcaacaaaaaagctccatatgttggttaatcatgttctcaaagagaagaaaacatacctgaacgctcaaccagaacttgggaggcttggttccaaggacatcctccactgcagaaaccgacatttggccgtcgaagatgctaggccgagagaagatgttctggaccactgctcaataatacaaaacatgaaaatgtgtggtggtggtggtgagcattgaagggaggaaatgaaagagaagaagacatacgagtgactttgttgaatatggtgtcggcatcgtaatcaatgacaaaccagcccttgaggtcctgaccgttgaccttgtaggtcttctgggctttggggaagaccgaggagatggtggttgcattgtcaagtctgatatctgacaagcaaaggcccacaccgtccttagtcatctgaaggttgcacaacattgtgaagccaggcgagctggtgccaatagccaagtcgtttgcagagatgcttgactcagggaaaagacccgagaagccccctctggccacaacggcaggctcttgtcctggaagacaaaagacaggtacggattcttagaaacaaacaaacaacatggtatcttaagtcttaacattaaacaacaacaaaaaaaaaaacatggtagtatgcaatatgggcatactctgtaaaaggatgcttaccgttaagggtaagccatttcttggcaggaacagctgcggcagcagcaggagtcttgggtgccgcaacagaagagtgtaagaaaagggagaaaagaatgaaaaacctcagcatctctatctgattgatcctgcatttgtgtgtaacgtacgtaccccaatggaaaagcaaagtcaggatacatgtaacaaaaacagaattgtcacatttaagaaaattgtgaaagagagatcttacagcgagaaaagaacatgaatcccctctcctgcttgttttcctcgtttagttagaggaaaggaaaaagaagagaaagaggagatgggtcaaacaaggttaattaatggtaaaaaaaagtaacttgctctcatatcctccatttatggccatttactcctttctatttttatctcttcttctccaccattcccttcttaaccgctttttctttttttgatgctttcttacatcttctttgcacaaatgggtgtaacacccctcagttttggactttgtactatattcatttgtcatacatgtatgtagttaaaatgacaatattagagtttggcattcggaccaaaccaagttgtccgatctaaaccaaaccaatattccgttaataagaaaactcgattggcaaaaattaaaatattctttggtttcagtttttgcctagacttaaaattcttaaaaatccaattctatgtgatggaaaaatctttgattccggtccaattctgcatcaatatatgctaaaccgaaccgagactgcccacataaaattgaattgaaccaaaggtttttaatttttacttcaacatagcgaataagaaaaagagggtatatattcattattcaatgttaatgagaaggcgtctgcgtttggttcgacacctcaaaacttgttttgcctttagcatctccgagtaaggaatccaggtccaaagcctcttctcttcctcctcctcgcttccttctcacgcaaccttggatccaccgcagctatg

SEQ ID NO: 33243 - DNA, 3000 bp, Unknown
  misc_feature (1)..( 3000): 2750-1469P.txt file - cDNA_ID_3067266; gDNA_ID_1620525; Annot_ID_159557
ttatgcaaagtcgtctcttttaccataaggaagcgcacacaaattcaatcagatcaaatctgggaaagacaattcaaatcttgcagaagttgacattatgtatttggataaacacaccacacgactcgagacttatggaatcaaaataatgcatgcaaactacagacggaattatatgtatagataagacgatagaaaaaacagtctccccccagcaaaagtttggttgactatatacccagcaggacttccagctcacagaatagtacagcatgaatttgttttcttcgcttgcttgtaaaacatctgttccaaccaatacaaccaaatcagattttcatgttggaagtaaacatggtttacctaatctaaataacgaagaatatcttgagattccagaggatatgactaatacatatgttcctccccatggtcagatgatatagcaaaaaacactatgattcttcgtagcaaacctaataattccaaaatccaactgtatagttcaaactgcactcaaatgtctgcaggctgaagcagaaagctttttcaaagaaggtattctaaatccacattcttcctctatttatctaccccaacaataacatgcaatagttcctctatcaatcaacaacacttataagcctgctaaatcaacaaccctttctaacgtgttcaccaactatgctcagagatcgagacagggaaaaaaggaaactaaatctataagaatttctagaatgtgactttagaatgttacctgtgatgccatgctcaaatctgagctcttctccactaggctgtccagcttctcaccacgggctagaacactatcaatggttttatgctacaatacagaacaaaaaatcagtcttacggagacagggacatccatcataactaccaagactttcttcttgttttggtgtttttcagaagaaagtaaactcaccgacagaacagcatttatgtataattggcaagtatactgaaacttagaaaaggaagtaccgcttatgtataagggtctacaagaaaggaccggagacagcacttacaaggataatctttgtctcatccaactccctctggattttcaacagcttatcagcctctgctgggtcctgaagattacaaatacgggacaatcccaaaatcaatttaagatcaaatcactcaaaatccaacatggtcataaaacaatgggggctactaaaattaattcatgaagaatgaatcattcgattggattctaatgtccacctaactgagcttaatataactacagttttaacaaaattcacagtaaaagagcgaatacagttgcacaagtgaagaacctgaaatttgtttaaagcttcggttaagtatggccaaggctgattggagtcttcttttgcagacctccatgactcaccaaaactcttctggtactcatctaggacctgagacaaaattaaatgtcaagcaacccaaattacaggaaaacttacgaatgatgcattgagaaccactttcaacataatgatattacctgattgagaagagagaaagcacttcgaacagggtaatgatcgtccatgaaacccaccgcgcaaaggccatttctattgtaagcgtgaaccttgtactctaaaccaaaaacaaaataaaaacacgaaccctaattatcccaaattcgaggactagaacaataagatagaatcgcaagaaattaaagccggggcatagtccaggaagatctagaatcagaaacggtgcacatcctaaatcataaaagtttcaaaatcgaaaagccgatccgaatttagaaatcgaataaaaatcaaagaggaaaggagattgcattagatccgggagaaagaagatttgaaaacaatcgatctagagaggtagaagaagaaggagaagaaccttcgtgttgaacagactggcgttgggaaggaggggttcggctagcgacagtgcgaccgacaaagacgacgaactccttgacgctagatcgctggaaataaccgaagtgagagacgtccgaagcgttggagaggatgacgggatcagaagcttcgggagcgcacttgagaacgagcaaggcggtgatcttcatagctgcggtggatccaaggttgcgtgagaaggaagcgaggaggaggaagagaagaggctttggacctggattccttactcggagatgctaaaggcaaaacaagttttgaggtgtcgaaccaaacgcagacgccttctcattaacattgaataatgaatatataccctctttttcttattcgctatgttgaagtaaaaattaaaaacctttggttcaattcaattttatgtgggcagtctcggttcggtttagcatatattgatgcagaattggaccggaatcaaagatttttccatcacatagaattggatttttaagaattttaagtctaggcaaaaactgaaaccaaagaatattttaatttttgccaatcgagttttcttattaacggaatattggtttggtttagatcggacaacttggtttggtccgaatgccaaactctaatattgtcattttaactacatacatgtatgacaaatgaatatagtacaaagtccaaaactgaggggtgttacacccatttgtgcaaagaagatgtaagaaagcatcaaaaaaagaaaaagcggttaagaagggaatggtggagaagaagagataaaaatagaaaggagtaaatggccataaatggaggatatgagagcaagttacttttttttaccattaattaaccttgtttgacccatctcctctttctcttctttttcctttcctctaactaaacgaggaaaacaagcaggagaggggattcatgttcttttctcgctgtaagatctctctttcacaattttcttaaatgtgacaattctgtttttgttacatgtatcctgactttgcttttccattggggtacgtacgttacacacaaatgcaggatcaatcagatagagatg

SEQ ID NO: 33244 - DNA, 3000 bp, Unknown
  misc_feature (1)..( 3000): 2750-1469P.txt file - cDNA_ID_3067270; gDNA_ID_1620525; Annot_ID_159555
ctactatcagcttgatctgtgccattttcacccgagggttcatcctcatgtgaatcctgacatacaatctagcaaaaaaatcaatatcagttagtagcagtcagtatacagtatgcaaagatgcctcaccagtaaaccaaaatcaagagaaatttgaaacatgttcaacctcaatgatagcatctagatcacgcatccgaggagcacgtgtatcaatggacggaagacgttcaccagaaccagtctccacaggtattggtcttccagggggctgagagaaaacaaattcaagaaatactcttaagctttgaaaactaacaagataatgtctagcgacaatgttaccattgtgatatacaatataataaaccacatattgacaatgctactttaaaatgaaagcaaaggaaggagaaatcatactagtgtcggtctaacattggctggcactttcgctgaatcaccttgaacagagtctggcttcactaaatttgaagaatcaacgggaacaccctgtgcccctgttgctgcagctaactctgggggtagatctggatcataaccctatcatttgtacaagagaatgattaggaatacattgtcaccctttggtatctgatgtagacaaatattgtccagctgcaaagaataatcagctcgtaaacaccacaatatgtgccaaaatccactttacctgatccgttctaccgctttcataaacacgtattctgctttgcatcgtagtctgtatacggtgttggtcctgtacgaaattaaaagatactcctcttagtactcttcatccgctaaaataaggatatgaaacacagttattaattaccagctgtttgcaatagtctttccagctctcctcatttagtccaaagttgaagtagtctgtcatctcaactcctggatatctccagggcttttcttcaaaactatctatgtcgacctcaaatatagtcctaaaaagcacagagtagacagcaaataaaagaaacaaagaacaaatcagtcaaaaagattgatatgcagacatgagcctaagctactagaacctctagttcctgaacagatgaaaaattacttgtgagagggaagagtgaagtccagtccacgccctgctgtattactaccccaaggctggtggaaccctttctgtgcagcagaagcattcctcattcccagtggacgccaatctcctctgccacgaccagccataggaccaaggttggcgggtggacgaacttgacctgaggagggtccaccaacagatgcagcacctccaggaatgggagctgcccccggtcttacatactgcaagaaaaatatatgtaaatgtcaagtagaacaataccacccttattttgtttcggcataacgttggtatgataactccaaataacataaataaaatctttgaaggggtgttggctttataaagttagttagtgtctcaagaaactggttattgttcttcttacagtcttcttcttcaatagccaaggaattacgaaaaaaaactgttgaacatcgtaattgatggtggtgtaggattgcgatatacaagagagaaagtgaataggttattatctccctttcacattcttcattttatgaccaaacacccggtctttgggtaagcaagtaaagagatggtttgtcaaaatctagaagcagactccaatttctttgattaacacactctgcatttgcattcaggtttagatacaagtacaaagtatatatgcactcagaatttaagaaaactaaaacagggtaacgacaagaaacccaggtactaagtaatctgaccagtgacaacagtgttgcatcgacactgaccttaaactgagaatgaaacggatgatacccatgactgctataccctgctttgggcggtccagtagcacctcctggtccacttcccttgccagcttctcctccgtctttgccatctccttcaatcccttgaagaccatcttctccccacatctgctcctccataggttgatttggatccgtgtcggccactataacaagtgggtcttcatcatcttcatcatcgtcatcttcattatctcccatccttgatcttctatcagctcctccgatcatgacgttacggctactatcattcaacactatctgcaaatcatcttcactgtcgctatcccaatcatctccttctccttgtcctccatagcctccatcgccaccaccaccaacctgctgctcaattcttgtcgtaacttgcgaaacgcctcgatctgtagccaaaccaggtaacgctccagtaacgaaaagaccaggaatcgtaggtgtagaatcggcatcgggttcttcgatatcaaagctcatatccttatcgtcgccgccaccatcgacaattgcttgacgagtcgcgtcctgagtagataattttacggcatcgttgtccgaaaccctagagattggagctgaattaggttctgagacatcttgatcttgggatcggaggttgaggtcgattgaacggtgaggaagaggaggcggaggagggagaacaacgggaggttgaaacggctggagaacgtcggaatatagatctccgaactcatcgtcctcttccattggagtaaagagattggaggaagaagaagaagaacggccgattcgaattgaagctcacgagaaagagagagagagagacggtgaagctttaagggcttcttctcaacaagtctcggcttctttttatcatcgctagggtcttatttatacacttatttacccctttttttttctaccccaattaggattagtgaaaaagtaaaaattaatattaacaaaaatgtaaataaactctttttttgtactttcatcgaaccaaaagacaaaccaggttgcaataaacaaaagcatcttcagattctttcaccggaaaactaagaaaggttctgtgtttagggttctggttctgggaagctcgttctcaccggaaaaccgaagaatatg

SEQ ID NO: 33245 - DNA, 3003 bp, Unknown
  misc_feature (1)..( 3003): 2750-1469P.txt file - cDNA_ID_3067273; gDNA_ID_1620526; Annot_ID_159581
tctggtaacaccatcaccatccaaaataagaaaaaaaaaatacgaaaaatgattaaagagagcgtctcccatcccaattactaaaaaaaaatgggaaagaaaccacccggcaattgctggtagccgtaaaaaccaaacaagaaaatagatattacttttgtcctcccaaagattttgtccagttaaccaacttttcgaagccatgtcttacgttttcagtatatgcctctaaggcaacttgtattttctcaaagtgtggtttccatattgtcataactcggcttacctagaaaaacaagtaacaatggtcacaatgtatagtgcaatgtcaaaagagaatcagacataatgaataaagatggaaacatattaacctcaagatagtcgtaggaaacgtcgaatggttgggtgaaatgtggggtcaaaagcctgcttacatgtatgtaacacctcgatggacttatcggttaagtattgaatttttggttggagataaatggttaatgtcacatacacatctttgatgcttggaatccatttctgtgatatctaagagaagaattcaaaggttaataagaataaagcaataatgacttgtcttataacgaaaaccaaaaactttcagaataaaaccttttgaagagtttggctaagatcttgttgccgcagagtcactatatatgcttgcaaccataataaaaaaaaagaggatcatttaagattgatcactatgacaattttatcgatgttaattatgaaccttcttatagagttacctgagttttatttaggtttagaccaagcaacttcccatcgatctgaacacaagtaaaaaaaaagtaaagaaagcttttgaatatgtacatacatcagatccaagggacaccatgtttcttacattttcaagctttgagccaagttccgcgactttcttttctgcgatttcagctcgagtttccacttccagacttctcttgcgttgcatttccacttcttctcgtagttcaagtatctgccaatgcagaactaaattgaggtaacaaaacaagaaggaaatacacacctcaaactacaaaacaccaacctgtttctgaagttcataagccgttccttctgcttcactggattctcagtctaaataaaaaagcatcaacagcaacaaaagtgtaaataagtttcttctatacataacaattttgaatacatgaaccaaagattaattaaaaatatcacttgaagagatccaaccacatcaaagatgatgcagcttgagtaattgttaactctttccaactttggaaagagacaaaacgtcaaagtgatttccagaaacagagaacggaagctcaaaagtctctcttgtgccaaatatattaaaccctaaaaaattcaacttctatccgaatttctcagaaacaaaacaaagacacataacttcatatgaaattccagtgaacggttacctgaggaagaaccttatttgttatcagtgtaaaataacagagaagaggtacgagtaaaagaaacaaaagtgacttaggaaacgccattgttggagactgctcactggaagatagagagtcgtgagagacagtgataaagcgtatcaagtcatatagagggtcttcttatctttttctttaacatgtgagggttgagttaattatgcgggctgattatagagtttttaaattgaatttacgattgtttttttcttacatataaatgcaatctatatttgtgttcggaataacccatctaatattactccatgtattaaactaaaatattttgcatgttttggtagatcaactttttgaatgatcacagacctacaaacatcaaccctctaattatccaattttaccataatccacgagctcttaaaattcatttttaatatatataattaaaatagttcaaacagtttaaactttgtgaccaagttaaaatatttaaaatagtttgactttgtgatcaacatatttaaatataatcaatattttcatttttaagccggaaaatcacgtcttacaaatatatttctgatagacacacctataattccaaaattttgacttttaaaacaaacaaaaaaaaatctcattaataccactacatacgtttttacaaaaataccattaaaagatattttttcaaatactaaaaaaaactaaaactaaactttaaacctataaaacactaaatcctataaagtttatattcgagtataaaccttaaaagttcaaccctaaatcctgaaagcaagaccctaaacccaaactcaaacttttaaattataaatccttaaacaaaatcatttttagtctttatggtatttttagagttaacagtttgtagttgtatttttgaaaaaaaaacactagtgataggtttttagaataaaaacttaatttagtggtattgaggatatttctctaataaaaattattcacaaaaaatatgtattaaagcaaagtgctatgcttattccatgcaatcttttttgaaaaaaaaaatattttctaaccgattagtatatcttctagaggattcatagaaaaagaggatacaattacaatatgtagagtatcttataggtgacgtaaccatgaaatatagaattctttggaatctgaaactgaattattcagttgataaatgataaaacaaatactcatatctcatcctttggcatgtttaggagccatctctcagctggacggagacaacacagacacttgtgccagagagggaacacaatcttcccaagtcttcgaaagggtaatctcagaccaaaccgttgactttgttctcattaattgtttatgctaaaccacaagatatttggatcaaaagtattaccataaatcactatataaagacataaatgtgcaccccacttttcttatcaatcataaaagtcagcaaaacacaaggcatattcctcttctcttcctcagccttatttttctgatattcagtttcaaggatatatccatg

SEQ ID NO: 33246 - DNA, 3003 bp, Unknown
  misc_feature (1)..( 3003): 2750-1469P.txt file - cDNA_ID_3067287; gDNA_ID_1620526; Annot_ID_159584
cagaatgttgtagtgattagaagacattaagcatgtgatcgtttcctattatccgcttgatgcatgtattatgtaataattaaatcatacgtgataggtgatttcactgaagaaataatcaaaattgtattttatgtataatactatttcaccaatgtagtaagtggaaataacttcaaacatatttcaagagtttttttgaaatagtaatattccaaatgaatagctagataatttattgatagaacatttgcaatagattatacgagaacatataaataaaatagttttatgagggcgttatcttataaccaactatgccaaaagcattagggtataactaaaaattatcatcttgcattgagactctaaacaaaatttctttaaaattggcctttaaatgagtaccatcaatagaaatgcagttccagttcctcatgaacttataactgatgcaccaaaaaccaaaactacatcatttgacttttttcgacatatcttttcaataaaagagacatacatatttatgattttttttaatataccatattaaaacacttcaataaaacttcataactaataacaagtgtacatgaagaaatttatatttgtaaatatgaggatattgaggatgacggtaatgatgatcaatttgataaaataattaagaaaaatatcaaaaattaaccaacaactgcacgccttattattgttacaaaagattataacaaccttaaaagaaagttagtgtatcttccaccttaatcaacacctgaggattatggacatatattgttgcttaccgggtatgcagttgacgcaaatggcataaaagtttgagaagctcaagattcttatgtattaagcaaaaaaatagtcggatttataagaatagctagaggaaaaaacttaatctccgatttctttgagatgaaaattcgactttgagataaatatttattaaccatattattgataagtcttttatatagcaggtaactttctcatcgtaaatcatggattcagatctttcttgaagttttaaaactctatgtaatcggtggtaaatctattaggagatcagtagtaagtctattaggagatcgataaggctctgatatttattaagttttagattagtttggaatcaacggacctgccttaacgacaccagaatttcacccagcacaaaactcgttcagtaataacgaaggtaagtgacaaaacttatgtattcatacctatttaatcccatagattatgaaccactaaaaaaaaaaaaatcttagaagtattttctaccaagaactcgaatatcccaatatagtacaccacaatcaaattaaatactatattaacgtcattcattaaaccatcatatgaaaatatatagacatgatcattttaaatagacaaacaattggatattaatgactacctcttaataaggagttcagatatccaaaattagattcgatgtcacaatattgtagcgattggaaagaaaataagcatgtaattgtgttctattatctgtttgccgcatatattctacaagaatttgatcatatgtggtgatttcatgagatattattctcataattaacaatgccaaaaacaataggatattaaaaattattaccttctattaagactctatacaaattctctttaaaatttgctttcaaatgagcaccattaatataaatgatgtttttcatgaacttataactgatgcaccaaaaaccaaaattatattagtgacatctgattctttctttaataaaagagatatatccatgatattttaatgtatcatgggaaaacaccttaataagacttcataactatcatcaagtgtacatgtagaaacctatgatgtatgttcgtgagctttccatatttatgtactctatctatccaatccgatagtttatatgaatcattgaaacaaaaatttaaaaaatctcgagattatttttcttccgtggacaaatatgtagaactatatattaaaacaaaaatttaatcttttaaccaaaagaaaagaaaaaaagaagaagcaacattggagaccaagttgtcgttaataatattggcccaagcccacaaaacgttatgactattgtctgactgtcattggaccgttccataaattcatatagaaacacaccaatcaattattagtatacacaagttgtgaggaccttacttttaaaagtctttctttaatagattaaccaagtggaacaagtcttcttgatattattacacatataaaaactccattaagaaactaatttggtttgtccaaaaaggtttagatttcgcagttatctagtgttccttgttaaaattttcttaattgttaaacatgcttaaacgagattatactacaacaaaaaatggattggatataaaagtttcaaacatgtcgttctttatttggtaacaagcaaactttcatacccatatattaacaacaaacaaaaacaacaatgtctttatataaccagaaaaacatgtaaaacagcttgatttaaagaaaaacaatgaaaacataaaaaatagtaaagatagttctgtgccactgtcaacgatgctttcccgatcaggcaaatatatttttttctaaaaacactcaaaagaattagaaaatattctttttttgggggtcaaatgtaaaactttctaatattctgtaggaccaatagaaaaagtagaaaatagaatatatgacttttttttttttgagtctaaaatagaatataggactttgaaaatcccaatagccataaaacattatataaaaaaaagactgttggaaatgatattttcttgtttaaaataaaatgatattcattggcataaaagctattttcaaagcaaagtggaacacttgcattttgcattgagcatcaaattcctccaccatctcctctcctacttctcatcttcatcaccaccgtctaaagattcaaccttttgtaactgcttccaatg

SEQ ID NO: 33247 - DNA, 3000 bp, Unknown; identical to SEQ ID NO: 2374
  misc_feature (1)..( 3000): 2750-1469P.txt file - cDNA_ID_3067325; gDNA_ID_1620527; Annot_ID_159606

SEQ ID NO: 33248 - DNA, 3000 bp, Unknown; identical to SEQ ID NO: 2377
  misc_feature (1)..( 3000): 2750-1469P.txt file - cDNA_ID_3067329; gDNA_ID_1620527; Annot_ID_159605

SEQ ID NO: 33249 - DNA, 3003 bp, Unknown
  misc_feature (1)..( 3003): 2750-1469P.txt file - cDNA_ID_3067333; gDNA_ID_1620527; Annot_ID_159604
tataaagggtgaaacttgacgacaaacaatcctaagctctggatcaggttcacctatagaccatcaaatattaaagtttcaggctcctaccatagacacatcaatacttacaagtgtgaagctgtattcaaaagcatatatattaccctcatacattgtccaagacctcggatataaagcatggtatgtagacttgtctcctttcagattccagtcccaagaaccaatacctgattccgaatcttgtctgttcgaatatataaacttcaatcatctcaaaaaagaatattcactgcaagctaacaaacaagagagagtactgcagtggcttacttgtcaagctttgggttcctaggacataacacactcgagtactttttaccattagcacgtgaaacaaatgcctgcatcaaacaaatccaccaacttagtagagaccatggagagaaatttcaaacagagcataaccatcctgaaactctcttctatcatcttcctcctgcaaagtctatatttgtaacttactgagaattgatttgctaacactggttcatcttcacattttggagggaatagctgccatctctggaattcacctttaaaactccttcctatgcttccagctctgcatgtaaccatagctaaataagtattaagagaacttaccaatatctttacagtaagttctgtatgacaggttacaaatatgatcagagagatggatttctccgaacggttgtttcaatgaaacagttattacataccaatgtggtaaagttgattggatataaaggaaacatacccaatacctccaagtggaacaccatgggaagacgttacagagtgcttggagaatggatctatgaaggccaactgtaatcaatagattattacaatataactgtgtaccaaaaagaaaaagcatatttcaaagactctttggtaaaactgaactaggaaaatgtgtttacccttcctttagcagcttcttctctgcaaagaaaccataaccgaatgccaacaggagcctaccggaacaaaagcaagtctcaaaaacatagttttgacaatcctatcaaacatcctacagaattttaataacagttatatcaaaaacgttttgttttccataggtgtaccagctggaaaatctctttaacactcagattgaattcccgtggagcttttacgtcactatctatctttctttgccatgtcaaagatgcaggtactgccggatcaacctgatttgataagtgggaacaatataagacatcaagccacctttacttgaagattcaggtatcaagttgacataaaataagttacaagtattgtttgatgcagatttaaggactcgaaagatgatggatacgagactaaaacagaacccagaagtttaagctatccaaattagtctaatatatctcaatgaagtccctcaaaacatgaaccacatataagaaatatggaaaaaagcttactttagtatcagaagagtttaaaggttttacatcttcaccaatatccatgatcttttcctcaaacattggtcctaaaaaaaacacagaaacaattcagtgtacaagtcaacaatttcaagtacttatccatctccagttgtcagccatgaagaggttaatttaaggaatacaaaaactggtaatgagaaagtaaacatagttaatggcaaagtagagaataagttaatcacactaacaattaccgtacacaataattcagcattgcgatcattcatgaagacgaaagaaattaacaaatatagaaaacatgagactctcatgatgagagtacctgaaagcaattgctctgaatcgtgattggttattggttggattggatcagaaaaatatggtaaacaagaataaaaccgtgagaattgttgtggcagagaagaacgatcaagccgaagaagatagatatataaactttcgtaaagtgaatttgaaaagtcgtgactttttcaacaaagcttttttttttgtgtgtgtgtatttgtgacttatgaattttttgtgtttgagattagaatttaataaaatatctcctgaattatttgtactaaccagatatggtcgccagtcgccaccacaaaggcacaaacaactatttaaagatcaaaatcgtcttattaatttgggtcaaaacgtgtttttctgattttaaaactttactttaaagcaattttaatatttaatgtaacacactatttgtaactaccaaaaatctttttattaaagagattccctgaccaaaaatctttttattaatacagtatggccaaaacatcttaactacctttttgatctcaaaactttactttcaagcaatgtaaaactaagatttactgacaaaaataaagaagtaattattaatactaatgaaaactgagagtaatcattaaactcatgacgcaattacacaatggtgttatttaggacaacaagtaacaaagtagtgaaacaatgtctgacacgttacttgtgtttgcaactttgcatcatcatgcttgatatgtggacctattagaagaacttgggccttgcacgattgcatctttgtttttaattagtaaagtgattaaataagacgcaaatcaattaatgtccttaacaaaacataccgacatgactttgaatagagcaagcatcacgaaacgaactctattccaaacgtgtgtttgacagtttcttgcttttgaatctccggttcgaattaatttgtgtttgaaccgtgttccgaatggtttatgatgggccaagttattttatatgagaatgttgggctcaattatacgaagcccaaataattataaataaatgcaaatcgaaaggtatatgttaccaccaccaaccattttctagaaccttccacttcttcttacttagcttcccacatagttttcttctccttccttcttcttatcttcttcttcttcatctacctaacttaggttttatcaatctctcatttccaaccatg

SEQ ID NO: 33250 - DNA, 3003 bp, Unknown
  misc_feature (1)..( 3003): 2750-1469P.txt file - cDNA_ID_3067337; gDNA_ID_1620527; Annot_ID_159601
gctaattttaagggattgacttaaagtttgtttggattaaatttgattgataatgtggttgacaatttcaatcaagaatttaaaataaaattaattattttggaaaaaagatttaatgctaatggcattgagttgtaaataagtccaaatccaggatttatttattaaaatggctgaaaaaaatgtatatatagataatagaggtttccacttttgctatgaagaggactagaagaaatgctcatcgataccagaaaattgagaaattggccaagaaaatcacaaacttttaaaattagccaaaaaaatgttcaaacttttccattagaattttaaaaataccaaaaaatttaagaagcagccaaataatgcttacgattttatgacattaacaatgtttaaataaaaaagagttttagttctatgaatatgatacaatggttcttacaaattgattacaagagcttacatattataacataataatttaaattattaacaattaaagattttttattttaattgaataacactacacttttaatgactttataagagtactagattttaatataccgcgagatgatttattttttaaaagtaatatatattaaaacttgcaaattttatttttataaaatatttatatttttacagtttataattattattaagtatttatatatattatttttttattaaaaataataaatcaaagatttaacctgtattgaaacggtggattaattatattttactttttattaatgttgattcaaaaacccgttcctccaaatccgtcttgccaaaaagccatttattttattaatattgattttatttatgatataagtctgaattataatctaaacattttagctaataacataggagtgcaccatatttatttaataggggaatgtaccatatgacccgaatgcacttttacccaaatccaccaaaaaagtcttgcaaaactactatagacccgaatgtaccatatttttttgtgctaatttttatgtgattaagatttaattgatttcgtatataaaatattaaattgttttacgaacttatttgtttataatttggtaacagatagataattgaatattcagtatattttgcttcagtttaggaaatctttaatgacccgtctttaaatccaataagccctataattaagagatgaatattgtcgttaaatgattttggtaatcttaatgatgtcattaaaagattttgtttttgattaaatttttctaatggcattgtcatgtaattaattacaaaaattaaggttacatttaaaatgtacttcccaaataatatagtaggacgatatgcacttttatccaaatccaccaaaaaagtcttgcaaatatactatagagataagaaacgatagtcggttttgataggtatatgattagcaaatatattagttcgcttaaattagttaaagaatacaaattgaaaaggtatattacactttattcgaatatagtatcaaaacttatatagagatttgataaatttttaattgttgaatactttttttttgtgctaattttatgtgattaagatttagttgatttcgtatataaaatattaaattgttttacgaacttatttgtttataatttggtaacagatagatatttgaatattcagtatattttgcttcagtttaggaaatctttgatgagttgtctttagatccaataagccctgtaatctagatattaacttgcagtataccgcaggtaggcttatattttagttcaactaaaaacttttattgtaaagatgatttaaaaatatatgatattattttatttgattttaaatgtatagtaaactgtgagttgtatatattttttgatattatctatattgtttagtgtttaagattatacacttgtagtttgattgttaatttaagagtttcacctgtagtataccatcttgtattaatatcgatctaatcccgtcaattctaggattttccagcttgtattaaaaattgaatcacatctaatatgttattaattattgtagtatataagattataaattttcaatataatatgtatgaaattgaatataaatatttcaaattatgacatgttactcagtagaaagttttcttaaatctatttttcacccgttataatattttttcatgtattgaacagtttatattcgtttttaaaaattcaaattatggcatatgcgaaaaaactctaattatttttctataatgatgatattatttttcggcaaaaatagaatcatataaagatgagaagtaaactataataattaataaaaaattaatatgataatttagatatcaaatctaatttgttgattttaattggttacttttttgggaattaataatgtattttgtttttctaattaaattaaattaattaaaatttagatatcaaatcttatatgttgattttgattggttattatttttggaaattaataatgtatttcgtttttaattaaatttaattaattaaattagtatttgactttttaatcctcaaagagataaattaatttactctttaaaattttatttctaatgacatacctatgtaattacttacaaaaattaaagttatatttaaaatgtacttcccaaataatatagtaggatgaatctaataacccaaaatttataaagatttaaattataatcaacagtttgatcatcttgttcatacaaaatttcgtataagacattaattaacaaagcaaaaaatcatatatcaaaatagacacatattaacaaaggattaataatttaatagttgtgaaaagcctttccagtttcttccacggcctagctcctccgtctttacgctctctcatcaaactcgagaaaaaaaagtggcgcctctgcaatttcaattttcaaatcctaataatttttctctcgcttcccggagaacggaaccctaatttctcgacgcagacatg

SEQ ID NO: 33251 - DNA, 3000 bp, Unknown; identical to SEQ ID NO: 2381
  misc_feature (1)..( 3000): 2750-1469P.txt file - cDNA_ID_3067364; gDNA_ID_1620528; Annot_ID_159637

SEQ ID NO: 33252 - DNA, 3003 bp, Unknown
  misc_feature (1)..( 3003): 2750-1469P.txt file - cDNA_ID_3067368; gDNA_ID_1620528; Annot_ID_159633
tgctcattaccttttctctttttctcccaaaaagcagtccctcgaatcaatgaatgcggattattagctggcctctctgcctttaactattgtttgtatctatcaaaggcagtcattgtgttcaagatagaatagtattgattctgagattagaaacaccattacagattcgagaaaaagagcggcatttggtttgtttgtttgttagtttcagatcaagaatcaggcccagatggcgaggagagacatggaacctgcgcctaggacgagagagagataagcagccaagtgaagccagagattggattgcaatcttggattcataaaatcagtagcaagaagatcaacaagtgacatgtatatgagtatcccagcagatgcagcattcaacattccttccaccattattgcctctttgctctctttcctgtagcctaaaccacttgacatccccaaccctattcctatcccaagtggcgccgtcaccgagaaaaatgtcgccattagcactgtcgatttcgacttcatatccgcctattcatatacacacaacatgatcatcatgctatcatcaatcaattgaattttgaacaatgaagaaaaaatgattgttgtgacacgattcgtctaagctaagctacctatgaccataaacgatttggaagagactaaccagggagatgcatccaccgaggccaagaccttcaaagaactgatggaaagatagtgcagccatgagtggctttatggtgtctatgctctgtgaagctccaagtgatatccctataataaccgaatgcacaactatcccaatctcaagcacctgcgacactatacgtcttctgatcaactcggtcgaaccatgtgtgtgtccgtgactagcgtgcgtgtgaatgtgaacatgacccgcatgctcttcttcatctactactacgttcacttgcttgctcccatggttattgctaaaatgttgcctcttgtaataccctgtcgcgaatgtgtcgatcataagagtccccatcgccgacagcatcgctacaaaaccagcaaacgggaacttcccagctgtagtgtcctcaagacatggagagctcaatctctcgaacgcgtctggtaagatatgaacgaaacctgtgcagaggatcactcctgcagcaaaagctttcaccatgaagaagatatcattttccggttgtaacgccggaatccttttcccgatcaacggtagactcacgccgactcctccggctacaagaagtaaagctatcgaaccaagctttagcttcgtcgctttctctgcttcgtcttgagacacaggatcatcgtgacttgtacaatcactcgaggcacaacacatatgcaaacatattatcaatactacacaaattctcaacatagttgttgccgaaaaacatccacattcagacatgagtttaagatatttatgttcttgttctgtaagaaagtaaagtttgaagagttatggtgaagaaagaggagctttttatagagagaaagcgagagagaacctcacttttgaagcgagtggtccataaatgttagtagcagaatctctagttacgtagagttgaccactatacacatttctttgtttgtcgcacacaaaaaaataattaaattctgttattactcttattgtataccattaagtctttaacaatgactagataaaataggatggaacatttacggaaaaaggctgcgaaagaattcattggttagtataagaaattctgcaagcatcttagattgtagtctatggatggttcaagtaagacgccctttcgatctcttctaatcattacttatctatttatacatttttgagatatacaaacaataataaaacaaagacgacaattcaaagatagatgattagggaaagatcatagagactaaaagtgagtttggaacattattggtcttaaactttaggggcgtagaatagggtggaaaagagattagctgtgaatgctaatccttgtaattattaggttagtacatatcttttcactttaccaaaagcaaaatatatgtgtattatgaattgaaaatttgaagacttttttactagaaagtaaaatgtgaagacagaatgtcgtcatgttactatgtgagccgtgaggagagtggttttggtttgatttgttaaatctacttttggattcaagaaacgtaagatggtctcatcgtcctctcaaggtgggatgggtgggtaatgctggcccaatcaaaccacgtgtttcaaattcagatttcaccatcgccacttgagtgtgatggttacctgaacctaatgattttggccttttatatcttgttttcgaaaactctgaactataaataagatatagaggtttgagaaaacaatggttgaattttcataagcaaagaaattggaaagaatccaagtttgatcacacttgactatcatttcactttttttttgtttttaattcctaaaattgatctaatagattatatataaacatatatgtacctaattaatctctggtatatgtaagacattcactttttatttttggttggtaattttatatcgctgcagtatatgatttaacgatttaataattacgaatcataataactatatcaaagcgataccaaaaacgatatagttaaattttataccattattgtctactattttttttaccatttcaagataattttatatcgtttaccgttttttcttcccgcgaaaaaattcataccacattctagctccaattgaattaaaatgtatcaaattctctatcaaatcaggattttataaactataaggtacaatttatatcccagctgattaactctagtccaaagcttaaagacagaacagtataccggactaaatttccggtccattttgtatagggagacattttactaaacaaaccggtttggcgaaccggagtatttgcataactgaaacaacatttataagaaagaaaagtagaaatg

SEQ ID NO: 33253 - DNA, 3003 bp, Unknown
  misc_feature (1)..( 3003): 2750-1469P.txt file - cDNA_ID_3067371; gDNA_ID_1620528; Annot_ID_159631
gtggtgatgatggctagaaaagtgactagatagaaagacgcaagattgatcggttataattgtgcatataaacttttataaacaaaaattgaccggagagattttgcatgtaaatggatgtgactttaaaatatataaattcatatatcatgggcttctagaaaaaacaaaaccatccgaagaacaaaaaacaagaaatcaggttgtgagaactaggatcgaatttagaactatagaattgtccaaattgagtaaaatatatgtatcattgtgcaagtgaacacatatataacaaaacacaagagttgtgataatcatgaggcagcatacgttccacatcatcgcatatatagatcaagggaataacgaagacttcatatgtttggcataagttattacaagtaattttgtgcataattttatacaccaagtgcgcattagaaactagagaagaaagagtcaagtagctagatctatatttgatatatctcttctctaaccgagacaaaccgtacggcccttagtgatggaactcctagaatcttgtagggagaagttggaattgatgtcggggagaatcaacgtagagtccatggaggaagaggaaggaaaatgatcctcgaaccatgggattgggatggacgatgtgttgttacaaatattggtgcggtcgaaaaatagagtagagtagtctttagtgaggcttgcttcttgggtttcacatgctttctctaacatgctctccatgtatttcccttgtgccgctatcctttgattcacctgtctttctattactacctcttcctctatccttctttgcacctccatttgcatccttcattaccatccataattaccatttttatattataaaattttgagtaatatatctatttatatatgaatcaatatatagttaggatttggaattgaaggcacatactcgttcatattgcgaccaatgatgagcggactagtcgtgaaaacagcattccttcgaagatccaacatggaagctgcatgcatgatgtttattaattaacatatattcatggcatagtcacagatgaattaattaaccaatgtatatatgaattaataattaagtttatgacagacctctatttgtatctctaatacaaatggagtgattttgactatgctccttgtgaggctgcttcccaagtctgaacttctgtagttgaaacacacatacagtatatgttttaaatcctaattactacggcaagattataaaagaagctaataacaaaaaaattaaagaagaggaaactgaggaagaaggtatatacacctggagatggctcttgagatgataaagagtgagacccttcacacccataactctcattattgtctttggtgtagcctctgctcatatatagcgcaattaatatagctttaaaggtttatctatatagggagatgtatatgatgatgatgatgaaaacgtactttcagggcctccaaggtgagtgacggcgtcaacgaagcgttcgtgaagctctgtggtccagcgaaggcgaggcttagggtcagtggtgaggacgagacctgatgatgaatcatctctgatctcctctctcgactgcatcatttaactaacaaagtactaaatgccgattgatgatgctctaatcaacaagagaatattagtatttatgaaagatggaaaaaggaacacacgacgtcttgcaaattacaagtataaattattaagagacattgacataaataatttttaatatatggaaaataatgggagacatatctatatatgcagtagggtttaggctttgaagttgtaaaccatgcaagcttttttgcatccacacatgtctaaataccaaaaaattcaaatttacatgtctaactccttctatttccaatgtattgacgcatgtggccttgcaaatatcatcatccataactcataagatatgaaaattacttttttttttttttttcatttagtgatttagtatgcacatgcatgggattaaggaacaaaattaaagcatctaatctgttgtaaaatttgtttaatctcgatgaaaagattcgtgtgctttgtacctttcaataaagatgacaagtggagcaaagctgatgtttaacttttagctcatcaattgagtacatatgtatgcaaataggaatcagaagttggaaaaaaatgaaaaaaggaagaaagtattttgttttggttgcttagattttaagcagtctcctttattttatgggttcttcttatattactttacagatgaatctattccctttcatctcactctaatatgaagaagacttgtcttgatccagcttgagaaaaaaagaagaagaagacttgtcttgatccagcttgagaaaaaaagcaatacaaatattggaccgaataaaaaaaaagcggaggcctttttaaaaatagtttaagcccaatttatgtattaaaggcccaatgaattggtcgctatctacgcgtcctaacgtgacgtttgccatgcatagatttttcaatttttttgaccactctagtctatagtgctctatttgttttttgttcttgtttctttttgtctccctaattcaatattcatgctgtgatcataagtccataacaaaataaaatacttggtcatgcattaatctcgtaatatttagttgtatttttcagcttacaacaaaaaacaaaaaaacaaaaacagagcagtagtagcaaaaagaaaaaagggacagtctttaccaataggaaactgacacgatccatcctaagaaacttcaattttggggtttctcttcgtcttcttcttcttcttcttctagatcgagagggacatgggtcttaccagccgccgttgacgactacgacgaccattctcttcctcttcatcttctctccttctgcttttctctatttcctattctctccaaattcaccatttccttccaccactcagagatctccctttcttattagctatg

SEQ ID NO: 33254 - DNA, 3000 bp, Unknown; identical to SEQ ID NO: 2382
  misc_feature (1)..( 3000): 2750-1469P.txt file - cDNA_ID_3067377; gDNA_ID_1620528; Annot_ID_159624

SEQ ID NO: 33255 - DNA, 3000 bp, Unknown; identical to SEQ ID NO: 2379
  misc_feature (1)..( 3000): 2750-1469P.txt file - cDNA_ID_3067385; gDNA_ID_1620528; Annot_ID_159621

SEQ ID NO: 33256 - DNA, 3003 bp, Unknown
  misc_feature (1)..( 3003): 2750-1469P.txt file - cDNA_ID_3067413; gDNA_ID_1620529; Annot_ID_159674
gaatgaaaaatttgtaagccaatttccacgagttcactaacatcttccacggacaattcacttttcgctctaacaaagctgcaaaaagaaaaacaaaggtcatcagacacggaatagccaaatgcagcataataagaatcatgtatgcccaacttacataagtgagaaaactacaagacggaaattactacacaatcaatcacaggtacatagtggctactggataaccagtggaaccagtctgtaaaatgatttcagactactagactgcatggtttaagtataaaatctgaacctaactacaattttcacgcaaattccaactgtttattgaactctatcctagtcatgtatcgcgaacacccaaaacccccagcagtttatttcgatatactgactcgattgtaaactgagctaatcgtctctcaaattcatcatcctcgtctacaaatcccaataagaagcagccaattcgaacgagaaaaaataaaaaaatcaacgaggtttatgcaatcaaaatcgaggactcacagttcgataacggagatccatttaagagtggcgtaaacagactctggatcatcgggtcggtgcaactctttgacgcatctcacgacacgcgcgaaggactctttctccttcttcgtctcctccgctacaggcggcggtaaccattcattgtacagatgcatcgcttcttctcagtctccgtctttcgtcgtcttcaattttatgcagattgatgtagtctctcctctctcagacgctgaatttataagctgcgtttgctttttcagtttattttctcttgttttctttccaagcaagaaaaatcatatccgaggaaaaggacaatgaacataccatagaaatgaaaacaacttgaggaaaaaaaaattattgtattgactttaccgttgactggctaccggcaacgggagcggcaggtacaccacttaccgaaaccgactaaataggatttcaaattagccccttaagttttacttataatacaatttacccttaaacatttgacttgtgctatattgtttagatggaacgcatactgtccacaagtaattccggccaataaattgtgaatttaagtctgaccgtacggtggagacacatacgcatagatggatatttttgttgtcaacaggtggaaatttaagcagctattatttgttcatcgaattaacttacgtacgtatatgatgacgacattaacattgcagtttattctgtgttaggtcggggtttgtgataggaccaacgttctaaatgagtgattaaaaattactaaatcatagataaactatcactaaactaattgctaactgaggtttagcagaaattcaatgaattaataataattattttggttttaacaatcaacaaagtcgttgtagtatagtggtaagtattcccgcctgtcacgcgggtgacccgggttcgatccccggcaacggcgtttatttttatttcccttttttgtaatgggccgtttctgtacctgaaaagaagtctttataagcccataaagacgaactaataggcccaaatttgtgatcttaatatattatggactctgttttctttttcgtaagctcttcaattcttaactgtttacacgcaaaagtgccatagtggttaacacttaaaccaaataaagacacctgaaatgttggaaaatatatgactctcagcagtcagcatcacgtaatcgtcgttgagccgcgctatctattttgtgcatttttctttaatatgtactcataagggttttttttttgcatgagcataagcagcgataagttgatacatgagaatgtttacgtgtggacggaagtaaattgttttgcacttgaaaagataaattttatgagtcaatgccattaaacattcttattacaagtttattttctcgaagttgcatctgaataacattgtagtattgattacgagattgaatttatctcgaatagtgagtctaatgagtgtacacatatcggattttggatgggaccataaaacacgacgtggtatttgataattataatttattaagtactgtactgtctgtctgtgttccgaagataatgttaaacaaataacaccacaatctcctatagaaagacaaacctgtcctcataacctaaaccaaaattttcattcaccttagggtgaatatgtcatataaggtaataaagccaatcttgtaataacatatagaattatagatatgattctataattaattaacccaaacaataagtagatatctatattaaaaatcaaatcaaatctagtaatcggaaaaaaaacgaaccgtccctttctccactcaagtagttaaattggttctgtgaaggaagataaatccgctgttcctctcctctctctctctcttcccgttttcacttttgttcgttctctggcggccgatcccgtcgctcgctaccttttaagatattttttttatctaatgaacctgaaattgtaattaggcatataattggggattatttgctgaaattctcatttctagatcgaaaaaagcgaataattcgttttcatttgattcttgcctaatcttagggtatgtcctcccccttgatctgtatagtttttttgatgttgtgatttgttagggtttgtgaattaattgtttcagattgggttttgctcctttttccatttttgtctgctttagtttataggttaggtttccggattttgtgttggagtttctaattttgctttgaattggattattagcccattacgtttcctaggcatagacattgatcaattgcacggtgaatgttttaactttttaagctgttttgatttccttaaactgttcactgattactatttatgtgcagtttatgcccccatttttgagtagggatgtagaatttcttgatttaaaagctttaataatatggtttgtgtgtttgtatatgcaggtgtctttatttatctaccaaaagaatg

SEQ ID NO: 33257 - DNA, 3003 bp, Unknown
  misc_feature (1)..( 3003): 2750-1469P.txt file - cDNA_ID_3067417; gDNA_ID_1620529; Annot_ID_159672
cagaaaaaaaaaacgattttgtgcgtaacacactccattttttagtgtttaacaaacggtggtagtccattgttttcatcatttacaatatcaacgcaaaagagattgtattttgacagtaaacattggaagaaaaatatatggcttgtaaattgtggcttatagtagtaagcacatattaatatttgattggtaactggatggatgaaaactaactttgttaattatcgctcgcaataagcttctagacttgtcgtttcatattaacaatcggccggtaagcttgggtcatatgttttattactaatgtatcggatgaatgaaattgaactttgttaggtacttactttaaaatgagtgtctcgcaataagcttctagactgtggttgatactagtagtaataactgataactatataagcatgtaatcaatattttattaggatgaatgagatttacctttgttggttattttataatgagtgtgtctagcaataattaaagtttattatactgtgatttaatgaattgtgtagttaaaggtggggactactactttggttgagggaacttggtgggggagtcatgtttttgtgtgtactccaagttccacaaatactaactcttctttgcttccctttttaatatgcaaatcaaccaattatatttctgttattacgaccatctactaatatttaagtctttcttgctatctattttctaaagcatccacttagtaattaaaaaaggagacacttgtaaacttcattatcatcataaaaagcaccaccacaaaaaaaaaattataaccacagcccacaggtccacaagtaaccagcgtcaaacaaaaatcttggttgtttttttttgttgtctaattgaaatagttacttgtcttttgttcatatatgtggatattttgtttggctctatagcaactctcattatttcgcaacctaatcattatggtctcgcgaagtcactcgatctgagccaaaatcagatacttagtggtttgcttgttacatcttatatcatttcgatatttgtcaagaaagaaagaaagaaaaactaatatcatttcgataaaaagaattaaacaacaaggtagtagatgaacaaactaatgacagacaatacacgtatataatagaagcgacaagtcggtggtatgaagatacctggccatgtgcttaactgcaaagaaaagtacttctcaacttcttcttatcaaaattattttttaatgatcgaattatacgaatctgtatagatttataattagaggggtattgggctaattgctagtgagtctagttatactgggtccatactttgagaacatgaaccttacggcccattaaactactcataggcctagatcgctctctactctttttataaaatttcaaacgaatagtataagactataagttttgtgataattgcaaaaatatactcaatctacaattaatttttaaaaaaattttaggggtaaaattattaaaaaatgagtaaacaagttcaacactgaataagtgttaaaaacattatttgcttcgataccataaagtttaaacccaaattcagaatataatcctaataaataaggtgtatgcataaaaagctagtggtggaaactcgagcaccagtctcgattgaaagttgagaagaattatcaactcatggagcatcacaaatagccaattggtcgtaacatagatagtggctacaagtaatatttaactactgaatcgaatttgtagtgatttgttcaaataattcgaaacctattgtaccatttttatacttttttgtaacatcagctaaagtaccaaattaaatgataaaaatgttgttggttaaataatttattgcaatatatactgaaattaggacaaagaggctagatttcttgagggaaataaatgcgggaactgtcgtaaatggggtgtgaaacggcgccgttatttgggtgtctccatgtcttcttccacattctaagaaagaaagaaagaaaattaaataatttattttcatcaactgatgaaacatcaattcaaccaagaacgaaacttcctctcgctcgcgctctactgacaatctgagatccagggattctattccagatcactctcaattctctcctccatatactatcgagcaaacggattcatcatcatactctgcgttgtctccagcagatcagaagaagaataagtagagaagaaacctcaatcaaagtcgttgttctttcttatttcggttatgcttgatttggtttctcctacttgttcaccaattcttcttctctgacccttcgttgactgcaaggtaaagttgccttctttcttttgcccttttgttcttaacctcaaagtctcgattttgttgtgaaatcattccatctctttccgattcatggctcttctgcgttaagttctctggattaggtttagcaattttatacgaatgagtaaagtttgactcaacaaattcttaatttggcgttattcagatacttttgattttgattcgcgactcttttctccttttccctaaggaatgaggtttataactctgtgcagtgctacttgtagttgttgctcctgtaatatgaagctgttcaattaatataaaagtgtctgtttccctataatgttaagcgttttagattaatttgtggtgtaaaaatcatccatacgactcctcaaagtgttttcatctagtgtcactgtggttataacttggatctcatacaagaagctttcctctgtatccaggttgctgcagaagcggacgctgtagttttatccttggtccatgtgttggtagcacaagggtatgagttgttgtaaagtgccagttcttattgaagcacaagttgaagtaagttagttcacggcatactctttggtttctggatagccagagattttgtacgtatctgagttcatcggcttgttgtgggattaatgaaaaagatgtttgctgtaacagatg

SEQ ID NO: 33258 - DNA, 3003 bp, Unknown
  misc_feature (1)..( 3003): 2750-1469P.txt file - cDNA_ID_3067426; gDNA_ID_1620529; Annot_ID_159669
ttctcttaacaatatttgtttttatactcttgcatcgttcactgagatacactattaagcttggtgttaccttgatttggcacatgagatcctttgttacattcgttttgaaacgaaaatcagatttggtatataactggcatttatcgatgatcagtttttgcttttcataccttggtaattttgtttgatttttatttgttgacctgaaacgttattacccttccaggtaatggcttcgcagaaggagatgcagagacaactatcaaatgctgtcactggccctatcgtaaaagaaggtaaaaaactagaagttgccttagggagaatgattgagaaatccagcaagtcaaatgctgatgctctatgggcccacttccaagaggaggctgttaagaatgaaaaggcattacgtgaccatggccagcaaattatgaatgaaacgacaaacttcacgagtaaagagttaaatgccatgtttgagaaaacgatgaagaaggaatttgcttcagttggtccaaccctagcacgtgtagtaactccagttattgaaaaaactgtatcttctgcaatcacagagtccttccaggttagtaatttaagagaaatttagagctgatttatgagaaggtccattgatgaaaaagaaaactgatttctctttatacagagaggaattggtgacaaagcagtcaatcagcttgaaaaatctgttaattcaaagcttgaaacaaccgtagccaggcagattcaagcccaatttcagacatctggcagacaagtcctgcaggtaaaaattcgagtttaaactagtttttttatgccttactgtctcttgtatatatattttttatgcttttcagacagttatgactgattgactggttatatatacaagtcttgtgcatacattctcaactgcatcgttgtttatcgtaaaagcagttgtctcttatatatatttgctgccatttgtcaacttcaggaaggtcttaggtcaagtatggagtcctcagtcataccttcctttgagaggtcatgcaaaaccatgtttgagcaagtagactcaaccttacagaaaggaattggtaagcacacgagcgcaacacagcaacggattgactctggacaatctcagcttgctcatactctgagggtatgatagaaaatcgtccttcttccagattttttggctctttcttctagttatggtagcaaaatccttttttaatcctcatgttaaacatgcttttatacaggaaaccattagttctgcatcatcagttactcaagccctaaatcgtgaattagccgagagtcaaaggaatcgcttagctctcacagctgctggatcaaatcccttggttactcaactaagtaacgggcctttaggtgctcttcttgaaaaggtttgcacatctctggatcaaatttcttaccatgaatattttgtcattttctgcgtgtttgacatgtatatacgttaactgcaatgcatcattgttgtttcaggttgaagcacctatggacccaacaacagagctatcaaggttgatatctgaacgcaagtacgaagaatctttcacatcagctctacaaagaagcgatgtctctatagtatcatggctttgctcacaggtgaattcttttttggatttcctgcatcataagatctcataaccatcagttttgcgtaacatcccatgacactggtgttgtgccaattcaggtggatcttcgtggactactggcgatgaatccgcttccgctgagccaaggtgtgcttctttcactgctgcagcagttagcttgtgacataagcacggacacatcccgtaagctaggttggatgactgatgtggttacagccataaacccatcagatcagatgatagcggtccatgctcgcccaatctttgaacaagtttatcagattttgcaccatcaccgtaacgcaccaggcagcgacgtctctgccgtcagactaataatgcacgtcatcaactctttacttatgagctgcaaatgacatctcgctctctctgtttcttcttgttagttacatgcataaaacataggaaacctctcttctctgtatttctctctctactctagttagattttttttggttacccattagttcaatttcctttaactgtaaacatctggttggttctacgtctataatgttccctttttcttctccgagagaatgagtttgctaggatctggaaaaccctgagaaaacatgaagatcatgtatgggcagggtatactgattttctaatgaaattggttttgaagtaactacaagttacctgcagaatagacagatgagtttgaagacattatgggaatctggtgtggcagtaagcagagaatttgtcaaaattgagcaattgcaataaaaaatctttttctttacttttgagttcagttgatcagtttttggattgaagggtatttgctgttgggttcggttgcctttacttgcatgtgagctcagctgaccatgaattcagaatccttgtcatcttcttctcttttgttggaggttccgatgaagagcaagaagttggaaacaaatgatgggtgaatctctggaaatgtaaatagggcccaataattgaaattaaaggcccaaacgagtaaaatctgaaaattgttttacagaagcggtctcatattttagatataaacacgatcatcaccccaaaacttttcgtgatctgggacatgcccaatttaatattttcattaaagaagaagaaaaaatagctaagtctccaaaagttctctacctgttctcactttcaagtcatcatcgtctctctctctctattgttgctctctctctcgctttttatgtgactttcagatccgccgagtcttctttttgtggaatcttttcaaggagctcagtattctatatacacctctctttgtttgatcgatttcacaaaccctagcttcggcgatcttaaatctgcaaaaaatctatg

SEQ ID NO: 33259 - DNA, 3003 bp, Unknown
  misc_feature (1)..( 3003): 2750-1469P.txt file - cDNA_ID_3067430; gDNA_ID_1620529; Annot_ID_159667
ctcgacactaaaacagagatagtgaacaattacagagcaaaatcttgatatttattgtttggttaagttcctcaagaacctagtgtggttcttatttgctttttcaggtttccaaaagaggccatttccatctttgcgataaccagagataccattttcttcagattatctctgcattgatggtgatcactagatataattcaagatatccatgctgcattctctcttcgatggtgaatgtaaagaaataagtcagatgtagaacaagtaaatatgcaccaatcatatttaaagcagaaagaattattcgtgcttccgtggactgtttattaagttatagggcttaaaaagaccattaaggcccaaactaatgttttcgtgtctgaatttgtgcggaagcgtcctcacattttattgcgattatcaccccataacttttttagtcatagaatttacgcccgcactatcaaaaaagcaagtctactacaaaacttctatagctgttctcactttcaaggcatcatcgtctctctattcttgcttttcgcgcttctctctctacgtgactttcgatttcttcttacttttttctgaaatctattcaagaacctccacattcaattacacttgtctattgatcgatatcgcaaaacctaaatttggcgatcctgaatgcgtctttgaaagtagagagatttaaagatagtgtataaaggagactgaaatgttttccatcttatttctctctttaattaatcctattacattgagttcttatatatagtgtgaggattaggtttacattttatcctcatcctctaaacatttgagcctattagttaagatcgtatcttgacttgaacagctggagatgcttttccttgacgctctcttagccacagaactaactggtttgtcttcttgttctgttgcagatgaccgttgcacttggatggactgaatgggcttctcggggttctcctcttctacagcagcttcctcagtctttaactttctcatcatcatcatgcattcttcctagaatgttttaggattacccaaagtcagtaaatccaaattcaattgttattatatatatatatatatatatatatatatatatatttagaaatgagagatgttaaggttgactattcaccatggtaacagacgtaaaacaggggtttccctcctctggtcgaatcttcaccatggtagaaccgtttcccttgttgcatgttttaccatcaaattccaacatcttgcagagttccttgaatgttttagcatcaaccaaagtcagtaaatccaaagtcaatgctatatatgtacttcacacaatagcacgtaaatacacaaatattagaaatgagagatgttaaaacttgcctttagtgttagaggagaagaagtatgatacgctatatcttgagtaaccagcaagtcccactcctgcttcatgagaatggcaaattaggtaaagtcgtgaaagggtaactgtaagtcccagaaatcagaaatctctcaacttgagatgagatattaaaacttgcctttgatcgacccagcaccatgttagcagggtctagtcgatccacattgttatgactagcctccctgtcccattcctgcgtggagatgagaggcattatgtacttttgaaagggaaacttgtggtaagagaatgatggtttagaatcagagagctagtgagctgcttacagaatacgcatgtttttcactcttgagatgcgtggtgaaatcttcaaagctttgggcaccaaaatcgcattctgagcaaaacaagggagtttcaccggtttcactgcgcttgtagtcctgaagaacaagtcttgttgctcctgtttgttatcctccatagcagcatctgtggattcaaaacagcttaatttgcttgttatcagatgcatgttatgagagagaggccataaaaaatacctgccattaagctatcccagaacaactcttcaggaacatctttaagaatgcttagccggagagctagagctcgtggaggatatgcgagaagaattctgtatcccttcttctctatgtcgtaaagtgtactagctaaagttttcaggtccttagaactggttatgagcattatagtagccggagcaagattctcatcagtccactcaaacaaatccctttgaatatctgtctcagtaagtaaaggaaactaacgtttaatctaaaccctaattaacaaaaaaagagatgaaagaagatttttaactaaccgtgggcatgtttaagagcgattccagtggaagaaagcgttcgcagggattcgtcaccaccagggatctgcgttaggttgccaacggcagtgataaagagaggaccccggcggcagcgccactggcctgacttttccaacgccgattctatcctcggacccaccagacgaggatcatgaccatcgggaagcggacaggtggtcatgttccacaacaccaacgttttctcgaaatgtttgttcattattcttcgacctaaaagacaccttgaatcctatacgcacagagaagaccaaaaggaaagaacgatggtaactttcgatcagtttttttagggttcatataaatgttgtggagggagagagatacttgcggttggtttctatgggccgatgcgcgtggcccatataataataattacttgtgaattcctttaaacccaagtttaatttgttgcgcgattatcaccccatcacttttagtcatcagatttacgccccactatcgaaaacgcaagtctacaaaacttctttagctgttctctcactcctttcaagtcatcatcgtctatctctactcgcttttcgcgcttcccctctctacgtgacttttgatttcttcttcagatccgccgagtcttctttttctgaaatatattcacgaaccttcacattcaaattacacttgtctattgatcgatatcgcaaaccctagattcggcgatcgtaaatcaatg

SEQ ID NO: 33260 - DNA, 3000 bp, Unknown
  misc_feature (1)..( 3000): 2750-1469P.txt file - cDNA_ID_3067437; gDNA_ID_1620529; Annot_ID_159661
ttaaatgttacttgatttggacaggtgaagaaagaatctatctatcagctgatagtatagatccttcggattcggactcactaaaaaatcctgttatcactccagatttcttaaacagtattaaggtatcaggtatgccacaccattctttgcgtttgaaggttggggctcctgttatgttacttagaaatttagatcctaaaggtggtctttgtaatggaacaaggctacagataactcagttgtgtagtcatattgtcgaagcaaaggttataacaggagataggattgggcagatcgtgtatattcctctaataaacatcacaccttcagatacaaaactaccattcaagatgcgtagaaggcagtttcctctctctgttgcatttgttatgaccataaacaagagtcagggacaatctcttgagcaagtaggattgtacttgcctaaacctgttttctctcatggtcaactatatgttgcgttgtctagggttacttctaagacagggttgaaaatactaattctcgacaaagagggaaagatacaaaagcaaactaccaatgtggttttcaaggaggtgtttcagaatatttagtgacaagagtcaactcacatattctgtaatctatatagttgagaaggtatatttactatacctttgtaatattgattcaattatggtttgaataacccgcaaacaaactgtctaatcaaaatctgaatcttctgttatgcaggaaactcagtatcattcaagctatttcattggtcactgaataacctaacaaagcagttctaaagggaatcgaatagactttggttttccagttttcatttacatttatctttacagttcaaacaagtacttattattcttacacattttcaatctgcagtttgccaagtgttttccattttaacaagttctacctatgcttcgaacacttgcttttaacaagttgcagcaaatttgtaaagacaaaaaacgaattcaatcagttatacaattaactcagatttatacttcctactcataacaaaatccacctaaatgatatgaacactttaactttaaacacaaaatactgcaactaaagaagattaagaaactgacctctgcaatagattgataacctcttgctcagttctttgttcagacattaaacctgtaaaacagaaagaacaaagtgttgctatataaatttggtagctattaattaaggaaaccgagtaattaaactgtattacaactcaaaaatattataatctaacctctgcaagatatggcgacatctaaatctagagattaaccaataccctttattttcaatcacgaaataacaaaatgtgccaaagtacagatttggtcattatttttcttagataccaatttgttagctgttctaaactgtataatgacagagacatataacccaggtattgttgtattggaaaagggggtttctgaatatgattaaaaccaaagactgccaattactaaccaaatctggaaaaaatacacacctttacaaactccattcgcctttacttctgttgagctgacttgattctctgccgccatagcttccttttggttcgtattcatccaatggtaggtgaaatcgtatgaattcggatcaaatgacgatttgataaccacttttcgttggaagaaattgtagattagttgtttctttgaggaacgatgaacaactattttgaaattgccgactctatattgactctgaagtcgaagttttgcaagagaataataacagcgattgccgagaaatctcaattacacatgaagaacaatcagttgttttaagaaagtcgattattgaagcagacactcacaaacgagtgtattaatttttcagatattttgtggttttcactattgattatcataaaaatttgtgtgggttatgtggatctgtgggcctaatgaattattaaagatgaagcccataatatgagttgtattttgaagcaacatttttacaatttggtactcactaaaaaatattgtttgctaaatcttgatatatagatttcaatattaaacctgaaaaacaaaaataaaaacaacatttacagtaactttaaattattgtttttgttaaattacaagactaatgaaaaaaggaagacaaaatctatatatagatatacaaagacataatttataaactgtatacttacttaatttctaaatttatatagatacaaaaaaataatcaaatttcctttgtataaacatactaaataatatacctaaatatacaaaatataaaaaatataaaaaataacaaataattataagactgtgaattatatattacgaaagtaattagtttcaacactaaaataaaaaatagatccgcggtataccgcgggttaaaatctagtaacaatagaaaaaaatgcctaattccattagaaaatttccataagcgatactaaaaagaaaataagctatattcttatctatctatatgaaaaaggtaatattctcgttcgttatgactttacctcttcctaatgacataagaattgatgttcaattgattcatgacacattgacctttttatactgatttgtttaaactaaagtataaagttaaatcttaagtctatatcctttaagaaccaacaaacaataaggttaattactgttcaaaagtcaaaacaaaggttgattagtaaagtacaattaacttatgaggaaacggtcgggatttaaaaagattcaggggtagtttcgggatttaaccaatacggggtagtttcgggatttgaagaccaatatcggtggaagcttctgggtcgaaaggcgggtttaaggtggtttggcttttcttataagccagagttaacataaaacctgaagtaaagccatctaaggaagtcacagagattctgatttataaaattgaccaaaacaagtcacagaggagaccccggaaaccaaacagtcgacgattacgaagatg

SEQ ID NO: 33261 - DNA, 3000 bp, Unknown; identical to SEQ ID NO: 2387
  misc_feature (1)..( 3000): 2750-1469P.txt file - cDNA_ID_3067445; gDNA_ID_1620529; Annot_ID_159657

SEQ ID NO: 33262 - DNA, 3003 bp, Unknown
  misc_feature (1)..( 3003): 2750-1469P.txt file - cDNA_ID_3067475; gDNA_ID_1620530; Annot_ID_159711
tgggtttttgttaaagttcaagaaagttcttttttctttttttttcctcctttaatggacgaagtttctcctgcagtcgctgttccattcagaccattcactgaccctcacgccggacttagaggctattgcaacggtgaatctagggttactttaccggaaagttcttgttctggcgacggagctatgaaagattcttcctttgagatcaatacaagacaagattcattgacatcatcatcatctgctatggcaggtgtggatatctccgccggagatgaaatcaacggttcagatgagtttgatccgagatcgatgaatcagagtgagaagaaagtacttagtagaacagagagtagaagtctgtttgagttcaagtgtgttcctttatatggagtgacttcgatttgtggtagacgaccagagatggaagattctgtctcaacgattcctagattccttcaagtttcttctagttcgttgcttgatggtcgagtcactaatggatttaatcctcacttgagtgctcatttctttggtgtttacgatggccatggcggttctcaggtaatgaatcgatttggtttcgatatgatatgatcggaaactgcaaaaacttggtttttgacatttgtttttgtgtgtttaggtagcgaattattgtcgtgagaggatgcatctggctttgacggaggagatagtgaaggagaaaccggagttttgtgacggtgacacgtggcaagagaagtggaagaaggctttgttcaactcttttatgagagttgactcggagattgaaactgtggctcatgctccggaaactgttgggtctacctcggtggttgcggttgtctttccgactcacatctttgtcgcgaattgcggcgactctagggcggttttgtgtcgcggcaaaacgccactcgcgttgtcggttgatcacaaagtaagtatagatgtttctatgaatgaattagtacaatcatatattcattaggacttgcggttttttgttatggtgttaccaatcatagcatgtttctatagattagttaatgtacttatagcgtttgggtctacatttatgtgtagccggatagggatgatgaagcggcgaggatagaagctgccggtgggaaagtaatccggtggaacggggctcgtgtatttggtgttctcgcaatgtcaagatccattggtaattatttaactttctcttgataatgatccatgaatttggttcttttagttgtttccttacattacaacccgtcgcgaacaggcgatagataccttaaaccgtcagtaattccggatccagaagtgacttcagtgcggcgagtaaaagaagatgattgtctcatcttagcaagtgatggtctttgggatgtaatgacaaacgaagaagtgtgcgatttggctcggaaacggattttactatggcataagaagaacgcgatggccggagaggctttgcttccggcggagaaaagaggagaaggaaaagatcctgcagcaatgtccgcggcagagtatttgtcgaagatggctttgcaaaaaggaagcaaagacaatataagtgtggtagtggttgatttgaagggaataaggaaattcaagagcaaatccttgaattgaaaaagaaggtttggaagaaaagtgaaaaaaaaagttttgatggtgggtaaaaattctctttagtgaaaaaagaaagataaaacaacaggtaataattacattgtaatattaatttcctgcttaaatttgttatttactttcttagtcttcccaccattatttaatctttttatatttattttactaacatgatatatataatgtacatgggaatagtgtaacttccaaacaaaaagcccccttgtatttttttttatcttggggttagttgtaataacactacattcgtctacgtaaatatttagtgttattatttgatgtttcataacttctctttgtgtgtgtgttttcgttagagtgatatagtttcaatagtattgacatcattttttcattaccaaaaattacattagtcttcatcaccataattttttcattttgtttaaatctactaaaccaaccagaatatgggatggttgaataaacgtcacaataatttgtaaatccatgtgaatgtttagattgtaggtgattgaagacaaaataatacatacttatatcacaagttaattgtaaagtggtgtgtaaggcagcttttatccccaagaaaaatcatctttttatcacatcaacattattcaacaattacacaaaaaggtaaatatcatatttaaatgtgaaagaatataaataaaattagtcttgtgaaaaatttaatctcttcgaataacattgttttattattcttatttcataaaaaaggaaagaagtaagcgttggttagtaaaagagtgttttttactttctcaagagtttcaatttcttcttcttcagctttatacgcatttaaagcgccgacgaagttgaacactgaagaagaaaaagaggagacgacacgatttttgtctgaattatcagattcagatttcgtttaatcgccagattcatttcgaaaaatcttgcactagattctcttatcttcggtgagctctctctgcgatctttgtttttttttccgagcaatttccggtatttaatgaaacgatggatcgacgaattgatttatttgtaaagctaatcctgtagacaactgagctcaaaacattcaatttttgttaaagagacgagtcgtatctcgagtttgaagttttcgcggttgctgattgatttgatggggatttgaaatttatagtgtgagttttggttagttgctgctagggttttcgaatcacactttgtattgttggtcttgtgttgattgaaatgtatctctagtctttgattactgcttgtgaaattctgatgtttttattatgattgcagggaaattgaagatctgggtcataagcaatagcttaaagcatg

SEQ ID NO: 33263 - DNA, 3000 bp, Unknown; identical to SEQ ID NO: 2403
  misc_feature (1)..( 3000): 2750-1469P.txt file - cDNA_ID_3067492; gDNA_ID_1620530; Annot_ID_159697

SEQ ID NO: 33264 - DNA, 3003 bp, Unknown
  misc_feature (1)..( 3003): 2750-1469P.txt file - cDNA_ID_3067502; gDNA_ID_1620530; Annot_ID_159692
tagctttaaatattgatgctctgtttcatctacatgaagtataacttttatctcaaaaaccaaattaagatcagtttttgccgtggctgaagctcgacaagaactcgagaatcttggaagatatgttccctgagtttctggttacagccgtgtcaacagtaacattgctcttatttacagcttctgttggatcattgttgcctcgttcaactttagcggattcgaattctgcagcgagtttcatggctgagagtagagaactttgaatgtgtgagctaggcgtagtcttgagatttttactacttgctggtttttgaggctctcgattcagagttttttgttcttctgatgcaaatgataagaaacttattccttttggaggccccagagggagaaagcttccctgttgtgactgcttcaatgtctgactatcagagttgtctgtgtttggcttggacgcagaagacgctttcaccgtatcctcttgtgaggttttgtctaaagagagaaaactcataccctttggagcaacggatggttttctcaaaggaggaacctgtggaggcgttacatgttcattgatctttgaagatgatgcatcagatgagtttcgttggttagaatgacttgagggcttcaaaaacgcaacagagcttgaaactcttgcttggatcgccggtaatttggctatggcatctctcacggattgtttttttgttttctgaggcgagaaagacgctgcagtgatcttagtagacgagactgttacatttgcactcggcgtgtctgaagcagattgtggagtaccctgttaagtgaagattagtatagtaggatcaaaagatcaataagttattagactctggaagaagaatcatgagaagatcgagagattggtttttaccttatgcgaaaacaaacaactatcacccctgtagcagaaacctttagtaatgaaattattgcaagggtatttggagagatcatggtcgaaaggacaatcatctcctttcatacatgactgggttgcaaagtagcagcaaggctgaaacaacaagaagacacgagtattagagaccaaggagatgacccagctatttaaacttgagaaaataagttatctcttgaaacagtaatcttaccgaacatttggtttccggtattgtatcatgtgaaaatttgcatttatctccctacaaaagaagaaaaacaagtgcatcagcaaacaaaacttttaaatccaaagaaatatttataatccaaagccgttgtgtagacctcatggcaccgccccttgagatagtgtcgacaatacttgataggctttggttttggagctactggtttcagtttcagctttttcacgccaagggctatacgctcttgagctctttttatcctagcttttgcctgcatgaaatagcttatcagtaagtaaacatcttactccacacacaaaatgattgtaagatatccccgtaatatgtcaaagaaatgcatacactacattaccctctttctggcttttgcatccttagaaggcgcagacctttttttgatggaggttccaggatccatctgcaagttaaaatacaagtcagattttattaacacctaagcaacataacataacaagattctttaatattggatacctttgcttcgttactgaaagtttgatcaatcttcttggcttgattatctacattcattacctcaacaccaaaactcttatgactagtgagatggctattaccagttccatcttgtgagacctgatactcctcatgtctttcgactgtttcatcatcttctacaagcatatcatcattatcatcccctgatatctctccttcttctacatcatcacctccaactatccgagacacagaatctaccaaaaccggactattatcaacaggtttctctaattccatctctctttgaactgttccattacaagcttccaaaactccagaacttataacctcattagattcaacagatttaggaacctcctctgcctttttctcactttcaactggatctacttgaacttgagttgcaatattaggcttctccaggacattttggacaatgtcatagtcattcacatccaatgcctcaaagagattcacacaactttctggaacagaatcttgagtttcattaatcataagctcaaagctatcgaaaaaatctgtgtgtctactaacaacagatgcatcttgcaagtcaattccatcacaaatatctccaagcatcaaactcttttcctgtgaaattgtttccaccttctcaccacttgaatcaccagacactccattgagttttgattccgtaattgataaattctccggcggttcgcaagtttctcccggagactcttgagcaatttctatgtaagaaaacacaaatagcatcagaaatagtttcaggcaatttcaagcaacagatgaactttgaattttgattactagaagatgaattaatcattcctaagaactttgacttcgaatcgaacactgacctgttcgtaagaccagctcctggagaactgccggtgtggcaagagaaatttgaggctcccgatcgaaactcgagcaaaagtgataaagcaaagagcgataatttcgattcggcagatgcgtgcgtcggtgaggaaacggagcgacggaagattccattgtctccgccggagaataatctcaaccagtaccgataggctcaacttcggcttgtctttcgccggagaaaggccgtcttgtggcggtggacgatttaaaaatctttattgggcttgtatcatctttgatgttaatgggcttcctgattttgtaggcccaatgaatccttcaacaaacggcgtcgtaataaggatccaaaccctaaaagatttatggattcagagttttcgaaattggaatttctcactctctctatctctcttagccagctctgatcatttcgatttttttccggtgaaaagggaggagaaacatg

SEQ ID NO: 33265 - DNA, 3000 bp, Unknown; identical to SEQ ID NO: 2395
  misc_feature (1)..( 3000): 2750-1469P.txt file - cDNA_ID_3067513; gDNA_ID_1620530; Annot_ID_159687

SEQ ID NO: 33266 - DNA, 3003 bp, Unknown
  misc_feature (1)..( 3003): 2750-1469P.txt file - cDNA_ID_3067544; gDNA_ID_1620531; Annot_ID_159736
atgaaactcagatgagtcaccaactaagttgagaacttgagatggattcaatagtcaatgatgctaggtgaaataacgtaatcaaccaaaaatattattcaatttttaattcgcattcgcaaacacgaggcacataaaataatattatcagtctcaataaaatcttgattcttgatcttgagcatcccaaagcattattaactaagcatgtatctcccactaaggcacaaattactaaccatataagtctcagtactctctgttctgcaaacttcatacacaaaaccaacattaagagatggcgagccactacagaaacacaagcgctattgcttatctattgctttgtctcttcattacatctgccactgcacattccttcatacgacaaatcactgatgacctcaaaacaaatctgcagcgtatgccaattttctatgttcttttagttgttataaatggaaaacagatcctttgtttttatttctcaaatgctctgtttttgtctggaaacagaggaggtaggagcagaaccaatccaaaacctggacgtaggacattacttacaagaaaataaggagatctcatcacgtgattataaagtatcagcttcaaacgcagtgaaaggtttgagagatcgtcctccatcgtcttactctctcaagatggagtctttcaacacgctccttaagtcaacttacacggagaaatatgtatctcgtcccttttcagttggtggatacaactggtatgttggtcatctgatctttatttgcttgaatctataatcttacataccaaatatattttgatgaatctcaatatatacaggacacttgttgtgttcccaaatggtaacaagaaggatagtggttcagggtacctttctctttacgtagccatagacaactcaactctcggacagcaagagatttacgcagatctaaggttttacatctttaacaagaatgagaggaagtacttcactatccaaggttcttataattttcaatcaagaaatgtagtgttttagcaagaaagatactttgtgcatgatagtaatatgtatctatatatcgactggtctttgttatataatctgtagataccgatgtgtggaagtttagtgtcttcaaaacgatgtggggattctctcaggtcctccccattgatacattcaaagatccgacaaaaggatatctctacgatggagatcactgcgagtttggtgttgatgtaaccatgccttctctctacgaaaaatcggaacttttctctgtcacagagaattttctaaatccgagattcacctggaccattcggggattctctacgctgctaaaaaacagttacctatcagaagtgttctccatcggaggaagaagttggtgagtcaacattatttcaaaataaaaactctggtggagtagtaaaatggtggtaagtagtaacaagtattttatatgttgattaggaatatacaaatcaatccaagtggtcttggtacgggagagggaaaagctttgtcgatgtatcttggccttaatgtgaatgagatattcagaccatatgagaagatttatgttcgagccaagcttcgagctcttaaccaactcaatctcagtaacatcgaaagggaacgtaagtaaatgatatgtgttcattgatgggtatacataacatctcatcgcaatgactaatgagatttacttcttttttttgggcagtcgatatttggtacaatggtccgggatatggagaatatagctggggtttccctgagtttatctatttcccttatctcacagattcatcaaagggtttcgttaagaacgatgtgttgatggttcaagttgaaatggaggccatttcttcaaccaagtacttcccgagttagattttctctaagcaaagaacttgtacctacctccatgtgtttgatttgttatcaaatactaataagaatttgattatgcatttcaaatacaattgtttctttttcttcagcatatcattatcaaattatcatatatcttcttgaaagatcaaatagtcttcacccaaaaaaaaatccgccaatccaacattcggctcagttttgtttgttttgatacctaagaattaaagaattaatggataatttatgatggaggttagagtctactgctaaattactatcactaatgtattgccataaacaataaaataatataattgctaatcttaaatctcaacttgactataaagataaagactaaatcgatcaaaaaccaatacactagatgaagcctggcttttggtgggggattttaatgaaattcaatgtgaaaatttaataagaacttttgtgaaaagaaaattggaaaatataagtaaaagaaaaaggttaaataaaactatctaacatcataaaaagttaaagaatagagcaattggatctagtgtattggtttttgatcgatttagtctttatctttataatcaagtggagatttaagattagcaattataatattgtttattgtttatggcaatacattaatgatagtactttagcagtagactccaacctccatagaaaaaaatccattgattcttttattcataggtatcaaaacttacaatgcatttgaacctattttataatttaattcaaactactgtattcagttccaatcatatgtttttgaatgtttttttaagaaaattgaagttcatataggatttataaaaatttattcatctgatgtagaattattttatggtcaagttaatgaaaacttcaagtgagggcactcccaaacttgagatggattcaaaagtcaacgatgctaaatgaaaccatcgaatcatgttttgtttttgaaacaacattattacgtaagaatctaactaatattcgaagactccatcctaaagcatttctctatctctttaatatataagttccactaacctctcttctcttcacttcattcacataagtcataaccttgaaagatg

SEQ ID NO: 33267 - DNA, 3000 bp, Unknown; identical to SEQ ID NO: 2417
  misc_feature (1)..( 3000): 2750-1469P.txt file - cDNA_ID_3067546; gDNA_ID_1620531; Annot_ID_159730

SEQ ID NO: 33268 - DNA, 3000 bp, Unknown; identical to SEQ ID NO: 2408
  misc_feature (1)..( 3000): 2750-1469P.txt file - cDNA_ID_3067553; gDNA_ID_1620531; Annot_ID_159727

SEQ ID NO: 33269 - DNA, 3003 bp, Unknown
  misc_feature (1)..( 3003): 2750-1469P.txt file - cDNA_ID_3067557; gDNA_ID_1620531; Annot_ID_159725
ggaacaacacacacaatttcttctttgatttgtctgcaaaagaaaaatccccaaaccggatcttaaagatcgtataaaaagggaacagttgatgctacagtatttgaaatcattgtgtgttcatcactttattatatcaacaagggaaaagaattggagatgggtgtctttgaagcttcccagctgaaaagttgagctttttcatcttttcttcacaccatagaagttgctctttactgattttcgacatcctcaaaacccgtgttgcgagtttgatgtcaatggctgcaaacaagagttgaacaccttcccatgtttgaggccatgatttctttctcagcccttttgtcttctttgaaagctcctttgctttcacccttttctgcaaaagttcctctcttatgagacaccaaagaagcatacgatagtaataacatttgagtacagagaaatcgtaccttatcaatggatgactgaaccagtagtaaaggagttgtagaattcacatggttgttgttgtggttcccaaacaagtgaatacccccatttggtttcttcttatccattttcaagaagacgttgaaagtaaggatcgagctctctatgactttgatgagatcatcagcgaggaccatgaagcctgtatctttctccatctcctttttatctgaccctgatatgttttgaacataaccaacttcaagtgttactactacacataaggttttaagtcgcgcaatgtatgagagctgagaaatcaccttgaatcttaggagcttgaagtagcttaggcattgcatttctagcacgagcataaagttccgatcttgagccttgctcaaacggttcattctctatatacctctgcaacaagactaggaattgctgaaacagttgggcagtatggttgtagcaagtcggggtttcgggttggcatgagattaagtggctcagctgcgtgtattgacagtgaagtgcctcccaagtgaggcagagttgagcaacataggccgtctctagatcttgataagggtcgtcaacttctgtcggctgcaaatgctcgatatcttcctccggaacatcaaactttttgagagaaagacatcggaaaggcgatgacagcttcttagatgcagatcttggcgatggagttgaaggacttggagcaattccaatgcctaagagattgaaaagtaaccaacaaatccatgatcagtccaatctatcacaatgaaaaacagttcaaagcaagaagcttttaccagtttccttgagctgctgagagcttaaacgatcaaagaagagcatacgctcgcaatacttttcatagacagcatcaaaacctccccaccattgaagtccttcagcaaccacatctctccactcacttgaacacttgtcttctccgtcatcatcatcttcatctagatacgattcctcttcttcttcttcttcttcctcaggtatcaacaccatgaaactgtttctcctcaactccttgagccttctcttaacctcattggtaatgaaatcatcatcgtcatcttcgatctcatctcctttccccgaatctatcacaccagcttcagtgttctcactccttgcctgttcttgctgagccaatatcttgtcttctttctccttttcaaggtttggcttccgagactttcgaaattttctaactttcaagaaatccattgcctcctcaaacacacttaggagagtgagtgttttttgttaaatcataagatctaaactgagactagtctctttgcatgagtaaaagcgtttctcttctgccacaacgaacttaatcaaagaatcaaccaaaccagagaatgaggaaaatgcatgaatctagtaagatctcagagaatcatgagcaaaccctagagaattaggaacaccgacagaagattaagaatgcataagtagatcagtagcaacaacagcatttgtctgaaactttagattcgattcactaatctctagctgataagaacactagcattccctgataaatcaacactccactgaaactactactacactgagcaaagagtgtgagaaaaaaaacaaaaagaaagaaaaagattcaaaatttaagaaagaaagagaaacccaaataaaagcaaaacaaaatcgaaagacaaagacaggaggaggaggagattaaagaaggagaaatgtttctaaccacttgcaagagagagagagagaaagcaaagtataataatgtctcaattcaagttttttcagtaaatggacagagagagcacaatataaatgtgagagaggaaaggagagcaagtattattgattcttaaacagatgtcattaaattcaataattaaactttgtgatttcaaattccaaaaaaaaactagaaattttcttcctttcttaaaaccctttcctcaaaaatttccatttgcagtcaaaaccctcacaaagaggtttctgagtcaatttgactttttgtttatttcctaatgggtcgaaattgtcttttactgtttggtttcttactttactttttctgatacttcattttctattggttaatttttggttttgttttggtgtttgattagagaaggagagagatgtatgaatgaatgaaaaggagaagaagcagtaacaagtaacaactggtaggtaggtcagtggggggagagatagaaagaaaagcatcgtacagagaatattgtcagaaaagccgcgctatctgttctccttccatttgctcacttctctcttttaaaattacatctttaccctcctccgtctcatacatctacgggtcttatctttgtttctgatgacaatttgggcttctcttaaaatgggctttttctttaccaaatttatgtatactgctatgaaacgacgtcgtcttttactttggttatattggtatggtttttgaatttactttggttacgattccggtctagtggattggatgaaaccgaattggagagcttgaggttatgatccatg

SEQ ID NO: 33270 - DNA, 3000 bp, Unknown
  misc_feature (1)..( 3000): 2750-1469P.txt file - cDNA_ID_3067612; gDNA_ID_1620532; Annot_ID_159777
tgaagcatgtacctgacatgcggaagaatctcatctctggaaagggttttgttaaaggtggactagtcaaaatgtctgtaatgacagtctttccaaaaaatgtagcttctgcttctgttgtggaaatgaatgaaaatcctattacttacttggttgaatcgtttactacttggcatgaacgtttaggacatgtgaattataaaataatgcgaaaaatgcaaaacatgaatttaattccgaaattcaaaactaaccaagaaaaatgtgaagtatgtgtacatgcaaaactcactaaaactccctcaccacgagttgaaagaacaactgaacctatgaatttaattccgaaattcaaaactaaccaagaaaaatgtgaactatgtgtacaggcaaaactcactaaaactccctcaccacgagttgaaagaacaactgaacctctaggtttaatttacacagacttatgtgatttgaaatatgtgcaaactagaggtggtaagaaattttttgttaccttcatagatgattgcacaagatattattatgtatatctattacatagcaaggatgaagctctggtaaaattcaaagaatttacactcgaagtagaaaatcaacttcagagaactataaaaatagttcgaagtgatagaggatgagaatataatgagccattcaatgcattttgcggaacgaaagaatcgaactctaaaagaaatgatgaatgcactgttgcaggaatctgggttagccaatgataactgtgtattttgcatattttgagcatccatttgtcatcactttagcaccatatcatcattgttttataccatttctcatcatttgtcatcactttgtatgtttaggatagttttgcatgcatgtggcatatttgtgttgttttcaagtgattcggagctgttgacgagctaattggaagaagcggacctgatcatgccaaaccactcgacctccaggtcgagtagacgcttcacgacctcaacacaccactcgaccacctggtcgagtataggacttcaccacttcacctcatcactcgaccccctggccgagtacccccacaagagtcactcgatcaattcactcgaccgccaggtcgactgtgttcacctccaccacctgaccatcacttgatcacaccactctacctggaagtcgagtatcaccatcaccaccactcaactacatactcgatgtcgagctttagagtcttctccattccgctctcaaccagacactcgagcacaaggaagaaaagaagattccagcttatcactcgacctctcactcgaccacctgggtcgagtacagtttttaatccgtcccaatactgcgtcattttgtgtattagggtttcagaatattttgctataagtagcatgtactttacattttcgagaacaagttttttctaagttttattccgtagacactgtgttcttgaccttttgtaatccgaatttctctttatctattcagtattcagtatttgttcttgattttgtttattgttgttcatcctgttttcaccttgctattacactgttgttatcatgttttcatttcattcaacgtttatgttttctacaatgatgtctgagtagtgaataggtttctgaggatgggttagagtagtttagaatctcagtatgctaggtggttgagtttgattgatagatctcttctgggttagttgttcttaatgcctatagatttctgatcaactggaatttgagcccagacatttccacgcccaaaaggtgttcgctgaaatgtctgaaccactaattccagagattcgtgaccctgtaccaaggtattggttgcagggagcgttttggctttaacttgttgattcgtaatgcctgttaggttagctctcgtcaatggtgattgagtctgagactaggttaacttgagggtctctattgcggtggcacttagatttggttaatgaacttgttgtgtagggatagtttattgagcatgtcaatcacctgtaaactgaggaaacgaaactactcaattactccatcctcggaaattctttatctgattgattttattatttactttaccgttgtttactgcatcttgtcatctgttgcttagtccctgcaattctttgctgttactcgacctgatactcgaccacccagttgtctggcaacagactctggagtcgagtatccctgttacattttatgtctgttactcgacctgtcactcgaccacaccctgtgttgagctgcatcgagctgtgttggtcgagtgttttcttgtttctacttgattttctgttttctgcatgctcacttaggactgctagaacacaccaaaatctgttattgcttggcttgatttagtgacttctgatcacaacttgattgttagcatcacacccatttggattgacacctaaaatactacaacgacatgattggtggtttaggataattgactaaaaacctattatcaatttggcgccgttgccaattgggtgtttgtgtgttacatttgagatttcaaacttgcttagatcaagttctttttcaattttcaaatcggttgctaactgtgtgtttttcttgttgtctttttgatctaggtacacctctgctgtatgcaaactcgatcaacaggcaatcagaacctccttttcaacgataacatcgaccgcatagctcgcgaactcagagaaaggagaaacatagtcaaccttttgccccaacaaccactcgatgactgacgaaaagaatcaacaaaatggccatgtcaacattggtgctggagatgcaccaagggaccatcgttagaagaaaggaattgcacctcctgctatccagaacaacaacttcaagattaagagtggtctcatctcgatgattcagggaaacaaattctctggtttgccaatggaggatccactcgaccaccttgatgaattcgataggctctacaacctaacaaaaatcaatg

SEQ ID NO: 33271 - DNA, 3000 bp, Unknown; identical to SEQ ID NO: 2420
  misc_feature (1)..( 3000): 2750-1469P.txt file - cDNA_ID_3067650; gDNA_ID_1620533; Annot_ID_159787

SEQ ID NO: 33272 - DNA, 3003 bp, Unknown
  misc_feature (1)..( 3003): 2750-1469P.txt file - cDNA_ID_3067684; gDNA_ID_1620535; Annot_ID_159851
gtttctccgtttacttcttctgacatcatctatcgttttctctttttccaatacatcatctgcagatctcttgtccacatactccagacgaagctaaaatcagacagagaaaagttaagagttaaaagattaacagaaaattcaatcattcagctatagtgctttccattaaactaactataacaaaaaaggagaaaggaactcacaacagtctttccatttccggaatcatcatcttcgatatcactttctttcaatttacgtgcataatgtccaatattgccagtctcaacataccgtgatgcgtctttgaaggattgaaagatatactcacttttagggtcaatgaagaactgcaaaatcaaaaacaagacatgtccaagaagaatcacataagagattttctaaagtgagcttatgtggaaaagacacaaaatgtacttttgatcaaagatgatgttatcacaaagagagtagagggtacaaactggatctcttctggttttacggcctgatctatttgttatttcaagtttcttgatccatccttcaggtaaaccttgagcagcagatttctcaactataacctgtatcacttaaacataaagagtttttcattttaagagacgtataaatgtcaaatctttttagggatcacaaagaacaaagtaacattgtcttcaaacatataaacaacacaaaactctcagatattctgtgcttatgaactttccatgaacaacctaataccagacccttgccaatataaatgtgattcatctcaaaactttccctttgcatacgcgagaggtacaaagttttagtgcttacgaatattacagtattctctcgaagatggttacttaacaatccaaattcattttcacaagatctattactcttaatgtctaaccatctcagtaaagtaaccatataattccttttcacacgaagtaaactaagagacaaacttttaaaaattcaagaaaaacttaaaaaaaataaacatctccaatcatgcacacaagtaataagagctttctaagccacagtggaaccaagtaaaatcaattgagttcaaaatgtagctacataacaaagctttgatcaaactacatcatctataacaaaacaaaaagtcaggtcaagaccattttcagacacttaatcaactagacctcttctcttttgatcacatgtcatctttccctaaaagctaagcattgcatgcaagagaaaatcactcaaacgtcacaaaagacttcacctttttccatcattacaaaatcatacaatcagaaactaagagtgaatcaaagtatttggcacttcaataaagataactacaatttccacaaaaggagctaacaagaaccaaacatgcaaaagacaatcaaaattaagaaaagggtttaaaactcataaatcaccttatcctttctcccattcttcctcactctaatttccactttcctctcagccgacaaaccatcagagatcccttctccgttcatctctccggtcaccgtaaaaccactttcctctctctcttgtatccctgattcacaactcagaatggtttatcaactcaaaacgccaaaacccatcaagaattgtcggattcagataatggacaccgtcggaagttataaagaaggaacctttttattttgtctgattgtgtgatttggttctgtctccactaaggtaaataagaaaaatagtaggatttaatggggaagaagaagaaagggtttacacgtgtagtgtggaggagtttcaatggagattccccgatttgagaggttcaagaaaactcagtccaccagcacgcgagtcttctggcccaacgcttctcttctctgattgcaatttagctcattttctccattttattctcttgtactgtttgttgtttacttccattgttattgtcccaattttaaaaaaacttacactgtatattaaaaaacatttgcttgatttggttataaaatctaattgcaaatctatttatgatgatattttttgggaaacatttaagactttgttatcattttttgacccaaaagaaaaaaaaaatgttattattgtaaatgttaggattggaagatttatcatgagaagaaaagtgaaaaatactaatatagtcaattatgaattttcataaatctgaattaaatataatttatttttacttaatatatagttttaattactttttgtttaaatttatgttattaaatttggtatttgtatatcatgtttaaaagatttagaagtatgattttattctatttctagtgatttaattattgaaactttgatttttaaaaaagtttatgtattaataaattatttggattgaaggttatatcaatgttataaaatgtgttttaaaatctgaaaagtggttgattttttctttttaaattctgcatccacgaaacttatttttcttaaaacttatttttcttttcgaggttatgattctttttagttttttttatcaaatttcatgatgaaaataactgaattgaacatcaaagattttcagaaaatactctactgcttttttcttaactatattctagccatttacatatctaagcttgatgtcttttctatttcgtcgaaaatctatctattttacggcagagacttgaaacccgaattttgacatatcaaaaacactaacacaatcccatgtactacattatcatttgtattttacttatagaagaaaataactttttatttaaaaattgtatggtaaaaataaagattagttccctaataactatataaaaaatcttattcggtcgttttagctgtatttaacttttaaacccaagaaagaaaaaaatcaatcaaccaaggaagtagtacaacaacaagagtcaaaacccaacaactctctatctagcacaaaagcctgacttttacaaagacaagccttttcaacacactactgatcttgagaatcctctcttcaaagccatg

SEQ ID NO: 33273 - DNA, 3000 bp, Unknown; identical to SEQ ID NO: 2433
  misc_feature (1)..( 3000): 2750-1469P.txt file - cDNA_ID_3067701; gDNA_ID_1620535; Annot_ID_159849

SEQ ID NO: 33274 - DNA, 3003 bp, Unknown
  misc_feature (1)..( 3003): 2750-1469P.txt file - cDNA_ID_3067703; gDNA_ID_1620535; Annot_ID_159848
atgtcatatcaaacaaaaatacaatgacaaatttggaatatgatgtaagaacatagaacatggaagaacagaggtgacagtaagaaattgcattcaaaatgctataaaagacaatcacataattgatgggagtttttgtttccttcttaaatttctggaagattcaaattgataaaaaccaagattagttgagattgagagctctctgtgaaacatggagcagagtacacatttgattgaacagaaaggttttatattaactcaggggatgaagatgacgacgtccctgataccgttttggttgcatctaactctttgtttccgcctttagtgtgtcgtgagtttgttgttgtctctgatttactaccttttgcaccatcatcctcttcctcttcttcttcatagaatgaccctgaggatctcagttccttcaccttccgaaactcgtcgtaatgtgcttttctgtgtgcgttgaaacgttcatttttaccacttccagaacctgtggttttgcacacaaaaaaaatagatatatcgggatgacctaacaaaagaacctatatatgacagtagatttgtttggttttagaggaggaccttcttcatcttgatccattggatctgcttcttcttcttcttcatcagacgagctccagccaccaccaccagaaccctggctactatttctactggaagaagctgctgcatcattcagaacattcctcagttcttcagctcgttgcatatcatcaacacattcatcaaacgctcttcctctaggagacaaagaacctggcacaatcaatcacggattagaacagatcagaactgattcaagttaaccttacatctagagtgacaaatttccaaatcaaccaaccaattgcaggtacaagatttcccccaaaaagataagtaatcgtccaactttgtagatgaattaaaaagcagataattttcacatacaatttgctcttgctttctgtctgacatacattccatttttacatatatgtttagatgatgacaagtatgtatcaacaataaaatgcaaaaacgtcataagcatataaacgtgtatcgaaagttctgtgcatatactaagagaaaccaaataaagaaaaatagacaaaccatcatcatccatcatcgggtggtatggtgtctttggttcagtaatcttctgcctaacaggtttgttcgattcaatctccactatattagcttcatcccattgaacacgccccctgccataataacaaacatacttagtgacaattccatgagaaactatactagattatacaaaagatcacctctctttacaaaagaatgacgatgtctaagccttaaactaaagacaataaagttcacagaatcttacagttaaacaattctgctggaatatgaaaatccatgaacattaacacaataagacctccctcttccatttcctttttcaatgggtgtagtagaaaatatatctgttttacgattccttcataaaaagaccgccatataaggcttagaacttcatatctatgaatatacatccctccacaaaaatgacataacacagcccattgacttcacaattgatcttatttgaacacattgaaaaggtaccgttctgatgcagcaagcattctcaaatctaatagaaactaaagacacaagcgaaagtaaaaatttgaaaaggagaaacatacttcaaagaaatccatcaaaatcaatccaatctgctaactttccaaacaaaagaacacaatggtataactgaccactcaaaatcacaaacctttaaatacgaagaagcaggaatcagtatctacctctctcatgatcattgagctaaagtatcctaaaatctataaagcaaaaacctcctaaatttctcaaatttgctgagtaatggtttcaatcagaaagggtttaacctaaataaccaattgatatcaaaagcttatcactttcctcaatcattcacccataacatatcccgaaagacactgtaagaaaccctagcctatgtttggttctacaaagaccaaaactaaaatcaaagatagatctttcgtgacaatcatcaaagattcaaactaagagaaaacaatcaaaacaataaaatttatttacctctttggttcggtcatcttcaaaatctccagcaacttttttctttgtctcgatcgcaagtttttaagacctgttgtgttcttgattaaagaagatacgagggtcaactaaagatgcaacagaaaccgtccgtttgtttgacttttatcactgttgcatccagattccgccacgtggattacttcaaacccgttcgattgatcaagcgcgtgaagacttgagtaagggtagtttcggaaatacactttagaagtttttttttttttcctttttcctgagaacgatcgaatcgaagacggagtgtgcaaaagccaaagctttgatctttcattaattcttctcaagatcttcagagtctgtaagtatttttggaatcttatttttcttgtttctcaatcgatgtaaaataaaattcagttgttgatgattttaccatgtttcgggagcttgtgttgatctagttcttcgctctcactaggctaattttgatcttcctgatgtgcacaatgtgaatgggtcttaggtattagtgatttatcggctttttatttgatccattatctatccaaagatctaattttttctgttttgctgaagttgtaaattggaacccttttgtgaattgtgtggtttttttagtttggtattgcatagtggtttctctgaaactgtgaattagatctgagaatggagtcttgtgatctccaattacttgtgtgatgcttttgttatgcttactcaaattatgataaggaagcaaagttatgttgatgctgatgataataagctcttctcttatttttggttcatgtgaaagacaagggaagatcaaagtaattaaataagctgaagtaagaggaagtgatg

SEQ ID NO: 33275 - DNA, 3003 bp, Unknown
  misc_feature (1)..( 3003): 2750-1469P.txt file - cDNA_ID_3067756; gDNA_ID_1620536; Annot_ID_159869
ttttgaaataattcaatttagacgcttgtttttttgtggatcaccaaattcaatttagactataacaacttttaagatactactaatcatttaaacttcatttttttgtttttaatatatattaccagtttgtttgttgcattttgagcctttgaggtggactaatcgacgcaaattatctgtttgaaaacatttgaattaaacaatatagtaaccgtgttaattaattaccgatatagaggtaatttgtcacatatcagtaaaactaatagtatttgaacagaatagcctagttatattttggtttagtttttcataataaagctcatgtgactcatatatactttactttagattcgtcgaaatcaagtcacgtgattaactaagatctagtgcttcttctatggtatctattaccttttaagctttgtatccgctttttccatctttgatcttatattcttattaattattttataagctttcatcagatcctgatgttactctttgtaaacttataaatttcagtaattaaccctttatcaaaaataataagggtcgattatatacatgggttttagttatggaacgtaatgtatatagactatatataagtacattttaaattgataactatagtagataaataagtgttacctaatatgttaaaacatacacaaatcgttgcatttggcgtaatcttaggcttcttgtcaaaagtcgtaagactgattcctaggattccttcattgacactgatgtggttttgaagaggttgtagatttggtactgtcgtttttctttctttgtttcttaatattgttgttttttaaccactccccatctacgtatactcggtccgagatttctgtagagatacatatataagaaattggtaatccaaatgcaattattttaactagataccaaaaaaagaagtgtcttgagttttataaaaattcattaatacccaacgaaattttgtaattaaatgtggacaacaaacttatttggaatttttgtttgtatcttagaatttatggaaatactgctgttgaaggaacaaattacaattttttttttctatggaaataataattcgaaagatgtcaagtatgtctccatgctggggtgtgcggggtccatttgagattgcttgggtttcaccgcatcctaagtttattatccttgagatttgttcccgaacccttattttcataaataaaatagaaaaatacatttaaagtagactagtagagtgataagttggggcacaaaaaaaaaaaaaaactagtaaacaattgctaataaaaaagggtaaaaactatgagtaaacaattgtgaaaatatatataacaagtttttaaaaatatatttatttgatgtaccacgtatatcaatatataatccgttaaataatgatataattacaaaaaaataactcacacacttatatttaataaattatataaaaataacatattaattatttctgtccgtgatcattaaattggaaaagtgaaaacgaccaaaatgatccaaattcatttttctttgctagacattaatattttttccactcaaatatcatttgtttcattgccaactaacacaaacactcattaaactatatataaaaactactcgaataacatttttttttgtttactgaaagtcaaatttctagcaaatgcatcatatcatttacatagatgcaaatatataactttgattggtatcttattcaaaggacggtaagagaaataaatatataatgctatttcataactaatcgtatattaatacgaataacagaagaaccacactgtctctcataccaaataattacatctcatgctcatgcttaattatgttgcttccccacatcctatcatcattacaccattttctcaatctccgcccaactttttcagcaaataccccatgtctccccttaaattattcctagttttattctgttatacattcttataatctcacttttttatctgtgttcaatttttaagtgtctatctttatgatcttcatcaggctttcattagtagacataacaatcgacatatttcttttggagtggggctaaagggttcagaggcactcgatcaagataaacatgaagaactacgaatggttgaaaattacatcaaaataagtaccgtatcctaatataaattgctagctaataaaaattgtaaagaggttaatatcgttgtctcaaaatcatatgtttcataaatataccacatatacaaatctacacatataaaaagggtcattttgatacatttatattccattatctgaagtccaattgcagtaacaaactacaacaaatcggattttaacatactaaggactcgacccatgaatgtggttgattattaaaatgtcacaattattaaatatatcatcttgatctttaatcaatctcaggactcaatgaccgatatttcaaaatcccaatattgaataacgattaattaacaaaataaaaaaatcaataacgcttcatccggagaaccatgacgaccaaaaccttaatttttgggcatgttgaactttcacgtatccaaaaataggtgaacacatgtcgtcaccctcttagatataggatttagcaaaaactaatggccacgatctgttaagagtcaagcgataaaaagcaaagctcctttcgttttttcagaaattttgaacccattcaagtcggggcgttgcaggatccgatttctcgttttgttcttcgttaaaattcaccaggtgataaccaaatacccttgtttcttggtaacaatttcgattttcttgcatggaaaaatgtcaagaaaaatagattttagataaatcaacttgaatatgtaaggccattttcatttaaaatggcttgttgaatgaaaatttcatgggaaccgttacattatttgcatattacaattgtttgttaccggtcttgattcatattcatatatagattgaagaatg

SEQ ID NO: 33276 - DNA, 3003 bp, Unknown
  misc_feature (1)..( 3003): 2750-1469P.txt file - cDNA_ID_3067760; gDNA_ID_1620536; Annot_ID_159890
aagagtaggctttaaagcttccctacgagcttgctcattcacagatagaacactgcatcccaaagattctaggtaactagattcagttgcagagagaactgggtcaaacacttcaatgttatcaccaacccaatcaaactctctcttcatcaagattgcaatgctcagctgaaacctcggagattcataagactcaatgctacctataccgtacatcaccatctgcaactgtgtttcagaccctaacacgaggcgaatctgattcgaaacctcaggagacttaagctgctccaagaatgctgtgtaaaaactcgagctttcgattttcttcagagagatttccatcttctgctttagtcttgcttgtctctgtggatcaatttcaagatcatctgatttccatggttgctcttcttcttctgcttgacctttaggtttcggttttcttcttcttccttgtcttcctttactaggtaagactactttccactcaccatcactgcttgagtttttaacagtcgtttccattgaagcttccacaagaaactggttttcctgatctacttactccacagtcccccaaaattagggtttctactcaatgcaatgattccattggttccgattacctaacatcacaataaatttcgattcctaaacctaattatcaatctctttgcttaactctgatctatctactttgagattgacaaaaatcttcgataccgagcaaaattaaacttacgattagagacgaaaacacaggaggaagatcgaagaagcttgcttgaaatacagaggaagcaaagaacgcttcgaatatgtggtgaccgagtggactcagtgagacatttgtgagtttggtgcgccgagtcgcgcggcgataaagtgaatcagatgatttgtacgcgaagatttggtaaacaggtattgggctagaggaaatggaatgggtctagatacggcccaataaaggcgcgagatagagacaactgaagtcttgtttcctgttatttcttttgattttgttttactaatctaaatatactaaatcagcagtcaattttccaataactgatgcattcagtgattgacacatcagcttagtactacttttttattttttcatttttacgcatagtatgtgtcgtttttatttaactttgtttcattctcaaacgattttctctttcatccccacgatctccacatctccactttctctcttccaaaaactccatgactactgtgtaaaatctcaaagatgggtttctcaacatcattaatcgattactcagaaatcaggtactttgttcatctcaatgaaccaatttaccatcttctatttttgtttgtaattttgttttatatatatagaattctccatagatccgaaaatcatatatccttcttctagatttctatggcttttttttttttttgctttgtttctgctttatttgactgaattcgatttctctcatacatctccatttttccataggattattctttaatacaatcaatgcctatgattctcccgtctcacaaacactcaaagaacaacgacaaattttggcttctcatctgaacagttgccttaaaacaagggtgagtttaatatcttaatcgaagctcaagtgtttttttaatggtaaattaattctcatactttttactattcttctttcatctcttattttacttctttatatttgcaatttcttttttgtattaaaccgcaattgtattttcacgcaagatttttgtattaatacaaatacttcaattttaaagtcatctcttattttacttctttatatctgcaatatctttgatattgtttcaaaggcagcgtctgcgttatgtagttacttacttgtgcacattttacatttttttttagacttccaagctttgggtgtcaacgaatgtttgtaaactgaattactgatgatgagaagaagaacacattacaattggttggagctaatgatgaaataagcggacatgtatatacccagcataattttcgtacttatactctcttatatttctaaactcttgatttgttagttactgtctatcgcaattgattcattgggtagaaaagttgtaccttctttatatctttttcttaatctttgtatattcttcagtcaatgataataaatttgttgtatatttatgctgtctgctttattttaaaaatcttagttaagagttgtagcagatataatttaaaacaatgttgtccctgcatagtaggggccaaatgctagtagtagtttaaaagtaaagtacgtaaaataaaataacgtgtatttttcattataggaaatgtagtttaggccgttattgttctttttcattataaaataacgtgtattttatgtgttgctgtttaaccctaaactcagacagcgaatgttgagttccgatgcagtggtgtatggtttgcggatacagtaaaacttttataaattaataatattagaattgcgaaattttgttaatttaaacaaatattaatttatagagaaattttttaaatttaataattgttttaaaaattgaactcttttcgtagcccaaacccaccggtattgaactctttttggcccacttagccacgttaaagggtcacttgttactagttgtaattgcaactatctgcctaaaccgtcgtgccttttgtctacattctagaaccatgcactaatgacgtggctggagataagttggttgattacacacgtgtcacttagacagagcgagtagactttgatgcgggtaaaagatattttagattatctagctcgctaggccacgttggcggatatttgcactttttctttttttaaaaagaaaaaaaactaggctctacgaattttccggtcaccttctccgatctctgatccgatatttttccacatgttgttgagctttaaaggatttgaaaccgttatgaaagttatgaaaacgaagagtgtgtgaaacatg

SEQ ID NO: 33277 - DNA, 3000 bp, Unknown
  misc_feature (1)..( 3000): 2750-1469P.txt file - cDNA_ID_3067765; gDNA_ID_1620536; Annot_ID_159887
actgttcagatgagaagccaaaatttgtcgttgttctttgagtgtttgtgagacgggagaatcataggcattgattgtattaaagaataatcctatggaaaaatggagatgtatgagagaaatcgaattcagtcaaataaagcagaaacaaagcaaaaaaaaaaaaaagccatagaaatctagaagaaggatatatgattttcggatctatggagaattctatatatataaaacaaaattacaaacaaaaatagaagatggtaaattggttcattgagatgaacaaagtacctgatttctgagtaatcgattaatgatgttgagaaacccatctttgagattttacacagtagtcatggagtttttggaagagagaaagtggagatgtggagatcgtggggatgaaagagaaaatcgtttgagaatgaaacaaagttaaataaaaacgacacatactatgcgtaaaaatgaaaaaataaaaaagtagtactaagctgatgtgtcaatcactgaatgcatcagttattggaaaattgactgctgatttagtatatttagattagtaaaacaaaatcaaaagaaataacaggaaacaagacttcagttgtctctatctcgcgcctttattgggccgtatctagacccattccatttcctctagcccaatacctgtttaccaaatcttcgcgtacaaatcatctgattcactttatcgccgcgcgactcggcgcaccaaactcacaaatgtctcactgagtccactcggtcaccacatattcgaagcgttctttgcttcctctgtatttcaagcaagcttcttcgatcttcctcctgtgttttcgtctctaatcgtaagtttaattttgctcggtatcgaagatttttgtcaatctcaaagtagatagatcagagttaagcaaagagattgataattaggtttaggaatcgaaatttattgtgatgttaggtaatcggaaccaatggaatcattgcattgagtagaaaccctaattttgggggactgtggagtaagtagatcaggaaaaccagtttcttgtggaagcttcaatggaaacgactgttaaaaactcaagcagtgatggtgagtggaaagtagtcttacctagtaaaggaagacaaggaagaagaagaaaaccgaaacctaaaggtcaagcagaagaagaagagcaaccatggaaatcagatgatcttgaaattgatccacagagacaagcaagactaaagcagaagatggaaatctctctgaagaaaatcgaaagctcgagtttttacacagcattcttggagcagcttaagtctcctgaggtttcgaatcagattcgcctcgtgttagggtctgaaacacagttgcagatggtgatgtacggtataggtagcattgagtcttatgaatctccgaggtttcagctgagcattgcaatcttgatgaagagagagtttgattgggttggtgataacattgaagtgtttgacccagttctctctgcaactgaatctagttacctagaatctttgggatgcagtgttctatctgtgaatgagcaagctcgtagggaagctttaaagcctactcttttcttcatgccacactgtgaggccaatctatacagcaacctattgcaagcaaattggagaatggatcgactgtcgaaaatcgcattgtttgggaacagctttcagatgtatgaggagcaagtttcatttgacgcagaagtcatctgtgctaccaaacgaatcatagctgcacaaagagtcacaagcgagtttgctattgagacggaatcagatgattattttgcagcattccatgattcaagctggcattttttcagttctggtatagattcggagctgccattgttcgtttcagactaattttagatcattgttttcaaaagctttttgattttcacttgtgcaacattttgtttatctgtctttttcctccttgcataatcttagccttcaaggcgggcaaaacaattgaagttattgacttatcaatgcagtcaataaaatttaatgcttgtctgatcataataaagatgcaaaccgtggtttatttctatgtcaatcaattgtatttgtgtttctagtctttaagatggtaatcagttgccatcattacgatttgtctatctattttcattggttgcaacttgcaaacaaaaagagaagaaaaatagttgaggaacttttcttttcgtttgtttttaacttttgataatatggtcaatttattaagaaagcattacatcccttatattgagttataaatttagttgttaatacacaaaggtactattcaccaaaaaaacaaatacacaaagatactagttggtttatgtaatgtatttttatcaaattcacctataatttatgtagccatcggttgacaaataaacatattgagccatcaacgtgtaacaattctaattttctaaatactccatcctccacctcattggtcgacattataaaatacagtagtatatcacaaattgtttaatgaaattcattttaaaaaaagaagaaaaaatagttaaaaagtgatataattattttgcagttagcacacttttgtttctggcatgattcacaggtcgaaacgatgtcgtttagtgtctttcccagaaaaaacggagatcaaataggtcccaaatggatcccacaaacagcagacacggcgcttcttttgaattttctactcggcgttttacactttccacgtttggtcaaaacgctccttctctatacgtaacgaccgtttataactccgctatcatctacccagtcaaacactcaccacgtgtctatttaccgtctaatccgacaccgttaattccgctcctaagaatcgccttaaaaaccacgttttcattttctcatcttcaaacctctctgtcattactctggtcagcgattcttctttcttcttcttctcagatcctttcaccgagtaagaagattttaaagatg

SEQ ID NO: 33278 - DNA, 3000 bp, Unknown; identical to SEQ ID NO: 2436
  misc_feature (1)..( 3000): 2750-1469P.txt file - cDNA_ID_3067768; gDNA_ID_1620536; Annot_ID_159885

SEQ ID NO: 33279 - DNA, 3003 bp, Unknown
  misc_feature (1)..( 3003): 2750-1469P.txt file - cDNA_ID_3067783; gDNA_ID_1620536; Annot_ID_159874
gagttctctcatgtctattgacaaactgattgaagatcatcgtgtaaaggaggaattcccggaggaagaaaaacctctaatgccagtagctttatccccttatcggggatctttgagtccctgcggattcagttctgtgataaatggcaaagtagagaatgaggtagatggttttagttactctggtggtagtgatgcttgtcaagtcgggaacttcagtcaagatgtaaaaccggatatcgatggtgatgcagtagttctggatgcgagacctaatgttgtagttagtttaggtagtagtagtagaaccgaagtgccatcaattgggaactgtgtttcccatggcgttcgggatgatgtaaatttgtttagtagagatgatgatgaaaacttttccaagtacattcacccgcgtgttacaaaacattcacctaggactgtacctcgtattggggacagaagaatcaggaagatattggcttctagacattggaaaggaggttcaaggcattcaggtagtagcctgcctaaggggttcttatctgtttcatatcttaaatacatttgatgggttttgttttaatgacatgtatttggtgttgcagatacgaaaccgtggagaaattattacttgcaccagcagaggagctatcctatcaagaaaaggaaaaactttgaccacatatctgattccgttactgatgattaccgtatgcgtactaagatgcatagaggtaaagagactttttacgcctaaacctctgttagatcttgtagctagctttctctttgttgttttaactagatcttgtaaatttaatttgcaggtagtagaaaaggtcaaggggcatcctttgtggcaagcgactcccatggtaacaatggagtctcatctgaattctttgtcggtgttatttacttacaaaagcggagaagctaacatgagaatgtttatttcagtgaaactacggatcaagtcgttcagggtgcctgagcttttcatagagattccagaaactgctactgttggctcattgaaggtaacattacacagctcttcctttcgcctcctattaagaaagtaagttcttatggtcctttggcttctgcagagaatggtgatggaagcagtgagcactttactgagtgatggacaccgagttggtctgatggttcaggggaagaaagtccgtgacgataacaaaacccttcatcagactggtatctctcaggataactcccacctggactctcttgattttagccttgaacccagctcagaaatgcctcaactgttaactaggttcagacttctattcaccacttaaaacccgccactgtgtttaattattcaaatcttttgtggcttaatttcttatttgttttccagtcacccgttgggacatgcttgtgaggagctgctacctgtgtgccaagctactaaaatagacaatgtgttggaatctgaccatcatgactcagcattattcccatctgactcattaggcaacaataatgtgacagaagattctaaagctatgatttctgtggcgctcaacgaattgtcttctcaatcacaaccaccttcccggaaatctagaagaagtgaacagcagcagcagcaggctgcacaacgcagaattcgtcgacctttctcagttgctgaagtagaagcacttgttcaagcagttgagaaactcggtactggaaggtaaaaaaacactaatacaagtcatatagtgttggcttatttgtgattgtgaatagaagaagatgatgattaaagtttggtgaaaactgtaggtggagagatgttaagctttgtgctttcgaggatgctgaccaccgcacttacgtagatctcaaggtttgcattttaatcagtagtttaaattctaaattcggtgaaaccaaatcgcatgattaggtctgagaaataactgtttggtatttgtgcaggataaatggaaaacgctggtccacacggctaagatatctccacaacagaggagaggagagccagtgccgcaggaacttctaaaccgagtcttgaacgcccatggctactggacgcagcaacagatgcagcagctgcagcagaatgtgaacaagctggagcaggagacacagtctcaaacgacagagggtctgttacttctctaaatgaatctgctgcagccttggaggtcgtctctcctttgtgtattactactactattgatgattatgtaagattctgacatagatgcaaagatttggtcttttactttggtttgatttttttaacttttctcaatgtaaagtttttaactggaataaggtttctctgaccagtttagggcttttagaggatctgttgtacatcttttgtgacattctcattctctttacatatttcttatctagactttttaaaaattcctcgtgtgtataattatttgatgtgctacttgtctgattccacgagttcgagttttgtcgtgtgattgaattcgaattgtcacttaccaacgtcgttaatacactaacactatgattggtctgatcgctggatcggtgaaccaattggaaaatccagttcaagttgttttagcaaaaaccaatctcttctctgaaccggaaaactgtaaaccggtcagtacttgatccataagaaaccctccgagtgatttgaagggtttgagctgtgttgaaaatggttcgtcggctctctctaaacccctctttttgtcgactgcttcttcacgccgtcgaggaattcttctccaccaacgaatccggcgacgtcttatcaccaccttgtcgaatctttagttgatgttgtttaaaggtgagtccaaattccacgcgccgccttgactttcatgaatgtgtgttttgatacatttcctacatattccgatgttttctagctagatctccaacgattttctgattgaatttagggttggttacatgatgatctttgactctaactcgcaggttttagctaataagggcatg

SEQ ID NO: 33280 - DNA, 3003 bp, Unknown
  misc_feature (1)..( 3003): 2750-1469P.txt file - cDNA_ID_3067787; gDNA_ID_1620536; Annot_ID_159872
ggtagttcggcatgtgttttacccacgatatatggcgtcggcctggtttatggaggagatccgtttgactcagggcttgtctatagcagtcagttgtcatcttctgtgcctattttgtcaaagtttaatggcatcctcctctccgtgctagggcctgcttttggatatccgattgcatcttctgcaggtaccttaatgcaaacacgattttacctataatctggtaatagctagcatttgcttctactgagataataatgctgtttgcagtaagagtacttaaagggttatggagaaatgacttaacggctctaaaaggagactgcccgaattgcggggaagaggtgatttctttacttgtagttcttttgcagcaacaaacaaaattgttgttgttttcagttctcgtcacatttgagtttgatgaacttgtgtaggttttcgcatttgtgagatccgatcaatcgaaccgatcagctcacaaagccgactgtcatgtctgtgagtgcaccttggagttccgtaccaaagtagaggtagatgttagtgtttttttcccgtgtgttgcttcatcgtgaccttgtttatttgaacaatctctgtggtttaaatgtgaaccagtcactgccttagattaatccttctgtagctttctaacaacaaagattatttgtttggttgtctatctgcttcagaaatctgcctcacgattggggagaaaatgggtttacggtaggatataccttgtttcacggccaaggagagatcggcgttcaaagtttacataattctaacaaaagaagaaagatttttttgggatggtttctactcaattgtgtattgtaaaaatgatactatagaaagcttttgtaacattcaaaagattcataaaaattgttactataacgttttgtctcttgtagccttatcttcagacagtttacaaaaacaaacaaaagaacaaaaagattcgttccaaagttccaatgcctttgctgctgagtgaaaagaatgttgctcagcttttttttcagaagtgtgccaagctatagacaagaatccatgcgagctgaagacagaacattaaacagattctgttagaccttataattactgttaaagaaagagtctgtactgttgagatgaaaacaaacttaccaaaaagagagtaagtgacgcaaagagaccctcttggagtaaagctgcgtggcctccgaaatcttcttcatcaaccttgagaatcattgcgtagtaaccataaactatcccagaggatatcgccaaaaacctgcaaaatcccatcattagttcattacatcacaaagttttgccaaacttaagaggtttcaaagaactgtgatccatgaatctacggctttgggtcgatgcaaaatgaaactaaaacacgaagaaactgatagaaacgaagctggaacatgatccaaaactaaagactgttcctttgcgttttcatcaaccattataacatgaaaacacaaatgtggaaagaaacattagtggccaaagttaatgaaaacttacagaatgatccaaatgcctccaacaagtggaatagagccccataacaatccagagatcaatcccaccacttgtcgaatccaatgtaacacatctcctaattgatcctgcatcatcattaacaaaacaaaatccaattcataccaataactcaaatttacttgagcttaaaattcacaaattgaacagtagagaacagcttgatcggatcaattattcatttccttactgattcagtaagatcgactacgacgattcattaatcaaatctccatgtaaaaaaagtcaaagactcaaagagattgccgaaaactagggaggaagaagagagtgttgagtaccttgtcccaagaagcatcgggatcgaacaatttcgctaatttcgatggagacaagtgagcattctggtgattctcttgttgttgtagctgattcagcttggctgatttcgattctttcatcctcgctttcaaacaaaaaacaaaacaaaactttggatacggagagaatctgaaaccttgggaagaagaaaccccctttgtggagtattgaattagggttcttagatttaaagcactgttaattggtgaactagtggctgagtcgtgagattattattaaactgtgagtgtagttcatgttctgtatcgaagtgattcggactgtgatcgagtttcttttttttcttcttggtaaattaaaagataaatccattagttctagtaattaattatcccttaattataatatattgggattagcttttggatattttggatctgatgcctcaaaatactgcaattatgtaccttgtttatatagtgaaacaaaattatctatactgatgttttgtttttgtctgcaatatattaaaaaaaaaaactattttcgagttctgactttggtcaaagtttgacttttatttgtaaagtactcttcctcaaattcggtcagtttaaaactttagttaatgttgctattaatattaattaatgtagtcatatagtttttaaactaacaatatgagtaatatttatatattattaaaaaaacaatattagtaatagcctaatatttgtcatactgtaatttaaaaaatttatatagttttgaattctcataaaaatttgtgcaaagatattataatttttttttgtgtaaaactgattttatcctttggtaagcttaacaaataaaataaagttatcgttgatggcaaaaaataaaaaaataataattatcctatgcaatttgcatctctagtcctcgttatttaaataaactacagatcgaacccatttctcgttccttttttttagtctccctccgcgtagaagcttctccgagacttgtctctgctttgattgaagaagacgcttgatcgaaaattcccttagatttcgtaaatagggttttacagaaggtgagattacacagagatcggatttgcgaaaaaaaaaaatg

SEQ ID NO: 33281 - DNA, 3003 bp, Unknown
  misc_feature (1)..( 3003): 2750-1469P.txt file - cDNA_ID_3067791; gDNA_ID_1620536; Annot_ID_159870
tccagtttctatatgttacataaatttgatttttaactctgaatcatatacattactcaaaaccttaaaaaggtttcttttttgtttgtctaggttgttcaaaacttgatctttcagtagctaaatatatggatcctctataatctcatttgtaaagctcttttattgcagctttaagatggagaaaaatcaacaaaagcaggaatttctagctgagacctcagagatgaagaacaccaaaaacaacgacgactgttctgtacaacaacaacaacgatttgtgtggccatgggttggtctagtagccaacataccaacggaggtggaaccatcgggtcggagagtaggcaaaagcggttcaacgttacgtgatgagttcactatgaaagggtttaatccaacaagagtccaacccatttgggatttcaagggtcattctggttttgctttggttgaattcgctaaagactttgaaggattcgaaagcgccatgaatttcgaaaggagttttaatttagaccgtcatgggaagagagattgggaaaaaggtaaaacattgtttcagagtttttaaagtcatttgctttcttgacattgatgagttcactttctttgtaaaaggtcatcgcttgagagacaataagctctatggatgggttgccagagaggatgattataatcgaagtgatactgttgggaagaacgtcaagaagaagagagatttgaaaagtatctctcagattgtggaggaagacgagaggaaaatggttcatcttgttgagaatatgtctcaaaccattgagaagaagaagcaaagtaaacaagagcttgaacagaaagttgatgagacttctcgtttcttggagagtttggaattgcataacgttctgttaaacaaaaactaccaagaaggtaaaatagaagcacttgaataagctttaaaaacataatctgttttgtgtttcatgctgacatgtatagtccttttggtttgtttgtgtgttattgtgatgagaagggtttcagaagatgcagatgaagatggaagagttgtatcaacaggttctggatggacatgaaaagtctttggcagaactggaggcaaagagggagaagcttgacgagcgtgcaagactgatcgagcaacgggctatcataaacgaagaagagatggaaaagtccagacttgaaagagaaatggtgattatgctttccttacaaagtaggagaaaaagatcacaaggcaataaaatctttgttgttgttgttgttgtagaatcaaaaggctatgtgtgagcagaatgaagcgaatgaggaagctatgaagcttgcagaaaagcaccaggcaagtagttcgttagtgtttctgtatatattcatgaacaagtaataactaagcttccatttccaacttttgagttcctgaactatgacaacttttgcagaaagagaaggagaagcttcataaaaggataatggaaatggaagctaagctaaatgaaacgcaagagctggagttggagatagagaagctgaaaggtactacaaatgtgatgaagcatatggtggggagtgatggagataaagatattgtggagaagatagccaaaactcagattcagcttgacgctcaagaaacggctctccatgaaaaaatgatgactctggcacgaaaagaacgtgcaaccaacgacgagtatcaagacgttcttaaagagatgattcaggttcgaaaacgttctaaatctatctgttccaaactctttggcttgtccttttaacttgtgtaattactttgatgaacaggtatggaacgccaatgaagagttgatgaagcaagagaagattagagtgaagagaatggggcaattaaaccctgcacccttcttgcctgcagtgatgaagaaacataaagttacacaatcaaaggcagagaataaggctatgaagctgtgttcagtgtgggaagcaaacataggagatgtgcaatggactccatttagagtcgatgagtctgatggaacaccaaaggttaggactttaatttaggagtctactttcaattctcaaaagatggggttttagcaaaaaaagacctctgcttttacatattatatcatccacattccaaatgtgaaatgcagagagttgtggatgaaaacgacgagaagcttcgtacgctgaagaaccagtacggtgaagaagtttataatgaagtggtaagaacaaaactagagattgaggaacataacgctagtggcagctatgtgattttagagctttggaactatgaggaaaaccgaaaggcgacgatggaggaagcaacagatgtgatgttgaagataaggtccaaacttgctgctatgaagaacaaacgaaagaggcttgaggtctaacttaaagaaagaagacaataattcaagtaacaataccggagacgagaaagtgttctgtttttcgttaatttaccagtttaaattagttttgctactacaactattgtaccgaattggattttgtttcttcaaaagtttttctccacaaatcttatgtgttgtttgattttttacgtggagtctggagctgaaaatctttttccggttacgtatgtttggtaaattgggttacgaagttcttacgaatatataattcaactgtcgaattttaacaaaaagcgtctgtagtccaacggttaggataattgccttccaagcaatagacccgggttcgactcccggcagacgcaatatttatttttatacatctattatcaaatttttaatacatttagcaacgacatcgttttattataacccgccaaaatcgtatcaccgattggaagggtattatcgtctaatcataaaacgtagtatgttgcgtgcacgcgccgaaccaaatcgtgtggccacaatttctcggaccaaccgtctccaccacacgctttgtcttctctttcaatttgtttccggcgagtgaagaagaagaagatatttgttgctgatg

SEQ ID NO: 33282 - DNA, 3003 bp, Unknown
  misc_feature (1)..( 3003): 2750-1469P.txt file - cDNA_ID_3067811; gDNA_ID_1620537; Annot_ID_159928
ggctgcagtatgggttttactcatgccattaacttacgcatacagccacacctctattttcattgtggctattcttatctacttatccccaaacatgctcccggaaatgttgctcttgattcctagcatccgacgtacacttgaaaagtctgactttaggccagtgaaattgataatgtggtggtctcaggtatattattaatatatcctatgttgatacactgtcaattcatacatgttgataaacaaggtgattgatcatgattcttggtgacgcagcctgaactgtatataggaagaggtatgcatgaaagtgcatggtcaatctacaagtaagaacatgcatatgcttgttgaaatgttggttggtcttcctaaatttcctaatgaggtttctatgaatgattttaggtacatgatgttctggattgtcttgttaacctcaaagcttgcattcagttattatgtggaggtatcacaatttcacttatcttcaactttttgttttgctgtatgtaaggaaacattaacattaaaacttagagacatgcgtttctctaataacgtcacggctgaattttagtgacattttcgtcagtccatatatatgttctcatacttccatcttcaaagcagattaagcctcttatgggtccaaccaaagaaattatgagtgttcctatgccaggctactggttgcccgagtttttccctcatggtaatggttaatagcatgtggatattttcttattacatagtgaagcctttattcaataatctggtttttccttttgttttgttttttcagttaagaacaatagaggtgttgtgatcacactctggtcacctgttatccttgtgagttagaatagattcttcatttccatatggtcatttctcacactctccccaatctacgctaactttcatatgcaggtttatttcatggacactcaaatatggtatgctatagtatcaactctggttggaggtttatatggagcttttcgacacatcggagaggttcatactttctttaccataaattttaaaagaatttaggaacagcttatttcatgaggaaatgacatgctaataaatctttttaagggttatggaagaataaaatagttcaaacattggcataatgtcacaaaagcctaactaagcaccatatgtttttttttttttttttggtgtggtatcaactaaccatatatattttaacaagttagttggtctttgttgagtatatataagtatagatttcaatggatttatacggaacttttggtatagaactgtttgggaggcttagcattgagaaataattgatgctctagaatttatcctttaggttctggcttgcgtttcctagctatattgtttcttgaaagaagtttatttcattttctcagatccaaacacttggaatgttgaggtctagatttcagtccttaccaggagcctttaatgcttgtttgattccaaatgagaatacgaaagaaaaaggaattaaattggctttctctcgcaagtgccacaaggtctgcttcctactattattatacggctatatgtatatatgaaatatcaagatatatgaggcaaacctatatttattaaaattaaaatgtgagttctcagtatcattgcttttgaatagaactcactttgagttgttgtttttttttctttttcagatcccaaatactaatggcaaggaagcaaaacaattttctcagatgtggaacaccataattaatagttttcgagaagaggatctgattagcaataggttgagtctgccatcgaattttcgtccgtttgacaactaaaagttattgctaaatccttctagctggagaagagtttactgattaattaatgttgataagtatgtagggaactggaactcctgctgatgtcatgttgggcttaccctgatctggattttatccgctggccaatttttctgttggccagtaaggtaaatattatccttgtcttaaatctgatcttacgttccgatttcggttcttatttgcatatgtacttgtgtttatacatggtagatcccaatagccgtggatattgcaaaaaaaaggaatggaaaacaccgtgaactgaaaaatatactggctgaggacaattgcatgagttgtgctgttagagagtgttatgcttctattaagaaactcttgaatactctggtcaccggaaatagtgatttaatgtaagtatcacaaaacttatcttatataaacttttcctataattagcttatcctatatagttgtcctttcctaatttatttgtctttgtacaggctcataaccacagttttcaccattattgacacacatatagagaaagatacactcttgacagagttgaatttgagtgttcttcctgatctgcatggccactttgttaagctaactgaatatgtggtaagccttgtagccataccatgttcaacatctcatcacccttggcgcgaattcaggagaataactgaaattagccttcttgcaacagctgcaaaacaaagacaaggacaagattcagattgttaatgtcttgctgaaaatattagaaatggtgacaaaagacatactaaaggaagaggtttcaagtaagatcacctgactttaaggtttttttgttgaatggttgatcaatgttttttttttttttttttttgaagcatgctcatttataatttcctttatatagcttgctagagttatgccactctggatcatacaaggttcatcaccaacataaatatttcagcaaactccagttcccagcgttctctcaaacagaagccgagaaagagagagcaagtctcctctttaaaatttcatccttgcaccattcttgtttccatgaaaaggggtgcatttgactctaagctgtgtgtgattctctattttttttttctcccggcagatcaagaggcttcatcttttgcttactgtcaaagagtcggctatg

SEQ ID NO: 33283 - DNA, 3000 bp, Unknown; identical to SEQ ID NO: 2447
  misc_feature (1)..( 3000): 2750-1469P.txt file - cDNA_ID_3067823; gDNA_ID_1620537; Annot_ID_159925

SEQ ID NO: 33284 - DNA, 3003 bp, Unknown
  misc_feature (1)..( 3003): 2750-1469P.txt file - cDNA_ID_3067827; gDNA_ID_1620537; Annot_ID_159923
atcctagatgtaaaatcaatatacaattatgaagtttggattgatactaaaacttttttgaagttttcaatattataaatattcgaacttcataagaaaatgacaaaatgatgtttaatttcacgggacgaggttatatggtgggatgggtttggattgatattaatacgggatggtatattatgaatgtatctatagatcatcttaaaaacaaaaatttaattttttatttaataaaagtataggcctattatatacctcttgaatatgttatttgtatataaataatattaatttaaataaaaatctttaattttttaacaaaaatatcaacctgcgagcagcggtgtaccgcaggtcaatctctagataatacaagttttaaatcgttattacccctaaccacaaaagcaaaataatgaattttaatattatgtgtcaatatcatattattcatatacaaataataattcttataaaaaaatgaacatattcatccgaggtgtcccgcgggtcaatatctagttttgctagactttttggccaaaaatccctatactatttactattaacattcaggtccttacaaattctatctcaaccaaatattttatgtataaaaacttacaattcgttaatttgcattaaatacttcaattaactctctcttaaacttttttcttaattaaatctttctttacagaactatattcgattaaggctaatttcctaaaatctcaatatcgatattaaatataaacatagaatttttctgtcactatatttgttcttatatctaatttatttttactttatatataaaatacatatagttaataaaatatatgattttctgcatctgatataattcgaaaacaaataaataacttaaaagtatatttttttaaagtaataaaaattgtccggaagtatatcatagtatcatacataaaaaacaatagcatgtatctataaatcatctttaaaaagaaattcaattttttatttaataaaaatatatgcatgtgatgcacttcttgaatatgttatttatatataaataatactccctctgtttcataatataagttgttttagaccaatttttttgttttacaagaaaagttattttctagtttctatgcaaattatatgttactttaatattttatgattacttatattatttagtctcttttatgattggttgaactttttcaaagtaaatattcttaactgaaacaacttatattgtaaaacggagggagtattaattaaaataaaaatcactaattttctaacaaaaatatcaacctgcggtttaccgcaaatcaatctgtagataatacatgttttaaatatttattacctctaaaaaaccttaaccacaaaaatactgaattttaatattaaactaatatacaacaaatatcagaacataaaacatgaattatccaaactttacatagaaaaaaaatatatgtcaaaaatatatgccgtgaattcgaaacttgtgtttgccaaaacaatcgcacatttgcaatttcgttaaatttctgtcttaaagacataatctttttgatcatttagcttccatagctaccgtagtatctaattccttcccttagattttgatttctctcattttatgtttagcgttaacgcaaacgagttcaaaattttgagttttcggtttcttatttttagatacatgcctcatatttagacttttgctggtatcttgcttgattccttttgcaatttctcttgtttaccttgaaatataattttgtattgattgataatacacttggtgtgagcagtttttgatgggaagggatcaaatggataacattgtggaatctttgcaattagataagagtaagttcttagaggaatcgagaaagatgacattactaagctctttcagccatgtctaaacattttcaaatgtacagtattaaattacattgtagataaaagcgcgctaacagctcctcgataattatattacaaaaaaaaaacgtgcggtttggcgtggtttgccctagaatttttaatgtcttagtactccaatgttttttataaaatttaatgttggattttaagagtgatttttctatgattaatatacatataaactaaattccttaattattatttttgatacaacttaaattgattcatgcacttacccttgctatacagaaacctagaaagaaaatttgaattttggcatttaatcttcacacacattattagactttcgatttaattcaattaaaactcttttttcttacacattaaaatttgtggttggacactatatatatccttttgctttgacgggagttgtgaaagcgacaagcaaatatataaacgaccttatcaacaaagcaaacgtatagctacaaacgattgtgagcttttatatcaaacaatgcaaacatatagatcctcataactaacgtggtacacccatatatataacttatatatttgtaaatctgcttaaaactttacaacttacggcctttatacctttagatacggctatgcaactatacttttactggatttgtaggtttgcatgcaagatttaagtgccataaacctaaagcctaagggtcaatgtaaatataaaacaacctaaatctagatctttatatcactttgctcttttcatgatctctctcttaagtttggttttcccttctttcctttcctctagtgattcaccacctctgtcaccgtggcaagaatgcatagtatgtctgcctatttctgaatgccgcatgcgattttaaccacacaaaataagagggaatcaaaagattttttagaatagtataaatttcattattattttaattgatagactctatggaaacagccatttttctgaagaaaaaaactacggttctagcctcaaaactatcacgttatcttccatgtcaactgtcggttacgcacaatgttattttagtcaaattttaatagatg

SEQ ID NO: 33285 - DNA, 3003 bp, Unknown
  misc_feature (1)..( 3003): 2750-1469P.txt file - cDNA_ID_3067845; gDNA_ID_1620538; Annot_ID_159962
ttgggggtaaaatgttaaacatatcttaaaaggttgagtttcacaaaaaggttatcaagagttttgagaagaataagagacaacaggtacatacaatagtagaagatcagtaaaacctagcggttaattgttgtaaagctaatctagatatgtcaacatgtaaagctaagttatacgaggtcatgtagtatggtggttttctagtttaccaggctctcagtggacaaaagtatttgtcgatttgataccatcttcctcgttgtgcgatagtgtaagtacgctccacaatggaaatagagaaaaagaagggtaatcagctagagttaaatccatcggcaaaatctaacacacatagttttcactcaatcactctagattgatttaataagtcatttataaaagttcttaatcctcaaatttctatggaaatttttgttcatatgatttaaaattttgtacggagctccaaagaaattaagtttacttggaagcgaaactcgactggatttgtcagacggaagactcttacattggatttaagctagagaaatttttattggatcgactagataagttgttctctcaaattgatactcgatactcaaacttgtacacaaactaaactacaaatgctacgttgcatctggtatgaattatgtctcaaaagaatccgaccagatccttttcaaggttacaccccgacaacaaaaccagcttggtaatttgcctggaaacgagggagttgaaaacgtaattcttggttcacaattaatcctacatttggagacttagtgcgatttagtcgctgcaaatttgttggtttgtccatcttagtttattcaacttgaatctcgctttcgtggtccaacttttgatttgaatagcatctccacaaacagaaatacacatcttttatttccagttttaaaaagaataaataagcctcaagcagctatcaaaatataatgcaatattgtttaaagagtttcattttattccgtagccatttgaacagcattcgacatataaattttaagtttagccaacaattaccgattcttgccaaaaaaaaaaaaaaaaaaattaccgctttaatgtttaaaggacgaagaaaacgtgttattttaactttaaattatttttaaaagtttaataattattgtgtatgcatggagaagcaataagttacaccaagtaacacttgagacatatacttgatttttttccattttcaacgttataggaaaattggtgtgaattagtatatccttgtctttttcatgccctgcaacttgcagctgcttatataaaggactaaggaaaggagggacactttcaaagctcattagtaatctaagactttttcatattttccaaacactaattgaagaaaaacatgcaggttcgattctttatatatattttcctaatctatgtttcttaattggaagcttgtaataatttttccgaatatttttttattgcttatatatcaaatgtcataattctaccctaattagctctttaccataattaatattttcatgacaggtagttgtactgaaattagatgttcattgtgaaaaaaccaaacaaaaagctatgtcaactgtatgttgtctctcaggtataaacaacactcatcaattgctaatatatattttttttactcataagcctctaaattctcttaatcaattgattaaatcataattaagtacattttgatttttttttgtattgaaggattattttttcttttggtattgaaggagttaactcggtggaggtgaaagatggtaaactaacggtgacgggagagattgatgcctatatgattgtgaagaaattgaagaagatatgtcataccgagtttatatcggttggaccggttaaagaaccagagaagaagaagcctgatgatccgaagaagcctgaaacgaagccaccagatgtcatttatcattatgtccctccatgtccaccttattaccataatttcaacggatgttacaatgaagatcccaacgcttgcgtcacctcttgaaaacaatattttggtcggatcagtttggttcacgatagtcatcactcatcagcttcgtcgtagtctttggttttgttctattgtgattgttttaactctttcagtccagtccattatacacactcaacatgactagaccaaggttgccactcccaggcccatttcttgttttaattccttttttgttttcttgttaataacatgcatttaaatttagatgacgacgcattaattgaccatatttaacacaaatcactaggttatatacgtctaattcaaatgattttgtttcataaaaaataaaattagatatctagtgatcttatagtaatatataacagtaatctaagtagactgctccacaattatattttactttatttaaaaagaagaaactacgtaagaggtaaataaagtacatctttaaaaacaaaatttatgaatgaaacattgtgactttaatctcggtttgatttcgatttcagctttggttttgatatgattcaacttttacctagagaacttgcttgagaagttcttatgaccgaagaagtcaataaggtccaaccacaaatcaacgttgtccgggtcgtacacgcggaattctgaaaactacacttccttttgtgttcgttagactcaaattaattttcaaccaaatcataaaaataaatataaaattggtagagaatgagtcattctgaatgactactttaacctctttgtggtcgttattgcaatactatttttatttaaaaaatacaaaaactttcccttgtggccttgtgggtcatatataataatacttgcaaattccttggcaatttctatttaaaccgatttcagtagacttgctattgtcatcatttcatatcttagatcatctctcttctctctctttctcttaagaatattggaaatttctgaagcttttctatagttgatctcgagccatg

SEQ ID NO: 33286 - DNA, 3000 bp, Unknown; identical to SEQ ID NO: 2455
  misc_feature (1)..( 3000): 2750-1469P.txt file - cDNA_ID_3067882; gDNA_ID_1620538; Annot_ID_159947

SEQ ID NO: 33287 - DNA, 3003 bp, Unknown
  misc_feature (1)..( 3003): 2750-1469P.txt file - cDNA_ID_3067886; gDNA_ID_1620538; Annot_ID_159946
cttagtatagatccacagaacttggatgcgagaccaaacttagcgattgaattagtagacaatctcgagagtatatcgagaatgatatcaatcgggattggatctgattttccttctctttccatcgtacgtttttcaaagatcgtgtattttggattttggttccagttccagttccagttccagttccagacttaacgtagacgacaacctagggttcaaaggcaattcattcatacctaatgggccgaatgaattcatgggccatgttagaggcaactaaaaggctggacgaaactatctattttagccttttaggggaggtaacgtattaatgtccccaactatcttttataggatgcatagttggttttaactaacattaaaggtgttactaacaatgggcaatgatggtaaaattataacgcagtggacacaatataacttagccataccaatgcaaagaatcttgaaactagtattaaactcagtcacgtatatgctctccagtctatgcttcgaagagctttcttctaatcccatacgaagaagctctctatgtttttctaatttaatcaggcttagacaactagtttcaaagtcataattcttggtgtctgagttgtcttccctttccatcgagttttttaaagatcgtgtcttttggtttccagttccagactacgtaggcgacacttcagggtttcaaaggcaatggcactaaaagtcactaatgggcctaacgacttaatgggccttgtgaaacgttacccaataagagacctggtttctcactgagttcaaccatcttcttccccatggctctgaattcttcagctttcttcgttccatgtcacaattacaatcaaatctgtgatcttcttctttcttcagctcgaaccagatcaactattaaaggacttcagcttcatggctatgtcgttaaatcaggcctttctcttatccctctcgtcgctaacaacctcattaatttctactccaaatcacagcttccgtttgattctcgtcgagcttttgaagatagcccacaaaaaagttcgacgacttggagttcaatcatctcttgttttgcccagaacgagcttccatggatgtcactcgagtttcttaaaaaaatgatggcgggaaaccttagacctgatgatcatgttcttccatcagctacaaagtcgtgtgcgattttgagtcgttgtgatattggtagatcagttcattgtctatcgatgaagactgggtatgatgctgatgtgtttgtggggagttctttggttgatatgtatgcgaaatgtggagaaattgtttatgcgaggaagatgttcgacgaaatgcctcagagaaatgttgttacttggagtgggatgatgtatgggtatgcacaaatgggtgaaaatgaggaagctttgtggttgtttaaagaagctttgtttgagaatctcgctgttaatgattactcgttttcgagtgttattagtgtttgtgcaaattcgactctacttgagttaggtagacagattcatggattgagtattaagtctagctttgattcttctagctttgtgggaagttctttagtctcgttgtattcaaagtgtggtgttcctgaaggagcttatcaagtttttaacgaggtgcctgtgaagaatctcgggatttggaacgctatgctcaaggcgtatgcgcaacattcacatactcaaaaggttattgaattgttcaaaaggatgaagctttctggaatgaaaccaaatttcataacttttttgaatgtgctcaatgcttgtagtcacgcgggtctagttgatgaagggagatactactttgatcagatgaaagaatcgaggattgagccgacggataagcattacgcttccttggtggatatgttaggacgagctggtagattacaagaagcacttgaagttatcactaatatgccgattgatcccacggaatctgtatggggagctttattaacgagttgtacagtccacaagaacacagagcttgcagcatttgcagcagacaaggtcttcgaattaggaccagtgagttccggtatgcacatttcgttatccaatgcttatgcagccgatggtagattcgaagacgcagctaaagctagaaaattgcttcgagaccgaggggaaaagaaggaaacagggctaagttgggttgaagaaaggaacaaggttcatacatttgcagctggagaaagacgtcatgagaaaagcaaggagatatatgagaagctggctgagttaggggaagagatggagaaagcgggttacattgcagacacaagctatgttctgagagaagtggatggtgacgagaagaatcaaaccataaggtatcatagtgagagattagctattgcttttggactgatcacgtttccagctgatagaccgatccgagtaatgaagaatctgcgtgtttgcggtgattgccataacgcgatcaagttcatgtccgtatgtacgagacgagtgatcattgtgagagataataatcggtttcatcggtttgaagatggcaagtgttcttgtaatgactattggtgaagaagacaaatgagagttggtttatatttaaccataatttcattcagttcacactgaaccggcgaaatttctttgccagacctattcggaattgaaacaagtggagtctcgaaacgaaaagaactttctggaattcgtttgctcacaaagctaaaaacggttgatttcatcgaaatacggcgtcgttttcaaagaacaatccagaaatcactggttttcctttatttcaaaagaagagactagaactttatttctcctctataaaatcactttgttttttcctctcttcttcataaatcaacaaaacaatcacaaatctctcgaaacgctctcgaagttccaaattttctcttagcattctctttcgtttctcgtttgcgttgaatcaaagttcgttgcgatggcggatgttcagatg

SEQ ID NO: 33288 - DNA, 3003 bp, Unknown
  misc_feature (1)..( 3003): 2750-1469P.txt file - cDNA_ID_3067894; gDNA_ID_1620538; Annot_ID_159941
atcaattcacgtgttaaacaaaaataacatgcaaattatcaattgatatctcatatgtttatttttgaaaagggttatatattcttgcctttggtccaagaaacagcccatatggtacacctttgaatttgtctgtgtggtgtagctaaaaagataaagccataatcgttagcaaaattttgtaaatcaataataactatatggaatgaagaacgttaagagcgttggttaacgatggtattaaaacctggtgagcggcggcgacctttcgaaggtaaggaacgttggcaatgggacctacagggaatctcttgtgcacaagtccatcgtgaacgaacatgtaagccattccaaacatcgttattcccagtccctggtgatattacaaaccagtcagcacaaaaaacaagaaacagatagtactcgtatagtggtttcattagtctaagtacacccaatctttcatgtttggacgggtactagatgataggtctcacccaactcacacgttcacactctttgtgggacggtgaaaagaaaaaaaaaaaccacaaaaaattttcatactttcggtttccgtgactttatttaaagaagtcaaataccaatttactattgcttctctctttatagaaaaacaaaagacttttgatcttttctttataagtttcggatattgtcgaaagagagaaaaaagacttacggcaccgaagcagagaccaggaacaagtcctttattcaagaatccataatagagtagaccaatcgcaggaaccgcgtttgttatagcaaacacatcgtttaactcaaacgctccttctcttggtttgtgatgtgactgccacaaaccaataaccggctatgaatattcttaatttgttagcagtaaaccggaaaagaaaaaccagaataatgagaaaaaatgaaatacctcatgcatgttccataaagaatcatgccaaagagctctatgagcccatcttgcccaaaactccatcccaacctaaaattcaaatatacgaaaatataaatgaatcggaataagcatggacattggctttttacggtttaacttgttctggttattgaacttcgtttttttcggatgttagaaaataggctgaaaacaaatgtattttgataagtctagttaaaaataaaatttcttatgaatttgtggtttaattctgtttgtttgcatagaattttatttagtttgagttataaataaaatttggttcggaattagattgacatatttcggtttggtttggattttcccaccccaaaatgggaatataatgtaggaatgaaacttacggcagcaccaacggaaagagcaaatgtaccaaacatctctaacacagacacttcacctccctaaaaaaaatcaaatttttcacttttggaaattaggacaaatagtattgaattttcgttatttatttatttattataatttaccttcatttgccaagaaaatcggtaataaacagccattatagccatagaagtgataccaaagctcgacatcacagctgctattaaataagtgaacctctctgatttcttcttctccgctttcttgagaagccgcgacgtcatcaagatctcagaagagcttgtcgtgctttctggtttgttgtcatcgtccatgggagagctttgtttccgttcttccacgacgaaacaaacggtgagaatctttcgacgtcggaagccgttgaatcttagagatggagggaaaactgcggtggatatagggtggtttgcggagaaagaagagcggttgagtggtttgagtgttacggcgattgttgatagtcctgctgccatggaaggagttcgttgaggttttatgaaactttaacgaaagagagttatagagacaaatataaagagaaacacaaggagactattgtgtggtaaagctttgcagagagaagagctaaatggagagaggccacatttttattttcttttacaaacaaattatataaaaactataccattttgttttttttatatgttgagtcaattacaataatattgttaatgtttataataagaaaaacatttcgcaaaagcaagcatataaacaaatacaaaaagtgagtttattagaatttgaggtaaggagaggtgatggcctgatgggccattttctaggattttcccaagtcatcgacagcgaatcactccacttctatttaatggctccacgtggcctcttcttccaccgaataggcaagaggagtatcaccaacttccacatgtccaatccttatttgttcatattgtttcatcagatgacactcttcaaaggtaaatgaggtattgcttgacatgaagcttctagttctcgttctaaacttgtgcgacttaaaaaggatctcaagtatacaactacaggtggtttaatttacacaagttgtttccatgcattttcaaaacagatttcagcttgatttgtagttttgacaagttactaacaaaacaaaatagcaaaagttatgactgaaatatatgaatgtgactatgtgagtgatcagagcccagaaaagttactaaaaagccgcagcataaactaattgtttaaagttacagatcaatttgctttggttttaactaaaaggaaatattaatttgctctgtttgattagtatgttactcaactaaaaatatgcatttctgataaattctggttaatgtggttctgttacaccaaattcgcattttactactatagtaaagaaacttatttcgtattattcggattattataaagttgactaaattcgattcgattacaacttggttcggttcggttcggttacaacgccgacctgtaattaaaacctttttaactgcaaaattaatgaagatacacacacgtaatcgaatattctcaacgacgcgtaagcttcctctctaattacttacttcgtctccagggtaatctgatctctctcatcacctctctcttctcctgaaatcaccatg

SEQ ID NO: 33289 - DNA, 3003 bp, Unknown
  misc_feature (1)..( 3003): 2750-1469P.txt file - cDNA_ID_3067898; gDNA_ID_1620538; Annot_ID_159939
tatgagtcatcacaatcttcgccaagtaagacgtgcagagcaacagcctctgctatggcggcaccttcctcatccaatcgcctttgttcctcaagttttctaagcttcttcttctctagctcagccctgatggctgcagaagtagcgatggatttctcaatacgtctctttttcctctctgcttgtttgatacgctccagttcctctctctcctgcttcttctttgcagcatatgctgaatcttcttcaactgctgcgtctagctgtccttccttcttcatttgcttcttcttctctagctcagcgcggatcgctgcagtagtagcaatagctttctcaagacgtctctttttcttctcagcaatggcagcaccttcctcagccaatctcttttgttcctcaagttttctaagcttcttcttctctagctcagccatgatggctgcagaagtagcgatggatttctccagccgattctttttattctctgcttgtttgatacgctccagttcgtctctctcctgcttcttctttgcagcatctgctgaatcttcttcatctgctgcctctagctgtccttccttcttcatttgcttcttcttctctagctcagcccgaattgctgcagaagtagcaatagctttctcaagacgtctatttttcttctcagcttgtttaattgggtccactacaccttttacttttttcttcctggcttttctaacaattggctgagcttgtttgcacatcgagctactgctatccatgattgctacaagtctttgtttgccttgcttttgttaactggcttcttcttttagttggttgtttccttttactttgattctaccaaactcactacaccaaggcgcgatgatctcaatgactactacacccactcaggtatgtaggtatacctcattttacggacaatacaatcccaaacagaaacaacaggagataagagaagggagacgttgtaggagtttgcagagttatcctttgaaagcattcgtcctaatttccaacatcccttaacttctcccattttctacaaaagaaaacaatactagattagacttgcgttaacagggatctcaaaaataatataccaaaccaaaccaacccatctgctttcttaacctaatgaaagctgcacgaccacacagttctattttctatatggctatatgcaaaaacattaaacaagaaagctttttcacaaccagatgttacccagctgattacttaattactcactcaggttaccaacctataaacacaattgcacaagggacctagaagatacagtgattcaaaagaactaacactggtcaacaaaccaagataaatcaaccaaagttgaatgtacatactctcgatcaacattgaaacccaaattcggaaagctagccacaaactacacaaagtaatccacgaaacatggacataaaaagtcaatttgaaacaaatcataagccaaatttaacgaaattcatactgcgcacactaaatccgggacaaactgcgatcggatgaatcaacctataattatcattcagaaactaatgcatacaccaaaatcaaatcaaagcaaacacgaaacgagtaggtcgattcagagatcaaaacctaaggcaatcataaagtattacaaaatcgactcaaattggattgatctatggaaattgaagaagattgaatcgaagcaattatgaaaaggaattggatcctaacctcggcaaaatggcatagaagcagactacctcgactaacttctcctgagatttatcggatagaaagagagagagagagagagaccaaatcgcggacgtaaagttactacttcgatccagagagaataaacgcagagacgagagaaagaagattttgagaaagaagattttgagaaagaagagacactggagcggagcaattatgttatatttaatccaattagaaagtaacacgtggtggatgatgtgttgagtggaggttttcgattgggatttagggacctaaaacttgattagtcaatgatatatgtattggatccacatatatttttcagccgttagattcgacaagtattgccattaatatttgataatgaacggctgagattggatcttagagaaagcaacaagtgtatgaatgaactgtcaaaaatagaaaacctcgtgggccttttctgggctaaatcttttagattttgatagaaaatgtggatgggctttcatcgagctccagttccgcagcgctcttctctaatatatcttctccacggtaataatatgttaggtgggccatgtgttatcagaaaattattaaaattgtgattattattcgtaaatacattgcttaaaaagttagttagattttgattcgtttccaccagacgaatcttcgtaacgcattttcgttgattcactttccagctttatctcaaactctctctctgtcgtctcgatcgatctcccaaatctcaaattctgaattgattttttttgtttataaacaaagcaaacaaaacacataattttggttcggtcttcttcaattttcaccgacacaaacccgtcttttcctcttctctctcatttctatcaatttttctctacaattccccagtcgtcgaagaagctacaggtaaaccgatcttctcaattttcatctcttctcgtcgcattatgctcatacctcgccgcgagaggatatcaaaaagcgagatttgttatttttgcatccgagaattttggttatggattacacaaccgaattaatcgaaattctctttgttcgtgtttcccttgatcgccacgaaagtttcagatttttttttggatttcttaaccgaatttagtttaatcttgctcatgttctgtttcataccatgttctgaaatattgtttttttgaatcataccttttgaaactcatcgccaccagcttgcaatttgctcgtgttctcttccatcattcctttgttaagagcctcttcatg

SEQ ID NO: 33290 - DNA, 3003 bp, Unknown
  misc_feature (1)..( 3003): 2750-1469P.txt file - cDNA_ID_3067918; gDNA_ID_1620539; Annot_ID_160008
attcgtggaagaaatcgcgtgcggagctcaccatgtcgcggttttgacatctagaagtgaagtcttcacgtggggaaaaggtgctaatggaagattaggacatggagatacagaggataaaagaacaccaactttggttgaagccttgagagataggcatgtgaagagtttatcttgcggctcaaactttacgtcaagtatatgtatacataagtgggtatccggagcagatcagtcaatctgctccggatgtcgtcaagcattcggatttacccggaagaggcataactgttataactgtggtttagtccattgtcatgcttgtagctcaaagaaagctttaaaagcagctttagctccaactccggggaaaccacatcgcgtatgtgatgcttgttacagcaaacttaaagccgcggagtctggttatagttctaatgtaaacaggaatgttgcaactccaggacggtcaatagatggatcagtaagaactgatagagaaacaacaaggtcatcgaaagttctcttgtccgcaaataaaaattcagtcatgtcatcatcaaggcctggattcacacctgagtcttctaatgctcgtgcctcgcaagttccatctctccaacaacttaaagacattgcattcccaagttcgcttagcgccattcaaaatgctttcaaacctgttgttgctccaactactactccaccacgtacacttgttattggaccatcatctccatcaccgcctccacctccaagatcatcctctccttatgcaagaagaccgagccctccacgcacttctggattttcaagaagtgttatcgatagtttaaggaagactaacgaagttatgaaccaagaaatgacaaaactgcatagtcaggtatcttcattactttttttcttgttttcaagcaccaaacactaacaatataataaacctaactcattattggaacaactcaaacttttaggttaagaatttgaagcagagatgtaataatcaaggtacagagattgaaagatttcaaaaagcagctaaagacgcttctgaattagctgcaagacaatcttcaaaacataaagcagcaacagaagcactcaagtctgttgcagaacaggtttgcttcatttgttttatgctcaaagaatctttttttttttgttgcaacatatcatatgatattttctatttcagttaaaagaattgaaggagaaattacctccagaagtatcagagagtgaagcatttgaatccattaactctcaagctgaagcttatctaaacgcaaacaaagtatcagaaacatctccacttacaacttcgggacaagaacaagaaacatatcaaaagacagaggaacaagtaccttctaactcaagtataaccgagacatcgagttcatcaagggcaccaagtacagaagcttcatcatcaagaataagtggaaaagaaagtaaagaacaatttgagcctggtgtttatgtgacttatgaggtagacatgaatggtaacaagatctttcgacgagttagatttagtaaaaaaagatttgatgagcatcaagcagaagattggtggaccaaaaacaaagataggttgcttaagtgttatagttcaaattcatcatcatcatcatcatcatcgaatccaacggcttccgactcacctgttgctccacaaccaccgtctgatccgtcggtacctgaacagagcaatgagaaggaaccagattctgaaacctagtcatatgtgtgtaagtttatttattgttttcatttgtatcagttacagaagcaaaatggagaagtagtcactactgctagtacattgtcacatgttaacagtaatgtatgaaccgagttatatactaacgtataattttgtatacaaacgagctgagtcttttaattacatttatgttcatttaaatttattgtatttttcacatctctattttatttttattttttaagcgctaacaactttttatttaagattttttccccccaatatactcaaatgaacgaacttttaacaactaatatttttcgaatatttcaaaacagtttttggtataaattattttaagacttaaaagattccaacaattttaaatatagaatcctttcaaatatatgacaagttttaatttaaccaattttatatttgagactttaatctatatacaacaatcgcaaaaataatttggattggagagttccatctctttatcattactacttgttttgtatatttacaaagatcacaatttactacaaatgtagtcacattttttttacttacctcatcttattatcaactttcgtttcatattctttttacaatttgtcacatttatttattataactctttgttttacatctactaacacactaaatgtttgtcccacatcatgtgagagattaaatgtcatttctctaggacctctacatcacaatgccattgaaaataatcattagaagattttttaatattttaaataatataagaaaatatatatgaagtttagtgtaacataaaatatggttacaaaacttatactttttaagtatactgatcatgaaaaaaaactcacatatttttcaaaatggttaatgaatggtttataatatccaaaaaatcatctccaaaaaatagttaaaggatacaaagatgaaatatcctaaactatagggagcattttataaaatccagtaaactctatagaaggaagaaacgtcaaacgtgaattacaaagttgttgtttcctctgaatttctcagaactcttctttgctaaggaaaaattaaatatccatccaactgtgtgaattagatattttctcttatctcttctctttgttcgatcaaaaattcaattttcccgagatttttgtttctctcgatcgattcaacacctaaagattgaagcttttgctcgtgggttatgtaaagtttccacctttcgtcttctttctgatctgtgagcaaaaatg

SEQ ID NO: 33291 - DNA, 3000 bp, Unknown
  misc_feature (1)..( 3000): 2750-1469P.txt file - cDNA_ID_3067922; gDNA_ID_1620539; Annot_ID_159995
aggaaaaaaaaagcagaattaatatcaactgtcgtagttaaagtttttaagatagactattaatcctttgactaggaaaatatgagaaaactaggatatattgcaaatttatttgtttaagtatgagaatcggtcaagtgacattattgtctctgcagaatctttgagcgcgatatatagtttgtatccacaccaccacagcaaatagttgagtagaaaaaccaatagaccttgttgacaaaaaaaaaaaaatagagaagtaggagaataaaaatatatcattttttagattcaatgggatctccataatattattgaaaagaagaggtaaaattaaatttatttataatcagaaaactaaacagaacttttttttatctaaatctaagtaaactattctcgagttagatcaatgatatattgtaggacacttttcagattctagccagtaaggcagtaacttgggccaagtctatttaatttataccctgaagccaatcaacacacttgtgagttgtgacaactagtaatttaaattttcccgggaaaattgactcataacagaataacttcctaaactaaagtatattatattgattattactctttactccaaaaacattacactgtaagtaagtagtgatgatctagcggtttgcgtcgttacaattgtcttggttagatctctcaccataatctaaaagctcctccaataaactatcatccaaatactcgaactcaataacttccctcccatcatcaccaccacctcctcctctatatcccgacgacgaggaagccactgcattctcgtggctgccatttggaccgtccttcatcatttgatactcgtgaggaaaattgagaatggccctttggcctctcatgccgaaagctgctctatcataagcccgagccgcgtcttccgctgtgttaaacgtcccaagccaaacacgagcaccgtgtctagctgagtcgcgaatctccgccgcatattttccccatggacgctttcgtacgcctctgtatttcatctcattcgtgttataagactctatacgttccatgaaagcttttaaggtttttgtttttgcatgtacatgagttgatagctatgacaacttatacgtggaagtaatgtgactctattagagaaatctagtggatattattttaacgcacgtgcctgttcaaaagcctcctttaaattaccaataaagttaaatcagggggataaattgcaaataaaaatatttatatgccatcgtaatagtatatgaaatttattggtgcgactaaaaaattggatatattgtggctgctctgtgtacattataatatatgaagaattaagggactaaattgtaaaaatcaaaaagatagggtcgtatgtgtatctggatggtcaaggagacggctaagttgaatgaaagtatttttatgacaacggaccaaaagatactctcagcctctcacttttgtttttttgggtcaagctatttgtttttgtttttccttcaattaattgactcacgtgtcaaatttaaatgcacgtgtagtagattctagtcttttaaatttcaatttgaccatcgccaaacacatagaaatgtgtgtgaattgaatcataatacttataaagacatgtaaaatatgatacacttatagtagataacataaaatatttctgcattttgatagagcatactacttttgtttttgtttttccttcaattaattgactcacgtgtgaaatttgaatgcacgtgtagtagattctagtcttttaaatttcaatttgaccatcacgaaacacatagaaatgtgtgtgaattgaatcataatacatataaagacatgtaaaatatgataacacttatagtagataatataaaatatatatacagttttgatagacaagttatttcagttttaataacatatattttaaaaaatatagttaaaataaattcaaattttaggagttgtgtgtattgtaaacctatttgatcaaattatatgtactttagcatgattatatcactacaaaacattgcagaaagaacattttagaacagctgtatattagctaggttcaaaaaaataactacaaatgtcaaatcatgggcttaggcctcttaattcgacattgttactgggtatgttgagcgacccaataagcccaacaaactgtttcccaccaatgcttgaaggccatatattggacaaaggatattagtttataaaaacatcttcatctcaaaatatgtaggagaacaactttaacatccaatagaatatgttcacttttgttaactttatatattaccctaggtcgtatcatcttttcaatgtgaaattcctaacacgttctcctcgaaataatggttttccgtccaatttcgaattgatcacactatgcaaatattacgtagatcaaatatggtctctaataccacattaagtttcatagcttttaacttgaaattaattaacaatgagtgtattatctcatatcactataggtcccatcacatgttggatgtgggttatgcttaaaataatttcgagtattgaaatgtgtattttcatgagtataaaacaaaacgaaagaaatctaattcagaaattggataaagttgtggaagtaacatcagcatgtaccaaataatttcacttaaacaaaaaaatgtaccaaataatttcataacataggttttaaattacaaagataaaatataatgaaaagatcatctccgggagatagatgcttgaaatccgaagatgcatggcggcgtttgaaaacaccaacgaacgttttgttgttccaacttccaagtgtcaaaaacttaaaagaaaacatgaatgattctttgattctttcactgtaatgatcatgacactgcttcacttgtctttccttttcttcgattggccattttcccactttgtgtcttttatttgttcctgcttttatcaaagttagattttttttccatg

SEQ ID NO: 33292 - DNA, 3003 bp, Unknown
  misc_feature (1)..( 3003): 2750-1469P.txt file - cDNA_ID_3067926; gDNA_ID_1620539; Annot_ID_159993
acaatattggatcaattatttgcctacaactacatattatacgtaaaagttatataagcaatggatgattttgtagtataaattaccgtcaagatttctccttttgattatgactcttcttcgtcaccaatgtaaatgcacatctctcttacttctttcttttatttccttatcctcaacaaaacccttcattgacctctgctctctctgtctctatcttattatctccttaaacaaattttttaaaccttaagagctacgagtgaattggttttattgtaaactgttttgacaagcgtccatacttttgccaagttatatagccaagtgtataatccctaagataaatgtcaagagatccatcttttctgtatgtgatgaattggaattataccgcaccaatacaccaagtacaaacaagatatacttaataacatggtatagtagactaataaattggtaaaatagaacaaggaacctatacagatgtcaatgaaatatgctatgcacatgcacttcatctttaactacaattttatatttttttaatatttttgatgaaattaatctaaattttcttagagatcaagaagcttgaagaaagaaggaaaaaaaaaacaacgtgcatccactattttctccggaaagaagaccaaatctgcaaattcatcaccaaagaatcagagatggatgttgtgcaaagaaaagtgaaaaaaattggaagaaaagttgcttctttccctcatgttgaaactattggaagagctctctttgcctcctccttcttcctctcttcttggcatgagtaagaaacatcattctgattcgtacttggaattcaaatagatctaagtcagagtaatgggatctgataatttttgaaaattcatatatacaaacatttgaagatgacttgtaattgaatgattcttaggcatcagagactctttgttttaacaacaagaaggttattgaaaataaagaaataaaaaaaattaaagaggttcttgatatttttctcagttgatgattaaacttaacaagtgggattcttttctttgttatatctagttacatggagctcaaagccaactggaatggaacagaggattattggagcccaaagtttggctattcaggagaccagattaagcatcttatgacagttagtatcattgtgagaactcttggaggacttatcttcatctatggcagcttcttcggagcctttctcttggtactaatatgaacactttatttataggaaagcttgaaacctaatgaaattaaatacgaatacattgaaataattataagaataatatacagctattgtgatatgcatcacttatagatcatatgctttgtgtcttattccaaatcaatatgtttcttgtgggtgcatatagcttatgtaccaaggcattgctacaatggttcatcatgatttctacaatcatcgtttagatactgaagaatttggactgctctatctcaaactcaaaagggtataacgacctatatttcttctttttaaggcactttcagtttctttagctgctcatttgttctttgttttgtctcctggtttgtttgtcagattctgaacgaaacagtgtcgtacaatactgcatacaatctctacaaatcagactttgacgagcagcagatagagcaagtgaaatcaaaattccgtgaggtgcgttattgaggcctacatgtaaatgtaataattgtagcttgtgaacactgtgtgatgattgatttaatgtgttgtgtagcttgcggatcacgcgatgacaaaccctgcattgttcggacataatgagtttcttcgtcggctcttaagcttcgtcaagggattggccgtagtaggagcattgctgtttttcgtggatatgaagtatcgtctcaacaaagccaagaagcaatccaaagttaaaaatgattgaaaactaaaaagccattacaaatgctttatctttatgtgctattgaactagaatcatatatccatcttttgacaatccaacaaatatgttacctttattaatttggtcttgatttgaataatggagctataattaattcatgtagttgaaaagttcaaaatacgaaaagaaaacaatatgactagctaaatttatttattagaagttgtagcagaatataaaattgaccacattagtacaactgtgcacgttctatgctactagctagcatagtcaattacaagcaagtaaacatatttttaatgaccttttcacaaattttcgaaaccaaaaccagacaacacttgataatattatttgttgtaaagctacaaaacgtgagaatcccgatagctatctttaatacattgacttctaaccggttaaaaaagaaaagacatttggtatgtaccaccaacgagtcaccctaactaaaactataattgggaactccgatcaatttttcaaatccctctagtcatcttaaaatataaatttatttcactctataattgagcataatgcaagttcgttctgatccaaaaaaaaaaaaaagttccggtcgttttataaggcaagtcaactttgatagaaactaatttagcattcgcataactgtacattttctttaaaatacacattaaaaaggtttaaacgttcaagtctttattttttatgatgaggatatagacggtctttgatttcaaatattcgaaagtcatttttttttaatatcacaagttgtagtattttaaacaatatgttatttcttgacatagagattatttagtcttttatttatatgtgtttactattcttcttccttttatataatcatataacctatagtttgtatatttcaattattccatcatttaccatttagtcgtctccttggtgatccaaatacttcatcaccttccttcatagcaaattctcttcgtctatctcatacatttaaacaaacatagacatacactaatcaatcttccttaatttaaaaaaaaaacatg

SEQ ID NO: 33293 - DNA, 3000 bp, Unknown; identical to SEQ ID NO: 2463
  misc_feature (1)..( 3000): 2750-1469P.txt file - cDNA_ID_3067932; gDNA_ID_1620539; Annot_ID_159990

SEQ ID NO: 33294 - DNA, 3000 bp, Unknown; identical to SEQ ID NO: 2462
  misc_feature (1)..( 3000): 2750-1469P.txt file - cDNA_ID_3067942; gDNA_ID_1620539; Annot_ID_159986

SEQ ID NO: 33295 - DNA, 3003 bp, Unknown
  misc_feature (1)..( 3003): 2750-1469P.txt file - cDNA_ID_3067946; gDNA_ID_1620539; Annot_ID_159985
gaatctcggttgtcatcgcttcctagtgataagcctaaggccggcttaactaatggaacttactagtgataccataatgcgaaaggtgctaattaagcttgacagtgaagaggattcttatcaagttttggaaaattttaatggagattccttggttgggaagaagtatgaacctttgtttgattacttttagcgatttctcaagtgtgacttttcgactagtagcagatgattatgtcatgaatgatagtggtactggtattgtccattgtgctcctgtctttggtgcagatgactatcgtgtttgtcttgagaacgagataattaagaaggttagatttgacaacatcttccttatatcaccacctttaacattaagtttattttctttcttgtttaagtttacagtatcttcaagaacccatgttcatgacacattttgttcatgtgttgtttagattgtcagagatttcaaacgtccagatggtttgaaagatacagagattgatgcagctgtagatagtacatatcttaattaaaaataccacttctctatgctctattgttgaggaaacatataatatttgcattcgttcatggttcagatatgatgttatggtaattcttgatctacgagaagatgaatctttgaaaaacgaaggtgttgcccgtgaggtaaataaatgtaaccgaagcgattaatggtcatatataagttgtatatttgatatatgggtttccttctcattgtgctcatgcattgaaaagcaccctgttatgactgtggttctaggagaacatttgcatttgacagtcggtgactaattgttaagcaagaagaacgcatgagagccttttaaagtgttttcttctagatcgttgcaaaaagttaaatgtctcttgagactttgtactcattctatagataaagatgggatttattacaaaaacaacaagaaactttgttacttgtggaaattcaaaattatccgaactagcttcacaaaatatgctcaagagtttcaatgtatttttttttgttctgtaattgtatgactccgtttgaagcatcaagattatggttataggtagtgatgctaaaactctctgttgttacagtgaccactaaaaacaccaacaaaaaaaacttaggtaacgtgtcgtctaaaaacttctaggttcaatttctttagatagtactatcaataaataaaataaatatgtacaaaggctttaaacaatgatgtttttcaaagatgattggtagatactaattagagcttcaatataaaagaacacatgcgattctgacattctgtggtctaacatggtttcttctagagtcaaaaccatacaattaaaagttaggaaagtaatagcaatgtggtttcaaatatatactcattactctttagattcatgtatggtgaaggaaacattataataaaatcaaagatcacagttttgtaggtccctcatattaatcaacatcttaaggcgttatacatatcttctttttgtaaatatttgactaattaaaatatctaattagagtattagactaatctcatcaaatatccgactacttgtgtcagttcaaaacacagtgattacgttagattttgtgctcttttgtttataaacaaagctaatttaagaaatatatgatctatttgcctccttggtcttaattttatactttcttggaataaaacacatttattaaaataatttttaggttcctagattcatgtcatgtggcttgatagtttccaacaattataccaatattttactcattcatatacaaataaacaagctttattctattcttcagtctcatgatatacgggattttgataaaattcagagtacccattaattattctatgttacagcttgtaataagttaaatttataaaacgtacaagttgaggaaataacaaatgttttcaatattaaatgatttattaatacattagtgaccaaaaaattattaagtgtaagaaaaaaaacacaactcagaaaaaattcaaaagaccgtctaagttcggttcatgtaagaacaagtgggacctctttaagtttctaaatcagagaataaagaagaagaaaaaatctcaaaaccttcctctaaaaccaacggctcctacctttacttacaccctatacatacacttctctttttatcctccatcggcggcttatggcggttttccggcactaatcatctccggcatatataaataaacgtacttcacgtttttttatataacttcaaagtagtttcagatttgtctctatctcttcacttttaagtcttctggttttgtcatcaccagctttttttgttctgtctctgtctttctctttgtgtatttttattctcgtcatcgttgttcttctatgagaggaagatcggaatgtcgaagagaattagaagattctcgtacatcacttcgttggaatttcacaggtcgatgagagatctgagaactgtttcattttgatccaaactcatctctttcaggtattccaaatttttctttctctgttctttctactattacccaaattaaagttttgatttttatttctcactctgtttcttgtttttctaattgcagagtataatggactaagcattttttttctccgaagatggttaaagaaatagcttcttggttattgatactatcaatggtggtgtttgtttctccggttttagctataaacggcggtggttatccacgatgtaactgcgaagacgaaggaaacagtttctggagtacagagaacattctagaaactcaaagagtaagcgatttcttaatcgcagtagcttatttctcaatccctattgagttactttacttcgtgagttgttccaatgttccattcaaatgggttctctttgagtttatcgccttcattgttctttgtggtatgactcatcttcttcatggttggacttactctgctcatccatttagattaatgatg

SEQ ID NO: 33296 - DNA, 3003 bp, Unknown
  misc_feature (1)..( 3003): 2750-1469P.txt file - cDNA_ID_3067973; gDNA_ID_1620540; Annot_ID_160024
ctaatcatgtatattatcaaattttgaaactaattaagtacgtacgccatccaacaatccaataatgtaaactatataatgttcgcctaaaaaaaagaaatggattagcatatccataagacatggccaaatcatgcatgttacgtatattaaatttgaaactgggatcctggctctagtaagagtggtttataattttatattgggtttagaattccaaattaaatggtcaaattctttcattccaatacaagcagaaacttttatgatagtaaaaagattatgagaagacttatgaggtgttaagaaagtgggagatgtattatgaggaggagagattatgagtatagtaaaaagattatgagaaaaaagattatgacaatagtaaacaagaaggtccatacagtatccatgtttttcaagaaagtgggagatgccaaagtcctggacctaatatttttgttttaagttttgataactaactaattttttttaaatcagacacaaaaataaacatagactgttgatattttagaaaattaagatctattaaaaaaatattgtattttcttatagataaacaaaaaaaactttttttttactaaaagactaatatcaaactgtcctaaggtccctactaattttgggccggtggtcctgacaagtgacaacagtttaatggtccattttgtacttaaaattgagtcaaattagttgcggcaataagagcagagcagtaatgtgttacacccttaaaggacgttagtactgaagcccaaattctttggaggttggttggttggttgatgaagtgcggttttgattaattcacaaatatgacttacttgatgacttttcacaaacatccatctggaaacgctactatttgatgatgtattaacagtagaaagcatattaaaaaaaataaaatctcttattgattaaattatcaagcgtcaaaacgaaataggtctgctttacaagtcaaagaccttcgatacattatctttgagactacttcatagagatttttaaagcagaaagattacaaaatctgaagatcagtagttcagtagagataaactttcactgattcacagattattgcataacaaaaaaaggaaaatgaaagattgtaagaacttgttcacttctttgaagaaactgttgatgaatctggctctttccatgcagcttgccattgtttgtcatataacgtagtctcatcgaacagatccttaagtttgtctaaatcttcattcttacggatgaagagaactccagctacagccacaaacaagagtgttttgcagaagaaatttcccatttgatcaacaagtcctactccggtaagactatcaacaaagtaagccatgaagaaccctatcatcgcagcacgacctacaccaccaagacaacaacttagatgcacaaaatgttaagtgtactatatctaagtgttagatcataagtgttttgaaaatcaccattgagaagttcagcttcaggtagatggtatctcttcatccatgcccaccatggaataatcgaagtatcgaagacaacaagctcgtcgttactcgttgtttccgggttatcttcaagccattttctcctctttgcctctataaaaatacataatcaacacatttacacaacaaacactcctcttcttacacaccactataagaaaccaaagcagaatcttcctaataacaaagcatagacatatatcaagtattcaaagaatctgtactgaactgaagttttaaaaggatctaaccagaaacgataacagaatcccaatcagttttgccatctttctcgaactgtttcagatcccaagttccattaacccacttcgcattctgatatttgattaccgtctcagtactcgaatcagtcgcttcacctccaacggcgccgttttcagaagcggaggagctttcggctggagatttaactggaacttcctctacagccacagaagcaggcttcggaatctccacgacgggggaagtcgtaccattgtcggaggaagctctagggacggagattagagagaaacgcttggtggagagaagagaggttgagatcttggggatgagattagggttctgaagtgaggaagagatcggcggagagaataacgccatggatatagacatttttttgttaagatctctctctctctctctctctctctttgtctctctcgatctcctctgctctgagttttttttttttttgcagagttagtttgaatgtgtggtttgaaatgagctatgaaggaagtgaaagagatgttgttatcgttagaaacttggattgtatgtcgttttccttttttaattcagtttaaggaagaaactacgtgatgttttctgtaagcaaaaatagaaagataaacgagactgttaatgggctttgcgatcagcccatatagaactagaattcaaaacctgacatttaaccatactctcgacccatgatttacgaattgactagacgatatgaaaatgtccttggtcttttctttattagtttgttaaacttttgatgcaactgaaaataatagagaaagattatagaaaagtctttgtaaattaataaatactgttatccaaaatactttatcacaaaactaaaacaaatttattcctaagcttaaacaataatatgtaaactaagtgaaaaatccacgtggatgattcttattggttagatgacgatttagatatttcatttgcttcgcggcaaagtttcaactcattacgacgacgacgatctcaacgttcaagaagtttccagaactacccttctccgtgtttaatgcccctacacgtgtagcgaatgcgtaataactacacataagcagtaagggtattattgtcaatttagtccccaatcataaggcccattataaataacgaaagtctttattttctaactaatattttcattaatcgattctcaaagtcaagcaaaaaaaacgaaacaatg

SEQ ID NO: 33297 - DNA, 3000 bp, Unknown; identical to SEQ ID NO: 2465
  misc_feature (1)..( 3000): 2750-1469P.txt file - cDNA_ID_3067976; gDNA_ID_1620540; Annot_ID_160023

SEQ ID NO: 33298 - DNA, 3000 bp, Unknown
  misc_feature (1)..( 3000): 2750-1469P.txt file - cDNA_ID_3067979; gDNA_ID_1620540; Annot_ID_160019
aaagaactcaagcggattcagacattccatgctgtggagtgattctctctaatccccctgtacggcgacgcttttacatatcctccatgttctttgactacaaaagccaagtttgaggatcatttagttgaaactcaagagttcagacaagaatcatttgtatgaaactcaagagttgataccaaaaagaaatttctcacggaagatgacacttcccctggcacaatctagatgagcgtgatagtgggacgttgtccatatctaaaaaaagaaaaatggcatggtatagagaatcccggaaatacggagaagaggttaatctgttgtataaccgcagattcgacctcggattagtactgtattgtactctataattgcgcttaactcgcaagtttatgttcatggttttttttttccttttaactctgtgtgtgcacttatcctccatactatgggtgtgattggtaacatgagttaccatgagttatatatgcttgcacaagtgatctatcttctacacctagccacatacgtttatgttaatggtacaccttaaaaatttgtgtattataatggaagaaaaacttagttcatgtctatgttcaaacttccaaaaaagaatattggaattttggttttccctttactatttcatgattatatttgcccaaaaaacaattcttatcatcgcaccgctttactattctgggccatataatttgaaccaattctattagtgtacatagagatttgatgaataatctctcaaccaaaacttaacatgacgttgtgttggtgtttggacttgtaatccgatgatagcactctctatcatatgatatatataactctgcaggtaacgagagagagagagaggagagatcatatcttacatatccaattagtcttcatcaaagtacttatcttcagcgtcacggccaatctctcgaagccaatgatcatcaagagtctcgtcattgtctatctttgcgtaatccaaatgttgatgatcttctcccgataagaacttctgttccatgattgatgtgaactgatccatcatatcttgcatctcctctggcggtaagactgttgttgccttctctttctgttctttaccattcagacttgaagagctagcttctgtaggattcttcgcttcttcatcttcttcttcttcctcctcttctgattcctcctcttcctcttcttctgattcctccatcttctcattaccaacccaatcactctctgaaacacctaacctctgctgctcctctctaatacgagtaaccaacaccgcttcctcagcccgtctcatcaaagtctcagaccaacgttctccaggcctagccatgttccttcccatcacatcctgaaacttcccaacatactcatgatgtagatacggctctctatctctcatagcatcctctgagaaatactgtccctcggatacaagcttattcaaataagccaatctcctattcctcacagctacagacctcgatttaatctcttctgaagtcggacttatcttcttccgcaggtttttcaaatgccaatcaacctcgtagtcatgtttcatagcatcaaactcaagcaattcatctactagtagctccgatccatatctctctgaaatcatcaaagcaaaaacaactaatgcttcagttcccaaatcatatttaataaaaaagtttcattctaataacattacacactcaatacttagatgattatgaagccaaaactcatctatctactaacctatgaactaacctaaggactaaaaacttaacctaatgaatcaatagtttcaccaagtacttaattaaggactaaaaactcagtaacacatccaatcatacttagacaaaattgaaattagaatcgaggaattggagcagaataatggaaagtacctagaaaaacggcgggatcacgacggaggaggtcgaggaggatggatttgcgttggtcggaagatgcagcggttaattggacggcgcgtggaaaatagagattgtcgagagaagagagtctctccgttatatcttccgccgccgtgcctttcattgttgttgcttccatctccatcgtcttcttcttctcttccattgttctcctctctcggactcgaccgactgactaaagaaagatgtaaatcgtctcgttcatgtgctggtcacgtgacaagactttgccggtgttcatcacctgttgggctttcttgggccatttaaaccactaattgatgttttggatgatgaattggttaaaagacaaatcggtcatttttaaaacaaattacagcaagaaaaactgaaagattatcaaaaaaaaatctaataatatacgtgacatgaaagattatcattagtaaactgtaaaaaaaaatcttaaaatattgtaataatgtatgtgccaactatgttattaaaaagacaaaagaaataatacaaaattttttattcttttatgtaagtaatttatgtctatcttgttaagtgagcatatttctaaaaacaaatgtgggcaacattggcaaaatggcaattaaagaaacaagagcggtcgttgctgtgcagtgaaatgctacgtgttgaaccagaagttagtggttagttcgattcgacccatctctcccactactttctctctagtggctagcttagctaccgattcactccctcgtctccgggagctctttatttctctatttcccattttacccctataattttttttcaaatcaaaaattaaacggtgaccaaaaaataaaataataatctttctctgtacgaaacagactagttgcgaaacgcgaaagaacaagattcgacaaaagctaaaaataaaataaaagaagaagcaaaaccctagagctcaaggtaatcgccgtcgatttctcaatctctcaccggcgattacatgccgatgaaagttgtacaatagctgctgtaagagagagatttatcaggtatttttagaatcatg

SEQ ID NO: 33299 - DNA, 3000 bp, Unknown
  misc_feature (1)..( 3000): 2750-1469P.txt file - cDNA_ID_3068009; gDNA_ID_1620542; Annot_ID_160054
tgtagctaagaatcaggatttgttttggtaagaagctaaggatcaggatttgatgaaaagaaaaagctataatgtagccgaacttaggcagaaaggggaatacttattgtttgttagtgaattagtatattagataccatcagaaaccaagttatctcaaaagaactccaattctaaaaagactactctgtttcaaaaatatagatgttttagattaaggcacaaagtttaagaaaataattattttgagttttttaacattaaaacataaattaatatctattaaaaatattttgaccaatgatataatttattgcagaatataaacaatcatatagctgtttaatttaatatttttgcatagaaacttgaattgttttttcgaaacatcagatattatgaacaaaaaaaaatctaaaacatactataatctgttatttatgggtggactagacccacttttgagtaatgtgggggcacttgcacctagtaatataaatactgttttacactagccaaagtattcaaagtggcaaaatggtttgacatacaccctaataatccatgaggtaccaagtttgatttcttgttctagcaatttgcacccgctaacattttaatggcgtctctagggctagctataagctctaatgagtaattagttttattgtctgatttgttgacgcatcctggaaatctccagatcaaaatgttggcatcggtttgtcgcttcataggaggaagtgaacacatctttttaaagtatatatatgatgcaagtggaaccgattcactccccattgaaagctaaactctaagcttaagaatggtagtgcaccaacttcggagcctaggatatactcaagtaacattatgttggggctctacaacctaattttatactatatgaaatgatacaaagtagaaaaagcagcgactacaaagaagaatgttgacatcattacctctcaacatatgtatgtgacatcttttagatgtagttaatgcatgattttaacttcctctatctcactagaagtgtaaacttagtcaatagcatccatataccttaacaaaaagagcttatactcaatgtaatccgtagtatcttggaacaaactttgtaaatacttatctaatgaatttaccttctttgacgacaaaaagaagaaggaacattgtaagtttgtaacttcaaacgtagagaagaagacgcattttttctctataaaacaacaaaaagattaagaaaacaaaaattagaacattttataatttaagtcgaaggctaatgatttggattggccggggatgagaggcacataaacaaaaagtaggtattctttcgatgactttttattttaaaatgagatatattccaataatatcatcattgttaattctctcgatctcgctaaataatacaaagaataataaactagatggtgttggccggtggggaatcatgattcatgagtaatttatataatataccgacctgttatgagatataattaataatcaatatataacttttaaaataatgagggaaaaaacggtatggttgtgtttgtgtatcctctataatcggatttgcagcagcaagcacgtgaaaaccagcagaggcagtccaaatctagacccgaggaaacaaacattactgattccgataatgtcttttggattttcttgagttcaatagtatatgattatttttttatataagttatttcatatagcttacatattacaattattaattatacgttcgtaacttagctattaattttaaataagtttacatattattaaacttggcgggtaatgtggtgttaaataagtaaaataaagtagttgattttatataccgcatatattttggagatagtcagaagttgttaattagacagataacttttcaaataaatatatcataaaaattacttataaaacaaaagttttacggcaaatgcatgcatattgaatcattgtaataaagaaatgcatattgaattatgaaaggaaataaaagtttttatcgacggtaaagtataacgaaaaaatattaatattaatctagtaacaatctcaaacttatgaattaataatcgaaattgttttagcttatcaaaaaagtacatggtttttcacgaaacaaactatgagcacatcattttcaaaaaaaaaataaaaaaaaatctaaactaaacaaccatgatatgtatataatgttgagagacgcgtaaactatatataaatacaatcgaatttacacaaaactattcatgaacaattttcactcaaacaatatatgagaaattttactgaactaaaaatttaactttttatcaatagtctggcatagttataggtcgatgatataaaggagtctaaatgtctaattcaagttgtttaccaacgaaaaaggagtcttaaagtgaaaaagttattaaaataaataaataataactatatacatataaggaagatgtgttgagtaccaaattaaaggacccataaatcaacgtgaagtacttataaacattatcattcaccgagtagcacttggtccagtaacgtatgatcccgccaaatgaatgaaaagtcgtgtttccttgaaatgctagtttcggtccaaaggaatgtatgtccctaggatccgaaatctcttagatattcagaaaaatgaaaataacattcataaagaatttcaacttgagaattacacacgcatatattaatatgtatataattaaaattgtaattttcaagaatgatttgagtaagaggaagatgtataatgatttcagttcccactagtcgttgcatgtgccatctctaccttcttgtcccacttacccactattctgctttcaactctgtctctttctctctctctcattctttctttcttaaccaaatccatgacttaaaaatgcagagcaaccacatcataagtcttcataccttcggattcttcaatctcttctacacatcatg

SEQ ID NO: 33300 - DNA, 3003 bp, Unknown
  misc_feature (1)..( 3003): 2750-1469P.txt file - cDNA_ID_3068013; gDNA_ID_1620542; Annot_ID_160059
ccaaagttcatgacagtccacttgggaatcctctgcctatcagagcagctaagacagaattggtactgcctagagtttataataacttttcagtgggaacgcgagtgcaagttctaatcaatcgtcatcaacgatggctagtcaattttacagctgatgtgtaaactcatattataagcaattttcatgggatactggcatatctaagagacacaccagacgtctaagagtgaaaaatatttcatttttctaggcatgtctgcatttcctaagcactttatttttctagcacaactttagaaaaaggctgaaaatttcggagaaaagtgtttgtcaagatagtctacctggaccatgagattaaaccggtgggcactggatgtaagcttattctgaaatgctgtactagcatgacgactaccagcaggaggacttgtcagtacccaatcatctgcagcagccatagctgcagtgttttcttcaattcgcttaagatttgcctccaatgcctgttccacaataggcttaaagtgctttaaaagcactgggcaaagggacaaaccacgagcttccaacaaagaacaatgcccaagagctatctgtgcacactctgcggcagctcttagtcctcccgctgctgcagaagaagctaatgcatgccttttaacaagaagggaaaacgcctctgtttgcttagtagcccaagtcacaagttcagaactatatgctggctctttcccaaagattcccaatgagtcactagaagcttgagagatagctgagaacacaagctgagaaagtgcagcagtgtacgcccctccatatgaggtgctagaaggacgaagactttgcatgttgtattgatatctctggaaatgggcatcaagaagtacagtatgggctcgaggaccatcgccaagccttttgagagctgctatggctgaccgaagttccccacctcgagttgaaggttgacaagcagccttggcaagttggtcagctaatttttgcttgcgttcggcaatagcaaactgaagagatgaaagtacagaagagcttaaagtatgcttttcgtttgcttgagatactaaaatttctccctcatcaaaagctgccagagcttcatccacccttctttcagctaataaagcatcaaggtggtcaggaaattccgtagcccatttctccagatcagagaggccgttgtcctcaaaattcaataaaccattcgcaagagattcatcagaaactttatcgtcatcaatgttaactccatctgctaagccatggattagagtcgcctgagtggagagaagatttctgatagatgatagctccccctcaagatctgatatctctttagatgtgctgcacagaacagaaaaaagtttaattttcaaaataacacaccgccaagaaaaaacaataaggtagtgcgaggaaaaagaagtcatatgcaaaacgcaaatgcaccaatacccacaagaaatgaaataacttgaaaaagtagagctttattatcacatcaacttcaaagaaaataaccaagcactaaaaacagacaggatatcagctaaccgtataaaggctggataattagcataaacacttcgccgcatttcttcagcagatgctctcttcaaatccaatagatacgagcataactgctttatatcctgtgaaccgaacagaaatatgtcatcatcccaaaataactgagaaaaaacaaagagtccagccaagtaatccaacaatctatgttaaccaaatcaaacactactctttttgtagtaaactctagaaggcctaaactaacttttccctcagctctctcacaccatcacagaaagtgactacacagacgagacaccctttatacccaataccataaccgaattgaatcttttctgtaacagaaaacgagaacaacagattctgtctctgatacaagacatagtcatccatgtatattcacatgagctacattctgtattacactgaacacatcatttggcaagctaaaagcttataaatgggtactaaacctatcagcatttcttaagagtaacatttttacataatcataattcacaaactgccttcaaactccagaagatcacaagaacaaccatacaagcaatgagtattgttacattgctcatcatcttctcgagcgtataaaatctgctgctacctaatatccattccacaattacgatttcctacagctaaaacgaaatgcaacaaaacaagaacactgcgatgatacaatcccaaatctacgaacaagtccccacagactcagtcctagaaaattctcactcgtgataacaacaaatcaacgagaataagaacacgaaatgataaaagaacagaaaaaaaccttctcgttgatagaacatttggattgcacataagcatcagcatcgaacttatcagacttgaacagactcaatccttcctcgactctgacaccattttccttcgtcggcgtagcttttgatctggccgtcttcgccgccatcgttaaacttgcctgtcttctcagagaaaacctaaaatttcacagcggttccagatcagcaatcccagtgatgccggtaatgttaccggagaattaagcacagatctgagggagctcctagatacggagagcagatagagaaagtgggtagaagaagatgatgatcgagttggcaaccagagcgatttagccaacgacggtagcttggctttttcgtctgcttaaacaaacgaattttcttgttgaaaactaataaataaaataacgactctgggttttttttactggattttttactagtaaacggcaaaacagaaaccctctcatttgcacggaggctttcctttatccttcacctctgccatcacttgagctaaaccgacgccgttttaaagaatgcttactttaagattgccgttaatgtaaatctgagcaaaaacctttgaagaatcatatcatcgagacaacagagagagatg

SEQ ID NO: 33301 - DNA, 3000 bp, Unknown
  misc_feature (1)..( 3000): 2750-1469P.txt file - cDNA_ID_3068017; gDNA_ID_1620542; Annot_ID_160057
tgaaaattgcttataatatgagtttacacatcagctgtaaaattgactagccatcgttgatgacgattgattagaacttgcactcgcgttcccactgaaaagttattataaactctaggcagtaccaattctgtcttagctgctctgataggcagaggattcccaagtggactgtcatgaactttggatgtatttgtcaagtagatccttttgataatggtattttgttgcaggacttctttgaggacgtaggacctctgctaagtatgcaattgggaagtaaagctctggaaggtctgtttcgggtgtttaactcatatgtagatgtgctggtaagagcacttcctggttcgatagaagaagaagatccaaattttgaaagttcatgtaataagattgtccaaatggctgagacggaggcaaaccaacttgcattactcgcaaatgcatcattgctagcggatgaattacttccacgtgctgccatgaaactctctcttgatcagactggtcagaggacagacgacctaaggagacctttggacagacaaaatcgtaatcctgaacaacgagaatggaagaggcgtttacttagtactgttgacaagttaaaagatgcgttttgtcgccagcatgccttggatctcatttttactgaggaaggagatagccatctgtctgcggatatgtacgtaaacatagatgaaaatggcgaggatgtggacttctttccatctctgatattccaggtagttgttgtttcatttccatcagtccagttagcctttatgaagtactgtacccagatgtgtagtcacttgggaactcttatcggcagattggatactgtagagttgaatccatgtttgtcatagtctactgtccacttcaagaacatgatttttttctgtcttttttagcttaatattcttatactttgggtgttgcgtcgttggaaaacaggaactttttgccaaacttaacaggatggcaagtctagcagcagatatgtttgtaggaagagaaagattcgccatatctttgttgatgcgattaacagagactgtgatcttatggctttctggagaccagagcttttgggatgacattgaggaaggtcctcgacctttgggacctcttggcctacggcaggtttgtacactcattcttgcttctgtatatgtatattcagcgagcatcgaaattgttgtgtacctttgttaacaaacaacctgcatctgtcacagctgtatttggacatgaagtttgtcatatgctttgcatcccaaggtcgctacctatcgaggaatttgcacaggggaactaatgagataatatctaaagccttagcagctttcaccgcaacagggatagatccatataggtacatcggttttgagggtgttttgcaatgttttagcctttatggtaagtataaatgattaaaatgtggttgtgaatgatgtgcagtgagctgccagaagacgattggttcaatgacatatgtgtggatgcgatggaaagattgagtggcaagacaaagggcaacaacggggatgtccacagtccgactgcttcagtgtcagctcagtctgtttcatcagcgagatctcatggcagctattgaaaccaaacccatcttacatttgttaagaaggtgaatggtcaataacttttgatcttctcttttcagctctgcttttccaaaagctttctattttgtagagtctccagttgttgatgagatgattttgggggcgtgtaaatgttgttgagttgacatgtttgttttcttgtattggtcctctctctctctcaatggatgcattctttgggttaaaatattgaagagagtgttgatctttcttctctatgatacactctctttctgttttggtattggatcagatgtagcaaacttgaatgagatatcttacgattcactttttgtatttcctactcgaatcatgtagttcatagcgtaaattagttttaagtaaatcgtgttgtgtaaactcctagtctaattcttggtacggtgggtcggatcttgggatgtacaaaagtttgaataatgggtaaggacggttacctaccacatggacccttaaaggcttggtaatttggccacgcatgcccgataaggcaataatcattcgcgaatgaggcttagagatgctagagtcatccctcgccattgatgcaaacacctcctttgcttctctacatgtttgagattcatgttttgacagatgacaaacaaaagtaggtggtgatactcaggctgtgaatggtaaccaaaaccgtatcgcaacagtgctgtaacagtatcaaaatctttacatatacatatgtatctatgtattttcgttcctatttgaaccgcaccgcacttcttccgcaccgcaaaacgcagtcaccattcggagcctcagaatgtataaaacatggcaaggaagatgtgatgttgatagctctatggtagatttcaggtaatgacttttccaatgataattccaagtgatagtagtctataatcacgtgggaggaggcacaatcagactacattactgaacattttgatttcagcttacttaccattcacatgttatgagctgaatctgatatttaattaacaaaatttgcctcgttacaaaaatcgaattatcagggtgcaaaacacaacaatttattcaatagattatttctattatgtagcttaaaatattttatttttttggtgagaaagtaacttaaagtattttaaatgtctagtttgatcagaatttttattttattttgtcagatatacactgtgggactaaaaagaataaaagaagagataaatataataataaaatattggaggtgaatttgtttgtggaacaactggtttcgcttcttcttctacagagcttccctcgtttcctccgccggagagacactccattaaaatcccttcttcatcgatccttcattagatttacaacaacaacaatg

SEQ ID NO: 33302 - DNA, 3003 bp, Unknown
  misc_feature (1)..( 3003): 2750-1469P.txt file - cDNA_ID_3068046; gDNA_ID_1620543; Annot_ID_160084
caatcaaagatctatttaagaagtttatttataatgtggactctgtggccgtttagaaacataagagaaaacgcaagttgatgagggagcagaagctcaaatgtatgatattttcattgaccagatgaaggatggacaaatggatgaaatcaggctaaacataagaaagagagctcaggacatccaaatattatcactagaaataatttattatgttgtaaatgtaaatcatgtttaaatatttatcatgcatgttgaaggttgttttcgggttttccttatgtgtgttgggttgtttttcttgtttttattttaattgaatttcctctgtatatagtggctcattttcttaacatgaaataaaaaaaatgtgttcatgaaattagaatattttgtgatccttcttacgctgtttagctaattttctttatccttttggtttggaagtgtcaaatggtgatgcatttcgagtttgtgagggtatatttgattgccgtgtttgccaaggtacatcataaggaaaacacggctatgggatcgaccttccgaatctctttgccaaggtactcaaatacatcaccatttgaccatggtggtggacgccatgggatcgaccttccaaatctctttcatttgttcctcttaagtcttaactctattagctttccattatgggtatagttcatatttgtatgcttttaagtttctcaaatctctttcatttgtcagtttttactttttaggactggtttattttgcacccattccaatcgtggggttttaagttttaacccgtaaattatttttttgtttattttgtatttttgatacgaaagcccataaattgtgaagtaaaaaggcccaataggcccataaaattgggagaagagacgatcatcggacaaaccgagaaagtgaaacaacaaagaagaaacctgactcttcagaaactattcaggcgagagagagagagagaaacaattttggacaagaacagaaacgatgtacgttttctgtgatctcaatattagatatagtattccagttaatcggaaacaaagaagcaacaatttgcaaatcacggaggttgaaccactggaggagttggattcagtctggaaggaaatccaagttaaccaacaacacttttagataatcggaacactatattcaatgactattttgattccagagactgttttgcaacccaaacagatcctgatctcaagaatagctaccagagtagctatgaaggcagccgtgtatgatgtatcaagttcttcacatcttcaggttcaaagctagtaaaccatttgagaatccatccctggcaacattctttcctttctaagacattgaatttgatgagctttatacatcttaggtaatgttactgttgcaccagaactttgtgattccggcaataccataatttaggagttgtaattaatcttccttgagatattatgcttgtaaaacacatgtttaataagttattcaagacttttccacaagtcttgttgaacgtttttgaagttgttgagagatatcatagaaaattccaaaaataatgaatcgctagatcaatctatatccaaactgattattaagacccagtcaatacacaaattgctattctagcaaatgtaagtggtgaggtgcaccttaggcttcaaatggccacggcggactgacaaaaccatttgcgggattggatctcttgttgtttaccattcataaactgtagtctgtggaccgaaaaaaaaaaaaatcgccgtagacaaactagctactgattttacatactgtagaaataaatttggtatggagctgacaacatggtttagtccgctccgcccgtaacatccattcaaagccttaacatataacgtagttaacgcgtagagtatttgagtgtatatatgtatcccctaaacacacgtagttgcacgagtgtagcttgtggacactaacagtttcagtccactatcaagttgatcgacaaaacattatgttgacatacatcaatagcttgatcctaccactacaacattgctatgatgtttctccacttcttgttgttgttgttgtccttgctacttgtactctcttagtctcccctagcttggtaataaagttcatcaatagccaaatttaaaggtttggtccttgtaagcttgacacaacacaaattagttacacatcttcttctcatagctcacatttatttatatatgttttgcatacccactcgattattaaataattagttttgaagttctagtcaatatttcatcaaatcatcatcatcatcatcatcactgttgttgtaattagtattagtatatcaagttggaaaatggcttgtcctcatttttccaacgaggcaacgaccatgactttattcaatcttggttgttaaaaaaaacatatcactgcatagttgatgaccacaactatattccacaagtctctctttctgagatctaacgatttgggcaaacaaaatcatattttattctttgtttttgaagtttatagatatttttttttgtaatcaataatgagtgtatttaatacagtagataaataagggtcctactttagtttcgcatcacgacaactcatatgtatactttaatgtattgtttcataaattgttccttcccattactcaattgacatttccatttaacaactcttcccaattgtgaaacctttatatcccattatcagctgttttaagttgaccaagttttttcttatggtcctcttcctattttcttcttttgatatacttttttttttaactctatttgttcaaagtcttcgtcttctttttgttaacattattgtttacatgtttttgaaagagagattataatttttattaagagattcgtcaaacctttgtgtagagcacatgcttttttcttagattattttgagataggatcagaaaacagaggaagtgataagaggttctttttgggtttgaagatg

SEQ ID NO: 33303 - DNA, 3000 bp, Unknown; identical to SEQ ID NO: 2473
  misc_feature (1)..( 3000): 2750-1469P.txt file - cDNA_ID_3068054; gDNA_ID_1620543; Annot_ID_160081

SEQ ID NO: 33304 - DNA, 3000 bp, Unknown; identical to SEQ ID NO: 2472
  misc_feature (1)..( 3000): 2750-1469P.txt file - cDNA_ID_3068058; gDNA_ID_1620543; Annot_ID_160080

SEQ ID NO: 33305 - DNA, 3000 bp, Unknown; identical to SEQ ID NO: 2483
  misc_feature (1)..( 3000): 2750-1469P.txt file - cDNA_ID_3068096; gDNA_ID_1620544; Annot_ID_160118

SEQ ID NO: 33306 - DNA, 3003 bp, Unknown
  misc_feature (1)..( 3003): 2750-1469P.txt file - cDNA_ID_3068100; gDNA_ID_1620544; Annot_ID_160116
cagtggacgtgatgatgggattgatgtttgcattctctgagagagcttccatgcattcctctttgctcatgttaaaggtcaaacatgtctctatcatgtgttgcacctatacataacacatgacacactatcacgtttttatatatatacccttaagaatgtacctaaaagaaactgttccttcatgagaagaaacgcatgcacatgttcgagttattaccagatgaatgtatacagcgggagaagagtgtctcatttctattatatattttgctacaaccacaaataaactcgtatacttagattaaaaggctccactatatatattgacgctcatttatagaagagcttgcaaagaagaacatgaatagtgatgtaaacatgtggcccgaagaccgcacacgtaggagattaattataattggttgagacatgataagaagatattgtaagaaaagtgaaaaaagagagagagaaatttgtaaaaattactcttttatctcctcttctttgtttccatttccaatctatatctcatttttcatccataggtcctatattttttcccaaaataaataaatttattcaatcaattttgctatagccttatctgcggtttattaggtcataaattttaattaatacacaaatctaaataaatatgttatatagatcatagatttaaaaacttttacgggaatttatctatttaataatttacaaatactagttgaaattcaatgttatcttgttaatgatttattactagatttgaaaatccgaaaatacaaagattcaaatccaaagttaaacttttgtatttcaaaatccacatgtctgattttaaaatctatataattttctgggtcccataaagatttatatattcattaacaaataatggtatcatatatagagttacagaataacaacatttgcttcactaaacatgggaaatagatattggattagcaatagactattaaatttttttgagtacataaatgtaatttctaattactgtgtaagcaacattgtttttctgcaaccactacttccgcataccaaaaagcattcaacataaaaggtttccatgaaaactaatataggctgtggtaatgatttaaacatccaaaaggattcagaaaagaaaacaacaataaggatgaaagcttaacgaaatttgcttcaaaatacttaaataaatatctttgggtcgactgtgtaagcagcattaagaatgggtttacccataatttgtccagataaaatcgtcactctaatgtcaaatctctataatagaacccatctaaaactcttctattgagttgtttgatttttcaacccattgtttacaatctcatgtaatttattttaccactttgtgtaggtttgtttaactaagttctttacatgcatctatcatcaaaacgtgctggtacatagctaaccaatccatatatttatgcttaatttctgttagtttttaatagttagttatccggtaatttagtgtgaatgtttttaattgctactataaaatatgttacatcaattattctaaaatatagcttctttttcttttttttttaatataaaacttcattgatcgatccctaactattgatggtactcttcgtctcgttgtcacttttcggatcaatcgatctacgactactggtcaccaacacattttgatctacaaactcctgatcgatcgttttaggccaaacaagtccaataacgcatcaaaacatccaaatctctcacaaacacctagtatatgtaatagactcaaattaaaacaagagaaaaaaaaacgtaaaaaaaactgcaatacgacaaatgattcaaacgaaaactaaacgaaagacttaagacaccaaaaaacaaaacatattagaactattcaaaagaaaatactttaataaatcataaaatttcagaactggaacaaccaaaaccgaaccaaaatttaaaaaaaaatctaatagctggaaccgaatgaaaccgaatcagaaccgatagcaatactcgaacgcccagccatactttttgtataagaactcagataaatgatggatttaaagcattctaagttttaagaaaaaaaatgatggttataacaatattgacatataaaaaaaaaaaaacgccagccgtcaattagagttttgaaatcgcaataataatgttatgcatgaataggaattaggttcacattctttttgtatttgatctgttaatatcatggccgatatagattgaacattttatctaaaatactattatatttgaccatgaaatcatgttgttcattaccactacaacgtttacaaccatattttcactaatcactagttgaattcatatatctaatttgagaaacaaaatatttcaaaaataaaataattttatagatgatccacttatgtattttcaatttgtctatgtattttaactaaactaattaaatcagtataataagcatacatttaatttcatgcaacccgcgatttctaacctagttatcatctaactacgttcataagcccagtcaaattaggattgaaataaatgtacaaaaagtcaaaaagtcttcagtcaattcaaagtcttggtctctcaagttttccatttaataaataagatatttgaattcgaaataacaaaagtctatattatttaacacaataatatatccaaccaatgaagacatacaaaatatcttagttattaataactaaataaataaaaaacacgtcaagccgaccaaactttcctccaaataagaccaaaaaaactcttaacaattccaacaacgttaagaagaaactaaagaaacttcctatttccaatttcttttcaaacaaggactctgtcttttgtctctacttgccctaccactttccttgcaccaacacttgaaaatctcaaatcttgtatatatatcaacaaacaaacacaaattctatatatcattcataacaaaacataaccatg

SEQ ID NO: 33307 - DNA, 3000 bp, Unknown; identical to SEQ ID NO: 2481
  misc_feature (1)..( 3000): 2750-1469P.txt file - cDNA_ID_3068104; gDNA_ID_1620544; Annot_ID_160111

SEQ ID NO: 33308 - DNA, 3000 bp, Unknown; identical to SEQ ID NO: 2485
  misc_feature (1)..( 3000): 2750-1469P.txt file - cDNA_ID_3068108; gDNA_ID_1620544; Annot_ID_160108

SEQ ID NO: 33309 - DNA, 3000 bp, Unknown
  misc_feature (1)..( 3000): 2750-1469P.txt file - cDNA_ID_3068110; gDNA_ID_1620544; Annot_ID_160106
agtttgttatcttttaagttaaagaagattatcgatcgaacaatttacgtccattcattaacaaagaaaaaggacgtttccgaagaacaggaacccaagagaaccatgaaagttgtattctaattttttatataaaaaatcaaaaacattattaattttatttaacattattatatcatatcatctactctattatttgagacgtacgtttagtgaattgggcatggatttcgctaaaattacaactttaccataagtttaaaagtttagtatcataaaaataactcgtttagaaacgcgcggatccttttaactcgccttttaaacaaatgggtcataacttttaatcttggccattcaattaaattgtttttagccgttcgatttcgcgttttcacttaaaaaatacgcggatccttttgacccgggttttaaaatactgggtcatactttataatcttggccattcaattgaattgttttcatccgttcgatttcgcggcttcacttaaaaacacgcggatccttttgacccgtttttaaaaataatggatcatacgttataatcttggccattcaattaaactatttttctccgttcgatttcgcggcttcacttaaaaaaacatgcggatcattttacccggttttaaaaaatcgggtactcgcctctaatcctggccattgaattgaattgtttttagcctttcgaatttcgtatttctcaaaagaaaacacggttctttttatcctgttttaaaaaaatgggattctccgtttaatcgtggccattgaatagatttattaccagccgtccaattttgtagtttcatgcataaattcatccgactatatttcaggaaacgaatcgtattaatttcattcaatttattgcgtatcttcgttttctgccttcaaatatatcacttctccataattatagcacatctaatatttcgtttggatcttcttttggaattatcttacattttccacaagtattccctatatacatccacttttacggaaaatgctaaacattttgctataattatgagatttgtgatatggaataaacttgaattccacacgaataatatcttttgcgcatatttttttgacctaaccacttattcttataaatatcggacgcctcatttcaatctactcactcatcttagactcatacagcttcatatctagttttgatttttttttaaatgatgctcgccaatcctcttccatttactcccttgaaatcgctcaagccttacaagaacgcttggcgtattcaggttaaattgcttcatgtttggaggcaatattctgtaaaggttggtgaatccatcgaaatgattttagttaatgaagttgtacgttttatagtttaaacagtatatttggtccagccttatagtgtgttcaatcatcattttcatatattaattattattcatttatttttgtcatatagggtgataagatgtatgctcctgtgagaagagagcagatcgagaagattgaaaggtgcttaaccgagggtgtttggaagatcattacaaccatcactctaaatcatacaagtggccagtatcgtatttctgacttgaaatacaaaattggttttgttttcaaaaccacggtctctccatgtgataccgttttcgatgctttgtttctctcacttgctaagtttgacgtgatcctctctggatccgctaactcaaatatcttgcatggttagcttcaagttttcattttacttttgaacatacatgcattatctcttatatagtcaatatattcatatatttattctctttgtctatacagatgtaatgggtcaggttgtcgatcggtctgaaatcaaagatcttaacgctaacaacaagtccactaaaaaaatcgatttccatttgagagattagcagtacaaagaatctatattcatattcctttttatttagatgtttattatttatttacttttttactaataaatttattattttcatttaagtgacactcggttggcatgtacactttgggggaagtatgctgagatcgttgaccaaacttgccaggagtcaaccgatggtattgtggtttgcttaatccgatttgcgaagatcaatctctacaacgataattatattgttacgtgttactacatatatattgttttttaaaatatgttcttttatttataaaacagatagtaggagtgttttcaattcttttgatgtttcacaagtcttcgttgatcccacatagactgagttggatctttttaagcaaaagtaattatatttctatttcactaaatatatttgcttctagataaaatttagcaaattatattttctttatatatagcataccaacctattcatatttttttcgttttttttttaattatgagtttgaagtttgaagaaatatattttccaataacttacatcttaatgacatacacgaaaacgtacaaaactactatgtttacacctacatatacaaaatatataattacgtttccaaacgtacataccaactatacacatatattttccatgctacaaaccgaggaaactacatatactaaataaaatatggtttgacgagactaaatatatttagttgataccaataatacatgatatacaactacatattacatataatgaaaatatagtatagtttttgtggaatatacagaactgatatttgatgattaattaaaccaaagatatcgtgtgtagcacggataccgacctaattattcgtattaatttatttttataaccttatatcatcattgttcatattacttaattttatgactaaagtataaaattagaaatacaaaaagtatatcaaagtttatttttctgataaggttagtggaggagtgactcattgattaaagtttagaaataggaatctcaatcactttcattagtttccaatttaacaaatcaaaatcagaagaagaaaaagatg

SEQ ID NO: 33310 - DNA, 3000 bp, Unknown; identical to SEQ ID NO: 2477
  misc_feature (1)..( 3000): 2750-1469P.txt file - cDNA_ID_3068119; gDNA_ID_1620544; Annot_ID_160100

SEQ ID NO: 33311 - DNA, 3000 bp, Unknown
  misc_feature (1)..( 3000): 2750-1469P.txt file - cDNA_ID_3068132; gDNA_ID_1620545; Annot_ID_160140
gtgtacgtacaacattcactaaaccacatttttcaatacatttgacgtgatatggtatagtaattattagagagaagagtttgtagcaaacctagcaagtcccatggatcaacattgcaagaacggagctcagggagatcgaagtccattggacggtggaggaccttcttggcgagatactcgaacacaagatcttcatcatcgggatcgaaccgaaacccgggagggagtctcatgcttcttccgttcatggcaaatctctgcgcagaaatgtccattgctttcttatgagtatcctttgtgtttggtttaggttgtttatatatacttatgagtgtgtcacctttagtttggcaaaagcggattctgcttttcctttagatactttttacgtactactattaatttcaagagataaatagataaaaaaaaattgataactgcaaattcagagatcgtagattggtttcatttttgtttatttaaatgcgaggatcatcataacaaattgtggtgcatgtacccatgcagtcaacgttgttaaggttttgaatatagcgagtattcaaaaatatctttatttttttggtaaagataatctagttcctttttcgttttcctgggcaaaggtaattatttattttttcaaccaaaacgaaataaacaagatttaagttccaaaagcctagatccacgctgattcattaccatataagtacattcaacatcaataactaaaacgagcacatttctaacaattggcccagaactaattttaacatgcatttgaaattttatttttcataagccgatcggttagcccaggtaaaaatacacgtaagtgtttagagtggatttaaacccgaaaaattaccacagtgtttattccaaatctgaaatgttttcacaccgaaaaagaaaacaaacctttatgttagggaccttacacatgtttagggactagtgtatatatcatccatgtaaaaatatccatgcgaccctttttttttcttatagtaatgtcggaatgatatacgaattatagatatgaatgtacataaataagcgaaagttttggacgtacgttcaacctataattttgtagtaaaatcatttcttggtataaatttatacgtggaaaaggaaaacttatatcatcgaggaatcaaaattttctttgtctttatcatttggcaagtgaaataataatgtcgggatacaatacatttttaaaacaataaatttaagtaaatatgcataagcaatgattaagaaataagaaaaatataagaaagtatattcagaaaacaaaagtgaatttgaaagagagtccaagtcgatcccaacttaaagatttgagaagctgacttaacgagtaagttattagatgttggtctgactcaattttctactctcatgcacttctttaatttcaattattttagataaattattgtatatatgtgtgtctttggactggtgacttgccttttatccttcctttttttccttggatcaataaagctcccaaagcccccaccaaaccaaagttgttccaattttttgcttcaactttccagcatcagcctttgatttttacaaatagcattttaggtttagtcctctttgtataatgttatgttttatacactagaaataaaggttacataatttgtctttcgaaagactaagaaaagaaaatgaaatggattaaagatgattgtttcattgttaaggaatcgagattagtttaattggttggaacttggaagagagtattcatcagctttcttttgctgaatcttaattcgaatgcaacatgactagcttatatttgataaatattttaaattgttaacatctagctttaattctagtccaaaatttctctatataattttcatgtgttgaaagtaggcaaagctctatttgttttatattcataaaggatatagaaaaagctttaaatttgtcaatttagaatcatatgtcttactcctcccacgcagcattttggatttggtacttttcttcacctcgaagatgttggctttccatttcctttatttgtttgttttcaatcttctttttactttagattttgatgatttagcgacatttcttaagcaacgacatacataaatgaaaagtttcatttctttataacttagtgttgtcaattgatggttgatattgatatggtacaagcaccatcttcatgttcaattattctttttaaccatacatacacttgaacgtaattttttgattggttctccaatgcaaaaagaaaatagttttaaaataatgtctttgaatctagttctaattgaatgggtttaccaaagcatactaagttagtcaagtaagttacttttctttcctttttttttttttttttgaataccaggaggttttgggacgaagcccgtaattcccttaggtccgaaatttgttccaagcgtcactcgaaccgacgacctctaaactttaaagttaatcacaatggagattgtaacattttgattatcttggagcaaatgaattcttagaagaatatttgatatacaccaccaaaaaaatacatgaactagtcaacaaatagctgggtgaaccgccagttcccggttccatcagagttttaaaaagtccggttttatgactagtttagacccaaatgtgcctgctggttccctattaaaccggtcgggtccgggtttaaaatcactgagtctacccaccctatatatccgtacactcggcccagatcatgatccatatttaaatcaaacttttacatatttgatctcaatatgattatttaactgttgggcttttaatgggggttttggcccaataagtaagtaagcggcgtctcttgaactttattgtagccttttggggtttttgagaaaagtttttagggttttcagtcgctgagaacaattttcttctccttcttcttcttcaagcagagacgctctcagctcaccagacatg

SEQ ID NO: 33312 - DNA, 3000 bp, Unknown
  misc_feature (1)..( 3000): 2750-1469P.txt file - cDNA_ID_3068139; gDNA_ID_1620545; Annot_ID_160136
gtggctttcatccttgtgaggcagtcggtattgacgctacaaatcaccacgtgatatttcctcttgttttatcctcacttacacagttctgataatcattttttagaagtttactaatcctgaaattgctctagatcaaacacatttaaccgtagaattctctcaaaacagttgaccggaaaaataagcgcaattttgtgatatggttgtcaaatcaacttttttaaatctctttgtatgcaccaccatatttctgaaatagaaatattacaacaaatttcaaaaataaaacatcaattatatttattggagccttatctccaagaggtctctccatgaagttttttttcttgacattctaatgagtacagcggattaagaatgcttaggattaccagatatccatatttcaccaaatattctttcatttttttttgtaaattcccaacaaatctcattatgtttatatcctttgctaggatatggactaaacatgtcccttttttttaggccaaagactaaacatgttcttattccattctttttgctttatcaattaatcttcaaaaaatatttacaaagtaaaaataaaagctaaatataatcatggtttaaattttgagaattaatattattttaattgattttcaattacaaacgtatcacacgaattctaatctagttgcatgaaaagtctaaaatgttttactcccatgcatgtacaatatttagagactccatgtagaatatatatatccaattcaaattatgatttgagtttgataaaaacaaacaacaatacatgaaagttgaaatatttaaaatatatttaaacaaaccattttttaatacacccctttttggtttagaaaattaccactaaaattgtaaagttaagaaaacaaaaagcacaacaatttgtgctttaagtagtgttcattttaaaaattttgcttatctttttgataccctttctaaaacacaagtttatggtaccttttaataaataacataaaaacctgataattttatttaagaatgacttgtaaaactaaataaaacaaaactgtatgcgaatcacacgtattttattagatatccgaaatttctgcaagtgatttttttcttctaaattgaaaagaaaatagtgaccaattactttagccagctcaaatagatatatattcccaataaaattagtttatatgaaaatataactgtacgttttaaaaatatatatataacttcttcttttttttagaacaattaactttacattttctttgtcacaaactagtcgataaagttatggaaggtggaagcatagattaataagagattaataaatatataaataaaaggttagggagataatttgctttgatacattatcgactagtttgtgataaatttagataacacgaaaagtagccaagtggaacatccagaagtatgacgttgaatcctacctatacccacacgacagtcacgttattaagataaaacgcaatacaactctattcttattttctttcgtgatttttatatcgtaaaaccaaatatacaaaaagtgaaaaataccatttaccatttatatttttctttataatcgtttcttcttaaattttttaatttttagtggttatgatcactttatagtgtgatgaatttctttctgtctcaatgaaatatttgaaaaacattacccactcattaatgcaattaatcataattagattgtttatttgacaaagaaaaaaactaggaagcttataagaaatcagataaagagataaacacaaatgtgactttaagagtaataataaattagttacggacctaactttggctgccaaatcatagagtataatggtgctcataaacaacataaaatatggtacacgtggtgcagactcaatgaaaaatgttcatgttgactggtataatgaacaaaaggagcgatcacggttaggatttttgatgcttgtacctgctgttggaccgcctaatgcaacttcgatgtgacttcttctctttagatatgttttgatactatgaacttctttgttgtgtctcaacataaatcatattccctattaattaagaaatttgatatggctaatgattctttggatacacatataatatacattttgttgcaagtcatataaacaattacaacactggagtgcttaaattcgtttatgtgggataaactttttattttagtctcaaatttaaaattacttaatatcagtttcggcaatatattttgattggcttaaaaggtatttagggaatcatttggctcgactctctcccgattaactatttgagaatcattactttaaaaggtgactaatactaattaaaggcgtataatgatctatatttatttttgtcaaaagtataatgatctatattacttaaatggtactagaaagctaacagcgatcaggagcttcttggttacctctaaataataagtgaccactcgttcaatggctttctaaagaaacctctatcgaccgttctttaaattttcttttcggttttacagaaaatctttgttaaagctcattagtatgaatacgatattaatatataaatctaggtttggcataaaaagtttgatactaacgtaacagacgccaagagtgcataccacataaaagtttcatatattttccatttaaaagaatacatcaattagaaatatctgagaccaataatgtgacacgtccttctcgatgtcgtcttaaacgtattaacattgcatactttcacatgtgaaccctctatatatatcttccatctttggcattgtaaattcatagctaaaactcacaaactagagcttcaagagttagaagaggcttcaagagctctatctctctcttaatttctcttggcctttgatactttttcccgctcataagttttttcgatagtccgaccaaacaaagggagagaaaactaatcaagaaacatcaagaaatg

SEQ ID NO: 33313 - DNA, 3000 bp, Unknown
  misc_feature (1)..( 3000): 2750-1469P.txt file - cDNA_ID_3068143; gDNA_ID_1620545; Annot_ID_160135
acgttgaatcctacctatacccacacgacagtcacgttattaagataaaacgcaatacaactctattcttattttctttcgtgatttttatatcgtaaaaccaaatatacaaaaagtgaaaaataccatttaccatttatatttttctttataatcgtttcttcttaaattttttaatttttagtggttatgatcactttatagtgtgatgaatttctttctgtctcaatgaaatatttgaaaaacattacccactcattaatgcaattaatcataattagattgtttatttgacaaagaaaaaaactaggaagcttataagaaatcagataaagagataaacacaaatgtgactttaagagtaataataaattagttacggacctaactttggctgccaaatcatagagtataatggtgctcataaacaacataaaatatggtacacgtggtgcagactcaatgaaaaatgttcatgttgactggtataatgaacaaaaggagcgatcacggttaggatttttgatgcttgtacctgctgttggaccgcctaatgcaacttcgatgtgacttcttctctttagatatgttttgatactatgaacttctttgttgtgtctcaacataaatcatattccctattaattaagaaatttgatatggctaatgattctttggatacacatataatatacattttgttgcaagtcatataaacaattacaacactggagtgcttaaattcgtttatgtgggataaactttttattttagtctcaaatttaaaattacttaatatcagtttcggcaatatattttgattggcttaaaaggtatttagggaatcatttggctcgactctctcccgattaactatttgagaatcattactttaaaaggtgactaatactaattaaaggcgtataatgatctatatttatttttgtcaaaagtataatgatctatattacttaaatggtactagaaagctaacagcgatcaggagcttcttggttacctctaaataataagtgaccactcgttcaatggctttctaaagaaacctctatcgaccgttctttaaattttcttttcggttttacagaaaatctttgttaaagctcattagtatgaatacgatattaatatataaatctaggtttggcataaaaagtttgatactaacgtaacagacgccaagagtgcataccacataaaagtttcatatattttccatttaaaagaatacatcaattagaaatatctgagaccaataatgtgacacgtccttctcgatgtcgtcttaaacgtattaacattgcatactttcacatgtgaaccctctatatatatcttccatctttggcattgtaaattcatagctaaaactcacaaactagagcttcaagagttagaagaggcttcaagagctctatctctctcttaatttctcttggcctttgatactttttcccgctcataagttttttcgatagtccgaccaaacaaagggagagaaaactaatcaagaaacatcaagaaatggctctaactaacaatttatgggcatttgtgtttggaatcttgggtacgtgcacatacataagcatttataaaagaaaccatcatatatactagtaaactctaccaacactttgaattacgttttaagactcataatgtttactacgctgtaaatttgcaggtaacatcatatcattcgtcgtgttcttggccccagtgtaagcatcaacacgcccttacaaagtctctcctttttatttgtcgattaattgtttagagataattaaacgtttctttgatattatctaggcccacttttgtaaggatatgcaagaagaaatcaaccgaaggttttcagtctctaccctatgtttcagcactttttagcgcgatgctttggatttactacgctatgcaaaaagatggcacagcctttcttctcatcaccataaacgcttttggatgcgtcatcgaaaccatctacatcgtcctctttgtctcctatgctaacaagaaaactagagtatgttgaaacacccttttttatacatatatataattttatcgtaactttcacgttgatcataattacacatgcacacataaacatatgtaaatgcttttgtatccggtttgctgataactacatccttgaaacgatgttacagatatccactttgaaagttcttggtctcttgaactttttgggatttgccgccattgttcttgtctgcgagctcttaaccaaaggttcaacacgtgagaaagttctcggagggatttgcgttggattttccgtcagtgttttcgcagctcctttgagtatcatggtacgttttatttatatttctagacgtgcatatatataggaacatttatatatacgaacgagcaatattttacgttacatgacctacgaagaacataataaataaatattcctataattaatgtatgttgtgtcttgtctctcctttcctatttagttttttgcacgttgggaaatattaaaatagttaaaaactactaattttggtgcagagagtggtggtacgaacaagaagtgtggagtttatgcctttctctttatcgttgtttcttacaattagcgccgtcacgtggctcttctacggtctcgctattaaagacttctacgttgccgtgagtttatttatacaattctcaaataattctcttattttattctgtttcgattatttcaaaatatattataaaggacagcacaacattatatgattagattaattattatgggtggttctttaataaagtaaaaacagtagttacctttgtcttttttttcctcattcaaactatatgattttgaaccgtacacatttttcgctttattattagcattatataaataattggacccccactaaatgtgctaaggaattgagagtacaatagcaaatactagaaacaaaaaaactaatttgttatgttgtgatg

SEQ ID NO: 33314 - DNA, 3003 bp, Unknown
  misc_feature (1)..( 3003): 2750-1469P.txt file - cDNA_ID_3068150; gDNA_ID_1620546; Annot_ID_160161
aatatgagtagaaacctcctcgtttcatcgccatcttcgttaggagacaaagccatagcagagtcccaaaacttttgcatcattgagtttgctgtctcattgtttattccagccgtacttccagccttgtcaaaaggaaataaagagtttatagcaaaacaagaatagtatgcaacaaatatatcatgttctttcttctctcggattgtttatcgatcttgtctcatgttttcgacttcaactagaagagaataatagaagaaaaaaagtgtaccgtagtaacagcagcatgagttatgtggatcacatcaataacagcgacaacatctccatctgtatgtaatcatcaacattagacaagtgttgaaataacaatgcttcatactttatagctcaaagtcagttttgaggacattttgttacctttatccaatacaggaagatgcagaaatttgccattatgcatgatatgtaaggcttcaacaattgccatatcaactgttgcagattctggattcggtgtcataacctatagaataatgggattgaaaagaaacaacaaagacgaaaaatgagtactcatataaatctaagagttgaaaagaataatttcaaccagattcaaaactaacgagcataagcatacatacatatatagcgaaaacacgaacttaacgaaaactttaccttctccacagtagttgtctcttgaggaaggttttgggatatcacccgcatcaagatgtcctttgagctaacaaaaatcacaatttaagatcaaagttccactagaaaagattaaaacatgatattgtagagaaaaaatttcagaaccatagaaacgaaaaagaagacaaggggccaaatatgacacttacgttagaatcccaactaatttgttctccaccatcaccatggctgcgctagactgatattccaccatcttcatggttactcctaacacagtctcatccaatccaacctttaaaaccctgtacgttttcattccaaatttactcgttaagctttgcattatttctctcaataaaacaagtataagatcaaaatgatttcaaatatgataataaatatagaggagatattacctactttgtattctccggaattatagttgaaagtgaaggcttgaatattcgttctctaagtgtctccataaaagtgtttggtcctatcgtatatccaacaaaaacgccatcagaggcatgcaagaagacatttgtgatggattcaaatggagatactcaattccatatttttaaacataccagcaatagatgttccccagttcttttcaacgccttcaacagccgcagcaatagccttacccttctcaactgatctttccatgcgggcaatagcatcatacaaacactttgcaatatcgagaagcgcgataacttctccattctccaccaccggcaaatgtctaaacttgcctgcatatccactagtcagctcaagtaccaagaccaacaaagaacttataaaagaacaagaaataacaaaccttgaaccatcttttgaagagcttcaacagcaatagtatcagacaaaacaaaaacagggttcttggtcataactttagatacaggtgtttcttcaaggttaagttgtttagcaatcacttttgttgctatatccttaaaaaaaacaaaagagataaaaaaaaaaacataagtgaaaagtccagtttgcatttagaatcctgttcatgaaaacatgtataccctatctgttaggatcccacaaagtaatgcattagaatcagtcagcaataacgcatcaacacgacgagcagccattcttcgacaagcttcaaataaagttgtgctatctggtacagtaagagccttacacaaccttagtctctttaccgttctctcaccactcctttccccactcaagcttctacaccaagaaacaacatgcaaacatttacttccaatctcatatattttgaaacatgtatcattcctcagaaaaatgaagaattggaagagaatggggtgatgattacatggaagaacgagaagatgtgagagatcttcgtgggaggagatcagagccaccaccaccaccaccttcgttttctgaagcttttttccttccttgaaatgaatgaccggagaaggagagacttttcctcgacggaccaccttggttagccattttcaactattccgatctcctccttcaaattctctgaaacactttaataaaaaaaatcatcagattttgatttttttttttttttttgcagcaaatgcatattcgaattggaacttaccaaataatctttctctttcggaaaatttttgatatcaattcacagaataaaagagaaattcaaaactgggaatttcgaatcttcacttcgataatgatcgacgatttcgaatcgcctagttggggcacgatcgataatgcagttcgaaggaattggaattttttttgtttctgggaatcaatcgaaagaaattttggaagagaaagacgaaaggagagggaaagcaaagggccagaggagataataattaattgaataattaaaaaaaaaaaaaaaaaaaagaatccgtggtggaacttttcttcattttgccaatctgttaaccacgaaaatacagatttgcccttggtatccgatcgggctgtgagtatcacgctacgcgggaacgacgacgctgacattgttaatgaggttatttatttaaatccggaaactaataatcagtcccattctttatgaattcaagagcacatgtgccaatttggttcaagagctacgataagtaattgtttttaacaatgttatttcttaattatctatgatctatattcactgtgataacaagatgataaaaatgacgtgaatgcaagatatattaatacaaagctttttttaaaaacaatttactcatttacaaagataatgataacattctgagttaccataacacattaaaaacagagatatctgaaatg

SEQ ID NO: 33315 - DNA, 3003 bp, Unknown; identical to SEQ ID NO: 33314
  misc_feature (1)..( 3003): 2750-1469P.txt file - cDNA_ID_3068150; gDNA_ID_1620513; Annot_ID_159171

SEQ ID NO: 33316 - DNA, 3000 bp, Unknown; identical to SEQ ID NO: 2490
  misc_feature (1)..( 3000): 2750-1469P.txt file - cDNA_ID_3068160; gDNA_ID_1620547; Annot_ID_160188

SEQ ID NO: 33317 - DNA, 3000 bp, Unknown; identical to SEQ ID NO: 2495
  misc_feature (1)..( 3000): 2750-1469P.txt file - cDNA_ID_3068166; gDNA_ID_1620547; Annot_ID_160181

SEQ ID NO: 33318 - DNA, 3003 bp, Unknown
  misc_feature (1)..( 3003): 2750-1469P.txt file - cDNA_ID_3068199; gDNA_ID_1620548; Annot_ID_160214
tggcaatcaatgtttatatctcgggagagaaaacattcgccggagaagctgattggtatggtgtccttggtgtagacccctttgctagtgatgaagcactgaaaaaacaataccggaaattggttcttatgctccatccggataaaaacaagtgtaaaggcgctgaaggtgcgtttaatctggttgcagaagcttgggctctactatctgataaggataagagaatcttatataacgtaaagaggggcaaagatgtcaaagcagctcaacaaagattcccaacaacacagagagagattccatcacaccagccaacttccaacgggattccaaatgtaagagagcatgtagtttcgagtgctagggctagatataagcctgctacccgtaagcctgctgcccgtatggatagatctcgcacgggttcgcctgcttttgtttatccgacacaggagagtagtaccttttggaccatgtgcaacaaatgcgacacacaatatgagtaccagagggtttatctcaaccaaacattgctttgtccacactgccatcatggtttcgttgcagaagagaaaactccgcctacaaatattccgaagcccccagtcaacatctcatctaaccaacatcaccggagttccaaaaaccaagcgtcgaacaagaactcaaatggttcttcttataggagagagcctgcaacatctgttaaccataattttcagtgggattcatcaagaatgggtggttcttacagccgaaatgccacaaatgaaacggcgaatgtagttcagcaaggacaagataaactgaaaagagtgttttgggagacgcaagaaagggaggcggctagaggatttacaaactctgatctggggaattttaagaggcagaagactgatgattcccatatgcgtggtccatctgcaggcaagttgtcgaatcaaataggtgcaagtaggtccagtactcctttttatgctgccaatgaaaatactgaatcttccaacaccataggctctcgtcatccgtatgtacaagcattgttacgttctgatataaagaaagctcttatggacagaggccagtcagagatttttaagagacttcctatgatgatcgctaaaatggaagggaaggtgaacccaactgaaggggagaagaacagtacgaaggcaatgagtagcaaggcaagtgaggttgaaaggagcaagatgagtagcacggcgaatgaggttgaaaggtcagttgaggtaattccccatgagtcagatgaagtgaaggaaatcgttgttccagattcagactttcacaactttgatcttgaccgatctgaaagtgcttttaaagacgatcaaatttgggctgcttatgacgatgctgatggaatgcctcggttttacgcccgcatccaaaaggtgatttctgtgaatccttttaagttgaaaatcagttggctcaattccaaaaccaccagtgaatttggtcccatagactggatgggtgctggttttgctaaatcatgtggggattttaggtgtgggagatatgaatctacagatacactaaatgccttttctcacagtgtcgattttaccaaaggtgcaagaggactcctccatattcttcccaaaaagggacaagtttgggcattgtatcgaaattggtcccctgaatgggacaagaatacccctgatgaagttaaacacaagtatgagatggtggaagttcttgatgactatacagaagacgatcagagtctaacggtggctctcttactcaaagctgaagggttcagggtagttttccgcagatgcacagagaaacttggtgtgaggaagattgccaaggaagaaatgttaagattctcccatcaggtgcctcattacattcttacagggaaagaagctgataacgcaccggaaggttttctggaactagaccctgctgcaactccttgtgcattctcttcagagaacgcagaggcggatgagaaaagtgaagctgtgaaagagaatgagcaaggtgaagccgtgaaagagaatgaggaaagtgaagctttgaaagagaatgaggaaagtgaagctgtgaaagagaatgaagaagtgggtatggatctagattaggggggtatgaaggtagtagcagtcagtacagtgtacaatggaggaagaaacatatcgtatcatctcattagggcacaggactaatcaatgtcaggtctgatcttttgcttttttctattttttctttcttttgtttaaggttgacccagaaagtagccatattttggcataagaaactatctataccggaaaaattaacctgagtatttcgaatattttttgggggggtcaatgtacaatcttttttggtattttggtatttactcaatagaccagaaagaatcttgtaagaactcagtttgggattcgaatatatatatggtggttatggttatttgttactttttttatctttgaagcattcattttgaagttcattgtcatgtttagtgaatttggtggttgtgaatttgtgattggccaaaccggtccattttgagaccagcccatttaagcatgcaccgacttggtccttgttttagaatttgtgcctcatatatgcaactgatatctctcaatctggttaagtttgtttcttgtcagcgtcttcttatcatttacttaggcatcaaacttttgtcggcatgccattgtgtttgagtaagaggccaactttgatatttcaagataaatttgtgcctcctatatgcaactgagatctctgtttcaaagctacaacgttctctgttttcgtaaaaaggactttaacagcgaacttttagaaattgtagactagtagtgagaaatttttgactcacatcatctttttctcatgtatctgaataaagaagaagtgtgagattttgattcataagccattaatggtgttcacgtttctatagctgaaatggtcaaaaacaaaagatagatgcaacacatg

SEQ ID NO: 33319 - DNA, 3003 bp, Unknown
  misc_feature (1)..( 3003): 2750-1469P.txt file - cDNA_ID_3068208; gDNA_ID_1620548; Annot_ID_160210
tgaattgttatggttttcacagcttctccgagatttgaaagttaaggtcacatcttctgcaaagatgttttgtgacaacaagtctgccattcacattgctcataacccggtgttccacgagaggacaaaacatatcgaaatcgattgtcatacgacaagagatcagataaagaatggatttcttcggctgtttcatgtgactactgataaccaacatgcagacatcttaaccaaagcactccagccaggtccgttctactcgttgttgaaccggatgtcaatatcaaacctctttcttcccaattctggttcagtttcagaggtttgaggggggtatattagatatatcatatagtgtatatacttaggcttatacatgtaattaatgtccactatataaggtgacaatgtacagaactttatgattaatgagaataagaagtttaataatctcaatcttaatagtctaataactaattagatggtcttcttcgacaaattaaaaccggaagagtttaggttacgtataaacaagttgtggaattgtgaaaaaaaaaaaaaaaagaagttgtggaattgtgacctaaataacacggccctttagtttgtttcctcaccggtgacaaattcgtaaccacgcttttcagtgtaccaattttaccaggacaatatatatgaccattttaatttttaacaattaaagtgcattctcttaagagcttattcttgcataattgaatatgatgctcacggtcacgggtttcttagggataacgtacatgaaatctcaaaagaaccaataacgtagcaagagtaaaaactctcatggagaactacgttcagatctccttggtctaacacgctagcaacttccaatgtattctacagtttggatagatctcgcaaatgaaacctaatttttacttataataaatcgtaaaagtaaaaccatatgtgatgggttctttagaaaattgaaattgtaaataatttcctaaatcacgatatataaagaatgtgtatcaattttagttttgttattcagaataatattacttaattatgatcacaaattcacactgaacatattctaggttccactgtttcattcaataattgtatctgtatatgttcattacctctaaaggtaatatgtgatccttaccattttcattcttggtcttcgttttgggaccaattgacaaagaacgattgaaacaatctctcaacgaattttgcgtttctcttgtgatgatcagatttcttggcactacaatgctcatgtacttgaatgccaaatcttatgcgagatatattggtagtatcttttgttgttttgtacatttaaagctgtacacatgtgacacaaagtggttgaatatatttctgtgtgttttcagaaattctccttgattacatgcaagttctcaaacttatgatgtacatagtattcttaaaaccaaatttatcttattgatcatggtattttccaatacaacataacctatgatgacataaataactctatttcgatgttgtttatctcaatgccatggcaacctttgggctcataaacataattttctttatggttgaggttttcgactttattatacccataatcttcttctttttttgcctgacactaacctttgattatacaataatacttgttaaatcaataatacaaatttaggtgacataaattaataattctctgtttcgcgaaacgtatcattccaacatattaacacaacttaagaaaactgtttaaatttatattttatcttttacaaatacattagaatcaaagtatctttcttattaataacccaaaataaaagagactaaaaagatatttattttcaaaaagtgtatagaaaaaaacaaaaagacaagatttgtaaaacaaaaataaaattttaaaacgaccctattgataaaacggaaagagcataacttataccaaatagatacaccactaccactcaaaactataattttttttattttcaaaaccttagttatatgagactcataggataaagaatgaatgagccagctatggttatagtataatttgttttaattaggtttataatacaatgaaagtggctaattttagctaattgtttaaaaagttgattagttggaataaagtgaggtaatcggtaatccaatggaaaaagaatataacaaaacctagtgggagtatataaatctaggatgcatgactagtgccacgttgccgcttctgttcggtgtcctctctctctttcactactcaccaccactctctctctctctccctccatctctcttggattctctctcagattccatggaagctccaaaaagctgattcgttcagccaatttttcttcactctctctcagattcggatccgtggtcagatcaaccaccgtgtgttttccgatccgattcgattctttttttgtcagagctctcagataaatactaggattccgtttccaccacagatccttgatttgatttggatttatttcttcttctttctctcttcgagtttgattccacaagataccttgttagtttttctctctacctttgatttgatccgttttcgttatttgaatcgaaaatttgcttaggaagtagagattctggatcgtgttcgttattgttcatgatttgcttgttgaattctataatcttactcgttgaatatgcaggatctaagtttaattgaagaatttagaggttgaaatcagtttaacaacatttctcaacttatccatacagatagatagggtttgttatcttaatttgggttttaaggatccaggatctgtattttagctcttatgttgatgatgatcatgttctatgttgttgaagtagctcgtatcttcgttttctgatttaggaatcgtattattactaatgacagaatgaattttttctatatgcaggtcctgcattggagaaactaatttaaggtaaggtttgactacttagatg

SEQ ID NO: 33320 - DNA, 3003 bp, Unknown
  misc_feature (1)..( 3003): 2750-1469P.txt file - cDNA_ID_3068216; gDNA_ID_1620548; Annot_ID_160205
aaaccgactatcgtttcttatttctatagtatttttgcaagacttttttggtggatttgggtaaaagtgcattcggtcatatggtacattcccctattaaataaaaatggtatactcctatgttattagctaaaatgtttagattataattcagagtcatatcattaataaaattaatattaataaaataaatggctttttggcaagacggatttggagtgacgggtttttgaatcaacattaataaaaaaataaaatataattaatacaccgtttcaatacgggtttagaccactaatattaaacatatcaaatcatcctaatttagaaaagattatataaaaccaaaaatgttatgtggtatgtataatgttaccatatataaaatataaatgtattagagaatgatataatttgcaaaacttttatctataaaaaaaattcttaaattttaaaaattactactttaaaaaaaaatcacgggacgggttaagaaattatagaacgggttttattttggaattaagttatatggtagatgtatttgaatcaatatttataaaattttaaaatattattaatatgttgttttaataggggttacaacttcagttttttaacaattgtctcatagattcgtggtatagccttacttaataacaattataaactgtaaaatataatttttttataaaaataaaatttgcaaattttaatatatattacttttaaaaaataaatcgtcccgcgatataccgcgggttaaaatctagtgtatatttattttgtacaaacacaaatatctgattgaataatgtacataaaactacaatatacgaaaagtaaaacgataaaactttcaaaggtcgtataagttaccaaagtgactaagcttatgaatgtgaaaggcacatcaactaagcgtttatggttttcctcaacctttttatcctaaacaaaaacttcaaatatacttttcaaaaaataacaaagaggcttatactatgacaaattggtaaaatttaattcagaattttctatatcttttcttgtcttacatgtctttcactttcagtaagaaaatatataaatcagaaaggaaaaacacacacactcacacattaattgagaagaatgagaagttgggcgatagattatcagtgaagtcgacaaaagggtcggtggcgtaataatgaaagctccaatgcgttgacttatcatccactttaatttgcctttgccctacttctctctttaagtcaacgattttaattgttacccattttactaaagagtcttctcttctaccaattacatttttgagacattatttttcttcttttatccttatcttttcattacacatgatttaatcatgattaaagataattaatcatatctttagttattttcttctaactagtcctcttttattttcagctattccgagaagagctcgttacgcaatagccgtaggcgccggaatcccaggagctttaatagtctttggtcttttctgcttcgtatacagcaaaatcagttcatgcattaaacggcgtcgtctcgtcccaaccccagagatcaacaacgctcaagcccattatttacattcaagtgtcatagtaatgggtcttgatgggccaactatagagtcgtacccaaagatagtattgggagagagcaaaaggttgcccaaagttgatgacgctacatgtgctatttgtctctccgagtatgagccaaaggagacgcttcggacaattccacagtgtcaacattgttttcatgctgattgtatcgacgagtggctgaagttgaatgggacttgtccggtgtgtcggaactcaccggagcagattttgccgcctgcttaagctattatcttttgtgttctctttttcgttacatcatttgtactttttgtagttagttcaatactccgtccgttttatttaaatgtcgttcttaagattttttttaatacatatcataaataagagtttttgtagatttttaatgtatatattagcttttatagaaattaatatgctttcttggtttggtgtgaaaatgataaacgacaattatagttaatgttttaagtacaaattccataatttttgtagagttatcacatctcacaataaaaaaattactttcatatgtaatttcttgtcccaagaacatgcatagcataacacatgtttgaatttgggtggttatacatcaattgcactagtacgaacctctaaacacacatcatgatcatttttaagaagtaccactattgttcccttaaattatagcacctacaaggtttggtccaacgtaacattattgtgaattcgttcataagaaatatcatttcaaaatttggatttatgtggtatttcatatgttacatagatttttctaatcaggaggacgtaccaaaataaggagaagattctcgaacgatggaaatgatccaatgactttggtttagtaaagacaccgacatctacccattcattattcgtgggaccttcttcattttgggctatgaattttttctttaagatattcaagtaagcttacgtgacgtcttattatgatgttcgatgaaaactccaaatattcgttgacgttaactaaacaagcgacgcgtggtctcatctttgtgaatactatttatcagataatgacattttatctaccaattattcctattggtgaaacgttttaaatccaaagagataaaactgagattttggaattgacaagacgtaattgtgaagatagtgaaatgcaaataaggaaaccaatcgcattctatctactgcaaagacttgagtcattgtagtgttagaccactataaggaggagccgagtcggggtattaaaaatggataaaaatcgattagataaaaaagtcttacacgggtttatcctatcagattgtgggtacaaaacattatagtcaacaatttaaatatggatttgatcagttacataaaagcaatg

SEQ ID NO: 33321 - DNA, 3003 bp, Unknown
  misc_feature (1)..( 3003): 2750-1469P.txt file - cDNA_ID_3068242; gDNA_ID_1620549; Annot_ID_160256
gaggtttggttggtcgagcttactgattaaaaaatatacacgtccaccaaatattaaaacaatatatcccatttttcctcctctcttttggtattacattaatattttattatttccccatttgctctgtatatataaacatatgtcaatagagtgcctctacagtcatgtttccatagacataatctctcaccattgtttttctctgcaaaactaaagaaacaaaaaaagaaaaatcggagaaaccaagaaaaaagaaatgggaagtgtagaagcaggagaaaagaaggctttaggatgggctgcaagagatccttctggtgttctctctccttactcctacactttaaggttttgtttcctcttctcctttcacaagaaaatttggttttgttatgtagaatttttatggttttattgaacttgtttttgttgaaaattgaattttggttttgttaatatataggagcacaggagcagatgatgtgtatataaaggttatatgctgtggaatatgccatactgatattcaccaaattaaaaatgatcttggaatgtctaattatcctatggttcctgggtaatttcttctctcttttcttatctgccttatttttcagctttattcttgactggtgtccatgaatggcgattttctttcatctgttaaaaatggatgttatcgctagacttcaatttagatcccaatcatatataaataagatggtttcagattttaaatggaattacatctttttaatttatttgaagttatgcatagattgttggtaaacttaagtatattagcacttgtgactagcttaataatttctaagcgtgctagagataactccaaacagtacattttcaaatgtaagtaaattgtttagacatatattttaattttagataacctaagggcaaaaacaaatattagataatcttagattgtaaatacatgaaattcttatttttaatggttcagatgagttgattagtaagtagttaaccatatgatatgtaatattttgtacaaatgttattgatatattcttctcggaatttagatacccattatatgatgcatgttgttaaatgacttttgtggtatgacagaagattttggtataaagttgacttgacattattgttaatttgaagataattgaacgtgctactgttacacatctgacattcgtttataaccacacctgtcactgtttagtcttctaaattaatatgcaaacaaaaaactctgtcaatgtgggacttgtaggggtaactgaaatatacgagtaagattccgtaataactaaaagtgtaattttgatttacaggcacgaggtagtaggtgaggtgttggaagtgggatcagatgtgagcaagttcaccgtaggagatgtagtcggagtcggcgtggtcgttggatgctgcggtagctgcaaaccatgcagctcagaacttgagcagtattgtaacaagagaatctggagttacaacgatgtctacaccgatggaaaacctactcaaggtggcttcgccgacaccatgatcgtcaatcaaaagtaagcacacgcacacaccttgtttcacaagaaacacacagagcatttgtttcttcatccacaagtaacttatttttgtttcaaaaggtttgtggtgaagattccagaaggaatggcggtggagcaggctgcaccgctactctgcgcgggagtaacggtttatagtccgttgagccacttcggtctaatggcgagtgggcttaaaggagggattctagggttaggtggagtagggcacatgggtgtgaagatagctaaagcaatgggacaccatgtgactgtgataagctcatcagataagaaaaaagaagaagctatcgaacatttaggagctgacgactatgtggtgagctctgatccagcagagatgcaaagactcgcagattcccttgactacatcattgacaccgtaccggtgtttcaccctctcgacccttacttggcttgtcttaaactcgacgggaaattgattctcatgggtgttatcaacactcctcttcagttcgtgacccctctcgtcattcttggtcagtactatttcttgcgtttaaatcatatctagctaataacaacaaaattcaatagcaaacctgatgtttttttctatattttgacagggaggaaagtgatatcagggagctttatagggagcattaaagagacagaagaagtgttggctttctgcaaagagaaagggcttacgtcgacgattgaaactgtgaagatcgatgagcttaacattgcgtttgagaggcttcgcaagaacgatgttcgttacagatttgtggttgatgttgcaggaagtaatctggtggaggaggctgcaacaactacaaactaaagagggcagggcacattgatacatgaacgaaaaattgtaacgggcttgtttgtccaacgaatgttttgttgttgtctttttcaaatggttcaaacacgaatgctttggctttatttttttctaatcaatgtggattttctgtttacgtgtgtttgtcacaagaaaatcattatgataagaattttcttccacttgaactcaaatttgttaacaattctgaatctgaattatggctgacaccaattgaaactgagaaccagtttaaagtgattataaagaaaagtgaaatctttttattgccaaccaactttgggctaagtattaaaagaaaataatacttttttgataagaaaaaaaaaagaggaaaataatttgattataattaaaatctaaaaactttttcgcggaagcgttaaggaaaaatctttgatctttggaaaggaagagagcaggcgcaatcgagtaatccaaaggagttgcgttgttctgcgatcacgaagcggtctctcggcaaatctttcgacgcaagacatcgattcgtgtatttcatttttgctttggaactctatgcggaagaaccctaattgattcgccatg

SEQ ID NO: 33322 - DNA, 3003 bp, Unknown
  misc_feature (1)..( 3003): 2750-1469P.txt file - cDNA_ID_3068244; gDNA_ID_1620549; Annot_ID_160247
gtctccagtcaaccctgcactgtcgttgttgcacgtgcttctctcttctcccacacgtgcttcccagctcattctctctgtttttttttcagtaacaaaaatattccgaaaacaacaatacatactaaacaaataaaaacaatactcgaaaccattattaatatttttttccatttaaaaatgatttgattccaacattcctaacaattactgccactctcggataagttcagatgctttttttgcctttacatttttgtttcgatgtgtagcttttctccaatggtttcattttgcttcgtttgtactttattctttattctctctataaagaaacaagacgatgcatgcatgaacgttatataatcttatcacacttattagatttaatcaatagagcatcacggaaacaaattcatagttaaaaatcgtttttttcgaatcgattattttacaagtatgaaaaccgccatacatactttgatataattatataaaatggttgggacgtccaattgacaaacctcaatatttaataacaacttcgcattcattttccgtaatagatatactttttaatgatcatttcaagatatagaatagagtttcagaaaattttcaaaatttaaatatataacttactatcagaaaagttataaaataaaaatatatgtcataaatttatcgtctaattgtttcaaatggagaatataaatacacaaattatttcttaattaaaatatgcaaatttttattttaagaaaacatctttttcgtttttttttatatccagacaagacatcagataaaaatttataaatgtaaatgccaacgtttgatgaaacactcaatgctatattttaaatattaagcattcgaatttaacatgtaactatctaaacaaagaaatacaaaataataataataatacaaacaaattaaaacaaaacaatggacccctagctagtatagtatctatgcgattgtcatgtttagtaatcgatagccgatagttagactgttagaacttaagaatcataggcagtaccagaaagaagtattggcccatatcgaagacttgaagtgaccaaattagtccatgtaaatcaaaacgtaaagtaattgggtcggatacattttgcagttgggctcatataactttgaaatatctctctcgtagtctcgtataaaggatcggttatattagaggaaaaaatatatagattttttttttttgataaaggacaaatagaagttggcctttcaatatacaaagaataaagatcaattttgggtgtggatactgataaatgatttaaatgtaacaagaattaacattacttcatattcaatggacaatggttatccttttcttcgtcgtcgcccgactattaggagatgacgagtcatcgtttatcttaattatttagaaagcaattgatttagtacgtgagttaaaataatttcgttgcacgttgtccggccgtttatgtctttatgacgtgcctatgatcttatctaactatcattttctcttccttactcaacatcctaaaagaactattcaaatttattagaattccattttcttgagacatgaatactatcaataataattaaactatagttaaacagaaaggcgtaataacataaccaaagccaatgggtttttgcttgacttcccggaaatttaaaagattatgtggttcgataatttacccccaaattattgatgagcaagtagtagtctttagaaaatggagatggacagacctttttcccatctttaaacttgtaattaataaagactttttagactattgcaatactataatgaatcgtgtagtgttgtgttgtgttgatctctgtgttggaacccaaatacaaaaaaatattgtgctaaaaagtgctgcattgatttacaacaatcaaatactcaaccatatttcaagtgggttgaattttaataaggatgaatgattcaagcatcaatctataaacaccaacaacgaaaagcttctattcacaatcgaatgttgtaatcacatacatatatataaactgaaaacaatttttagttaaatatttttagttattaaaagttggcaacttctacttaatgttatatatgttgcacctactattagacaatatctagttaaaacatagcaaaagaaagcttgtggccggtgagaatacaatgaagaatgtaaccccaaaatcatcccaatttccactattttgcctcttaataatagtaaacaattaataagggaacgcatgataaaagttcgaagattatgtacatatgaatatttggttaaacaagacatatgatgttgttacaaacgaggattacataatgtaatagtaatctaaagtcttagggactaagagttcctcattttaatttttaatttgaataaaaattaaaatgatcaatataagagtttttaagatgcaagcaacacaaaaaaacaaaaaataagaaatgaaaaaggaatatttttcattagttagtgtacattttaatagtaataccgtgtatgaccacgacatcatcaaataataataatatgatatcgtatgtaatttttatatagtagtgtgttatttaaaagtttccaaagtgcgtgtaacatatgggttcctagtaccttccgggaatggttagcgtcgtcaagaaactactctgtaaaaagttagaattaggttttccaaactaagaaacatgcttgtaaccaaaatttaaacaatggacaaaatacgaatggaattatcttgcccatgtgatgtgacgtgttttttattttcaatttgtttttattccagaaaataaaataatgacacgttggagccaatacgaagaacacatctatccatcccaatcgctctccacttttctgctcttcgacgacaaaagtttcaaactctataaatacttgaacgcaacagttacaaaaatgtcaaatcgaaaacaaacacaaaaagcaaacaaatatg

SEQ ID NO: 33323 - DNA, 3003 bp, Unknown
  misc_feature (1)..( 3003): 2750-1469P.txt file - cDNA_ID_3068248; gDNA_ID_1620549; Annot_ID_160242
gctctaaccttgactcttcacgtcattcgcatattactctcctcctcgctgatccattcgaattctgcactcaaatcgtgtttttgtacatcatagtttcaagcattatgattctctctagccaatgacttttcttgcgattgaatccttttgcagtctcgttatcaaaagttgaagaatttagtttagtttggttgtgtagataagatttgtaatcgcaaaattcgatctttgttacagttatggattcgagttactctgattctcgtcccatgttcgtgcaatcaccttatggtggttggaatcaaacacagatgattgattcaatggctaatccaatgaacaatgaacaaggagacttgcattcactatctgaatcacaatcacaatctcaaccgtctcagcaattacagcctgcattgaaaaggcctagacttgttgatgataacttgtttaatcctgcttcgtcgtttcctcagccttcgagtagcaatccttggatggttccatctttgaaccctcctcctgtgaacaaagggactgctaatatattctataagactagaatgtgtgctaaattcagggcagggacttgtaggaatggtgaactctgtaattttgctcatgggattgaggatttgaggcagcctccgtcgaattggcaggaaattgttggacctcctcctgctggtcaagacagggagagggagagagagagggaaagggagagggaaagaccgtctttggcgcctgttgtgaataataattgggaagatgatcagaagataatcttgaggatgaagctttgtaggaagttttgttttggggaagagtgtccttatggggacaggtgcaattttattcatgaggatctgtcaaagtttcgtgaggactcggggaagttgagagagagctcggttataagtgttggtgctactgctgctgatcaaccatctgatactgcttctaatcttattgaagtaaatagacaaggaagcatcccggtacctgcacctatgaacaatggtggtgttgtcaagactgtgtactggaagacgaggttgtgcatgaagtttgacatcacgggtcaatgtccttttggcgataagtgtcactttgctcatggccaagcaggtatgttatatgttgaacatgtatctttgctaatgcgaccttatattatagtatcctagtatagatttgcaagttctgtgtatacaggctatctctgaattctcttcttttgaccgacatttgtttgatcttgatttggttgttgattacgaaattgcagagttgcataactctgttggaagggtagaaggagaagctatgaacgcggtagcgtctgtgaataaacaagcagtggtacctgcgaatgaagcatttgcaatgaaaccgattacacaagtaacagcagattcctctggtctgaatgaagaagggcggcgaaagaagtgtttgctcaagtggagcgactccaagaagattaaccgaatatatggagactggatcgatgatttaccggtgggtcaaaagtcgacaaagccagtagagagttgagttttctagcctggtttcatttgtctcgtccttttgatgatcaaaactgataaagctttggtcgaaaattttgaagagtagaaacactctttattttgttcattagcaattctttgattcgctatagcttagaatattgcttttgttataatctttgattacacaaaaaaagtggcttggctcactaatagcatcttattcttaatttgtttcctttggcttctaatgttcatcattatatggataggtttcgtatttcgtttgccttttaatgttctaacgaatcggaagagatatagaaggaattgggcgtatcctaaatttggcctctagtgtttgttgttggttgacaaaataaaaatgtttgttgttgacttttgttttcagattaaggtttaattatctacatcaaagtgcattaaggttaatcggatgttaaaaataaaccactttaccgatttatcaattttcttatatgataaaccaaaaccggtacggtttgctaccgttagattttggatgctcaaattaaatcggttggatggtgctagtttttagaataacgatcatacattctcttttctaatctgttgatatattatatacatacgaatgcttattgttaggtacttaggttcatcgcatgcaaacaaaatcatggaattgtaccatcaatttttaaaaatatatatgtctaaactacgaataatgcagaataaatccatttaacaaagggaccataatgattctttagtgccaagcgatctttttggtttgtttccctacaaaagaattaataaagatttcatactaacggcttaaagtgattaatcatattgctatggctatggcaatacttatttgataatttcgtcgtagctttattctttttatagaaatcacacaaaatatatgggccctcaaattaatagtgttcgtaacgtctcctttactattccccacttctccatttctatgaacttttctttttgctactattgtttttgtattcttttcaacatgacatgatgagttattaaagagctgttgtaggtagagagtcgtagtaaaaaactaaaactgtcggtggaggctggagagcacttgggaatcctatggccctcccaaaaacatataaaagataagaaaagtagtgaaatatagtaataattattgtctttgttagtgatttagtggattgtctaaccatgattagtttatatatttgttttctcacaaataatgaaagtaggtagtatcaatatctagacctaatattttccatatatttaggtcaactctttcatatctggttgatcagtaatcatacaacgttggaattgtttgttttgtttctattataaactaaaacattggtaaaaatagattttcatttgtggaattttcgtcaagtcataattcacttgtttgaaaacaatg

SEQ ID NO: 33324 - DNA, 3003 bp, Unknown
  misc_feature (1)..( 3003): 2750-1469P.txt file - cDNA_ID_3068256; gDNA_ID_1620549; Annot_ID_160232
cagagaggaataacaacgttcaagattcttagtcaagtctaaaacagaggaatgcaatctgaaaatcatgagcatacagtgtagatgatccttcaggctcccattttccatatactcgtagacaaggaacctgtaattctcaggttagatgagcaaagggcaatccacacaaatggggagaaacgaaatgaaggtcaaccgtaatcattcacctctcgttcttcttattacaaaaccctttcaaagcaactaggtggcggtgatgcagcctggcgagaagctctatctctctgcaaaattcatcttcagcttgttcagagctcttgttcatcttttttacagctgcaaccaacccattactgaactcagctttgtaaacagtcccaaagcccccacggccaatcaccgcgttgaaatcttcagttgctttccttatctccttgtagctgaatttccgaaaaccaaacgaattacctgaaaaatcaaaaccacacatttgttttacatggtctaacatcccttgttagtgtaccatcagaagaactcttcaccttcatgaatcatcgaccttgggcggggagaaggagatgtccttgttagattacaagcgatgctcttggagtcatcaagttctcgtttttttctttggataagaactattaggactacaaccatcacaagagcaaaaactgtgacagcaatcccaatagtcggaaccattgtcaagtgatatggatggtgactttttaatggagacaaaacaagattatcgctgcttggactatcagctaacactggaggagaagcttctggactcagcgatgatggagacgaacctgagtagatgtgtcaagaaagtcagaaaagaaaagaaagtccaatcttgatctgatactaagaagattatacaggacacactagtaatatatacaggatctgtcaagcatctttcccaatatagaaacaatgataagattctacactccatgaatggtatgttgacagagaaaacagtatatacctggagtggggctaagctcaggcacattaaagaagcagctagctagttcaagagccgatgaattgtcaacccggcttgctaacacagcataagttgcatcacgacaagtactcagtttgatgctattatcagcaccaacgaggctcctaaggtagctgatactggaattcaaacaattcctgcattgatcacccggaggaagcgggagtttgcagtttctggaaacatctccaaaacttgtggaatgaagcattggcggtacagtagtcagaccctcacaatcatagttaacaagaatcttggtccctaatccacagaagatggtagcatttcttgggattccataaagctccatggttctagagatagtagtgatacagatttcagtcaaatctgatgtaactccaagatcagctgtgtagtttgcatagcgggcgacagatattgcaacgaaagcattcatgtagcggcagcatttagctctctcggtgttgttcgagcatacggaagccactagagtgaagttagatgaagtaaagtccaatggacaacctgtaaacacaatatatcacataactttgcttcaattttgcaatagtttctttctctcaatgaaaatctcatcaaagactacgactttaagcaacgaattcaccacaaattagaacaaaggaacacacaaaacactttaatgcacatcgaaattcgcacaaagcttaaacctttcagaaaaagcaagattaacaacagttcgttttctcttctttatctagttacgaatcaaacccatggaagaagattgtcaaggaagattctcaaaagactgatgtggtgagagacaaaacctgcttcggtgagtaaaggaaagtactggaatccaagcaatgcgaagaatgcgagcaagagagcttgattataaaccaacaccatggccaaagaacagagagagtcgttaggagaggtcaatgagaagtcgcctgaagagaatatgacagtggaagaaggtcagtgacaatgagatggagagagaaagagagagcccccaactttctctatttcttgatgaaacccattaaacccctgaataatccttaaatttgtcattctcttatgtttttacccgaaagttcgttgtaatagttttaagcacccccatacaaataaaattactaattttcgttcaataaaacttttcatgtataaacataatcattgcagtggtcggtttttaagtttctttttttttctctatcttatctcttcacatgatttggttccacaaagaatattaacaactcttagaaacaataagccgctatatgttttcatcataaaacacctgtaaaatgttaacatacggcggacacctaaatgtcaaactagatgatagtatggaaggaatattaaaacttctccaaatactttatcatatggtttttctctcatgtgtgaggttagttttatgattgatttggaccggcacaaaacgtatttaattttcataagactaaagtactttataattttagctggcatgctaattaacttgatagcatttgattacttgataatgatgacagtctcatgcaagttcttcattttttggttaagtttattctttaaaatggaatcaaagaaccatttcatgtaggatggcatgttaacttgttaagtataataataagaacaaaccataaaggaaaacgagaagccaataaagaactctcttctatagctattaatatcatcattgtatcctagatactcgcgattcctcatgttattttttgtttgaaaagataaatttagatttaagtttttatttaccgttttttgttggttggtcaaaacaacttgtaaatcacccgttccaagtcttttggagttttaccaagtagttgcttcttcccaaagtcaaaatctttgggtttttattcttttaaacttctttatgggattttggtgcaagaaagaagaaaatg

SEQ ID NO: 33325 - DNA, 3000 bp, Unknown; identical to SEQ ID NO: 2522
  misc_feature (1)..( 3000): 2750-1469P.txt file - cDNA_ID_3068269; gDNA_ID_1620550; Annot_ID_160290

SEQ ID NO: 33326 - DNA, 3000 bp, Unknown; identical to SEQ ID NO: 2521
  misc_feature (1)..( 3000): 2750-1469P.txt file - cDNA_ID_3068277; gDNA_ID_1620550; Annot_ID_160288

SEQ ID NO: 33327 - DNA, 3003 bp, Unknown
  misc_feature (1)..( 3003): 2750-1469P.txt file - cDNA_ID_3068304; gDNA_ID_1620551; Annot_ID_160302
gtagattaagacaatctagtttttgttggaaattaacatcattttaaaggtatttaaatatttaaggagagagatcatatacgtttcacctctcgaattcattttcatctttataatatggtattgtatttactatctatggtttctaaatttttttgaatatttaatcacttcggataagaaacgatcatacattagagtttggtataaaaaaccgtatgcaaatagttcatattgatttggcggttttctcgacatatttacacatataccttagccaaaatggtcttttcattttcaaacaaccttttcttttcaaatcctattaatcctcctacttcttcatcaccatatttgaatcaaaactatctaacttctaatgtaataattgttcaagaaaaatataaatataaacatttcacttttttgtattttattaatataatttaaaccattcatcgacattaaaaaaaaaaagaaaaaactaacacataacgagtttacaaatataaattatcaataaaagtctcatcgtcaatcccaccaaagacgaagaagggttatctccactcaaacatgtgtcatgcaattgaaaacgataaaaatacgtactgtgggaataaagtgatacgtttttccggcattttttgcaacataactccagttttagacatcaatttttctttgacgaaaaaacaaaaaaacatcaatttttcattgacgaaaaaaaaaaaagacatcaatttcattttttttctaaccatgataaaactactacaaaacaagttaaaagggatacgatgtacatcaaactcataagcttgcgaaaattatcaataaaaagtgatccaagaagataaaattatgataatccacatgtgattgctaacaaattgaagattcgattacttgaaatagaagctaaaagccaatcccaattttccaaggaacaaatcttctttgatttttttgggtaaatcgttgaaccaacgacacataagtaaagagaatctgcatataaggtagaagaaagtcatcgaatctacaacactaactcttgcaataattatttaatactaaaagaaaatacgtactgacaaaaccgtgacataaaccagatatattggatggcaaatttggatctcatccaaacttgaaaactgccaaaacatactggaaaacgaaataaaatagagagaatatccggtaggagatatttttaaaattttcacattaattaacttttttgcgttttctttttttttgttactggaattttattaatcaagccaaacatgtttacaaaaccggataaaccggaaacttagccagagactttaacaggaaacagagcccgactttaacgggagacaaagccggcgaacaacaagatgtccccggaaacaaaagctcaaacgagagaaacaaacgagggagacataaccctaaagtacagggaaccaacttacaaccaaaaaaattagctcactaagagaagtctacaaccaatgcactaaacatgaccacatgttccaaagagaagcctactaaaccttcctatagaaactgtgaacgccagatagcatcaggaagaccagataagacacaacaccaaagcctaaccaatcgcaacaccgacaaggaaggcaaaaggcttcacccgataccaaggaatcatgaaccactagagccaagtcacaccatagcagacggagataaagagacaggctaggaacaaggagaaaaccttgtgattcggcttgagacaagtcaaagaagaccaacagctcttacacgcggacactcgtcgacccagtttcagccatctaccaacaaaaaactggtaacctcctcgcaagagaagaacatgtgatcgttccactgtgacgcctgtagcccaacttcaaacctcaaagaagctagaaaggagcttgtagatgacgctgcaacgaaacaccatccaaaagacaagcacaacccgtaacctagccaaaaacaaaaccaccaaacgcccaagaggacccagcaaagcagaagagcaaaggacataaaggcaattccataaccagagagaaactgacttgcgcaaaacacaaaccaagaaggatctctgagcttagctaattcaattggttaaacgcaacaaaacaaacctaaaactaggaaaattaacacaaacgagccaagacttagcaaaaccaaggacaaactatgagcagagactaaattacccaaccaaaggcaacctaatattagcctaagacagaatcgagactacatagcttccactagatcaggtatgtataagatgaagaaaccaaacctccatctccaaaaacaactgccgtaacagtgaagaaccacacgggctccgacaaaaacaccaaccacccacggagaaccaagcgacaccatcactagaacggaaccaaccttccaatcgaagcacaaccatctagaatctcgtctttaatccgccataggaggagccagagaagacccaaaacaaaggaaaagcaaataaaagacaaacagacacaccctctctgactccggccaagggcaccagataatcagaaaggtaacgtcagaaatttgagaagaaaagtttggtggtggctagacctaaaaaaatcgcctctcaaaggccgtagagccaaacctttttatgttatagaaaacttttttgcgttacattgatattaaaattcttctaaacgaaacaatataaattaatttactcatgatttgttagaaatattttttatttttattttgtgtacatgacgtggataactaattaaggttagaaaacaaaatccaacaatctgataacaattagtcactaaatattcggagtaatgactaatgacctccgctcttatccaaaatactgattagtgtctgttttaaatgatcctaccttataaaaacgacgacacatctctctctcgtcttcttcttcctctaaacctgtgaaaaactttggatcaatcaacaatg

SEQ ID NO: 33328 - DNA, 3000 bp, Unknown; identical to SEQ ID NO: 2532
  misc_feature (1)..( 3000): 2750-1469P.txt file - cDNA_ID_3068365; gDNA_ID_1620552; Annot_ID_160330

SEQ ID NO: 33329 - DNA, 3000 bp, Unknown; identical to SEQ ID NO: 2538
  misc_feature (1)..( 3000): 2750-1469P.txt file - cDNA_ID_3068369; gDNA_ID_1620552; Annot_ID_160323

SEQ ID NO: 33330 - DNA, 3000 bp, Unknown; identical to SEQ ID NO: 2536
  misc_feature (1)..( 3000): 2750-1469P.txt file - cDNA_ID_3068373; gDNA_ID_1620552; Annot_ID_160322

SEQ ID NO: 33331 - DNA, 3000 bp, Unknown; identical to SEQ ID NO: 2534
  misc_feature (1)..( 3000): 2750-1469P.txt file - cDNA_ID_3068382; gDNA_ID_1620552; Annot_ID_160317

SEQ ID NO: 33332 - DNA, 3003 bp, Unknown
  misc_feature (1)..( 3003): 2750-1469P.txt file - cDNA_ID_3068389; gDNA_ID_1620552; Annot_ID_160314
ttttcttacagaagcaaaacctgaggaatataatgatagagtaaaggaaagagagagaaaggaagaaaatggtgattccagatatattttctggatgaaggtaaaggagagagatagagagagtaattcatttgttttattgcaatcttatcctaacgcttacaagggaattcatgccatgcaatttttttgtgtaaatttgtatcgatcggtgctcaatctccttgaggagaggatgaagacggagatgatagaagagatggtgatagtaggaggtttagtaatggttcaatttgtatacgcaggcaattctttgctcatgagttatttgatgtcactcggtcttggccctttcaccattgtcatcttttctacattcgccactttcataatcctctcccctttcgccattctcttcgaaaggtctgtctgataacattttcacatagcctagaaaaccaaacttgtctttttttcttttcacgttgtaaatgttttgttttgtttttgttgttctaaaggaagcaatggccaaatgagcttagcttgaggctgattggtaagctagttttgatctcctttgcagggtaagctatttactctctttttttgtgttaaaattagaaaacttggtttaaattttcacagctttttttggttctgtattcgaaaacaaaaacagggttactctgttccagtctctgtttctagaaggaatcaggttgacatcaccagcaatggcaacagcgatgccaaatcttgctcctggtctcatttttttcatcgcttggatcgttgggtgaatcactaaatccttgttctaactcgtaatttcacgacgtgttccaacattaagtgtggtcttattttatggataggttagagaagatgaatctgaaatgtgtgtacagcaagttgaagatcttagggacattgttgtgcgtatttggcgctttagctatgagcgtaatgcacagcacttcgatcagtcacaaagaagaagatgacactccaatattcgtctttgatcgagacaaggtcgttggatgtatctaccttcttggagccgtctttgttttatccaccaacgtcgttcttcaggtaagtaaacccggttcgtcataaccggtttggttcggtttctaaaatgtcggttattgtaggcgtcaacgttggcagagttcccggcaccgatatcgttaagtgcaataacggcattactaggagtgttgataacaacggtggtactactattacaaaaccgaaaaacaaaagtacttgccagttcattaattagtttcggtaacctcgttggttattctgtcctggtaagttcaagtagatcattcgtagatataaaacataatcaattggtttatggttggttggttataatgtatatagtttttgaaatggtcaggcaggggcagtgagtggagcatgtgttagctttaatggatgggccatgaagaaacgtggaccggttttcgtttcaatgtttagtcctttcgctaccgttatttcggttgctttcgccgttttgacattaggagagtccgttagccttggaaggtgagcattattaacacaactcttttaacaatattttaggttttcattggtaacattacacatttggtcttcaaactaagaaacccatcaaattagtaggaaaacatacaatggtaaaacttactcatacacggttatattaccggagatatgctaattgttaccggattctaatcaaaccgtcaaaactaatattcgattttccgaaggttatatttgattttgtttcttttaatgaattgattaacaaaaaattgcagtgtgggagggatggtgttgatgttcgtagggctataccttgtgttatgggctaaaggcaaagaagggttctctgaaattgagagttttgagagtgagttcgactctaagaagcctcttttgtcttgattgttttctttttgttcatcttcttcttctattaaatttatggaaaagaaaaaatggtcgaatatttagatatagagttttagtctttatttctagtcaacattttagacgaagaaaatggaaatctatatatgttccatttttatattgttttttttcgcagaacattgatagaagatctgatggatgaagttacaaatcatatcgaattacacaagttttgttccataattttaatttatttttttcatgagttagagcaattatcttataagtccaccaaagattacaagttaggttaacatataaatcatgttagaatatcaaacctataagaagttactgagcttagatttgtacaaagcattgtaaataattttaaatgtcgttaaattacttgatgacataatttgtaaaagttagctttgtgactatttttcaacatactagtgttatagataccaattagattagatatatcatcatttatggaacacaatctattattatgtctgatctatttattacagtgataatacataaattaatttgttttttttgttgttgttgtttaatcaagcatacactgtattctttatattttgttcgaaaaacgttatataaaatattgttaatctttttaggacataaaaatgcggtcaataatcgatagttattggctcataatcgtcactatgaaatatttatgaatcttatggaaacatacatataagggtaaatccggaaaaaaataataatcaaagagtctctctctctctctctcattcgatctcgacgatttcaccgactaatcggagtttggatcggagattagatccgggaaatcactgacgaatcctttctggattttggatcggtctatgcttctctactctacttgatcttgatcttctagaaatttaacttcgttttgcaattgatcgtctcgctttaagaagcttgcagatccgttgatctctttctgtgattttgcggggtttagggttagggttttaatttcgatttcggttgtcaattttgatg

SEQ ID NO: 33333 - DNA, 1725 bp, Unknown; identical to SEQ ID NO: 2528
  misc_feature (1)..( 1725): 2750-1469P.txt file - cDNA_ID_3068401; gDNA_ID_1620552; Annot_ID_160308

SEQ ID NO: 33334 - DNA, 3000 bp, Unknown; identical to SEQ ID NO: 2549
  misc_feature (1)..( 3000): 2750-1469P.txt file - cDNA_ID_3068438; gDNA_ID_1620553; Annot_ID_160367

SEQ ID NO: 33335 - DNA, 3000 bp, Unknown; identical to SEQ ID NO: 2547
  misc_feature (1)..( 3000): 2750-1469P.txt file - cDNA_ID_3068442; gDNA_ID_1620553; Annot_ID_160365

SEQ ID NO: 33336 - DNA, 3000 bp, Unknown; identical to SEQ ID NO: 2550
  misc_feature (1)..( 3000): 2750-1469P.txt file - cDNA_ID_3068446; gDNA_ID_1620553; Annot_ID_160361

SEQ ID NO: 33337 - DNA, 3003 bp, Unknown
  misc_feature (1)..( 3003): 2750-1469P.txt file - cDNA_ID_3068474; gDNA_ID_1620554; Annot_ID_160401
attttctattattgtattattcgaagttaaaactagggagacaagtttttgaagtggtatggtgaataaagtttttttctgaagttacagaaaaaaaaacagaagatattttgaaggtttcaagaaaagtattttctacgtatttatctcccgatagaaaggaaactcttcaagtgcatgatgaagaaagagaaaaaagaaagaacctgtttttgggatgaatgatgtatttataatcattatgaccatcggtttcaattctccgatgctctgatgaatcaagccaccgaaacgtctcggctaaactgagttttcctcttcttgatgaaacgtcgtcgtttgattcctcttcttcatgatctattatctcttgccgtctccggagacgtcccatgttttcaagaatcggttaaatgaaatctccggcgatctcttcgacacaaagatctagaaaaacagagtttaatacccgattcaactcttgaatctgacactcgaaacttcgtctttttggtagaagatagatcttgtaatgttttacaagttgaagagaaaaggcgggaagatcacgagagctgcttctctgtttttttccaaattattttttgtttggtcttctttagttcttctttctcgtgatgttaaagctatattgattttgtttctgtcgagaaactactgttttttttttgtttggtttggactctttattagttgaagtgtataacgtaaggttttgtctagaaggaccgaatttatataggacatcagaacatgtcgattgtcgaacatatatcattgtttttttaatataaaaaatctcatctaaattaaaatttggaattgaattgtacgaacggctaataaaaatttaccaaaagattacgatgctccaaatctggatgatgattccctaaaccggtttttgtgaatcatttctagcataatcgaatttaagttaatctggactagtgtacttgaacattcacggggtaagtgggggagttatttttttttaagacaataaatctgttgtaaattgatgtactagttatagacattaatgggtgtgtaacagcatttcctatatgtttaacgtaggatttctgtttaaagtaaaatcaaaatttacatcaggttttgagatttttagttttaaattttccaaatggtcggctttgtataaaaccaagagaagaaattaaatatacacgaatatgaggacgtgtccagaaaaagaagaatatcgacaataaaaatcacctaatttgcatctaaatattgactttcatagtacgctagagataatcagttcatcttcaccttattctttgcattgtgtaaaagagagattatgcagagtttcctagttgacgagaatgagatagcagagatatttcttgttttcgttttgcactttagaggtactaccttatcgagttgtatgaatatgattgtcttgcttctatttttttttttcatttttggctttgattgaataaaggtgagaatttttatttatttttcgcaaagtatttccttaaaatattagtatttcggtttagattagaacaaatacgagacgataaatagtttgataacaaaaagctatatatgttgtgtttcatatcttatcaactcggtcacatcctctttccattggatgcaattctttttcatagaagaaccactaattcttttttttcttttgccattaacccaacaatttttattgtagttagtggttctcccttatgtttctttgccttggaatgtaatcactctgttttgacaaaaaaaaaaaaagaaggaatgtaatcaccctgtttgacaaaaaaaaagaaaggaatgtaatcactctgtttgacaaaaaaaaacaagagaggaatgtaatcactcttaaagtgatctataacaatttgaaaaagtgtcatatttattagctataacttataactttataagttttgaatggatgcagtggacaaagcggtatactttgtatgcggtttaatctaccttattttgaggcggacaataaaccgctgtggaccaagtttatttatatgtaaaaatagttcgtggatgattcacagatgatctgttgcggttttcttcttttttttttgtccggaccactgtgcactataattgattaatggtaaataaaaaacagtctgatccgttgatggttttgtccgcccgaaccgccgtaaccattcaaacccataattaaaattataacgaattactatgtaaatttataactaaaactatcaaattaaacgagttaaattatacttatcatgtctgcctgtaatgataagataatatatatcaaagcttatgaaacttcatttttttttttttttggttgtcattgcaaaggttagattaataacaatatcactgataatgatgcttacacgtaaacctaaacaaacgaggaaaataaactaactcttacacgtaaaccttaaccgatgcagcataggtgttgacaatattttctttccttttatttaaatagacgacgttgagatgtttaaaattgtcatcatttataaccatattttaagttgtctttatctgaaatatacaaatgttcaattagtacattgacctaaaagtctctaggactaatgattgattagaggtttattttgctagaggttctaatatgttgtatggaactagaagcaagattgttttaaactcaatgtcattaagtgaattagagaaagatcatcaaaactcttaaactatatctcccaaaattaacttaattcagtttgaaaagaaaaagcccacaaagcccaaaactcactcattcataagccaattataatatccaaaataaaagcccataaagcccaaaactcactcattcgtgtctccttctctctcgcacaaatgcttcaggagttctcacaacaagatcgagaaatacacacatagaagacgaagaagaagaagaagacgatacagatccacaacgccatg

SEQ ID NO: 33338 - DNA, 3003 bp, Unknown
  misc_feature (1)..( 3003): 2750-1469P.txt file - cDNA_ID_3068508; gDNA_ID_1620555; Annot_ID_160438
gtgaaaatatgctaaccagttaacctatcggaatttggtagaaattttcttccatttcacttttcacatagtgtgacataggtaaaagagggaaaatagcatttggtcgaagtatgtcaaccagttgagctatatatcagaattttgtaatattcaatcgcttatcaaaaatatactgagatttaatttacctaaggcaaatatgttgcaatgtatatatatatgaatcttttgattcaaagtggaatgttatttaatttgaagacctttgtatcgctggtttcggttaatttgttggtcagcagttcagtctttcagtttccgctaaagattacaaattttagaggcaaattatttgcgatatcgagatgtgactggttaggagaaacttcggaaggtcacacgctatctaaaccactataccaggttggaagtctccaactaaagatgtttgacaactttttgtcatcgaaaaatgatcagaaagcggtgtttttaactattctccgataaatattggtaagaatttgatctattatggtgagtacattatccaggtttatatagatatggtaaattatgttttgagttgggtctagttagtggcaaagcatagagcaaccgattgcatatagtttccggtgaatatgatataactaacacatgatggttataatgaataattatgtcgaataccatgcggcggatcatatgttttaggctgtatatgccatacgtgatcttggatgacatgtctttttttcgagatgataacatttattagtcggtcgcttaattgatttcgagttttctgttgccattttaaatacacatttgcgtcaaaaaaaaaaacgagtttgctgtctcgaaaatagcaccaatgcccattatttcttaattgtattttttcggctaaggtttctaattattaatttattatcaaaaccttacatatggtaatggtacactgtacgagtttttggttgtcttgtgtttttcaatttgttcttcctctttatgttttgagttttgttgtcctgtttcattttattcttacttttgttttctctgaattttgttttcagtgaacgtataatttaaaaatctgcaatacaaacaaacaaatatctaaaagtcaagttggctttacgcatgtgatcgacgaaacacctaattgtcttgttctttttcattcgtctgaataatttcatgaaattaacaagacaaaggttcacatttataaaaagggaacgagagcaatcaaactacagaagatcactacatcaaaataacgcatttctcagattctcagattcaaacacattcacctaattgttttgttctagctaggccttttagctatacaaattttgcattaacattacaatttccatcggcatgtaaacaattagcactaactaattaattagtactgcaatatatcaaacataaaagatggttaattaattcagtgtcaagttgctgatcctaatgagaatgcagtgctgagacaagatctgatgagtctaacaaaaatgtgactaattcaaatcacattaattactgtatgtagcaaacataagattatatatataatatatcacaccaatttatatagggaataaaacatatccttgtatgcaatgcataacgtagttattaatatagccttacatgaataacgtcgttaagataacgatatgacactataatgacgaaaccttatgggaacatcatgaaaataatgtaacgcgagttttgactttccaatgtaaacgaaaggagtagaaagcaacggaagactacgaatgaaagtatggagctacgtatagtttacgaaataattaattatacatatagaaaagtagtgagtcaacttttctttccatcgtaatcaatagcccaactgtttactatcattgtttgaaatatcctctgacacagaaatgttatcttatagtcaatttgacgtacaatatgctctcttaataaaatcaagaaatctagtttttatcaaaaactaaattttgtccccattccatggataatgttaaaacattacattcattatagatccatgcatgtgaatgaaaaggctcacgggtaaaaaggttattaaggtatcaatatgacctcaaattttggatagatattgaagatttcataccactttttttagtgtcaaaagacggaaaagtaataactaaactatactacttttaaaagtttgaaaattgaaaaacagattttacacctaatttaaaatatcagatcaaagatcttatctacaagactaaaattaaactagtagcggtctttgctgtccattgaccgagttttgcgggtggtttactcatttaagtaccacagcatcaaattaaaataactgtcacttgtcgaaagtgactagataaaaccaaaaatagctttaattgagtcaaaattgtagttctagtgcaaagtaaagagttatcatcttacaaaatgcgactcattagtgtattaattaattaattttcagtccaataatctggttaatttggtaaactatccaaagagtaattaaatgattcctcgtcataaatactaattttctacgttttaagcaaaaaagacaataattatttggtctgaaaactaaaaaaagacacgagattaagggaagaagataacgatctagaggaataggcaagtggaagaaccagaacaacagctgttcttttcttctaaacttcagaagtcagccgacagttaatttctcctttttttgaggttttgtcgaatcctataaatttcaactaaactcttcttcattttcaatatcaaatcttgtcttcttcttcttcttcttcttctttttcttcttcttacatttgatttctctgtctgaattcgagaaccagatctactaattacctgagagaaaaaagatctgctctgtttgtctgaaacagacagaagtcaacaaatctttcatttgttttttagcaaatcaaagaaatg

SEQ ID NO: 33339 - DNA, 3000 bp, Unknown; identical to SEQ ID NO: 2561
  misc_feature (1)..( 3000): 2750-1469P.txt file - cDNA_ID_3068512; gDNA_ID_1620555; Annot_ID_160433

SEQ ID NO: 33340 - DNA, 3000 bp, Unknown; identical to SEQ ID NO: 2556
  misc_feature (1)..( 3000): 2750-1469P.txt file - cDNA_ID_3068516; gDNA_ID_1620555; Annot_ID_160425

SEQ ID NO: 33341 - DNA, 3000 bp, Unknown; identical to SEQ ID NO: 2555
  misc_feature (1)..( 3000): 2750-1469P.txt file - cDNA_ID_3068520; gDNA_ID_1620555; Annot_ID_160423

SEQ ID NO: 33342 - DNA, 3003 bp, Unknown
  misc_feature (1)..( 3003): 2750-1469P.txt file - cDNA_ID_3068542; gDNA_ID_1620556; Annot_ID_160451
ctgagcactgaagagagaacgctcctgcttgacttgttccgcaaacaaaagcaagatcctggtgcatcaactgtagttacccaacttccagctgtgcaaattctgctcgcaagactaattatgattgcagttagttactgtggaaacgattttaacgaggatgattgggattttgtcttttctaatctgaagcgtctgattcaatctgcagtagttgtgatggaggaaacttccgagaacgtcaacgacttcattagtggtgtttcttccatggagaaggagaaggagaatgatacccttgaaggacttgggcatatagtttttatctctgatccttctataaacagtgctcagaatgctctctcagcattttcgttgcttaatgcgttagtaaaccataaatctgttgaaggtgaagacaatctgaaatccttggcagatgaaacatgggatcctgttaaagatcgaatacttgaaggtgttctgcgtcttttcttctgcacgggtcttactgaggctattgctgcttcatattccccagaggcagcatctattgttgcttcatttcgagttgatcatctgcagttctgggagctggtagctcaccttgtagtagactcttctccacgcgcaagagatagagctgtcagagcagtggaattctggggactaagcagaggatctataagctctttgtatgcaataatgttctcttccaatccaatcccgtcattgcaacttgctgcatacactgttttgtctaccgaacctatttccaggctggccatagttgctgatttgaatgcaccactgaatgatgagtctctcaatgatcaggactcaagcaatgctggtttaccatctgaagacaagctactgctaagagatgaagtatcttgtatggttgagaagttagatcatgaacttcttgatacggacttgactgcgccagaaagggtaattcttacttttcaaaagctttatttggtttattttccctctttgggcaagtcattcactgtttaatcacttttaatggcaggtgcaaacgttcctggcgtggtctttgttactctccaatgttaactctttaccttcactaacccaaggacgagagagactggtgcaatatatagaaaaaactgcaaatccgttgatattagatagtctttttcagcacattcctctagaattatacatgggacagagcttgaagaaaaaagatggggatattccgtctgagttatctgtggtagcttcagcagccactcgtgcgattattacgggttcgtccctgtcaacggttgaatcactttggcctattgaaactggaaagatggcttcgcttgctggggcgatatatggtctgatgttacgtgtccttccagcttatgttagagaatggtttagcgaaatgcgtgaccgttctgcatcatctcttattgaagcatttacaagaacgtggtgcagcccatctctaatcaagaacgaactgtctcaggtatgtacaataaaaaaccttttctcatctctgagagttgcagtgaagatccactaatgcatttgcaaatattctgttcattgtttatgtgagccgcagataaagaaggcagactttaatgatgagagcttttcagtcagcataagtaaagcggcaaatgaggtagttgctacatatacgaaggatgaaacggggatggatctcgtgatccggcttccagtttcttacccactcaagcctgttgacgttaattgcgcaaaaagtattggaataagcgaagcgaagcagaggaagtggttgatgtctatgcaaatgtttgttcgtcatcaggtactgtactttatgagtcatatcgatctttgttaacctgaatgatatctccagttccatcatgtagaccatatatgattaatcttgtcctctccatctaagcccaaattgagtgcctgtcttgattgaatgtttttcttcttcttctttttctaatgtgttgttactgaaagcagaatggggctctggcggaggcgataaggatatggaagcgaaattcggacaaggaatttgaaggagtagaagactgcccgatatgttacagtgtgatacacatagggaatcacagccttccaaggcgagcttgcgtgacttgcaagtacaagtttcacaaagcatgtttagacaagtggttctacacgtctaataagaaactctgccccttgtgccaatctccttgctaatacaatagctgaggatatacatttttgtgacattagtctgtgagttttgctttaactctttaacgttcttaggttttactttccaagaaaataaaagggtttaggtggaaccgcattgccattgatatacatatacccgtatcatatgtgaaaattggaaaagtaataaatagagaaatttacttcgggtacacacacacatgtagtagacccggtcgagaatacaagctaattaataagcgaaagatttgggtgactaattttttttttcctttaattattttattttatggtcaatgcatatatcttaacagacaccaaaacacatagaaatacattaccaaaaaaaaggaatatatttaagctggggattcgcggaggtaaatgagaaaatacaaaaggaaacatatatttaaatttaagaaaacaactaaatgttgtaataataaaggaaacaaataattgaaattaaaaaataaagtgcaacgtccttcgaaatcgtcctcactaagaaatgatgggatttttgatatatcttggaaagaaataatcccagtttgtttccaaaatggcgtaagaagaataagtcaaagctattaattgcaatttaaacaaaaaaaacgttcgttattataacgcaaagactagaaataaaaagaatatttcgaaatatataaactctcctccatcgcattcacatatatcaaagaacaaacaacgaatatcaatattacttttgagttttgtatctgtttgtaagagaaaatg

SEQ ID NO: 33343 - DNA, 3003 bp, Unknown
  misc_feature (1)..( 3003): 2750-1469P.txt file - cDNA_ID_3068550; gDNA_ID_1620556; Annot_ID_160464
tatgtggtccgttaatacaacattacgctgcaatctcggataacaacagtttcggacctatatactctattacgagtatttttcccaaacggaaggatcaaatttaatctcatgtggatttgtgttgttctatttatagaaattttaggctgtataatatctatcctatcaatctatggctaattaaatttcctacaattttagaacttaaataaatgcaaagtatcgatagctactacacatctatggtcagaaaaattagttgctatcttattaggatttcataattcatctaagttcagttttaaaataaaatatttattcttaccctgcaatttaattcaaaagaagtattcaagtcttcaatatctttactaaatacagaaaatatcaaaatatttgtaatcagaattcacctcacctgtattaattacagatttgatcttcttattaataagtgtgttcaacctacaaatcttggaaaatggagaaagtattaaacagaatactaactatatttagcatctaatttcttttacctaattataattagtaacgctaaaatcacaaccaaatgttagaaaccaaaacaaaaacaaaataaggagagagatttaacaattccaaaaatcttccaaccacttttttattaaccagccctctctcttcttccccaaatctccattttctctgcaaatcccaaatccatcacaaaccctaattttagtctctcaaaatctccaccgtttctaccaccgtcaatgtggcggccgtggcgtaaatcgtcggttaagattcacgacacatactctccaaccaccgcttccttcaaagacattcaccatctctgctccgacgactcaccttccttcccttcttctccctctccatctccaaaaaccgcttctagagtcttccaccgagtccgtgcagctaatttgatcctcaaatcgtggccaactcgtcaatctaatcacctcctccgcgcagattccgaacctatcaatctaagccggaatcaaaatccagaatcagattcgaaacaatcgaaaaccaaaaccgaaccagatgtacggatttcaatcccaggcgcagagaaaagcattgtcgtatacttcacaagcctacgcgtggttcgtccaacattcgaagcctgcaaatccgttacatcgatcctccatagcttcccggtacgaatcgacgaacgagatctctcaatggacgcgtcattctccaccgagctacaacgaatcttcgggaaggatcagaaccagaaccagaaccaggcgaagacgccgaagctgccgcgagtcttcatcggtggtcggtacataggaggagcggaggaggtgaaacagctacacgagatcggagagttgaagaaacttgtgcaagagttgccgaagattgaaccaggggtatgtgagatgtgtggtggtcatagattcgtgccgtgtaaggattgtcatggtagccataaggtgcatacggagaagctagggttcagaacttgcttaacctgtaacgagaatggtctcgtcaggtgttcttcttgttcatttccacaatctcctccaccctaattcctagattttcagtttttttttttcaatttcaattttcgaataccagaaattggaataattaaatattggtttttaatctaatttttaagaagtttccaattttgtataattcgtaatggaaaagaagtagtttcggattattagattcgtcgaaagaaaaaacaaatcattagatcatgtgatgaacgtgattagcagctaagtactatttgctgtccaagagtatatatattttcaaattttaaattatagatctgaaatgttgtacggaagaggaaaaaaaataaaccagaggtctaaattgttagtataaaatatagcaaaagtagcaaagattaataattgatggacgttaacacatttctggcctaagaaagaatgtatatgtacatgtgcgcattacatttcatgttatttttgacattattattactcgatttataaaaattataacgcttcatagatgaacaattgattgtccatatcgttgagttaacgtacaaaataatgttggctgtttgagtttttatttatatcaaattttccgagaataggtgaaaatgaaatataaccattggtccactgcaaatatttttagtatttatttatcaaaaaaaaaagcaaaagattattattttttaatgatttttaatttgtaactctgccataccatgattttaaaataaatattatgcacttgtaaaaagtaacaactctaatgaatacaatttgttttacagaaatgaatacaactagattttaacctgcggtataccgcgaagacaatttacttttttaaaattaatatatataaaagtttgcaaattatatctatctataaaatatttttattttctagtttacaattgttattaagtaaagtcctttcaaactcgtcttaccaaactcgtcccgtaaaaaaacctgaagtacaccgctaatttaaatatataattaaaataaatattttacgggattgcaattgtattttagtttgtcaaacagatttttgttttaaatagttgccaaaataagatttagtgaattgataagaaatgtatttagatgcgttttgctcattttaaaggattgcaattgtattttggtttgtcaaacattttttgttttatatagttgtcaaaatctagttcaaatgttggaaaaacatgcgtgatatatgggattggaaaatatttagaatgtttttcgtttgttaatcaatttattgccaaaaaaaccatcaattaaaagctaatggcaaccattgtaaataagtttgaactccacgatttatttcacaaaatcgctgcaaaaatgtatatatagattttatatatcagttattatgttctaacataagacattgtatatattaggtaaatactgttatttatcttagttaatttatatgttaatg

SEQ ID NO: 33344 - DNA, 3003 bp, Unknown
  misc_feature (1)..( 3003): 2750-1469P.txt file - cDNA_ID_3068554; gDNA_ID_1620556; Annot_ID_160463
agctttcttggtttggtctatgtctatatataatgtctgagagatttgggagagtttacaaattcctcagtttcatttggaatgcaccaaagatctatgaaatacccttttctataagctactcgtatcaaggtgtataaagatagctaataaattagataaatgagttgtataatcatgggaaacacacacatggcctcaactattccgaaagactgagagtaaaaaacaaatcctcaaagtaatgtattgtgtagactgtagtccaaaaagatacgaattttattcatatgatgcatggatgtacctcttagtggatcttcagcagagtaccactcactccaaggacagtcatcatcccagagcaccttattgcgtgactcagaaccatagtgttctgcagtgtctgatttgtcacccataacctcatccgtatcaatttcctcatcctcctcgtcatatgggaaggtttggtatgttagcctcatcataaaatggactctgaaagtatgcatcgagaagtccactcctgaataaaccttcaaataataaaatgtcatcgatgaatacaatatctagctaaacaatttaattacgtgatagaattgatggctaatgcttaagtttcaggtccattttgataagcaatagccatactaatggacatcactaattaagagccacgaagacttacaaacttagaaacaaacaactcatatagcccttccaggtgcatgagtttcacgggaacttggctgccaacacgatctgcttcaaatcttctagtaaaaacagtgcccatattctggattccaatatatgctttgcgtgaagggtcatgcacagggacaaaggctggccacaagctagataccaaagtagtataaaaattcttaataatcactcaaccaaatatgcgtctaatcattatctacttagcaaagacagggataacacatttctatcaactctgatttccaagacttcggagtaattggtaggcaatttggatcaactcaaagaaacagtgtatcgtaagagattcacttgacgatgcaaaagctaaagtgatgttactggctaggatatcgtacctgccacagttagacaaagcaatagcaaccgcactcagaagcttgctagactctggtgtatcaagaagcaccccactggcactttgtggagcaatcaactagaagatgccataaaaatcaataaaatatcatatatgtaaacgggcaggaactatttcaagaaaaaaaaaaagtggatttaaagtgtaccagaaaatccttcaccccaaagcaaagctggagatcatgtgaattactgttccaattaccaattccagctgcatcagtcagatactgaattatgaaacagaaaatacagtttctcccagataaacagcattattttgaaatcatataccttgttggctaccattattatcaatttgaaagtagaactccatacaatagctctttgcaacattcttaagttcgtgtttgaccgtaaacagattctttgaatcctccactgcaacagcacccttttcctgcactcaccaaatgcaggtagcctaagaggtcaagcagataacgaaactaaagtggatttcacaaaacaagactaactccatctttgatcatcaataatatccaaaatagtacaaccagctataacgtccgggaagaagaaaactcgagcattcatgggattctaacgagttctcacttatagaactcgatcgaagatggatgagatcatttggaaaagcaaacgtaccaccaggtttttgggaccatcagctaaccattgacgacaagttgcttcaatgtctgagatgaacctaaaaaagcgacgggattagtaatgacattagtgattgaatcaaagcaattgaaatcgtgaagatgaatacctttcccaggaagaagctagagtgaaatcatcgaaatgttgcacctgcaaaacaattgctgatcattgaatacaaaaacgaacagcagaagaagaacaaaaaagttttaggatgtagtaactggcatacctcttcttcagcatcatcatcttcttcgagatgattcgatttgcttacagaagccataataaattgcgtaacgaatatctctcagtctctctctgagtttgtatgggtaaggaactcttgcagatcctccgatcacacagacgaagagatccgcttcgggaaagaacaacgacgatgatggtaaagttacaggaaaacgtcgtcgtttgaagctgacttgagactttgacaaacggcatgaacaacgcgtgccgtttcgtttgattgaaaaacgggttgcattattgttcgacgattaaaaaggccaataataataggcctaatattggcccattataactttaatgctcaaatttaagtagtgaagtgaacacatgttaaaaactaagaccatctctatcaatggtttcttatctagaaactgttcaaagtatgagaaagagtagaattagtttttcaagtgagaaactctgagaaacccataaaaatatttatatatcatctattgatcaaatattattttattattaaaatttaattatataattaatatttattaaaatactaatctcttttttttactgatgaagatgccttaatcttttcgttgtcatcctaaattcctaatatctgtattttgtgatcattaaaaacacaattatgttagcagggaccacaatccaccactaaaagataattatctgtaagaaattaaatgaaattggtccaacacatataataagaaaattaatgataatttgcaaaattaaaatacaggagcgtagtggatcgagaagagagtgtaaaaatcgtactgctttacataaatgaagtcgtcctcactaaagctaacaaagatgaagaaatccaaaactccctgaaatctgaaagcacaaaacttccattttcatctatctcaagtgctcattgttcattgtcgacgtacaatg

SEQ ID NO: 33345 - DNA, 3003 bp, Unknown
  misc_feature (1)..( 3003): 2750-1469P.txt file - cDNA_ID_3068562; gDNA_ID_1620556; Annot_ID_160454
gtttcccattttctctgcgtatccaacctgcgtccaattcaagaacacaactctttctttaaaactctggactctttgattactagcaaatttatatattcctatcctctcttctaccgcattatctttaaaagaactcattttcatttgcctacaagagacccatgaatgccatctttttattctacttctccactcttgaaatctcactaagaatgaaatcacacactttgtgcttaaactaaacaatctccttatcacattcttcactctattgggcaattaagaaaggcatcatccttctaatgttaatgtgctgcataataataacgtacctggttaacaacaaaacccttcatcatgttcatgaagtctgcacgcctttctctgtccaacctctcaacctcagatcggttgttttcctgcaatgatacaaatttacacagagcataaccaaaatattcatatcatgttggtaaaacagcacaagttgtgatatgcatagggttattactaaataccttgattcgctcataccctttgatggcaacattttttgcatcctcagtgaccttgattgtttcttttaactcttctatttttcggatccttgatttgtcaccaccaaataccttcgatgatgcagcctctagcttctcaactctagtttgcagagaaggaagctctgatagaagcgtctgaactgtcagtaaagcactagatctatctgcaaatgcgccttggacagccatcatcatgccaaggtactcatggagtgtgtcctgaaatgaacaattaaaataaaagaacagctcttagtgaagctcaaattccagcagcatctccaacataagctgacaatctgccaagtgtccactagttaataatgaagatacttgctacgcatggcgagatttccgaaatcctaatgtcaatcgcttaaatcgaaatgatcatttttttcagatgaagaaaagaaaataacatttcatttgattccaagtaagggaggtagctgtataattctgtagttatttaccaagtgtttgacagtttgggaattcaactccctataaaatctgcttgcttttacagcagcagtggctaaattcttcatatcattagcacgagttctttgggggttgcagacagcttcctcgttctcgaacttagtcagcttaatgaatgctaatcccagttcacccatggtttcacccatgtcttgctgtgctttcacaagggattccgcctacaaaaagaaaccacaaaagggggttgttccaagcaggatactacatactgccagaatgatgcacaattcacctaacaagtatgaaattttacctgctgtgaggcattgataatttgctgctcaagatcatgcatcttctccttcttttccaagaactctttatcttcttcaacaacgggaggttttgatccaccccagtcattagaaactgactgcctcagctccttgaataatctcagcagatccctacctcctcttgcaggctgacccacctcagtcaccggcactgcagaggctccgccttcaccgaacaactgttttgggagcttcaccgccccatccaacatccgagaggccacatcagtactcattggtagtggcaacttcccttgcacctgaagaaacactttcaactcgtcactgttcctaataacagggtgtgcacttagcctgcgcaagtatttctccaatgcaactcttctctgctccacgaactcttgtttctgcattacttggctctctacgacgctcttatctggccgtggtggtatgcagaaccctctatacgtctcagccaatcgatcagccaatgtgacaacatctctgaatcttcttcgcacgctaaactccgatgggccgccaaagtcagggagattcgttctggtcgtaatttggtaggtgatgtaagtgtttcctccaacaatggaatttgaaatctcctgctctttctgagggttagatacagtgatcttgatgtaatcagagcttgaagaagaaggagatctcgatagtgaatctgagaattgactatgaaggctattatcctcggtaccgttaatctcgctatctgagttctcatcaaagggactgaagataacatctgcatacgacggaggctcgatgtaggagttatcgctgctgatcggcttagagctgaagctgctgcggaaatcttcgtaggaggatggcgcaaggagtggatcagaatcagctggaatcataacggtcggtggcggcgagagcgggtcacggacgttggagagtgttgacatggcgctacggtaaccagagttcgatgtatcaccgttgacatcgcttatcttcagaggatggtcaccaccatctactcctaggtcgagattctccatatcatccctttgcgcattgagattagtttcttcgaatccatcggcattctctgagcccatcatttcgacttctctggagtaacgacgaactaagctaattgaaattaacagaaaattagggtttgatgatttgggaacaaacggagatcccctgaaatgtgacgctgagcgacggtgtggctatcgaattaaaagaaaccggagtgactaaaatgcgcaggtggggactatgggagcaggagactaacgtgcacaccgtggcgggttaggggtggcacgtgataatggcttaaagtctcgtcaattgacaaatctgccaatgcgtacatgtgatgtgaagaatctgacaactttcaggtaaagtatagtcgccgatgggcttgtttaggcccattaggaaagcccaatattaattattgacggagatagccatatagctgcatccaaacattcttattaggtttcgttaagcagctgcagagcttccctgatcgtgtcgaaatcctgtgtttaactggaaccgagtcttttgatgtaaaaggtcaacaactcataaagacacttcaaaaaggttttccgacaaaattcttatcttctcagatg

SEQ ID NO: 33346 - DNA, 3000 bp, Unknown
  misc_feature (1)..( 3000): 2750-1469P.txt file - cDNA_ID_3068580; gDNA_ID_1620557; Annot_ID_160490
attttgagattttggtagtgactgtgggtttctttggtggctataggttgtaaaaatgagttctagggctggtccaatgtctaaggaaaagaacgttcagggtggttataggcctgaggttgaacagttggttcaaggtttggcagggacgagactggcttcttcacaagatgatggaggagagtgggaggtcatttccaagaagaacaagaacaaaccaggaaacacttctggaaaaacttgggtttctcagaattcgaatcctcctagagcttggggtggtcagcagcaagggagaggtagcaacgtatctgggagaggaaacaatgtatccgggagaggtaacggcaatggtcggggcattcaagctaacatatctggtcggggacgagcgttgagcagaaagtatgataacaactttgtggcacccccacctgtatctcgccctcctttggaaggaggatggaattggcaggcaagaggaggttctgctcagcacacagctgtgcaggagtttcctgacgtggaggatgatgtggataatgcttctgaggaagagaatgattccgatgctttggatgattctgatgacgaccttgcaagtgatgattatgactcggatgtgagtcaaaagagccatggatcacgaaagcagaataagtggttcaaaaagttctttggcagcttggatagcttgtcgatcgagcagataaatgaaccacagaggcagtggcattgtccagcttgtcagaacggacctggtgccatcgattggtataacctgcaccctctactagctcatgcgaggacaaaaggagctaggcgagttaagctccatagagaattggctgaagttttagaaaaggatctacagatgagaggcgcatctgtcattccttgtggtgagatttatgggcagtggaagggtttgggtgaggatgaaaaggattatgaaattgtctggcctccaatggtcatcatcatgaatactagactggataaggacgataacgataaggtggaattcttctgtcttttacttctttaatttttctcttgcattctactgatcttagaatgttacattgtagtggctcggcatgggcaaccaagagctgctggaatacttcgacaagtatgaggctcttagagcacgccattcctatggtccacagggccatcgtgggatgagtgttctgatgtttgagagcagtgccactggctatttggaggccgaacgcctccaccgggagttagctgagatggggttagatagaattgcctggggtcagaagcgcagtatgttttctggaggtgttcgccaactgtatggcttccttgcaacgaagcaagatctggacatattcaatcaacactctcaaggttctctcccccaaagaaatttgatatatgcttttagttttgtcattggaatttaaagttttgttggtccgtgttaatgcatctgttatgtatatatctatgattcattaggcaaaacaaggctgaaattcgagttgaaatcataccaagagatggttgtaaaggagctgaggcagatctctgaggacaatcagcagctgaactactttaagaacaagctctcaaaacagaacaagcacgccaaggtgcttgaggaatctctggaaattatgagcgagaagctgcgtagaactgcagaggataatcggatcgtgagacagagaactaagatgcagcatgaacagaacagggaagaggtatgatttttcctagaaaatcacaaacttgacattttgtattacctactgattcacatttttgattatattgtccaacaaaaaacctgtggtggtttgaagatggatgcacacgacaggtttttcatggattcaatcaaacagatccatgaaagaagagacgcaaaggaggagaatttcgagatgttgcagcagcaggaacgtgccaaggttgttggccagcagcagcagaacattaatccctctagcaatgacgattgccgaaagaggtatatgtactaactaacataatccctctggcgtttttgtttttcaaacctaagagtaactgaattattccggttttgattctttcgcagagctgaggaagtgtcaagcttcatcgagtttcaagagaaagagatggaggagtttgtggaagagagggagatgctgataaaagatcaagagaagaagatggaagacatgaagaagaggcatcacgaggagatatttgatctggagaaagaatttgatgaggctttggaacagctcatgtacaagcatggccttcacaatgaagatgattgagacaaaagtctggtacacaagacaagactaagtttctttgttttgcttttggtatgtcggaaagtaggagatctgagagactccatttaaatactaggacaaatctaaggagattatagattattatcctccaatttttagtagacggatctaaggaagcattaagttcttgtgactaaaaccaagtttccttagtattttgtttttttttggtaaaatttcatatgaaagttagacatattaccaaacgtcagagtgaatcacagaatggcaaatcaaaatcatgtttttagaattttatatctacaaaatatatgggtacaaatattattttctaaaggttcgggaaataatagtaaatatctaaaatacagagttctttagatgcaaatgttactttgttctaaagtctaaagcgacgtgttggtgtcataaaacacttctacttgaatcgcattggaagagcatcgtcacgactccatcacacttatatattttgtttattcaaatcttctttcagatttttatacaaaaaatataaattaaataaagaatcccataaatatctctctatcgaactctctctgcttttacaaatctcagaatctccttcagcgaattcacatctcagctgcttttgaatccgccgtaactaaaaacaatcctccttttctcgattcgttaaactatg

SEQ ID NO: 33347 - DNA, 3003 bp, Unknown
  misc_feature (1)..( 3003): 2750-1469P.txt file - cDNA_ID_3068588; gDNA_ID_1620557; Annot_ID_160486
gttggaagcagtagcaccattgttgtttattttttgccatgtgattggtctttgttttgttgagatacttttgttttccgcaatagtgatgtcatgaatgcttggcctctttctctttttatcctctgagttgatatgtgcaaagtatttttgagcatgacttgcaacctgagttgatgttcttgtcactacacagtgacgagaaatactacgccaatcacctttcccatattttttcaaaccatgcagaaattgtctagtttcattaagaaaacaaaaaatagtgtgagaatcaacatattttgagttctaatatcaaactgaaaatgcaataatgttaccagtgaccacatatacaaatcaacacattctgagtttcacattcagtgacctgtaaaataataactacgtctaaaatattatttaaaaacaagtgagtttagtaggaacctgtgttcaaaaggcttccaaggaacaccccttcgtcgtttttgctttagttttgatttacctttgtgtttagactcatatttgcgatcgttgccaccttccaatatgcttctttctttaccaaaagcattgtgatttggttcttctaaaaaatcatcataatctggaagacgtacacatccagattcaatcaacataacatcacgagctaaaatgttgtaatgctctataacttgttctaaagtttttcccggaacaactgtagcaatttttttccaacgaatctctgttttatcgttataaattgcaagggctttctcgaaagcaatatcatcatccttgctccaagacgatccgacactaatttcctgtcctaaattcattttctcaaaaaaatctattacttcaaacaatttagatcaaccaaaatactctccgaccaaagaaaaaaaaagaccaaaacaattgatttgaaatcgtaaactttgttttatgaaccccacaaactagtattgatagactagtaagaaccccaacctttgattatttcaagaactatgaacagaagatggaaaaggatcaaaacaccagttctatagtatttatagttaaaaccacaatatttttattttcctttttttctctaattatggtgcttaatactttgtaccatacgacaaatggtatataatatcaattgactccttttatgttaggaaaataatatatagaaataaatcttcttttcttggcagcacatagaaataaatctaaattaaaattttccattttataggattaaataaaattgtgctggtgtcaactgtcaagcaacaattttgcaattccaacacatctaagtcatgaggccaaatttaacttttaataaattgccctatatatctttaagaaaataatattaaataacatcttaagattccatcacattttgatgtagaatattctttcacacgcctagtgagacaagaatcataagaatattttttaaataactaaatatgtggtctctacatttttttaaataattgaataaaaataaaatacatttttcttaaaacgtggagaccacatatttaattattagaaattacttagtaaaactaaatatatacatcttaattatttttttcttaattttaccaaaaataatatatatatatattaattaatttcctatgtgtaaatagatatatatgtttaaaataatcttgtgtctatttaaatacgtcatcatagctgacgataatggccaatgactaagcatgaacatttgggtactcaagtcggtttcggtttgggtctttcgagttcgggtttttcgggtttagaagtttaggatccgttcggttatatgtattatttcaggttgaatttggttcggattcacctcgggtttagttgattcgggtattggtcgaaaaacttggtaaataaccaaaactattttgggtttgagtactacttactgaaaccttgtctaaatatatccaaacatgcaaacatacataaaataaaagtatccataaaacccaaaagatctaaaaataacacatattttcttaagacaataacataatacaagaagtaaactttattttgagtttgttccataatccaatcattaaaaaaattataaattaaagttatcagtatatatatatatgtctgtacatgtgtgtatatatatacattcgggtaataaaaagtactcaccggtatcagatttggttcgggtaatatccaaacctgaatttattttagaacagaatccgatcagatattttacaagaaccgaagtagagcggattcggattattcgggtcgggtttggcttttggattcgggtattgcccaggcctacccaagacacgctttctcgcttattgtcgacaatctccgaagacggcccacttgagaagttcaacttctaatctatcacattaatgggattaaagtctgcccgtataaatgcagacaaaaaataaaaaatctcaaacttctcttattaatgggctacgcccatataaacccagacaaaaaaatggaagaagtaaaacttttttattaatagataagtaaaaaggttataaataaaaattaagattagagatgtgataaaatcataaattaacaaaatatagaagtcttcgaaaagaaaaccgaagcggctagagagctaaactaagccgattcaatcgtggagtcgtgagacgaacaaaaggagagagattccttttgggtttcgccgtgattcgatcttcgcatgtcaatttgaaaaccctagtttttgatctctctcaattccaagctactcctaatttcaaggttcgtctctttccctcctccttagatctgcttctgaattgaaatcttttgaattacgattgtaggaacttggaattttcttagctttttgtttcattgaaccgttttgagattttgatttgttcttagtcgtgaacgttgtgcagaactcaaggaacttcagacgaatttaaggagaactagttttttttttttttttttgaaatg

SEQ ID NO: 33348 - DNA, 3000 bp, Unknown
  misc_feature (1)..( 3000): 2750-1469P.txt file - cDNA_ID_3068597; gDNA_ID_1620557; Annot_ID_160480
aaaataatgtgagaatcaaattcaaaaaaaaaaaaaactgagagaaaatatgcgtgcataacacataaaaaaaaaacgtaaaaagcctaaaataatatgtaaagaatatgattattccattaattttacttatgattttaagtttcgttatatgatcgaaaccattaatatgattttggtgataaagaagtgccatttttttctatgcgccaaaatatttcgggcaaaagaaaattttagcctaaaagatggtttcaaatcaaactaacttcgactacgttgtttttaagaaaattatttatgggaattaaaaagaaaatcgtttaaaaatgttttaacaaaaacaggagataagatttacatgtaacgtgccacatttgatattttagtgtagagtgatatctctaattattgaaggctttattggacaatagatgagtgatgattccactcccatgtaaaggagaacgagataatatcagcacattgtgtttttttgcccttttctttgtttttctctctttctctttcgcttctttatttttttataaataatttgcttctctttttttttcctaacatactaagaacaatgatgttggtcttttccaaaatctgatagaacacttggcaacttgtgtagctgtagtataattgtatttctttttatcgcaataattaatgccaacatatcctcaattatatatattatcctagctaatcgtatttgcaccgtacgtctatttcttatatttttctactctattaattacttttattcccttaaaacattaacactaatttttattgcgtagaaataatcatatttcattatgtaagaagaaaattattttaataatggaatatattttgtacatatataatgtgtaaaaaattaattttaacttctattactaatttgattaacaattaaacgcatattttcattacgatggcactcttaagcagtctagtatctagagtgtagacaatagacatgcatggttattgagactgtttacctaatctcattaccatttcctcagccagttgatagatcatgcttcactttggcttcttgtgtttttttcctcttcatcatattttatttgtaaataggtgatcgtgttcacaaactatatacgttatacattattatttataaatgaaaaaccggaattggttagtaaattaaaccaattatgatatgtgcttggtgcgtatgtgtatatgtatgtctataactctatatatcctttatataaactcccactatggcactctcatctttgccgttaagatatgaattagatataattcatcaattataaggcaaaactttcgaatatggttggattttagtagagctggccggcagctttggtgcacaacaattgtctctcttctttacaaaatttatatatattattatgttgctaattaagtttatctgctcagacgtataagatatttgtactcacatattgcatatcgtactgtatatgataatggaatgtgctaaggatatatatatttaaaacgttttcataaatctcatcaaggacttgatctttttataaaagcattttcgtgcctttctaggtgtatggacgtatttaaacgaaggtttatctagtccttcctcaactttattaaactgtatgcaaattaatcagttagttgtttattttgtagaccaaatataatccgagtctatattcatttgctgattcaaaaagaaaaagtatatatatatatatatatatatatttttttttttttaaaattaaattcaattaggtttaataaaattatacaccggactaaaataaaaaaccaatttgaattattcatccttcaaataattcttggtaagttaaacgaaaccaaatcaaacataatcacgaattttccttactcactcgttttatgcaagatgaaaattacaaatcgaataaatataccaaaatatcaaattaaaagtcacatacatatagtaacgaaatcgaaatttgagaaggaaaaattgatttttattttcctctcgcttggttggtgcatgcacgatgaaaatgttttatctttttttttttttctctcaaaaaccgacttgacattgtatctatcggagtgttgtaaattatgtaacctcttttgataaagacgagactctttttcatcgcaacaatgacatatcctaattcttagaaatccttatttggctgctatagaagaacaacatatttttttctttttccaccagccattctcccatctactcgttggtgcaatattcacatggaaaacagttggatttaaaggagattacaaaacttaattcataaaatcgaactctatatatggaaattaagggtgacatattaaatgcaattcaacccaactaaaaatgttgcaaccgaaacaaatcaatcaaactaaaataacatgcaagtccaaatatatcataatactaataaatatgattcttttgtctcattaagcatctggttctatggtgtagtggttagcactcaggactttgaatcctgcgacctgggttcgactcccggtagaacctcatttttttctttctccaaactaaattttaaagttctaaacaaacaggtcatcagctatcacatttgggcctagtttgaattagtggactccaaggcccaagatacgtaaaatcgctatttcgttttaaggttctaaagataaattatctgtactattaaatattttaatattaaaaaagaaaagaaatggttttatgatccgatcccttctcaatctcacggaggggaaaagattcctccaattcaaatctctgtctgtgtctctgtctctcaactttcaatttctgagagagtcggaaatattctccagatcgcctaaggcaaattcgttttccgattcggcctagcgacggcgagagaggagaggaagaggcaagttgattgaccggagaagaagacgaagccgttcttggagaaaatg

SEQ ID NO: 33349 - DNA, 3000 bp, Unknown; identical to SEQ ID NO: 2573
  misc_feature (1)..( 3000): 2750-1469P.txt file - cDNA_ID_3068622; gDNA_ID_1620558; Annot_ID_160528

SEQ ID NO: 33350 - DNA, 3000 bp, Unknown; identical to SEQ ID NO: 2576
  misc_feature (1)..( 3000): 2750-1469P.txt file - cDNA_ID_3068657; gDNA_ID_1620559; Annot_ID_160564

SEQ ID NO: 33351 - DNA, 3003 bp, Unknown
  misc_feature (1)..( 3003): 2750-1469P.txt file - cDNA_ID_3068669; gDNA_ID_1620559; Annot_ID_160555
tgtttccacacttttaaacagtaaaaatcaaatatagtagttgtacacttaaaatttatagatataaaagttataaatttagaaaatacaaaaaattaaatcatatatatttttaatgtactaaacaagttaaacttttatttttttttttataaatatgggttataatctagtgcaattatataagtattacatatttcaattgttttaaaataatgttgtttctgaaaaatgaaatgttataattattggttttgaaaactgaactaatgtataattattatatgtttgcaatatcagtattaaattgcttatattgattaaagtttatgttgattacagaaatggatcattcaaacaaaatgatagcaaagaaaaatatcatagaaatttgcatattagataatggaacaacacactattttgagagaagatatttttctctaagttaaaaccgataaaaattattatcaatacaatgtctaatcctacagacttgattgaaggaagtggcaaagaaaattttaaattgcctaatggatcggaacaaagttttccataaagaatgctttatattctctgaattcaaagagaaatttgttgagcctcaagacatataccttcaaggatatgttactcagtgtgcaaatgagaatggaaagaagtgtatgtctttaactactaattaatctggaaacaaacatgtctaggaaatattttcagaacttcattggtgtttgcatcatacttataaagttatatagatgccataaaatcgtatcttctgatcaaaagaaatctagaagatttcgtattatggcatgatcgccttgggcatccagacactaaaatgatgcagaaaatcatagaaagctcactaattaaaaaatcatgagataaatcatggaaagaaaatgacatatgcaacatgttctcttagaatattgatcataaggccatcgacaaccacaatcaatagaaaatcaccaaagttccttgaacgaattcaaggagatattttgtggaccgatacatcaaccatgtggaccattccactattgtacggtaatgattaacacatctagcagatgatcacatgtttgtctattgtcatctcaaaatttggcttttgcgagatttatgactcataatatcaaataaacagctcaattctcagattattttattagcagagttagattacacaatgcttgtgaattcacatcccaagcattcaatgattattgtatggtaacgggaattgaagttgaacatcatgtagctcatgttcatacacaaaaatggtttgtcagaatcataaattaaacgtttgcaattgattgcaagaccattgatcataagatcaaaacttccaacctctatatgcggacatgctattttacatgcaaacgcactcattcggataagaccaagtgcatatcataaatactccccttatagttagaagactcactacttgtgccacaaatcggaagaaaataattactcatgccattgttatgtttgctatttttttttttttttaaatcgagtaaaagacaaaataaaccaaggaagaagaagagggaaccaatgctaatgttgtaaatttttgaatggtgcttcggaaacaagtagttcaactaggacgaaaatatggtattgataatattccggattgaatatgcaggatacatataaggatgatgatgattttcaaccactaccgccacaaagtctatagttttctccaactcagtacaccaaggtgtgtaagataggaaccatgtgtcaattggtccaaatagtggaagtgatagagaaaatggatgcataatcgaggtgatttaggaatatgatcagtttaagcatatattccacatgcctaaggaaccaaatcacatgattcaaggcaccgctaaacgaagatgatgagagagtgttggtttgtgatgaatggagtgcatataagatattctttgaaaaagcatgagtttttgaccgggtaggactgccatgagtacccaaaaaattataagaagttggacattttgaagtttgttgaaaagatgtttaagaggactgggatatcaaaataaaagacgtggaagtgaattgatggaagagttcaaaagtgagacgtctgtggctaggataaagttgacaatcttgttatttttatccaaggttgtgagagtagattcgaaaggtgatgcaaagatagaggacttactattaaggattgttgataatgtgaaatcttgtgagacattcccgtgaggacgattttcatttgagcagtgtatgaaaggggtccggatagtgatgaagaacatgaaaggggtggtgaaaccaaaagcacagactaccttttatggattcatttctccacttgacgttatgagactagtaaattataaaaattaacaattttgaagtgttgttgtgcatttaagtgtgcgtgattgtgaatgtgtagattctagcatttaagtgcattcccccagcttagaaaaagattcatagaagttgtacccgcagaaaaggattatccaagaatgtgcaagcacaagttcactgaactggagagagcggcttatcaagcacaagcacaagcactgaaagttgcatgaaaggatttactttggaagaaataaatgaagcgcttggagatataaaggttagcttgatcccttgaaaactatcaatttgaaactgtgtggtgtttgattatatgttaacttgacaagatatttcaaacatcttagaacctgatgtggatgagagaaatatgttgtctcgcctaccgagagttatgttgatgatgagatttgatatatcgatccaattgttgatagctggagagagcgacttatcatagagaagaagaagatctgttggaatagactttacaaatcaaacattgatgttcgacgtattattgatgttaatgatgtccatgaagtccttgttgcattaattctcttgttacaggaaactatg

SEQ ID NO: 33352 - DNA, 3000 bp, Unknown; identical to SEQ ID NO: 2577
  misc_feature (1)..( 3000): 2750-1469P.txt file - cDNA_ID_3068677; gDNA_ID_1620559; Annot_ID_160545

SEQ ID NO: 33353 - DNA, 3003 bp, Unknown
  misc_feature (1)..( 3003): 2750-1469P.txt file - cDNA_ID_3068711; gDNA_ID_1620561; Annot_ID_160595
aaggccttgccaaggaagactagcaagagagactgaggtttagggacaaatggaaacaaattgaagaaaactctaaaatactgggtgaagtaaagatgtatctataccttcctcgaagaaaatacataagcacgtagccaagagattccagatcgtccctcctactttgctctgtttaaaggatctcaatttagtttgataaacgtacaaatagtcaagtttttaatgtgaaaatgaaagaagaaaaagcaaacaatactcaccaattccaagatgagtgttaacacttgcatatcgagctgttccagtaagattcttgttttccctaataagtaactctcgattagtaaatatattaccaatatttcactaacaattcgaaaattttaaattgagcaaaactttttaacaagaaaaagaaaaatgtgtacctgtagggaatgtgtctatgagtttggagatctctatacttttttgcaagtccgtagtcaatgatgtacacctagacaagaacaaagatgacatatcagagaaaagatgcaaacatatagaaggattcacaaggtagtagcaaaagaaattccaaaaccaaacaagtatattatcattccacacaataaagttgcataccataactactcacctggttcgctttgcgtccaagacccatcaaaaagttatcaggctttatgtcacgatgaagaaatccccggacatgcatatactcaactctattgatctgaagaaatcaaatcatgagcaacacaataactcaaacatatcagagaaaaggtagataatatatccgtaccatttgatctgcgagcattagaaccgtctttagattgaacctccgactacaataattaaataaatcctccatactcggacccaaaaggtcaatcaccatacagttgtattcaccctcaaccccataccattttagatgtggaataccagcttcaagaacacaaatgtaaaagttaataaaagaacgataactgaaggtttaaaccgacaaaaggcaaaacttacttcctccttgaagaagcatataaagctttgattcataatgaagttgaggatgtctagctctcgcaggttcctacaaagaaaaaaaccaaagttttagtaatcaagaatgagtttttacacattactgaattgaaaagggtaatagtcaaatgttgagacttacaagcttcacagcaacttcttctccagtttgtacattaacccctgaaaacaaaagagttattacaaaagcaaaacttggaattaccaaaagacagaagaaacttcaaatcacattacctagaaaaagttcaccaaatgatccacttccaagtttacgtccaagcttatacttaccaccaaccacacgatccatcgttaccaaatcaaaaagcttcctcctttcttcgatctcttaaaacaactaatccccaacaaaaccaaaagttgacccagatctcaattcaatgttccctacctctctaaaagcctgatcgaaattcaaagatccccaattcaaattctagtaagaacccttcaaatatctgaatcaaatcaaaattgtaatcgattcaccaagtaatcttatgcttctgctttaacacaaactaaaaatcacccattgaccaacaacatcttcatagaaagtctgacactttttttcagacaaaagctttagatcagattgaagaaacacaaaatgaaacggaagagacaaaaccaaaacaaaaaaaaaaggtgaaaagaacaaagagagacgaaatcagacccaaaaaaaaaaaaaatgggtcgttggattcgattatcgtttgatctataaagactgctacgagacagcttgattcactatttttttctcttttttttttgctgaattttttttttcttaaggaagataatggattagagacgaaaccaaacgttaaaagaaaaatgaaaaagaaatctgacgagacggccttgaagaagagattttgagattttctttccttatccctaattttttacaactttttatttttttgcttaactaatttgttttctttttctccaaatttgatttattcttcattaactgtaaacagtaacgtcactatatgaaaaagatgataattaatgacataaaattagttggattttaatattttctagcatctttattttcttccgctcaagcaatattgattattttttggtaggcctcaagcaatattgatatttgatttgaaactattacataaaaaatatcataaaaaaacataatattctaccaaaaaatgagtatttgataatatatttttaaaagtaaacaaaacaaaatttgtctcgaaactatcagatacaccataaaaaaaaaattggtactatttataaaatactatataatcacttgattgttaaatttgctttttaatttttattggtaataagaaaaattattactaactcgataaaccctgatataaaatattttattatgtagaataaagtaatataatagaatcgaatttcgattgatattatattatcttctttttttgtttagaccatttcttcaataacagtgtcaaacatataatgacatgcattttctacaaagacagctagaactttagttttatatattcagacaccacttacaaaagaagaaaatattaattaaacatgaaaaaagtaaacattgaacatccccatttaattagggctttaccaaattagtcggtacgataaactcgtctaaacattaaatgggcttaattagttgggcttattttaacactaaattggcccattataacttcccaaaatgatattggttcgagatgattcgataacgtgggcatcaatccatggatcatctcagctttcaccatcaccaataaataaacacacaggtctgctttcataccttcacgctctctcactgatcattcacaatctctctctttttttcaccggcgataattttccgatctcgattataagatg

SEQ ID NO: 33354 - DNA, 3000 bp, Unknown; identical to SEQ ID NO: 2581
  misc_feature (1)..( 3000): 2750-1469P.txt file - cDNA_ID_3068725; gDNA_ID_1620561; Annot_ID_160618

SEQ ID NO: 33355 - DNA, 3000 bp, Unknown
  misc_feature (1)..( 3000): 2750-1469P.txt file - cDNA_ID_3068738; gDNA_ID_1620561; Annot_ID_160613
gaaatcattgttctgtagctgcatggttccagtttcaacaaaccaaaacttcaagatccccaatatcaaatcacagtattagtataagatcatgagctaatctaagaatcctaaaacagaaagaaaacaaaagttctaaggaaagattttgtcgggaaaaaaggaaaaggcaaggtattgcttgctcatggcaaaaccagaagaaaactaatattgatactaggcagctttcggcttaggtgtcctcttcttcaaattcttcttggcgggtgtcgagttcttcattccgataaagaagagtaacgctccaaagagtgcaacgctctgcaataacaaaaggcatgagatttttatcgagatattgtccattgtgataaacagtatgatctcttggctttacaaggctgaaactttaaaggtgcaaagctgcgtttcttaagattacgataattgataataagtttctggacaaacctgcaagaactctgtcaacagaagagagaaatgacgttcctgaggtccgtagttgtagaaatcatagagaataggaccgaaaaccaccaagtaggaagcctgaaacaaaaaagattaagattttaagagatcatacaaatagcaagctttttgaatcccttatttgtaagttgaacaagaagaagcctaaccagaagataagcaccgaaggtgtttccgataacaaagagtaagcctccgactcctttcagggcaataatagtagcaacgacttgtctcacctataaaaattcattctccaagtcataaaaagacacttttaaagagtgcgaacaagagacaagaacatcataaccaggtcattacctctattttgggcaatgttactcctaatctagaagataaatgtgccttaaccaaatcaagctttggagccaattctttagctgcaggaccaccatcattgaacctattcaaattcccccaaataagcgttgttaaaatttagtaatatagtcaaaagaggaagataatattttgagctatcaagtaaacaaactaaaatcctagtaacgactaacgaatagtacgagaacaatcttattttacatttatcgatcatcttccatttagagtaaatgatgctttgtctctagaccactaaacattggaataaccaaaccaattcaacgtctaaccatatgaacaacagagctaaagacatctataaacgaatataagagagaacaattatatgtgccctaaatgcggtaataagcccaagccagattcaaccatgatcaaacaacatcatacattgattgataacacaagatacataaatattcaaactttgattaatctaaagtgaccagatcaccaaaacctaaaatcaagctcaaaatacaaatcaataacagtaagaaatctagatcgaaacataacaagtactcaaaatcaaatcgtgatagattcagataaatatccaatttcacgaaaccctagatatcaaaaagagcctataaagcttctcaattcccagattagatctagcacgaagcaattcactattaagcatcggaaaacaatccgaaatctcaatcaaggaacacgaagagacgcgagaacagatcgagaatggagaaaaaagaaaaaggcctcacatttgccaagcggagaggataaagagagaagcgaagagaactcttccaagaaaagagaagaaacccatctctatgagtttggtcttaagctcaggctcgcttgttcgtagatttgtctgacggagagaaggagaatcttcttcgtttcggcgaggaggaaaaactgcggttctattggtttaggtttatttattaacatttcaaaaaaaagaaaaaaaaacattatcaaatttattaaattttaactcccaacgagaaactatattttacacgatcgattcatttctccgagaagaatatgtacttttttactttcgacaaaagaaccatatttttagcttgggaatcttggattaaatattaggacaatatttttaacttgagaatcttggtttaaatatgagaaccatatttcagaaaaaaaaagtttatatatgtgtaattttgtcggaaccggatttactaacattcgtaggtagtcggatttggtcccgtaaaataaaatggtaaataaaacaaaattaatagtaaagaaaatgaaaaataatttacaaacacaaattaaattgaatacaaactagctatcataatatttttcaagttggttttcatgaacattttagagcactaagctatataacaaaataataataattaaacatcttttaatcattaagtatttaaagatccatacaaatgttggttacttggtacaaccaacaaggcaaaggcggtactgaataagaatataagatacatgaaaaattgatctactatactttacaaaacgcgttagatattatataattgctactcgttcaattcatggggatgtagctcagatggtagagcgctcgcttagcatgcgagaggcacggggatcgataccccgcatctccacttttattgttttctttttaaggttctttttcttttaatttattttcaatcttctagtcttcaattctgtttttgtttctgtcggaatctcttaaaagtcaatttaaatactttaaattccttgcacaacactcaattttgatactttgaattccttgcacaacacaacacgtcgctatcaatcacagacaccacaaacttggacacttatctttagttctgtcttaaactgaatctccctcttatcaattctgtttttgtttctgtcggaatatcttaaaagtcaattttaatactttgaattccttgcacaacacaacacgtcgctctcaatcacagacaccacaaacttcgacacttatctttagttccgtcttaaattgaatcttcctcttcttcttgagtcttcagaacaacaacaaaaaacagaatcttgaaagaaagaaaaaaagaaaaaaacatg

SEQ ID NO: 33356 - DNA, 3003 bp, Unknown
  misc_feature (1)..( 3003): 2750-1469P.txt file - cDNA_ID_3068774; gDNA_ID_1620562; Annot_ID_160651
tgagaaagatttcttctccgttgttaaatctagtgaacgcgtcgtttgtcacttctaccgtgagaattggccctgtaaagtaagtttgtggattcttcgtccatgtgatctttgagtttctttagagcttgtgagggattagtaagtaacaatgcttgagttttttgctgctgggcttcgaaaagtttgtcacttgttggtttgatccacaaggtcttcttctccatagctactagacatgttttagcttaagattcaagtttatatatgccttgtggattaatcattgcctgattcttccgtgtcatctctgagtttatttagagcttggaagtggtgtagtaataactaacaatactcttgataagttgtagcaatgctcttgattagtggatgtaatatgatgttgataagatatatgaggcacagaaccaaaagtggtgcttccactagacccgtttttagcctaaggttcaagtttataccttgtagatgtttctgtattgtctgattcttccctgtgatatttgaatttcttagagctttggaagtgatataggaacaatgctcttgtgtgtttgtctctatgaagattatcgctgtcgtgtttcatccgagtgtgcgggattttttgctgctgggtttagcctttcttcaaaaagttattacttgttagttttattgttttggtcttgataagagatgttaggacagacatggtgcttcttgtctatagccactagacctattttagcataaggttaacgaaattctctctacataccttgtggatttgtttacattgcctgatctttcctgtgatcgctgtcatgtttctttggaatgattgatgtttataaatggaaaaatctttgtgcaggtgatggataaacacatgagcatattggcaaagcaacacattgagacacgtttcgtgaagatccaagctgagaaaagtccattcttggctgagaggcttaagattgttgttcttcccactcttgccctcattaagaacactaaagtcgatgattatgtggtatataataataatgcttaatctaatctcttagaatatgatttatatggatgatacaatgttgttgttgttgataggttgggttcaatgaactgggagggaaagatgattttagcacagaagatcttgaagagagaatagccagagcgcaagtgatccattacgagggagaatcatctcttaaacaaaagtctacaacacaagtcagaaggaacgtgaggcagagtgctcgttcagattctgactccgaataaatcccttttcttatcaaaggtttgttcgtttgtatcctcttgttagttgtaatacttgcaattcatcgttttgatgatcaaaatcaatgttgatcgttagattgatgaacatgcaatatctagaatactacattgatgttttatatgttacctagtgagagtgttggaatgaccaaagtctttttgagtttgttctttaacttttgaaaaccttctgtctcataccatgtcttctcgattcctccttaagtctgaaacctagacaagtcaacaatcgaacaacactttccctaatttttttaatttattagtaattgatagtggagtacatgaaatgttttatttaaaggacgaatcacgttacctaaactctcatagaataaagtcattaatggttgcattagatctcttaaacttgggaaaacaattatataggacacgtgatcattttactcaacttggttaaacaacaatactattaaactaataccccaacaacaaattttaattaatatttcttatcgatgcaagctacttctactactactactaaattattcgacaagaatccaaattaatgatggcgaaacttcttggtttcatcgatatttaacatatatcccgatttcgatcaaattgcaataatgtcacaaatccatacgaattccacatactaataataaaactaaaatacaagtcatggatgggtcatggtcatgtatacaatactagaaaaagtataacttgtggacatcataaaagatagcaactttgattttgtctacaaatataaaatgtagatgccatattccttgaataaaaaatgaggccaaaaacataaaataaacagaagaaaaagaagaatatgattcttttagaaaagttaaactatagtagaacagtctgtctctctttgtttgttgtatttatatatagtaataaaaagatttgaataggcaatattagttttatattataataatcactttcaaagtaaattactaattatttcgttttttttaactatttgttttgtaaattactaattaatttgtttttttttaactatttgttttgtaaaacacaaaatttgattttttttgtattttacactgaaaaatgggaaacaataaaatagaagatcgttacagatacgcaaagcactccattccactctcgtcccgcttcgcctcttttagggcgcaaccaagagacagagaagaagagagagactcgtaagcaacaataaccaatagctctctctctctctctctctctctcctctgctgattcttcgctgactcttgcctcctcgacgtcgtcttcggctttgtagcatctcgccgaagcgtcgtaagttctcttcttctctaacctctttgcccttgagaatcttagatcgaatctgctcctcctttactggaatctaacatctttaaaaagtcgagtttcgttatactcctccaatcgcttctccaagttcgtgtatgttgttgaatttgaaggaattttttttttttgtaaaaaataaaagtcttgtctttttcagatgggtcatgtcgatttcgtgtttattgctttagggtatttgaaaagtcgtcgtctttgaacaaaagattgaacctttaatgacattcttggtctgtttgttgtttttgatctttgaacaggttgatttgagagagacccaatttggattgttagaaaatg

SEQ ID NO: 33357 - DNA, 3003 bp, Unknown
  misc_feature (1)..( 3003): 2750-1469P.txt file - cDNA_ID_3068778; gDNA_ID_1620562; Annot_ID_160649
aaaagaaccaactttttttgtggatacatccaaaaaaaccaactttcggtttgttcaaaattccacaaataattaaaatgccattggcatatattccttggacaaaagctttttaaaacatgtatgcaccagattaggaccaatgccatataggatacgaaaacacattagaggttattattaatgtagaaatcttaaattagtacatatgcggagtggtggaattattatgtaatctcgcatcatacggataattcatactattagcaaacaacttcgatatctaatatacatataataggtattcttaagaaaagtaggaatgtgaagcaaagctcaaagaaatcaacaccattcgcatatttttaggaaatgagttttagaaggaaaaaaatttgttctacaaaatgtacaccattttacagtttgtttgattcaacctcatgaataagaaatctcaaattaagcccaagatacaaggaaaacgcccattagttaaatgaagcccagaccataacaaaaaaaacacgtgattaaaaagcatgtatagagtctggtgcgtggaagacaagaaaagcaaaaattctgtttagcagacaagacaagtgtcaaattatcattcgagaatgtgagctccaagtttagttagggttttgtataaatattgtacacactttctttcattcttaaaaacttgtgagaaaagtattgaatcaagaaaattgcttcttatccgatctctctttcttctcagtcatgatgaaacaatatttgttcaagatcgccgatctcttaactgctcctgtaaccattggtgttgctcttgcttcagtggctgtcgtagttgtggttcagcatcgggaatttctcatggagatagccatgaagaagaaggagaataaggcggagaagaagaacttgaaggaggaagagacggtggagaagtagtcggcggcaaacttgaaggaacccgtggagtagaggagtttacttgtttgtgttttaatgtttcttttgcttaatcagtttgtgcttttaatcgtttgtttaacatcggcagctaatgatgtttagtttcttttactttatttccttctttttttttcaagttttattagtgttaagcattgaagaactgatgactaaatccagtagtttgctataaatttgtttggattacctcaaccatcatcttatattttagtttcttccagagtataattaataattatcagtagaatatgaatttttgtttatggtaacagtttttttggctttgacattaaataataatcatctatttttttagttattctctatgtttcataatataattttttaataaaagtacggaattttgtttttctacgttaaaaacagaattcaatattaaactaaagataattttgacaataataaaatatatacggcagaatagatcgaccgtagtcataactcataaaatctatataatttgatgaacatctttctaaaacatctatagtaaaaaaaaaaaaaaaaaaactctaaaacatttgtatatgaaactggtggagtgttggtattaaattgaaggatttggctacattgtaacaaaaaagatcaattttaatattagaaacaaatatgtcagttagaaaaaaagttaaaacaaatattaaaatttatattgaagacattttttgagataattgtgaaaccaagggtctaattgaaaaagacaacttggagcttacacttaaatggtaattttactattaaattgaggaactattttttttttttactttttattttattatgcttggcgaaaaattacttggttgtcaaacaaaaaaaatacgtgctttacaattatattataatttaattaaaattgaaaaacaccattttattggattgattttttttcttaaagtggtaattttttaaaagtaaaattaccattcaagaaggtgtaagctccaagttaagttaggtttactgagtaacgtccaagttttaagacttcttataaaatacatagtttcgttcattgttaaaaactcaagagcaaatattgactcaagacaagtttttcttcattaacttcttctatcggatctctctttttctctctctcaatcatcatgatgaaacagtatatgtccaaggtgaccgagttctttaaggctcctatgaccaacggtatggctcttggtacagcggccgtcgcagttatggcaagcaagcgagacctattcatggaacagttggccacaaagaagaaggagtacttcaaggaggagaagtcggcgacgggcttgaaggagaacgtggtggaggccgataagaaggagtcggcggcggacgtgaaggagaacgcagtatagaggagtagcgttaatgagttttagtttggtcttttggttttgatgttttctagctagtttgatcagtttgtggttttttttaatcgtttcttttaagttttaacatcggtagctataatgatgtttagagtcaaaacttgataataataactaatactttttctttatctcaacctaattcttatatttagtttcttccagaattatctaccactagaatactgaaagttttgtttcttttagattctaaacttaattgagacaaacaaagaagtgttggagattacacaataaaagtaaaagtacgtaaaaaagatcctctgaggaagcttgttgcttattccgtcgtctacgcaacttggaagcagagcaataacatgctacacaactcgcatcacatataaaccggtttggattaaactgaccttaacccttcttataaaagactctgtatcaattagaggctttactttaagtcttccgtagctgagacactctgtctcacgcagagtcttttgaacagattttaaaagcgaagagagatctacatcttctcatcgtcgtcgtcatcatcaacaattcgaatctgaaatctgcaattcacgagaagaagtttttttttgtaacaatg

SEQ ID NO: 33358 - DNA, 3003 bp, Unknown
  misc_feature (1)..( 3003): 2750-1469P.txt file - cDNA_ID_3068788; gDNA_ID_1620562; Annot_ID_160644
atctaacttaaagcattgtactttcttttatctcattctcctttgctctgctttcttctggtcaacccccacgagattccttcttatgtgattgtaaagagaagatttttcagagatgggtctcttcgaatcggtgaaatcaatcgattgggaacaagaatcgttcccaacttatcaagatttagggtttttgcctctctttgcagtgttcttccctacaattcgatttctacttgacagattcgtcttcgaggtaatttacttattcatgggattttagatttgttgtttcttcaatcgcatttattgttgtttcaccaaccaacccaaaaaaaaaatattactttcggatttctactttttagttatgagttatgacccttgagagaccaatcattagtcttgtctctctgtatgattctgctgatgtttagattttgtctgaaaataaatgcaatgtatatgaagatattgtttggtaggtgaaagcttacatatttgtttttattggtgtttgtagaaattggcaagtcttgtgatctatggaaggatgagtacgaataagagtgacaacataaaagacaggaagaaaaatagtccaaaagttcgaaaatttaaagaatcagcttggaagtgtatttactatctatcagctgagctacttgctttatctgtcacatataatgaaccttggttttcaaatactctctacttttggattggtcctggagatcagatttggcctgatcaaccaatgaagtaagttgtttcgttatggtcatcgatatcttttgtgatggtcatttgctaaaatatgatactgctatgtgtgcaggatgaagttgaagtttttatatatgtttgctgctggattctacacgtactctatattcgcgttggtgttttgggaaacaagacggtctgatttcggagtttccatgggtcatcatatcacaacgcttgttctcattgtcctctcctatatctgcaggtacgtatattatacacttgtgttgtggaggaaaggatacactgactcttgttttgtttttggatgttgatgatatagattaactcgtgctggttctgttattcttgcacttcatgatgcgagcgatgtgttccttgaaattgggaaaatgtctaaatattgcggagcggaaagtctcgcgagcatttcgtttgttcttttcgcgctgtcttgggtcgttctacgtctcatttactatcctttttggatcctgtggagcacgaggtttgtttaatatccactttagcgtttgttcttgaatgttttttccttgatgtatatatattgtggggttttgatttgcagctatcaaatcattatgactgtggacaaagaaaagcatcctaatggaccaatcttgtactatatgttcaacacacttttgtatttcttgcttgttcttcacatattctggtgggttttgatttaccggatgcttgtgaaacaagtgcaagatcgaggcaagcttagcgaagatgttagatccggtacgcaataaaaactcttattacaatattttgagacaaaaacactctattaataatgttcatgtctttttgcagattctgaaagcgatgatgaacacgaggattaatcgcatgttgggaatattagtagtgcacacgctctatatctcatgaatctgaaccacacggagactaggaatttcaacatcaagtaggatgcattgcagtatttgaacagttggttcatcatcttccagaggatcgtaaccggatcaaaccgttttgaatgaatcggtttctcaatctgaatttttgagtttattgttttctctaaagtttgagcaaattcaagattttgatcaaactgctccacgttctattgttttttcttctataatttttaatttacgcttttgcaataacacaattccttgtatcattatactaatgtcatctcaaaattagctcccttcaacatctatgcaacagactaacaactaaatgaattttcttggggttttttttggttcattgcataatttgataaaatccaataaaatacttggaaaggataaaagaagaataatttttcataaatgaatgaaaaaaaaatcagcatctttaggcgcacaatagtatcgcacgatagcgacgcacaatagtagcgcacgatagcggcacataatagcgacacgcctatgggatttgtttgaggttttagctttctcgctgtcttggccgagaagactgaaaccaattgcaacaaaaagaaagataaaaaaaaacaaaaaatctcttctttgttcatcatcatcgatcgattctactgcaacaaggtacgtctttttcacttccttctctgaacaaaactctaaattttgttgcttttttttttcctgtgtcgtctcgcgctgcgattcttatacatcttggcttcaagtgatactttgcttcccaactcttgaaatgtataaattttgagactttactggagattttgagttgggattgttttcatgttcttaaagattcgagtttcgatctctatatgattcagtagattgtaattttgaatcggatgtctggaaaagaattgattttatagtctcttaggttactttaagtagtactttgcataagatctgtgatttgatgattgttatcttttgttacattgctggtggagtataataagatgagcaagaaccaacagaagtttgcgtttgatttaggttatttagcaactagtcctgttttggtgtgtttctaatctcactcactgggtctctcttatgtggaatataagatatttgatcctacgactgttagtgctttcatgctgggtttataatatggatacaactgaattcctggcattacattttttgttcagaaccaatgaactgtttgtttaggtgtcattgttatctaagtgcttgcatccttcttctgatgtgtgtgtgtcttgatacaggtctgtgagattttgataaaagctaagatatg

SEQ ID NO: 33359 - DNA, 3000 bp, Unknown; identical to SEQ ID NO: 2590
  misc_feature (1)..( 3000): 2750-1469P.txt file - cDNA_ID_3068796; gDNA_ID_1620562; Annot_ID_160641

SEQ ID NO: 33360 - DNA, 3000 bp, Unknown; identical to SEQ ID NO: 2596
  misc_feature (1)..( 3000): 2750-1469P.txt file - cDNA_ID_3068800; gDNA_ID_1620562; Annot_ID_160638

SEQ ID NO: 33361 - DNA, 3000 bp, Unknown
  misc_feature (1)..( 3000): 2750-1469P.txt file - cDNA_ID_3068808; gDNA_ID_1620562; Annot_ID_160634
cctatgtcaaaagcaagaggaaaatttgaagagtccttctccacaggccatgatcgaggaaactgaagcgcatgagaaatgggaactgttggcggaaatagaagaaaaatatttgaaacagaagtcaaagctccattggatgcaagtcggtgacaagaataacaaaacattccatcgagcggtaatggcgagagtagcgcataactcaattcgtgagattcaaaggcaagatggcagtgtaacaaaaaaaggagaagaaataaaagaagaagcagaacttttttccgtgagtttttgcagttggttccaaatgactttgagggagctacattggaggaacttcaagttttgttaccatttaggtgtacagcagaggatcgaagtagactgatggaaccagtcacaggggaagagattaagactgttctgttttttatgtcgagtgataagtccccaggcccggatggttttacaactgagttctataaagctacttgggagattataggtgctgaatttatagtggcggtgaagtctttttttgaaaaaggattcttaccaaaaggggtaaactctaccatacttgctctcatccctaagaagttcgagaccaaggaaatgaaagattatagacctatatcttgctgcaatgtcatctacaaagtcatatcaaagttgattgcaaagaggttgaaagaaattcttccacagtttattgcggggaaccaatcagctttcgtcaaggatcgtcttctaatccagaacttattactagcgactgaaattgttaaagactaccataaagagtcagtatcagatcgttgcgccataaagatcgatatctccaaggcgtttgattccgttcaatggtctttcttggagaacgttctccactcgttgaatttttcgcaagagtttattcattggattatgctctgcatcactactgcatctttttcagtccaggtcaatggagaattggttggtttctttaacagttcaaggggtctgcgtcaaggatgttctctttccccttatctctttgtcatagcaatggatgtactatctaaaatgttagatagagctgcaggttttaagaagtttgggtatcatcctcgatgtcagactattggcttaacccatctcacttttgctgacgatctcatggtgctttcagatggaaaggttcgctcagttgagggaattgtgagtgtttttgatgagtttgcaaagaaatcaggacttaaaataagcatggagaagtcaaccatctacttagctgggagtgcaaatatgtacagacgagagatagaggagcgatttaaatttgcagtgggaagtcttccagttcgatatctcgggttaccattagtcacaaagcgtttctcttctgctgactacagaccgcttgtagaacaaataaaaagaaagattggaacttggacggctcgatatctctcatatgcgggtcgcctaaacttgatcagttctgtcatttggagtatttgcaatttttggattgcagctttcaggcttcctcgagaatgtataagagagatagacaagctatgttcagcgtttctctggtctggcccagagctgaactctaaaagagcaaaggttaactgggaagcaatatgtaaaccaaagcgagaaggagggcttggtctacgatcgctgaaagaggcaaatgacgttagctgtctaaagttaatttggagatgggtctcacgtggagactccttgtgggtaaaatggatagagacctatcttctcaaaaccaagtctttctggtcgctcaacatgcaatataacggttcttggatgtagcgaaaactcctcaagtaccgagacacagcaaaacaattctgcaaagttgatattcgaaatggtggtcgaacgtcgttttggtttgataactggtccaatatgggtccattgattgatattgcaggtgatagggggcaaatcgatcttggaataagtaagcacaaaacagtagcagaagcttgggaaggttgcaggccaagacgacacagatccacacatcttaatgccattgaaacaacactcttacaacaaagaaatcgcagaacagaggaggaagacattgtcctttggaaagggaagaatgacgtttataagccaacgttcttgaccaaagaaacctggaaccatacacgttccatatccatggaagtgttttggtataaaggtgtctggtttgttcactccacaccaaaatactctttttgtgtttggttagcagttcaaaaccggctctcaacaggggatataatgaaccagtggaacggaggacaatcagctacttgtgtgctatgtaacaatgcattagaaactcgggatcacttatttttctcctgcgattttgcttcagaaatctggagtaacttagcaacggaaatctatggagacagatattccacgagttggcaagacctgatacaagccatttccggctgttggaggactcggcttgatggtttctttgcgtgatatatttttcaagtctcggttcacacaatttggcgtgaaaggaagggaaggaaacatgaagagaaaccacactcagcagctcttttaaccaaatggatagacaagcaaacccggaatcaactatcttcgatcagagcaagtggggataagagatatgacatgagcttgcaagtctggtttgcgatgagacaaggagccacaaattcttgattttgttctagtttgtttcaaaattattcaaaaaacgttgcactcgatgtaaaaacgttattttcttttgaatctaatttaacattattttcaaaaaaaaaatatatatattcgtttttagaagagaatatttggccactgtgtaatttatcttgtattttgattagatttatgttcaagaaaaaaaaacaaaatttgacatatctattgatttttttttctttttgttctcttatcctcttcgcgcttccacacgtcgtcaaattaccaatg

SEQ ID NO: 33362 - DNA, 3003 bp, Unknown
  misc_feature (1)..( 3003): 2750-1469P.txt file - cDNA_ID_3068812; gDNA_ID_1620562; Annot_ID_160633
aagttcgaaaaatgtcacaaagaaccctcattatacagaaaacaagaaggcgagaacattcttgttgtagccgtatatgtggatgaccttcttgtcacaggctctaacttagacatcattctcaactttaaaaagggaatggttggaaagttcgagatgagtgacttaggtaaactcacatattatcttggtatagaggttctacaaagtaaagatgggattacgctgaaacaagaaagatatgcaaagaagatcttagaggaagctggaatgagtaagtgtaacacagtcaatacaccaatgatagctagtttggagctgtctaaagcacaagatgagaagaggattgatgagactgattacagaagaaatattggttgtcttcgttacttactccacacccgtccggatctctcttacaatgttggcatactgagtagatacttgcaggaaccgagagaatcacatggagctgcactcaagcaaatcctaaggtaccttcaaggaacaacttcacatggactttacttcaagaaaggagaaaatgcaggattgatcggctatagtgacagcagtcacaacgtggacttagatgatggtaaaagcaccggaggtcatattttctatcttaatgattgtcccatcacatggtgttcacagaagcaacaagtggttacgctatcttcttgtgaagctgaatttatggcagccactgaggcagctaaacaggctatttggctccaagaacttctggctgaagtcattggtactgagtgtgagaaggtaacaattcgagttgataacaagtctgctatagctctcacaaagaacccggtgttccacgggagaagtaaacacatccaccggagataccatttcattcgggagtgcgttgaaaatggacaaattgaagtagaacacgttcccggagtaagacaaaaagctgatatactaacaaaggctcttgggaagattaagttcttagagatgagagagcttattggagtacaaggagtgtcaaaagaagatttcaagcttaaaagggagattgttggagtaagcttgaaataacttaataaataagttattaaatattacaaaggattatgttaaatctctaggagttatctagatatttaaattaggagttatctaatgttaatcctagtatgattaggtctaattattctctatatatatgagtcccaaggtgtggttgaccatatgagttttagagagattaagacttagagattgtttaggttttaagttattttcctaaactataaagagagttattcttaaatctttgagttcttaatcttctttgaaaactagaacctaaatacttgaaatataactcttctttatgtaacgaaacttgatcataaaacttacaaagcaaggaatacgaatacatggcaaacaagtactttttagagaaatatcagttttataattaggacataaccaagacaacaatgaacaagttaagaaccaaaaaccaaaaaccaaaaacaaaaaaaagtttgcatgtatagcttaatcattaccttgccggatttgagtcaaacttggaacataataaaagaataatggttttaatccgactctaaacaccacttccctaacttcgttgtcctctccaacgacgtatatcatgttgtttttgccgtttattacaaaattttgctcatacacaaggactttgttctcctcatcgaccaagaattttatgccatatttaatctcaggcttcaaatccaccgttaaaaacttgatccacgacaacactttggcctcaccaatcttatttgtcacccatatctgtgtcttcgatgtaagggaaggttgtaataacacggaaagtttctcttctttaacaactgatagagatgtattacgaaaatacggaatctgatacggaagacatagacgttcaaatctttctgtcgtataatcaaaacagatcaagaataggtcgcacggtttatcatttccatctgtagcaaaccagtaagtcttacccttcaaagaaacgttttcaatgtacaaagaggagtccacagtgacatcaagaatcctccatgaatttgagttaatctcataaatttcgaactcttggccaccataaatcccgtggctcaatattttgtagctattattgtcggattttttgtcttggtaggatccaagagcatagttgcagatgtagcccatccttctgtgttgaatccacttggttttaccagtacacgggttccataccacgagcctagtattaattttctccacgttgacgcataacaataagccagaagtttgacataatggagagttcctgaacatacctaaactagaatgatggtcgattaggttaagttcaccagtgacctctataggtgaaactctttggagattgatgctaatcgaagaaaaaccaaaattcttccacatgagaatcagagattgccttggggctttatggcagtgtttgcttttgaatctcttatcgttgtataaatggttccatagtttgcaagtagatcgtaatcgtttcaaagatgtagccggaacgcggcagagtatctccactaacaaatcctctggaagttctggcatcatcattgttatctccggaggaagaaactgccggtggtggctttgattgttgtttagggttttatgttgctttgttgttttctagggtattatgtttaatttatgctgactctttaatatatagacgaaaaaataaagtttttgatatccaagtaaaacaataaaaggtaaagtaaaacaaagctggtttgattgatgatcaagtaaaaaaataaagaaaaacggaaaccctgtttctgagacagagtcttcgtttccacaaccctagaacaaaaaaagtatcccatttgtcatttgtcaattgtcattagcaagaacaggaagaagatagagaacagagctcttcgatcttttttcctccaaggaagaagtagaaagatg

SEQ ID NO: 33363 - DNA, 3000 bp, Unknown; identical to SEQ ID NO: 2606
  misc_feature (1)..( 3000): 2750-1469P.txt file - cDNA_ID_3068830; gDNA_ID_1620564; Annot_ID_160676

SEQ ID NO: 33364 - DNA, 3003 bp, Unknown
  misc_feature (1)..( 3003): 2750-1469P.txt file - cDNA_ID_3068834; gDNA_ID_1620564; Annot_ID_160674
taatttgcctcatcaggccaaacaaatattcaatatatagtggatcatgctcattatttcagtgtgtatttatgacgatcatacatatatgttccgagaatgagtacgacttcaaatattcatcacataagtaaaatgaaagatgattttttttttaatccaaaactgattatgtaaacttagtattaagatgatttgatgtcaaaatctttatcacatgatgtaacttatcaaagattgaatagctaagctagtccttgcttatcaagaatcaatactataatgaaaattcatgtatgcaaacagggcaatagaaaaatcaccagcttaaattcgacaaaagcaatgcgggtttggtggtaaaagtctccaagcaacctcagatggtgaacctaaaacgaaatgaaaagatggtgtaaaatgagaaaacacaacatctttataagtgtataaacaatcagcgacagtcaaaaaccaaatctatacctccccacaaactgttttaaagaaattttccaactccatcttagtgacctgcaattaaaaaccaaaaaataaaattggtaaaatttaaatttcaccaatgtctaacaaatgacataataaagctacctccttgtcaatgttggtacaataaacagtctttccacacttctctagctcgtccttggactgaaggaagaaaacaacgttatgcatataccacattattgataagaacaagattgattcaaaattatctagtcaagcctagctaagattggtttagacatgattatctcaacttacttgtggaaggaaagacgggttaacaggcgcaatagctgttttggacataaaaaccctaataggatgagaaccaaacatagtaccggattttcgtaaagcagacctagctccctctgagacatcacttcactgattaataaaaaaacagcaagaacatctcaactcataagaaaattggcgcataattgagtacctgcatcggtgaactcaatgaaggcgaaacgaagaatggacttatagtcaccgcacatacggcaatcaacaacctttaacccaaaaaaaaatggcaagaaaacttatgagaaatgagtttgcataaaatcaaaacgaagatcattaagtaagtacctggccacaagaaagaaagagacttgcaagctgctcctcagtaacctacaaaaagaacaagagggtttttgttatgtatatatgattagattctttatgaaaacgtgttttcttgagacaatatttctctgttttgtacttggttatcgatgtctgagacatatacagttctcttgatcatatcttcattctgaaccaagtttgtttttttggttatccatggcctccctttgccaaagttccttctctgtgttaattgacaagacttagagagcaagcacaaagaagaattacaatcatatttttcaataagcaaattgaaaagctgatcctaacatgacaatctatcaccatctaaacctcgaaatggcgaaaaatgtgtgttatgttaacaaattgattaaattcctcaacaccaagacatctaaaatgaaaaatatatgcaaaaagagtcataaccatttagagcagatatttcatgaacacataacatagttcacagaaaatagtatagatgaaatatataccattgtagcaaactggccaataagaaaaatagtttgctttggaaaatggttagtaaaccagaatctatttccccaaaactcagagtggtgggtttgagccagaaaagaagggacaaattccttagccatcggattcaaatgacttatctcactcttgagattcacttcactggttctttggatcaattcgtttgttagaacagaggatttggatttaggtgtctgatcatcagaacatgatggttttgtctctactaatgaagtagtgttgttgtctatattctgattattagaagagtccaccttcacaccaacattttccgcgacagccatgatcaaaccaaaagatcaatgaatctttagatgttggtaataaaatataaaaaaacaactcatgcactggagaaaggttagaggatttaaggagatgattaaaatagaggaaaaattattatgctctttatagctaaaacaattagattttctagtcaagatttttatttcatttttttttgacattagtcaagaaaataagcaaatacaataaattataattatttaaattttctttgtgtcagcacaatttctgcatttttttcttactacatataaagttattattacattaataggattctgtttatttttttaattatctctatcttatttatctagttttggtaagagagaaaaaaaaaatcgaaccggttaatcaattcaataccggtcggccaagtgtctctcagaatttgaccccaattcgatccgatattctgaaaacgacaacgttagcatttcgccatttagaacaggaaatagtttccgtgcaaaagcttcggtggctcttctcccaccgccgtatgttcttccagcgctccggaccgccgtctggtctgactttaatttgagatctattccgatccctaacagctacttctggtatactatcgttctctctctctaacacctctgcgtatttggatcgtattgactagagtcttcccattatacttgcatcgttctctcttccatggtttcgaacttgtttaagcttatagtcttcaataccttctaactatctaaaaggtttcgtgtttcaatttgcttctggtgcgatttgctcagtgttttctttctctaccggaatcagctctagacaaattgtttgctatgttattgtattcactgggattttggatagtcccagtgaaaatctttcaatcttgttcgtgttacattttctgatttatgagaggaataaaagtctaccactttaggtaataacttatctcttttgattcttgtatcacagcaagtttcaacttggaaagaaacaatg

SEQ ID NO: 33365 - DNA, 3003 bp, Unknown
  misc_feature (1)..( 3003): 2750-1469P.txt file - cDNA_ID_3068848; gDNA_ID_1620565; Annot_ID_160696
tccaaaaggctagggattctaaagggtatagcttcagctcttaaatacttacacacagaagctacacaagttgttctacacagagatatcaaagcttctaatgtaatgttagacacagacttcacaggaaagttaggagattttggtatggctaggtttcatgaccatggagcaaatccaacaacaacaggagctgttggaacagtaggatacatgggacctgagctaacatcaatgggagcttcaactaaaaccgatgtatacgcatttggtgcattgatccttgaagtaacttgtgggagaagacctgtagaacctaatctgccgattgagaaacagcttctggtgaaatgggtttgtgattgctggaaaaggaaagatttaatcagtgctcgagatcccaaactgagtggagaattgatacctcaaatcgagatggtattgaaattagggttgctttgcacgaatcttgtgccggaatcgagacctgacatggtaaaagttgtgcagtaccttgacagacaggtttcgttgccggatttctcaccagattcaccgggaattgggattgttactccggttttggtcggaggaagctccaccgtgatctctaacatttcttctccggtgactgagtttattactcactcgattcaatacggaattggacgatgagatgtaaaatttgaagcttgaagatgaacgttgttaacaaaaagttgatatggccgagttggtccaaggcgccagattaaggttctggtccgaaagggcgtgggttcaaatcccactgtcaacattctctctttttttttttttaaacgtttgcaatattttactaatgtatatattaatttatgaacatacccctttgtgtaattaatttataactatacccttgttaattctctgatttacaatattgaaagtcttctgggaattttgggagacaacatactccaatttcagtttcttctggaagaaaatcttaattttgctacaatggtgaaccatggaaagaaggaagcctggattatggctctggacaaggtgaatttcctttctctgcttctgggtattgatcatcaaacatgagttctggaatttaaaggttttgagcgattctttagctacgaaatgtgtgaagaaggaataacttcagttcagaacaaccaaccaggctctatgtttcaattagatacagctcaaaggttttcatctaatctggatgttctcatgtggtcttctaaagtcaacaagaagctctgggtttatggctttggccaagcttcctttctaatggattgttttagctgatctatagttcggggatgcaaatgggttacggtttctttctaaggacatgtcttcttattctgcttatcttactggtaattatagcgctcatggttcttggagtaggatatctattcagaaaaaagacaagacatatgtagatgtaatagaggctttcatgcaaaaaagaagtagtagaggcatgagaggaggttcttcctggtggtaaagacacgtgtttctaaatggaattgctttagctcttaggtagttatacactgaaatatcaaggcttctcatgttttgtaaaatgctgagttaaaggcaaagtgagtaggttttgtgtgaccatgggtccaacctagataccgttgtctctgtgcgaactttaggtcaaatcgcatggagcttgcaacaatggctgtttgcacagtaactgacatgtatgcctgtatgcttgagcaaacttttggaaaggaaactgtgtaagctgggatgctagctgatagactgtttgaaaatgttggaaacagataagatctgagttcagcttagaaaatagggtcgctttgctcaaatcaaatggtgtgccagaactgaaagcctccatggaagaagtggtgcaatatcttgaagttggaacctggtcctattctctgctgattgttggaatcttccttcattagcagttatccagaaaatgttcaaagctaccacaaggagcaggtatctgaccattaatctcttatctgatttatcactatacagtaatggattttcaccaagttaaaatttcctgctgccacaaaaaactgcctagctacctctgcggaatttaggttgtctaagcaaactaaactttcttctatctaattttgtcccgctggtggtgaggctactatgacataaccaaacaatgaaagaatatgctctatgcgattccctctgtctattatcttctctccaatcttagtttcagtgatttgaattgttgttcatgtgacgatgtattctcctgcacctgtagagctgaattagcaagtcctaaagggttaggttagtaactatatatttttgtcaattttcatattcaccatttaaagaaaattcgtagttttcatgaatatgacaggctttcctaggccttttccctttggtcgggctcataattgtgttgatattattacaaaacttggattttttattcattctacgtctgaagggtcaagggcatgtttaaaatatgtttaaaataatatttatttgtctgcgtccttctaaagatggcttcaaaattcaaatagaagaaaaatccaatgcaagtaggtgtgctatctagtcctacacacattttaaggaatttataaatgttagtcatacgcattattattgttccagggtacctccatgcaacagttgcgttgtctatctaataaattgagatcatataagttaaaatattgtgtcagaatattttgaaaatcacgttgaagctttatggttatctttttaatataatcgtgttagtggagtacagtttgtaaagcaaaggtgattctcttgattaaataaacatctattagaaagtttgataggcttgaatcactgatacagaagcttacatcctctttttgtccattttttctccagcttgcgaggttatgattcatcatcagatccagactctctgattcatcatctgcaatg

SEQ ID NO: 33366 - DNA, 3003 bp, Unknown
  misc_feature (1)..( 3003): 2750-1469P.txt file - cDNA_ID_3068871; gDNA_ID_1620566; Annot_ID_160716
acggacgacgatgttcgatatatgatcaacgaaggagattttgatcgagacggtgcgttgaatcagatggagttttgtgtgctcatgtttagacttagtcctgaattgatggaagcgtcacggtgtgttgtgacggaggtgatcgaggaagagttttaccggcattgatagagaaaccttcttatgcgttagagactttgactgaattgtttacacaaaaaccaaaatataatttaataatttattaatgttatttttattctctctttgatttcccattattgttgaggtggtccataggattgttggattaatactgaattactgatatgcaaaatttgtcgagagtagcgaaggaaaatcttaactgattctattcttcttttattcaaactttttagtttaggcttcgtcatgtaaggatcgatagataagaatcattaaccaaaaaattattaaaaataaatataaatcttcagagtgaaaaagaatataagtgtcaaaaacattttggcgatttttgttttgaaaaaaaaaaaaccccactaaaacattaaaccaaactaaacttaagaaccaagatgtttttataccattaccaaaactttaacctaaatattgaaccaaactaaacctaaattggctgctcagttaaatcttacgacctgtttgattagcattttagaaagctatgagttgctggcaaacaaaaaaacccaactccaagtctaatatacatcataaataagatttaggctgaccatggacttggagttgtgtttttttttgttattggatagaaatagcattaataaaggaaaagcaaaaaaaaagaagagatttattttatttactggatggtaagctacaaaatctttataacaaacgtcttaacatatcattcatcaaagtccacatttaattattagaactcttgagtgtagtgtcatctttcaaccacctgatcatatttctacttttcattagttaatttctttataaagcaaatatggttgcacattgcgagtgattcatcatttaggctaatgcgtgtagccatgcagttcctgagatcctgcgaaaaagaccaaatcatgcatgtacgtatcttaagcgacactttggtcaataaagctataaaaagccgattactttgtttacacgaaataccagcagaattaggggtgaattgatcatcataaaaaaaatggggtgtaaaagcgaagcatccttgaaacgcaagccaactttggcatttttatcattatattttctttttatcttgaactgtttattggacatcatatattatatttttatatttttttgattaaattgttttattgtcttacaagtgaaacttttaaaagttactaaatcgaagactatgtgattggtccaagcctcctcttttggctgaaaattggaagcgactgtggattataatcatatttcacatagacttaagtaccaatgaacttaactcgtcgcaactcgcaacttgaaaccagcagaaactacaaaatgcagaattaacagaataacatgataacgatattaatccttctatctatgtcgacgttttcctagtagttagaaatgaaatactcgagtgctgacaccatgattatgcaaatgaagaaaaaataataatgcattatcggatgacacgtcaaaatcacgtcctaatttatctcgtttcataactatagtatagtatattatctatcgtcaaacaacgtatagttgtaattttatactagtgttattattattgaaaaattagatgcatggtcgtagttttatactttgatgtagaaaattaaaagtcaaaaaagtaacacaaaaaataataatgacgagagcgatgatgcaagagcttgaaatcagaatataaattggatcaagagccgtcgagaactacatccaatggctagattgtcatcttcggagatcggacggacaagacttgttgaccctaccctcggtcaatttaacacctacttggttgtcttcatcgagctctcggaccatattcgttgacttattcaatatttctcaactttaatccttcttcctaaatatcttatcgatagattcttatatatgaggaggttgagtgatttgtatggtacaaaatgttgttctgttctaaaacgattcaaagaatgagttagctaatttgaagtaaatttgtactgttctaaaacgattcaaagaattatttgtttttaatactgaaatatatatagtcttccatttatattacaaatatatttgtatgctctttcatttatagttattctcgttatctgaaacaggttagtcactaacattagtgttaagattgactaattgtttaatcatgtaatatttgaatagattaaacaccataattcatgttttgaaaaagacatcttctagagaaaacaagtaagcagagaaagctctgttttatgtaaaaattaaaaacaaattttgagagaaaacgaacatgatgatgatgagcgtgacagcaacatatcatcattattatgttattttaaaaattaatccaaagttttaattttcccgcaccaaccccacttttcttttgtatccgtccaataaccagaccaagtacccaacggcgtcgttttactttgaccacgtctaccccctatattatccaaacatttcaaatcgccccactagtttgttttttcctaaactgttacgaaacatcacattataattgagtggttaaatgttaaaatataagctctgggtgaaatttaagttgactaaatattcaaggggtttaagcaagagtttatggaaagaagaagaaaaaaaaagtaatggaaaaaggataaagagcacagatcatcttctacatctctataaatacgctttctacattttcggatcgttgaacaacatctctctctctctctctctctctctctaaacccattaaagtaatttagctcctcatagattctcgagaagaacacttccatg

SEQ ID NO: 33367 - DNA, 3003 bp, Unknown
  misc_feature (1)..( 3003): 2750-1469P.txt file - cDNA_ID_3068877; gDNA_ID_1620566; Annot_ID_160706
atttttgtttctttggttgtttcatttttctttttcttttggagaaatccatctttcataacttcaatccttagatttacctaaattccaacaagtcaaaccaaaaccataaatcaaccaaatctttatttgatgttaccatgtaactaaattctaaaataccagtctttattaaagaaacgtataatccttcttcttcctaaaaggggttcattaatcatacaactccttcatgtttaatgcagaaaccactcaacactcattcatattacataacccaaagaaattcatcaacattgtcatagctaaagaaagaacacacattcaacactcctctgaacattccgctaacacccctacttgctttgtgtaccttattaattccaaaaacatgaagaagataatcaagagacaggtagaccatataagcttacagatatcgttgatgtgagttttatattacctagaagagaagagggtgatatattacttagatcccacgaatcatcactcatctgtgacagaaatacaggaacaaaaaaggaataagacattgtcatttggtcagatcatagatatatctactggaataacactttattcacaacacacatttcactgttcgaagatacacagagagggatcacttaaaatatcatgcagattatacattgctagtcgtgatgcagtatggtggagataacaaatgtaacctatagataatagcctttttaccttatcagtgtacattcagatctttttacaaattcactaggtagctccgatcttgtaacgtataccaaatgctccagaactaacaccagtgactatcttacagaagaagcaatctacgaaactcagtaactttatttgacaagttttcatctgaacttgtcataaaagtaagaaggtagtgcctacatctcagttagatttgatatctaaacattacccaagagtatagataaaaaaaattttggcatgttaaccagattcttcctacatattcccattctttcctaaattttcctctgttaacattgtaacctttcctagtctggaccaaagcaaacaacaacaaaaagtataattgaagcttcctttttagaactactgcactatttgattttcaatgtttcatacaacaacaagtatacagtcaccaacttacgaaatgaggggttatagaagacataatttcttatctgccttttcccaagtcaagaatcataatacttggatgctaatgatacttaatgttgcctcaaactaaaccgaacagaggaaaaataaatcaaacaaactcacttagaaaagtttatcttcaagggtcaaaagaaactttcctctggactagagtacttttaatctaaagtctaaacgcaatcaatgggtagtgtaaacaatgcaagaaatagaacgatgtcggcgcttctttgtcccatgtgtaggggaacaataatcttctaacatatattacagcaaattagccataaccaccaaaaattatgatatatactatacaactaacttcagtaaatagaaacagtttcggcagatgaagaagatatatacaaattcatagaacgaatacactaaagctaggaaatcatctatgtacatgaccatcatcctcaattttcgggtaagcaaggcaatgaacatggacagcatttctcactaaatcgacaaaatcatcttagttcagctataaaaggatctcattttcctgtgctaccatctatggcaatctttttcacaacatattcacgtgatcacaaaattcacaacactcactacactactgaatctaaatctgacacatcaacagaaacatccatgaaaaaaataacaacgaaagcagcttatctaatcaatcactgaatcacatagagatagagataattgatccctgacctttgatgtgttcatgatgagcagaagcagaagcagcaacaacatctccatcatcatctccaccagacttgacagtaacaataggcacaggtccatcacgatcatcaggatatctaaccacaacaacaggacaaacacagtgatgaacacagtaatcactaacagagccaagcttgccatcacttcctctttttttctcagcaccaaaacctctacttcccataatcacagcactaagaccaagcctctcaatctcaagacataatctctctctcatatcatgatctttcactatatggatcttataaggaaaccctaactccttcaacggtttagctagatccgcaacttttgttgaagtaaaagcatcaaaatcctcttgactaggttgaggttgagcgtttggatcttcaatttgagttttcagagggagaggtccccaatcggcaccgaagaggacggaggttggagaaacgtggagaagaacaacggcgtctccgggacggatgtagtgatctacagcccaacgaacggcgaaagagctttcttcggagagatcaactgcgactccgattttacgacgagctccggcggttggtgttggagttgcggcggaggagggagtagatgaggagtggtgatggtgagagtgacgtggagatggagggtgatggatcttgatgtttggaagctgtggatgatcggaatctgctggattcatgatttttttcagatgttgtttttgttcgtcggaaagtgggagtgagggaggtttctcttaacggagaagaaagaagcgttgtttttgtttttttaatagaacattagactgcatgccgttatttatatacaaagacgacaagcattctaatatagatgtagttaatagaaggagtgatccaacggtcaggatcaaatctgagcgccatagttttgaagaagacgattcactagatctccggcgtcggtgatttcctccacttccttttctggcagctagaagacgaaacctcactcaaattctgatctctttgtataattcgatcgagttattcgtatgattcgtatagatcggtgactcagatg

SEQ ID NO: 33368 - DNA, 3003 bp, Unknown
  misc_feature (1)..( 3003): 2750-1469P.txt file - cDNA_ID_3068890; gDNA_ID_1620567; Annot_ID_160736
atttctgctctaaaaatggtgtagatcctcttgctcaagtagccaaagaagcatgataaagtcatttggtaaatggtaacatgtttatgatcattatgcttaaattctctgtgtttcaagaaaatgcaattgtgttaacttgattttttctatattaacttcggtatataccgaataaaaggctccaaaaaatcgattttaaagatcaaatgttttattttattttattaatttatttgttagataaataaaggtagctacacagagcagtaatgttaaaaaaaattcaaatattttgagaatcccaaggaggacaaagatcaaacattccagtctttttgttcagtttgcaaggtccttcttcacgtatcttccattcgcatcttttgcatccaaacattgcagattcttggtctctttcttgtatgtatatacggaaataacgaaacactagtctccaagcaaaagtgcaaatgaatttagtatctccagaaacactgggtgtaaattcaaatgatcacgatccaccagctagcatacgtcggagtccaaaatcaacgtcttttgatgcacaatggtatgccattggccaataacctgaaagagcgttatgtatcaccactgttgtatttgggttctcaacacttggtggtgaagccatggggttttgagcgagggacattgttacacttgcacacataacgataatgagagctacaagttctgctagagcacccatgttgtttttgttttttgttttccttgcaatatgaaagtatattgaatatggactctttccacttagtactttattgtatttataataccaaactttattgattatgtttccctaacaagcttctttgttttgttgactcagttacataggttatatgttttgaataatatgagtcaaagtaaaacttaattaggtataaaaggaaatctcatcttggtaaaaagacagctatatcttattatataaagtatggatttcaaagttgctaactcatataattgttacacatgtcaagtcaaacgatcagatgtttacatgtgtcattcaaaatttaacttttttattctctaaaaaaaattgaaaattttaaaaagtaaacaaatttacatatactaatttatacgtctatatatttataaacaattaacatttattcaacaaaaggaaaattaacaaatttgtctttaactcatctaatcataagtgaaaaatataacattttgagaaaaatagcttagcttataggatttaacttttcaattattttcatttattaattttaactcatttaatattaatttgcatgatgtaaaattaacttacgagattacggcatatacaaaaaatatattttcaacaatgtttggtttctaaatatttttgtggattgttttttttaattaattattagccctatgcgtttgggtattcgggtcgggtatttcgggttcgggttttcgggtttagaagtttaggacccgttcgggtaatttaagattttgggtcgggttcggtttgggttcgggtttgggttcgagtttatttatatattgaaatatgaaattttgtgtgcaaatttattaaattacttgaaaatttcaaaaattcccaaaacaacacgagtagttttgcttgaatatatctaaaaatacacaaaaatcactaaaatatccaaaaaaatcctaatattttttatatataagtataaatataactaatatatacttatatttgagatatgtttggatacctattcgggttcgggttcaaatttttcgggttttgaagtttagacccgttcgagtatttgaaaatttcgggtacacccgcctaaataggcgggcctagtaatatatgtagtcaataatctatttataacttaggtatataaggaaagctatatatttctcaccattaaagtcacatattaattttggtaaatataaagctatatatagtcaataaaaattatatattgaaggaaatctcatcacgattatataattggtcttgagtcagttaaataaccgtacctcttaactaacagtattttcatctaaacatgaaatactaatttttatttttattagaaaaatagaagtagacatacatgctaattatttttaaagcgattgagaattccaaggaagacaaacatcaaacatattactgttcttgttcaatttgcaaggtccatctttgcgtatcttccattcgcatcttctacatccaaactcggcgaattctctgtctctactctgtttgtagatatcgaaccaatgcaactccttatcccatataaaaccgcaaaaaaacaaagttcctccaaaaacactcggtctaaattcaaatgaccaagttccatttaccgccatattccggtctccaagatcatcattttttgatttacaatggtatctcaatggcagatgacccccaagatcattgtatatcaccactgttgttcttgggttgtcgaaaccggatgttggagttggagggatgctatccttttggcctcgagatattgttacactaacacacatagtcactaagaaagccacaagttctactagagatcccatttttttttttttgttgcaatatgaaattattgtatatggatgaatgactctttcactcgatatatactgtgttaccagtttattacatttccgtaacatgttttttgttcttcatatgtggtcaaataaaaacttaaatgtcatggttgatgtatatgtagtcaactatggtgttaagcccaataagctttataaaagcccaataacattttcaaaagcccgagaaaacccgtgaaactacgtccgatccgaagatcgatcacgcgactctgttatttagaacgacgatcgcattatttttctcctaataaacaaaacgagcccgccagatttctctgagacagtgattcagttttggttttggaacctaattctctctcaagagattcagctaagatg

SEQ ID NO: 33369 - DNA, 3000 bp, Unknown; identical to SEQ ID NO: 2625
  misc_feature (1)..( 3000): 2750-1469P.txt file - cDNA_ID_3068895; gDNA_ID_1620567; Annot_ID_160760

SEQ ID NO: 33370 - DNA, 3003 bp, Unknown
  misc_feature (1)..( 3003): 2750-1469P.txt file - cDNA_ID_3068925; gDNA_ID_1620567; Annot_ID_160754
caaaaatatccttgtgtttacttatttttacaataatgccattggctttagttataaagtttatatgtatttgtctaaaatagcatgatatatttacaaaaatcatgtaattctttaaaatacatacagaatatatatacacgatatatatgtttctctgaaataatgtgtttctcagaaatagcacgaaatatttataaaaagcatgcaattctcttatagatcgcgaagtttaaaaaaacatatagaattgttacaatattacatgggtttttattggataacatgacaaatatttatttatttcatgagtttttattggatagcatgacaaatattaatatatcagtgttaataacatgttttgttcttaaaatacatgcattttaaaatcagacatttgttttaaaatcaaatctaatctcttatatcacaacgacattgacggaaaattcaggtaaaaagagaaaataaagaatgagagatagagagatttctatggaaaaagaaagagagaacatgtaggtgaacaaaataaagagatatgatgatatattttatgagaggtggtgaagattattttaggagagggagagagaaatagaaaaagaaaatgacatggtgaatctgaagaagatgaattgtgttaaagatgaagagagaaagagaactccatggctaaagtctcgtaaagaagatgaaaaagaaacaaaagaaggaagaagaaagagaaaggctaaaatagactaaatattgccaaaatttctgtagccgacaaatactatttggtccaaggttattttgtgtattcttttgaagtcaaaagttatttcttacacatactcaactataaaggggataaagtatagtgtgaattgttgacggcagaagagagaaaggtacatatttatatctcaatgaaaagataataaacgtgttaatagagacagtaaggagcgttagtgtaacaagtcagattcatggggccacggtatcatttaggaaatggaccgattcaatttaatgttgtctttaagtgcgatgtgaagagctccctaccaatcggacacctcccatgccttatgatttctctataactattgattttattcggaaatactataaatgttacacttcaatctctgtatatagttaatggaatggaattggaagaataaaaagcatcacatcaaattccagactctgatttgcataccctaataaaacatgtactaatgtaacacaatcatattgggatttagacttaatttaggaatgagaaagcaaaaaagtgtgagacaaaacgaggttgttgacgaatttgactacgatgagaccccaaaaaaaaaaaaagatgttgaccaactttttaagactgtatggttctgaatattcagatattttgggggttaaaatcgaaagatttgtatagttaagggactagataaaaatatttaagtgcgaggaggcagttgagggaaccacttctgttgaagtctgtcattttcatatatttgtaaactgggccagatagatttatagtgatcaaaatgggaccaattgatttttcaaattaggacaatatatgtcgtctctgtatttgtcattgtctattccaattctgttctggtcttgattttttcttataattttgtacataaattagcaaaacttagttttgtttccaagggaaaaaaccaaaaaaatatatcttacaaacaaaataagggtgcaaaacgtataagaaaataaaagaatgggatcaaagtggaataaaagaatattagggcgtcggtgacgtgaagcttcgctgctgggagaaaaaagctcacatgcgtattatctcagtctcagctatatttagaacaacaacacatgtctgaacacattacagttcctatatctgtttcgaattcaaatctcctgtccttttttcatatataataattcatcataaatatttattgatttgattctatctcttatatatattttcgatctctcctgaaaagagaaaaaagttggaaacttcgacgaatgtgtttataaatctttttattttctatctgtcttgatttagttttatcttttttggaatcggtctgaagttggacaaaagaatccgccattttctcctcggtctctctgctcttctcttcagtatcggatctgggtctccttcgctttcgtttcaaggtaacacaaaaaaaacttcaaattcttttctcttttattcacaccattttcgctttctttttcctttttcttctttaatctttgtgactgttctatatcaatcttcatttaacatttgcattctcatcacttatcagtattttctgatatccaatttctgggttttcgaattcgattcgataagaatatttatttcatttttttttttaatgtagtagtatatgttttttccccaaagtcacggcattggaaaaaaggaaaaacacagctgttccttgcttcaagcccgagattaagcaaaaataattactatttctttcttttaaaaaaatattcgaatcaacgcactatataaaattacctacttttgacagtatctgaattaaacatcaaccaaacttcaaactctctcctctgtaatccattctttttgtattcccaaccacgtgattttttgattcggtaattatccatattctacactacgattattaagcattaaaatttatcgattggtgaaaaaattaaacttcgtgattttggcttttgcagattattttgggagacgaggaggcgttagctgtaattcattgtatacttgctttggctattaaagccgtcacacaaaaaaagtaaaagcaacacacacacataaatagacacacttttttacgtatatgtgtgtcttctttcgtctctgttgggaatagatcttgtcctaagagatcacttcgagtctgatctaaagtgagaaactttggttcttgttttggtttttggaatcttgtctaatctggggagataatg

SEQ ID NO: 33371 - DNA, 3003 bp, Unknown
  misc_feature (1)..( 3003): 2750-1469P.txt file - cDNA_ID_3068929; gDNA_ID_1620567; Annot_ID_160753
tagaacttacgtgactcttacgtttccattatcctcgattccttataaatacttacgcggaccaacattctctccatagatcatccaattgatttctaaattacaaacggcttctctagctagctcttttttctaaaactttcacaaagaacgatctcttaatttgtggctgacatagcttggttcttaataaagaagttgtggaaatgggaagcctcaagtacttaggagttgctttctttgttttagttgtttttgacgtctgtttagcagctagatcaccaaaagctcttggtagagggtccggttcaggttctggatatggttcaggctctgggggaggtaacggtggtgggggaggtggtggtggcggagggggaggcggcggaggaggtggtggtggagatggatcaggttcagggagtggttacgggtcagggtatgggtccggtagtggttatggaggaggaaacaacggtggtggcggtggaggtgggggcagaggtggtggaggaggaggcggaaatggaggttccggaaacgggtcaggttatggaagcggctctggatatggaagtggtgctggtagaggtggtggtgggggaggcggcggtggaggaggaggaggtggtggtggaggtagccgcggaaatggatccggctatggaagtggatatggtgaagggtatggaagcggatacggtggtggagataattacggtgactcaccctaaatcattcttattgcttattgtttcatgattctgaacttatgataataatgtgttcgatgttttgtcgttacatatatatacatgcttgtatatagtagatatcactcttcttttgctattgaagagagatgatgtggacctgtggtttcactttctatattaggaatcacaagtattggcatatgtattaccatgcatatcatttccgattcttatatatatcgttactattcgtatgtttatgtaccttgtttatcccacttattgattccttccactggcactaggaaatgttttggagacgtacgtccaataaaattggaacaacaacaaatttgagtatgcctcgagtgaaaagaaaacatgcacgaactgaaaaatgataaaacgaaaaaaagaaaaaaacttgttataggactaaagcataaaacttaaagggtttgtactttgttgtacttatagcattgtggcaaccgaattcaaaatcctcataagcatcggtgtcgttgaaacaaaaaaaaaagatataactttgacgtagaagacgggctcatcggcccaatacaaatattcgtagaccacgtatcggcccttaaccactttaaggatttgccgactcaactggcaaacagaatttgactggtctgctcttcgtcaccaaaaaaagtcttccacgtgtttcttttacacgtacagagtttctccttgtataagattttaagatttatctgggcacgaaactcgaaatatactttttaaggtctatgtacacattcgtttttaaaaaggttcatgatgggtaaaactataaagggtaatattagaaactaactatgaaatggaaaagaattgagagaatgacattgtgtcagaaaagttaggtaaataacattttctgaaaaagagaaaatacaaaaatatccttgtgtttacttatttttacaataatgccattggctttagttataaagtttatatgtatttgtctaaaatagcatgatatatttacaaaaatcatgtaattctttaaaatacatacagaatatatatacacgatatatatgtttctctgaaataatgtgtttctcagaaatagcacgaaatatttataaaaagcatgcaattctcttatagatcgcgaagtttaaaaaaacatatagaattgttacaatattacatgggtttttattggataacatgacaaatatttatttatttcatgagtttttattggatagcatgacaaatattaatatatcagtgttaataacatgttttgttcttaaaatacatgcattttaaaatcagacatttgttttaaaatcaaatctaatctcttatatcacaacgacattgacggaaaattcaggtaaaaagagaaaataaagaatgagagatagagagatttctatggaaaaagaaagagagaacatgtaggtgaacaaaataaagagatatgatgatatattttatgagaggtggtgaagattattttaggagagggagagagaaatagaaaaagaaaatgacatggtgaatctgaagaagatgaattgtgttaaagatgaagagagaaagagaactccatggctaaagtctcgtaaagaagatgaaaaagaaacaaaagaaggaagaagaaagagaaaggctaaaatagactaaatattgccaaaatttctgtagccgacaaatactatttggtccaaggttattttgtgtattcttttgaagtcaaaagttatttcttacacatactcaactataaaggggataaagtatagtgtgaattgttgacggcagaagagagaaaggtacatatttatatctcaatgaaaagataataaacgtgttaatagagacagtaaggagcgttagtgtaacaagtcagattcatggggccacggtatcatttaggaaatggaccgattcaatttaatgttgtctttaagtgcgatgtgaagagctccctaccaatcggacacctcccatgccttatgatttctctataactattgattttattcggaaatactataaatgttacacttcaatctctgtatatagttaatggaatggaattggaagaataaaaagcatcacatcaaattccagactctgatttgcataccctaataaaacatgtactaatgtaacacaatcatattgggatttagacttaatttaggaatgagaaagcaaaaaagtgtgagacaaaacgaggttgttgacgaatttgactacgatgagaccccaaaaaaaaaaaaagatg

SEQ ID NO: 33372 - DNA, 3000 bp, Unknown; identical to SEQ ID NO: 2629
  misc_feature (1)..( 3000): 2750-1469P.txt file - cDNA_ID_3068938; gDNA_ID_1620567; Annot_ID_160741

SEQ ID NO: 33373 - DNA, 3000 bp, Unknown; identical to SEQ ID NO: 2631
  misc_feature (1)..( 3000): 2750-1469P.txt file - cDNA_ID_3068942; gDNA_ID_1620567; Annot_ID_160733

SEQ ID NO: 33374 - DNA, 3003 bp, Unknown
  misc_feature (1)..( 3003): 2750-1469P.txt file - cDNA_ID_3068946; gDNA_ID_1620567; Annot_ID_160732
gacacgtggcgtcttctggtttttccggttagcggaccggaaattatctcaaattaatttgaaccgaacatttttgtgaggtcgtcgatgcaatttgaggatcatgctctgactgttactacaaatctacaatattgttcgactaaatgggaaagattacattttgtcattttctattcgattatttcaacatacccaaagaagaataaagagtagttcattttgttttgaaataaattttgttggccattataggaaaacaatggcaacagaatcacgttattcttgataatattgttagccattgaagaataacaatggcaacagtatcatgttttacacgtcattgataattaaagaatttcttgccaattttggcactacacaccaagaaaacattttttctataaccttatcccaatcacattattaaaatcacttaagatctctactagatttgacctgactagatctgaccgttcgtgagaaagctacttaaaataaaataaagaaagaatgacgtacgtagaccaaactactgttatttcttgaatccatttacatggcgtttctatacttctatcttatcgacctaacttaattgcttcgaatggtagtcacattcctttggccggccagttgctggagcctggaagtagctattcacagtattagcttgtttgtgttttttttttatcaaaccgataatctcattaactcaaattctatcaaaagaggaaggattacatccaaactagaagaaattacaaccaacataaaaacaattatacgaagtaattaagacaaccaaacgatgactaaactagagataaatagacgataacaatcataaacatagaccataaaaaattgcaagacaacaatctcaaaatcttttagatctttgtcttcttggtgtgcatgcaatatatatttatattttttgaaaagaaaatggtgtggaaaatattgcaatcgttcgtacgtatatttttacaaaatattaaaaccaagcccatgcaaaacacatatacaccaaagtcaactttctttttcaaaagtcaccgaaccagaggttataaaactttcactcaagaagaggaaccagaactcggaggagcagaggaggaagaagaaaaaggttcttgatctgcgcatgacagcttctcgtgaggaccagcttcttctcgtccaacacctatcagatcaagataatacaaataatgagaaacaatgttgttcatctcatcgttatcgaatccgctgttgcagatttgatcgccgtaaagaacgtttatggtggctccaaaccccggagttcgttttgcagcagtgtcattctttgttggcttccattttccgacgaaaacatcgtgcgccgacggtaaatgcttcttcggtggcgtcatccaccgccaaatcgccgcttgaaacgctaacgtagcattgttctcgagatactctggatgactcagtagatccactttcaaagcctccccggtttgaccataattgtaattcctaaaccagaccaatgataatgaaatttaaaccgagaaactttaaattagaattaaccggaactgtttaatctaaacaacgtaccagtaaaccggtaaagctcctcgaccgtggtacgagacaccaggagtacaaggatatgtcaatttgtagtaatcatcgcaataaagctgatcaggactcatctccttgttgtaacacaatccccaagctaatggtccgcctgttgcaaccccgtacccgcctttaaaccgaataatcgtaacggttattagtgatttcaattcccggttaataataaataaaccggtttggatcgctctaaaattaaacttacatgaggttttgctcccaacgtggccaagaaacgcagcgacttccttcatcccttgaagtttctcaccagcagtaccgaaaccaagaggctggtactcggcagccgcagtaatgaatgatcggtaatcccaaaagccgacggcgtgagccactggactgttacgcttagagaatagattctcgaattgatatgtctcaaaaaaatcggagattgtatggttgcaacaatactcggaccatcctttgcattcccatcctttgtcgcataattttttacctttcacaatcttcaccagaggctttctcgttgaactcgaaggctcggaatcttcagcgttgacaagggttccggtttgaaacacaaccaatgcaaccgtgagaagcaatagggagaatagcggtttcgaaaccatggttgatttttttttgtctttttcttcgtctatcaatgtgaccattgtatgtataactttatatacaaacatatatgtatagagtagtgtcgtgttcgttttaggaggaattaagttttcggaatttggtggtaggagaagagttgcttttcgtgagtttttttttgcttggttttgaagtttcttagagtggaagttacatgttaagaaaattggtcgaagcatgtacacgtagaactgtaaatgttttaaacttcatttttctaacaaaatggttaatctattttaccaaaataaaataaaaatggttaatctattgcaacacctttacaattagatttttttttggtttaggggacggattataactaatgattgggaaacaagtttgagatagaaattggaaatcgtttattggagcggttttgttgctgctagaatactttggaactaatttaaccatatattttttcttttccaggctatgaatgtcaatatatttagatattgaaaatgtttggccaatcttgaccttgacaaaaaggaataaaaacaaagaatcaaatatttgggacgtcacttcgaatgagttcatgttatccgcagttgcatcagattgctcaagtcatttcaataacttaaccattatttttatattttttgtcaaccaataatttaaacattaattaacccaaaaaataaatacttggaactaataagtggtaagtaaatg

SEQ ID NO: 33375 - DNA, 3003 bp, Unknown
  misc_feature (1)..( 3003): 2750-1469P.txt file - cDNA_ID_3068965; gDNA_ID_1620568; Annot_ID_160795
ttttctttttttcagtgtaagttattttatttttactttcattagttaaatgcaatcaaagtgttatataactataacgaaaattaaaaacacattagatattttaatctattttatatgaaaaaatgtagaactacacttgtaatgattcaaacaactacttagattaaatgacattaaatatttaaagataaattaaatccatatataatttagatttttagctttattaataacaacaaaaacaaaacaaaatcgtgtattgtaaccctcagtcgaattctctatatctagtgagggctttgacttatgattagaatccaaagagaaattaatacagaagaagacgaagttataatgaaaattgaggagcagcttttttggttagtcacgtcatgtgaagaggaagaagatgaaggagaaggagaagaagaagaagaagatcattaattagggagagggtcacaatgcagtacgagacagttcactgaatctgtctatctatgtaaaccccacaaactctcacgcatatcatagcttctgatgaatacaaacaagcctcgatcccattaaccacagacttgtccgtctcttcttcttcttcttcttcacactcatctttataattaacacacacatatgttatatactcatctgtggatgtgcctatactataaagacatgtcacacgtggtgggttatctatgtaactacgtttttgagtgcaatatgtatctatttacacgatactttactgttttcttttaatggatagcattagaatgacttgatggtctaaccattaacattagaatgacttgatggtctaaccattaacattagaataacttgagtccatcataacttggtttaatagttttttttggttgtgatgttacgccacaagcacaaattctgggacctttatattgtgtgtataaatgatatttgaatacagaaattaatatttgtagagattcatcaatgatatatttgcttttgttttttgttcatcattaaatcaaagatcttcgtttaataaaacttgtgtttcatatttttaaataatttataatccagatatattgtactatatacacccacacatgtataatatgaatgtgaatgttgaattatagattgaaagtgagtgaactgaaaggacgagagaggcctaagacagtttgtttgttttcgtgaacatggagcttctctttaccatgtgctctcgatctttttattattaatcttacttttatttacttttttcacattttgtttttatacggttttttatatgagaatggcactgaagatggagcaagaagttcacatgcaaacataaaatattacacataaaaaaattgaaaagctacattctaggcatatgcgtgattttccaaggatttttgtttcgtataaataatattagcagtcaaagtagctagatttgcttctataaatatactttcaaatttcacccctttactttcagatttgtcaatttacgccccgaaatggtgcccttgatagcaaacaattatacagtactactatgagaacgagaatatatctttaaaaattcgaaaagctccaatattttcggtcattagttcataacttcatcatattcataacaattaccgcgaatagcccatccaattattataaaaattttgactatgtaaaagcgttaatcaaaagaataaacgtcatatcaaacgtaagacaaatgtgaacacatatgacaattattaataggcctacacttgaaaaaatgagattactattcacaaacattaccttgatttaagggtcaaattgaaattaaaaaaaaaacaagtgatgctgaatataaaattaaggcaagatctagacgcaatttagtagaatatgcgtacacaatagataattacgtacgcctgtgtatatacgattaattccctctcaataatagttcatcattattatgtaaaatataattataaaaatatatatggcagacagaaaaataaagaaagcaagaggggtagacaaatgttcatccgttttcgtcgagacatgaaatttgtgggatcaaagcaatcctgtaaggaaagggaattaatcaatgtatattactctctttttgtttgtttctcaattagatgaatacatttttcatttatataataactaagacctaaactcttgagtccattactccatttcccctttgtttttttccaacacttcgaaacacagatgtgctagattatatatgatcacctaatgcatgatttatatataatatatgaaaaagtaatataaaatagccagaaatttaatcttgttatgaaaaattgaaaatgattcgagtaaacacctagatggtcattttagactgatatagtaatatctcaatgtatcatggtatttttttcgatggacgaatctgtctacatacaatgcacgtatacatggatgttagaaaccgcaacctctagaactatatgacacacgaattgcagaacttctaaaagttttactgcagtaaaatatcaatcattaaaccaaaaagtctcctataaaagaaatttgattattgattatatgattttgagtgaaactttcttagcagttagcagtaccttttcttttttcgtaggctaaacttaccaaaataaaaactacatcggttcatgtcaagtcttgtaatatatagctaatctagtactagctataggctacagcaaacaaaaatgtttttattatttgtcacgagaaaacaataaaatgtgttatcaaactaaataaaaaccatatattatactaatcacaaattaaacgggaatcttttatttaattaatagtatactctctcacacagacagacatctctggatttatatataaatacagttcatcttctttaatccacaaactcacacacacacacacacactctgttttcttcgtccattctattaccagaaaacagagtttgatagagagaaaagaatg

SEQ ID NO: 33376 - DNA, 3003 bp, Unknown
  misc_feature (1)..( 3003): 2750-1469P.txt file - cDNA_ID_3068969; gDNA_ID_1620568; Annot_ID_160791
atacctgatcgcgggatgaatgatgattcgtgattggttgaattacttctcccacatcctctatgtcagccccaatcgatgatgatttcagaacacaagcggagaaggaagagattgggggcagtgaaagcgaagagcacctaggaaggttttgatctcgacctaggaggaactctaacatgaggaagaaaccccaatcaaagaatccatgtaccagacaaagagatgagagacgatcaacttttgatcaaagacgaaaagagacttctcagatttttcagagtacgacacggtgggcttcgacttctcgtttccattgacgacggcggagatggcgacagagagagagacgattgagaggagagatcaaaggattctcgtttccattgacgacgatggtggaggaagaaagcaatcatcaaagacaaagaagcttctcagattacgaatgaagaagacggagaatttcagacgacgacgacgcaaggtgggctcacggtggtgggcttttttttatgggccccttctttgctaccaaatccaaccaggtatttctttattcattctttttcttctttttcttttctctaaaaaaatgtttttggtaaaactataattaaatagtttaaatctttcactaaaacatttcaataaataaaacttagtataaaatcatattaatttcattattactttttaaaaatgagtttaagtgttaaaattttaaaaacgtcggaaactaactgcgcctacgcatcccgtccttaattggtccgtaagtcttgcggtgttcgaagttcggcaatgttttcacgtaatatagatttgacacttaaactcattttaaaaataataattatgattttcactaaagaaaaagttttatgcttgaagctctcgtcggtcgctagagctgaatttgatttgagggagatggaaagagacaaggttaatgattttgtggttaatggcaagattaacaagttaattaagttattatcaaatagaggttcgtagcgatggaggaagagagacagataagcttttaagtagacaagattctgatgcataaagatgtacaacttgttcttggaagatatgctatgagactcttttagtgatgtcctcatatttctttgccttaatccctttttctaaaccgtcaaaagattcatggtttggaaacttgcaatagcctctggttggttggttggttgtttcaaacgttacactcacaaatataacacaatttaaaaactaaacaacggtcaagaaaagagggtttattttaagagtccattcaacagatcactagcactgaactttgtttaaatattcttttaaatctatgtggacctccctgttttaggatcccatatagtaactttacgagagcataacgtagacgaaccaacactaaccacaagtataagagcattgttcgattcaattacgcctatttggtaccagagatgttaaagtgcaacatggaaacatgattgaatttttctcaagctaagaaggtctaaacaaatgctaaaagaaaacgaaaccaacaaaactgtagagtgtagaaaaaaacatagggtacacatgttataaaccaaaactattggggtatatacttaaataaataaaagtacacgatagggaacatttgtaatacacagaacttaggggtgcatacaaaaataaaattgaaaaaacagagcatagatcagtgatccggactctgttttggaagatctctaaaaagcttaggatcatcatcggcatcgcgcagatagaaaccatcatcgaaattctgcgaatagctcacagcatcgtagtgaaacgtaactaacgttttcgatttattattctccaatccgcaacttctaaccaataataatcttctcatcaaatcccttaacttcggactaggtcttgtcttgttgttgtggttactgattcgagcgtactctgtttcttctgtatggatgagacaagataacggcgaactcaagcatcgaccggtggagtacgattgtctacggttgtcggcgagaactctatccatttcttgcaaaaataaaagagagattgttttattgattgagtgagaaatatggggtttataatcgacgaaagagttagagctaacaataaatgaattaccaagcaaagttggaaaataatgtagattttggctggttatggttaagcggtccaatcataattctcgttttttctttggcagctcataatttctcatttatgggaagcattcatttattgaaacttggaagttttcactagtcattagtcaacattttttggttgtaatgtacctacctatcttcatttggtagtaaaattgtggtacaatgtcaatgtgaagttattagttttaactcctgtttggtttcatcaaatgatataaatttcattgtttcttttgtttttaaaagaagcgtaaagttaaaacatatttggtttagtgaacaagggatcagacttgccagattacgtggtcgtagtatttggggaacaacacacagagctacttcactatcacactatatcttgaacgtgtcgtgtttgttcttgggatgctctcttcgaacaagttatttattatgtatccgtgactcgtgaacttgtgaggcccattacttcataacagttttcggtaaaagaaaaaggacgaaaaagaagagttaaaaaacgctagaaggaggggtcgaacctccgaccttgtggttaacagccacacgctctaaccaactgagctattccagcttttgttaactatttcaaaaacaataaatatattcgtaaacagatgttttaatttcaatttgacttgacaagattaccctttggcacatcgattaacatatcatcgactttggaacctcacaacataatcgcatgtagtcacacttagtcaaatccaaacccaaaaaatctcaaagaaaataagaaaaaataaaaataaaaatgaagagaataagaataatg

SEQ ID NO: 33377 - DNA, 3000 bp, Unknown
  misc_feature (1)..( 3000): 2750-1469P.txt file - cDNA_ID_3068981; gDNA_ID_1620570; Annot_ID_160831
agtaatcgctctgttgctggtaccgcctatctcacgcgtagtgtaaccctgcggtgccgctgcaatatgtgctaactgctatacttcctgctacacctacgctccgtgctgcaccgccggctgtaccactgccattgccatccgctgcagcttaggacaaattggcctgagatgtcctctctccctgcagtggtagcactccctcgtctcagctcgctgcgtgcaatccgccaccttgtggtcaaggctcccacaagaaaaacatcctgcacgaccaccctgtccagctctggaaggatgatcccacttcctcttctgcccctgcgcaggcttgccgcccttgctaggtgccacctgctgctgagtcttcttcagttgtaccgctggactcactcccaccacctgcctctgaaggttctcctctacctcagcagccgtctccaccagtgtcgccttcatggcgtactgcgacactctacaccgcaccctcaaatccggtcaaagtcccctcaagaaccttctaatttgggtctggtcatcctccatgcccccacccgcatacaccaagagtcggttaaactcccggtcatactcccgaaccgaccgctcaccctgtgtcagctcaagaaaacgcgcctccatacggtcgagcgcctcctgcggaaagtacttggcattaaactcagccacgaaatctgcccaagacatatccgcctgcctcctcctggcagtcccactccgccaccacaaatgtgcatccccctctagaaaatgcactgctagatccacccgatactccgccgggcatctgctcgaaccgaagttccgctcaacccgcgacctctaactgtcggtctcctcaggactagtaccaccagaaaaatacccggtgccaatcctttgcaagtgctccatcatcctcaaataagatggaacctcctcagcaaccgcagccctctgctgcacccctgccactcgtggcgccactggaacctgcactggtaccacacctggtaaccgctccaacaactgtctcagtaggcccgccaaaccaacctctggaacctgggctcctctggttgcggcacccatcactcttgggccctcagcaccaacgacatgcacaccggcaccgacaccagctccaccagcccccactccggctgcaccagctatatcggcaccaagaccgttcctaaccccaggctccacaaacccatgctgcgaacccacactctgctcaactgtggcactgtggccattactctcgccggtaccctcgaggactcgtctcctaccgcgaccacgaccacgaccacgaactccagctcctctacccatctgcgctactcaagaacaaatggctaagaaactaaaacaaacgaatatatcacaaacaacttaccgtggaatctcatttaaggctcggagaagatgaagctaggactccaacaacacacaattgactaaacactccataatcaatcctcaatatgctaacaccctagctcatcccacatcaatcatcaggaaaataattcatcaattaatttttctacacatcctagaaccgtaatcgctctgataccaaattgaaacaacccgaccccatttttttttttttttataaatataattaaatattcccaaaaatatctaattaaaccaaccaataacataaaaattaaaccgtaagtcaaaaatatcattttatgaataaataaataattcgaccaacaaaaccaagaataactgacaatcctaaccggtttccaataaccaaaaacaccaaaaataaaacaaacgagttcctagatcatcctctcttccttgccatgattccacgatcatactttatctttacctgcatcaacaacacaatgagatgcgtaagtattatcataaatacttagtgaggcgatcctcccatctacgagctatacacacaagcaaataaaaaggtataatcacgaatacaatacaaacaaaccagtcattgaacaattcacccaaaacacattcaccacacctacataccatcacacaaaacaaatcatacaacccaatcgctcagataagctcatggtcacacactcaccttaacaaattgatcgtaacaataattaaatccaggagagactctccttgcgtctgaaacattccagaaacgtcctacaacaagtccacaaccaaaagcaaccttgaagcaaactgaacaggaaaaaccagaaacaagcagtctcaaagacgaaaccctaaaatacaaaataaccgtttactattcaatcgctccggtgaaatcttatccgcagacgtcacaaagctgcccacaaaatctcgtgccgatcggaaaacagacgagaccacgatcttagtttcaatctccgctggtcccaattcgcgtctgagaaaacgtgtctcacgaaactgcgaataactcaaccaatattaatacaaatccagttctgtaaactggagaataacgataaacgacttgggaataactctaccaaatttcgttaccttttaccacgatttgataagacgaaactggtttctcccaaaccctaacgattctgctccttctccctttctctctttttctcctttataaaacgaaaagtggctaactaaagccctaatttcgagttttcttcttttataggcacactctagggtttccaattaacccaaccaattaaaccggatgatttaaaaacaaaccctaaccgattttctggttcacgggcgttacagtaagcaactgtctacataacaaggcatgaatgaccttacccgaagtcgcaaccctactaaccggcaaatggaatagagatccaaagcaagactgaagaataatatctaattcctctgtcccatcaaaaaccttcctgataaaggatagaatatcttgtctagagtataagtttagccttcccctcggatattgatcggtggcgaagagtctatttggaaattttgaatcccactaagaagatg

SEQ ID NO: 33378 - DNA, 3000 bp, Unknown; identical to SEQ ID NO: 2656
  misc_feature (1)..( 3000): 2750-1469P.txt file - cDNA_ID_3069038; gDNA_ID_1620572; Annot_ID_160882

SEQ ID NO: 33379 - DNA, 3003 bp, Unknown
  misc_feature (1)..( 3003): 2750-1469P.txt file - cDNA_ID_3069042; gDNA_ID_1620572; Annot_ID_160881
cggtgatgatgactccggtgacgattttccggcgatggtggcttcggatacgattttccggcgataatggctttaaaagtagtggtggttgtggtggttgtggaagaaaagaagaaagaagagagaagatgttcatgcagaagaaagaagaagaagaggatataattgtatttattacatataatatacacaatatcaccttatggtttttgaagtgttagtttccaaattattaaatttttttaggttatacttgcaaatttcccttataatatttacaaatggcaaaaaaatgattggaatgactcagaactctatcaaaaacgtttacttagatttaaactagctagtagtataaagaagaccactctatttgtttatttcctagtaaagtaacgaattatttcttcttgagattctcccacaattgtgtgccaacatcaaacaaaacaatacaaaagtttataaaggcatgactaaaaatgttatgaagttttgaccattgtatttcacatcatgaagttttcttgttaagcttgttttagttaagtatttcatgtattatttctcaccacgatacatctaatctgacgtactgaatttcaaaacttttgatttgtagcattttatctaataaattacaagttaattctacaaaaattgaaacccattccatcgaatgcgtggtttaagtcccaaatttttatcttctagatttttaaaatttttaattttaaacaaaattaaaataaaaaacgattttacaagagaaagtttttgccttttcgagaagaaccgcaaccttcccacaatctagaaatcaatctccacttctcaacaatggaacaaaaatcttttatatctctcgaattcaacaatggaacaaaaagctttccttaaaacaaaatttttttatgtcaaaccatacgagcacaaaagacagataagtcttttgttattctatatttgatttgagccagaaggaatatctttgccaaaacgaccaaaggcaaagcccattttgtgattgccaagagcaacttatcagtaaaaggttaaaacatagtcaaattaaaccggtaagtgttggactttggaatccaagataattaccaagagaaccaaggattccaccaaataaaaatatatctattgttgtagtttagtatacaaataaatattttattaaaataatactaaattagtaactaatttcatttatcaccaaagtgattacaatagaataatctataactttttgagtgcatctataaaaaatgtcacttaagtaatagccacaatccattagtataaattttcgtttgttgaaaaacgaaggccactagggtgaaagatgattatgctaaggtatattcacatcaaaatatatggtggttctatcattttcattgtagttgtgttcgtatataggttaggttagttaaaaactatttaaactttgtcatgaatattcctatataaaagtgcatatttgaccataccaaacccatacatacctaaccggctaaaccccatttgctctaacaaaaggtctacggtgacaacaccacacgcacgcatatgcaataatagtattaactattaagtatatgaaatacatatgaatatatgcttcttctttttttgttaactagggaaaatctagaaatctagaccaatgcctaaactaattttcgaaatacagaaatcgaattttctttccactagaaacgtttacgggtggctaatctgtgactgtgagacatatacatttctcatgatatgttgatattaagtgaggttgaggctgtgtcaaaaaaaaaagaaaaaaaaaagtgaggttgaggttttgaatctaagcaaagaaagatcatacacaaactccattgagatgcaaatttatctctcctaatccacttagatcatcctcaaggacgtatacataatgtattatgaattagatatttcaccttcgtgtccactacacttcattggtaacaaatactctctctgaatttgaggttttgagttttgcacatctattaagaaaaagtaaattttatatttttagttattattttgttagtttaataatattattattatttatctcattcttttattggtcacaaactaaattaatgatgatacttttacagaacattaatcttaatggaataaattaaaaattcaaaacattaaatttcttggaacagatggagtatatcattaggactaatgattgcagatagtgtgtaatccaactatatcatttggactaataattgcaactagtgttttaagaagaataagttctagctagtaattataaatgacgtttatcgagatatcttggataatggaattaaacttttaagcgtcttccttgtatccaatgaatttttataattttatcaaattaaacatgccagttttaatgctattgtcatcttgttgttataaaaatatcacactccaaaaagattgtaagaatccttaaatatcaaaattaaccaataaaaataactaccatcatggttgacagaaaaaaaatttaactaccactcggttcacaacaagcatatgatttactgcaaaagctcaccataatatatatgaatcgtttccgtgactttttccaaaacaatataaagacggtcgtaaaactttatcatctgcgtaaattgttgtaacaaagtttttttaattgtttctatttatgtgattttctaattttagatctattatatttatcaaaactttagggttttatatgtttatttttgggttttttgagttatgagtccatgagtttgctcaatttgagcttaatactgaaaacacggttctgtagaatcgaaaaaacaaattcggataaaggatatatcacataatatttgtttcgtttttcgttgttttgtcgacggatcatggaaaggaaatgacaagttttatggataagagtgattttgcaccttattaaataggaagtcgctaaccatg

SEQ ID NO: 33380 - DNA, 3000 bp, Unknown; identical to SEQ ID NO: 2660
  misc_feature (1)..( 3000): 2750-1469P.txt file - cDNA_ID_3069056; gDNA_ID_1620572; Annot_ID_160870

SEQ ID NO: 33381 - DNA, 3000 bp, Unknown; identical to SEQ ID NO: 2659
  misc_feature (1)..( 3000): 2750-1469P.txt file - cDNA_ID_3069062; gDNA_ID_1620572; Annot_ID_160868

SEQ ID NO: 33382 - DNA, 3003 bp, Unknown
  misc_feature (1)..( 3003): 2750-1469P.txt file - cDNA_ID_3069070; gDNA_ID_1620573; Annot_ID_160916
aaatcaggttggcttcaatgagaatgcttctctggtctaccaaacgggatatggatacaaccctcaaatgccatatgggccatattcccctgcagcaagtcccttgccttctgagggacagttgtattctccacaacagtttccgttttcaggggcatcaccgtattaccagcaggtagttcctcctagcatgcaatatattacttctccaactcagcccgagctcaccagccttgtcggtgttgaccaacaaggtgataacatcggaccacgccaatcctaccatcctcatcccattggaccgtttaatggaaaccagccaaaccttggttttcctgaatggcagcaaggttttgacgggggaatatggtcggattggtccaagccttctgatatgcacaggcattcttcttctatttctccggctttatctcctcagccactcggctcatatggatcatatggccagaacatacccatggttggttcacttttcttatctactcttatccgacatatggatagctttcttctattcatggttacatattggattatatgttaaaagtagattgttctttaatttgtcaggggtcacagcgacagagatcattttacggttttggatctggttcgaactcttataacagaggttatatgcatagtggtggtcgtggccagggttctaactatggaagtagactaatttctaatgtgggtatgggaaaccaaggctggattggggttgacaacagtcgagggcgtggaagggttagtgatccatctttgggtggtgcttataatggtacttttgatatcctcaatgagcaaaatcgaggaccaagggcttcaaagcccaagactcaggtcttagaggagcttgattctgctgctgattctaagaaaaataacaaaggcagtgcaaaggagcacgaggaatccaacaacgcagactttgtcaccgactacactaacgccaagttgttcatcatcaagtcttacagtgaagacaatgttcacaaaagcatcaaatacaatgtatgggctagcacccctaatggcaacaaaaagcttgacgctgcttatcgtgaggccaaggatgagaaagaaccgtgtccactttttcttctgttctcggtacgagtctaatccttgatcaagtgaaaaaaaattagtttttcttctttttgcagattgcttacgggtttgtaaattcaggtaaatgcgagctctcaattctgtggtgtagcagagatggttggacctgttgattttgagaagagcgttgattactggcaacaagataaatggagtggacagttcccagtgaagtggcacattatcaaagatgttccaaacagccagttccgccacattatattggaaaacaatgacaataagcctgtgactaatagtcgagacacccaagaagtaagtagcaatttgtgcctatcaagctttcttgtccataagatacctcttttaagccacaccataaccacaaccaaaaactacaggtaaaactggaacagggcatcgagatgctgaagatcttcaagaactacgacgctgacacgtcaatcttggatgatttcgggttttatgaagagcgggagaaaattatacaagaccggaaggcaagaagacagccaagcttgccatctgcaggagtagtagcaggagaaaatgaacataaacctgcttctgctgcattacccacagacttcatgaagaacatgtccaagagttttgcgcaagttgtccgcttggacgaaggcagcaaagaagcagtcaaggccagttcatctccagatgcaattacaacagcagcagtctcttctggtcaatccaactagtaagtaaaagacatcaattagcaaagactatgttttcaaattccataatatgatcttttgtttgttctaagaaggtatttcaaatgaaattttacgtctgaccgggtctggtttttgtgtaaagtaagcctctttcctccgcccttttctgcttcaggggtatttagccaaaatttgattcatttccctcttttcaatgttctataataccctcactcttctgagttgatagaagaagaagatgaagaagataatgtatgaaagacaatataatgtttctcttgtaaagttggcctcatttatctttgcaggcagtttttcaaaataaaaatgcagattacacacatcaatcaaattcaaagctctcagctttccacatatccaaagtttgtttctttgtgtgttttttctacacatatcttagtttttgagagtccgattgtgaacgtgacaagaaagtcaatcaatgacttatccatatgaatgaattgtcatcaaaagggacactgaattgtgtggttcatactcatagcatgtcaatatattcgtgaccctttttacaagcaagacagattcagatttgtgagatgttatgattcactaacaataatgtggctaagggatcagttgtaattgatattatccatttgtgagaaacaaataaaatagtttcatataaatctaaggactgtctatgtcagtccttagtctattttgccatatttctagatctaatcgggttgcattattacgtagatagatatgatctacttactgatgatttttttttttgaaaccttaatgtataaaaaaatggtttaaaagtactaaccattgttggtccacaaaaataaagggaagaaaggagggccaaatcgtaacattaataaaaaaggggccaaactgtaacaacaaaaaaacaaaaagggccacaaagaaaaaagagagaaaataagaagagtcccggacaggaccgagcttgaggattcgttgttgcctttatgactcagccaacaagaaccagactaatcctagtcctagtcctagtccacgcgcgaatatacaaacgtcttaaagccatttgatagaaccgatttccaagggttttgctcagaaaaaacacagagagagattttggaattcgatg

SEQ ID NO: 33383 - DNA, 3003 bp, Unknown
  misc_feature (1)..( 3003): 2750-1469P.txt file - cDNA_ID_3069086; gDNA_ID_2936568; Annot_ID_194683
aggtttaagtttctttcttctgtttaacactcattattttcatttttgagctgtaagtacttttcttttcgtcaattaggcttaaactttttatctatgatttttttctaagtattgcaaaggcatcatcaaacttaagaaaaaataaatccatatacttccgtgtatatttcaacgtatgattcgattacttaactttaacagaaggtgtgcagtgaggaaatcatgaaagaaatatcaaatagtactagaattgatttttggtttgcaagaaaaataaaatgaagaagtaagaatataaatgtaggtgatggttttggcgtgcctgcttttgagggcaaaggcatgactccattgagttgataaaagtagtttattttctttctttttctttagttgaacttaaaaaagtcgttgatctattattttcccacatcatctcaaccgctcaccataatgagagaatctcaatgtcacacaaacacataatcgaacctctaacttttgtatacataacaaactttattattcttttatcgagggaatctcgttttcatcatccctatgttcataatatatctcctctaccatatacatatgcttgatagacgtcatatatgccatacatgttaaagtagttgtgtatatattaaagtagagaatatggacattgcatatatgtatggcaatgtatagataatcgatatacgtaaaatacgtgaaagcaatgcatcagaaaagttggttgagcaaagaattggatacggctcgagatggcatcacatgtattggaaaaagtggagcaatgtgtcattataatccaaaaccctcaataatgtgtgtccaattctttactacttccataagcttacttaatatccaatttgtttttatattcttacattaggaataatggattcctctctcgagtttagatttcagaatgcagctctttaaacaaacaattttgcggatttgaagtattatcaaatgtcttagaaaaaacattaatttaaacctcttctaacaaaccaatgtaacttgacaacaaccaattagtataaaggagcaaaatatattattacaagaattagaagcaacggtggtattcaacgatggaatttatacgcgtattaatataaataaatgaaagattttggtgggggaagggaagttgatatatagatcaatggagctcattgtcaacattcaaacatctcattacttctatcggaaacacacttaacaaagactttaatttccactccttctcgcacctcattgttacaaaacttctcatttttatttattttgtctactccatattccacgatatttttgaccgttgcacttgaattcatgcaccagcatgtggacccacctaatctatctgataaagttataattgagtagagcagcaaaaactcatacgaattttcaagtctttacacgttacgtggatccaaggcaatttgtagatcgagacggagccgtaattatcgaggactcatataaacaatattattaacgtataacgtagtataaaataaaagaaacatctccattatatgggttactcactcatgtaccttcacctaatccttctgacctatccccacgttaacgtttcattttggaatcagatgccacccacaactaatctctctttccatgtttgatatgaatcgtatttatcctctgtcgatagctccaatttgactaagttgtcatatttaaattaattaactagtgtgttaattagctgccaagattgattaacatataaaatctttgggtgaagataaggaatcaacctcaccctcccacccactacacatatgaacagaaaacaagtgaaatcgataggtctttctcttttctcaatataaatatggatattaattatacaataaccataatggaaattaaaaaaaaaaggaaatgtgagaccatgagaagacgtgaattcactgtcaacttttaagagaatgcatgaaaatgtgtagagagaaaaaaggggtcggcaaaagaaaatgaatggctcttcctctccaattccattacaccacatttctccgtggatttatgtcaatatctttgaaaattttgtgtgttttgagtatagatgtgatataacaaaagaaaatgtcagaattgtaatgaacagaaaaataaatggtacccgaaaaaccaagaaaaaaaattaataagaaaaatgttgacaggaaggtagatgtgcggttgtattatttgcaatgtccctctcttgctctataattacacaaacttgtccaattcatcacacttccccaaccaaacttgtttgcttcatataaattattttataaaaagtatataatgtatgcaggcagagacatgtgtgtgtctgtgtaggctactagctacctctctttttcataaattatatcgattgattccgtgggattatgacctatgtgagactgtgacatttgaggtttttttggccctctgtgttatgtactcatcatagaatgcgacatttttttatttatatatatatgattaatgatcaatgccaatttgggaactctagtaagtatgcttttagtggtccacccccatttctagtcttatcttttcgataatttcgtttctcatttattccattctcaacaatcttgcctgataataccaaccaatcaagtcagctccattttttaaaaatcttagaataaaatctaaacaacaacacacagtgatagagaacattcggctatggaattagaagttgcctgcatgtttattatctgtctatctgatatggatccttgaaacaggcccatttcgagatattagaggcccaaaacgaaaataagaaataagcccatgatacgatgtgtgtaattaattaacacaaaattgaatatcattaagttaatacttttatcagaacaaaggcgaagggttttagatatcttatccgcttgacgagtagagttttcgaaaccagcgagattaatg

SEQ ID NO: 33384 - DNA, 3003 bp, Unknown; identical to SEQ ID NO: 33383
  misc_feature (1)..( 3003): 2750-1469P.txt file - cDNA_ID_3069086; gDNA_ID_1620573; Annot_ID_160896

SEQ ID NO: 33385 - DNA, 3003 bp, Unknown; identical to SEQ ID NO: 33383
  misc_feature (1)..( 3003): 2750-1469P.txt file - cDNA_ID_3069086; gDNA_ID_2936568; Annot_ID_143732

SEQ ID NO: 33386 - DNA, 3000 bp, Unknown; identical to SEQ ID NO: 2670
  misc_feature (1)..( 3000): 2750-1469P.txt file - cDNA_ID_3069096; gDNA_ID_1620574; Annot_ID_160931

SEQ ID NO: 33387 - DNA, 3003 bp, Unknown
  misc_feature (1)..( 3003): 2750-1469P.txt file - cDNA_ID_3069112; gDNA_ID_1620575; Annot_ID_160966
tgtcactgatccacttgacgacgacgcgaaggctcggatcttgagcagccacagttacatcctagaccaagattctcctcgactctgcgagctcgtacacgggtttcttgaggatggtcctgaagagtcattctacgactctgaccccgacctgtctgagacttcttcagctgaacattctggtgaagctagtgtggagatcgtgagaatggcggtgagcttctccgattccgatccttaccggaatctattgctagctcacgttttgagagccgtggaggtatattccggttttaggtcaaggaacaaaactgttttccgggataaggtagcttcgtttctgcgagagcttggtcacgacgccgcggtttgtgtatcaaaatggacctcttcatccaaactcatcgctgggagttaccatttcattgacgtcgttcacaagccgtcagataatgatcagaaggccgtccgttacttggttgatctagactttgcttcggagttcgagatcgcaaggccaacgcgcgaatacacgcgtgggctgcagctgctgcctaacgttttcgtaggaaatgaagagaatctaaggacgatcgtgagagagtcatgcgacgcggcgaagcgatcaatgaagagccgtggcttgtctcttccaccgtggcggagaagctcttacttacagcataagtggtttggtccgtacaaaagaaaggtgggatctagtttgggagtgaagccgttgaatagtgacgccgttagttgccgatctttagggtttgatgacggcgccgtcaatactcgtttgttcatcagggcatgatccatatgcatgtggtatgaagtagactagtataaagtgtaggcgaatagctggagactacacttctttttattcaatctgactgactatgtatgttctcgtttaatattaaaaaaaaagatttgttctaaatcagtaacttaaagactaatagaggtcaaactattaatcagtatcttatcattaattagaccaaaatgtaaaatacttaaatgtatcaatcaacctggattatgtggcattcatttgcaatgaaatctcgctagtaatgttgatgtgtgatataaaaaagaatatgcaaatgaaccataacagtgtcagttgacagttaatatgtgaagaaagaaaaaaaaaatatgagtttagatcatcaagatcggaggctagaaaaaaaaaaagatgggaggctagagactcatatgtcaagctttacttcttatactttttaattaaacttccaaaacatcaaggtcctttcattttcaatttgacttctaactttattccaaattttgaccgagactataggaagtcaaatatgagtttgtgagttaagtttgagctctcacaaccgctgggataatctcaaaggtgaatatcttaggtataattattttcatccgagtgcttactcacatgaatttgtgtctaaaggttttgctcggattttacatattttccgctacatcatatttcaccgtcggataatcctaaaaataatttggagaccataaagatttttgagatagcttccaatgcaatgagaatcaaacgatcacttttgactaagactttaggaggtgatatgtgagtttgtaagtcagggctctcaaagctgaatatcttaatatatgtttcaattatggcaactgtccaaatgagcgaaatgaaactttcatcccaatgtagtactcatagaacttagttaatatacgttttgcttgcgttaaattttcttaagtaatgagaatttgccgtttatctagaaattacctaaacgccgatggtttttggttcattcggttgggtttctgaatctctcagtcgaatatcccctcaaatgtactaacttgtatagtttatgtatcccattgaacgggaccttaactgctttatgtatcataaaccctgaatattgtgcatttcaaaatatatttctgaaattatttagttttggctaatcgtttccactctataagactataactactgttgatacgagattctcatcagattgttcatgtttgatcaatcagtcatctagttttgtgaatcgcttttttttttttttccttttcatataattttgtaaatattctcttatatatatttttttcaactttttctatttaaaattaataattattcaaaaaatatcatgtaagttacaaaaatgtatccagattctttttgtagtgataaatattaaaatcaacagtttgttaattttaaaataacttttgattttagttttaattattgttttttaaacaaactatctacaccagtaaaatacctttttaacacaccaaataatatgagattacattccaaaagtatacaatgttttgagtcttgactaaaaaagtataaaaaaaagaaaaatctctgtttccttactctattcttaaaattagttaatcaatgcaatttttgggccattgggctttagaaatattgaagtattccattatactctttcgctgaccggtcaaaaagctttaacgctcgaaggccgccgcgtcttccaaggcattgaacgtccctcctccacgccttctaggttctttcgcctccacgtaaaacgtcacccctgacgtcacatcctctagaacaccacgtgtttgtcttaaacacgacgagtaattacacatttggtcaaactcaaaccaacaaaacactttttaaacaaggctaaattggtcaaacgcatggcaacgaatctcaggcgttttttcgttttctttattattgacttatttttatttttattttattttgcttctttgaaatcttccccggcaaggcaaagcaaacgagtggacgtttttgaagattcgttaatttttctctctctctttataatataagaagtcgcctactacgtagaaccaaaagagagacaaaaatacactttcattgctgtcttaactctaacggagttaactaacgtcgacattatg

SEQ ID NO: 33388 - DNA, 3003 bp, Unknown
  misc_feature (1)..( 3003): 2750-1469P.txt file - cDNA_ID_3069116; gDNA_ID_1620575; Annot_ID_160965
gaatcatcatgtataaaacgtgaagctaaacttattagtttaggcgatgaagttgatatatctcaagtctttcactgcaacggtttattgttattcatcagcatcaccaaagacaagactaggctagtggtttggaacccgtatgattggggacatacccgtacgatcgaacccacacataactgccacatattcaataggtataatatatgtatgctctcggatacaacaagagctagcagctaatcccacaaaatcttgaggtttgttacttactggatgagggttatggatgagttcataatctacgattttaactctgattcatggagggttcttgatgtcactccagattggacgataagttatatgaaccttggcgtgtctctcaagggaaatgcatactggtttgctactgagagatattccgaaacagacgattatttcttagtctgttttgatttcacaagagagacatttgggcctcttttgactcttccgtttgtgtttgttaaatctgaagatgttatgtgtgtatctaatgttagagaagagcagcttgcggttttatatcagccgtgggataaataaaagatggagatctggattacgtctacgattgagcccaacgcggtgtcgtggaacagcaaggtgttcttatcagtgagtataagaaaactcattggccctccgtttcagttttgtttggggagtttcttcattgacgaggagaagaaagtcgctgtggtttttgataaagactacaaagataagcgcaacatagcttacatcattggagactttggagtcgatggatcctttaaagaagggatctcggagaatcagcctacgcaatgtgttacccacttatgtgctcttatgttccaacttccaagtctagtgcaatttaattagtcgaccatctacttcttgcatatttttgctcgtttttttttcctacctaaccatctagttcaaacattatcttttgctaaagttgggaagtgtggtggaaatgtcttctccttttttttcttgtaatgagtcttgtacggtggtggttatatcgatctacgtcggttgtgttcccctcggtgatctcgacctcagcgtaggtggcgatcaatgttggaaatgaaaattcctcctctggattatcagtctatcttttattggtatattgccatatatgtcttcatatggtattctgctatctttcaatgaacatcacaaaaatagtgatgcttaatgtcttcatatgattcccctaaagttagtgcttttgtgttttgtgtgacatatgggattgtcatatatatttcgaatctttttcgtttgttacacaattaattgccttaaaaaattcaaactattaattaaaaagaaaaatcagataattaaaattcagtggcaactattgtaaataagtaccaactccaagatttatttcacaaaatggctgcaaaatgtatatgtagatatttagcttaaggaggagtctaaatttaactttagaatttttttagaatataatgtatattagagtaaaaacatttagaatatacatataaggattaaattatattgtgtattattttttactgcataaaattgatttgtaattttgagaaatataagataaatttgcaaaaattaacgaattggaagattgttttgcaaaaaatccaaatattttgatataaattatttgatctattgttaccatatatttttgaaccatttaatccgtatttttccttgaaatgtgtttgatatggtttattttgcataaacaacttgatttgtgaatttcattttcctatttgaaatctctttactatataactagccttgttgggcgcgatccacatatgtattatatgatacttttgctcattagttaaaaaaaacaaaatgaatagttattagtcaaaacccaatgtagagatattgccgacgtagtcaacacatatgaatatgatatgatcctgcaaaaaattttaacgacgttagaacctaaagaacatatgtgttctggaaccacctttctgtcacttaactctgtcatcacctttcgaataaatgatttaaggagttctctagaagactagaatcttccgtaacctaaaactcaacctcatgtagaaagactcacaaatccaattcctctattctcctgcgaaaaacggtttctttatatctctcacgatttgatttcctcttcgctttttttaattgaattgagattgatggatgataattttaatttcaagatttttttgttaatcttgtaatggaaaatattaaaaataattgcttcaatattgcaaagctttgatattttagaaaacaattttatttaataaaagtgatatatatatatatatatatgttatagtatattaaaagtaaattagatttaaaagaaagtgagtgtataagagacaaaacacgaaaaaaaaaatatgattgaggatgacaaatggattataatttcatatatatacataatgaattcaagcttgtaacttatgaaaatttagggggataattaatactcaattctagatttatttatttgcaacgtatccatctatacctagagaatttttaataatttgtaagcaaaaaatcttgaaagaccacaaatggatttgaatttgttctggatttgtactgtgataatccattttgctttgcttgattagtttttactttttaccattggtaataatttgggatcatgtttagttgtttactagataaccaattttgttgggcctgatccaacaattttgccgattataaagtaaataagtgaatagttaagcccaatataaatttacgagtgacggatcatctgtgttctcgaaccatctttttaacgaactctctagaaccctttttctttttcacccaaaacccaacctcgtataaatctcaccaatccatttcttctcttcttctttgcgttttttgtttggaactgaatcgaaaaagatg

SEQ ID NO: 33389 - DNA, 3003 bp, Unknown
  misc_feature (1)..( 3003): 2750-1469P.txt file - cDNA_ID_3069124; gDNA_ID_1620575; Annot_ID_160962
tttattaatatttttacatctagatttggggtttgagttttaaaaaataagattaatgatgcaaagcttatcgaatgtccaaaataccacatgtagagctgtttgtaatggtttgagcgttgtagagaaagcatgtcatacatacataattatgtccatcacaaggatgtcatacatacataattattccttgaaatctgaatattgtggaatgagttgcagcgtggaatcgttgttcgtaagaactgttcatcgtaatcacatatgcgtagttaagtatcattataataattaataagaatagattacatatataattcaaaaaaaatcattaaagtagaatgatataattgtgaagaaaaaaaagtataaaataaaattttagttgaatgaaactatgtttgaattttatttttttaaaaatctttgattgattgaattcaattttcgaacccaaaataacatatcgtttaacacactttgatatcttgaattttaatttatataactcttattttctttctttagttatttttcccttattctttttccagtttatctaaacaaaaggtaattaatttcaaaattcgataaaccctactatttgacatcttctacgaacgggcacaccggagaatcagcttctcgttccgtacgatgtcggcgacactccgacgcctcattcttctcacctccacaaatcgctcccgtaatctatctccgccgtttctttccaccgccgtgaaccacctatctctatcattctcttccgtctcatcttcaccggaatcacacacttccccttcccggatccgaacccgaacaccactcgaaactcaattcgaaacatggattcagaatctaaaaccaggattcacaaactccgacgttgtgatagcgttacgagctcaatccgatccagatctagctctcgacatattccgatggacagctcaacaacgaggctacaaacacaatcacgaagcttaccacactatgatcaaacaagcaatcaccggaaaacgaaacaacttcgtcgaaacgttaatcgaagaagtaatcgccggagcttgtgaaatgagtgttcctctctacaattgcatcatcagattctgttgtggtcgtaagtttctcttcaatagagctttcgatgtttataacaaaatgcttcgatcagatgattcaaagcctgaccttgaaacttatactttgctactaagttcattgcttaagagattcaacaaattgaatgtgtgttatgtgtatctacacgccgttagatcgttaacgaagcagatgaaatcgaatggtgtgattccggatacgtttgtgttgaatatgattatcaaagcttatgcaaagtgtcttgaggttgatgaagctataagagtgtttaaagagatggctttatatggctctgagcctaatgcttatacttatagttacttagttaaaggggtttgtgagaaaggtagagttggacagggtttagggttttataaggagatgcaagtcaaaggaatggttccgaatgggagttgttatatggttttgatttgtagtttgtctatggagaggagattggatgaagctgttgaggttgtgtatgatatgttggcgaattcgttgtctccggatatgttgacgtataatacggtgttgacggagttgtgtaggggaggtagagggagtgaagctcttgagatggttgaggaatggaagaaacgggatccggtgatgggtgaaaggaattacagaacgttgatggatgaggtttattttttgaataagggatgattgattgggttctgtttatctgaaaggcgatcaatcggctaagcttaagggctacaagatggggggggtttgttgcaaagtctgtgttctgcactctagttagtgaaccccaaatctcagtaatgatctgaatcataagggttatcaagttttgagcttcaagattctgtgttcttgagatacataacaggttgaagcatagtgtgattggaagactgaagatctcaagccatgatagcttagagatattctgtaattgcaatttgattcaaggattcaaaatcatgttgtctttgtatcatgttctgtgtaaatgaggtcttatgacaatcaaggatatcaattgttactgacactacttgcaaaccaaaagctgttcagcatgattcttaacgcccttttgtgtattattactgttgatgcacaactataacatttgctgttacaggatctacattttcagacaggtcacaagattcttatgttagctcaatatctcatacgagcattggttacagtttattctattttaatgctctagatatatctctttgtggttttattgattctgactggattctgcatctttataggggattctcttgttttttgggaagtcaaagaaacagtccattatttctcgcagttcttctgaaacaaaatacaaagcaatgactcatggacaatgctgcaattatttctactacacattgctaagaatcatgtttcccataaaagaatttgaacacattgttcttgaatgcattagttctgatttcatgaaaactttacatgtttgttctaaaaactccattttggttggaaggtttaaaaattgatttgtaacatatatcgtttctggaagcttataagttattagaagatgataatggtcatagttacgttttctagtttgttcaatgactctggagtacacatttgttcattcaatgaaactgaaacaaaggtacaaagtacaatgtgaatgactccgtgatctgccgcttaaaacacgttagttttttcttcttgggacaccgcttgaaaacacgttaattaggtgaatctgtggatacacatatgggcttaatggcccctatatataatacgatgataggcccattacatttagttgtcttccacaacaaaagagtaccctgaaacagatctttcgtataatcagtgacgtagagatcgaagacgatg

SEQ ID NO: 33390 - DNA, 3000 bp, Unknown; identical to SEQ ID NO: 2685
  misc_feature (1)..( 3000): 2750-1469P.txt file - cDNA_ID_3069140; gDNA_ID_1620575; Annot_ID_160944

SEQ ID NO: 33391 - DNA, 3000 bp, Unknown
  misc_feature (1)..( 3000): 2750-1469P.txt file - cDNA_ID_3069143; gDNA_ID_1620575; Annot_ID_160943
ctgagaggtgaagggccaaatatctatttgtcaaacattgagggaataaaataaactttaaatcatctttcagggcaatttcttaattatgtaagagttatgatcgggtttcgagttagggttcaatctcgggttttagatcaacccgattcacaacaccgcattgaaattggagttctctcgaagttccgtggcgtcaaaaatggcgttgggtgatcggaaatccccagaacaaacaaatcaggcgttatctcctccgacgcctattgtgcaggaaaatggaactccgacgaagcgtgtgttgatcacttcccttttagcaggtttcgcaatgcttcttctcactttcgggatttattattacgtttagttgatcgcaagaactaggatactctataatgagttccatcttagaacaattttgagatttttggttgcacatatcatcggaaagtagccaaagttcatcggaaagaagcaattagattctcgttgttgtatcggttactagaagttcgattctaggttttattgctccattaattagaagaattcataacttttggtgtatagataattcagttcaccagctttgattggctattcaattgcttaattattgcatagaacatgtaagaaatgtttgcatcacagtgactgagaagatgtttcatgtgcaggagtaattggtggaggagctggtttagtgtctaaacaccggatagctcatcccaatattcctactgtttacgctgctaattttgctattgtcgccggttgctattgcggtacctgctcttttccatctgtgttatcaagattgaaactgagtgtttccattttctctaagaaggtggactctcatgtaatgtgaatattatgtgattgttgcaatgttttggttttggtaggagctcgtgaatctgtgagaataactcgaagatcagaacacgatgatttaatgaactcagctattggaggactttttagtggtgctttgcttggaagacttcaaggttcgttatcttgaattcttttctggcagtatctattctactccatgtccctgaagatttggctgtaatactctcagtctcaagtagtctgaccatgagagtgtgctattttctgttacaataagagatcaaatcataataactctgccatatttaaatcaattggaagaaactttcatgatagtctctttagggttattaagctcggaactgacatattatcggtgtttacaggaggtcctaagggtgcgattcgctactctctagtttttgctgctgtaggcacagcatttgattatgctacccttaaaggaaaaccaatgttagagagctaccgtaacatggagtcattcaagttacctgaatggtctcctattaaagtcctcgacgaagaagccttagcaaagaagaaagctcatgaagagaagatattccctgaaagagtcctcggcaaattgaacaaagaatagtcttaaccaacttaagattatttctcttttgcccccataaatttcttaagttggaattttgtttatcggtgatgtttcgtgaaagactgaaagtaattccagaccttgtagatgagacttgaggaggattttggttttttgttgtttcctcaaggtaaaaattttcttgagacataagaaaacatctttgtatgctgacctacccataaagcgtatatattcatggttaattatgggcttacctaaaagttcgaaaattttgtctatagatgacttttggcttaccattgttaaactgatataacgtacatttctgaatttgagctctgattatgatacaactaactagtatgaaccgctaactacgcataatggtcaatatatttggttattataattcttctgttttaattagtcttacacctatatgcaaatttttatatttttctttgattacatcaataatccggattaagtcctagtaattcgttggataaaccaattcatcgctagatgatccgatcatgttacaaaaaattcgggtcaaaggccaaaaagcacaaataacctgccccaagtttgatagagaaatcaaatgcggagttttttagtgtttacgtcatgaggccctaggtccaaagttctttttggtattaatcttataccattttcgtttctaagagatggttacagaatgatacaagtagcggaaaaaaccgaaaaaactacaatgcgaaagaaaaagaacaaggaatagacgccaactcgaacaaaagaaacgacgagatggataagaaccacaacacagaaaaacaattgtagaacgcaaacataaattcaaaattgatgcatatgtccaaaattatttctagaaatgactacatttgcaatgaatggatttcttctagactatacttgttgtttagttaacgttctagactatacaaattgatttatatatatttaaaatcgtgtgatataggttgaatcgtccgacatagttggtgtatagtggtttagaagtagatactaaaatgtgtgagttgttatgaaattatacactaatagtgatgcgtaatagaatgagcaacaacaacaaaaaaatctcaacaacaacaacaatacatgtggaggagaagaaaaagtcttcgctcttcaaaaaaaaacaattgcaaaaaaaataaagtcacgtgattaaaccgagaagacagggaagacacgtgcttggctacattacaaaaacagagcacaccacaacaaacaacaacactagccaggctttttttaacattcgtctttgacaattgtccatcatcaatggcattaaatggcaaaaccgtaatttcgaactccaccaaggggcaaacttaaaagtcgatgtctttcttcttcacctcggacccatcggagagaagatactactagaagagattcattcacagtgttgaaattaaaaaaccgaaactttctcgtttcttcttcttcttctccaattttcaaaattcgaaaagatg

SEQ ID NO: 33392 - DNA, 1490 bp, Unknown; identical to SEQ ID NO: 2674
  misc_feature (1)..( 1490): 2750-1469P.txt file - cDNA_ID_3069156; gDNA_ID_1620575; Annot_ID_160936

SEQ ID NO: 33393 - DNA, 3003 bp, Unknown; identical to SEQ ID NO: 27633
  misc_feature (1)..( 3003): 2750-1469P.txt file - cDNA_ID_3069167; gDNA_ID_1620576; Annot_ID_160997

SEQ ID NO: 33394 - DNA, 3003 bp, Unknown; identical to SEQ ID NO: 18639
  misc_feature (1)..( 3003): 2750-1469P.txt file - cDNA_ID_3069169; gDNA_ID_1620576; Annot_ID_160995

SEQ ID NO: 33395 - DNA, 3000 bp, Unknown
  misc_feature (1)..( 3000): 2750-1469P.txt file - cDNA_ID_3069177; gDNA_ID_1620577; Annot_ID_161024
tgattgacccaatgaaacatgatgcggtttggtgcttggggaatgcatacacttcatacgcgcgtttgactcctgacgacactcaagctagattaaactttggcttagcttatctgttcttcggaatagctgtagctcaggttattttctttccattcagaatcattgttgatctggatcactctcttgtgttgtggtttctcgatgtgtgatgttgattttaaatatatttttcatctttgaagcaaccggataatcaagtctaccataaatcactcgaaatggcggacaaggtacttatagcggtttatgcatgaatggctttatatgtttctcaaaccaatatgttttattccattagaaacatgtcactcactgatcaacaaaacaaagtagctgataaataagcaaattaagttcatgtgcttttagttttgttctctagctggatttgttacctttctactaagttaaggcatatcatgaagggaacattgcatctcaaaatgtccattactcatagaaactcaaactcaaagttttgttgtttatttaatttcataggctccacaactacacacggggtttcataaaaaccgcttactctcactattgggtggcgttgaaactttagcaataccgagcccaaaggtacgttcattctcattatgggcatttcaattttcaatattttgatgaatacattcaaaaaattagataatataagaagatatatgagtttgaaaccatgtttatttttcttatgtacttttttccaaacaggtagtgaagaataagaaaagtagtgatgagaagtatattgttatgggatgggtgattctagccattggcgttgttgcttgtattagttttcgaaagctaaggtgaatgagcttgttgtgagaatatccacacagaagatatgggcaaaggagaaaaaggtttcaagcgtaagacccctagagcctagggtctctctcttatgtttgatgttttttaagagctttttgtgagtttaaaacaaaagtggtaccatacaattccaagttataaaaacattttttatacttcttttttttggtaaaataaataaatcatagattgtcactgaaaaacaataattatttcatgttgtctcataatccagtttttaataaacagggtaaatgcatgtcacccaatataagtgacaaaaaatcagttgatagaaattttttctgttggatttgaaaaacatgattatgaatgatatatatactaccaccatatatctaaataattccgtataataacaaattaaacatagagtaattaaaatacacctttaagatgaaggatgggaataaaaaataagagtattcctgcaatcacaaacacaggagcttgttcttcggctttatgttgaattttttcagcgttcatgttcaacaacactaaccccacaagtcctatcaatattagcataatccatcccttgcttatagttatagtactattactttgttctatttcactattaggttcagacgaagtttcgccactaaaagtgcctattaacttccataatccagctccacccacaataacaccgaacacgaattttaccattttctctttgtgtagttttattttttaaaagatattgattgatttttttaaaagttttttttgatactaaatgagagacatttgcttttatagttttttttgggtctatatatcatagattcacatatatattttggttttctgaattaagtaagattgaaaaacaaaattatggtcactcaaatgttgttaggttttctatttaataatctatgatttcattatttgaataaggccctgttcgtttccagagacgctgcgacagagtccggcgactggaaaaaaggctttatttctctttctcatccctttcatctctcctgcatcttctctttatcttgtcgctgcgactgcaatttcatgattttggagtcgctgaaaataacagcgacccccactaaagctttattaaaatcagcgactatcgccggtgtcttcccccttggattaatgagtcgctcgcttctttaaaaaagtgtcgctggagagatctcgcgactaccaaaagaacagggcctaacctaaatgtttttacaaggattcttatgcataagttgaaataaatagaaatatgtaactaaattactgtaagaggaaaaggctataatgtgatacattataagtttataacccatagtaaatgtttcttcttttgtatattttcagtcaaaaatatgaatttcagtatatcaagtttattcggttcgatcgcatcaaatttgagagtacaatttggttaattcggtattagaattctatcggtcaggttcttataaaacttggttcgtttcggtttaatttaaacatcaaacttgattcttgtgcccccaagtccaattacaatacttatatgattatattctggtccgataaatccattgggcttattaatgggctttaactctctaaaacacattttggcgcgtgtaacatcgcaacacatcaaacgtaggtgcgtgtacctcacatgaaaacacacgagaaccacatacgtacgcgtccccaccaagagtttcgagttttaacaaaatgtcgtttatacccttatacttacccggcaaatttatcgcatgttgccgccaaactttatcacttccctcgcttccaaggctaaatctcagtgggtattgacgataatacccttcatcttcctcaacaagcttttttctttggataaaaattcccgaacaagcttctcgaaaccaaacaaatttcaaacatttttaatatttccctcctctattttccctcttcacgtcaaaaattcaaaaaccccaaaaccctataatctcctatataaatattcagccctagatcttataattcatcaatcaaacaatctcttcaatcaaatctcttcttcaatcaaatcttcaaatcccttcaaagatg

SEQ ID NO: 33396 - DNA, 3000 bp, Unknown
  misc_feature (1)..( 3000): 2750-1469P.txt file - cDNA_ID_3069181; gDNA_ID_1620577; Annot_ID_161023
tgttcaacaacactaaccccacaagtcctatcaatattagcataatccatcccttgcttatagttatagtactattactttgttctatttcactattaggttcagacgaagtttcgccactaaaagtgcctattaacttccataatccagctccacccacaataacaccgaacacgaattttaccattttctctttgtgtagttttattttttaaaagatattgattgatttttttaaaagttttttttgatactaaatgagagacatttgcttttatagttttttttgggtctatatatcatagattcacatatatattttggttttctgaattaagtaagattgaaaaacaaaattatggtcactcaaatgttgttaggttttctatttaataatctatgatttcattatttgaataaggccctgttcgtttccagagacgctgcgacagagtccggcgactggaaaaaaggctttatttctctttctcatccctttcatctctcctgcatcttctctttatcttgtcgctgcgactgcaatttcatgattttggagtcgctgaaaataacagcgacccccactaaagctttattaaaatcagcgactatcgccggtgtcttcccccttggattaatgagtcgctcgcttctttaaaaaagtgtcgctggagagatctcgcgactaccaaaagaacagggcctaacctaaatgtttttacaaggattcttatgcataagttgaaataaatagaaatatgtaactaaattactgtaagaggaaaaggctataatgtgatacattataagtttataacccatagtaaatgtttcttcttttgtatattttcagtcaaaaatatgaatttcagtatatcaagtttattcggttcgatcgcatcaaatttgagagtacaatttggttaattcggtattagaattctatcggtcaggttcttataaaacttggttcgtttcggtttaatttaaacatcaaacttgattcttgtgcccccaagtccaattacaatacttatatgattatattctggtccgataaatccattgggcttattaatgggctttaactctctaaaacacattttggcgcgtgtaacatcgcaacacatcaaacgtaggtgcgtgtacctcacatgaaaacacacgagaaccacatacgtacgcgtccccaccaagagtttcgagttttaacaaaatgtcgtttatacccttatacttacccggcaaatttatcgcatgttgccgccaaactttatcacttccctcgcttccaaggctaaatctcagtgggtattgacgataatacccttcatcttcctcaacaagcttttttctttggataaaaattcccgaacaagcttctcgaaaccaaacaaatttcaaacatttttaatatttccctcctctattttccctcttcacgtcaaaaattcaaaaaccccaaaaccctataatctcctatataaatattcagccctagatcttataattcatcaatcaaacaatctcttcaatcaaatctcttcttcaatcaaatcttcaaatcccttcaaagatgccttcaatgccagaagagccgctcctaacaccaaccccagacagattctgtatgttcccaattcactacccacagatctgggaaatgtacaaaaaagccgaagcatcattctggaccgccgaagaagtagatctatcacaagacaaccgcgactgggaaaacagtctcaacgacggtgaacgtcacttcatcaaacacgtcctcgctttcttcgctgcatctgacggaatcgtactagagaatctcgcttctcgcttcatgtccgatgttcaagtctctgaggcgcgtgctttctacggtttccagatcgcgattgaaaacatccactcggagatgtatagtctccttctcgatacttatatcaaagataacaaagagagagatcatctctttcgtgccattgaaacaatcccttgcgtcgccaagaaagctcaatgggctatgaaatggatcgacggttctcagactttcgccgaacgaatcatcgctttcgcttgcgtcgaaggtaccttatatttactattttaccctttattttttgtgggtcttccttattgttacttgaattgacgattatgtcctttgtgttgaaggtatcttcttctccggaagcttttgttcaatcttctggctgaagaaacgaggactcatgcctggattaacattctcaaacgaattgatctcacgtgacgaaggtttacactgtgatttcgcttgtctactctacacgctactcaaaacaaagcttagcgaagaacgcgtgaaatcaatcgtctgcgacgcggtcgaaatcgagagagagtttgtgtgcgacgcgcttccgtgcgcgttggttgggatgaaccgtgatttgatgagtcagtatattgagtttgttgcggataggcttttgggtgcgcttgggtacgggaaggtgtacggtgttactaatccgttcgattggatggaacttatttcacttcaagggaaaacgaatttcttcgagaaacgtgttggtgattaccaaaaggcttccgttatgtctagcgttaatggtaacggcgcgtttgataaccatgtcttctctctcgacgaagatttttaaagagcgtttgttttgatgctataattacgattctactcttgtattattaccgtgtattatccttggtttttgaattaatgaataattagttgcttttatcctctctttcttcagcttaatctccatgaattagggcttattcgattaatgaatccaatgataaagtttcaaaaagcgaccaagacaaaggatattaaaaattaatatgaaaagcgacaaggaataaaattggacagaagaaattaaggttaagggcacttccgtcattttcatattatttgtggcattcccaatttcccactttgtggctccaaagagttttttttttggggcaatg

SEQ ID NO: 33397 - DNA, 3000 bp, Unknown; identical to SEQ ID NO: 2694
  misc_feature (1)..( 3000): 2750-1469P.txt file - cDNA_ID_3069193; gDNA_ID_1620577; Annot_ID_161014

SEQ ID NO: 33398 - DNA, 3000 bp, Unknown
  misc_feature (1)..( 3000): 2750-1469P.txt file - cDNA_ID_3069204; gDNA_ID_1620577; Annot_ID_161008
tgtgcctattacacctgtcactcgccagtagtgtaaatctgttcgtaggggttcatatagcaaaaagttcacttttttttttggtttttttttgttaaatatagtttcaatgggcttttgataattaggattttatgttcttaaaatgtgctttgtatgctttctaattgtgcgtctaatccaaggtttcaactctgtaaacatatcataaaaatcctttgttttgctctgagattttactattgttggaagattctatagattttcaaattttcttgttcctctctttgaaatttacatggaagtcagatttggaccaaagtgatttgttgctcgtcttttaaagtcttctggtcaaaacgccgacaaggctttgcttttgactaataaagaaacatacttttccacaattttcttgtctttttatcttatttccttactcgtcagggattccctgtaacgcggcaatcctgacgaaagacatatcagaaactttgatagaatcacatagcagcaatctcttagctggattttaccagcttcactttgagattaggtcatttacccttttaagggtttctctcctactttcttgattctcttcattcccaagactcaaaacctagcaaacttggacatttggattgagtgtctctagtccgggtaagatttgtgtgttgtggtaactttatctgacggtttaggagcttaggttgcttagatgagttccaagtttttatttttcttttgcttattgttcttcttgttcctttggtccaagttcttgatttggacagtaactgaaaatttcctaattgattcctttaagtttgactgtgctcttattactagtcttctctaaatatttttgttctttgcttcgacaatttcattgatgctttgaatttgagaatctctctgtcctcttattattataggtctcatttgggtggattctttctggtgaaatctttcttgtgagagttttgtattgggagaaagagataatcaaatgccggaggaagatttggtagaactgaaattccggttatatgacggttcagatgttggcccgtttcagtactctccaaccgccacagtgtcaatgcttaaggagagaattgtctctgaatggcctaaaggttagcaccgagcacaatcttttggtttgtttttcggctaatccgtgaaaaagaagtaaaaatgcgatagaagtgctctttaatgctttagatttggctttagaacgtttgcttcagccatttttttttttcttcagtttcttcacttgtggcttgatagacaaagttcagacataagtcataggatctgattgacttactaatcatttgtcttaaagtaggaacagaagaaggaagttaaactattgatcttttaaaaggttactcgatcttgtgatctatgttttaacagtttctccacttgtggtataggcttttgaattggtctgattgtattactaatcacttgtcttatactacaaatcatgtctttagagactatagggacgaatactgttctggttctttttagtagaatttcttgatcttactcttcagtcttgtgcattcaacaaaaaattgaatttgtctcattttgtttcctattgtatcttattgactaatcgaatttgggggttttgaatgtgtgtagacaagaagattgttccaaaatcagctagtgacatcaagttgataaatgctggtaagattttggagaatggtaaaactgttgcacagtgtaaagctccatttgatgatctccctaaatccgtcattacaatgcatgttgtcgtgcaactgtctccaacaaaagcaagaccaggtcttgttctttcttatctccgtaaatcttgtttgtggaatgaattctttagcctaatatcttgttttttctttctcttacagagaaaaaaatcgaaaaggaagaagccccacagagaagcttttgctcatgtaccataatgtgagaacaacaacaagtcccaagtcaaaaaatctgaaagagttaagttttgattctctgtggtatttgctaaaagaccatataaacataaactaccgcttcatattcgacattttcttcacaagttcaaagaaaccttcatctatggcgttataaagctagtctattagagttgtttctcttgagctgtgatggaaaaactcttgtttggagcatcctttataaagataagagttttgttaccgcgaactaattcaagtatctctgtaacatatcttgtatggttttgtcaatctttagtacattttagacctggtttttttctctatcaggatccgcccaaaactgtatccaaacatctttatccagtccattacctacagtgaaaacgagtactaaacgtttgcagtttggttcttgagtggcaaacactttgatatgttactatatggtccatacctttctcatcattttccacttccacaaagccaatgttttggggatgtaggtagatacaaacctccaaaagaaacagagagcatgagatctcaataaatgtcctttcacctaacttatcactgtctcccacttaattctctcatttataaccttcactttcacttagtgtctctccactatcttgtcttgtttcgcctttaattctattcctctcctctggctctcatttataatcttcactccaaatgcacctttctttgtactcccatcactttctcttcgatatggtatttactttaatccgattcgaatattgtaactatgaaaaacaaaatgaatagtaaaaatatccgtttcgtatccaagcctatttttaaaagacacgtttgtataactctctctatatatagaaaggaaccacgaagctctttcaagagagttctattcttgtctgaaaactagttccctatatttcttctttcttcacacacatattctccaattcttacataaatatcaaataaaccaaacttgaaacttgttgtgcttaagatg

SEQ ID NO: 33399 - DNA, 3003 bp, Unknown
  misc_feature (1)..( 3003): 2750-1469P.txt file - cDNA_ID_3069235; gDNA_ID_1620577; Annot_ID_161033
aagagcttcaaatgtatccaagcaaaaccaacttctcaaacaaagatagttcacttgttaatccaattcagttaacagaacaaaagaaaaaaaatgaaaatctttgctttgcatcatcaacaacaacaactaaccaatttcaaaactcttatgcctcccaacaaaccaaacataagcaacaaatatcttatagtaagatctttagcttcacatgtaacaacaatcaaccacaatttccaaagtaaaccaacttctcagataaacatagctcacttgttaacaaaactatataaaagtttaaatcttttggtttccactcacatcaacaacaactaaccaatttcaaaactcttaatcctaccaacaaaccaaccataagcaataatcgatgatgcatttgcctggacaaagtatgctaaactctatacttaagaagctgtaaccaaaccctaattagtcaccagaaactgctaccaacttcagaagattgctctgaaccaaaacttgttctcaaaacgaatgctaaattaggttaaaaggtataaagaacctgcaagcaattctcatctcatctttccaaccacactccaccaatctatctctcacaagctccattagattctccttctctccactctccaccaactatgacgatttcaaatttccaaaaacctttcaatcaaaagtccacaacagtaactgaaatcgatttcgcattacaaaatctgaaaccttgacgttgatgatttctcgaagcgtgaccttgtctttctcgaaaccatccgccacatcgtcttcatctggtgtcggaggccgattcaccgaatgtttcctgatcagaaaaaagcgagaaatcgaaagatgaaattgaagagtaacgattcagaagaagggaataagattgtctaatacatacatgtgtttgaatcgatagattcgtttcaagaacacgaatcaattgtgatggatgaacttttttccagagtcttcttcagcaaacccagaactgtatcgcacgacgaaggagaaagcacacaacgagtcgagatcattaaatttcaatattataaactacgtgccgtttgttaaaatttgccgaaacaaacaggctgttttgtttaagtccactggatagaaactacgtgccgttttaaatggactctacaagtagggaaaaaaccttaaaaaaatccccatcgattttctattttgccgtttaatacccaattatttttggttggaaaaaaatacacaaagtagttaaactgtgtgatttaatactcaaaaaataacatattattattgtcatactcacaatttcataacaaaagttaaatttcaattatacccgtattgttgaattaactattaatttgtaaatgacatgacaatcatttttattttttcaataaaaagatttatattttgttttactttttcttatttatattctatgaataaaatgacatggtaactactttatttataaatttcaaaataaaaaattatagaaaatctggagaaaaatagaatttttagtaaaattagtatacattaatatgattctcatttttaaaaattagtatatattattgataactgttttatgatcttttaaggtacgcattcaagaaacaatcacaaaaaagagttatcgattctttctcacctcctctagcattctcacatcctcctagccttcttctttgtttccaccatcttctccgtttccaccatcttcatttcctcagcctttttcttgtcttccaccattgtctcatggatctacttacctctcagtctcataatagatcaaaaccatgtattctcatagagagttatcacaaatggcgctgtatgggatgatcttctcgtttgttattgccttcaactcgtggagcaacactttaaacctaagcatcattataatacatatgataatgattttcttcaagtatagttgaaaatgatttatgaagttcaaagtacataatttggcttgaattttacattttaagttagaaattttatggttattagttttaagttagcaaatcagagttctgactgatatggcgtaaacaatataattttatatttatgtcgcaaaatagtaagtataagatttgtttttaaggagaaaggggtagatagatatgtagataatataatacttttatatattaagtatgttttaataaaaaacatttaaaagattataaataccaattagagtagaacaaatatgaaaatattaattaaaaacaaatttgaactaatccactatcaaatttcaaagttattgactaaactttgaactaatccatatatgataaaccacttatgtcatgtgggaaaataataatatttggcaactaatggttcagaaaaaaatattttctcgcataacaaataattcacttaaacgtcaatttcctaaattttgagtttttaaatcaccagagtgttaggtgaataagaatacttaaaaatgttgtgctatgaaataatcaatcaaacaaataatccaaatttttagaattttttcgtcgaatagtgtataagtgtacgaaatttgcaaaaacccaaatgttattttcaagaatagtaagctcttatgttaaacttaaatgttttcattgtgagaacgaacgtcttttaaacataccatttaatagtaatatgtactaatgttattgaaaacttactttctgctaatattggaagcccattaaactaaggcccatgaaagaaaacacccacaccgacgtcgtataggaaagatgtagtcatgtgaagaaaaaaaattaacggtcaacgggaaaaggaaaacgatggcgcgtcaaatgctaaaccattaaactacggttgtggacggcaaacgcttgtcgtctccgaaacgcaaccgcagagaacccaaatttatatcattctatatcttctcttcttcaccggcgtacaatagcactcaactcttaacttacgcacctctcttctctcatg

SEQ ID NO: 33400 - DNA, 3003 bp, Unknown
  misc_feature (1)..( 3003): 2750-1469P.txt file - cDNA_ID_3069268; gDNA_ID_1620578; Annot_ID_161066
attaaaagagaaacgaaaaaagtatgtacaattaacgaggatttgaacggcggaaaatttttgtcgctaatccctcgcttatatacaacagattttgaagatagacatatcatatcattgcagtcttatgtccgttgcaaaattgtgatgactaaaaattggtaaccaatgttatagtctcttttatttcttactgactccatcaaaatcttgcttgtaaactttggacactatttcgaaaagcaaaaacgtattaattttggaattattaaaacattaatagaatatttaatatgtataaatcaatagaatacattaaactaataaataaataatacaaaatatgaattttaaccatacaaaaaatctcaactataattttaaaacccctctaatagctaaaactgtaaaacatatactgagttggtctctgatattgctcataaccgaccgacctaacctaaccacacacgggatacgctcgatgttcccattctccacggtactccaacactggcatacaatacaaaacattgaaggagacagtaatgccacgtgcacggctctgcaccataaaatttaacgcctctgatttaaaacaccacacattgacaaattgacataaccaaagctacatagagaaaaaacaccaaaaatcaaaattccatcaaaggggcttttaaaattttggacaagaacaaaaaaaaaagaaaaatggcaacgagaggagctgttgctgctgctgcatccacaatatggaagcaccgaagaaacccttctcttcgatcattatctcgccatttcaatcccaatttcaatcatagaatcatcccaacaggtacaatttcattacaattctgttctaagatagatacatgaaacataagagttgtgtcaaaagttcatatcaatttagggtttaaagtcaattgtggtgtatatgatttttccttgtagggtttaaatatcaagttagggcgatacaaggaacaagtactgatcctgtcattacaccattaaagaacagagaggaaccaaagccacaaaactggaaaatcaaaatgctttatgatggagattgtcctctctgtatgcgtgaggtctaagttagacctctgtttcttgtttatgtttgttcataaagtgtttttgatactgaatttttgtctttttattggtgaatgaaggttaatatgcttatggaaaggaatgaaaaacatggaactataaagtttgtcgacataagttcaaatgattattccccggaagataatcaagggcttgattacaaaacagtaaatttactgtcttttaatttggttcaattttgtttcatcttctgtttgatgttcgaactttcggatttgatcgagatctttattaggtgatggggcagattcatgccattcagtctgatggtaacgttgttaagggtgtggaggtaagcttattagcatcattgttttacactaaccatttcatatttatcattttggtgtaacgttttcaggcatttaggagattgtatgaagaagttgggcttggatgggtttacactatcaccaaatttgaaccagtaagcttttctctctttatctcctagtgatctcttccattgtgttaagttccgtattcatggataacacgcgattacttgcagatagggaagttagcagatgttgtgtatgatgtatgggctaaataccgacttcaagtcacaggtatataaaatgacctgaaaaatgttgtacaagcttacttgattatttgtgcgtctcaaaaactagatctctttgttgattagggaggccatctatagaagctattcttgaagcaagaaagaaagataaggtagggaacaaaggttatcgattttctgtcgtagtaacctttgctcggtaaaaccaatcaatgatatgattgtgtttgcaggtagagacatgtggtgaaagcaagaactgcaagatatgaattttctttatactctttgaattgttacaaaataccaaaaccagtttggagttacaaattttctttatgtgagtgtgagaatttgtatatatatgatacacagccccattacattagccaaatcatcctgatgatacattatacacatgaataatttcagcaaattttgaaactgttaagagttttatatttggtaatgattttgtaaaggttagcttactaatgttattgaaatatttgtttgaataatgaaaatgaaattcaacattgtagatttgttcccagtcaccaaagaagaaaaaaggttgtatgtgaaaaaaaaactttaagaatcaatagaatatgagatcaatttgttcatttgttgaaaacaccaaaaaaatgcactgcgtctcacatattctctctctggggcatttaatcaaacaccttccatgcaccaaatcgcacacatttcttcggaggagatttcactacaaagccctctctaatgccaccgtaagcacaacagcttcatgtttcaaaactctcagttctagccaacaggaccaaatccatctctacgttgatacacttctccaatggaaccaggtctctctctatctctcgacccttttgctagataaacatgttggaactttggaattattcgtgggcattatttgtttgaaaagattcgtgaatttctaatcaaattgaaagctttagaatccaattttgggtttaatggttggtttaagcttgttgcccaccaagtatttgttataagtccttactgggtcaaagcatgataagtcgaatgcttttacctgcacaatgaaaaaaattcaatcttgttgtcccttttttggcgcacttcactttaacatctgagtgtttggtttgttatatattcctacctcaaactcaaactgatgttactcaattgaaatcactggtgaatgtctatgttaccagtgggtttaaagtatgtttttgcttgggaattctatgtgagtttgagtaggccttgtgatttatgtgcagaaaatg

SEQ ID NO: 33401 - DNA, 3003 bp, Unknown
  misc_feature (1)..( 3003): 2750-1469P.txt file - cDNA_ID_3069276; gDNA_ID_1620578; Annot_ID_161062
ttgggagccaggtgtggcaaaagatctggcccagacctgactaatgactatctttccttccttctccagctttgaagtagtaaaggcaaatgtaaggatcacccattagtgtggcaggccgttatttatccaccacgagaacagttataagcattggctaaattcatgtttcgcaaatcattgaaaagaacgaaaaatggatatcggaagaaaagggataacaaaatagatttacaatttttttttctcatttcattctatttacatttttatttgattttttttaaaaggtttttactaattatcctaagggtaaatcatattacttcttatatcataaataatatttatttgatatttccttgaagttttaaatattttggctttgaaataatatatagtactggaaattagaaaataaatagaaagtggcaagtagaaagcagataaaagagggaatgatatacattacgatccaataacatattgttaatgctaaacttttggaaggtatgtttttctatttaaaatttttaatgtattttgattatactatttagcagctgctagattttgcgaaattaattattgtcatctaaagatttttgtctataattattttttctccaacctaagaaactttatgaagtatatataaattcacttttatagcatttaaagaatactgatatatttctatcataatcaaattttagtaacttgatcaagaataatatgaaaatatattttgttgaacgagatacctttggctctcatcttaaagttcgataggatagaaaagtataaacggaaatctaaaagattgagacccacctaatctaattctactattttttctaaagcgtagtgcccctcctatatggcgccttcaagatacataaataatatatgactacaaataacaacggtaacgagtccattcaaaaaaatcaaaaagattctcctgtgaggaaatggcttctttttcgtttccatggcagttctatccgaaattctctttatctcttcttcgggcttaacctccacaaaatatattgatgcgctatgccaacatgtggaaaacggtaccttctgcatgcacatgttgagagcctatcctcccgcggttactgccaccgatttggtactaatctttaagacacatctattaaatttctcatgtttctgttttaaccttaagaaaaaaaggtactgtattacgttttctcttctttctttgatatcacaccaaaagtttacatgcaaaagtttcagttgagttcttaaacttatgatttgatttatcattacacaattattctttcgctcttttggaattaaaaaaatattgtttagattgttaattcacctttgcaaagttgatcatttttctgcaagcacttggacacttgtaggcaaaagttttgcaagatgtaacataaactttttattttgcaattgtagttatctttataatttattttcagttcattaacatcaaatttgtatgattttgtttagtaaaccatcaataactgtattttctaatctatagttttccctggctaacatcgtgatcaacctcggcatatcctacgccaacaacacgggggcttttgccgccgaagcggctaagaaagagccaacgttgaaggtgcagttcaagtcattccagcatgaatatgacggtattcagttgtatctaagaatggcaaggggggagctcaaggaatctccaatgagtgcaaactatgacatttttcgttgtacggatatcactatgtacctgaaggatgtggtcggaggaaacagagacaacacctctaaaacgttcatggatatgacattgcaaatggagaacattatcgatgttgcccttggagccaccgtagctcttggcgggtgaatatgaatcgtggcgttgtcaaaagctggcttaggtttttaatttgtagtttgcatttcctcaaagattgtaatgatttaatcctctgcaataaaaatcaatatattttcaaggtactctaagttttgttgtaaaagaagtacaagacaaaggttgatatgtattaggtggtttttttcattaagcgaaattaatgattttaagagttagctcaatcacaagcgaaaatctatgagccttcaagaattaattaccaaagtgcaggtttagtcaacaaaccgaaaagcaaatatggctcaaattcatgagaactatgtgaatttggttgagcagaaggacaacggtgaaaacaaagttgctcattaagcttcaagaagcagaatgtcaaaaacagttgcttatgtatgttaagtcttttgatatttgacatatacgactaaggcatatgcattatatatctatttgtataataatcaatttgaacccgaattcgaaatgtaaaacaatcccaacttattactttcatttgtcaacctttggtttcggtggcttgactccaccgttaagcccttcaccgtgccatggtgcgtcgggttaatcctatcactcacttgttctcctccctttggtataatccttttccgtggtgccgccggtaattgagcattttgcttcttggagctaacgcccttgagcatatatcacagtagtcttataaacttttcgttaataaaaatctaaagagttaccaaaaagtaaaaaaaaacttgaccaaaataaaataaaaaactagtcaacaaattgtatagactgtactaagatgaaaaataaggaaagaataatctcaacaaaccagtcagatttcctagatttcagcacataatgaaaatgaaagaatataattaataccagtcagatttgtttttgttttttactaaagatggtgataaatttcatgacttccaagaaaagttcccttgcacataaatatgactggtataaacaataaccacaaacatcaaaaagcaaatccaaaagttgaatcctaatttaacttataggttgagagaaacaaaacgttctcccacgaagaaatg

SEQ ID NO: 33402 - DNA, 3003 bp, Unknown
  misc_feature (1)..( 3003): 2750-1469P.txt file - cDNA_ID_3069292; gDNA_ID_1620579; Annot_ID_161095
ttatgaacttatgatatgagttaatggcatcatttttttttttttttttttaacacgaacttcatttttattacttaggaaacgtagtctgaaaacagagcatttgagatacacaatgggataaagctatgaactatgtatgaagacagagcatgtttctggtttttcgctaaaatatcagcaggttgatttgttgatctgtgtgaccacgtgaacttgattgcgtcaaacttatttctccaaactttgatttcatggatccaattgatagcatcaaatcttgagcctcttccattcagaacattgactaggagcttgcagtcgccttcaagtattacttttctaaagcctcttatccataattgttgcatggtaagaattaggctttgacattctgcttcaaaggctgaggaaacggtcgcacctgtcgcttgagcagcccctttgaacacgccgttatcatctctaattatccaagctgccgtagagccacgaactcgattcacaaagctgccatcgtaattacacttaatccatcccatatgtggtttttgccactgactctgaaactgcctagttgtgccattagtcgtactcggagtgggaacttgcgcacataagccatttgtgatccattcttccgcttcatttgtagcatctctgatatctctccaccaatcgttctgttttcgttggaacactagcttattacggcttttccatattctccaaaggatcgagataggtagctgcccttgcattgtatgttgtcctgcatttttatgaaattcataaatctctttaatttttgtttcataatgcacctggggatttgatagactcggaaggggaatgttcgaagctctccatatttggcgagcgtgtggacacgtaaagaacaaatgatccgtagtttctctcgttatgacacatctacgacaaaaactatctgtgacgattcttcggctttcaagttcagagttggtagaatggcatcatttcttattttcttgataatgacacaaagttttcttgtctacaacatcattttaagaaaattaaacgtttttcaccaaagccgcgggaataaaatcatgaagaatggttagaacgtggtatttaaagatgagaccagaccaaagcaagtcaatacaaagtcaaatagaactcgatcggaaacgattatcaaattttggatttctttttttggggcaaattttggtgttttgaactgtatttttaattgtttgttatgatttcatatacaaattagttttagatagaataatgaaaatatttaagtgaatactatgttgtaaagtgtaaataatagacttttataagccttttaacgaaaaaagaatgtaaaaaataaaatatagacttttgtttatgaaattacaacctctttgataatgatataacatatgtgaaaatgcaatgtttttcttgattcgtttggtcaaaaaggaaaaatcaagtgtgaattagtttctgatgaggttcaatagttttttttgtattatcttaaaatttattcacaataaatatagtagtaggcgataaagaaagtgcaatgtttttcctttgactacatttaagttatagattattttatgatgagcaaaatcctcaatcttatatctaattggtttttctgaaaatatccaccacaactcaaacttcttctttgtttgcagctgcaatgtcaaccggtattaatatagaagagtgacagagaatgtatgattctctatctgcaaaatggttttgaattgggactgtgccggtcgatgattccgctcatcatctagtcgcgggttttgaaatgggactctttataattgatatccaactgtataaaaatcttgaacatccttaatttgaaacataaaaaatatgacattaactatctgattaattttcacttaagggatggttagttaagttacattggattaaaaatggtattagtagaccaattagaacatgtatgccattttttgtttacaaaaacctttttaagtggtatttataagacttgctcaatttcattcaaaagaacatgaaatggatggactagttttaatggcaataacccacacaattactcatatttggttcaacaaacttctatttcggttcacttattaattttccatctatatatgaatcatataatatgattaatttacacaagttcacacggccacgtaaaatgtaactgtcttcaagttgtgcacataaagagggtagtttcgaagataacgggtcaacgaaagggtaaaagagtaaattgcatagaacgcggccaaattaaaagcccccaattgggataaaagtcatcgccgtctcttaggtgtcaaatctcaactgtctaaaaacattaaaagcttcgttggggtagttgcatcttccctctctaatacaaaacttattttatccagttttagtttcgatttttcatttgttaacatgttttcatttttcttttaatgttaatagcctttttatttggaaaatgaaaacaatttcacaatttaattctaaattaccatttctaaaaaatagaaataatataaataataatattgaataatacatggactaaaaaattatagtactgtcctaaacaaaattgcttgactagattgaacagaaaatgtttttgatgtcttactagtttgaacaatttatttgctaacattattctctttgtatatttcttaaaaacccatattttttccttaaatatttcccatttcccctaactacattcaatagctaagtctctctctccctctctctttctctctcactcaaaaatttcccattaaattctcaaattttctccaactttttaggccattctcttttctcctctctctctctctcacacaacacaaacaactcttgagagagagaaacaaatctttcacttgacacttctctccaaatcctcatctcattcttcatcctaaacatttgctcattctcacgatg

SEQ ID NO: 33403 - DNA, 3000 bp, Unknown; identical to SEQ ID NO: 2708
  misc_feature (1)..( 3000): 2750-1469P.txt file - cDNA_ID_3069296; gDNA_ID_1620579; Annot_ID_161107

SEQ ID NO: 33404 - DNA, 3003 bp, Unknown
  misc_feature (1)..( 3003): 2750-1469P.txt file - cDNA_ID_3069312; gDNA_ID_1620579; Annot_ID_161102
gatttctataaaaaatacattccttaatagattaacttaagccatataattataggccggtggtttgcatatctaattatcaacttcctcgtaccagaaggaaccttgtagcttatagagatatcattgtattcgaattgatcatattaaactattttgatatttacttatttttctaaagaaactaatttttgctaaatttattcaatgactagtattatgttttgaataaactttgaactgtatattctaacctgaaaaataagtggaattctacagatcaattaccaaagttttgtctttgtttttgtgatatatcgaaggttttagagccaagttcgtaaaaaaaaaacaatgtcaaaagttaaaatagctcgaatgaattttgtttcatgtaggttttttttcttatgatcggacgtttcatgtagtctcatggagtatgttataaacaaaagaaaaaaaaaaatagtggaagaaaacaaaattaatgaggttgtagtagagtcacgaaatggggtctgcagaaagaaaagaaaagactgcaagttcgaattattccttcttccgtgtgtgtaattatcatttgcttttattattttaaaaaatataaaacatttactatgtattttcttacatgtaaaccatttactatttttctccacgaatatttcttatgtaaatttatataaatgtatgtataaatacatacactacgttagtggtactaaacggaccacaaagaaagtggccatcaagcttaagcagctgcaataagctgacacataaagaaatctgtctatacatatccaataaaatctaattcaataaatatgtacaaatggtcacaaaaatagtaaagggtgtaatcatgcaaagtcgtggtctagtcgttttctctattaattaagcccaatttcgaagtatacaattaggagcaattgggaaagtagtacattttaatgatgatgctaatttgcagttgtaacactttatcacaaactagacaatccacattcaccggcggaaactaacctagactagtttccaacatcaaaagtccaatttttgtttcgtttaaatagatggcgcaaacgtacaactaagattagatttaagtatttaactctacaactaggttgagccaaatgacgacaatgacaatgccgacgactgttgatatacacaactaacgtttatctgattagatgagttcgtgaacggctacacatccattagcttctatttaaaccatttgttatgaaacaatgtttgacaactcaaatgaaaaagatgaacaatatttctataccaagtaccaagtgaaactttttgtgtttacatcaggtatgtaatcattttccgtgttcctttgttaaaaaccgtccatccttgattcttctgataatggtaaaactatccgtttgttaaattgttttattgtatttttatctattgtaaaaaactaattaaattttaaatttgctatgcataaacaatactgtatatacattttttataataagattagagaattatagtaccatcttgtaacaatgatgtaataagagacgaaaaaaaaataactaactgatcattaccatccataaataaatagttgctgccataaaccaaacacattgtgcttatcaaaaagaagaaatttgtacttaatgaaacattcattattagcaaagtgtaaaaccaaagaaaaacaaactttatttctcattttattagtaaaagtgaagaagagtaaagaaaaagagagactgagatgaggctgagagcctgagtctgcgggtggagagagagagaaagaaagcctctttacacgtgatttttaaaagagaccaaaaccccaaaagcaaacctcttttgcatgcgtccttaaaagacataaatttctctcaaaattttctacatcacaaaatcaatctttttctcttcttcttcgtcttcatcatcatcatcatcatcttcctctttctcttcctactgagatattttctccacattgagaggaaagctatcttctctagcgtcactcttcttcttcattggtcggtgagtgttttattttttttactgtatttctttttaatatagcggacgggtcattttctctccgtagcaataaattcacttatataaaataaaattttcattcttcttggagatattgatatttccactgctcttttcgatgtttattccttcactttgttcacttgctcttagtttttatctttcactctctctctctcacaccaaagttcacagcaaaataaaattaaaataaaaaagcttcgatttttcgattaaaatctttgtaattatctgtttgggttttctccgggatctcattttccggtttcaaatagagacaaaagattaaagctttctccggttttgtcttctgggtattcccaatttcccccatttcacttaaagctttaatctctgttccttgtttttgtctgtgattcttcttaatgaaaacaaaaactgtaaaaataaaaaaaaaacttctggtgattggttccttttattcttggtctttacagtgttttcttctaatttcatggtttcttgtctctctcttttttatcgagaaaaaaactacatctatctctgtaacactgtatgtatatacttcagactctgttttaatctctgtttttttttacctctctggtttctgaaactttgtaatagaagaaactagaacaacaacattttttacttcactgtttcaaagttttgatttttattattaaatttaacccaaaacaccatcatcatggttttgttttctggattttctccatttaatgcaatctgacattttcttataattattttttgtttgtacttatttttctttcatcctcatgattttgcaggtagaataaggccaaggaagggatcagttttaagttttgtttcattctttttgtagtggagaaaaagagtttttgaaaatccaaacaacaaaaaatg

SEQ ID NO: 33405 - DNA, 3000 bp, Unknown
  misc_feature (1)..( 3000): 2750-1469P.txt file - cDNA_ID_3069333; gDNA_ID_1620579; Annot_ID_161087
tcaagtgcttcaagcgctgtagttcctccataattatgtcatcaacacaaaaaagagaataaaataatttcaacacttgcagatttggtaaagttgttgctattccaacaagactctcaagtacattagtgaactccagattcaagtagattagtttcctcaacttcttcagaccaactggtagcgattttatccctgtgagtgataaattgagatattgcagggagcctaggttagaaatttcttccggcaattcaataagactccagtttgtagaaagatccaagaccacaagttttggcataaacagaaagaatccaactgaaatatccaccaacttgttatatgggagtaatagggttgaaaggttggggcagttgggactgcaagctatcttctcaacctgagtactaattaaagacatctgtctcacaatctcccaactgatgtcatttggtatcagacgtacatgagcaccagatttcacacaaattgtttcttgctgatttccgaagtcagaatttatccaaagagccatctcacgtatcacatcatgcattttaactttgtctgtgagttcacattcaatcaacaaatgtgcacgaactaacaagccaattatatcataaccttggttagtacctccatcttcatatctgttcggatttatatatccttcgcaaatccaatattctatcaacttatccttctctatttcaaaatcttcaggaaacagagaacaatataggaagcacaatttgatttcaccattctttaagctatcataactgaacttcaaaatgggaagaattctttcttccatacctggaaacttgtggccaggcgaattcagaacattaatcgcatgacgccattcttgtacagtctctttacataccatggctttgccaatgacattgagtgcaagtggcaagccatggcattttgcagcaactattcttgcaagtgcgggaatatcttgatggctccttaatatgatatctccaacagtgagtcgaaacaattcccacgcttcatctggtgacaaacagtcaacttttatctgcttgtcagctttcatgtgcttgcaaacttcctttgaacgtgtggtgaaaactatcttcgatccattttctcgacttggaggtggaactcctatcttaattagatctacttcgctccagagatcatccaacaacaacacaaatttctttctcttaaggttattgtttatgagagaggctttcttactttctgtttctctttcccattccttgtcaggacgtaatctccccagaatctgatcttgaatgccctccaactgaaagtctttagataccacaacccatatcactacatcaaattcactctccagttcaacaaatttgttgttgagactttctaagagggtggtttttcctattccccccataccataaagacccaaggttcttatttcatcgtctatgaggctttcccatgctattccaaccattgtatccaaaccaactgtggtttgtatatgcttcttctctgccttaggtatgattttctgcgccaccacttcaaaattctttttagatagaagttctttaacttcttccaaattcttcattacctttccaccataattgtagcttgatatgcaatcctcagaacaatatccaaatagacacaatcttccagtttcgattgacatagcctcaagcagatccttgaattcggattcaacaatttgtacccttgaaagccatccgttgactagagcaagccgttgcaaacctttatcttcttctatggaaactcttgctaacagatcatctcgcccattcttaagttcttccatagttttctgcagagcatcgagatttgactccatcaagtgaatgtagttgctatcgcttaaaaagcagccacatgcagcagtgaagattttattccagggtaatagtgaaagccagtccaccattttgcacaaactttaagaaagaaacccccgagattactgccaaggcgatgcaagaaacaacacgatcgaagagggtgaatggggggagagaaagaggtatacaaccgtactgtatcaagaaattaaaagtcaagacaacaatttctattagtttattgagagtggcagcttccaagaaactgcaatcgtcaccaataattgtttaaatgagatcaaccagtttattaaatgtagtgatagtcaataaaagtcagaagtttgatatccacaaagtgaaatatactactaagcgataaaataagaagagcaaaattctctctttcgaaatcttctcttccttccggtagtctaattacacgtaacaaattcaggacatagaggctagagcacacacaaagtaacacacatggcagacattagtcaaatgcgacattcagaacacataaaactgtctacagatattctcaccaagtacaagtaggaaccaagcgtacctgcagacatcagaagaaaatgtcgcattttgaagaaaaaagtctgtttaaacttagatgtcactgcactagtgcctaactgctgcatcacactagacggagagggatgaggatggattccaaaggtaagtaaacagattcctacttctccggcgatgcagtaaacggattcgaaaggcatgtagcagagtgcagcaatccggagatcttcgttcgctcgattttgatatacaaattctgataaatctaaaaatcgagcaatcaaacacgaaatcgatttctgacgaaacgattaagcgacctagggcaaaactggaatttccataaactaatatcacattccgacataccggttaacccagaaaataatccggttcaacctagttgtttatctccctaatacgcagcgtttcgacgtccgattgaagagtaactaacgccgaacaaagaagaaaaaacacaacccctaattttggtctctcaactcttcctccttcttcaacttctaaaaagctttagcaaactccttcagccatg

SEQ ID NO: 33406 - DNA, 3000 bp, Unknown; identical to SEQ ID NO: 2712
  misc_feature (1)..( 3000): 2750-1469P.txt file - cDNA_ID_3069341; gDNA_ID_1620580; Annot_ID_161130

SEQ ID NO: 33407 - DNA, 3000 bp, Unknown; identical to SEQ ID NO: 2715
  misc_feature (1)..( 3000): 2750-1469P.txt file - cDNA_ID_3069346; gDNA_ID_1620580; Annot_ID_161126

SEQ ID NO: 33408 - DNA, 2372 bp, Unknown
  misc_feature (1)..( 2372): 2750-1469P.txt file - cDNA_ID_3069350; gDNA_ID_1620580; Annot_ID_161120
taaaaaaaaaaacgaaatcgatcgaattcgaaagacgaatccccccaaacccaggtggcacgagatgtgcacgtgcgagaatatacgagagaggctcccgagaaagagattaaagaaaaaaaggaaagtttataaatataaatacctgttgaattttgactttgaagaaggagagagacaaagcagagaggaagaagaggaagaagaagaagaagaagaagaagactttggagaagagagagagagagacgtgggggctatttatggcgataatttctgatgctgtctcgttttcggagtttcctttttttttttttggatttattgctttttattttaatttatgagtttttatgatttaattaatttgtttttgtgtggtcgttgggcttctattttttttaatagaagcgtgtattttgtagataggaatttactcaaaaagcttaatctccccactataataagtaaccttcgttttaattactttttctaaaatttattttaatttaatgttttcgtattttattttaatttaagtgacgtattgatgttgttgcgaatctagtacaacactgctgtctaatttaatgctctctcgttaggttttgaacgtagctggggatttttttttgtttttcaaactatacattaaagtagagtatctcataattggtttatttctgtttctgtatagaatttagtgccattatattatttttatgacatcaactaaccgtcaattaatattgcaaatattttttttatgaattaattatttaagtaatggattttgaagtttttaatttagagaagaatagcagtaaatcagatgtgatatttttatttccagttatgtagtacgcaaattaattaaattttattttcttcatcttttattgtcaaaaaaacaaattaaaggttttatggataatttacttttggaaaaatataaatcttatgtggtaacaaataagtgaattttacaaatgtgtattctttcttttttgttatagtaattcacagtaaaaagtggagttttattctataatacggtttgtaacgcatttccgtgaatatattatgctaatttgttaggaatttaagagatatggcctattcacatgtttagttttgttctatttataaaaaaaaaaaaaatcaaaatttatatttgtactttattttttttcccatggatgttttggctagtaattactatgctacttcaacagtccatccacattatggttctagtaggagtcatatcaaatcttcttacaagtattcctacaccagtattgcttacattggtttgggcttttaggtctagattatcgggggaattgactggcccaattgctaaacatgattgggaatcaatttcgtcccaaacatgttttccttgaacaatcactttgatgacaatgacacacccagacagttatcaatgactgcaattaatcagcaaatggttccataagcccatctgcccatgttggtgaagaagcatcacctcaaatatataattttaagatgagagagcaaacattcctttctgatcgctctgaatattttagcaatttactaaacgtaaagttattttcatagctttaattcaaaatttctgtaactagagctagcaaagaaacaaagacttgtgtttaatattatatttttgaagaagatagtagaatcttctgtctatttgtttaatatttgaaacatcgaataaatggtttcaatgagttgtcctgactcatcagccgacccttaacaatgactacaacaacttcaaattttaaaacatcaagtatcttcaacaacataccctttccgttttatattaaataattggtaaaatccagcttatttataattatgttatttctgtataatacattacagaagagtaaaacaaaaactttaaaacgacacatataataaaaaggaaaaataaataaatagatatgagaaaaaaatacagttggaacttaatatatacacttttatacaacggatactaacgttcaaaaattttattcttcttttggttaaagttttatttattgtttatgacttttccatatcagcttcttttttaatactatatatatatttttaaaatttgtttattttatgcgagcaaaaaaaaaaaaaagtgtgcaaaaataataaaaaagaacaaaataaatagtctacttgtacttctgtctctctctctctctgtttatcaatctcacatcgagacgaaattagagctactcagacttgttctattaaactgttaccttctccagacaaagcgttacctttttttttggtccgtacgaggaaaaatctaggagacagagctatttgttcgaaagatg

SEQ ID NO: 33409 - DNA, 3003 bp, Unknown
  misc_feature (1)..( 3003): 2750-1469P.txt file - cDNA_ID_3069377; gDNA_ID_1620581; Annot_ID_161166
cattagatcacaagattctaacagaggaaccattaatgtgatgaatatatttaaccatatgattacggacccaatcgaccaaactgtcttccatttcaccagtgagatcaacaggtctgcgtccggtaactagctcaagaagcatcactccaaaggagaaaacatctgatcggtctgtcagtttcccgcttgacgcatactctggagccaagtacctgtcgtttgattcacaatttgagattctttagagaaacagattttcggatgagattataaaacaagaatgtttttgatatagaagtaagagctaatgaaatttgcaggaacatttttcatcagctggtttcgcagtctttagtacccgaaagttcccatgatacgagtggagacatgcgtaacattgtcttgagatagcttcgctaacccgaagtctgcaacctgtagatttgagccagtccagttagagaaaaaataataccaacgaatctgaaaacattatgagtttaaaaattataagaacgtaccttagcctcaaaggattcatcaagaagaatgtttgaagctttaatgtctctatgaatgattctcggatgacctaagtcaacaaagtcaagaaaacaaattttgatcacaacctaatcaaaccactcaaaaagattgaattaataatttagatttttgttttgactcacagtcttcatgtaagtaagcaagtcctttagctgatcccaaagcaatcttgagtcttgtaggccagtcaagaaccttgccacttttaccatggagatggaactcaagtgtgtcattaggtaagaactcataaaccaacatcctctgtcctcctgcaatacaatatccaacaagagacacaagaaaccgatgatgaactcggctaatgatgtcaacctcagcctgaaactcgcgctctccttgcccgcttcccgctttcagactcttcaccgcaatctctttcccattgggaagtattcccttgtgaacatatccgaacccgccttgacctaacaatcttgattgggagaagccttgagttgcagcggctagctcgtcgtaggtgaatgtgctcttgttgaaacctagagccactgaagggtgaggtggtggtaccgacggaccatgtggtcctgagtagtttgagctaaagtcgctactgtttccattcataccgcctgagactggcggtggtggtggaggcggcgatggttgccagcttcctggtggtggtggaggcggtgaattcatccagttattattcccgttggatccaggatactgctgagacagattcattacgtgatcgctctggttattgtattgctgctgttggtattgatcacctaagataaaacagagaattgttttcaccttgtatcttggataacaagaaaatgaaagaaaatcatgataatgtttcttgggtaacaatattttggaatattatgaaactcaaaaactgtcatggtttttcaatcatatctcaaatggattgtggaatgtgattagaagtaaggttcttaagaaaatgctagtttattgattagcttggtgcacaagaaaatgttctaaagtagaaactaggttaggcaacggctaggtttgatgggttttgtatttacctttgccggtggcgtagccgtttcctgcataatagggcatttgatgcttcttttttttcttacgacagcaacagacgcagaacaatatcataacaagaaacaacaatccagcaccagccacaattcctacgatagcagccgtgtttggttcattgttgccggaggagttggaaccaccaccgcttgatctaggaggagccagcgctcttggtggggaaggagagttacggtcagagtttctggaaggaggcggaggtgaacgattgttgcttcctccgccattgttttggttgttgttgtcattgttattcccattgttgttattgccattgttgtcatttccattgttgttattaccattgttgttattgccattgttgttgttgtctttgttattcccattgttgttgtcgttgttgttattaccattgttgttgttgttgttgtcattgttgttattaccattgttgccatcattgttattgtttccttgcggagatggtggtgattgtgagtctgaagaaggcggttgaggtgaaccatttgaggaatcatcgggcggaggaggagctggtggtgaaggagaggaggaatcagaaggcggaggagaggattgttgttgattgtcggatgatgacggagatggtggtgtaggggacggcggtgaattctccggggattgcccctccgccataatctctctttcggtgttttctttttgtatatgattttatttgtaaagctctctcctttttttgttttttacgagaaagagatagagagagagatgaacagagagaaaacacaaaaacctctttgtgtgtgttcaaatcctatttttaaaagagatgctttcaaatctttgttgttgctgttgtttctgtattggtattgtcttctttttgtagggtctatatttgggtattaatacagccatgcaaattatgtaccttcaactaaatttgtaaaacaagaaaaagaaaaattacagtctagaatttgattacttggttttaccaaaataaaaataaaaataagcatgctctcgttgagagttgaactcaagacctcccgcttactaaacgggtgctctaaccaactgagctacgagagctgcttgctgatcaaaaccaatgtacatataagtttggtaaagtatagtttaattattagaggaatgattcacttttagtaagaagacaaaataatagtcacaaaagaaattagaagacagatcaggaacagctagaagactcttcagggcacagagaaaacacccaccacatcaccgtcttcttcaacaaaatttaccaccagagatcgcagatatttcttcattctatctctctcttttagatccgattcgatg

SEQ ID NO: 33410 - DNA, 3000 bp, Unknown; identical to SEQ ID NO: 2716
  misc_feature (1)..( 3000): 2750-1469P.txt file - cDNA_ID_3069406; gDNA_ID_1620581; Annot_ID_161139

SEQ ID NO: 33411 - DNA, 3000 bp, Unknown
  misc_feature (1)..( 3000): 2750-1469P.txt file - cDNA_ID_3069419; gDNA_ID_1620582; Annot_ID_161204
tgaataaaaccaggggaaataatagaattacttaggtaaataaaagagcttgaaggtcttttacaaggtccatagatattttatttaaatgagtgggattcaaatgggttcgtttaattgaatgccaaaacgcaacgtatatggttgaaggtaggtgtgtcaaaatgggtcaaaattcattggtcaactcaacccatgaactctaatgagttgaaaattttgactcaaatgagttgatgggtcaaatgagttattgagtcaattagtttgatgaataaaatgagttgggttgtaatgagtaatggtttcaatggtttagctaattgacccatcaaattttgtaaaattgaattaaaacaactaaaatctctaaaccaatgccaatttaagtttaaccaacaaatctaaaccaatttaataaaaccaatatttttccaaatttcttaaatatacaagcgatgaaattaagaataagcaaactcgtaatttttctaccaaaaaaaacataacccgtaattttcccgccaaaaaagtaaaccagtgattttccgcccaaaaacgtaaatccgtaatttttccgccaaacacaaaaacacgtgatttttctgctaaaaacgtaaacccgtaattttcccaccaaaaacgtaaacccgtaattttcccgccaagaaaatttaaacccgtgatttttccgccaaaaacgtaaatccgtaattttccctctaaaaaacgtaaatccgtaattttcttgccaaaaatgtaaacccgtaatttttcctaaaaaaaaacgtaaatccgtaatttttctgccaaaaaaacgtaaatccgtaattttcccgtcaaaaaaaggtaaatccgtaaatttcccgccaaaaaaacgtaaacccgtaatttttctgccaaaaaacgtaaacccgtgatttttacgccaaaaacgtaaacttgtaattttcccgtaaaaaaaacgtaatttgtcatttttccgacaaaagtgtaaacccttaatttttccgccaaaaatataaacccgtaattttccctccaaaaatgtaaacccgtaaaaagtggaatatgtaaatatcgtaagtttgatgataataaattaataatgataattatttattattgttttataataattattaattaaattattacttagatgggttaacccatttaacaactcaacctatcaaataaaatgagttgagtcaacccataacttatttaactctaaactcatttgattatgagttgagttgtgttgggttacccattttgacacccctagttagtacgtaagctttgttgtttacctaatttttaattgtgaccgttggatgagaaaacgatgttcatatgacgtggcacgatcttgccctaagacttcatgctgttaacaaaacaaaatgcagttacggactccaaattttctaaagttttattcatggtcgtggcttagtggatttgagattttttaaaaccaaatacaagtaaaacaataattatcatccctagaaaataatacaaaaaaactatatatggcttaacatcaattataaaaaattgattttatatttaactaactagacagcaattaaataaaattgttactatttctattagtttatatcacttttttaaaaatgatataaatataagttttacatcatttagataattgatgtatctattaatttttggaaacatcactttttaaaatgattcaaactttacatcaaaaaaaattgacgttaattaaaaaattaagcatcaatattaatagtgatgtaaaattttacttgattcaaaataaaaaggtttaatactttcttatatatagtgactttagttttttggtggtctaaaaaagtgtaaagcttaggcactttataataattaatgaaattacataagacttgtagaaaaatcgtagcaaagccaaatctttgttgaaaatcttgttggccacaatgttattgttcacattagacttactaagaaagaagctaaaccttgacgagtggctttttttctttcttccctcatgacctttaattattataaacccatttctcacggcattactttagacacaaaagtgtgtgttacttttctaccatttattttgtcagcttgtttcagttattttttgtattccttttatctaagtacatgcatgcaaccatgattccttcattggccgctttgaattggatagaatcatggtaaagtgacccattgattttgggaatacttttttggatattaacaactatgtagatgggaccccctagatcgatatcgaagttactgaatctaagatcaatgctaaacatgacaatatcctttcacaaaaactactctgcccccaaaaagaagccatttaagagattagaataaggggttttgtttaccattgcaaatccaaaaggaggagctattcggtgactgatatatcaaaaccagagtgatgattttgagtcaaccattgcttcagatcaaagtcgccgacggtgacgattatgagtcaactctgataataatgtaaattttgttttgttttgttttgcttacgttgatgctgatactgagtcagcctcgcctatcggtggtaaatactttgaaggttttttttttacatttcagtgatttttttactgatataactcacgttatataacgacaatttagtaatgccttctttgaggcctcttcctcgctctggtcattgtcacttcaaatccatttctcacgacatttaattggacatacatgtttgtttaagtctcctttagtcttctactcagtttgtcttttcttttgtacgttttaaaagttgtccacataaaaaatatattcatcgtttaccatggaagactttccaagtcaagctccttacatagaattttcttatttaaatagaagtgcataagcaagacatgtctatcacataccaattgaacaaacaaatcgtcttcatttccacaagttatcatg

SEQ ID NO: 33412 - DNA, 3000 bp, Unknown; identical to SEQ ID NO: 2727
  misc_feature (1)..( 3000): 2750-1469P.txt file - cDNA_ID_3069423; gDNA_ID_1620582; Annot_ID_161200

SEQ ID NO: 33413 - DNA, 3003 bp, Unknown
  misc_feature (1)..( 3003): 2750-1469P.txt file - cDNA_ID_3069426; gDNA_ID_1620582; Annot_ID_161187
ctcttacaagcattgatccatcctcggcgattcttttaccatctggagcgaatagtatgtttggacctttttctcttggaccaagcgcccaaattctcttgagcagtttcgaccattcggttttacatttttcgcgatccttttcggtttcagaacttgatgaaacgccagcttcaactaactgtttcttcaattcttcgatgggatccacattctccccgaggcttggcttttgggattctagaatcttaacgctatgactgcctttacctccaattatgtcaccaagtaattcagtgttctcatcaagcagcttggttagagcgtgtggtagtttcatgacatgtactctgataatgcatctgccatttggagttctcttctcgatgtaatccgaagaattcaagcttagagatctcaaactttccaaaagattagatccatcaccttcaatggtctccctgtaggacacgagaggtggagagacttctaggttcacttttgcaaatctctcttttaaatccttaacgcatctttcaagatgaacctctccagcagcagcaagtacatgttctcctctagcagacactgtaatctccacaaatggatctgctcggtttagaagtcttagacctttcatcagagcactcatatctgcaggatccgatggttcaatcgcaactctaagagtgggagacacctgaaactccatgctggctaagggccaacagtttctagtagatgagagtgttgcgctttttgatatatatggtccaagccctcttatggccactacatttccggctttcacctctgttactggtgttaaaccttgccccatcataagatatagggaatgcagttctgcttcctgaatgtacttgtgagacgattcccccttgaggggatcatatagggcggtaattacaaagactctttgcccagcccgaagtaccccgctaaagatcctagcaaatgcaaggaagcactcatctgactcgcttttactgtcatcatcatttaaaccgttcatcctctctctgtgatttccatcttgaggaatcattttcattggaatagcaaacattttcgacacaaacacaacacaaggactgtcactgctagaatcacaagcctcgattgattttctaacaagctctgcttctgccaggacacttgaatcaacatcatcaccaccaataattttcctttctggaaccaagcgtgggattctatatgcctgtgctgcaatggggtctggcagatgtttcacagccatagacaagactgcatcagacagaggaagccaacggctcatcaccgattgaagcacgttttttggatccttgttctgaagttcgcgtggtggaatagacaaattgaaagatttgataactttctcaagaacggctttatccccaccaggatctagtgcagcttcataaacctgccacaaaggctcaagcacaaactgcacaaacattggtttcgccttgcttccagcacttaaattcttcttccctactatcatcttagtcttaggaatataataacgaggaccccataacgatttctgcaacgcagtcgcactagctccaagcttggaggcataaaaattagcaaactccgcaatcccaaaaccccacccgtctaaagcacacacgaatactacattacctttctgaggctgaaaagtaacttcttcatcatcctccaacaactcaagactctcagcagacaactcccctgaaggactagcaagtatagaatcaacatccgacaaatacttctctgacttatacgcactcacaatcccgttaacctcatgaacaatcctaatcaaacgagtatacgcctccataggactcaacctcaactcaaaaatcaacctatcaatcttattaagcaccaaacaaggagtcaacttctctatccaagcttgacgcaacacagcatgcgtttgaatatgaactccctcaacagcatcaaccaaaaccaacgcaccgtcacttaaccgagcagctgttgagacttcactacagaaatccatatgaccaggagaatcaatcaggttcaaagaatagtctttatatttaagagaaatcgaagagctcttcatcgtgattgcacgtctctgttcttcatctagatagtccatgaacctaagcttcccggcaagtctcgggtgaagaacaccgccaccggaagaagcaattaggtgatcggcgagagtcgtcttaccgtggtctacatgtgctagtatacatatgttcctaactttcctaccttcagattcatccatctcttcaatttacaaaacacacagctacctgcagattcaatatatacaaggattacattatcagaatcgatgcgattcaaattagtagagaaaacttcaacaaaacataatccaaatcctaaaaccttgtgtgagagctcacgaatttttgaatcgaatccacagagttgtgcacgtctcgtaagaatcaaagagagataaaaacgagagagatgctctttgaagattccataatattttaaaaagttcgattcaaaaattgagtgatatgtaaaaaaatcaccttaatcagttgatggagctcagacgtttgaagaagaatggtgcgaaacttgcttcggcggcgaaacaacggcggcgcagggtttggcgatttccctctgcaagtttgtctgtataaacatatacaagaagacgtgaacgtttttgattttaattaaaccggaaccctgtaaaccagagagacggtttagtgctctcttttaacaattttaattatagtctcggactcttcaaccggaataaaccggtctaaaacgtttttaatttcaattgtaccgaaaccctctgactcacaaaaagtgtttagtgctctttaaacaattttaatttttaaatcgtcttgggacttttaaaccggaataaatctttcgggtcaaaatttccgaaccctaactttagccccaaattagagagagatg

SEQ ID NO: 33414 - DNA, 3003 bp, Unknown
  misc_feature (1)..( 3003): 2750-1469P.txt file - cDNA_ID_3069439; gDNA_ID_1620583; Annot_ID_161222
ctccactggatccgacattgacaatgacgtcatcactacctgttcgagctccttcctgggtctcttcccggagaattttcgaagagagactccaagaccttcccaaatgcgctaatctaaaccaagtgaaacagcttcacgctcagataatccgacgaaaccttcatgaagatctacacatagcaccgaagctaatctctgctctttctctctgtcgtcaaacgaatttagctgttagggtttttaatcaggttcaagaaccaaatgttcatctttgcaattctctgattagagctcatgcccagaactctcagccttatcaagctttcttcgttttctcagagatgcaaagatttggtctttttgctgataatttcacttacccgtttcttcttaaagcttgttctggtcaatcatggttacctgtggtgaagatgatgcataatcatatagaaaaattggggctttcttctgatatttatgtacccaatgctctcattgattgttattctagatgtggtggtttgggtgttagagatgctatgaagttgtttgagaagatgagtgaaagagatactgtgtcttggaattcgatgcttggtgggttagtgaaagctggggaattgagagatgcacggagactgttcgatgaaatgcctcagagggatttgattagttggaatactatgttggatggttatgctaggtgtagagagatgagtaaagcgtttgagttgtttgagaagatgcctgagagaaatactgtgtcttggtcgacgatggttatgggttatagtaaagctggggatatggaaatggctagagttatgtttgataaaatgccattgcctgctaaaaatgttgtcacttggacgataattattgctgggtatgcggagaaggggcttttgaaggaggctgatagattagttgaccaaatggtggcttcaggattgaaatttgatgctgcggctgtgattagtatcttggctgcttgtactgagtctggtttgctcagtttaggaatgaggattcactccatactgaaaaggtctaatctcggttcgaatgcttatgtgttgaatgcactacttgatatgtatgcaaaatgtggtaacctaaagaaagcgtttgatgtgtttaacgatatacccaagaaggatctcgtgtcttggaacactatgcttcatggtcttggcgttcatggccacggaaaggaagcaatcgagcttttttcgagaatgagaagggaagggattcggcctgataaagtcacgtttattgctgttttgtgttcctgtaatcacgcgggtctcattgatgaaggaatagattacttctactcaatggagaaagtatatgatcttgttccacaagttgaacactatggttgtcttgttgacctattaggtcgagtagggcggttaaaggaagcgataaaggttgtccaaacaatgccaatggagcccaatgttgttatttggggtgctcttcttggagcgtgcaggatgcataacgaggtggatattgctaaggaagttctggataatctggttaaattagacccttgtgatcctggaaactattcgcttctgtcaaatatttatgcagcagcagaggattgggaaggagttgctgacataagatcaaagatgaagagtatgggagtagagaaaccatctggagctagttcggttgaattggaggatgggatacatgaatttacagtgttcgacaaatcacacccaaaatctgatcaaatatatcagatgcttggtagtttaattgaacctccagatcctggtgagctggttgctgttcgataaactgcttagtttatgtccagatcattaggtattatatcgattataggctgtgagcatcagcactgtggcctaggccaaaaatttgtagttcattttccaaaggaacacaaagatggttttatccttgtaacgagttcgagtactgtatatagagcataatttataaatcttgagatcaatttgattttgcaatactaactcccgtctccagacatggggtttctggttcttaatccaataacaggttctgtgaccaaccttgaagatgacagtaacaagagaagactaggcaggaccaaagacattcaaactcccacataacctcattgtgagtaatattgtgacttcgtgaaaattccactgatgatgtattgtcggtgatgtattatcattggacgtcagtgtgatgacgtattgctggtgatgttacctttggatgaaccaactagttatttagaatgatgtttagatggtcaaattagaacaaaactcgtggggtttattttattacaagaatcaatgtcttaatgatgttgagttgatctcttaagtttcctttttgtagtgatattcccattgaaatagtaataaaataatggagaaaagaggaccaccaatagtgcttccttgatttgttccatccacaatagatgactttgatcataccaaaaaaaaagtctaaacccgttataatggtcattcacttgttcttaagacccttttatgaatgatccaaattttactgattcacgtaagaaaaaaaagagagatagaggattagagattatggggatgaagtttatctagttggtggatgtagtaattatacgtgctttttttccacaggagtgggtaagtaactgcagaggcaaaccttgagtggccactagggttacacatcatcaaaaaaaaggtgataaaagatttgtctcttatccaaaatccaaaggcatatggaaatgtttatctttaaatacatcaacaccttaaaggttacggtatatccattgcccattcctctgactaggacgacccctttagaacttaatacattcagcctgtggttcacagttctccactctcttatatttagatgttatttttctgttctaccttctcttcataggaactaaagtgaattgagtcagagaaaaagagaaagagagaaggtaacatg

SEQ ID NO: 33415 - DNA, 3000 bp, Unknown; identical to SEQ ID NO: 2734
  misc_feature (1)..( 3000): 2750-1469P.txt file - cDNA_ID_3069452; gDNA_ID_1620583; Annot_ID_161213

SEQ ID NO: 33416 - DNA, 3000 bp, Unknown; identical to SEQ ID NO: 2731
  misc_feature (1)..( 3000): 2750-1469P.txt file - cDNA_ID_3069456; gDNA_ID_1620583; Annot_ID_161211

SEQ ID NO: 33417 - DNA, 3003 bp, Unknown
  misc_feature (1)..( 3003): 2750-1469P.txt file - cDNA_ID_3069470; gDNA_ID_1620584; Annot_ID_161272
cccaaatatttcacataaataaaaaaagaaaagaaaaacaaaaaatatgattgtatgtttcgcgagactaagtggtggtagttgttgtattcagtttcgtcagaaatagttcgagtctcactcttctagtcaaaaccaaaaagagttgcttgttcattacaggaggaaagaaaaagaagcaaaactagaaaatagtaagaaacaagatttggtaattggtaaaatagcctgaaatcacacttaaaaaatttatttgaaagagaaatatgtgcgtccaaaatattccataaaacgataatgtatgtgtgtacggaattttcttttagccaaatgacaaaaaaaaacccactaaaaaccaataatattcgtgaaaagaaagtaaactatataagagtaaattatacagactacgttattctttttttttttggtaggagactacgttattcttttgttgacaaagaaaaactacattcattacgatattttatatatgtggttcacaaaaaaaaaaaaaagcttatgactatgaaacattatgttttgaggcctctggcgatttattcgaaatgagctgtccatattgtaaggaagactgactagaccttaattcgtgatggatttcaattattagctgaccagagatttaaatgcaaaatatcataatggctggagtcagtagagtgggtgcattgttttgagaataagattcagtcgtactttgctcgtcgtatgaatatgtagcgagtgtcaattgatgttcaaaggtagataagttgtataatctctgaaactaggaatgtgttcagagttttagatccttaactgtaaactaagggaagaacattaaatgtatattcttcttatcaacaataaatatattacggggttaaatgtgaattgtgattagacctaattgttatacattaacgacattgtgatccgataacttttgactagctcgtgcatttctctaaaggcaaggcatataacacttagtttcgtgattttttatagtcatgcagaagtttttaaacatgtatttcaaaacaaacccgaaagctccttggaatttgcattttatgtatttatttagcagttaaccataacgttagtttgcatgttcaatttaaattcaaagaaattaagatgagatatggacggtctgcaataccgtatgttctaacataatattccaataatcaaagtgaataaatcaatctctaccgatgatgaatctttgaactgaaaggagacaagaaaacaatacatcaaatattttcaaccataatgggaagctagtcggtcacacttcacaaagtggcctttatttttgggttgtttcgttgaagggtcccgaatcaatggtagggaatactttctccttatctctttctctctcactccaatatatataatatgatgaatcttcacttccatttaaacatcacacaatcatcacacaatcaccctgaatccctgataataaggaaaaacaaaaaagtttgttttataaacacactttaaacaatgagggagaagtacacaaaggaggaagcagtgaagaattgggagaagaagaagaacaagccttcttcaccaaaaggagttggagagtttctgaaaaagaagaaaggaaggttctacattattggaaaatgtattactatgcttctttgttcacacaagtgatagtcaacacacattttttcatacatatttatgttatcatgtataggtatagatgatgatagaggtataaaaaggagagagagctcaacatatttacatctttaacatttcggtgttcatctctcattttatgtgggtgtgttcttgttgtcgtcgtcgttgttatatatggaaatatatcactcaatattcttcttgtgaactatatatataacggaatactatctcccatagtcccatgtttgtagaattaatattaatgtatgaataataaattcttagagaaaagacaaagacgatgcttttgagtactatatggagatgcatgcacacaaacatgtattatataacaaagaaattggattcagtacttacagttagaattaggttaaggtaaaagaaaaaggtaagggaaacaaatatcagtctcacatgtgttaatgcgcttgggcgtattttgattatgttagctggtcattatcagttagtttaaccattagtcattctacaatctgtagtgtgacgtttaattacctgatgattcaaacatttttcactataaatattatgaagttatcagttaggttatttaccaaacaaaaattcaatgacataacaactaaagtctcattccctttaaaaaatggtaacttttgtaatccatttcgagaagacaacaaacctaaattggctttgtgaagtaagattcagtcgtactttgctctttcaatacttgaacattaatgaaaaattccaagcaaaaggaaataaaaataaatagtttgactcaaatttggtaatgggcttatagtgttattgggtcttcatcttcagcccaaataatcttttactctttcaagtctgaacgtcgtcatcttcgttgtcgccgtcgtcgtttctctcatttctgctctgttgtgctatcgtagcgtcgcgctcctttaaacgcgacggacgcagccttctctgttcatcgtttcgccggaagttttcttcaggtatgatattttgagaccgtcgttgatatttttattcagtttccatagagaaaaaaaaacaattcctgagttctggatcgaggatcgatttcgataatactcgaagaaaagttgggttcttcgtaaagttatttgttgtagctgtgtgtggagttctttacattttcttcgattttgattttagctcttcgtatatgaaactttttgatttttaaaatttctcaaattgggtttttctttgtttctcttttggcacagcggagatttattttcagctggttagtagttttgagtgactactgaggtaacaatg

SEQ ID NO: 33418 - DNA, 3003 bp, Unknown
  misc_feature (1)..( 3003): 2750-1469P.txt file - cDNA_ID_3069488; gDNA_ID_1620584; Annot_ID_161255
ctaggctgatcagtcatttacagaagcaaaatagttcttttgacctcaagtgttatctagtctcctcagcacagtgagatatttttcagattaataattggttaatttctcatccccacaaatgttgtaaagctaaatgactcgaggtaagattcctaacttgtaaacttaagccttgaaaagaataaatccacatgattcgagcatgtttgttcaaaagagtaaaaaaccggtgaccatcaacagatgatgaataaaccggactaaaccataaatattccatcatacatgaaggatcaagtaacatggcatgatacagctttagatgactaattcattgtgtgagagtacaatgcatatgatcccaagttaacctctactagtaactgtgaaaaatggctgttacaaacggggatagaaattacatggcctaggctgaaccagcgggaacagtagctgcattggagctaggctgaaccaaagtggctggagtggcactcaggctcggatcttttgactcgggtgcaacaatgggaactgtagctccgggtagtgacagaggggtttttgcagccgcatctagagcgggtatctgatgctgatttgagttagccaaatcgtttacggcgttgtgaagttgttgtagcctgtaatctgtctcgggccgccgacaaatcttcctcaagggaacgatttcctgctgggataacggaaaagaaatccaaaataggtgagtgaggagggttttgctttatggtctaaaccatgaaatggagctgacgggtaaataaaaccgcaagggatagagagagagagagagagatgatcgtccaacctcggactggtcgtggctgtaacgcaccaagaacctacaacgacaacctctgacatcatgtcttcttctctgtgcgtcaagaacaatggcgtcaaagtaaagagcttgatcttttccttcctgaagatgttataacatagttctagtcagggataaactaacatgacacctatcactaaatgcttagagagcgaagttctaaacctggaaacaaaggacgagatctccagcaagaactgcaacacattctgatgcttcacatgggagagaccgttgtcttacatgctttttgacatttatccattcatcttcttcaacttcgaaacccgcaaatcgaacctgcacttcctgaaatacccaacagaaagattgttgttagcaaaacaaaaaaggggaacaaataagtcaacaagaggttggttaggaattaccggatcaccaatctccaagtttctatgagctaggaaagcttgcacatcatacctgtaagtaagcaagagagttacatatcagagaaaaccagtggaatgtaatgatattgttacaaagtatcataagtcagcaaaaaaaatactgaagattgaatgcaagggaatcaccatgcaccatccctggcagatttggcttcaaattccaagtaagagttgtctgaaccactcctcatgacaccgggaactatgaggaaaagcagtaaacagttacgaaaatggcatctgtgcaatatcagccatactgatctagacttatggagaaaaaactaaaactgaaaaaaccaatgaaacctattccaataaataaccttctcaacctattttactgagagtagaataaataaagcacctaaactaccagaaggggcaggcgtcatgccgggtaaatttccagtcatatgagtggttttaggaactgataatggttgaatcacacttctcatctgatttggtaaatccatacgcggcatggaagatacatttagcttcccaggagctttgtttccccttgctcgtaaagcatatcgcctattttgaaaccagttccagatctgtgatgcattaaaacaacattcccattaacttttaaaagcaaacccaacagactctgtctgataaaacttaagaatcaagaaggaaaaagccagtacttgcttgaactgcacaacaactttccccttccgctcaggtgattcactgagacaacagataacaaaaagtaaccacattttagatgataaagacacaaaatcactttcaggccaaggaattgagcaacaacaagtaaaatacctaaacttatcagcaagagcttcaagaatatgtcgacctggcattgctgtattatgctgtagcaaaattgcttccatctccgttaccttcataacaattgaagattagctataacaaacaagataaaacctcttcaaaagaagtcacaaaaccatagaacaacagatagatagaaaaacttatgtattatcaaatctaaactcttaaacattacttaataaagtaaagccaatggatttcagaacatacatcgaattgtcttcaagtttctactagctaattacaaaaattcaattggacttcaggatctaaaccctatcatgaacccaaaaagaagacctaaatcctaaggaacaaaaccgacacaaaaatcagatttttcagctctgggagctcaaaatccgtgaaagcaacacattacaaagaatcgagataaacctcaggcaggataaatcgaaacgccggaccgccattactgggaggtcgacccatggtatcttcttcgtctcaccgaagaaaaaacaaaaattggcggcagaaagtgaaatcaatcggagcttctctcacttaatattcgaattcacggtgaatctctctagtacggccggtgacccaacgacaacgaaaccggttttactcagacccgactccgtcgcttatataacttttcacctgtgtaatttttttaaacttaacatgtagtaatgggcttttaaaacccattaaaggcccattttcctaaaaccgatacaaaaatcttatccgtatggtcgagtaaatccagcttatccgcctgaaacttatttctcagtatccaaaacgatggcgaagaagacacttcgctgaagcttttttttccaaaaaaatttcttagtgtcgtcaatg

SEQ ID NO: 33419 - DNA, 3000 bp, Unknown; identical to SEQ ID NO: 2743
  misc_feature (1)..( 3000): 2750-1469P.txt file - cDNA_ID_3069522; gDNA_ID_1620585; Annot_ID_161284

SEQ ID NO: 33420 - DNA, 3000 bp, Unknown; identical to SEQ ID NO: 2750
  misc_feature (1)..( 3000): 2750-1469P.txt file - cDNA_ID_3069542; gDNA_ID_1620586; Annot_ID_161310

SEQ ID NO: 33421 - DNA, 3003 bp, Unknown
  misc_feature (1)..( 3003): 2750-1469P.txt file - cDNA_ID_3069556; gDNA_ID_1620587; Annot_ID_161329
attctcactctaccaaaataataaggtaacactttcatagaacgagaacctatgttaccgtcaactcaagtaactattttgagctttttgccacttggatttctcaattacgaacaaaatcaaaccaacaaaaatgattttacagattaatacataataacgcttcagtatcttttttctttgacaacatgcattatctgagtttaaatttggttagtactacatcgataatttacaagtacctatgctaatagtcaaaattcaaattaaaaatctaatatccgaataaatggaaatcacgtatatataaccaattacaaatagtttataaaaattcaacctttcgtgaatgattttgctatgtatagactaaaaccgtgtcaaaccaaatatattagttggcctactgttccaccaatatggatgtcgggacataccataccatccctttctacatttggtatgttttcacatttcttttcatgggaagactaagaactggattacattttatttttaatataaattagatattttatgacctctaagtaatagttgaaacctggattctatcgaggatgatcgatctttcttttctattatattttttgttacaatttttggttttacttcttaaaagaaatgacttacaaaaacagagcatcaaactttcgggtttggcaactctggtttttagcaattaaaacaacaaaattaccgagtgaaagagtctcaaaaccacgaaaagaaatgtctcgcagagtaattgttgcgtattactcggtcaacttgtttcaacaaataacacagaagattcggttcttacgttcttgccattaggtgtaactataacagcttgggttgcaataagacgaaggatggattattggttatcatgtcgaggagactcgaggcaagttgagagtcccatgatgtggcatctcaatcatgatgtgcaccatcgtcacaattaagtcatagctattgggacaacgttgaaacaatttgtctcttgttttcacatatattttacaaagagggaaagtgttatcttatctccaacaattcccaaagagcataaacgggagaggaggggtaatcgattcaaacaggcgattcacatggtgaaagcatgttttgggactgaatccgagaaccatacttgatgataccaagggatcggacttccagaagtggctgcatgttgtttgtgagacatggattaatgtcaagtagcagaggaaaacctcaacattgtggatttaagcaccagaaaactgccaaccctcttcattagtagcgttagctaaacactagtcaatgttagaagctgtccataaggaataccagaaaaagcatatattaccgtctttaagcttgaaataaaaggaaccataaaccatttctccttaggtttaggagttgttgccacatggagagctccctaggctcttcttcattagtggccaaaaacatctccatttctttttttctttttttaagttaactatgaaattttaagattatgtgacgtatcattcgagaagtcatatggtttatgttgactgcattagctaataaaactctacttaagattcatgttagtgatgtggaaattgagtcatcgtgtataaaggcatcccttttccgaatgctatgaaaaaacctaaattgatccaactaaatgggaaaccatgaactgcaactttatattatcgggatattttaggcgaaataataaactaaactcgagaatatgaagttactatgtaattccaaaattgttaaagaagaaactttatatctcaagcatatgacaactaacttctatataagtggctctttggtcgttcttaaagacatgaacatataaacaaattagaaaatgttaaaaatatgttttggtccgattaaagcagccgcgggtccactagcttgttccgactcaaatagttttcgttatcactttcttctctccatttttttcatacgacataaaagtgatatagttacactaaaaagttgttttgtcctacgcatagtgacgtgtaacaatattttaaaactcaatatcacagtaatatatgactgggaaagttacaacttgaggtgtaaaagttgcacacattaacatatctataggctatagcattggtacattttaaaaaactatagcattttttttacaaaagattacattgaattattagtaaatatataatatacataaaaactgattatgttgtaaatcacataataattgtatgattgaagattgaaatgataagcctattatcgaaaataaaattagtcaaggagaaaactttgaaagatatatgaatgagttgttaattgcttgtgcataagtgtgaacatgtaaataaacttttgaatctaggtaggtccatttactttggaattgttacatagaacacttcagacaagttatgtcttaatcactttatcggtcacccataattttgtaaaaaataaaagccacattctaacaaacttttataattccattttacatttatatacaaatcaatattctaccaactttgtgctataaatattcatcacaccacaaccattcaacactctaccaacctcttctaatttctacaatcactctcttaactctttgctaagcacttcttgttaggaaaaatcattccttaatcactctcgaagctttcacaccaatattacttccttactacatctcttcattttaaagatttgttagttactttttttttttgttattgtacgaaataatttgttttctttcagacaatgttcttgtcacacaaagaatacaatcgacttgacttgcaattttttctaaacaacaaatccagcatcgagaaaagtttctatttttggattttccaaatattaacagttatagcttcgtgacttcaagaaatatccatttcaagattatttaacctttttttgtctagcaagtcatcgtattctactttgttgttgcaaatg

SEQ ID NO: 33422 - DNA, 3000 bp, Unknown; identical to SEQ ID NO: 2757
  misc_feature (1)..( 3000): 2750-1469P.txt file - cDNA_ID_3069566; gDNA_ID_1620588; Annot_ID_161352

SEQ ID NO: 33423 - DNA, 3000 bp, Unknown; identical to SEQ ID NO: 2758
  misc_feature (1)..( 3000): 2750-1469P.txt file - cDNA_ID_3069588; gDNA_ID_1620588; Annot_ID_161339

SEQ ID NO: 33424 - DNA, 3003 bp, Unknown
  misc_feature (1)..( 3003): 2750-1469P.txt file - cDNA_ID_3069608; gDNA_ID_1620589; Annot_ID_161375
catcctacctgatataaaaatcagtgttctatcctttaagttgttcatgtattttcattccaagagcagccaatgttgagacagattctcttgctaagcttgccttatccgtttatgctgaaaacattgttagttaatccaagtattggcgtttcaaaaaagaagtgattttggtgcaaatatcttttcacagaatataaaataatttttaatcaattttacatacatgtatccgggacaaaaatatagttagattcattacatttagaaggttttttattttatttttgtagtttagggaccggccaaaagtatttcaacttaaatccaagacccaatgcttagatcacgttccgaccatggaaaccaaatccaaattcctcccaaagcatctttttagtttgagacccacttttggtaatttacgcacgtgctacttcatcaatcatccccattcatcactcatccaacatgtctatctataaatagacggagatatttcgtagaactcaaatcactcaccacataaagtaaaagtctcatctcttcataaaatagctttaaaccaatcaagtagagtttcttctcaagtctttttattttatttttatcaatggcttcttcagcagtgtctctccaatccatctctatgacaactctcaacaatctttcatgtaatcaacaatttcatcgaagctctcttcttggttcctctaaatccttccaaaatcttggtatctcatctaacggttcagatttctcctatccatcaagtttcactgccaagaagaacctcactgcttctcgagctctctcccaaaacgggaatatcgaaaaccctagaccaagtaagttaattgatccttttttgtcttccaaacttgattaaatatatgattacagagactcaaaatcaagaacacaattcacaaactgagtttgttttttcaggcaaagttcaagaactgagtgtgtacgaaatcaacgaattagatcgacacagccccaagattcttaaaaacgcattcagcttaatgttcggtctcggagatctcgtaccattcacaaacaaactctacacaggcgatctcaagaaacgcgtgggcatcacggcaggtctctgcgtcgtcatcgaacacgtcccagagaagaaaggtgaaagattcgaagctacttatagcttctacttcggagactatggccacttgtccgttcaaggaccatacttgacttacgaggattcgttcctcgccatcactggtggtgctggaatctttgaaggtgcctacggacaggtcaagcttcaacagcttgtgtatccgacaaaactgttctacactttttaccttaaagggttggctaatgatttgccgttggagctcaccggaacaccggtaccgccgtctaaggacatagagccggcgccggaagctaaggcactggagcctagcggagttataagtaactataccaactaattcatgaaattaaaatgtttctcgtatcgctgtgtaatgatataaagatttgtagttttgtgctcttatctgtaataaaatcattgaggaataatatctcgagtatgttttaagtcgtttggacgttggtacacgaatatatgaaaagtctttgtaatcttttggtcactctcaatgattttgaattaaaaatagttttagttatagaaatgattttatgtattgcacaagaaaatcaaataaaaagaactattaaataatgaaaatatatatcttaaataaaagagtataacaattgaattcttaaaaatcatacagtatctcaacaaatccaagaaacaacgaaacgaaaaattgatgtatcatttggtcgagttaagatacaaaatgaaaaattacatttttttttgtagccatcatcgacaaaaaaaaatgtcttagtcgcagattaaatgaaataaggacaaatgatggctacaaaaaaatatgtaatttaaaaccgtccctaaaggtaaatctgactcatcttaagagattgtttgatttttgatatataagtcataagtggttgactaatgtcaaataagtgacgccttttgatgacatggagaagtatgcagatgacattgattgatacggatggaatggagaagttaatgatctacatgtcacactcctcatttcaaaaatagttaacggtgattatgagtcttcatcgaatactcattttaaaggagttgctgataaaaaaaaaaagagtggatgttatgggcatgtatttaagggcatgtatttaaacaagaagttaccaatcgtagcctatgactaggattatggcatgcatgattaccatgatgtggatcaggatatagagtagagaatgttaacgcaagagacattgctagatcaagaattaactcatacaaaaatgatgaccggagattgatgatatcaaattaaattaagtaacatagactcacaaacgcatggtggtaatttgaagcctatgcattcaaagaatgttggagtcatggatccgaatagaattgttgatactagtgggaccagtccttccttgagaaaaaggatgcatgaaccatctcgtgattgtagtgctattatgtgtgtacacggcaaattgacacaaccgaaccgaccaagttatatatatgtcactaaaacagtctgaccaacaagagtttgaagacctgcaggctacgtttatatcttttgactattatagtatgttcccattactttgagatctcgtagtactcaataaatattacacggttttaagtcgataaataataaatacataaaattctctagctaacgcttttagacaattcgaaaccgagtggaaactacacaaagcatcttttgacatatacgcacgtgttacttcatcatcgtccaatataaatagactcattactaaactcaacaaccattaaaaccaaagatcaatctcttcttaatagtcaatcatatatcaaaaaatttaaactcttcttgatcaatg

SEQ ID NO: 33425 - DNA, 3000 bp, Unknown; identical to SEQ ID NO: 2761
  misc_feature (1)..( 3000): 2750-1469P.txt file - cDNA_ID_3069616; gDNA_ID_1620589; Annot_ID_161381

SEQ ID NO: 33426 - DNA, 3003 bp, Unknown
  misc_feature (1)..( 3003): 2750-1469P.txt file - cDNA_ID_3069624; gDNA_ID_1620589; Annot_ID_161373
gtctgatttacctgaagaactcctagatttaattgcaaaccgttattcctccaacattgacgtcctacgtatccgtagcacctgtaaatcctggcgttctgcggttgcgatgtctaaagagcgtcttcagtttcgctttgaacgctaccttcctacctccaacaagaagataaaggctcatctctctcccaccactttcttccgtataactctcccttcttcatgtcctaacaaaggatggctagtaagaactagacaagcctccaaaatgtatcgtaagattactctcttgtgtcctctctctggcgagcgcatcacccgttcccaccaaaccctagaccttttgaaggttggcgtttcagagattcgccaatcttacgagattcaaatattcgatggattgaaggacgaaaagataccattagattcagagatattctctaattatatcaagaatagtgacaaaataccatcaggtgtattctttagagttgctttcctagacaatattttttttgcagtcaattaccacgataataaaatatggtgttgtaagactagagaaggaagtagaagttggacaaaaattaaaaaccaagtcgaagatttctcggacattatacttcacatgggacgtatctatgccgtggacttaaaaggagcaatttggtggattagtttatcacagcttaccattgttcaacagacatcttcaactccgttggactactataaatatgatagttgccaagacacgaggctcgtggaatattgtggagatctatgcattgttcatgaacttagcataactcgaaatcatatccagaggaccgttggttttaaggtttataagatggacgaggatttggcaaaatgggttgaggttagttgcttgggagacaacacactcattgttgcttgcaacagttgttttactgtcgtagcctctgagtaccatggatgtttgaagaattctatttacttctcttattatgatgtcaagaaggccgaaaatataaaagtgttcaagcttgatgatggtagtatcacccagaggactgatatttcttctcagagttgttttcacatgttctctcttcccttcctcaactattaattacctttaatttaaaaatcttgattattaaattaaagatttttttatttaatttaagtatatttcaaatatgaatttaatgcatatctatgttacttataattaacagaaaatttaattaaataaaaactaattaaattaataaattaaatttaaaatcatgaaaataatattgtattttttttctcaggaataatactataatttaacttttcacaaaatgttttttgaaacgatcatatttcgaaattttgaatgtggcaatgaggtttagaatggaaggaaaagtaaatacatggtaaagtaaataacaatgtatgtgactgcatttataaaattataatctaataaataaaatttaaagtgaaacattagttcctaagaataatacattagagagagttgttatttattattaaatttttacataaatgaaaataaaataataccaaactcaacaatgtaattatccatcttctaaaaacgtaaataatcaagaatcattattttcatgagttataaaacaaaatatataaaaagtgatatgtaagctgttagaaaaaattctatgtaatttatgtagcacaactctttaacatgatcaaaatgaagaaaaagtttgagatttcattacttgaatcaaatgttgaatcaaaggctgactttaaacaaaatatttaaaataagtttttttttctttgagaaaaatgatagtccttatgtttttagttgatatttgaggataaatttttggaaattcacatgtctttggaatcataagatcatatgagcaagaagatttagatttcgaacctatttgaaattcccttttcaaaagtatgatttgatatgcagcggtgagaaaaaaacagagaagtagaacaaaaattctattttgttgaatagatttgagaattaattataacggttaatttacttagagaattaggaattcaaaagaaattgagccgttttataattaagttaccactaaaatccgctaatttatttacaaatatttgcttaaacacacacatgcactcgaggaaacgataatcgttttgaaatcaaatgacggggtttcagccaataatacggcgtcgtttaaccgtggagaggttggaaatttacacggtggcgtttaaaggttagttaacttagcgaaaggatttagacgatgttgttttggagttttatatgttttcttgtgtgtcaagctttgctccttaagtctgatttttttgtctaaattctcgagtttcttccatacctgtaaaaattcgttatcctaatagttttagaagaactaaatttctacagcttttctttgtgaattcgatttagtacagaataacatacataataaaagattttaaaaaaaaatcatgtctaacagagaggcatgttcatctaacaaaactattatcttttattatacacatacatatataagatgccaaatattttattttcatctaagagatgtctatctaattaaataatgtgggacaaatatgtagttagaataacgaattcaaagcttcacaagtcgcacgtttttcatttttctttctgtagtttagggaccggccaaaagtacatcaacttagacccaagctaagacccaaaaatttggaccattttctaacaacttgccgtccatggaaaccgaatcaaaaatagcatcattcgttggtgacccatttttgggatatttagcattatcccattcaccatttatcagccatcaatcattcatccaatatatatacacatagacatttcgtaaaactcaaatcactcaccacataaaaccaaagtcccatctcttaaaaaactaatcatttcaaagttttgtctctagtctttctttttattgagcaatg

SEQ ID NO: 33427 - DNA, 3003 bp, Unknown
  misc_feature (1)..( 3003): 2750-1469P.txt file - cDNA_ID_3069635; gDNA_ID_1620590; Annot_ID_161401
ttgctatagaagcttaaaatattaaagacacataatgttttaacatatttcatagattattttgaaattcagtgaaaaaactctaacatcagaaacaatcatactttttcattaacgatctcaaacttgtatacctttacaaatgttgaactttagcttaatcaagtttactttgatgaatgatgatagatatctatctgaaagtttcttgatgtaatgttttctagggcttagtgtattagagtaaaagtcgggaacatatcgtgggaattagtatactagtacattaatttagacagctaaggttacgtccaagaaaaacaatgataattttgataagattcgggggaagaaaaatgcttaatgagtaattaaatagttttttggaacttattgatcacgggagatcgatcacctggcataattatagtggccacacgacttaaaatttaaaggataatcattttgtttataagatgtatcgacataagtatgaccggacatgagtataatatgacccgcctcgttcataagattccaacgaatacgaaagagaccaagtaactaatcacatattgataagttaatactattaagaaactattaagctagaacttttagatctatgtgtggttgaatgaatatataaatcactagataacgtttacgtcaaaaccattattttttctcacatgaagatttcatcactatctaagatatctcatagtattttgtttcaaaatcaatcaaaggataaattaaaaacaagcaacaacttcatgaaaatacaaacaaagtagcacaaaacaacatcaataatatttccctttgatatatccaaaatccactgcattaggtataaatctataatcattggcgtggcgtatcacacaagtcacaacactaaactatatagtcaatggagaaatgaaatcaaatcttagtaatttccacacaatcatatgcaattaattgaaatcgtctcaacattaatttggtctttctccattaatcagagacttcgattttaatttggttctagaaataagtttgtgtttgatactgtataaaaatatgggtgctggaaccaaattaaaatgtgtggttttaatggaaaaatggactgtcaaagagagccaggctggcattttctctccgatgattgcttgtgggtcccgttgtcttcactgtcttaagcacatgcgcttctgcttacgtgtcctattcgcatttaacacttaatcatcatataaacctactttttttttgttcaccatgtataaaaacagacctcttttaatctgtaacattactacatctcacatttacgaaatggatactatatcttagtgtataatgttatttgaatagtatcttgcgtgtatatctttcttttacatgagtaatcctttaaaagcaatagataaacatggtttcgtaatgtagtggtagtaaactaatacgtcgtcttagattatccctatatagtaatcactttgacaaaatcattaatatattttagtgacttctttttgtttttaaaacagtaaatccaaacggctgctagctcaaatcaaaacagaccacatgagcaccatgtgtcgttttttaacacatcatattcttcttctctcctatctctatctatctactatcaatgtaattatcttctagttttagttatcttttcccaattgatcttagagtttttataatttgtatagccagtgaaataaataggctactaagactagtggtacatatacaatcatttataccaacaattcttaatctatatgaattagtaaaattaattcataatgtagaatagtcgtgtcggcaagatatgtttgttgttccagtcgttcaaggcaaaaacttaagaaaaaaaatgatgaatttaactgagttattattagttaagtttatagtcattatcattaacaagccaactatacagtcaattataaagataggaaacaaaaacagagataaacatgaaaacaaagttattcccaaaattatgaattaaattgaatttactaataagttataggagtgaagtctctcattaattcattttacttaggggaagaaggctaatataacgctccaaaaatctcagtgaatgatattgtctggtccttttatgtaaaattaataataataaggttgattagttactgggatcaaacaaaatgattaatattaatattaatagcaaattccaacaaacagtaagtgttaaacaaataataacatgtacttgtttcgcaactctctcttcatctcctcttcctctggtctttttttcttttgttgcgacttttcttcttcttcttcctcaggaacttaagtttctgagtccatgaagatgccagtaagtacgtttctccctttctttaattcttatttttgatttttttgtctaatgagtttggcttaatctctgtctgcaattctatgattctctcagttaaattttggtaaagaaaatcatatgaaatcgagatagcttgtaggattcttacctcagttctgtgttatttgtttgtaatcgagacctctctgcagccaaatctagaaatctgtctttagattcctctgttttttttttgtacttacaggctctgttacttggatcttcatgtcagtgtgttctgattgatgtttttcttatgaccgatgcttctgtttagtttcatagtttgaagtttatgaactcttatctctgtttatgaggttttccaagaggagaacttatcagattcccctgaatttcttccatggaaaccgaaaatataggagagttcatgtttttaatcagatatgattcttgtcaaactcaatttacgtttagctttcccggaatttcctttacgcaaacgttttttgtttcccttcacatatgactctcgttagtcatcacatataagatttgctaacatcatcagttttgatctgattttgtcgaatttagactgattttctcaagttgtaatg

SEQ ID NO: 33428 - DNA, 3000 bp, Unknown; identical to SEQ ID NO: 2773
  misc_feature (1)..( 3000): 2750-1469P.txt file - cDNA_ID_3069638; gDNA_ID_1620590; Annot_ID_161399

SEQ ID NO: 33429 - DNA, 3003 bp, Unknown
  misc_feature (1)..( 3003): 2750-1469P.txt file - cDNA_ID_3069642; gDNA_ID_1620590; Annot_ID_161398
tctcgtacccgagagcgtagctgttccatctcttgtaagaaatcctatgttcgatacactttgtttgcccacgataagggttccaaaccacaagcttataatttttttcgttggtgatgcataaaaataaaccgtgacagatatggacttgagatatacctattcgatctgaatcatctaggctgataagtttacatttaaactctatagatggatcaacattgttttgaatgccatggagattgacgctcattagataaactttgtattccgtcattattaccacctgaaactcactttcccttgctgctgcgtttgcttgaccaacgtgcttctttgtaaagctctcgtctttggatataatgttccattttttgcaagtagatcgcactgttctcagagatgtcaccggaactctagagagcacctcctctaccaaatccctaggaagatctgaaatcgccattgttgaatatgttatatgtcatactacaaatcaagttacctttagcagtgaaacaaaaaaaataaaactcttttcttttctctgcctagctagggcacacccggtggtatgcaacagaaaatttatattttctgagttaacttaagatatagattttattatgtttgatatcttgaatttccttgaattgcttttttaatttaaataatttgacatatgattttcaatagtggactttttttagcgaatctcattaattgatcatacgatgggtcctattagtgaccattatttagaaaatgaatgcacaggaacaacatgttgttcctctttttttcaccatcattagtattttttttccaaattgtaatatgtagaccccacaatattcctaatcattctttattttttgaggaatggtagaagaaaatttttccttcccaaatttgatgaggaacaaacaggaaaaaaaattaaatatttattaaataaaaattaaatttatgttcgttttatatttaatatttaatttgaaaaataatttatttattttttaatttttgttactatttattctatgttttggttatcatttacagtaacatttgttctatttttcctttatatccattccttttcattcctattttatcattttttcttttcctgtttgttcttttttagtcatgttcttcttcattccttgtattcatttataggtcaccaatcggacccgatatgttgatttaaagagagtggacatatcaattctggtagctggtaaaaagcatctatttcctttgctttcaagctcatgtgttacacaaacatgttataaagtcatttttttgtttttcatatgcaaagagaacaacaattgtatcatggacaatacagaacttctttattttcatctaaatagcaatgctaaagagagcttctaaggaaaaaagtgtctaagatgtattcggctgtttcaaaaaaatattggaagagccaacgagagattacatactaagtgaataataatggtctgacatacaaattaatgatcaaaccattattatgtcaagagcgaggcaaccatattcgattaattagttcgcactgctctaagagatgctaacgggaccctagagagcacttcctcttccaaatctcggggaagatcggacatcgccattgttgaatctctcatctccaagttaggtcaaagcttctacaactcttttcgtaccttccggctatatatgtaacagcaattgaagacacaactcactgggctaaacctgggcttcagttatcaagtcggcctcttaatgtgggaccaatacattttttgtatttgatcgtatagcaaaaacaaatgattagcaccatgtggaaacattagagagtttgtgtaattaaatttcaagtttcttttctgtcttgttatatacataaaaatggttacagtaaccttgttttttctagttatcctcatatgctccaaaaacataggagaaaacataatcatgaactttttgaccaatagtattgttaggacttgaattctcttagatttgttaattgatgatgaattctcttagatgtttataacactatgaaaatcattacttaaaaaaaaaaaaactaagatgatccatcagtcacactttaaatgttttttaaaatatgttcatatgttttgtttatggcattgcgtacataatttaattagactaattataatatcgatcaaacaaagaattattggctggatttggtcgcagccattagcagtcgctctcaactaatattattacgagaatctctagctgagcaagtatctcgtatttctcacgctctgacgaaaacttctacgagatagacgcagatatcgagaccacgtcattccccctaacaaggcaacaacatgtggcggacgccagtaaaactctgctcaattcacttcaattccatttttcgaatccgcgtgacgtaacccacctaagggtttataatccactactttgcacccccacctaaaaatgcatcacaagcgcgacaagtgtcaatacaattcagatacggagaatactctgagatcccacatctgctttcggtgggctcacccgcatcagataaaaaccctaagctaagggatcagaccaaacagtttaaccaaacgaggttatcaacttatacgacaacgaaagcacttatcaatgataagttagttaacttatcaaactacagtctgtgtgacaaaacgcatcgaagaaagtggagaacaagtcgtacttttttctttatctttttccttttttattaaatgaaaaaatataaatagaaattttgtagcatctctggggtcagctttttcttaatgttcgctttgcgacgcgaggaaatgcaaccttgaaaccctagaaaactcattctcaactacgactaaatcgatttcgcaaactttgacctacccttctttcacgataaacccagatcgcttaaattccttgaatttcttcttctgagagttttaggaaaaaatg

SEQ ID NO: 33430 - DNA, 3003 bp, Unknown
  misc_feature (1)..( 3003): 2750-1469P.txt file - cDNA_ID_3069654; gDNA_ID_1620591; Annot_ID_161424
attcccatctgaagattccttcttctctcttaaaaaacttcgtcgaatcctcgaagctatattcattgctgatcctgtgaagaagaagaagaatctgaaaatctccaatgccttagaaagtagaaaaaatgggcctgggcatggcctgttactgggctactgggccttattataataacaaaaggcccaataaattagggtttagagaactcttaaccctaatgtcgcatcatatataaagtcgccattgaagtgaagctgagatcttttcgaagagcggaagctaaggagaggcgaattcgaatcgagaagatggtgtctgggtcagggatatgttcaaagcgtgtcgttgttgacgcacgtcaccatatgtgtggtcgtcttgcttcgatcatagctaaagagttgctcaatggacagagtgttgttgttgtccgatgtgaggagatttgtttgtctggtggtttggttcgtcagaagatgaagtacatgaggtttcttaggaaacgcatgaacactaaaccttctcatggtcctattcatttccgtgctccgtctaagatcttctggcgtaccgttcgtgggttcgtattctaatctcacagtcttaaagttcttagcttagtatgtgattcttgaaaatgaagattagaatttgagtattgggtttttggaaagttgttatattttgtgtagcttgttagggtttgcatcaatggatggatttgtgtttaggttggttagttactattaagtatgaagaaatggtcagcttttgatctttgtgcaatgatgtctgtgttaggaattgtatgtttgatagtgtgatggaggatttgaaatgtgatcatttgtcatttacaggatgattccacacaagaccaagcgtggtgctgctgctcttgcacgtttgaaggtgtttgagggagtaccacctccttatgacaaggtcaagagaatggtcattcctgatgctctcaagtaatgtttctgcaactttgttctatcttgtaattttggttatgttcaatgtgttttagctgtcaactggttttcgtttgttttgttttgtttagggtgttgaggcttcaggctggtcacaagtactgcttgttgggacgtttgtcttctgaagttggctggaaccattacgataccatcaaggtatgtcccttttgtccttttcgtctgccttattattggaacaaaaggtgcttcatttactaaaattgtatttgtaagtttcctatgagttgatttgaatagcatctactgacacatctttgtcattgttctgggtcttttgctgattgttttaatttataactgaagatcatatcattgtacttagtttagtcaggagaaaattatctcacttaatctgtggaagaaactgggaatttactgttggtttaatgattttacaggagcttgaggtgaagagaaaggagaggtcacaagctttgtatgagcgtaagaagcaactcaccaagctcagggcaaaggccgagaaggttgcagaggagaaacttggatcccagctcgatgttcttgcatcgatcaagtactgaagaaaatcagcatctatcttttggtttaactcttgttttggtttttatctattcagattttgttttcttccttgtatcactgttgaagtttatcacctcatttcagttttatttatcagttgatacttcaatccttagggatgagttctataacttctaagcgtcccaattatgttaatcttctacaaatattcttcaatccaaattcactatatggcatgacagttgactaaggaactaacaaaattctcttcttcttcaggctagtttgtgtaattcttaagattttactggagatattatatcaaataagaggtgcgtaaaagtaattttatattcaaataaaaacattttgccatgaacaaaaaaaaaaggttttattatttcatatgtaagcaaggccatgaattgatcaactcacgtggtctacctgtccctctccttttggacctaaagttagctacgtggcacttccttatttccgtataaaatctgcgtcggcacttaccacgtgtcatacaactagtggagacaacatggaaaaaactattctgtcggtggacccacatcagatttttaattccaaaaataaaagttacacataaccaaactaatactgttaaaattgacagttatggttagcttagcgcttacgcgtaccgtaaccaccgctacaacaaccaagcggtcgttaaatctcgccgttaataagaagttaactaacaacacctttatctttgactagccgtaacgttaattactctccaaatctcaaagcattgattaataaaacaaatgttgactaataaaatctccggttaaacctggtttacttaccggtttagtttcggttttcatttctactccatgttaaagcaagctataaaaatggcgaatataaccatcgtgaaagctttctctctcttcttcttcttccttcttctctgcatttaattttgggtttgaatacgacgcttcgtcttcttctttctccaagctacgttccgaggaaaactttatacgtatatgtatataaaagatttgactttgtaatctgaaaacgacgtttttgttgaaagagagagcttttttttccttctttacctaaatctggaaaatttaaagaaagatttctgattttgatactccgcgatttcgtgagatcgcttgttaggtaagaaaagaattcgaagacgaaaaatgtcgaattttgagaaaatcatttctggtttttgtttttctggatctttgaatttggagcaataaaggatcagtttttatttgatgattcttgtctcttgatcttgggtttgatttaaaattacgatttgatttgatgattcgatttcatataaatctgagttaaatctacatttttgcagatacataggttttacattattatcatctgtttctttgataaaaacaaatg

SEQ ID NO: 33431 - DNA, 3003 bp, Unknown
  misc_feature (1)..( 3003): 2750-1469P.txt file - cDNA_ID_3069662; gDNA_ID_1620591; Annot_ID_161419
aatggaaaaggagatagccaacaatcctgtcaaatttgtttctgtttgagtttgtctttctcaatattgtttctttcttaatacctctctctctcttattttctttctgttataacctattaaactctacataaaacagcaaacttaatctgtttctggtttttataggactgttgggtattttctatgttcttcgtataaaactcatcaaaagttttgagagatattttcctatattatttgctagtaagagaggttttcagacgaagaaaaagaaaatcttcataaaatgagttgtttctcgtgcttctcttcaaaagttctggacaatgaaggttcttcgatgcctgctccttataagcaaccaaactcacctagtaagctctcgtcaatattcttggaaatgtgcacgtttgttattttgtctacatcttttgatttattatagaatttcttttaagaaaatttatgtttatgtatttctcttacagagagaacaacaggagaagtggtggctaagaacgcaaacggaccatcaaacaatatgggggcacgtattttcacgttccgtgagctagccaccgcgacaaagaattttagacaagagtgcctcattggtgaaggtgggttcgggagggtttacaaaggaaagcttgaaaatccagctcaggtaaaatctagacacttgtggaccaatatttttcgattaatctaaatttcgatatagtatttaacggttatatattaaaaaaaaaatgtttttgtcttacaatagaaaatagattcaaactcatttgtttattttgtttggggtatgatgatcaggtcgtggcagtgaaacaacttgataggaatggattacaaggacaaagagagttcttggtcgaggtcttaatgcttagtcttctacatcataggaatcttgtgaatcttatcggttattgcgctgatggagaccaaagacttcttgtttacgagtatatgcctcttggatctctagaagatcatctcctcggtaaatcattatttctcaatcaacatttcaatgtttttttaagaaaaaaagataacaagacccggtttggtgatcatttaaattaaaacagatcttgaaccgggacaaaaaccactagactggaacactcgtattaagattgctttaggagcagcaaaaggaattgagtatctccatgatgaggctgatcctccagtgatttaccgagatcttaaatcgtcaaatatattacttgacccagaatacgttgcgaaattatcggatttcggtttagcaaagctaggtcctgttggagacacactacatgtgtcttcccgagttatgggaacttatggttattgtgctcctgaatatcaaagaactggctatctaacaaataaatcagatgtctacagctttggagttgtgttgttggaacttatatccggaagacgagtcatcgacacaatgagacctagtcatgaacaaaatctcgttacttgggtgagtatactttattaacttatatgattttactaacggcttatcaatgtagacactatttaacaatttacaactttggtttaggcactaccgatttttagagatccgactagatattggcagctagctgatccattgcttcgaggcgactatccggaaaagagtttgaaccaagctatagctgtagcggcaatgtgcctgcatgaagaaccaacggttagaccactaatgagtgacgttattacagccttgagctttcttggtgcatcctcaaattcctccaataccggctctaaccatttgcaacaaaatcgatccaacaaatatcaggatgcagttcagtgggactcaagtcctagatatgctaattcgcaaatgtagacatttttatattttatatgacccaacaataattcacaacttatgtatcttccctttatttttacttttgggttatagtttcatctatttataatgaatttattcataattacatttatggttttctcaacgtcaatttcatttattaacgtattctaaattaatcaaacatatctcttctaaattgcataagataggccagtttagcctaggagtacactcacattccatttagaatagagaggcaaacaaactcattagtgttaatggtaatgggccgtctatacatttctgcccactcttttgagccgggcctcgtcgttcgatagggaaattgacacattgtagtcggagttcatagcttgtgatgtaaaactctccaaatgcttgggttatttcatttactgtatataaactaaacagtataataagatgatagtttttttttttttttgtgattagcaattttcaattaaacaccaactaaccattagcatttcaacggaaaaataaaaagttccaacaaaatttaaatacgtaagaatcaataaataatattgaaaatttgaaatcccatagaactgggcaaaaaatcggactgaatactcgaaccgtaattattccgaaaattggacttgaattcgaatcggaaaattcaaattcaccttataggatcttaaacatttctactcaaaaaaccgaatccgattctgataaccgatgatttagatttgttttactaatttctaaatttttatacctgatataattttatctgaactcgattacccaaatatctacccttatatggcatggcatgaaacatcatctctcaagaatatagtaatgccatgaaggaaaattggcaaataaaaatataaaatatacatgaaattctttttttttaaaagttttgtttttgcttatagtaataaactataaattaatttataattagaaaaaagaaagaagaaggtacggcggtggatattggcccttgccgcaaaagcaaaagctatcgccaccaccgtgtcataaatctcagatctctctctctctctctctctctctctctctctctctctctctctctctctctctctctctctcttgcgataacaatg

SEQ ID NO: 33432 - DNA, 3000 bp, Unknown; identical to SEQ ID NO: 2775
  misc_feature (1)..( 3000): 2750-1469P.txt file - cDNA_ID_3069693; gDNA_ID_1620592; Annot_ID_161452

SEQ ID NO: 33433 - DNA, 3000 bp, Unknown
  misc_feature (1)..( 3000): 2750-1469P.txt file - cDNA_ID_3069697; gDNA_ID_1620592; Annot_ID_161451
gcaatcatgcgttgcctggaaacattcagagacttccaacgttgtaaaaaaccagatacctactattaggcactcattttcttattgtctatccagcttgttcaaccaactttccaagacgtgcttggacatttgagggctggagcacttgaaaacttcaagaatgcttttgagaaggccttggatgctggagaagggttttcatcatctgcgaaatcctgcgctcagtcatgcatatctaagtttgataaaggatgtgaaggtatcatgtattgttactattactgctgaaaatattctgatatagatagcatgttgaaagcgatatctgaactcaatgggaatctcaaaggaaatgttatgttgcagaggctgttattgaacaagcaaaatgggatacatctaaaactcgggaaaagcttgagcgtgatattgaagctcatatctcttctgtccgtactgcaaagttggctgaactgactactctgtatgaggtaaaatagaattctcaagcagctgaaagccatacatattggtctgaattatctaccatcaaacaggtgtaaactcatatctggacatttctaatagataattttcattgcagtcaaaactaaatgtagccttatctggaccggtggaagctcttctggatggggctaatgatgaaacatggccagcaataagaaagctacttagacgggaaggagaattggctgtctatggtctctccaacgcattatctggtttcgaaatggacgaagaaacacggagtaaaatgcttgctgatctcgagaactatgcacgaggtattgttgaaaccaaggcaaaggaagaggctggaagagcgatgatgcgcatgaaggataggtgtcaccattttacttgtctttcatcatttccttgtccgataacttccatctcttacagagctttctgattaaacaaacttctatccagatttgctacaatcttcagccatgattctgattcaatgccacgtgtttggactggaaaggaggacatcagagcaattacaaaaatggctcgttctgcggtatgagacctacctgatatagcaatatctcagcacctattctttgaatcaatcgcaaatttctcgagattttgatatgacccttgttctctttttcagtccttgaagctgctgtctgttatggctgttatacgcttggatgatgaactcgacaatattgagaagacattgacgctagctctgtttaattctacgggcaacaatgctactagcaagagcatcagcacaattgattcacttgcctcaagcacttgggagaaggtgactaaaaccttactcactgtatataatgaaaacacaaaaggtctcatatttagtactcacacctttgagatataaaagatccttactgttaccttgttattatcaggttgcaccagaaaagacgttgatcacacctgtgcagtgtaaatcactgtggaggcaatttaagaacgagacagaatataccgttacacaggccatttctgcacaggtaatctttgcaatccacactttcaagcatatcttccgtttgctcattcacatgagctgatgttaaaatttggcaatgctacaaaacgtttttgaatatctttttttggtcatgtcgtttctagcttcttgtctcctttctcatctgttctttaatcagctaacacccggaaaaataattgaggtttcaatctgaataaagtctccttggatttcaggaagctaaccgacggaataacaactggctgccacctccatgggcaatccttgccctggttgttcttggatttaatgaatttatgactctcttaaggtaccctccttgtccattcttttgaattgactcggcggctttttcatacaatcaagattccgtactcactttggctcttcgtgcctgcatctctcatggcagaaatcctctatggctcttagttctatttgtcggataccttgtatccaaagccttgtgggtgcaattaaatatttcaggagaattccaaaacggcgtggtatgagcacgatatccaacatccatatttttacttttgcccctgttcttcatttgatctcaattataatctcaccgaaatgccaatgtttcatctatgatcaacaacagctacctggacttctctctttgtcaaccaaattcattccaacggtcatgaacctcctcaaaaagcttgcggaagaaggacaagcaccacccacaaatagcaaccaatcaatgaactctacagctcaatccgaggttacaaccaatggagaaagcagcagcagcagtagctctggttcatctccagcaaaaaacgtacccattgatacaagtgcatagaacaaagaagtatacaagcttaagctgttgtgctagcccacgaagctagaaacttaaaattcgttaccctttcaaaaaggtagctctcagttttggtgttgatcagagagattcaccgagagccatatgttttatgtctccgatggcattggttccctcttgcaggtgtcaaagtgatcttgtatgttcctagactaagattctgatgcagacaaaaacaaaaaaactcatgatttgtttgcgagttctgtagtgatgtggttattgtatctgataaaaagaatgttacttgaagaaaaaccggtttttgattaagtgaaattcagtttggtttttgttgattgaagagaatttcaggttctcattgcaagtttatagtgtaatcatgttagcatagagtttttgggccattggaaaattcataatgggcctaagataacggatgaaactgtaaacctaattatgggagatgcagaaacagagcacaaagaaagttccagactattagcttttctaaaagaaaaaagtttcactctttggaggttggaacttaattccttgattaagaaaccccagaaaaaccctaaacccttgaagcgtctccttctctagttctttgcaagcggaaatg

SEQ ID NO: 33434 - DNA, 3000 bp, Unknown
  misc_feature (1)..( 3000): 2750-1469P.txt file - cDNA_ID_3069720; gDNA_ID_1620593; Annot_ID_161460
cccgccagaatagttatatgaagtaattataaggacttctcaactctgatcattgaagaaaacaagggaattgagattatagatctattatgggagatatttacaacaaaaaccaatgccatcacctaacacatgagatgtcaatgattgtatagtttgcaatataatcgatagatcacaaccttttgatttttaagaaaagtattggagtttcataaaaaagaaatttatagtcagaaaatatcaaattagactgaagacgaaaacaattaaaaaaaaaaacagatttgtaaggtttaccgagaaaaaggcaatgtgtaattttatttttctataattttgttatacttattggtatatggattatagagctttcacttataagttcattaatatatttgtaatttcaagttgaatttaataaagaacatgtcaaaaaaaaaattgtttaggttttactgaaatttacctagtttaacccaaatttagagaaaaataactagattaacactaaaatattatggtttactaaaataatacaatttttttatgtaaaaataccaatacccattttatttttaattctacgttttatggttaattaaataaaataattactcaagaagactccacacaattgcattttcttacttttttttcttttttttcttcttatgtttatgaccaacttactttttatattcttatcaacattaacctcgttaattaattggtgataattcattggtatacactataccacacgatatcttacaatttataaaatttctatataatatattaaactaaagatattggtatatatatatatgtttataatttcgttgcaaagagtaggaccatttaaaataattggacgtagagatcgggagatactgatacacacgtatacacaaagataatcatttatcatttccttcagtgtgaaaaaaaaaaacattatcatttccaattctttcatctatatatataatatatatacatacatatataggaggacatacaaaggcatatttccaaaagaatattcgattgttttacatttttcatatttttttgatgcgtctgtgtatacatgacttcattggataatgttgatgtaaccttgaatttgttctttcacttttatgtttatctcttttcttttattatccacctttaatattatctttatatatctcttgctagttgaagattagcatagcattatctatagaaaaatttaaacactgtttcattataacaacttaatttttctttttaacataattataagtattttcgaaaatttatttacgttcttaattaaagtcttaagtttcaaaacaaaattatttatttggtgtttaaaactttatcggctgacgaaaataaaaaacaatttatgggctatcacaaaatgccttgaatgcgtcattgcattacgggccatgcaaagtcctatggaccatctccatgtgtggcccacgtgataatgggtcccgttattctcttcttttcttttacatcacagttctctttattattattgtcaaatttgttcacaacagttgggaacaatgtccactagttaaagtgacatttaatctaagatacatgatccgattggtaacacaaagctgtacaaaattattagcggttagttggagttataagttttttgaaaatagtgcaaaactgtataaaaaagttgtatgcgaaagctgtataataaagttgagagtaaaaatatttgtaacacttttaataaaacttttatgattgatagaaatgaaagctatacaaaatataatactttaattttgttcatcattcaaaaccataatacttgaaagttatgaaaaaaacataatacttgatttaaaatgtgcattttattaagtggttaaatttatttgattccgttttttcttccaaaatttgattgcattaaattgtattagcgcgtataataaaaattatttatggatggaatcttatcgatctaaaaatatcaacaaaaaataatctttttctaatcactactaagagctaacagataatatcatgattaaaaactaatagttgctaatgtaatcgacgtattatcatttcattaaggttcaagtttatatatttgatgttgttaacaattaaaaaaaaaggcactactactatatattttcttacttcaaaattactactagtattattcacaagcgccatcaagcgggttattaccaaggctcgaacactcacaaaaaatcgaaactctactgaggtagagaattgagtttaccaccagagacaatgcaacttggttatatatggattcgttgattagccatccaaaagcaaaataatgcagaccgaagagttgttaaggggagtgttcctccatggaggacgtggagaagaaaagttggttgctgcacgaggttgagcaagagaaaggttcgttgcaggacgaggtaaagcaagagggaggctcaatttaggacgagaaagagatttgtcatgagatacataaaattgcagagaaaaactcgtttctagtgtatcttataataataataataataatcttataataataataagtctatcaaagatttttaaaaagaaatacgccaattatataaataaaaaaattgaaatgtgcaccataaaaaatgctaatatatagtattcattcatagtactccatacaaaaagcttttttaaaaaaaaacttatcattaaatcttattatcttttacgggtgttttcattaaagtaaaataaaaataaataagaacagtacaaaactatagcttacgtatctgaatagttcctccaaatgacgatcctacccttcacaatctctctttgtttactcaattccatgaaccgctataaatacgctctaaacgttactcgtcacttggcttgcacagaacaaaccaaccttctagattcttctccttccttcttcaactctctctcacttctccagatatg

SEQ ID NO: 33435 - DNA, 3000 bp, Unknown; identical to SEQ ID NO: 2782
  misc_feature (1)..( 3000): 2750-1469P.txt file - cDNA_ID_3069743; gDNA_ID_1620593; Annot_ID_161463

SEQ ID NO: 33436 - DNA, 3000 bp, Unknown; identical to SEQ ID NO: 2776
  misc_feature (1)..( 3000): 2750-1469P.txt file - cDNA_ID_3069747; gDNA_ID_1620593; Annot_ID_161459

SEQ ID NO: 33437 - DNA, 3003 bp, Unknown
  misc_feature (1)..( 3003): 2750-1469P.txt file - cDNA_ID_3069755; gDNA_ID_1620594; Annot_ID_161498
cactgaaatgggtccccaaaggtctatatgtaataactcaaaagttgaattacaaatattgtttgaagactgaaaagacaacttcttctgcttagccaaatgacaaatgtgacaataagcagatcctttattcttgtgtttagtagtcctcaaaatgtctgaaatagcatccagtcttgagtaagctggatgtcccatcctcatgtgccataaactaacatccaccaccgcattaacagagactgaatccaatggaggtgtagtatccaacacatagaggttgccaatgcgtctacctctgccaattctcaggtccttggtaagatcctgtatttcacaacatgacggatcaaagatcactcttgaaccaatatctgaagtcaaactactgatgctgatcagattcaaacgaaactcagggagaaataaaacatttcgaagaagaatgttttcatttatctgtactgaacccactccactgattttaacacgtgatcctgttgggagattcacataactcaccacagaatgatccaaagaaacaaataggctcttatcatggcaaacatgatgagttgcaccagagtctatcacccaagtttcagtggaaagagtatgttgggatacattcaatataccaacaaagtagtatgtagagttagagaatgagataccagtgtaatcaataggagaacgtgaaattccagcatctgaagaagaagcagttggttgtgacttcagttgagaactgaacaaggctatgaagttctgaagttgatcattggagagattaccaagcagaccatctagagtagcctgagttggaaccatcggaggcaataaagagacctgagcagcaaccggttgaggtttggtacccttctctggtagtttgcctttaaaaccaggagggtaaccatgctttttgtaacatttctctgcaatatgtcccaccttgttgcagaatgaacagattggacgccctttattaggtccattctgaacatagcaaatcttaggagtcaaagcagtagaagatatcttagagacctgaaaagcagcaggaggagaaacattggtagagaaacctttctgactgtaatcctggtcaagaatattgtaaacttcaaccagagaaggcaaggctttctttgcaatgatctgtctcctgactatagagtaggactcattcaaacctgccaagaatttgacagttttagctctctctgccttctgttgcagacgaagaactttaccacaagtacaaggatcatcaggttcctctgtactgtccaacaaatcccaaagaatacgcaactgagtatagtactcagatagagaaagagaaccctggcgaaaatcctggatctcctgtgtcagattgtacgtacgaggaagattagtcatatgaaaacgtccataaatgtcacgccagatatctgtagcatcattcatgcgtagaatgctacgataaatctgcggagacacagagttcaacaaccatgatttcaccatactattacatctggaccaaaggcgaaagttcccatccgattcaagtggacgaggcaaagaaccatcaacaaaaccaatcttattcttagcatctaacgagatccgcaacgctgcactccaatcatcatagttagtctcatctaagcggatagagacgagattcaaacctggatgatcaccactgtgcataaaaaacggagactgagtcggatccatggaatctgaagtcacaacagctcgcgatgcgccagcagagagcagatctacagctggaggagagatcggaggagagactgtgagaccagtggatcgcgacgatttccatggaacggagcttatcgacgcctttgaacgagtggatttccgagttactcgagcaacagccaccatctttacagaaaaacgagtagtgaacaagaaaaaaacgagatcggagaagaagaaatctgatcggaaacaacaaaaacttagctcgttggctctgataccatattacaagataaggattgagctgagctagggagaaaacttgttaagattttcgattcttatttcttaaagagtaaagtgtacaacaatttccttatatacaattggtctaacttaaccagtcaattaaaccggagaataatctattctaactaaatcggatggtatatatactccaagagagttgttattatacctcaagagcgtaaaggtttagaacgaacacaagattcttgagctgcgaaggctgaatgaagaggtggacaaagagattgctctgagtaagtcatgtgcagcgaagattgttcaacagcttgaaaatgtgaagcatcacagttgcagataagtaagttgttgtctcagagataggcaagcaaagaaaatggtgtaacttgaaggtgctgagaaagtgactgcagaaaaagagagcacaaagagttaacggcgattccattatctgcaacattaaacaaagataaaaaaaagaagaaattttcacagaagtggacgaaaaaagatttgccctcaccgtttgtcaaagtgagaactggttttcacggtttctcttttcattcaatttcggaccaaattaccctgggaaaacttaataatggcacaaaccaaaccgtgcaacagttcgtatcggttcagttgacggcgtaaaccaaaccctacagcagttggttttggtttagttgatgcggttcagttttgaaaaagacaaaaaaaaaaaaaaactgaaacgaagaaacccgagaaaacgaaaaagagaagagagtaacggagagatttgagagagaatcagaaagcgaaacgaaattcagtatccattgcttcaaaattcgacataacttcgaattgttgggtagttgaattgagccactgaactcccacatccggggaagtgaaagttactgtttttcccggcgaagccaagagaaagttactttttattccggcgaaatttgaacctccggcgagatagcatctttagctatg

SEQ ID NO: 33438 - DNA, 3003 bp, Unknown
  misc_feature (1)..( 3003): 2750-1469P.txt file - cDNA_ID_3069780; gDNA_ID_1620595; Annot_ID_161520
actagctcatattctatatactttatccaacatcatacccatacattgttaagctctacctaacttccgttcctagaagtttggtcaacatagtttgtcaatcgactcttagtgcaaacccaatttattttctgttctaatataatagaccttgacactaatagagcaaccaatttggttgctagtttgaaatctcataataacatttggtttctcataactcggtcaaaccacgaaatcttcaggcatatttcagccgcgacgtattgttattgtaccgccaaacagaaaatttgaatatttgagggtttagttattcgaattaatttgaactcgtttgaattattttaaatattaactgttggcttgtgttcgtgtgaatatggacccaatcattattggcagttccccataaaaatactttttataatctcgataatgatataataatgcaatctcgataaactcagcctaaacaacacgttaattctattctatttgagtaagggacatcaatagaaccaacaataatgttagtatacaaatgggcctattaataacatttggttttctcataactcggtcgaacaagaaatcttcttacataactcagtcgtgacgcatgcataactaagcaatgtgactgttataactcggcaaaccctaaaagtgcttttcttaagccatcaggttgtacaatcaagtaattaacatatcatattaacttttcaactagtagaatcatgaaattagctcatattctatatactttatccaacatcatactttatccaacatcatacccaacaacatcattcctagaagtttgatcaacatagtttgtcaatcgacccttagtgaaaacccaatttattttctgttctgatataatagaccttgacactaatagagcaaccaatttggttgctagtttgaaatctcataataacatttggtttctcataactcggtcaaaccacgaaatcttcaggcatatttcagccgcgacgtattgttattgtaccgccaaacagaaaatttgaatatttgagggtttagttattcgaattaatttgaactcgtttgaattattttaaatattaactgttggcttgtgttcgtgtgaatatggactcaatcattattggcagttccccataaaaatactttttataatctcgataatgatataataatgcaatctcgataaactcagcctaaacaacacgttaattctattctatttgagtaagggacatcaatagaaccaacaataatgttagtatacaaatgggcctattaataacatttggttttctcataactcggtcgaacaagaaatcttcttacataactcagtcgtgacgcatgcataactaagcaatgtgactgttataactcggccaaaccctaaaagtgcttttcttaagccatcaggttgtacaatcaagtaattaacatatcatattaacttttcaactagtagaatcatgaaattacctcatattctatatactttatccaacatcatactttatccaacatcatacccaacaacatcattcctagaagtttgatcaacatagtttgtcaatcgacccttagtgaaaacccaatttattttctgttttgatattatagatcttgacactaataaaccaacaatttggtggctagtttgaaatctcataataacatttggtttctcataactcgatcaaaccacgaaatcttctggcataactcagtcgtgacatattggtattccactatcaaacataaaatttgaatatttgagggtttagttatacaaatcaattcgaactcgtttgaattatttttaatattaattgttggcgtgttcatgtgaatatggacccagtcattattggcggttccccataaaaacactttttgtaattttgataatgatataataaagaatattatttcgtatggaaataaggatgacaatgaggtacggcgaaatcaggaggcgcgataagggcgttctgatcgagtgtgattgcaatgctaaagttgtcgttgccacttctcgtgatcctgttacaagcggaaaactgtatttcagttgtccgtatgaaatatcagttgtaagcatcttttttgagttatgattctttattttatttcttttatttttgtatccctatgaatcaacctcttatttttcagggtcccggtcgaggctgcggtttcaagagatggtggactgttgcattgtgtgacgagtttgacatgataaaagaggagactattgtgatgaagaaggatctggaagcagccaataagcgcgtcgaggctcaggcggaaaagatcttttttatggaaaagaaatttgaaatgttagagatgaattatgagcttgaagaagtatctgtgagcatagctaaatttgattttttcaatttggacttccttgtactgtcaatttaattaagtcagccagtcttccgatttatgcgatgataactcagccatcacgttataataactcaaccaaatatcgaattaatctacgataactcagccgttacgttacaatgattcagctatcacacacgaataactcagccatcacacacgagtaactaaactaaacatcaagttaatatacgataagtccgcctttacgttagcataactcagccatcacacacgaataactcagccaaacatcaagttaatctacgataaatccgccgtaacgttagaataactcagccatcacacacacgtaaaagagagactgattatgaatcatacacacgaataaaagataaaaaaaaaaataacataaataacatagaagtactgcaattaaataacataaaataaaatacaaataacatggagatgtaattttgttatgaccaaacaatcacatccatcgccaccttcattcttcatctgattcaaaacttgaactctcggtcgatccataccccagcttatcccaatcaatactaatcaccttgaatg

SEQ ID NO: 33439 - DNA, 3003 bp, Unknown
  misc_feature (1)..( 3003): 2750-1469P.txt file - cDNA_ID_3069855; gDNA_ID_1620597; Annot_ID_161574
ctacatttttaaaattatttttatttattactgtgtcaagttttattacaaatttcataggtgatagcaattttgaaaattttcatttgtatgattaaaatgaattgctttttccatttagcaaaatatttgatcatttaaatatttatcatgttttctatttgtgaaacaaaaaaatagaatggagaaagcatctttcaaagaaaagagtagtgtagccaaaatggttgggacaatagtttcactagttggcgcacttgtggtagttctctaccatggtccacgagtcttcaccccatcttctccaccatttccacaactccgtcagcttcttttgccgttatcatcctcaaactcggattggatcatcggtggttgtcttttagccatcaaagacaccctcgttcctgttgcttttattcttcaagtaataacatattaattctcttaacttgatacatcatacatacttgcatgtacataaactaaattttccttatagtagattaatattgaattggacaggcacatataatgaagttatatccagcaccattcacggtctctttcttctattttctgattgcttcaatcttgacgtcattgatcggaatcgtagcagaaaagaacaatccgagcatatggatcattcattttgacattacattagtttgcatagttgttggggtacgtaaattttaatattttagaaaacttaattatatcttaaacttcttttcaatactatagctatttttcgcagggaatatttaatccaggatattacgcgattcatctgtgggcagtacgtaataaaggacctgtttacttagctatattcagacctttatcgattttaatagcagtgattatgggagcgatttttcttggagattctttttacctaggaaggtatatgtatatatgaatcaataatcttcagacacacttgtttgtgaaacaagaaaaaccacacatctaatctaatggtttcttgttatgtggttaatgttgcagtttggtcggagggattttgatatcgttagggttttacactgtgatgtggggaaaagcaaaagaagggaagactcagttcttgtcgctgtcagaggaaactcctcttctagacgaaaacatagacgaccgaatatagatttacaagaatattggaaacgatgatttaattaatatgattagctctttgtagaatgtgtttgtgttgatcgagattaggagcactctattagtaacaataaaatgttctatatagctttgtaactgaacattgaacaatatattttgttactcatttttgaacacatgttacggacaaatgtttttgaataatatgaaaatagattgagagagttgggaaaattggaggaagaagaagcgacaaacctgtcgctaccttcatcaagaatcataatatcagtgacctctccccatgaagagaaatgtttacaaaggctaatcatgatatcatctttagaaagcgaatactcatatcacagggaaaaacctaataatttgactgcgggagacaatattatcatgtgaaaaaaaaaaaaaaaattatcaacaagacaaaattacaaaatattaaattaataaataatctcgtttaactataaaatcaaattttaatatttttgtataaattcgaaccgatatttaatttctttatgttgtaaaacataaacgcaaactgtttttttttataaattcgaactgaaatttaattttgtttaattgtaaaatttaaattaatttataaattcatatataaactaatatataactcgatttaatgacatattagactttataattaaaatgaatttaattttttgtagatggtagattttagggtcttttgtaaaactaacatattttgataaagtatttaagaatatagcagtataatatggtaaactaaataaatagcacacatgagagatgaaatgtctaaatactccttcatgtttgtttcagtgtgtagacacacgggcgtgagattgtaagctgatgatttcatgtgttatagagagtggagagaaatgagagtttgtgagtttggtaagcacacaagacgagaaaaaaggtgggataaggagaggtgatggtggtgtgggcaacgacgacggtgatggtgtgggcaacgacggtggtgatattgattgcagtggtggtcgtcgcggtggtggcggtgactctgatttcaacaccatattgcagcacaataaaataaaaaaagcaattaattccagaaatcagatactacattctctaatgtaccaaacaatgcaaaagtaatatctgcaaatcgtggatgtcaatttttgtatctagaagtgatatagtttttactaaagtctaaagactcatactatttagtaatttttggataaatagtatactatttacatcaaatctatggtttctgttatagtcctgatttctcactcctaatcatcaaagttcatgaatcgacacttgtcgatttgaatcagatctgtttcagaagtagatcaatcgaatgggagttcgaaatatggtgtttgtgagaaggagagtaaatgaaagagacactagaaagagcgagagagaggataagaaacacatagaggcggataaaggaggaagaaaaagccaaattctggaatgagaagagagataggcgaagagcgtgttgttcacatagggttataactggaattaatacagaagatataaagaatatcaccttcttttttgttaggtgttagttttctaatttatatttttttgtgtgtttcttttgcaaatttccctagattttaattggcttaaaaaaaagttgaatctttattactttgaaaaacttccccttttctcctcctccatcactctcagggtttctcggttcaccaaaaactcctaaatctctctctcagatcgtcactacccttttcaattccatcctcaatcttcaaaattcccaaacgaaatcaacaaaagatg

SEQ ID NO: 33440 - DNA, 3003 bp, Unknown
  misc_feature (1)..( 3003): 2750-1469P.txt file - cDNA_ID_3069857; gDNA_ID_1620597; Annot_ID_161572
ttttgttttctttgactaattattaagtttttgctgatttcaattttagtttttcggattattctagtcaacaagtcgaaattgtaaccattccatttccggctaatttaattttaataattataatagttttttatgttaaccgaaattaattaaactcaaaagaactaatcccgaaagatattgtttacatatgtgatgaagccgttcgctatgaatttttcgtgcattataataaagttctttagaataattacttcaaagttcccctataattttttcaattcgactatttttttttccataaatcatgttagttttcacttcactatattcaacactatagtttgctaaccaattctttaccactagccgccttacccctatcccacaactgtctcatactcttatcagtaactaggtaaataatctatatttatggtaaatgcgtttaatatgttcttctttctttctttcaatgcatacattaattcaggttttcggcatctatatttatggcaattgatatgaagatttaagttactatcgcactattgctcaatcttgtggtccaaatcatacaaggctgtttgcatgaatgaaataaatgcgtattaattgtgtttgatcattgattatttcttagccttcttttggaataaacacttaacacactaaatttcattttgtgaataaagaatggaaaaagtatctttcaaagagaggagtagtctagccaaattgatggggacgatattgtcactgataggtgcacttgtggtgattttctaccacggtccacgtgtcttcctcgcatcttctccgccctatgtaaacttccgtcagttttctccaccgttgtcatcttcaaactccgattggctcatcggtggagctcttctaaccatgcaaggcatattcgtttctgtttctttcattcttcaggtaccaattttttttccttatatatagtagaaataattttaaatttatggttaagtcaaaaattagtcattaaaaaaggtggaaacatacgaacacatggtttagagtagacctaggcgttcagatatttggttcggttctagttcggttccaattctttcggctctcgagtttaggattcatataggaactaaaacagttttggtttggtttgggttcgggttcggttttttcggttctgaagtttaattaggacccattcggatatttatttcagatattttttagtattttcggatattttcgagtatttttggatattttggtatttttatatatttttcaactatattttcggtatttttgaatgttcaatctaaaaataactaatatttttggatatataatcatatttagatattctcggatacccgaaatatttcagttcggttcgggttcggttccaattattttggttctagaatttaggattcatttgagtattttaccattttggtttggcttcggattcggttctttttgctttggttccagttcgtttttttttggttcgggtattatgcccatgcatagaggggtgaactttggtttttggttggagatgatgttataatacatgtgggaaaacacatatcttcatttagtaaacatcatttcattctaatatttattctatataatgatttttggacaggcacatataatgagtgtatatccagcagcattcagagtctcctttctttacactgtatgtgtttcaatcgtgacctcgacgattggactagtagttgaaaagaacaacccaagcgtttggatcattcatttcgatattactttgattacaattgttaccatggtatgttatatatatatatatattttaaagatatcaaaatatctactttttgatcttaacacttttttaaaaataaaatatttcaggcaatagtaacttcagtatactatgtgattcattcatggacagtacgacataaaggacctctgtacttagccatatttaaacctttgtccattttaatagcagtggttatgggggccatttttctcaatgattctctctatctcggatggtattaatgaatcaatagtcttcataaacatatctataaacaaaaacatctactcaccttcgattttgtccttcgttttgcagtttgatcggaggaattttgataacattaggcttttacgctgtgatgtggggcaaagcaaacgaagagaaggatcagttatcattttcagaaaaagagaaaacgcctcttctattaaaccgcaaaaacgaccaagtttaaaaagaaaaagaatatagacaataaaactactaatagttaacaaatactgttattaataccatatttataaaattgtcttatgtctctatgaacctaggagttggaaaaaaatgtgtgtatttagatttttttttcaaaatactccaacatttataaatacgagttaacatttttccttgactcctttggaacatatgaaaagcttaaattgatattctttgaagcaatgataggtaactgcaccaagtatatatcccggtatagtcacacatcccaagtttagtgaactacacgaattatgtgtattgtatgctaatgtataccaattagtaacatatgatcaacaccatcatattccttttacaccgtttgtcaaatccatttttaaaaccacttttggtgaattacgccgtagaaaaacaagtctaacacattgtaacattttgaagtggtaataaaatttctgattcaaggtttcaatatctataattattgaagtggtttcaatatccattattggatgatcatattttggcacaactgttttcaagtctgcgcaaagaatagggaatcttataataaattcaagaaacaacaattattggacccacaatacaccacttcccctctaactagtactatcataaatgaaaagcaaacaaattaagcgataacaaatcaaagactcacatttcaacaccaaacctttctaccatttccaatg

SEQ ID NO: 33441 - DNA, 3003 bp, Unknown
  misc_feature (1)..( 3003): 2750-1469P.txt file - cDNA_ID_3069861; gDNA_ID_1620597; Annot_ID_161571
taggacaaaatcttttgtcactaattgatttcttacaccgtagctttccatcaaattgaaatacacacacaaacacaagcgcatcacgtttcacggctacaataatgttcttttagattttgttattttcctaaatactgacgtaaaagtcatatccaatataattgttttgtcttttcaatttctttttatgggcagacccaaatattatgcataaacattatatattagaatatattttagttgttagtgagctaattaggttttattgtatggcgtgtggaaacggcatgcttccattatatgcgaatggtctaaaccatgtgttttggtattcaattattatatagacaattagttaggccttggcttttttttttgcgattatgatataatcttatgaacctgataaagagaagatctaatcttatgaacctgataaaaagaagatctaatcttggttcattaaaataaggtagtattaaatttgtacggaagttgataagttgtatacctaatttttttttttttggtaaaatgtaaagtatttagggtaaattagctaaataaccaattcctgaaaagaaattaaatatctagcaccataagttgccgaattcagagagtaacgcatgaggtgtgtgtaatgacaacacactctttcaccacacactccttcacccaaattctatacatatcatcatagaaaaatagaatagtatatatttgttcaaaccaaaactttgattccgatgaatccaaataatcaattatatattttttgatggaatgatactaaaccctaagataatatatagggaacctaagggttttaatctaaaacaatgattaaatcacttaacatccttaatcaaaacaaacaattcattttaaaacgtatatagtacaatgtatacgtaaatagtatattcacaaaatagaatagtatctctcaaaaatcttccaaaatcaaaatcgatttattggctatttccctttagaatttccaacatcgtaaaccctttatcgcttctagatctaagaaatccataacatgatcgtcaatttgttgttcataattctcaattttattttccatggatttacaaattaaaattctcatatgaactttgatgggaaagtgaagattaatttgacataattggcgaaaggatttcaccggatttttctagtattctctggctgacgaagaataaatatagtcagagtattattgcgctaatggtgttgttataaaatagagtaaatcagatttgagtgatcctatcgacatttaagattgatccatatataattttgacttttgtttagttgatggtgatgtatgtaaagattcgtaagaaaagggcgagatagatgaaaggagcacacttcataaaagagaagaagatttattcacaaggatgtcttttgaagaagaaagaagaaggagagcgagatgtacaaacacagtaagaaaagggagagagagatgaaaggagcacacttcataaaagagaagaagatttattcaataggatgtcttttgaaaaagaaagaagaaggagagcgtgatgtacaaacacatgatagtattgtcaatattatatatattatacataatatttttttctattgtttgaagtgttagtttaccaattaaagtatttttgttggttatatttgccaattccccaagtatttataccattttcgaagtttcgacataagttaaaaaggatataagaaccggaaaaataacgaaaatctacagaaagaacagacaatgacaaaacaacaaaggaggaaaacatatgtatagagcgaaaacaaaagaagaaacaccgattccaaaatgccaaactcggaaatttgcgtgatttcctccacaactccaagaagctggagtctcatcctaagttgtatacctaatttgtttacagaagttatctatggtgctaaaaaaaatggttttaacacttgaaaaaaaagcttttactaaagttatatatatatggtttagtggttttctttagtgtatgagtcgatatgagaggacagtaaaagataaatcattttttatataaaaaagctgttgaatattatttgttatttgtgataaacaatttgaatagtaaaacatgttacataatttctttagctagtgcttatagaaaattgattttaaaacaaaataaagataaaagttagtttctattcaaaaaattgaaaatgattgccacatcatttaaaactaaaagttaaaaattaaaggtaaaattggttttttttttttgaaatcgctttaattgtaagggtaaaagtggatatttgtttttactgaaatcatgagtatgaaaataacagcaattttttttggataataaacgcacattttaattattatgtgtattttttccaaccaaaaataattgagtattcaacgtctagataaaaaagagactgagatttttttcgactttttctccaaaaaaaacgaagttccaaaaataatgatgaaattagtagtggtaaatggtcaatttaaatccgttgctacaaatcaaaatttaaatctgtaaattaactaaatctattaaattattaatgaaaaccaatgtaaaaagaatctcaacttctcaagcatactttgtttcaaatattctactattcaaaatactcccttaaatcataacctgaaactcacataagctgatccaaaattgaatttcattccacaatttttctcttaaacttcatataaacatgtcagcatgttacacggccttttttgtctgcttcatatatctctcaagtgtgtgtactacacaataacatttcctgaaaatctaactttcacccactcaccatcttttcttctctctttccccatcaaaaaaaacaaaaacaaaacacaactctgtttctctcatcttaaaattcatgtaaaaaaaatctacaaatcaaagagagaaacagagtaaagagaaagagaagaagatg

SEQ ID NO: 33442 - DNA, 3000 bp, Unknown
  misc_feature (1)..( 3000): 2750-1469P.txt file - cDNA_ID_3069867; gDNA_ID_1620597; Annot_ID_161566
tttacaataaattttgccttcaaggtttttttccttcttaacaaaaaaaagcacttagaatgaaaccctgattacaatttagtctttgaaataggttagctaatagtcaagctagatgtagatatcctatataatataataatatttccaaaagatgtaaccatcctatatgatgaattaccttcttattttgttaggtaaaacgtattaaaattaattaattgaaatctatagtgtataaattaaagttatatctatatagaacattaataagctatcatatctaatctatctatctatacaagaaaagctttcgattattatcaactttagcatactatatatatatatacatctactatatgaaatttaggtcgacacatttcttcttagataaatcagcttagatcattggtttttttacaaaacttttcatatcttctatatacatctttactggtgaaaaaaatatcaagatagtgaattcagtaatcaaaatacgatagattattactactatatattatgcagttgaactttactttattacaaattcatcaaatcttaaactacatcaacaacattgttcagtagtcgtttttggttatgggttataatattttattgtttaaaagtaaaaaaaaaaaatcattgtggttggacttgttggtttgaccattatagtgtgtgtgacattttgtcaagcaatcaccctagagaagaaagctttatacacgagatttttggtttccaattccatttcgagagtatttttacgcctcgaataaatttttgtactagaagacaattaatatagagttaaaaaattcatcactatagtaatagataagttagtataaatcataatttgccaaacgaatattaatgacgttgtgatgtggtgaagagagagcattaatgatgcacaaaccaaagcacatcactttgaagaataataagtgcatgcatgaaataattgggtaaagaaatccgttgtaaaacaattttttggtgttaaataaattttacattcaatacaagaaaaaaaaattcgtagaataaatttataaacttttggtataaacttttaaaaatgttcttagaataaattaataaacttttggcataaacttttaaaaatgtttttaaaaagcaaatcgtttaactttttttgtattcctttgataaacttttttttggttacaaattttcattcgataaacttttggaccaaatgcttttgtttgatgttcgtttgctgactttcgcatatttgttctcaacttagtggttccacggagatgacgatctgcccccaacatatacaaacatatatagtgaaatattttagtaagtaaaatttagaatttgataatatgatccattgtcgtaaattgtaaataatttaattgttttaaattttttaaacacccatagagtaaaaagtgaatgtaaatagattttgttttggtaatccaactatataatattttgttattatatttttttacaacagactgattcttgaccgaaaccaaaaataatttgtctagtatgtgaaacagacttttactatttgaaatatgcatagtagaaaacaattattgaaatcacattagaaatattcgaaccattatgaaacgatttttcataataattttgatcaacaacataaatgtttaactgaaagactagctatgtgaatagattagtattttaaatttttaatagtataactttcttatttcaatcttgtttttggaagaaaaaaacatccttttcaccatgtaatatctcagtaaaactaattttgtatcttaataaacaattgatctagttgttggtataccttactcatatcactacgaaaatacttattctatattcaaattcaaagctaaaaataaaaatctatttgacaaaaaaataattaggtaaagtgcaccggccgggaagcaaatatattattgcgatttttatcgtccatagatttcataaaagatcgttagcaatatggttacatcggcatcaaaaactcgaaatggacattgtcgcatgcttactttattttatattaaagttacaaaaatcatttgtttgtctaccttctcacaacacctgtaaagtcatttacctttcgcttcgaaactttatttatcattagaaataatctaaataagtgtattagttatttcaatacagacttaaactcgaactctttatatcattacttttgtaaacattcgtttaatttgtaactgtaatatgaattaatttaactatcgcaaacaaatgagatgtctcctaagcagagaaaatatatactataaatccatgcaaattaacaaatattttaccatataatatatatatatatatatatatatattataatataacaacgcatatttaaaattcgtccaaaaagatggaaaaggagaggaaaatatatcttacgtgatttgtttctctatcagagtgctcgcttacattcacgtcacgtggataactttttgatagtttttatttttaaatattcaaatatggtcgtgaataagaatattacaaaggaacttgcatacaatcacatgcatgtgaaatatacatgtatatatacatatacacacgtatactatgtaaggtaggcataatagttataatcatggatccaaaaataataagccaacgagaaagtgttgaaagatattcagataaatgtcatgattgtttccccaaaacggaaaaacaaaaattcaaggtcgttttcatttcaattcctttacttcttgagttttgcttcgtcatcaatacatatacacatacttatatcatagtggtatacatgagtatctatatttatacaaacatctcatcttctatctataaatatatgcaaaaaccatacaagtttaacataccgaattacatatatatctcgctcgctctcttctttgttcttgctccttgttctagttcggatttttcttttgaagtgaaatg

SEQ ID NO: 33443 - DNA, 1998 bp, Unknown; identical to SEQ ID NO: 2796
  misc_feature (1)..( 1998): 2750-1469P.txt file - cDNA_ID_3069894; gDNA_ID_1620598; Annot_ID_161585

SEQ ID NO: 33444 - DNA, 3000 bp, Unknown
  misc_feature (1)..( 3000): 2750-1469P.txt file - cDNA_ID_3069948; gDNA_ID_1620600; Annot_ID_161640
gtttacaacctcagtcaaaccttcatcacttggactagtcaaaccttcatcacttggactagtcagagctgcagcagcctttcccttgcctttcttttccactgcggcttttcttggagcttttaccacagtagacggagctttattagccacaaagctccggtgtgctacatcttcattgaacaacggttcaaaacatatagtcctctcctcatcaactagacgtttcttccaaccatcagctattagatcatcgacatcattcactccacactctttatccataattctttccaaaagtagcttctcatcaggagttggagccaagatactctgaatgtcctgtgcatgataagaaagtaattaatatagcatacatgatagaacatacatgatacatgatagataactaataaatatgtcatcactaaccttagttgtaccgagtttgtcatacacatctgacattggaaaccctttcatagtgcttgatttaaacttcattttacacatccggggacactgaggatctgcggattcaatatcttcgcagaaattttccctgagaactgggatcgcctcaaatgctagatactacataaaaacaatacaagatttttcaaaaactaataagtataactgctaataaaaacacagttgtacacagtttaactttcttaaaacaattcataaatgcataatgaaatgacatacctccaaaggcataacaaaactaggaaacaccttttgtggaccaactactccattgcactttttcatcagatagaaaatgtctttcacatttttttcaaatgcaaatcttccccacggaaatgttttgcacaactctagatcagccacagccctaaggaagaacttctccacatttggtgcgtttggtcctgtcttaccctttccaacgattacactacataaaaaatatagtacagctaccctcagacgagcatcagaaggttttttcatagacaataacttattctccacatcaagatactgaactgttgctccgagtccaaacatcttgccagcaaaagtggtacagcccaagctgtccaagggtttgggataattatggcagtataatcctgacataagtgcaaattcttcgagagaataccggatcggtacgccattgacaataaaccatacttccttcttcttatctaaacatgttgtacgaagaaataacagccacatacccatcaccttatgatttggatccttatgcatgtggaagaagtgtttgaattgtgggtgctccaaaaaccacttcaactcagactctttaagatgagtctccaataatccgactgccttatgaagataacactttgctgtaatcttgaatggctttgtatactcactcggaccgaagtacattttaagaggttgaagagcttcagtttcctcatcagaatcctgcaatcaacatagatatacctagattatacatagatataccttttagttttgaaaatttataagttagattcgaatatagatatacctagtttatacatagatatacattttagttttgaaaatttataagttaaattcaagtttagatatacctagtttcaatatagatatacattttagtttcgtataatttaatggtagaaatcagcatagatatacctaatttgaaaatagatataccttttagtctctaaaatatctaagttatattcgaacatagatatacctagtttaaatatagatatactttttagtttcatataatttaaaggtagaaatcagcatagatatacctaatttatacatagatatattgtttagtctctaaaatatgtaagttatattcgaacatagatatacctagtttttagtttcgaaaatttctaagttagattcaaaatagatatactcaatttatgcatagatatactaatttatacatagatatactttttaaaatttctaagttacaatatcaacaaagatataccaaattcatacatagttatacttttctaattgtgtaaagtttaaagttcataccgctctatcgtcgttagagattgaatttgttgcttcagaatccacttcaacagccgacgctactactacttcgtcattgattgtctgtgaaaccaccacctccgccgcggacgccaccgccaacggcacacatgcgttctttgttcgagccatttctccaaacctacaaacaaaatcatttggattagcactactcttcaatcaatttcgatcacaaaacccaatctgaaacaactcgaatcaaatcgacgaacagttaaatcacttaccccaatttcttagtttcctgtagatataccaagatcgacgaacagttatattgttgtcgttgacgagaattgagaatgattttactggattttacagtgaagaaataaagaagaaacaaaggaaaagagatgtgaatcgattttaccgcagagaattaggggaattagggttttatttggatttgacccgaaaacagtggacttggattattttaggatccatttgccctggttgggttgtaattaagcaatattcttagggttttctgagtaatttacttcgtttacggaataaaaaaaatcaaaaacaaatttttataaaaagagtatatgagattactcttcaaccaagaggagccgctgagaatttggtccccttggcacgtataaaccctagcagagacattaaaccctgaaagtaattagggatcactgttctccggctccggcgaaaaaatccctcgaaatcgtaattctctcatacgtctccatttctgggtttagcgtttcagcagcttccatttcagattctgaaattcaccgaattttctctgtcttttgtgtttattctactagaagattcttacggcttgttaaaatgattgttgatactatcactgtcgactcttatttgtgttgtgttgcttttcaggatcctaacctcaattgattgaaggaagttatg

SEQ ID NO: 33445 - DNA, 3000 bp, Unknown
  misc_feature (1)..( 3000): 2750-1469P.txt file - cDNA_ID_3069964; gDNA_ID_1620600; Annot_ID_161639
tcaaccaagaggagccgctgagaatttggtccccttggcacgtataaaccctagcagagacattaaaccctgaaagtaattagggatcactgttctccggctccggcgaaaaaatccctcgaaatcgtaattctctcatacgtctccatttctgggtttagcgtttcagcagcttccatttcagattctgaaattcaccgaattttctctgtcttttgtgtttattctactagaagattcttacggcttgttaaaatgattgttgatactatcactgtcgactcttatttgtgttgtgttgcttttcaggatcctaacctcaattgattgaaggaagttatgtattcgctttcgaggattctccaaaggtaaaaagctttctaatttataaattttggttttttttttcaatttttagagctcttgtgtgtggtttagcagcaagcaaattagatcttctcttatggggtttgttatgatttatttgaattgaaagttttattttttacttgattgtgtcatttaggagtcaaagatataactttgcaccttcttcgtttggtgcggtcagtaaattagaagtatcaagtggtggtgataaagaacgggtctttaaatcatttggattgatttatagcaaacctcaaggtttagtcagactttattccgcaagagatgtgttttcacggttctttggcatccacaagctttcttctatagctgatgctaaagataaaggagatgaggtagttagggaagaggagctgtctgaatcagaggaggcggttcctgtttctggggatgtaccagagggagttgttgatgatgattctttgttcgagcctgaacttggtagtgacaatgatgatcttgaaattgaagagaagcattcgaaagatggtgggaaaccaactaagaaaagaggtcaatctgagctgtacgaatccattgttgcttataaatcagtgaaacatgttcttgaaaaatgggtcaaagaaggaaaagatttgagtcaagctgaggttactcttgctatacacaatctgcgtaaacgcaaatcctatgctatgtgtttgcaggtaaatatgttctcattttacactttgccaaatcttttattgttctgtctctatcaccctcttaatgtgtatgtctttgcttgggctttggcatttgcagttgtgggagtggttgggagctaatacgcagtttgagttcacagaggcaaattatgcttctcagttggatttggtggccaaggtacatagtttacaaaaagctgaaatctttttgaaagatattccagaatcttctaggggagaagtagtatacagaaccctgctggcaaattgtgtacttaagcatcatgtaaataaagctgaagacattttcaacaaaatgaaagagctaaaatttccaacaagtgtgtttgcttgcaaccagctgcttctcctctacagtatgcatgatagaaagaagataagtgatgttttgttgctaatggagagagaaaacatcaagccgagtcgtgctacctatcattttttaatcaatagtaaaggtttagccggagacataactggaatggagaagatcgtggagacaattaaggaagaaggcatcgaactagatcctgaactgcagtctattctggctaagtactacataagagcggggcttaaagaaagagcacaagaccttatgaaggagatagaagggaaaggtttgcaacaaactccatgggtgtgccggtcattactcccactttatgcagacataggagacagtgacaatgtgagaagactgagtaggtttgttgatcaaaatccgagatacgataattgcatttctgccattaaagcatggggaaagctgaaggaagtcgaagaagcagaggcagtgtttgagagacttgtggagaaatacaaaattttccctatgatgccatattttgccctcatggagatatacacagagaacaagatgctagcaaaaggcagagatctggttaaaagaatgggaaatgcagggattgcgattgggccgtcgacatggcacgcgcttgtgaagctatacatcaaagcaggagaagttggaaaagctgagttgatattgaacagagctacaaaggataataagatgagacctatgttcactacttacatggcgattcttgaagaatatgcaaaaagaggcgatgttcataacacagagaaggtattcatgaaaatgaaaagggcaagctatgcagctcagcttatgcagtatgaaaccgtgctcctggcttatatcaacgccaaaactcctgcttacgggatgattgagaggatgaaggcagacaatgtgttcccgaacaagagtctagctgcgaaactggctcaggttaatccgtttaaaaagtgtccagtgtctgttttacttgacatataacgataatcatcttatgtattgagctgttaagtgtttgttctggttgcttccaagctaggaaataataaacagaggattcgtttttcttccaaagtttctcatttttgagtttgtgttcctgtggttttttgtaagtgacataaactggaataaaattgaactggactagaggtacgtggaaaaaattatcgaaccgaagcaaaaactagactagtagaaattggaagacgaaaccgagaagttgaaccgtaaataaataaacacatcagagccgacatgaaccgggttgggtatatccaatgacgtgggacccagcagattataagagaattgaaaaatacaaaaatgcggtgagcgtggatcgaacacgcgaccttcagatcttcagtctgacgctctcccaactgagctatccccgctttgttgttaccttaacgatacgtcaaataattaatctctagtttaaatttctattttctcaattattccttttgacttcgccgcttgcttttgagagacggagacaaaaacacacacgacgaagaaatctccgggcggtcgaagaagatg

SEQ ID NO: 33446 - DNA, 3000 bp, Unknown
  misc_feature (1)..( 3000): 2750-1469P.txt file - cDNA_ID_3069996; gDNA_ID_1620601; Annot_ID_161659
aaaaggttagaactttcttagatctttcgatttcttgatttagacccacttttcgaattctgattctcttcatttccattgattttttcttggtttaactctgtttctccagtggtttgacttgttactgaattaaaaattaggttaagattttgatccatttactggtttcgtaggatttttgatctgaagattctgatttgggatctcaaatggagaacgttgatgtgtctaagtacatacacagctctgtgcacaaagctgttgcttctaaagactatgttggtctcagagcaatactgtcttctcttccaaagcctaaagatccatgtgagattcaaacagaagcagcttcattatccgaggaagcaaaatccgataccatttcagctgtgattgatagaagagacgtcccaagccgcgacacgccgctacatctagcggtgaagctctgtgattcaacatcagtagaaatgctaatggttgctggagctgactggactttgcaaaacgaagacggttggaacgcgttgcaggaagctgtttgcagtagacaagaggcgatagcgatgattatagttcggcactatcagcctttagcttgggctaaatggtgtaggagactacctcgtttgatagctacaatgagtaagatgaaagatttttacttggagatgagttttcattttgagagctctgttgttccttttgtatctaaggttgcaccgtctgatacttataaggtttggaaagtgggatcgaatttgagagcggatatgactatggctggttttgatgggtttaagattcaacggtctgatcaaagtatattgtttcttggtgatgggtcagaggatggtgaagttgctcgtggatcgctttacatggtgaatcataaggataaagaagtgatgaatgcgttggatggtgcttgtggagttccatcagaagaagaagttaggaaagaagtggctgcaatgtgtaagagcaatatctttagacccgggattgatgtgacacaagcggttttatctccgcagactaattggaggaggcaggagaagagtgagatggttggtccttggaaagctaaggtctatgagatgaacaatgttgttgttagtgttaagtcaagaaaggttcctggttcattggctgtagaaggaggcgatgatgatatctgcgatgttttaacagatgaagagcaaaagcaactagaggatgctcttaagctggatttaccagacttcccaaatgtcaatggtgagaatggtttcattgttcatcatcaggaagatcatgttgaggccaacaagaaagcagagaagaaagggtggttaggaggttggagaaagaaagagactaaacaagagaagcagattcaatacgcgccaccgagaagctctctttgtgtgaatgagaaagtaagtaatctattgggagagtctaatcagataaaaccaggaagacactcagtagataatgagcattataggaaaccaaaagcattggtctctgacaagactcgccacgaaagcgaatataagaaagggctacgtcctgttctttggctatctccaaacttcccattacaaacagaggagttgcttcctttacttgacatacttgcaaacaaagttaaggcgattcgtcgtcttagagaacttcttaccacaaaacttccctctggaacatttccggtcaaggtatgttgtcgtttcatgttaagagctaatcttaatgttcttgaagatgagtttttttttctttttcttatagagattgtttgtgaatgtaggttgctattccagtggtacctacaataaaagtgcttgttacattcacaaagtttgaagaaattgagcctgtagatgagtttaagacgcctctctcgagcccgacttcttctggctatgagagtccagctgctgcaacaactgacttcaccaactcatcatcgtcctcctcgtggtttcgtcggtctagatcaaacaaagatggtgggagtagtaagtcaaaaacattacaagacccatttgctatacccacaggttatacttgggtcagtcttgaatcaaagaaaaggaaaccaaaaaagggtggtaaaaaaacagaacaagttagctaaccacttcaactcttgagaacataatactaacctacacaggttttcttcatgagatttgtgaaaagacattgaagaaagggtgagaaaggcataaaaattctgatacaactttatttgattattttgtaacatagctcagacatttgcaatgaattgttttcctttccattgtgatgtaaaaacatttgttctgcgtcttttgtatcttttttttattcttcttattcaatatgcttggaatatgcaacacctgagtcgatatcttggaaaaaactggagccgattaaatcacattctagtgtaattccaaataagtttgtagatgaggtaacgtttgttcttgaattttgactattttagatgttgaggactatatacggattgtcttgaggaggaaggcattttattaacctaactacttcataataatctaatttcaccaacacaaaataacccattaacacttgggccttcaattcaacaccatggcccattggcctttttcttctttcttctttctcttacgatccttttctctttgttgttgcagtctcttctcatcttctccactcttcacttgatctcatcttaaatacgattaagtataggatcaatttccaacaaaaatctggaattcaccagagcttcatcctcatcgcgaaatcgacccgccgtaagtcttttctctaatctctactctctacttgtcgatttgatggttgtttggtttaatcgattagatatagagctgtcaaatggtccgtccagagactattgggtgtatccgtacaaacaatttttttttatgggccaagttggacggttcataatgaacaatggtccgaaaatgtccatgcccaataaagaccatg

SEQ ID NO: 33447 - DNA, 3003 bp, Unknown
  misc_feature (1)..( 3003): 2750-1469P.txt file - cDNA_ID_3070000; gDNA_ID_1620601; Annot_ID_161658
aattaacaaaagcctaatagcttaatgatgatcagaacatgggtaaccacagaagaaacttacagagaactgattagacatcataggtgatggatcgcaagtcccaggagtgatttgccactgcttaaactcccctctgaagcccctagatatgcttccacttctgcaattacaagcacgattggtcaaacctaaattacgaaactatgccaaataaaaccaaaaatcagaggctatctgctatgtaccccattcctccgagtggaacaccttgggatgcagatggtttgcagttctctttggtgaagggatcgataggtgctttctgtagtaatcataagttaaatctccgcaaacaaagaccaaaactttgtaccataaatatgtaaatcaagaaactctattgatcaagggagttacccttccatgggaggcctcttctctgacataagaccataatcgtatccccaagcgtacctgtaattccgaaaataagaagtaaagagacgccccatacaacaacgaagcgaaggaaataaacacaagatgtctctttgtttaccattttaatggcttccctaaaagtaatagtgaattcttttaagatattggcatggcagtttaatctcctcctccatgcgtgtggtggcggagcagcactatcaaaatcgagctatggaaacaaagacaagtcaaaagtcaaattttccaatcgtcatgattcctaaactactaaaaatagactcaccaattgcaaagtacttctgctgatgaattcctcagtcggccatgaatgctttctacggtgaaacaaagttgctccaaccatatttactatacttctcgattctacactgatttgatcaaagaaaattgaaagcaataaggaattaaggatcaacacgaaattgcatatacttcttaactttaaaaaggttgaatttttttaccttttatttacataaaagaacaaaaggtatttctcagggaagcatttgcagcgaattgaaacggcaccgtctcagtcgcaacaatccccgattcaaaacctaaaggaagtgacaatgaaaacggttcacattcagacgaatcggtagaagcgaaattttgaatacaaaggcaaatcaaaacataccaaaaagttttgtattcgatctgtcacgttgaatagtcaataggacaaaaatatgaaatccgatgagattttctcagaagaagaaggaggaggaggagaagaattggattcgaatcttcgaaaatcggtttgatggtattggtgagatttagaggaatctatgtggatgctgacgtggcgtcgtcgtggcgagcggagaatcgaccgtcagagacaaggttctcatacggtggcaagtggtttttaaactcttttgatttgcgtgcgtctccacagtgacgaagacgaagaccaaagagaaatagaaagagagactaattttgcattgcgtttttttacgttttagtccttttagttttgtcaaaagtgttgttttgacactttttttttaatctaatcaggaacatgtttaaagaccacttaacattattaattggggaatctttcaccgaccacatctggataatagggttggatttggaaatctcttgtctggtttttaaatttaattatcgtatattgtagtaatttataaacatattaacaactaatataaggtaactaattaaaagagattatccagattagttgtacacttgtctttttcgagaacgtatttgtacggttttacaaattttcttctaaaaaatgtgtcactgtcttaagccaattatttgctgaattagattaaaaaaacaaaactttctatgataacgtattttaagaataatttatatataaagacattatattatactcaaatgccaatttgtagtaataaaaaaaggtattatcgtttttaaaataattttaaatgtcaaacatacaagctcatgtctaaactattaaattttacaattgttaggtaaattaatataggaaacctaattaaagagttggagatcagttgttttttttcttgaacaaatattttgattggacaaatgtctttttcctactatggctatggacctatggtttacaatgtttctttttaattgcgacatttgatgctgttggtaagattaagacaattagttattgaaatacataagaaaacatttttaaccaaaataaaaaatacataagaaaacactataacagcgacatcgacgtcattaaatattgttttataagaaaaatatatcatactcaaatggcaaattatgtaacagtataaaatagaagaaattttaaataactaaatgtcaaacattttaatatataattgtgtaaataggtttatatcttaatatagttaccttttgataatccgaatagtaactatgttttgcgatataaagaaaatgcgatgcaattcaaatagtaacgaaaatacataaatatatatatatatatagagagattttaatattgttataatattattgcgatgtggttttggatgtggtctacatcatcattcgtgttctatacatgagttgtgattttctccaatgttaataagtgaatatcgaaatcaacggaggaatagaaaatataataaaagccgaaaaaccaaggtggcgccgacgtagcacaaagaaaaagtacaaaaaagtcaaaactcgttgccgacgtaatgactatcggtgtaaatccgaggtcgcgacttcgaatcgttctaaaacccattttacatgctcccattttttttttcgaacaaatgatgtcacaatctcagagtcaataaataaaatggaaacaaataatcatcatatgaacttggtcttgccacgtggaccctccattgccgttaccttccggtgaaataccaaacactccgcttccacttagagccgtagaagagctactacttcatcaaccacaaccactatctcctcaaaatctctctctaccgatcgatg

SEQ ID NO: 33448 - DNA, 3000 bp, Unknown
  misc_feature (1)..( 3000): 2750-1469P.txt file - cDNA_ID_3070004; gDNA_ID_1620601; Annot_ID_161656
ctgatgttcatgtgtcatatgcttcacttaagttgccaccctgtatggatgtatacctgataatgttgttaactgaaattgttccatgttacacatacacacaatttgtcttccgttttacgtggaatagtgcttatgcattattgaccagcatcggttttcaacttcagattataagaggtgggaggaagatattgaagcatggcagaatcccattctcagagatgaaaggctccctgagtggtaattgctttggaacctaatagatctttgaatactttgctctctcaccgttctgccctgaactattttgtatttttgtaggtacaagttcactctgttcaatgagctttactttttggttgccggtggtacagtttggataggtacacatctatacgcttcttcaaagtcaaactcttgattgtaaaattgtgttcttcgcttttaacaaaattttgttgtttcattattttggtgccttgaaattattgtatcaccttatcaacggtttttggttgcagactcttcttcactcaatgctaatgggaatagtcagcatcaacaatcgggattaggaaattcagatggtaaggtcggtggacttgacattaatgatcaacggaatgaccttggtaatggcaacagcgttggagtaaaaagcaatgatgaagtatcagccattcataaccggaatggtttatttgtcgatactccccatgtagatgatggcgatgatgttggtcggtttctgtatttggaaggtgtggagtatgtgatgtggtgcacatatgatgtacacttttacgcatcatatgcgctccttatgctattcccaaagatcgaactaaacatccagcgtgattttgcgaaagccgtgttgtctgaagatggtaggaaggttaagttcctggcagaaggaaatgtgggaattcgcaaggtcagaggtgctgttcctcacgatctggggatgcatgatccttggaatgaaatgaatgcctacaacatacatgacacaagcaggtggaaggatctgaacccaaagtttgtgcttcaggtgtatagagattttgcagctacaggggattaccaatttggaatagacgtgtggcccgcagttcgtgctgctatggagtacatggaacagtttgatagagacaatgacgatctaatagagaatgatggtttcccagatcagacatatgatacatggactgttcatggcgtgagtgcctactgcggttgcctgtggctggctgctcttcaagctgcagcagcaatggctctccaaattggtgacaaattctttgcagaactttgtaaaaataagtttttgaatgcaaaggcagcactggaaacgaaactctggaatggatcatacttcaattacgacagtgggtcaagcagcaacagcaaatctatacagaccgatcagctggcgggtcaatggtatgccgcgtcttcaggtctgcctccattatttgaggaatccaaaatcagaagcactatgcaaaagatctttgatttcaatgtgatgaagacaaaaggaggtaaaatgggtgctgtaaatgggatgcatccggatgggaaagtggatgacacgtgcatgcagtctcgtgagatatggacaggtgttacttatgcagctgcggctactatgatcctctctggaatggaagaacaaggtttcaccactgctgagggaattttcacagctggctggtcagaagaaggtttcgggtaagttttctttcttctttatatccagtctgttaattgtttcgatatcacacacacatagatatactcgagcatgatgatgatgtatctttgttgaaccgaataacagatattggttccagacaccggaaggttggacaatggatgggcattaccggtcactgatatacatgagaccgctcgcgatatggggaatgcaatgggcattatcgttgccaaaggcaattctggacgctccacagatcaacatgatggacagagtacacttatcccctagaagccgaagattctcgaacaacttcaaagttgtgaaacacaaggcaaagtgttttggtaattcagcattaagctgttcttgctaaatcattcggtcttgttatatataagatacaagtaaattcacatctctgatatgattatcggagtaacatatataaaaaagaggaaatgttatttaaggagaggaactagccgacatagttcctgagttgtaataatattaatagagaggagtatgtgggaaaagtttccataaaaagatgatggaaacgtaaatgttgttcaacattttggtgtggaggtgacttgactcttgttttgtttagataataaataataatctgagaagaacaatttgtgttcttcttttcttctgttggttttgaattattggctaaaagaaaagccacgtaagagcatataatgacaacgcctacgtacgctttttagcgttcaatttagaccttaagttttgaaagattccatgtcttcgttttaaaagtcgctttcaattgtttgagcatatgtttcgtagggagcactaagttggtatacataaaggtattgatcaatctaaaaaactcaatggtttaattatattaatgactttagcctaaaaaaacttaagtcagtgtaaaacaatatcgatgtgtgattaagaagagatccaatttaacattacccacacaatcatttgattatttcctcctctccgtatctgtgtctctcttctcttgatcttttagtgttcttgctttgtcgcttcaacgcttaaggtaacactgcttcttctttgatattcgcgattcatcgaacgatttcatcattatagacaaacatcctatcgatcgggtttgtttttgctgattcgagattcactgtttgttagtttcatttcgttattttgcttcatgtggtgttgattgattattcgattttcttttttggcagtttggatttgtgtgagtctgcataatcatg

SEQ ID NO: 33449 - DNA, 3003 bp, Unknown
  misc_feature (1)..( 3003): 2750-1469P.txt file - cDNA_ID_3070035; gDNA_ID_1620602; Annot_ID_161690
aagaaaaaatatcacgtttttgaaaaatatcactattatacttatgacaaaaataggtcacaaaattaattcaaatccaccccttagctaaatataaaatataataatgtgtaagctaatttcatactccagatatatcacttccgaaatttattggatgaaatgaagaagcatgcataaattctgaactaatgcaacaactacatttcctaacagcaaaattacgacatctcatcttccctcattttcgtaggaagttaggcaatgtaaagactacttggttccggaccgaaacttggtcctccgagacatcatccacatgcatggatcagctacacttggtattaccttgacgtcaatagttgtcgacgtattgaaataatggtaactaaatcatccgtaaactcaatctgaaacttaagtaaatattctacaatttctcctttcaacaacctttttgaatgatgaagtcaattcctctttgtgactgttcgacgacaaagagcacaaatccgttgacagtaattagaagatgtggaaagaaaatcgagtttccacgcaccctatgtggactggttccctctagtttggaatgtatgttcaaacaaatttgaatttattttgtattcatgtacgtagtagacatttaaatttattagtagacggaaattcatatacatatggactacggataaattaaacactccctttctttcaggcagagaccgaacgtattgtgtgattaaaaatacacaaacattcaaactatgactttttcataggcgctcctcgtccttcgccacaaatacgtactattaacatttctttctttttaaatagctagagagtaaaatgatcaatcgaattttttgaaggcaacaacagaataagaaaattccagcaacatcttcacttaatagccataatacctcgagtctcctatataaacattcccactcctcaacgtttcatctaatgaaaaaacaccatctccggttaaaagatcaaagatcccaaacaatgatttcaaaatttggatcggtccatatcttggctgtggtagccatacaactcctaattataccaagcgtttcgtcccttaaccttacaaatgcgtatttgcaccacaaatgtaacaacaccgaaggaaaatatagccacgggagtgcgtttgagaaatatatcaacttagctctccgtgccatcgattcagacaattatctcaatggttttgcctacatcgagagaggtgaggatcccaataaagtcttcgtcatgtaccaatgtcgcggcgactcctacgggtctaagtgcaaatcctgcataagcgctgccatctctggggtaattgtcacttcaattttattagttaaccgtcatacatttacattttaaaattgcgagcacaaacacatgtcattttgttttggttaagatcttagagatatatccaatgatcctgacactctacatagatggatgaattgagactaaaaatgataaaagattgtgaccataactaaaaaaatgaagattaaacaatgcaatattgttcttaaccgcgatgtcacatgtatggatacgtatatgacagcttcgtaggagatgtccaaaaagcaagggggcagtaatatggtatgaccaatgtctttttgagatatctaccaatcaactccttcaataagattgattacgagaacgatttctatttgtccaacccgaacgacgtgaacgataaggagttgttcaacaaggagacctcggctctcttggaggagctaacaaataaagccactgataaaaataacatgataggcaataaatttgtgctgtacgcggcaggggataagagaattggaacgaagaatgtgtatgcaatggtgcaatgtacgaaagacttagtgactacaacttctgctgcgtgtttcgaatggattttcaagatgttttcaaagtgctgtgaaggaaagcaaggagggagagttttgggtacgagctgtaactttaggtatgagttatatccctttcttagaaattaacgactgtacagtgagtgctctacataaaataaaaggggtccagagccaaaatatggtcttatacattggttgtgtttaatagttgagcgaataaatgtatttcctctttgtgattcgttttgtatattttcgtttgttagcataactcattaaaagaagaagaagttgtatttaggtttttaaactaactaatttgaaaaatcaaagtatttctaattcccacttcattattttcatttttcacccacagtctccttctttcacactatttggtttataactaattagatagatagtgaaataaatctcaccctttcacacgaaagaagaagccaaaaggaaggggagaagctcatatgcccaaaatacatttttttaattctaaatctgaaatgatgaatcaaatttggtttataatagccagaaaatgatatggcaaagtaaatgtattataattatgaattaaaatgattttcagctttttttcttctttttgtaaaattatctagttacagacaaatttaagagtaatagtaaacgaagaagtcatatatacaaaatgctaaagagatgaaactgtatgtttagaatgcaattaaatctgagaattaagttcattttcaggttacaaaatttgactttttcataggcaatcctcttcccttgccgaaaataccaagtctcaacggccacctcctcctctcctgcattacagactaattttttttttttttttttttaaatagaaattaaaatgagcaatcgaattttgtattatgcaaccaaaatttgacaacttccagaaattctaataactatcaaattaaaaaaaaaaaaaaaaatcgtcacttaatagccatgcatatttccttgagtctcgtataaaaacattaaaactctttaagatgtcatctaatgttaaaagaccctctcctaagaaatagatcaaagatccaaaacaatg

SEQ ID NO: 33450 - DNA, 3000 bp, Unknown; identical to SEQ ID NO: 2816
  misc_feature (1)..( 3000): 2750-1469P.txt file - cDNA_ID_3070074; gDNA_ID_1620603; Annot_ID_161713

SEQ ID NO: 33451 - DNA, 3003 bp, Unknown
  misc_feature (1)..( 3003): 2750-1469P.txt file - cDNA_ID_3070102; gDNA_ID_1620604; Annot_ID_161735
gagatctagaagaagctattgtgatccttgacaaggtcactgggaaatcgaaagggtatggtttcgtcacttttatgcacgttgatggagctttactagctctgaaagaaccatctaagaaaattgatgggcgtgttacagtaacgcagctcgcggcatctggaaatcaaggtacgggttcccagattgcagatatatcaatgaggaagatctatgtggcgaatgttccttttgatatgccggcggataggctattgaatcactttatggcttatggagatgttgaggaaggtcctttgggttttgataaggttactggtaaatctagaggctttgcattgtttgtctacaagacagcggaaggtgcgcaggctgctcttgctgatccggtgaaggtgattgatggaaaacatttgaattgtaagttggctgttgatggtaagaaaggagggaagcctggaatgccacaagctcaagatggtggttctggtcatggacacgttcatggtgagggaatgggaatggtgcgtcctgcaggaccttatggtgcagctggtggtatcagtgcttatggtgggtactctggaggaccaccagcgcatcacatgaattccacacactcctcaatgggtgttggttctgctgggtatggtggacactatggtggatatggaggtccaggtggtactggcgtctacggtggacttggcggtgggtatggtgggcctggtactggaagtgggcagtatagaatgccaccaagttcgatgcctggtggtggtggttatcccgagagtgggcattacggtctttcatcatctgctgggtatcctggacagcatcatcaggctgttggaacgtcccctgtgccaagagttcctcatggcggaatgtaccccaacggtccaccaaactactgaaaaggtgcggttgttctcccttgtatattttggggtttaagagtgtgttgcattatcatgattcattgcatagttatatattcttccctactttgtggcatattgtttttgcaggttgtgcgtaattttcttgctagaaattctctgctattcttttccctgtgtctcttttagtctatttgcttgttagtactgtgttagctacttgatgcaatgcctttagtcgatgtttttttgcttgtgttcattcctttattttaacgcatgaaagatagccagaaaagtggcaccttgaacccttttatggggaatgtttgtggcattctttcatgcagtttttctgtttgtctttaagctgctagtctgtgcaccatgctttgtctctctatcatttactttttgtagtaatgagagtacgcatgtgatcgttccatcttgagtccttgttttccttctcagtatttaatcttcttctgaggatagcatgaggttgatttctttgataatgctaatgaccaaattgagttgtgaatgggtgttgattcaggtttgtgacagcatattgggtgaagatgctttttgtgcttagtggtgattacctgattgcagctctttaatctctggaatgatgaatgtatagctgctttgacctatctgcacttgacctgaatgtgctttggtttctataatgaatgattagactaggatatatttatgtacttttaaatatagacatactcggcaaatgagttttgttggtcagattagtgagtcttcaataatatgttgtattttctcctacattgttttctggtttatgtccagccactctattgggcttcctgattggtggttatatttcttgaactttgatacttaaatgtttgtgacttttggatatctaaaccttgctgattggtggttatatttgtgacttttgaggacatccagactggccctagaggctatgatttgtgattattgactaatgatgcctaggtaaagtggtgcatattttgtgaccagtcattggcactgtacgtgtttatccatgtcaaaaccataacttgagtagtgctgagtttgcataaaaatgtgaaacatgaaggtggtgttgaagtcttgctgttatttcatgctaaattgcgacccagttggtattgtatgacagaaactatgttctttcaaagcttagtgtggttattccaagggtatggaggatatatcgagttgttgacttgtttaaattatgacattattgtatcgtgaaaatctcatggcttgtgatgtcgaggtgttgcttctctgatcccaagatgctgagtttgtttttgttttttgggatttgagaaaatgataatgtgttcttagtctatggtggggtcatttatttgtcacttcgaagacagattttgatgcccgaatagctcttcttgcttctttcttggtcacaaacaaaagacaatttgtcaatttgtgtgttttaggtgtagaaaaaggctagaaagctgtcattgttaagcttgtatagactcttttcttgccaatgaccattcgttttttttccccttacattttgtcctttttgtcgagcgaatcttcaatgttcctaactgaaaacggagtgggctgaagaaaatctcaacaacggctggaggcgatgtaacttgagctatcgaaaaggaatggaactgcgacgaaaccatgtaaataataataatagtgtattgttgttctttggtatattttcacacacactctcttctgtaacttacaaaagaatattcataatcacgtttgaatagctcttagacacaaatgagttgggttataaattagtaattaacaatggcatgttacaaattagactaacaacattgtagcaaatcaagccgattatattttatttaattagtaaaagattaacacaacaaaagaaacctgaaaatagttaagtggagggccccatgaccactaacaaaaacatataagctcttttcgttttgttactctctccattgaattctgtcttgatcactttcgattctctcaaaaaatcccataactttcccaacgaaaaatg

SEQ ID NO: 33452 - DNA, 3003 bp, Unknown
  misc_feature (1)..( 3003): 2750-1469P.txt file - cDNA_ID_3070110; gDNA_ID_1620604; Annot_ID_161725
ccaaattttcaaagtcttaaaagtgccaattccctacattgttgctgatactgtgaagattataaatggttttgttctgcaaacaggtgtttatagcctgtggagtctcaagttctggtggtaaaggtggtaaagatgacctttaccgcaaacccaaggctggaatgtggcaactcatgaagaagcattttaactctggaattgcaattgatatggataagttagttttctccccacctgctcctaaaaacttgaatttacctgaaacttctagcaatgctggaagattacactcatttgtccaccagccttactgattaaacactccgtttaagtccactagcacattttttgttgttgatactgacatctgtgctatgctcatcagatccttctacgttggggatgcagctggaagaaaaatggatcacagcgacgctgacatcaaatttgcacaggtatttattgcaaacgtcagacaatacccatcctttattttataagtcaccctatttacttttctgactttcctcatagacaactactttctttggttgcaggcgagtgggctaaagttttttaccccggaggaatactttatcccctcaagtacatcgccagggacttagctgtatcagtcttgtgcttgtgtttgcagtttgcaacttcttttgcttttttttttgtgatgaaactagtagctagcttttgtgataaaactagtagtgtgcttttgtgatcaaagtattagtatgtgttttaactctttttgtatattactgatatttaagcgtcaactagagcttattgaaccaggaaaaagaaactcctttgaacaggcaggattgcaaagtcaacataacaaaccactgataacaaaaaaagttcaaatttccgactcatttacatacatgggattgggaaagtttaaaatctcttatgatgctaataacatacatcaaaaattcactctccttttcactctttaatcagaagactcagacatgaaatcactccttctgaccaatctcgccttccaaaatggcgtgtcttgtcagaacaatctctttgacaaggtttctgtaaacaaagggcctaacagcagcacggagaaagagctcaggtggaatcctactcttctttatcttcttcatccaccttccatatcctactgtcttccattcttctggcttcacttttgccttcttacctctcatttccaactcatctccttcaatctctcccttttctcgttcctccaatgcctttaactgcttctcataaaacttatctgacaccaccatactcatctccgcaagcttctccatccgctccgcattgtttgtcgctttgttgaattgctcttcccagtacctctcatcctcttccggatccgactcctctatttcatcttccaaactgtcttcttcaacgtttccctccacatcgacaaccatgttatcatcatcatctacttcttccacctcaccatcatcatcatcatcatcatcatcatcatcgtcattgtcagcttcatcttcaatccattctgagaactcagccttctctgagcttccactaatgctaatctcatcctcatcttcatctggagcatcacaccctaactccatctcctccaactttgctttccattcttttgtatacggatgcaacagctcgttcgggtggtttccaagcaagaacttcaacactctggacttcttttcatcactcaacttctcataagcattcaccacatcatccacgaaagctgtctgtctcaccttcaacatcttacacaatcctccgtaataagtactcaactccactctaccttcatcatcctccacttcacacacaaatccagattccgtcaccgggtttaaataagggataagcgagttaaagaaatcttcttgaggctcaaacctacactgaaacacaggcttcttcacatacacaatatcaggtctaaaccaagccgcacattgacatatcaaagaccgagacttgttccctaatctccccatcaaattccacttatccaacctctgcttcttatccgcttccacaaccacttcactaaccaacgtccattgctcccacggtaactcactgagtctccatttcggatgcctgacaaacacccaaaaatacctcaaaccaacattcgaatccaactccttaaccctcttctgaaaagctatattcatctcatgctgctcaatcttctcaaactcttcatgattctccacttcaccaatcatagtaacacactcatcagagatagtaccacgaaccggatcaccaaccacaacaccacgccacgagtaaggtccaaactctccatacttgaaccaatcataaggatgacgcaatctcgggtcatccttatccataaaccgaaccatcctatcgtaaccaagcccaatcatctcaagctcctcctcagtaaacttatccggatgactactgagaatctgactccgactcttgtcagggttattatacaatctataaaacaaagattccgctagcttcttcgacttttcacgagcattcctcttcacctgcttcctcatatccgaatctccttctatccttccaccagatgaacctcctccaagctttttcttgctcctcccggccaatgcccgcacgtctcgccggaatccaccatcttctctgagcaaaagctccgaccttttgacactaaacgcataattcctctcggtaattgccggtaaaaccgaaacgatccttcgtaccccggaattgagtggagatttacggaaggaaaagctagggttcagggttttagaaaaggataaatcttgactcagcatttcttctcccgacacagcttagagatgacgtagcaactgtaataatataagccaaacgatacgacggcgttttgctactgcgccattagtaatcagaaaaagttaaaaaccttgtctttttttttttttttttggttcaatagattgattagcgatg

SEQ ID NO: 33453 - DNA, 3000 bp, Unknown; identical to SEQ ID NO: 2830
  misc_feature (1)..( 3000): 2750-1469P.txt file - cDNA_ID_3070129; gDNA_ID_1620605; Annot_ID_161766

SEQ ID NO: 33454 - DNA, 3003 bp, Unknown
  misc_feature (1)..( 3003): 2750-1469P.txt file - cDNA_ID_3070160; gDNA_ID_1620606; Annot_ID_161795
gaaagagaagaggaatgaaactgaatcagtcattatcactctatgtaaaaagtgtaacgtttttggctggattagtttccaatttgtgaccaataaaacccaaatttcgaagataagagtttgggctcagaaccctttattgcttctgatgctcagaactaatgtacagtaatcttttgcattgtgtagcttttgatagtgaaaaatatttttgaataaaaagcttatctactgtaccattctagcagcagcggttggcaaggaatcgcaaaccaagggttgttccttactgttaagacactctcatatatggaaagcaatgttaaatactgcccttgtccgttgcaacagctggctatctgtttcggcttttgtctgtctttataacattctaaacatttcattgtactcatagttcagcctttaaacagattactttctttcagatttgtttcaatttgggacccatctctcttttagttttgtcaaaacatggttctgtgtggccatggttttcaaagttcttagttttccatgagctcacatcgcagaccttgatttaaagaaaatgcttgataatcacacagtagctgtagcgtgcttaaagcctcgtgaaaccaaaaggtcgacatgcatttaagtttcgtctcttcgttttcctctagaaaggttgatggtaacaaatattaatgcctcgttaatctaaaagttggagacagctatcatcatcatactttcgactctttgtagtcctctctaaaggttgtgacttttgcaattccctttcatgtctatataaagacacgtatgttcagaatgttatctaacacttaccctctttatttcagagatgtcttcttccattgttaaaatcggaatagatagcatcaaaacaacggtaactgaaaaagagcgagatatcaaccgtcttgtgaagacattcttgtccaacaaaaacaacaggaagaagatcattggtcttgataccgaacgggtgcaaaagggaagaaagctaaataagaccgtcttgttgcagctctgcgatggtgacaattgtctaatagtacaacttcccgatgaagatgaagatgaaggtgaaggtgaagatgataatctgccactccccctcttcaattttctcaatctacccgagttcacatttgtgggcattggcataaacaagactatgatgaggcttgagagtgagtttggtttgacctgcaagaatgttgttgagattggacccgccacatggaatctgaccaatatgacgaccgatgtgaaatttaggatcagtgctattgtttcgactgagagaccatcaaatgccgtacttgaggactgggagaaatttgttctcaataagaaccagatcaagcttgcagcctccaatgcatactttgcttttggcattgggaacattttgttggatgttcagattttaagttaatgaatctagatttctgtttgtctttctttgtttttctttcttatgttcttcagtatcttgttgtagtttgcatttcaaccgttttaaagaccacaaaatgtggtatttggttcttcatttttttgttcttgttctctctgttagaccacaaagtgtaatattgggaaagttttgaggttaattagactgccacaataagcgttcaactagctagagtctgaatgattgtagccaccctaaactctgaggtcaaggtaaaggtataatattattactacaccacgtgagctattgaactgggcctgataattaaaagttgattagggcctattagaccacataacgaaatcttgagccgctgctgctagggggctgaaggatgattaattaagtgttcaacttgaagcaatgaaatagcttctgagagaagagagagttatgaaactgaaatgatcatcattttttttcttgggacaaatcagtcatcatctcttaatcttatctatgtaaagtgtaacttttttttgcgggattagtttccaatttgtgattaataaaacccaaattttaactaatgtataagagtttgggcttagaacccaaaataagtgggcctctatgcattgtctacctttagatagtgaaactattttagaataaaatgacaaagtagaactgtacagttttttgatgttttccatgaaaaagaaataagttccatgtattggagagaagagagtcagaaaaaaagagtcaaaaagattcttttgaaagacgggtaaacttcggagttccaagtaattattgcattttcatatacgctctgttcctggattcactaaatcttatttgaatacaaatgcatatgtagcaaatttaatattgtaactatatgtaaaatgttattttacaaaaaaacctccaaagtatttagtttttgcaaacttaccctcctaatccttaaagtacatgacaattgacaactacccaaccaaagaaaaagctgcaatacaaatacaagcctcggttatatcgatcatccaaacatgtgttttctttttattcaaaaacgaaaagcaaggagcattgtttgattgcatgaaaacgaaattaataactcagatggtaaggaagctcgttgttgaccctatagaatacatagaatgcttcaaaaaaaaaaaaattgtaacaagtgtcgttctctatagagaaacaacacaacataaaattcttaaaacgacattgagaaaaggtgtgtattactgttttttccgttggtggttagttaattgtcattcatttttggaatataaacggtaaacttttgcaaaaaggaatattacaaggatttgtattgcaaaaacaaaaacacatcaatagttacttcgataaaagtaaaaatggttgcagagtattattattactcaataggccctagctcagtcacacaggtacatccataatagtgccccattaacttctttcactctcttattgtgtgttgaacagtgacaaagaaagagagagagagctttgctttgcagaaaaaaatg

SEQ ID NO: 33455 - DNA, 3003 bp, Unknown
  misc_feature (1)..( 3003): 2750-1469P.txt file - cDNA_ID_3070171; gDNA_ID_1620606; Annot_ID_161791
gtagcacacttgaaacacaaagcgaagtcgcactcaatgcaattgaatgtttcatttgtggaacaatgtcctaactctttgcaaacacaacatcttcgttcctctcctggtttcgatgttaagaacaaaggatccatatgacttgcatggaccaatggctcggaaattgtggcacactgcacgtgtaccttaaaacgacattctctttcactgcactcatagaagaaaccagttgtgcacctccaagaacaaattgaacatgatttcgtagcatccataacaaggtcagatcttcccactagagtaagcagatgtggatgtactgggtgatgtattttgcgagacagttttgcacattcttcatgaagaatgaaatcacattgcatacatgagtagaagttaccgaaatatatcggagtgatgcatgcttgacacaacttattctcgttgtaatctctgtcaatgttctcatcaagtttcaaatgatgatggtcatgactgaaatgtcgtatgattccatctcttactgtcacaaacggctcaatttttttgatgtcttcttcgggctctccctcgagttctttaccatcccacacattgctctgtgtggcacattttgaatgtgctgcataccaacaaccgtccttgttgcaagaataacccccataatcattatcgatctttctacgacaaacaccacaacatcgaacttcttggtcgaaagaaggagtaaaatggatacgatggaaatgacgagatatccttatgacacgtggtaagctgatacacttttggtggaccacaaagtcgcaagggggacacatataaaatggacagcttgaatgtgtcaaggcacaaacgttgcaagttaaagaagtctttcttggaaattgagcaagtgtatgctcatgccacttcggttggtccaaagacaatactcttgttctctttatgcaagcaatattcatagcataatcgcaagccgagcaataataaaatacctcttcgagatctttatcgcaacaataacattccctggttgtgtccccattcaacaagacaagttggagggaatgttttggatgaagagtatgtttgatcacaactggagccttttcatattctccatggttctcgccattgcaagtttggcagcgaatatgactaacgccttcttcagatatccagattttctcccagttaaaagggagacacttccacttgccattgctgctccacgagacttcttcgtcaatcacttgaaattttccttttttcaattttacttgtacttgagggtaaaggaaaataagccttttccactctgaatacatagagacgacgagtgagaatatttgatagatgagtgatatgagctccggctgtggctcgagactcaatgtttcaccaacgagggaaatgaggtaggaatcgagactcactcttttaaaatagcggaaaaagaggtcgggatctgcctccaggtcgaactctatgtccaggtctgaatctagctccgaaagctttatgtacacatatgtgtccgagttcgaatccatctccaaatgctctatgttcaaatccatctccaaatgctctatgttcgaatatgtgcccgagtttgaatcctgcttcaataactttgtcccggtatctatttcgggatggcaatttcgatataagcctcgtgggactcttagtaaacttccagcagaatgacgcaattccgggtcttgctcccgctttaaaacgctgacagatttgacatgagagatttctccagaaatgagagatatgagcttccttagcggatccggctgggaacccaaatccatagagttgaagagcgagactgcttgagtagtgagtgacatcatttccgtctccggctgcgcatccaaatcaattttactgaccatagatattatttgaggaatgagagatgtcttaatggataaagatattggttgggagattagttgagtaatgagagatatgattttcaacccaagattaatctccggctccggctccggctccggctccggctctggctccaaatcacgaactaactctggctgtggcttccaacagacgacttcgtcaattatttgactgatgagtgatataagctctggcggctccggtgttggactacataattctcgaatgagtaacacgaaaaactccaagtctggctgtgaattcgtgtcctgctccgaaataaattccgtagagttgacgagagagagcttgtgtgaaaagagagctatgagcttccttaacgaatctggctgggaatcaaaatccatagagttgaagacatagattgcttgattagtgagtgacatgagcctcgaccccggttgcgaatcgaaatccattgagctgaccagagagattgtttgagtaatgagtggtatcatcttagaaatagaatcccagtccggatctaaatatgaatccggattcaaacccacgctcagactatatatttgaaagatgagtgatttgagctctgactcgggattcgagttcgactccatagagatgctgagagattttttgagcaacgagagatatgagatgattatttggcttatgtttctaaatgctaatttttatacaaacacatcaaaatatcacgagacattctcaaacttacgggctgtccaactacaaagtcaatgatcaatttggagattagatattaattatcccaatactagtactataatattattacaagagtttagtatacgagtttatgcactacacgttctcttcataaacaaaattgttgaaataatctttccaatatttcagttatttaccaaaagcattgaacggtcgacttttaatttaatggcgccatggactttgtagttggcggatcttccctcattatattatatagatttgaaaaagtttacagccgtacaattttaaaatgtataggtcatctgaaggcagagtcaataatcagtttagatataaaagatg

SEQ ID NO: 33456 - DNA, 2571 bp, Unknown
  misc_feature (1)..( 2571): 2750-1469P.txt file - cDNA_ID_3070175; gDNA_ID_1620606; Annot_ID_161789
ttcctcctaaaagcactaaataacattttattttattttttatttaaaaaaaaaatttaaaaacactgtatttttttgtgcaatgaggatggtctaagaagctgatcaaagaaagatgaaaagaggtacaattattttatatactatctctgtcatgaatcttgcccattataatacattaagagaagcagttctttttattcttttcatgctctacatgttaaggtcagccaatgaaagagcacttgcactttcgaattttgatgaagagaaaacgcatgaacaacgggtctgtctaaactcttgtatgccacaaatatttatctaaagtcttcatcccaagcaaaccatctaatcagtgaagactcttataatcacattaaagttttcttcaaaaaatcatatactggtttttcaagacatcgacatcaaagttagactcaaatttctcacagacatctcagtccagcttggcccaatatcatcaaatcaatgaaatttcagtccagctgagcagatatagttggaaatttattaaattaatgacagagagtttacaaaatttagacccaaatgaaagaagaagatagctagtatacaaaattagttaataaattaaataaatatgtgaaaacacccttagctcactggctaaagggttaaaggtttgtctaatttgtcgttgtaaatgttttaagtgctaagtttccaacattccacgtattatataacataaggattagtcttagtcaggactttagtttggtatcttcgattataaatttttttttttttgtcttgcataactcttagcttacgcaatgcaagtcaatcatctaaatatccaataattgtttactgtattttcttttattatttattatttatttgtaaagtactgtattatttttctgacgttgaccaaaaaccacacaaaaaaatgcttttaacaaagtaattttttatttttattttaaatactttaaacaaagaattgtgaataagactgtaggaattagcaactagctttaaagaaagaagagttatggttttattagcttttctttataacaaactgaaaacgaaatcacaactatcgacaatgactaattgatgagaagaaaagaaacaaaagaaaacaaatttcttcagactttgtattctaccaaacaagaaatctaagccaaaacattcaaagcgatttctcaagcaaaactagaagatgaaggtaagtattatatggtttatgtatgtgtttttatggcttctttgattgacgttacaacatatcatttttttagcaaaagatcttgataagagtgactatgaccgatgacaaaacccgagcaaaagcaatgacaaaagcagttcagtttaaaggtaagaagacctttccacaaaaaagattaccaaactctgttggatctaatggttttataggcgtgtcagccgtggaaataaaaggcgatcacaggaaccagatagaggtaaccggcgttgaagttgatatgatccctcttatccaaatactcagaaagaaggtagcgttcgcagagcttgtgagcgtgaccaaagttgaaccaccaaagaaagaagacgagaagaaaggaggggacggaaagggtgcagagggaaaaggcggtgaccaaaaaggtggcgataagaaagggccagatgacaaggaacctccggagccaaaacctgtgccgtgttatccatggcctctgcagggatacggtgtaccttcctcctttcctcatcaaggatacggtgtgccttccacctttccccagggagacggtgtaccttcctcgtttccatacccgtgccatccggcacatccctacaatgatataggggaacccgtttacaatcacgaacccaattgcaaaatcatgtgaaatgagttttacagaggaagattgatagagagagcatgatgaccaatgtttttttttttattgtaaagaactaaagaagcactatgtttactatttagtcatatgaataaagctctgaggccaccaaatcaatttactgctatctcaacatgctcttttaatctttatgcatttcctagtaaatatttgtatgagcacagcaaaatcactcactattcgaaagattttgcacactgttcaaatgacccgacccaatcttggcccagaatcttctcactcactattcggattttagtttaggtataatcgtaatctttggaattttgaatatgatatcttgacttgtcattgtgcaataatgttctgactcctccagaataatcagcattttgaatactgtgaaatattactaatttaatattaaaatattaccactagatttccgaaaacacccccattactcttgctccgcaacggtaaacgtaacgtactcaaaggggtgttaacgtaatttcaactgaaaaaaactaacggttcccgagaacccatcacatattaagaaagaaaataaaaaagagatctttttcgcttttccacaatcacaagacaaccacaaaactctcactccaaaactctcaattttgccttcctttgatcgaatactacaatg

SEQ ID NO: 33457 - DNA, 3000 bp, Unknown
  misc_feature (1)..( 3000): 2750-1469P.txt file - cDNA_ID_3070191; gDNA_ID_1620607; Annot_ID_161823
agttgttatttttatggcttgaaattgatgttctaggatttgcaatcgccggaaggaaaattcttacgaacgctcatgtggtgatggctatgaatgatcacacattcgtggacgtcaaaagacatggctctcaaatcaaatacaaagcaaaagttcaaaagatttcacatgaatgtgatttggccatcttggagatcgatagtgacgagttttggaagggtatgaatcccttggagcttggagacataccacctctccaagaagttgtgtccgttgttggtaataaatcatatggagacatatcatgcatgtttcctacaatcttataattcatattccaatataccataaaattatgctaaatgatgaaatttttcttatgatttggttagtagaattatattaatgtgctcaaaatgcaggtggtgaaaatatctgcattacaaaaggtctagtacttagagttgaaactagaatatacgattacagtgacagtgatctgctatcaatacagattgatgcaactatcaacgatgaaaatagtggtggcccggtgattatgggaaacaaagtcgttggtgtggtatatgaaatagggtaagttgaaagctaaactgtaaatcttagataatcaatttacatacatttgtatcaagaggtgggggaaactctttaacttttttttttttggggtgtggtttttacatgcagttttgtgatcccaactccaataattaagcatttcataactagtgttcaagagagcagacaatattcttgtttcggctcattggatctttcatatcaatctctcgaaaatgttcaaatccgtaatcatttcaagatgagccatgaaatgacaggaattcttattaacaaaataaactcgtcgtcgggggcttacaaaattttgagaaaagacgacattattcttgcaattgatggtgttccaataggaaatgatgagaaaggtaatgatattggtaatagatattgcttaatggtcttctccatatttacttgtgaagtgagtttctgtttgatgcagttcctttccaaaacaaaagacggatagatttcagctacttggtttctatgaagaaaccaggtgaaaaagccttagttaaagttttacgaaacggaaaagagtatgagtacaatatcagtctaaaaccggtaaatcatcgtctgttatattttataaattgtttggccctgctcgttcacattttgttctgaactactttcttttgtacacaggtgaaaccaaactttacagtgcaacaattttataatgttccaagttactacatatttgggggttttgtttttgtgcctctcactaaaacatatcttgatagtgaacatcaccaagtcaaaatttccgaggtttgcatctttctttgtccacgatactatttgttttttttttctctttaattcaatcatgtttaatttgaatctgagtttggtagaaagaatgaggatatgtagagctactaaagatgctatttttcttaacaataaaagcatgtttagtttaaaaatatgtcttcttttcaatataacatttaggcattgcacttagagagaaattgtttcttggtgtagagattagcagatgacatcaacgaaggataccaaagtttatatggtgctcaggtaatttatttattacttgttcttgagagtttcttggtgaaagctaactgaaacgccattagtttgtctcaactttgaatctaacgataaaaacgatagaaagataaacatggttccaaattttgtgcaattattatgtctaggaaaagatattaatagttgtggtgggaacaggtggagaaagtgaacggagtggaagtaaagaatcttaagcatctatgcgagctaatagaggaatgtagcaccgaagatttgaggctggagtttaaaaatcataaggttttggtcctcaactatgaatctgctaaaaaggcaacgttacaaatcttggaacgtcacaaaataaagtcggtcatatcaaaggacatttgtcttcctatgttgcttgatgatccgttcaaagacaataagatcaaccttcttccttggagtgttcttcctttgatgtttgatttttcctaataaacaaggattgatttcaaaaggagttacatgactagctatcacatggagaatataatgaaagaatgaagaccattcatacgtagaagaagacatcttccaagttaaactaaataaacatatgtgtgttcttatttttctcaacggatatgtgttttaattgaggtttgtaattggtttaagagaaagtgttttcttatcaatggtttttttttttttttatgtttgttgaatcaaagagatttcacgtaaaagttaaaacgtgttatcttaattattagcatgattacttttatctttcttttttatcaaaaaactttttaatgagattgccaaacgtttttttgcatccacgtaaactcctctgaacgtaaacttttccagagtgtatttatgtggacgtcagaaaaacgtattttgcatccacgtaacgaaaatagttcatataaactaaaagtggctatgtcttacagatatgtacacgacgcatgaaattcgtaatgtttcgtagagaaaggggacaagaaaatataattaatcaattattattcaaaacaatttataatcgattttttttttttcttataattaattattactcgaatcaattatattttatcaaaagaataaaattaatttgttcatgacatctgatgggtccattttcactgctaggccctttgtggtggcgtccgatctgaatcgaatccacttggcttaatttatttgaccatttttcgaagtataaatttgaatattcaaactcgatggcttacgttatcccttatataaacacattatcaacctccaaatattttcatcatcaatctttcaatcacaaaaaacaacaacaccaaaaaaaaaacgcacacaatg

SEQ ID NO: 33458 - DNA, 3000 bp, Unknown; identical to SEQ ID NO: 2838
  misc_feature (1)..( 3000): 2750-1469P.txt file - cDNA_ID_3070193; gDNA_ID_1620607; Annot_ID_161822

SEQ ID NO: 33459 - DNA, 3000 bp, Unknown; identical to SEQ ID NO: 2841
  misc_feature (1)..( 3000): 2750-1469P.txt file - cDNA_ID_3070201; gDNA_ID_1620607; Annot_ID_161813

SEQ ID NO: 33460 - DNA, 3000 bp, Unknown; identical to SEQ ID NO: 6160
  misc_feature (1)..( 3000): 2750-1469P.txt file - cDNA_ID_3070205; gDNA_ID_1620852; Annot_ID_51002

SEQ ID NO: 33461 - DNA, 3000 bp, Unknown; identical to SEQ ID NO: 6160
  misc_feature (1)..( 3000): 2750-1469P.txt file - cDNA_ID_3070205; gDNA_ID_1620852; Annot_ID_170346

SEQ ID NO: 33462 - DNA, 3003 bp, Unknown
  misc_feature (1)..( 3003): 2750-1469P.txt file - cDNA_ID_3070205; gDNA_ID_1620607; Annot_ID_161810
gggatgatggtttctatgaagatgtgaggaaggtatatgtaggacaaggtgactccggtgtgtcttttgttaagtttgagtatgctaatcgcaaggagcttgtagctggagttggccatgggaagatgtcaattcttggaacagaggaggtttttgtgctctgttctcgtattgacctaataatgttttcttgagatccaagtttcactggtctttgtattttgtggcagtttgtgctcgattctccaaatgaatacattgtatcggtggagggaagttacgataaattatttggagtggaaggcgagttggtgacgatgcttaggttcaagacaaacaagcgtacctctccaccgtttgggctcgatgcaggcacaacgtttgcgttggagatgaaagatcataagatcgttggattccatggcaaagctggagattttgttcatcaagttggtatccacgtcacccaaatcaccaagtcttaaagctttgtgagctttctcttctattcctagaataaaattaaaaagccatgtctgtttgttactcctcagcttctagttactctcttttaactatgtcttgcttcgtttgtttgttatgtgttatgaagtggtctgcttctttgaataaagcatcgttttgttggaatgtgataaactgataattgtgttatgctatacttggatgcatgaggataaatgaaaactaactattcaactaaaccctaaaacctatacgatcaaaattatagtaaatagtaacacttaatgagactttaaagttgagatgtgtaactagtcaccactcactcatgttagtgattcatgtgtgtgtcagtgtgtgtgtgtgtgtttttatcaaggtcttctcttaagattcataagtgtgaatctggtgggacttaattggtctggtggagtagaacctatgcgggcaatgaggaaggttaaggtaggctaaccgagcccactctctaagtgtttaatttgtaaccttaattcgtaaataaaagctgtttaatttgtaacctttattagataaaattttgtctttttttttgtcaaaagataaaatgttgtcaatcattttaaaaacaaagaaaaaaacttttttggcaagaatttatatatttgcttgtcataaattttccattttgtagtattttgaaaaaaatattttaacgaatggaagcaataactcgacaaaaagagtcaaactaaagtaccttcacatgcaaaacaaaacgtaaatttggtatttttttcccattaaaaaaaatatatatatattcttggccttgtgtgcgaagacgatcgagaacgagaagaacgataagctcaatacgcacgaacgtagatcgaagactggaaaggtatatcttcatcaaaatattcatgattatggttgagtttaattttgtttacgtatttgttttaatttttcaaaagtccactgttggctggctgttgctatcttggaatgattttcatatctcaataactattgtttactctaagttaaattattggggtgctatttatgatgactgatgaagtgatgggaacatgattgcaatattaaaatctcttttttatttatattaattataagtttgtacccacttcattttaaatagataatgccaagacgtaggtatattattactgaatttattttttaataataagtaaatatgcaggtttcaactagaaaggtaacacatcaacaagaaataccaaaaaccactagcttacatattttgatcatataagtattgaataatatagttatagatgatcaaatagttattattaattacttagctagtgtaatttctatcgattgtttcacattcgcaacagataattatataaataaatacatactacatgttaacctttgtttttgttaaataggatgttttcttgattgatgatctagatcaacttttaataatttatacgtaccagctttcattcgatcgtgcgacttcttggaatatcccatggtacatttgcagtcgagctagaaagcttttttgataatttatgaatcatattaagcgtctctcaattagattaatatttagtaccagtgtaaatgatacaattataaatctttttaccaacgaatacagaatttgttttagaaatattcttcgcaaaattttataatatttcataaatcagttataaaaaaaaaaaaagcagttttgaattcagaggaattcgtaaatttccctaagagttattaaaactagttgtgatattttggagtattctttatggctagatccatatgatccggttcttgtatctagattttttttacggaatattgtatgatatatctagtctcctctttggttctaaacttctaattaatcttcggtgatttgaattaaacgttactgtttttaaattatgattaaggctttaaaacatgttcatacaataattaccaaatcttaaccaattagactcttaataaggagaacgtatatatatgttgcaacttgcaactttagccctttacaaataattaatcgtacataatctaattgataaacgattctttaaattttaaaacaatgaattagcttgctgccatcgtttaatgggccaacgccaatataaagacgattagttgagaagttgtgcaagtagaagtatatgaatattttcattatctaaaaaaaaaaatgtatatgaacatgcgtttttcccagtaatgctttttatataaatatgcctcgtggatcacgaaagaataaattattatttcccttattatttcatctagtacgatcaatatcaagaagtcaatataaataaacatacaattcactttaattgatcatagcaccgataacaatctactctctttaaaaggtcttatctctattcttctctattatgtaaaaattggttaatagtagatattaacaatttatttttgcaactacagaaattcgtaagtactatcaagaagcagaagatg

SEQ ID NO: 33463 - DNA, 3003 bp, Unknown
  misc_feature (1)..( 3003): 2750-1469P.txt file - cDNA_ID_3070208; gDNA_ID_1620608; Annot_ID_161840
aagatgatacatactaaaaaaaatcttataagaacccatgaattgtcacaaactggctgatatttctcaagtgtaaagccgactagtcattcaaaattcgaaactatatgtgttaaagtcaccaagcttatcaataattgtcatgaactatgaacaaaatcgaattatatgtgttaaagtcaaattatatctgaagttcttgtattaatcctttgagatatgtagtccaaaagattatctaaaatgatatatatcaatatatgcatagtttagagtgcattaatatatggttggagtaaactaaatgtatatagtaagcgccggcctcattttaaaaatcgcgtatgttctgcactaatcatttttttatttataattacgacaaaagaaaaagaaaaaaataacaataaatcatcaggtttcttgtctcattagataatatatttatggactaatcacagctcacgtaatcaaatttataagcaagttgcaatattctatgaataattaccaattcacccaatagataacctcaaacctctaaggagaaatccaacatatctttggtttatattaattttaatattcttgaaataggccctcgaatctttccttttctttttatagttttgaatttcagtttggtgttctgtgcccaactacagacgtgtgtgtgaaagattctaggggcttaacacaaacggtacgatacatttataaaaagggaaaaaacccaaaaaaaatctcaactaatttttatttggacgtttaatatctaattatttttatttgaaaggtaaatacacgaagtaataaaaccgtgcaatttaatacacaaacaagtaattgttgttattttcatactcacgatctcacaacaaaaataaaatttcaattttacccttaccatctcaattaactattaatttttataatatgatattaaattttataattttgaataaaaaataattttattaatattttagtttatgttaataaatttaatttttattcaaaatcataaaaattaatatcatattatcaaaaaaataatagttaattgagatggtaagggtaaaattggaattttatttttgttgtgagatcgtgaatataaaaataacagcaattaattgtttgtgtattaaattgtacgattttattatttcgtgtatttaccttccaaccaaaaacaattgggtattaaacgtctaaataaaaattaattgaggttttttgggggttttttccctttataaaaataacatagttctttcattctctttttatagaataacactgttctttcttacaacttttgatttacatttttctgtcttttttttctgtcaaaccatagatttccattcattaactttaaagaagggaagttcatacaaattaaagctaagagaatacaagaaaataaaaataaaaatttcatgagttttctaaagaactgtgtacttttaaaagagtttacaagatttaaaaaatctgttgagatcttggcaaattcaaccttgaagacggacttatcgaaatcctcgacttatcgaaatcctcgaccaacgtgtagtcataaacggttctcgcaaacaaagcaaatgaacctttgaaaagatgctctacaggggaggcggacgggtcaaacagttggaataagatatggtaaccatctatcggagaaagggtcataatatcgctccttccacactatcagaggtttgcaaattattcaaacaattgatgttcacatgaatgaacccgataattagcgaatggagagatagagttgaaaaaagctccgctaacccctactctgtagtgacggggtcataatgccagtctttttcactctattggttgtgatagagaatttcagatagggttcatactaaacttaactgttgatctcgacaaaggtaactattagacaaacctaaagaaacggatactctattagcgtgaagttcacgatcagcaaaatcagagctaaagggtgctaaaggaaaataccttgacagaaaattatcgatacttaacacgggcagcaaaactccaagacactttccaagtgagccttaacccaaagcgattcgagatcaaactttcacaattacttttttctcttaaccattattttttaaacaccaagaacatgtcatcaatcagactcaaaaatgctaaacaagattaggataactatggtggaattgtggaagaaacaaactgaacataaaatagtaatggtggttgatataaacaataggcccgatgaaaactacaatagatggaaaataaagggaatatttcattaataaccggactttcggcaaaaatccaactagtccccatttttttgtgtaattttttcttcaatctcttaaaaatacagatcaatcgcacgattattattttttattttgtaggattagcgtatatatttttgggaccctatatttttcttttgtagacaacccttaaaaaaaaaaaagaaaacgcaaacgtcgggtgttttaaaacgagccacatagctttaacttgtgggctatatatatagctttgcacacataagaacgaaacataatgtggcttggcttatctctcagcacaagtgtttcctcttaaactcatccaatagtcctttacgccttcaaatccttcttcattctcccattcacaattccttcatttttaatttttgattcatcctccattttttttttctgaaaaacaagaaaagttcaaaaaaaaaccaaaaaaccaatctcggttttcgtcattgtattcatctttaatggtagaccgtagacacgtattttgaaggtagattttaaataactctgtataatgagaatttcttactttgcgtaattttattgagaatctaatccgatgaatttggtcaatgcaacttatttatctacaatgcagggaattacaaaattttaatactatctcttaccaaaaaattagaaaatagagagaagaaaaatg

SEQ ID NO: 33464 - DNA, 3003 bp, Unknown
  misc_feature (1)..( 3003): 2750-1469P.txt file - cDNA_ID_3070216; gDNA_ID_1620609; Annot_ID_161856
atcatcagtctccaagatttaaactaaatgttctagaacaagataagaatgggaccactaaccagtctaagatctcggtcatccaaatcgcgagtccgaaaaccgatagtcctttcaacataactcatctcattgctcccagacccttttcctttctcattcaaaagatcagcaaaagcaccaccgtactcaattctcatcaatctgactgcagatactgtataggctccacaaacaaaaactgttataagatattgggacaattcaattgcacttaacaatattgatgcaaagacttcaaaagactctttgtactcattaataataattttctaagtactcattaaacgcaacgactctatgtcaacctagatattcagtgtaacactatcactactcaagctagtggtaactaaatcaatggatttactctaccagctctatgtggagaaacttccaaattcagattctgagatttccgcgacggagccaccggacctgaaaaataggaaattttccgagagattgaagacagaaccaggcaaacaacgtcgatactgccattatttttctatttttttaaagaaaccaaaaacagtagagaactattcacctcttctatcaggcgaaaatggttttcgagtcttttgggttcgcttaaacgaccctggagaagctttctgcgtttcagcagacagataaacgcgaaatgagagcaattgcgccatggatgctccactgctggagctagagccaaacctgggaactcttatcgtactttcagaagaaaacactcttttccgccaagagtgttggtttaatgggcctaaaagcccatactttgcagatctcaatttagttcaatttcggcccgtctacttttttttttcctttttttttacatttaacgcaaaggcaaaaacgtaattatctaaaagtcctcttcttccccagttttcctaatttggtaacccttgttgcaggcggctgttgctgatcgggtctctcttctccattttccgattagtaagtgtttattctactcattttgtcaaaatatcacaatgttaatgcaaatttacatatatcaactatcaaaaaggcaatcttttattgaaacgtgttctaagtttgaaaagactaaaactttcactgtgctgctgtaggattaactaggaagtcatgtggttcagaataggcaattcacgtgcaatgacagagataaagtaaaaaaagaaaagtatagaggtacccgtgacctctttcttacacgaacgtgacacgtgagcatgattgtacattagagacgaagctgccctctttcctccttccattacagtgttcttaaggtacaactatgtttctttactttctcttcagggcattgctacttcttaaagttcttcttcccattgacaaacaaagggatcagtgtttttatttcgtcccttcctttgtctgtattcttaagagacaaccaaatcttttttgtttagtaaagtttacgagtgaatggctacttttcataccgttagagatgcggtgaagctctttgacgctggtatttctggaggaaaacatctcaacaaaggacaagaagaggtattgtgccttttgtgtttctttcaccctctgtaacattgtgtgtgttccttggtgtgatataatactgcaatattttctgaaaatttggttattgttgcagggagtgttggtggaggagacaaatctctgtctctggaataaagaggttaacaagttgaaagaaaagataaagaatgctgtgaagaccaagattgaggctttgttagaactggaggaagctaagaaaacggttgagcaactcagtcaggagttgggaattaagcggaacatgattaatgatgagaaagatttagatttgagtagtagtgtaagagttgtgacttcagagctaggtgttgctaaggaatcgattcatagagtagctgaagaggagagtgagctgtgtatgttaatggagtctcttaagctcgagcttcaaaacgtggagaaagcacattcagagcttaaagagattgagcaaagagagagggatcatcaagccattgaagatctgaagaaggaaacaaaagatgcaaaaacccaactctcgttgttagaagaagagctcaagattgctgtttttgaagctcaagaagcaaaagatgcagaggaacacgccagggaacggctaaatgttgcagttttagaatctgatttcagatcattagctgtggtgaaagaaagtgctgctgaagaattaactgagacagaagctttaagagcttgcagagatgaaacactcaagacattagagatgagtgagagagaaattgaagatataaaagctgcaacacaagatgctttgaagaaagctgagatggctcaagaagctacaattgtggtggatgttgagctgaaacgacggcgtaaagcagcgagtaggatcttggcagaatccaaaatgtgtgccaaatctaccaaggaagtgctcaagtcaaaaccaagatcatcgtcaaaagaaggttgcctggtcaagtgttagaagaatcttggtcagagttgtaattgtgaaaatctgtagaacttcaataactagaagaagtgtcactttgttggttgtgttcaaagttggaagatttaataagattgtagtgcgaccatttgtggttttgaatgtatatgtaaacacattcactatcagcattcagcaatcggataactaaacaaaaacaatttgatgatttggagatttggaaatttacagagctaaaagtgaaaaatgccagtgattaataaaagaaaagataattaaggtcggttagtaaaaagacgtaaatataaataaaaggcttgtttttttatttttcactttgttctctctctctctcgtaacacgcctgagagttctcgtcgtccttatctcgatcttggttgattcgctctccgatcggaaattagggcttttgttttctgaagatg

SEQ ID NO: 33465 - DNA, 3000 bp, Unknown
  misc_feature (1)..( 3000): 2750-1469P.txt file - cDNA_ID_3070218; gDNA_ID_1620609; Annot_ID_161848
ttttgtcatatttagttgtataagtaagttcattttaaatataaacgggagtggacatgttctgctgtgtcaaaatcgtatagtctatcactattcgatagatctttcgctcctcaatcgttttcttaaactagttaaccaagaaaatttacgggtttttgtattagtaattacatatactcaatagagtaccaaatcttcattatccattcatttcaactgtctcattcctgcttgtttgatacatgtaacattcagtattaaactcttctttctggtttttttttttttttttttttttttttggtgttttcacgttgatcaattgaattagtcaaatcaaatgttttccttttaataaaaacctctcgaaaggactagagaaaagataaatcacattaaatggaacatgcatgatgctagctagtgtagttgaaccgtttcagaaaacaaaacaaaaagttgttcaaagtgaaaacccaactaagcgatcgactagaagattctcaacaaatttcacagtaactttattttttaatattcaaataaaaatgatcttatggagactagtgatgatgaatatgtaggataggatagtgggggaactgataaaaaaaaagtatggaggtctaaaactaaaagcagagagcagagaatctatatatggagtctttaaagcaaacttatattactttttaaacatatattcgattcttcgttctcgttgataaatattctacaggttgtacatatggattgatggatcatgggattaaatatatgtacacaatacatcattttgacgtaacttataacattgttagaattttgtaatgagtctgaaagtttctacagttatcatcttagggcttactaatagctattatattattgttaagaatacgtaataacattgataaatgcgtatgtacattttacttttaccaaacccatgatcaatttaaagaaatctatacgtactgttcaagcttggaatcatggtaccggatgttctgttggccacggaatcagcaaaagttatcagatcaagaaaattaaacattttaaaaatcaactatagccaagaaatagaaaaaaatggctcaatccatcacatatcatgtttacacgaaagtacatcatctcctaaaagacatatagaattaggaatatccatcatacgtttttctttgacattgaaaattcattatatgcaaaggtatacacgtgtgcatgcacggacagcattattcccccgaaactatcgggtgtagacaacacaccgctaaaaacatgtagtacatcagtctagcctatagaactaataatggagttcgatatgaaatatgtaaacatataattttgtatgtatatgatcatattgtagtttaatcgtatttgacgagtttcatttttgcataatatatacgaggtaacaattttcaagaaaaagtgtaacgcgagagaattacttagatttaaaaaggattccattaaaagagatgcttacagaggctaggaggatgtagaagaagctagaaaacgtaactcgctctctatatgagcaaattgcgtttgattaaacttaaacaaaactgattaattagaaagtactcaaacaaggattaaatgccgtttagcttcgattctaagctcttccttcatctttctgatgaactcgtcgaatttcttattcatctcctcctccgtcgatgtcatcactcctacgttcccttcttcttcctcgtttatagatccgccacgaagaccacactcttcctctccatcattatctgctaatgtgttgtcgtcgtcatcttcttcttcgttgtcctcggtttcttgatgttttgtatcttcctccactgtaacttcctctgcaagaaaggactctgttcctattccatgatcagatttatactctagctccagtatcgtagtgtaactctcgaaatctccataatcaaaggttttatcggtattactccaaattttctctattggtttggacgaagcgaccaaaccagaacacttagcaacaaccactacgagaccattgcagaggaggaacatgtagtttttatctactgcgtgtgttacgagttggatcatgaacctatataaatagaagtcgtggctggttaaaagagataaaatccacatcgaaactgctataaacttggtcaatttcttcagaaactccggttttatttgatccatctctctggtttcttttctttggttttgtgagtgaatggtgaggactagaataagaagaagaagaagaaggaattaaacaggttaaagtgtaattgtgcaaagcgttacactacactcaacggctttggtatttatagaatttaagccaaaggcaatgggcatctgtggatgattttaccaaaccaccccttgttctgaagctgcatggctgcatgccacgtgtgaagtgtgatttcccagttatgtggataaaaaaaagtctctgtgtttcttctattgtttgtttgtcaactaatccatgttttcttatgtcctattattggttacattgcgaaacgacctctggttagtgttccaaaagttccgaatcttttatgacctctgatggaattcggattttttttctttttatatcatcaagctatacatgatgacttagcttttatggtatgttaatggtaaaggaatatgacttttaagtcatgtatagcttgatgatatatataaaaaaaaatactcatgattgagacaaatacaaacggaatagtaagggatgattggtctttgaatagtgtgagggcttgtggacaataatatttagaagatgtcattgtcttttatgtctttgattggtttaagtcattttccttctttaaattgcatggatttggcgacatcattatgttaattgttaggcttcttctacatgtattttgcttttattaaaaaaaaattatacttgaactacgctaacaccttatatttccgtgtgagattatg

SEQ ID NO: 33466 - DNA, 3000 bp, Unknown; identical to SEQ ID NO: 2853
  misc_feature (1)..( 3000): 2750-1469P.txt file - cDNA_ID_3070222; gDNA_ID_1620609; Annot_ID_161847

SEQ ID NO: 33467 - DNA, 3003 bp, Unknown
  misc_feature (1)..( 3003): 2750-1469P.txt file - cDNA_ID_3070247; gDNA_ID_1620610; Annot_ID_161884
caaataggttattgtctaatttgtaacatctttttgctgataaacactattatctgatgatagaaaattgtaactataatccgttttatggattgctgacaaacaaaatccgttttggcatagaaaataaagttattgtacgtattgaatggcaatatgcatatatgtatgtattagttaaactcaccttctcagccccctttatcacgaaatatccaccctgatcaaaggcacaatccccctttttgcagttttctttccctttctcgcttgttttgcaaaggatagatttcaccatgacaggaatgctaccaattagaatgtcctgctttttgacatccagtatcttcttctcgacatagttgtcttgtcctgtcttgaatttgtcgcttttaacaacagtattcttgaacacctagtcaatttatagagtgaagaagcagttagacaataaactacatttataagaataagatacatggacagcaaaacagaaacatcatcaaaagtttgacagtacaagagtcattgcacacaagcataaaacactcaaactaaagcacagtgaggcagtggggaagaactaaataaaaaaaaaagctgaagatgtttttcttttattgcatccaaactttaaaatgaaacaaactaaagcttatttcgtttgaatacccaccactacaaggaaaagtaatcacaattcaaattttaaacaagaaacatctaaagattgggagcagacaaaatcatcaatcttaaacacaaccaagcttgaaatacacctctacttcacacgaacatgtaactgtaataaatctcttttactagatattttgctcaggtaagaaatccagcgaatgcaaataaggaaccaaatccaattacagaaaacttgtaaagccaaaaagagtgaaaccagtttcagacaaatatgttccttaacccttagtaaattatttgatggcaagttaaattgagaaatctatgacaggaacctcagtgtatgtcaacatcttcatatatgtgtcagaaagagtctagtagaaacatcaagaaataagcttataccatgtgttctttatcattcatcaaatccagacaaggttacttaatttcgacaaagaatttctgttacctcaacttggacattgactttgatccttgcagagtatgtcatgttctgaagcctagcatgccatgggagaaactcaagctccttgtcatccgaaaagaaagtaggcttctccacagtgacttctccgaacttcaccgttgcgtatctccaatcattatccttcttctttacaacatcaaaagacggttccacaagcatctcaccaaaggattgaaacacattctgaagcccgtgttcaatgaagtagttgtaggagttgagctgatgacttataagtccatacttatcaaagaaagaagttgcagcttttttgcagaaactctgcagaaaaccttctcctagctcagatagattgatctccccagtagtagcctcgaactcttcaagatccttcacatcaatgtccatatctggcatacctcaaaacacactgtacgaacaaaaaccctaaacaaagacagagaaattgattaaaaagctgtgaaaatcatgaaccacgaaaatgcaatcatgcgaatacaaacacgaaatcaacaactttcccttagaaccgaatcattctccataacatattctccgatgcttaaaagcagaatcaaagcgtattacctaaaataggtaccttgattgcttaaagctggcacgatggagtaaaacggcggtgtcggaggagtgcagagtaaacgtcgccggaaaatcgctgagaatgcggagagattcgacgtagaaaacccttggcacactttttcagtggttaagcgaagcagtcaaagagaagtgaagaaattgacgtcactagtactagtagacaatattattaaattttgctctttggtatctatatttttatgtttaagttttattttatttttattttaaagtgaaaaggaaatatatttagaagttcacatgacataaaatttgtaacatctttttttttttccaaaatttgtaacatctacattttggtttttacatctaattcgatttggttgtttggtttaataaatttcatatataacttaattttgaccaaaacacaaagaaaaaaaacaacacataattcactaaaaaagctcagagcaatcccaatggtttaaaatcaattaatttttaattttggatcttaagcttattttaaattaaaatgttgtttttactaagttaagaaaagttaggaagaagtttaaccaatttctacttcaatggttaagaacgattagaattttaagaaacaacaaactatttcaacacaatgtctacccactcaaaacacaacacatatgcttttcttagttttaagaaaatatcttaataaagatgtttttgtttaaccaaaaaaaataaaataaagatgtttttttttttggtgagtgacggagaggcttaataaagatgtttatcttagctaaagtttattggtttcattaaatttaatcacttttatacctaaaaattagctaagatacaaagttggggttgctcctacagtttagaaataatcatcaaatagttaccaaatttgggacatcataattatgggtagtttgatttattaggttaaatctgatctaattatagaaatataatatataagtaaataaaaagttattatataagtgtaagtattgagctctgttttttgttttattatctctgagagtctgaagaagccatgcttctgtagcggtgccaaccaacttggaactgatctttcctgtgaaaaatcgtaatcatgacatcgacctactttctcgtctctttctttctacctttctttgcttcttcatctttctctctttctcctctcatatattctctctatgcaagcaacttcatcacgataacctcttatctcctcagccatg

SEQ ID NO: 33468 - DNA, 3000 bp, Unknown; identical to SEQ ID NO: 2857
  misc_feature (1)..( 3000): 2750-1469P.txt file - cDNA_ID_3070251; gDNA_ID_1620610; Annot_ID_161883

SEQ ID NO: 33469 - DNA, 3003 bp, Unknown
  misc_feature (1)..( 3003): 2750-1469P.txt file - cDNA_ID_3070259; gDNA_ID_1620610; Annot_ID_161878
tgtattaatatttagcctactaactttctgacaaatttaggatcaattatgggattgacacattaaagtttatgtttttgtgaatataggaacatctcacagtacttacaaatttaagtacttctatctcttctctttttaccatattaacctttatattgttggaaaaaaaaatcaagcagaaacgtcgattttttctctccttatgctttcttcattcttccttcttcaagatcttgggtcttgagatgcgatgaagatgatttaggatttgctcatgattcacaattagattgcttttagttattgcgtacatgattgttttgaataaattttcagttattcacaatcaatgaatttgtgtctataattaaagccattgggttgcctaaacatcatcccttagggtttagatatcttgcatcaaatcttatttaattaattccattggattcatcgaaaaagagtcatagaaacgttgtgtgaatcaacggaggaaaaggaaacgatattgatggagtcaaaagtaatgattttgattgagtgtggagtccatgttaataaacaaatttgattatcacgacggagaggattgcagaaggtggagacagtgaggattgttgttctcacgacggagaagacgaattgatttctcatcaacacatttgagggcaaaatcgtcatttctcgaatcaagaagtacccaggcttataagtccaagtagaatgtgtttttcttcaaatttttggatccaaatatacccatatgtacaaaagccccgacaatgtatcagtgtttttatttttcatcatgtgcacaaaaaagaagagcaaatgctaatttatagtgagtaacaatgagatgaaaactaataatgataaatctggttacagatttaattcattattgtgagcaaaggtgcccacttgtagttaattttgtttaaacaggaataattagtgaatactataatgagtatattccctaaaaggtgaagggtttgtaatcttcttatgatggattagtaacagcagcatctcgtttgtatattaaaagtattttcgatagatcaagaaagattaagcacttgtcatccacccacaactcgatctaatttttttcatttaacatttctggatcatgtttttgagatttgatctattaatattagtgtttataagatgccagcgaagtagaaccaaatgtgaagattatacagtattagaaattactgaggtaatactgtttatatttgtgtaaacttgctatacaagtctctccaaacgaccaagcctatattaattaggacttgatcgacgtacctacgttccaatactataaaacctaataaaattaaaggaaggttttcatatcccagttaaaacattttacgtttgatcgaacatgaaaacaaaaaatcgcctcaaaaaccctatttatggattagagtctcgtgttttcgaagagttgcgttttttttttttttaattttctttggttcaaagaaaggaagagtttcgtttagaatttgaattttagcatgtacttactattcaataaaagaggtgagaattaatggagagaaacacgtgacctgaaacaggtatgatcgagagatgtcacaagtgtatttgtacttgaaaataaaataaaatggacagctaaaattgtgatttcttaaaattactagctacgaacctttctttttcattaaaccacaaagtacgttttctccttttcgtatatcttgttaagttcaaaaatccaaatgctttgatctaaaaaaaaaatattaattctaaactcttcaatcaattatggaaaaaaaaagaggctcaaacgaaattcgcaattcgaaactgtcacatgtgtattcgttatttcgatatagaaacctcaacttgaatataatagtttgtttgtttgcttgaagttaatctctctcttttttatcagctaaagctgcatttataaaaattctagtttaacttttaccatttgctataatttagagattttaacaagaaatctggcctagtccgcaaaacttatagaataaatcaaacattcttcaatattttacacatccacaatacccaatccaagaaatggattgcagttgcaccagagattacatgtctcgttttagtttgctagtcactcaaactcacaaagcataaattgtaatagaaaatagaactttatttaaatctgaagaaagatatatataaaaaaaaaaaaaaaagaagaagcaggctccagttttgatgggagaagaaaagagagctggcaacagctattcactgatagaccgatcactctcttctgtcccgcactcttttcttcttttgtttctttcttttcgacagctttcatttttcctccatttttaaatttgaattattttacagtcataaaagtacttcaaacgtatatgtaaataacgagcaacaaaacaattaactacaacaaaactagttctagctaagagaattagttagaaatttttattataatagttagtatatgtttattcataacacaattaattaacacacaaaatacatgtaatttcctctataccctcttcacatataattagagtagtgctttaatttaagattaattatcgatttacatcattaatgatcatctagtcttacacagagagtttcagtatctgcatgagattatataaaggaatgtattcatgtttttacttctttttattcatggttaaggatgatacattataattataaatccataatctatgaactcaactattctttataaaaaaggaattaaattctgaaaataaacaactgtagttggcttcccaaggctgctgcttcacctataaataccctatcctctttgaaaactcatctcacatcacaattcacatctcctcgaacaaacaaattataaacccattttccttcataaatttctaaaataaaaccccttaaactttcattcacatcatccaacccccaatg

SEQ ID NO: 33470 - DNA, 3000 bp, Unknown; identical to SEQ ID NO: 2869
  misc_feature (1)..( 3000): 2750-1469P.txt file - cDNA_ID_3070286; gDNA_ID_1620611; Annot_ID_161918

SEQ ID NO: 33471 - DNA, 3000 bp, Unknown; identical to SEQ ID NO: 2866
  misc_feature (1)..( 3000): 2750-1469P.txt file - cDNA_ID_3070290; gDNA_ID_1620611; Annot_ID_161917

SEQ ID NO: 33472 - DNA, 3003 bp, Unknown
  misc_feature (1)..( 3003): 2750-1469P.txt file - cDNA_ID_3070294; gDNA_ID_1620611; Annot_ID_161914
acgtcagcggaggcgctgatgacgtcatacccagatgggtttgggtttcgtggaccgttgttattgttactgccgttaccgttagtatcctttggatttggaatttgtgggtactgttttttcaggaaagatattccaaatttaccaaaaaggttaggtaaaaatatatttacagtttccatattcgagattttgttatctaatttgagcgtaaattaatatctccgaataaattatgttcatggatttggttgcatatatataaaaattgtccgggacaaatttttaaaaaaattatatcttagattccaaaataaagtctcaaaataattaacatatagtcaatcaaagtttttatatgctattagagttgtttaatagtaaaaaaacaaaaaaactttggttgactctgtcaagaataaaatgagatttgttctctaattttagcgtaaaataataaatctgaattaatcatatcccattatctctggacttggagctatatgatcagtactatcattgaatttagacacaaattggttataagggtgttcgtttaatatagtttggtattcggtttttacaaaataaatttgaaaatccgagacaaattggatattcaaaataattgacagatcgtaaggtttatttttattgaagatagaatacttttaattattattgtgagtcggtcttaggttgttgagacgaaagttaattataagaatgtttgtcacaacccattactaagtctaaagcatagaaaacttgggatgactaaacttggggtgacttgtacaatatcaaaaatcgagatcattgcctcggacaataataaattccacaaaagtacgagtgactagtgtccacgagactagtggttgaaaattaggacttgaattcattccctctagaagtttatacaaatttcagaccaactttttaattaacactttttttcatttattttttcttgagcaaaataagagaggaagtaagatagattaaaatttaaacaaccacaagataaacatgctttaagattctagttaagagatggataattgaacgaatccaaaccaattggaggggaatggtctgttagatttcacatgttagaggttcctccatgaagtctagagttagactctttcgaaatctcacaaaatgtagcttgaaggatgagtttgacatcaacaatctgttggtccaatagtaaatctcccagatggaggtgttgagttcaaagcatgttgggagggattttttctcctaaaaagatgaatttaacttggtgtaggtctcgccaggctgacctcgcccatatttacaaattacaatatcatcaaaacccgaaggagtaaacaaagagtggtgattaaagaatgaagtgtcattttaaatagctcccacttgtttttctctcgatctcaatctgacagaaactgatatattccactgatcttcatcgattcatcaaagttttagattttaattcagatttcatcttaagggagggtattacgagtataggaatgtgattatcatattaatgaaagttgaggttttaaaaatagcttaaccaaacaaatgtaatcttgccaaaaagatataaaatgagtccatcaacaaaatttatcggagttacaagatcatcagattccgaaaagcttttctgtttatgcgagcggtaatagtgttttttgatgtctccgtcgatttctttgaaggtggccaaaggcgaaacggagacactattgtgcaacaagttgttcatttgtttccaaacatggtaagctgtagcatgagcaactcctactaatttccaaagaattgtgggagcagtctctgtttttagcttagtccaagccagaattgaaatccaagtaataaagatataaggcgatatcgttaatcctcttctggtgttttctgtatgtaaaacggcgtctttcttttgattcgaaacggaggagtttgtgaagggtaacaagacggaatggttctttatatctgggaggaccaagatggggaaatgtggaaaaagaatgaatcgtagagacaatggaggatactggagggtagtatcatctctgccaagaagattcatgctggagaagcaggccttgtcggctacaaatactcactagagtactacattggaaaacaaccaaaatggcgtaaaagagggttggttgatgcatgaacactggcttaagtcttctgatgatattaataactacgagctggtaagagtatatatgtacgtttacttacttggtttccaagttattgagactcttgagttttggtttttattgtgacgacttctgttgttttgtttgagtagggcaattatgctatgtgcaagatctatctgagtccacacgcagcaaagaagaagaaaacacacgatgaagagatcgacgatttagttcaatttgtggaagcagccttagatgtttctttttatctacttttgctgtccaaagtcagaggtctcattgtctttatatagaatttcttgtatataacattttccactggttgtatagaaaaatcaattttagtcttttgtgcttattcactctaatcaaaatctctaatcaaggtgaaggaggaggtggaggaagaacattttcatcttgctctctaagaagatccaaaatctctgcagggttgttatcaacacgctcttcgtctctgtcttcctctccggatttagtttcgtttatgggcaaataatcaaattcgggtttaatcttccaaaccgttgtttccttttatattacatcatttccttttccttttttattattgggccgaagtagtttatattattaatgggctttaaacaagcccatattcaataattgtcggccaaaaaaaaccctctcttccaagttccaaaatcatttcataaaccctaacaaacccctaaatctttcctttctcaattctctccttcgaagcttttttcttgtgaggtcagaaaagaaaatg

SEQ ID NO: 33473 - DNA, 3000 bp, Unknown; identical to SEQ ID NO: 2872
  misc_feature (1)..( 3000): 2750-1469P.txt file - cDNA_ID_3070298; gDNA_ID_1620611; Annot_ID_161904

SEQ ID NO: 33474 - DNA, 3000 bp, Unknown; identical to SEQ ID NO: 2865
  misc_feature (1)..( 3000): 2750-1469P.txt file - cDNA_ID_3070306; gDNA_ID_1620611; Annot_ID_161895

SEQ ID NO: 33475 - DNA, 999 bp, Unknown; identical to SEQ ID NO: 2878
  misc_feature (1)..( 999): 2750-1469P.txt file - cDNA_ID_3070329; gDNA_ID_1620612; Annot_ID_161953

SEQ ID NO: 33476 - DNA, 3000 bp, Unknown; identical to SEQ ID NO: 2876
  misc_feature (1)..( 3000): 2750-1469P.txt file - cDNA_ID_3070333; gDNA_ID_1620612; Annot_ID_161951

SEQ ID NO: 33477 - DNA, 3000 bp, Unknown; identical to SEQ ID NO: 2882
  misc_feature (1)..( 3000): 2750-1469P.txt file - cDNA_ID_3070341; gDNA_ID_1620612; Annot_ID_161949

SEQ ID NO: 33478 - DNA, 3000 bp, Unknown
  misc_feature (1)..( 3000): 2750-1469P.txt file - cDNA_ID_3070356; gDNA_ID_1620612; Annot_ID_161945
acagcacatgctccatgatgcgctctcgggtaaacaacacttaggcctttgtatatagatgaatgtctgtccgagacaatcattaaatcgtcactgtctggaacaatctcagctaacttttcaaaaaaccatgcccaagaagcatcggtctcaccatcaacaacaccaaaagctattgggaatatttggaagttcccatcttgggcacatgcaataaggagacatcctttgtaaggtccgactagctgcgttccatctaccacaactaccttcctcatatatatcagacctttgatagaagcgccaagagagacaaagacatacttgaagcgctgcttaccatcatcttctggtgtatagtgtaggtgtgttattgtacccggattagctaattggagaagatacagataggtcggcaaaaacctgtaatttgctatctcatccccccgtacattttccactgcaacctcttttgctctccaagcggtagaatacaaaatacgcacattcagatcatttaggagcagctgtggtaagtcgacagctcgcggctcaccctgcgtagaactgtatctgctcctcacaacttctccgaggagcttataattagcatgtttattgtagttcttccgagagtcgatgttacacgtatgtgtcgtagcatacgaagtgattttgaaactttctgaatccttcacgacgcgagcagtcaattgccattgacaagtctcatcaacgcacaccatcttcaatgttttaggacatgacttaggttgcttgaagcaaaagcattgctttatcgcttgaagagacattgtttgttgcaggacttttctattcttaaaaacacttccaacaaacaaagtttcgcctgtggtgctgatttcaacctgtgtctcatcagctcgaaaattgagtaagtcatcgaacacaggagcagcatcgttaccgagattcgccaactcgccaccatgtaacttaggaaattcattatacacttggtaggcctcagctgcggtaactaccccattatcattttgtgtcccagttgaggaagctccaataccttcgatcacttcatccccggtgacttcgtctatacaaataagattggaatccctttgcccttcgcagcgtgtaccgtaacccaatggagagattgtttcttcgccaggtacactaagaccagtgtacgtacacgtttccaagagacgactgaattcccctgtatctccgccaggtacactaacacccgtgtacgtacacgtttccaataaacgactgaatttccctggatgttgagcagtctgttgagtgagactgacgtcttcctcaagatttccttgtacatattcttctactattacatcgttcctcttgttgtaatcgtattcttcgccaataccttcactaccgtctgtggtaggatacagggtacttcccccaatagatccatccacaccaagataatcatcacacccatcatcatcttcgttgccctcctccaattcatcctcttctgttgtatcgtcttcaacatcggcttgctcctctgcatcctcattattttcatcaacatttgtagcactgtcaaacacacggtcactttcagaaacttcaccatgagacctagagacagtattcccgaacgccttcactgtattattgaaagagacgaacaagttgagagaaagatacccaccacgaaccaaaaaaaacgtctcgagacccatctgactgtcaatgtatacaggagggcgtttagtatctatcagcactgacatttcacccggcatccagtagctaattatgggattgatctcggtggacttcaaactgaaagcctctcggagtgtacggacaaagtccgtgtacgtcatggtttcctgaacgcgtacacaacgaccaaagatgccttcctcaggttcaaatttccattctccttctttgcatttccactcaccgaccatggtaaatacgggaatatccgtaacccacctgcatcataaattcaggagacacacattaaatgcaactgaaaaatactatacatataaaaaacaaatggaatgtcgatactacacatttataaacctaaataccaattatcatttgactattttaaacaaacaaatatagattttgcaaatattctgataaaaaaatggagttcgaacacaatcaagatcctaatatgacataaaaaaaacttcttaaaagaacttcattacttacacgagcaatgctccaaacttggtacaaaaacaagatcaacacttcttcagcagcaatgtacgttcgcaataattctttgttcctgggttcatcttctttatctcaacaaattttttttttattattattaataatttttttaatattatttgatgtaatgatgattttgcattaattgtgacaatagtcacatctaaactttttgggggcattaaatgttgatgtcacttcggaataatctcacttgtaacggaaccgaatcgcgtcaacgtgaacaaaaaatcttcaactgaaccggaacagtgtacgtaactaaacctgctaaactaaaccgtacatttcaacagttgctaagagagaagcgcaagggcagaagcgttattttgcaggcgaaaagacaaatggtgaaaaccacatttgactttgacaatccatggaaataaaacatggtcaacggatgtggcctgcaatttacccttaaacaaaactctgttattggtcactattgggctttttgtattgagccgaacgacatatctccagattagtggacccttaaactgacacagagtacttttggtggttggaagaaaacaaagtcacagatgtttggtttctccgacaaacgtggaattaggaatcacagtgatgatcaagagtttatctctggcttctgctcgcatcttcttctctagaacctctccatcttttcttattcccttctcaaagctctctgtatctcatcgtcggaaattctcagtaatg

SEQ ID NO: 33479 - DNA, 3000 bp, Unknown; identical to SEQ ID NO: 2880
  misc_feature (1)..( 3000): 2750-1469P.txt file - cDNA_ID_3070360; gDNA_ID_1620612; Annot_ID_161943

SEQ ID NO: 33480 - DNA, 3000 bp, Unknown; identical to SEQ ID NO: 2879
  misc_feature (1)..( 3000): 2750-1469P.txt file - cDNA_ID_3070368; gDNA_ID_1620612; Annot_ID_161940

SEQ ID NO: 33481 - DNA, 375 bp, Unknown; identical to SEQ ID NO: 2886
  misc_feature (1)..( 375): 2750-1469P.txt file - cDNA_ID_3070398; gDNA_ID_1620613; Annot_ID_161988

SEQ ID NO: 33482 - DNA, 3003 bp, Unknown
  misc_feature (1)..( 3003): 2750-1469P.txt file - cDNA_ID_3070413; gDNA_ID_1620613; Annot_ID_161973
ttggtgactggactatagtgttgtaagatgaatgaagttataataataacgaagcttgctttttgttgttctgttagtactcgttcattcattctctattaagacactcaaaatctcataccactctttatttttctcaaacctcacactctctattattttctacgttgcttgatattgtaacttcttactcttgtattgtatgttatggggatgattgctctcgtttattctctctcaatctatgttctacagagagtctgcagcccacttttgttgacaaaaggagaaaccaacacatcttattttcaataataaacactatttaatttttcaacaaaaaaacactcctttgactaagaattagtgaattaccacatgtgatgcaattctagaatacgtggtaacagagattatttacactatgttttatctacctttccggctttgagcaacaattgcaacaacgatgatgaccgttgagttccaaaactggttccttttcatatattaaggagagaatcatatctttgattattttattcgaaatcttatacaagctggtgcactacgtgtctctcatgtctcaacccatgatcagttagcagacgcattgacgaaaccactaccacgtaccagttttcaagctgcatgttccaagattggagtgacaagagtccctccatcttgagggagcgtattaaggagagaatcatatctttgattattccaatcatacctttgatttctcatatcattcgattactacaatcatggacttatttatgtatagtacatattctgatttatgtctattgtaataccctagctagcatctcctctgtatataagttctcactctgttttaataaaaagatatcacttctacaaactcttatatcatactcctctgcttcttgtcactcttttgttactctctcttcttcaagaaacaaaaggactcacaagtgcttccgagccctccggctcttccgatcattggccatctccaccatgtactcttttcttcagcttacaagtctttacaaaaactctcatccaagtacggacctctcctatatctccgtatcttcaacttccctgtagtcctcgtctcctcggcctcagtggcatatgagatcttcaaggcccatgacctgagcatctcctctcgcgagaaccctccaatcgacgagtccctcttgcttggatcttccgtctttgtcagggccccttatggagatcattttaggtttatgaagaagctcttggttacaaagcttttaggaccacatgcactcgagaggtcacgaggcatccgtgcagatgagctagagcggctttacagaagtctttttgataaagctgtgaagaaggagagtgttgagattggtaaggaagcaacgaagctcagtatcaacagcatatctgcaagatgagcatggggaggagtttttcagaggagagtggtgaggctgagagactaaggggattggttactgatttagatggcttgacaaagaattttttgttggcaaacatattccgctggccgcttgagaagctcggaatctcactgttcaaaaaggagatagtgtgtgtttcaaatatctttgacaagttgctggagaagattcttgtggaacatgaagagcatcgaggaatccacttgacaatggctcatcctcttaagtgcactccagttgctcgatccttaaaccctttaatatcttatctgtaaaatcgatgtttgaatcaaagttggtgtctggactaataataaggacgattgcgctctgttgttctgtaacttactagttcattcatcttattcaggttcccggtttattagctttatatttggtttactgtggtatgattttttctctcgtttatatttgttgaattgtgttaaccaatggactcccgaagctttggtttagtttcccgattaagcattttaggtttggttttccttaagaaaccgtaaacactgtttattgtgttttgtcttgtttaggaattagaacggttgaatttcagatttcgagattcaaatgcgattattgaaggtgatgtccagaaagcaaacaaatttcgtcggtgtagggtttggtttgtagaagttttgtgtcaaaatgtattttttttttttttttttttttaccaatttcgagtgacggaggaggaaaataagatttgggcttcgaagttcagtgaactaagtgtgattttgggagaaaatggagtaaattatccctgcaagaaatccatcggtgagtaaactactatgttgatgaatcgcattgtgttagtgatgattgcatctcttgagtcaatcaagattgattatttattgagatatgttcgtcttttctttgccttttttttgactttatatggcttctcatcaaaattacttaaacatgtctttgtaaccaaatcgttgccaatataactactttcaggtgctaatgatttttctctggaatttcattgactcttcaaactttgaaaatggttagggaatcctcaaatttgtgggagaaatataatacaatcgttgcaaagaatcatatagcaagattctttatttctctacatattttgtagtttacactttacataaccacacagacttacctggtttaggaagaatatacttctttttgaggttttgcttcgctgattagattgtttatcatgttgtgtagtaaacaggttttcaaagaggaaaaagaagaaggttatgaggaacattacttatactgtgagtcaatcttgaatccttctgtttagttgcattattagcttgagaggttatgaactctatatttattattattatcgcttagatcacgagtgtctcttatctgagtttatcttatttcaaaaacaaggttctagttctccaatatttcaccttttttccaaagaaaagcattttttaaaacggatccctgattatgtttcatacttcttcttcactttggagcaacaatg

SEQ ID NO: 33483 - DNA, 3003 bp, Unknown
  misc_feature (1)..( 3003): 2750-1469P.txt file - cDNA_ID_3070421; gDNA_ID_1620613; Annot_ID_161971
ctccgactcttcccatcattggtcatcttcaccttcttctctctgttctagtccacagatctttacagacactctccaccaagtatgggtctattctctatcttcgcgtcttcagtttccctgtagccctcgtctcctcagcatctattgcttatgagatcttcagggaacacgacgtgaacatctcgtctcgtggtttccctcctaccgatgattccctttttgctggatctttcagcttcacctctgctccctatggagattactggaagttcatgaagaagctcctggtcacgaacttgcttggaccccaggcactcgagcggtcacgaggattccgtgcagatgagctagatctgttttacgagaacctgttggataaagcgatgaagaaggagagcgtggatatctgtgtggaggcgttgaagctcagtaacaacagcatctgcaagatgatcatggggaggagttgttcagaggagaatggtgaggcagagagagttagggctttggctacccagttagatggcttgacgaagaagatcttattggcgaacatgttgcgtgcggggtttaaaaagcttgttgtctcactgtttagaaaggaaatgatggatgtttccagcagatttgatgagctgctcgaaaggatccttgtggaacatgaagataaactggacatgcatcatcaaggtacagacttagtggacgcgttgttggcagcttgtcgggacaaaaatgcagagtataagatctctaggaaccatatcaagtcgtttttcgcggtaaatgttcctcccataaggtggtttcattgagaatgcataacttttttgcctaagaaaaaacgttttgcaactgcaggatctcttatttgcaagcactgacacctttgtgcaaacaacacagtggacagtggcggagatcattaataaccctaatgttcttgagagattgagaggagaaatcgattccgtggtcgggaaagcaaggttgattcaagaaactgatttgccaaacctcccttatttgcaagcggtggtcaaggaagggctaagactgcatccgccggggcctctctttgcaaggttctcccaagaagggtgtaggatcggagggttctatgtaccggagaaaacaacattaatgattaatgcttatgctgtgatgagagattctgattcttgggaagatcctgatgagtttaaaccagagaggtttctagcttcgtcaagatcagagcaggaaaaggagagaagagagcaagcaattaagtacattgctttcggaagcggacgaagaagctgtcctggagaaaatctagcatatatctttttaggaactgcaattggagtgatggtacagggatttgagtggagaatcaaagaagagaaagttaacatggaagaggctaatgtaggactgagcttgaccatggcttatcctcttaaggtcactcctgttcctcgaaccctagtccccttaactcagaatccactgaaccggagttcatgaatctttggtaagtaattaggtagccttgtttttacgttaccgtgtctgagtttactggtttagtttggctaatgtgtgaaaccgtaaacaattgtgttgttattcggatttatttgtggattggttcatatatggggttatcttgaaagcagcaaactttagcttcttcatgttacttggttcaatggatttgaaggatgccagttggagtagcatagaaataaacattatattgcaatcacatgagtttcttttgcgaaccattcatgtttcagggaagggagggaaaacttaagatcttgcagtagatttgagaaatgttttggtctttatatttgtcctctccacctatgatatgctactcatgtgtggtttctgtgactttgattgaatttatgacccgaaaggaagaaaatttcagttgtgtagggtttttgtaatttagatattaaagctctttacggagatttctgcagtaattattcttcttttaatgcgctttcaagtagtgatgtttgcggcttcttggctccctggatttacaacgttttcctggcaaactcatcaaatttcttcaaaccaatgctcgcatattcatcagaacaagctcctcgacatcaacgcactctcacaactcacaagctccaagctagccttcaatatcttcattcaaccataatctcacttggtaaatatctctctttcagtaattcctctttctttttcatgggtactacattacaaaaatcagacaaaactttcacggattcctctttctttttcatgggaactacattacaaaaatctgacaaaactgatagaatattaaattcacttgtcgtaagatgtgagttattagcaaaatttcacggagttccaataaagaaaaacatttcttgatctagtaaacaaaacatggccatacattagattcattgattcttgataagagaaattgtatctaatggcaaagatatcttgatgattttaaatgctattttcttaagaaaattttcaaatatgatatgaaaccaaagatcacatacaatctaattttagtggttaaaaaaacaaaatcaaattaaccaatttaaacaacaatttataatgattgtggtcctcagtttacaaacttttccaaattgagtaaggctattacattttggtaacaaagggggcacggcacctcaactttccaagaaatttgtatttttatgtgctattcaaacactacattacggattcctctttctttttcatgggaactacattacaaaaatccgacaaaactgatagaattattaaattcacttgtcgtaagatgtgagttattaccaaaatttcacggagttccaataaagaaaaacatttcttgatctagtaaacaaaacatggccatacattagattcattgattcttggtaagagaaattgtacatttatatgtcatttgcctcgtcttcactttgagtaacaatggcagcaatg

SEQ ID NO: 33484 - DNA, 3000 bp, Unknown
  misc_feature (1)..( 3000): 2750-1469P.txt file - cDNA_ID_3070425; gDNA_ID_1620613; Annot_ID_161966
gttccccaaaaatctcattatcttattcgctataaagccatccttaggtttcttgaagaagagatagcaacagagaagtgagaagagacataagaggatgaagatgaaggagttttgagcgtcaacggtgatatcattgttttttttggtaggttgatgaaacaagaggaatccgtagtcaataatcaatcaggattgtttataacagaggaaatttgtactaagttcccagcgaaactctcgtgaccttcatggcatgtacaattatggtcacaagtgtggaccaaaatagatcttttcatcaaaaaaaaaaatgtgtgaatccaatggataacttggttttcatattcttataattaagaacttaaaattaaataaaaagatagaagaaaaatagtgctttgagaagaagaaaaaaaccgttgccctagaattaaaatccacttctcagtgtcataggcgtcgtcggtttgggaattttataaagttggtctcttttgaattcatcagtttcgtcattctccttcaaatctggaaaccaaagcgagtgtgttttgctctcttgaatcgaatttgtaagctcgtcgattttgcttctttccgggtcgggtaatcaatttgatttgattcttcactcttctacagtgagcagaaaatggaagctctctacgccaagctctacgacaaatacaccaaactccaggttttctgcaacatcttccgtttaattttcttgtcaatttctgagggtttctccggaatttcgcttttctgggttcgattttgatttcgatctccttttttttcagaagaagaaatattccgaatacgatgagattaataaggaacaagaagagaaattccttacctttgtttcaggtaccaatttcgaaagattcgttctttgagtttgagttcctttgttccatacttgaattttagatatctctagttaggtttgatttcacattgcaattacaaacacttggaatcgagaattataacaagagaccttttaagtctgtgaatacgttcttagtgtgtctgtcttttctctcttttgctatttgcagcctcagaggagttgatggaacatttgagaggtgaaaatcagagttctctggagatggttgagaagttgaggaatgaaatcatttcaatcaggcatgtacttcaccttaccgtcttgattttcccagacattcttttttatttagagaagttggagccttgctaatgtaactataacaatcttgatccacagatctggcagggacgacaagtttctggagtgtcaaaagcttctcatggaagaagaactaaagagtaagaaactatgttaattgatgatagttgctgctctattttcatgtgtcatggaatgtagccttataattggacatgatatgtagtttagttaggaatttagctgagataatgtgaactgcttcatggagagtgatgaggacttggttataatactgtctaggataaaatctttgttgtttttcttacagacaaatcactttctgaagaagttgtcaagctaaaagagctggtccaagaggaacatcctcgcaactatgaagatcaaagtggaaaaaaacaaaagagaaagactcctgaaagtgctcgagttacaacgagaagcatgataaaacgtagcagactgtcagaagatttggtggaaacggatatggtatcacctgacattagcaaacatcataaagcaaaggtaaaacagatcacctcttaacctttcagttctgagctgaatgttgtgcatcttgcttcacaaacccagtggatcataaaattagccttactgatactttttcttgcttttgtttcaaggagcctctcttggtttctcagccacaatgctgcagaacaacctacgatggatcaagtagttctgctagttgtacatttcaagctcttggcaaacacttgctaggaatgaaattatcaactaataataagggcaaacgcgcctgcattgtagcctcacacccaacaaccggtaatttgtttttcctgcatgatctatttactttgattcaaaagatcttttgagatcatcagccaccagaaaagcaccaatgctgattttgtttccctgattattttaccataacaggtttatccttcagcctaacttttataaataacccaaatggtgaagaatctgagctgctttacaagcctgcatcactcggaacatttcaaagagtggcaccggaatggatgagagaagttataaagttcagcacaagtatgtgtcccatcttctttgaaagagtctctcgagtcattaagctcaattgttgatcggtaccgtatgtacatctccctccccttatcttgtgtagtcatctctgatggcttcttagtgtgatgtttctcaataggtttgaaaagctagggaagttatcattgtatctatagaaatgtgtctctctttaactttggaattagtttcaaagatagtgtgtccttgtgatgaatcatattgtaacaagatcttgatttatcctttgctctcgataccctctcctcttgtagacctcataaatctctgatctattgagcattttacatgattcaacattttacatatttttgtaacaaattttatcattggaaagattaaatagccgttacataaggtaggtgaattttcaattcaaatgcatcaaaatagccgctataacctaagtgataacgttcggaaaatgctttaggataattcctttttattgcttttgaaaacgacgacgtttcttgtgtcgtacacgttttataacccagacccacgtctctctctctcaaagaagagaagaagaactctctctctatctctatctctatctctcttctccttcttcttcagtttcgatcattcttgaatctgattcttctcgagaaaaaagcgtttcaatttcagaaatttcgactacgattgttgctttgttcaattagaagaggcgaaaaaggatg

SEQ ID NO: 33485 - DNA, 3003 bp, Unknown
  misc_feature (1)..( 3003): 2750-1469P.txt file - cDNA_ID_3070480; gDNA_ID_1621096; Annot_ID_55704
ggttaaccatggcgaagatgtgtttggctgacgggaagcttgctaaaagatatctccctctctttgcacaggtctgtctgcatttgctgattcatgtgtccattttatcattttgattatttctggaaaggaaacttttcgttccaggaacttgattcattggatggtagtctcctttgtctcttcaattttttttaacctatgtgaacccgttgatgccttactcttgcaggaacttgaaaagagtgattgtgcagccttgcgtaacaatcttgtagtagcgatgacagacttttgtgttcactatacagccatgattgagtggtatttcattcacagaacattaatttttcaaatgttaaacatgattgcgacattctaatggtttgtttacctggatagttacataccgaagattactaaacgtcttcgggatccttgtgaagttgttagaaggcaaaccttcatacttctctcaaggttactacaggtattgctattctccacagattctttatcttctgtttttaaaaagtattgaattgacaatgaataagcaggcttgttttcttgattcagagagactacgtgaaatggagaggagttctcttccttcgattccttctatcgctagtggatgaatctgaaaagatacgtcgacttgcagactttttatttggaagcatccttaaaggtatgagaactcacgtgagcaaccatgaaatgcattctttcattcccatgttattgaaaattcttacagagagacatgatctctaggatttttgattattgttacgccccatgttgcttatagtaaaggcgccacttctagcttacaacagtttcgtggaagctatttatgtcttaaacgactgccatgcccacactggccatagtaatccagattctaaacaatcaagaacaaaggatcaagttttttctatcaggtacttgtgttaaagttatatagtctatgctcatacgcaaacttgacattttggtgtgaatgatcttagtgattatctttgtttcatttgttctgtagagggaatgatgaaagggctaggtctaaaagaatgcagatctacgttactttgcttaaacaaatggccccagaacaccttttggccacattcgccaagttatgtgcagagatcctcgcagctgcttctgatggaatgctcaacatagaagatgtcactggtcaatcagttctacaggtaacttccaaaatggctacagagccttttttcttcttgtgattgccgatttttaactcgttttgtctcggtgtaggatgcgtttcagatcttggcgtgcaaagagatccgtttatcagtttccagaggagcatcgtcggagacagcagatatagaggaagaaggtggagatgcagcaactgcaaaaggaagggccataacgcacgctgttagaaaaggtttgattcagaacacgattccaatcttcattgagctcaagaggctattggagagcaagaacagtcctctcacaggttcgctcatggactgcctccgtgtcctcctcaaagactacaagaacgagatcgaagaaatgcttgtcgctgacaaacagcttcagaaagagcttgtttacgatatgcagaagcacgaggctgcaaaggcaaggtccatggctaaccaaggggttgcctgcgggacaagtcatagaaacggtgaacctgaagcatcagcagcaagcgaggagaatgttagagattcgggattggaatcaagagtggtttctgcggctgctgatgtggtggcggctaaggcagctaggtcggtgttgagagaagtgaacggtggagctgcaacgccgcctctgagcgcaatgagtgttccgaagctaaggtcgagccgtggagttagccagagtggtcgaccatcagctgatgtgttggagtctctgagaagaagaccaactttcatgtctgatgatgagagttagaacttaaaaatgagactgtagaaaatagcttttgctgtaaatgcatgacttcgatttttctttttgggagattagatcgagactctattaaagtctaaatcgtatttataaaccgcataagacactaaaacctggtgtgtgtgtgtgtgtgcgcgcatttgtttgcttgctcatgtttgtccttgtgtgataaatccatccctgccctcaaattgatttatgtgttgtatgtgttgattttagtgataacatctcaaagtgattaaatattttcaaaaatgctatttgatgtctataacggctttaaaacttttgcaagttcattagagctatctctagcacatatatggcgcttagagatgttacgaatatgtaagactgattacatatctctttggcttaataaatataagtatttgtgttgaactctttatcttcttcttgaagatgtcttatgggaaacatgttaaatggatagtaaatgagagattcgaaaatatagtgtgagcttccttctttggtttatgcattctccatgtggggggcaaggtttttgaagatttatacttttgtggcaaatctcttgtttgaatactccatgggagtctctcatcaaaactatgctgcaaaatatttgaaaatttataaatctattgtctttgagaaagtgttacaaaatttatgacctcaataatattgcatgaaaactttcatacatcatttggtatatgtatgtttaagaaaaggtaaaaccgtaattataaagagaaagaaaatacaatatcttaatacatatcaatctaattactcattaaccatattaagaaaatatgtgtctttattttttccttttaacataaagcttaaaaagaagatttgtagccagaaaaattaattgtgttcatttcccttttaaaagaatttttcggcgcaacaaaatcgtgaaattgatataaataaactcgagattattaatataaccctttttcacttcacttctctttctctctaaaccctaaaagaagaacgatg

SEQ ID NO: 33486 - DNA, 3003 bp, Unknown; identical to SEQ ID NO: 33485
  misc_feature (1)..( 3003): 2750-1469P.txt file - cDNA_ID_3070480; gDNA_ID_1620616; Annot_ID_46896

SEQ ID NO: 33487 - DNA, 3003 bp, Unknown; identical to SEQ ID NO: 33485
  misc_feature (1)..( 3003): 2750-1469P.txt file - cDNA_ID_3070480; gDNA_ID_1621096; Annot_ID_171056

SEQ ID NO: 33488 - DNA, 3003 bp, Unknown; identical to SEQ ID NO: 33485
  misc_feature (1)..( 3003): 2750-1469P.txt file - cDNA_ID_3070480; gDNA_ID_1620616; Annot_ID_162052

SEQ ID NO: 33489 - DNA, 3003 bp, Unknown; identical to SEQ ID NO: 33485
  misc_feature (1)..( 3003): 2750-1469P.txt file - cDNA_ID_3070480; gDNA_ID_2926164; Annot_ID_139846

SEQ ID NO: 33490 - DNA, 3003 bp, Unknown; identical to SEQ ID NO: 33485
  misc_feature (1)..( 3003): 2750-1469P.txt file - cDNA_ID_3070480; gDNA_ID_2926164; Annot_ID_198995

SEQ ID NO: 33491 - DNA, 3003 bp, Unknown
  misc_feature (1)..( 3003): 2750-1469P.txt file - cDNA_ID_3070484; gDNA_ID_1621096; Annot_ID_171053
ccaccatctgcaaaacatgtcaatgactattgtcaacttgtatcgcaaaaaacatatagctagaagcacgaaaaatctagagtatagtacttggtcagagttttcaattcttgaatccaatttagctgcaaaaacttgaaattgatcttggcaaatctaagtagcatcttgttgtgatcttcttcttgttcatagaaagaaatgtattccctcgcgaatatcatttcggcattgtaatgttgaggcatgcaaagagcatttcgtatacgcattaagatatggggagaacttgctccagctctagctaacgactccaagtttcttgtagtgaagcttaacgcttcctccaagatatcttctcttgttgtccttaagtgagcagcttcatacaaactcaccatgcccttgacatcactggttatagattccataaacttttcattctcccctttgaatctcttgaaaacatctattggtcaataggagaatcttgttaatacatatgaatcgattacaaaaaaatgtactggtagataacttttaccggtagacatgttgtaaccgtatgtcctgaaaacccaaaacatgatggaaatcgtgtacaaatcatcttcaccggctatcatctcctgtatcttttcaaaaccctcttctagactctgctcaatctcatcttcaaagtgaaacgctacaccaaggctcacaagcatatatatgaaaagaatcctcttcttggtcgactcaatgcttttcgaagaaaacatgagcatctcccctacttccggctttagtctctcaatctcttgggcaagggcattcatttcctaacaataatatcatatgttcatacccgttacatcgatcttttacatttattatatatatgtttgtcagtgtgtattatagactcaccgagacatcaacttgagcagagaggaaatggtgaccccattttgaaagcggcagtctcttgaacttgcgattactttcttgatcatgacaggcccgagtaggggtggccttcatgcgaacaagctttccatgctgacctgaaaatgacttgtggggaaagctagagagttttcttaccgaaaataaattggaacgtaaaggaagagagagtatagatccataagctgatatgcattgcatgtttactactagtgatatggaatacattttcaccaccaaatttataggcaaaacataagcgttttcattaagtcatcttttgaaaagttttggaagaatgtatattaatacccccatatttatcttcttcagtgtataatacaacctatgttgggaccatgatattttctgaatttatagtgatattagtttatctttaaattgatatttattaatctatatagatctttttttaattatttaattttttaaagaatacgagttgacacaattcaatatacatcaaattaatgacttggatgttgaaatttgtgtagtattagaattgaaaatttaatatttcaaaaaactcatttgacaataaatcacaatgactataactgaattcatttatataatagatatacatacatctaagtttatgattaataacctcaactatcagatttttaaatgtagtagactattgaaatgaaaataatgcagattaagaagttgtatacttataaaaacttatgactaattgtattaggaagttataaacgatactacaatatgatagttttaaaacacaacataatttaatgaaaattagagacaaaatcattgtttgatgtaataatagttcaagacaaactctaacaaacattcaatagttcaaaaaatatttaaactatagattatatatattatcgtatatatattatatttttgtggttattaatttatgatgttattaaaatcatattttttatatagggttttaaaaaattgttaacttattattttatcaaattatgttaaattttacattcacacgacttgaaactaatataatattatctccttgtatttattaatttatcaaaaattaatttgtagaggttttactgtaaaacatgtttagtttttcattttttaaaaaacctccaagtggcaaaaataagatccatctccatctaaaaaagtgcaaacaaatctccatcatttaaaaatcaacgttaacatccatatctattgttgttgttttttacttctttttctcttggtcaaactctacgttagtttgatcaataaatatgacaagaatttttgcagtctcataggcgtctttgtaaaggttagttagcgtctacataattttccgaaagatataattttcttgagatacagttaactcaattactgaaatgtaataactttctaaaagttgtggctattaaacaaaattgtgaaaaaatttaaaccaaaagccacttcaaaaacaaagaaaaccataaccattaatcaaaattcttttttttttgttaacaagtactagttgcattaaattgtaaacatatggtggtgttgtatatgtttgatacaaagaacctatataacaaaggcttgttgggatagtgcatctgccacattatttcttttccgattgacatgtccatagatgagtgtgatagcttcaacatccaatatcgtataccaccaaagactgaagagtagtaccaagaatatttatatatatatttatttatttatttattttggtaaggagaatatttatatcatgatcccaccatactttaattgttatgaaaaaattttaatttgattttcataaattttatagtttagttaagtataaaaccacaattttttttctttcaaatattatttttggagaaaacccccaaatttaaaaggaaagagaaaaaatcaaatcattcatctttgagctttcttttcttctacagaaccctaatttcatgttctaggtgtctctcgaatggttctcatctcattgattactcaatctctagggtttagtggttcatccaaattcgtaccctaatg

SEQ ID NO: 33492 - DNA, 3003 bp, Unknown; identical to SEQ ID NO: 33491
  misc_feature (1)..( 3003): 2750-1469P.txt file - cDNA_ID_3070484; gDNA_ID_1620616; Annot_ID_162049

SEQ ID NO: 33493 - DNA, 3003 bp, Unknown; identical to SEQ ID NO: 33491
  misc_feature (1)..( 3003): 2750-1469P.txt file - cDNA_ID_3070484; gDNA_ID_2926164; Annot_ID_198992

SEQ ID NO: 33494 - DNA, 3000 bp, Unknown; identical to SEQ ID NO: 2965
  misc_feature (1)..( 3000): 2750-1469P.txt file - cDNA_ID_3070544; gDNA_ID_1620618; Annot_ID_162126

SEQ ID NO: 33495 - DNA, 3003 bp, Unknown
  misc_feature (1)..( 3003): 2750-1469P.txt file - cDNA_ID_3070548; gDNA_ID_1620618; Annot_ID_46933
tgttcataccttcacaacgtcatcatcaacagttatgatcacttatcagccagatttttcaaactcgagctttgtattttagcggcaatttgtttttggtaacaaaggaacccatgcacttgtcagcgtaaagcaaacacgtgtccaaaccattaagccacgtggtcattgtccgactctacaacctctctctgtttcttctctcattcctttatatgatactacgatttaatacgctttgcattgaataacaaaaaaaaaaacagagcacaatgactagatttgcggtattgccactctctgttcttcttctcgttctcttgttcctctgcactgagtcgttggctaagtcggaggagtctgaagaatacgacgtcgctgtgccttcatgttgcgggttttcgtctcctcttctgattaagaaagatcaatggaaaccaatcttcgagacgaagtttggacagatctcaaccgttcaaatcggcaatggatgcggtggaatgggaccttacaagatacattccataacgttggagccaaacacaattttgctccctcttcttcttcattccgacatggtcttcttcgttgactctggtacataataaactgtttaaatttcttcggtttggtttacagatcagtttcggtttaggtcaaaattggattgtgatttgtataggaagtgggattctgaattgggttgacgaggaagcgaagagtaccgagatcagactaggagacgtttacaggctacgtcccggttcggttttctacttacagagcaaaccggtggatatcttccttggaaccaaacttaagctttacgcaatcttctccaacaacgatgagtgtttacatgtataagtttgatatgattctttcttttttcactttcttgacatctttttcttcttcttattgtatctgtattccatggatgcaggatccttgctttggtgcctattcgagtatcacagatctaatgtttggttttgatgagacaattctccagtcagcttttggggtatgtcttaatctgccgatgaataagttacgaattgtctatatcttacttgggaagcaagataggaattgtgtatatcttacttcccaacttactctagtagaggatattttgggttgtattaagtgatatattaaattcaatggttttaattaggttcctgaggggattatagagctgatgaggaaccgtacgaagccaccattgatcgtgagtgagacgctttgcacaccaggtgtggccaacacttggcagctccaaccgcgattactaaagctctttgctggaagtgcagacttggtggataacaagaagaagaaagagaagaaagagaagaaggagaaggtgaagaaagcgaagacattcaatgttttcgaatctgaaccggatttcgagagcccctacggtcgtactataacgattaacaggaaggatctgaaagttttaaaaggctcaatggttggagtttccatggtgaatctcactcaaggatcgatgatgggaccgcactggaatccatgggcttgcgagatttcgattgtattgaaaggagcaggaatggttagggttcttaggtcttcgatatcatcaaacacatcatcagagtgtaagaacgtgaggtttaaagtagaggaaggagatattttcgcagttccacggttacatccaatggctcaaatgtctttcaacaatgactcgttagtgttcgttgggtttactacttcagctaagaataacgagccgcagttcttagccggggaggactcggctttgcggatgcttgaccggcaagtattggctgcatcgcttaatgtgagtagtgtgacgattgatggattgttgggagctcagaaggaagctgttatcttggaatgtcattcttgtgcggaaggagagatagagaagcttaaggtggagatagagaggaagaaaatagatgatgagaggaagaggagacatgatgaaaggaagaaagaagaagaagaggcgaagagagaagaggaagagaggaggaaacgtgaagaagaagaagagaagaagcggtggccacctcaacaaccaccacaagaagaagaacttagggaacggcaactaccgatggagaaagaatgggaaatggaaggtgaagaggagagttaagccggaggagtaaaagagaaggccaacgtacgtcaagagtgtgtttggtttgttgttagtggttagaactttggttctgacctctcttgtaactttttttttccatagtcttgtttatttgttaatgtacttttgcattgtttttgttgttgccatgtttaaagttgtattgtgtttgtataatgttttgttttgtttaaatctttgtagatggtaaatgagaaataagtaaatatttccgagagactgttgagtgacgacgttacttcttgttattgataactctgtggtttattatacacttgtagtagtagtcgtacttgctaacttatgtcatttggtttacaattgtataatgtatttgtaaccctcttgctatagcttcggcatattaaagttttgaatggtgataacggaggagtcgtagataatgcaatcaacttcccatgctctgttctcttgttgttgcaagagatattggaataaaaggcaaatttatctcaaacacagattgggccatatcttgaaaaggcaaattcataaaactctcaaaaagtagatttatcccaaacacgaattgggccaactattggaccggatgcgctgaataatgggccttatcagatttggaccggcctgtttttatatgacatttacaaaaataccctcacaggaggtcccgtgttggctataaaaaaatagaataatccgtaattgccctaaaatagtttggtttctgcatccacccctttcttcgaatctcgacggctgaaacagattctaaatttatctccggtgagaaagagatagagagcgttgattccggcgaaaagatg

SEQ ID NO: 33496 - DNA, 3003 bp, Unknown; identical to SEQ ID NO: 33495
  misc_feature (1)..( 3003): 2750-1469P.txt file - cDNA_ID_3070548; gDNA_ID_1620618; Annot_ID_162113

SEQ ID NO: 33497 - DNA, 3000 bp, Unknown
  misc_feature (1)..( 3000): 2750-1469P.txt file - cDNA_ID_3070548; gDNA_ID_2926211; Annot_ID_142010
tcataccttcacaacgtcatcatcaacagttatgatcacttatcagccagatttttcaaactcgagctttgtattttagcggcaatttgtttttggtaacaaaggaacccatgcacttgtcagcgtaaagcaaacacgtgtccaaaccattaagccacgtggtcattgtccgactctacaacctctctctgtttcttctctcattcctttatatgatactacgatttaatacgctttgcattgaataacaaaaaaaaaaacagagcacaatgactagatttgcggtattgccactctctgttcttcttctcgttctcttgttcctctgcactgagtcgttggctaagtcggaggagtctgaagaatacgacgtcgctgtgccttcatgttgcgggttttcgtctcctcttctgattaagaaagatcaatggaaaccaatcttcgagacgaagtttggacagatctcaaccgttcaaatcggcaatggatgcggtggaatgggaccttacaagatacattccataacgttggagccaaacacaattttgctccctcttcttcttcattccgacatggtcttcttcgttgactctggtacataataaactgtttaaatttcttcggtttggtttacagatcagtttcggtttaggtcaaaattggattgtgatttgtataggaagtgggattctgaattgggttgacgaggaagcgaagagtaccgagatcagactaggagacgtttacaggctacgtcccggttcggttttctacttacagagcaaaccggtggatatcttccttggaaccaaacttaagctttacgcaatcttctccaacaacgatgagtgtttacatgtataagtttgatatgattctttcttttttcactttcttgacatctttttcttcttcttattgtatctgtattccatggatgcaggatccttgctttggtgcctattcgagtatcacagatctaatgtttggttttgatgagacaattctccagtcagcttttggggtatgtcttaatctgccgatgaataagttacgaattgtctatatcttacttgggaagcaagataggaattgtgtatatcttacttcccaacttactctagtagaggatattttgggttgtattaagtgatatattaaattcaatggttttaattaggttcctgaggggattatagagctgatgaggaaccgtacgaagccaccattgatcgtgagtgagacgctttgcacaccaggtgtggccaacacttggcagctccaaccgcgattactaaagctctttgctggaagtgcagacttggtggataacaagaagaagaaagagaagaaagagaagaaggagaaggtgaagaaagcgaagacattcaatgttttcgaatctgaaccggatttcgagagcccctacggtcgtactataacgattaacaggaaggatctgaaagttttaaaaggctcaatggttggagtttccatggtgaatctcactcaaggatcgatgatgggaccgcactggaatccatgggcttgcgagatttcgattgtattgaaaggagcaggaatggttagggttcttaggtcttcgatatcatcaaacacatcatcagagtgtaagaacgtgaggtttaaagtagaggaaggagatattttcgcagttccacggttacatccaatggctcaaatgtctttcaacaatgactcgttagtgttcgttgggtttactacttcagctaagaataacgagccgcagttcttagccggggaggactcggctttgcggatgcttgaccggcaagtattggctgcatcgcttaatgtgagtagtgtgacgattgatggattgttgggagctcagaaggaagctgttatcttggaatgtcattcttgtgcggaaggagagatagagaagcttaaggtggagatagagaggaagaaaatagatgatgagaggaagaggagacatgatgaaaggaagaaagaagaagaagaggcgaagagagaagaggaagagaggaggaaacgtgaagaagaagaagagaagaagcggtggccacctcaacaaccaccacaagaagaagaacttagggaacggcaactaccgatggagaaagaatgggaaatggaaggtgaagaggagagttaagccggaggagtaaaagagaaggccaacgtacgtcaagagtgtgtttggtttgttgttagtggttagaactttggttctgacctctcttgtaactttttttttccatagtcttgtttatttgttaatgtacttttgcattgtttttgttgttgccatgtttaaagttgtattgtgtttgtataatgttttgttttgtttaaatctttgtagatggtaaatgagaaataagtaaatatttccgagagactgttgagtgacgacgttacttcttgttattgataactctgtggtttattatacacttgtagtagtagtcgtacttgctaacttatgtcatttggtttacaattgtataatgtatttgtaaccctcttgctatagcttcggcatattaaagttttgaatggtgataacggaggagtcgtagataatgcaatcaacttcccatgctctgttctcttgttgttgcaagagatattggaataaaaggcaaatttatctcaaacacagattgggccatatcttgaaaaggcaaattcataaaactctcaaaaagtagatttatcccaaacacgaattgggccaactattggaccggatgcgctgaataatgggccttatcagatttggaccggcctgtttttatatgacatttacaaaaataccctcacaggaggtcccgtgttggctataaaaaaatagaataatccgtaattgccctaaaatagtttggtttctgcatccacccctttcttcgaatctcgacggctgaaacagattctaaatttatctccggtgagaaagagatagagagcgttgattccggcgaaaagatg

SEQ ID NO: 33498 - DNA, 3000 bp, Unknown; identical to SEQ ID NO: 33497
  misc_feature (1)..( 3000): 2750-1469P.txt file - cDNA_ID_3070548; gDNA_ID_2926211; Annot_ID_202656

SEQ ID NO: 33499 - DNA, 3000 bp, Unknown
  misc_feature (1)..( 3000): 2750-1469P.txt file - cDNA_ID_3070554; gDNA_ID_1620618; Annot_ID_162101
ttgttgtttaggtcccaacaaaagtgaacaaaaaagacaggccacatggtgggggtccattatcctccccgctcgtggaggtttcctttttatatcacctaactcaacacaacaaactcttaaactaatcacaataattaagaaaccaaactaaaattaaactctggtctatggaaagctaagtggatatcatattactacatccgcaaagatattaactctttacaaaccgattttttcctgtgatcaattaagatattatatatctctaagaacattatcatcatcacagtgataaattaagtataaacggagaatgtaacggtatgtttaaggttcgacccttttcgaccttcctcgaccatgcgagctccggctccaatgtactgtacaatgctgaagattttctctgttatggtccacaaggagactgatctgatcttttaccaccattttcaaactgatttcatgtttcgatttaccggtttttcagcatctggctttagtgccaccgagagtgagttcgagatcttctacgccaacttcatgaatcatttcgccttcccacggcttaactgttccattctcaaactcaaactctgcccctctcccattcattccggacattccccagtctgaccttttcatatcaatggccatagaagtttgctgaacaaggttaaatgttggtgaagtaggagcagtagattggaaattgatccaccttcctgaatcctcgatcgaatcctcctcggactcatcacattccggtattgtaggtggcgtttggtgaccagcacgacgagtctagatggagcagagatagcgaaaagcggatgtctcaaaacgtgtaaagacccgccatttggtaattgctctgaagtaagtttccgcttcgaaccacgagaagtaggagatgacaacggaggagtcacaggcgcactgttggatattctaagaggtggaaggttagcaggaatcgaagaagcgatgttgtgtaggaacggaagaagaaggtatgaagaagggtttccgtcatagcgagatggactcgggaaggatgatgagactggacttccgtggtacgaaggtgcaggacttggaaaagctgatgattgtggacttggttggattgatgaatttgtgctgaagtttgtaggagttcctgaaatatctgatgctggtggctaaacccctgtttccacaagaatcaaccattttagtgaccaagactagactaaatcaaaaccacatgatgatgcaaccgtcaaagtcaatgttttagtcaagactcaagaagcaaaagagatttccccaaaatttctcaataatcaaacttacatgatctatagaattagatgatccaaagcagaaaccatcgaattcataatcagttctaatcactacgaagaccagatttcaatccaaatagggggaaattgaaaattcaacccaatcgaacagtgaaaagtgaaatccaaatcgcaagatctcaagagtctctaacaattcgattgaattaaaacacaacaatcgcacagattcatcgattgaattatgagtaattgagagaagctcagattccgatctaaaaattgaaatccggaattttcagttttaccttgcgataagtggtgccatcgtcttcgacgatccaaccagcttcgagacagagagctttaagaacctcgttgttatcgcagtgcttaggaagcttatagttaccttgagctctaagaccagagtaaatcttagcagtgatggctcttcttcttctttctctcttcttattgttctctctctctttccacgtcggagtacgtcccgacgatgatcctcctcctcctcctcctcctccggcggccattgaagagctctgaatctctgaatctatctctaagtctttgtcagactggcgcacgagggatagagagagagagacgaagctttctttttagtttttttgtttttttttttgttttgggtgtgtgtgtgagtctgaagcggattggctgtaactttcattcattaagtataaataaattcaaatattcatttgtctccacacgtgtggtctgtttctacacgtgtgatcgatttatttctggaagtcagcttccacgtgtcctatttatgtaacgcacgagctgtggtcccttccccgttgtttccctcccgtccactgttcaatgaattcggatctttccttcttcttttttttcgtattttctttaatttaaatttgtatcttaaaaacaaaaacaaaaagcgttgtaagaattaagaatcagtataaaaactggatatactaacgattttgcattgttttttatgacgacatattgcacattttcatattgtaacgcattaatacaactcacaaaagctttacaccaaatttgatgttatttcttggagttgtcaaaacgtaattcgaaactgatctcattttcctaacataatttttaacctagtatagcatctaaagagttttaaaacggtcatattggattttagaaaatgacgaacaaattattccaaaaattacatgtttatttgattttcccaaattcattgatgtgaattaaaaaaatgtatccacataattagggaagctagctaaaacattttttagtaatattaaaaaggatggaaataagataacaaacagcaatttggctattgtggtcggagcacgtgcggttccagttaggcgtgagcaaagccaggaagcagaatcacccagctggactcatgccattattatttttttagccaactaattaatatagtactttaacaaatcctatttacatatttgttaaattttcacaaccttaaattaataaaagtaatttcataaaatgtcatttgttattattgcagacaatcaaatgaaacaaaaaaaagttcctaataattgtgtttattattttattttattaaaccacgtcttctcatttatagtcacaaatccaaaaactactaaagtttaaaatg

SEQ ID NO: 33500 - DNA, 3003 bp, Unknown; identical to SEQ ID NO: 18694
  misc_feature (1)..( 3003): 2750-1469P.txt file - cDNA_ID_3070562; gDNA_ID_1620618; Annot_ID_162093

SEQ ID NO: 33501 - DNA, 3000 bp, Unknown
  misc_feature (1)..( 3000): 2750-1469P.txt file - cDNA_ID_3070565; gDNA_ID_2926212; Annot_ID_202689
gaccatttgttatagtagctttttggatatcttgaccattttgttataatgtttttgtatatatatatataaatacataagaaaatattatacaaaacacttaattcagttcttttatgtataaggaccgtagtgttatatctctaatatttatataaatcgtagatgaacacggagtaacattttttgataaacatgtttaggagatatctgtactttgcaattaaattatgatgaatgatttattggtagtgactaaattatagaggtccccaatggaaaaaagaagcagcgaaccagtcacaccgtcgttgtaatctacaactaaaaaaatgcttgatttatttttccttatcaatatgttttcaaaatgaaaacgtgtacatataaaaaaaatggtcctaagagacatattaattttgattggtccacctggaaaaccggcaagggatggccatggccacgtgggatttgtggtccatgctgggatcaacgttcctcaatgtgccacgtgttttgatcatccagcgtgacagcctgtgttttcaacttttcatcaccaagcttcaaaatcttttttactctttttatttttatgcttaaaaataatttagaaattgatatggtcgaagagtaataataacttctcttgtcaaaagggagtaattatataatatgaaaatggatttttgtcaatacataaatttttattttctaaattaactgttttgtttttttcaacatgatttctctgttttctatttgattcaacggcgcatttttttaaaatgaaaattgtttgtagctcaatattaaagatattatcgtcaaaaattgttagacaaaaaaaaaaaaaacccagcccacaatcattatatgatatatggccactgataatacaactatctgtaactgatttaaacttaaaaattattctacaataagggttttgattcgtcggcccaaatttaccatatgggccttaagaagcctggttaaaatatatggccactggataatacaactatctttctttctttttttctttagtaatatatggcatcagtattagtgtcaatgatttatagatgtgaataaagtgaaatttttggaaagctaattgataactttgatgaccaatatataacaaataagtttgtctattgcagtactttaattcattgcttgcgtaagaagtgagtgggatcacaatttaaagaacgtcacttgattcaactactactaaaataaaacaatcagaaaaaaaaaatattaacagaggaaaataaaatatcctggagtagttgaatcatcttgctaagcacctaattttgataaaacttgcggtggcacagtaagtttgggcacctaaacaactaattgattggctaatcacaatatacacgttttttttttcacatgtggttttatattgaacccaccgaattctcttgatccttctaacaaaatttaatctcaaccacaaaaataaaataataatatatataagaaactgtaatgtacaattgtgattagcaatgggtcatctcatctaattatccagataatattgtctatatttttccaattaatttggtcgtatgtaactaaataatgcattaggttgagctaaataaagtattagataaccttacctactaacaattttcaatgatttttttcagtttctatatttctgctttgtatttttgtgtaaaattgggtttacagaccaggggatttcgaacagggtgatgtgttggacacaaaatttattccattcatgtgcgagttattattcattgaagtatattaaacttttgttttattttacttttttctattaattttaattaaaaatttgatgtgaaagaaaaaaacggtattttattgtgaatagtaaaagtcatgagcaaaatcatcaacttaggagtgttgaaaaaaggctaaagaagagtaaattagaggagagtcaaagattgtgtgtcactagtgttaatgctagtaaacatcagctcttttttttcttctctcttaatttttcaaacatttgatttctataaaccttcttaataatttcttccgtaaaataatatgattagtttttttttttgtaaacaagtgcccacttgcttgaccttcccaaccaaaaaaaacgtaacaatttccatcatcttctccataaagttcttacctttaagtgtgtttaatggagatttatcctctactcatctctctctctctattctgttccatttattaagctttcttcacgctttttaagataattaacagtcacgggttctaaaagctaaagggttttgcttcgaattcaagtgtctcccttcactttctctctctctattgctgctctgtttctgctgtcaattccctaagaaagtcctgatttttagggtgatcgagagaagttgaagaatcatgtttattgagtttccttttttgatccatagggtcatctaattttgctaattttattgtcatctccttcaggtaatttgcgatttctctttactctgtttttgacttgtacttagattccttttctttaacagtaataaacttcataaagatttcatttttcttcttatgggtatttggaatgatgaatgtagattaggttgattgttttgaggatgatgtggataatctttttctggatattattacaatttagggtcttgagattgtttgtaataagctccgtactttggtcccttattttcaattcagtctttaagatttcggtaacccttttatatttgatgcaatctccctataataataccttcttcaattgctgttttgccatttgcatattatttaactttctttgttggatcagtctgattctttcttaccaattattgtcttaatccttgattaagaaaaaacaaaaaaacaaaagacatggagtttcttctctttcttggatgtataacagtgtttctctatgcaggtaagggattgttgttgccaatg

SEQ ID NO: 33502 - DNA, 3000 bp, Unknown; identical to SEQ ID NO: 2979
  misc_feature (1)..( 3000): 2750-1469P.txt file - cDNA_ID_3070582; gDNA_ID_1620619; Annot_ID_162182

SEQ ID NO: 33503 - DNA, 3000 bp, Unknown
  misc_feature (1)..( 3000): 2750-1469P.txt file - cDNA_ID_3070585; gDNA_ID_1620619; Annot_ID_162181
cactatctcatagatttggtgaccagaacaacttatctcttgagtggttcaacctctatctctctctctttctgccatgaaaatgcaaagccaaatgtaatagttagagagggagaaaccaagaactgaaagaccatgacttccaacagaagcaacctcctgttctcattagtcctcttccactttctttttgtccccacacaactccaagctcttaacactgatggtgttcttctgcttactttcaaatactccatcctcactgaccctctctctgttctacgcaattggaactatgatgatgcaacaccatgcttgtggacaggtgtcacatgtacagagcttgggaagcctaacacaccagacatgttcagagtcacaagcttggtacttcccaacaaacaccttttgggttccatcactccggacttgttctcgattccatatctaaggatcttggatctgtctagcaatttcttcaacgggtcactcccggactcggtgttcaacgccactgagcttcagagtatctcccttggaagcaacaatctctctggtgatttgcccaagagtgtcaacagtgtgactaatctccagctcttgaatctctcagctaacgcatttactggcgaaattccgctcaacatctcacttctgaagaatctaacggtcgtttccttgtcaaaaaacaccttttcaggtgatattccaagtggtttcgaagcagcacagattcttgatctttcttcaaatcttctcaacggctctcttcccaaggatttgggaggaaaaagcctgcattacttgaacttatcacacaacaaagtcctcggcgagatttctccaaattttgcagagaagtttccagcaaatgccacagtcgatctctcctttaacaacctcacaggcccaatcccaagttccctttctttacttaaccaaaaggctgagtctttttccggtaaccaagagctttgtgggaagccattgaagatcctttgttcaattccttccactctttcaaaccctccaaatatctctgaaactacttcaccagcaatagcagttaaaccaagaagtacagctccaataaaccctttgacagaaaaaccaaatcagacaggaaaaagcaagctaaagccaagcaccattgccgcaatcacagttgcagatatagttggtctagctttcattggtctactcgtgctctacgtataccaagtcaggaaacgcagaaggtacccagaatctagcaaatttagcttcttcaagttctgtctggagaaaaacgaagccaagaaatcgaaaccaagcaccactgaggtcacagtcccagaatcaccagaggccaaaacgacatgcggttcatgcattatcttgaccggaggaaggtacgacgagacatcgacatcagagagcgacgtagagaatcaacaaaccgttcaggcattcactcgaacagatggtgggcaactgaagcagagctcccaaactcaattggttacagtcgacggcgagactcggctagatctagacactctgctaaaggcatctgcttacatattgggaaccaccggaaccgggatcgtgtataaggcggtgctggagaacggcacggcattcgcggtgaggcggatcgagacggagagctgtgcggctgcgaaacccaaggaattcgagagggaggttcgtgccatcgctaagcttcgtcacccaaatctcgtcagaattcgtgggttctgctggggagacgacgagaaacttctcatttccgattatgttcccaatggcagcctcctctgtttcttcaccgccagtaagttcctctgtttctgtaagcgcacgaaaaaaaaaacacagtatcatatctaaaatacgcaagtcatttggtacacattagcactctaaaatacgcatcactgtttttttgtccttcacaaacagctaaggcaagctcaagctcatcttcttcgtcgtcattacaaaaccctcttacttttgaagcacggctcaagatagcaagaggaatggctagaggactatcttacatcaatgagaagaaacaagtgcacggtaacatcaagcccaataacattctcttgaacgctgagaatgagcccatcatcaccgatttagggctagaccgcctcatgacaccagcgcgtgaatctcacaccactggaccaacttcgagctcaccgtaccagccaccggaatggtccacaagcctgaaaccaaaccctaaatgggacgtttactcctttggcgtcatacttttagaacttctcacaagcaaagtgttctcggtagatcatgatatagatcagttctcaaacttatccgactctgcagcggaagagaatggccggttcttgaggttaatcgacggtgcaattaggagtgatgtcgctcgccatgaggatgctgcaatggcgtgctttaggttagggattgaatgtgtctcttccttgcctcagaagcgaccatccatgaaagaattggtgcaagtgttggagaaaatttgtgttttagtttgatttcttaattcgtatagcctaagtcgttttggcaatatagaaagttatgtgttatgtatgttttagatgtgttgcttaatgcttactttaccctcgcataatactaactcttactttagagtttagaatgtgtttcactgttttgttatgttatatcacaaccaaaaagctatataaaaattagaatcttaaccgatgaagccaattaaaccaacacaacgggaatcacttaaaattaactcggtctaacttcctaaccaaacttttaaacagaccgacccaaaccggaccaagattctagtgtccacgcctcaacatcatcttctccgatcaactctgatgctcaccccaccaaactttactttctattcagacaagacatctcgatagcttatttctatggtctgatcacacgatagtgtattctgatatcatcactctaccaaagagataccaaattatg

SEQ ID NO: 33504 - DNA, 3000 bp, Unknown; identical to SEQ ID NO: 33503
  misc_feature (1)..( 3000): 2750-1469P.txt file - cDNA_ID_3070585; gDNA_ID_2926207; Annot_ID_202284

SEQ ID NO: 33505 - DNA, 3000 bp, Unknown; identical to SEQ ID NO: 33503
  misc_feature (1)..( 3000): 2750-1469P.txt file - cDNA_ID_3070585; gDNA_ID_2926238; Annot_ID_203962

SEQ ID NO: 33506 - DNA, 3000 bp, Unknown; identical to SEQ ID NO: 2980
  misc_feature (1)..( 3000): 2750-1469P.txt file - cDNA_ID_3070589; gDNA_ID_1620619; Annot_ID_162179

SEQ ID NO: 33507 - DNA, 3000 bp, Unknown; identical to SEQ ID NO: 2980
  misc_feature (1)..( 3000): 2750-1469P.txt file - cDNA_ID_3070589; gDNA_ID_2926238; Annot_ID_142809

SEQ ID NO: 33508 - DNA, 3000 bp, Unknown; identical to SEQ ID NO: 2980
  misc_feature (1)..( 3000): 2750-1469P.txt file - cDNA_ID_3070589; gDNA_ID_2926207; Annot_ID_141769

SEQ ID NO: 33509 - DNA, 3000 bp, Unknown; identical to SEQ ID NO: 2980
  misc_feature (1)..( 3000): 2750-1469P.txt file - cDNA_ID_3070589; gDNA_ID_2926207; Annot_ID_202282

SEQ ID NO: 33510 - DNA, 3000 bp, Unknown; identical to SEQ ID NO: 2980
  misc_feature (1)..( 3000): 2750-1469P.txt file - cDNA_ID_3070589; gDNA_ID_2926238; Annot_ID_203960

SEQ ID NO: 33511 - DNA, 3000 bp, Unknown; identical to SEQ ID NO: 2981
  misc_feature (1)..( 3000): 2750-1469P.txt file - cDNA_ID_3070593; gDNA_ID_1620619; Annot_ID_162177

SEQ ID NO: 33512 - DNA, 3003 bp, Unknown
  misc_feature (1)..( 3003): 2750-1469P.txt file - cDNA_ID_3070630; gDNA_ID_1620621; Annot_ID_162319
ttcaacatagaagagtgtgaaacagattcatggattgaacataagccgttgattcaagatcaagccgcgtttcactccatagacatagaaggtgtctcacaacttcagaaggttcgttcaaaccttaaggattttgataaagttgatgcaacaatgaatcaaatgctgtcatcaattggatttgttgttgatgaattacactctagttgtggaagtgctaccgtccatgtccagaagaagcctagtaagtctctcaaatcctggaagttcaaatttaaaaccagctcacaagaccaaggggatcatgaatcacttccaatagggttacatatcagattcaagtcctggaaatttaagttcgtgaatagaaatttacaaatgatgagagaacatggatatacaacacactttcagctaatgtctgataagagagaacatcaagagatgttcattgtggccaggattgttgatgtgagatgtttgcttagcatgatacttgggataacagagagtgatgcaggtcatggagaacaatttgtgtatgaccggattacaatggtaaagaggctgctgttgcaaaccagtttagtcattcaagaagtgatgagaaacaaaaagatcaagtttaccaaacggtggtggttcaagtataaatttggggaagagggtttcacgagactgaattctttcaatttgcgtatgacttatcattttgcggtttggcattgttggaagagcaagaccatggtgcatgttgaaatgagtggtgatcactggtcttggatggtcttagtcatgaaatctacaacatctagctttttgtcacttctctatgatcgaagaatgggagatccaagcagacatgaaacgggtcgggagattgtgtcacttcagggtcaaattcacactggttctcctatgattcagtgcataaagatgagcttcagcattctccttcttcagggtctgtttcagagtttgacaatgaagatgctcacatatatgcacttgtttggtagcaaaagttgtgtttcaactttgggagtgaggaaattaggcaaagattggtggtttaaatacaagacagatgcaagggctacagatttactgacaaatccgtagaaagagtaactacgaattagacaacagaggatgatgaagttgtcacaagcttggcgattcaaggtttaggacttggtaaaaggaaagctatgattcatgttgatttatgtggaagaggctacatggagttactctataaactggcaaatatgtttccatgaaccttgaggtcaaggttctctgaagaggggagatttgttataggaaaactgaagtcaagctatagcgttcaggggtcaagctggcgagctggaaatgtgaagtcagggatgttaagcaaagcacgtgttgtgagctggcgatctggaaatgtgaagtcagggatgttaagcaaagcacgtgttgtgagctggcgagctggcaatgcaaatggacgttaacggcgatcgttattaacgtggttaacgtttactttctttacctttttgtataagagcaacatgttatgctcatgctttcattatcgaataatctggttgtaatctctctctagagacttctagatttccctcatcgttttaccggagctctcgtcgagtctcttgtaggtgagaagttgatatcgcgtctctttacgaacgttgtatcaagtgtgttaatcggagtactctattttcatctctctgttctattgatttcaaactctgtttattcatttctggtttacgttaacaataatcctgcaacttggcgccttcattgattcgcgagctggtcgctccgacggcgcagctcgctcttcgtcctttaattgctatatccttctttcgctgcttcttctcgatcacgtaacatgtccgtgagacctaagatggtgagagaagcagagttgcatgctcagaaagacaaagaaaagaattgatcgacaccaagaacacagctgacacaacaatttacagcatagagaagagtcttggtgaatacagagagaagatcccaagtgaaatcgccaaggagattgaagatgctgtggcagatctaaggagcgcttcctctggggatgatctcaacgagatcaaggccaagattgaggcggcaaacaaagctgtttctaagattggggagcacatgtctggtggttctggtggaggctctgcaccaggaggaggatctgagggaggcagtgatcaagctccagaggcagagtacgaggaagtgaaaaagtgaggagatttggtaaattcttgccacttgggttttaagagatgaggtttagatcatggtgggttctatgtccaaggaacttttgccttttagaacaacgagcagtggatatgtttctggaataagcttttgtcagggaactaaacttaatgtttctctgctaaaaaacctttgttatgtaatgtgatggttaaagagaagaagttttcaaaattttgtcactttatactttatagtttattttcattggattggatattatctttctttaagcttataagttttcaaagaagcggtcacaaaactagcccgagaagaagctaccacaaaactagcgatgtaagaaccaacgacgacacagctggctagctcattgtttggttcttattctttggaacccaccaccacgccaaaacttatacggaacaactacaaccactacagtggttccgaagtttttatcacttgacttgtttgtagcactcaccggagagacccgctaaaggagccagaggtttcaataatctcattgtgaaacgtgcggataactttcgttggggaatttgtaatttacgcaattaccctctaatttattttaatttttatgaaataattagggctgatttaatcgagatcccatttcttttgttggcttacttctctcgaatttacgcaggaagatcattagcagagaattctcatctgattcagtccatg

SEQ ID NO: 33513 - DNA, 3000 bp, Unknown; identical to SEQ ID NO: 19835
  misc_feature (1)..( 3000): 2750-1469P.txt file - cDNA_ID_3070630; gDNA_ID_2926201; Annot_ID_201876

SEQ ID NO: 33514 - DNA, 3003 bp, Unknown
  misc_feature (1)..( 3003): 2750-1469P.txt file - cDNA_ID_3070637; gDNA_ID_1620686; Annot_ID_164608
aagattgccgtgaagctatctcctcgttaatgtttgcagcctctggattttccgagttgcctgagctgcgtgaattgaggcaaatgtttcacgaaaaatacacagattcacttgcattgtttgtcaaccaggaggtaaagagtttttctagtgtattcatttatttgtaagactcatcttgaaatcttatacggttaagttaaccacctgcttgtttcttgtacagcttgttgagaatatgtcatccaagcccttttctatggagaagaaagtgaagttaatggaagatgttgcattggagttctctattcgttgggattctaaagatttcgagaagaggattgtgagacagaatagtatttcagtaatggtatgacaatgactcatttgttttagggaacaactaaactgaaatatttggatagtgattgaattctgatttctttcttggacgtgaacaggagaccccaaaaagcaccaacgacaagtataagcctgtagacagaaacatggccttgccaaaaagagaagagtttgaaggttctgaaaatggggttagcttgaacagaaaaacggctgaggcatcagaaagaagagatcctttgtttcaatctgataaagaaagttatcagaatggtctcagaggaaatcagcgtgggctaacatataaagaaaggtcagagaatgttcttcacgcctctagatcggaaagcaaagacaataaggccgaaaggaaagagttttatctgcattctaagcaaaaccctgctagagaaaaacatcagcctatttttaacgaaggtgacactatagtgatgaaggtcaactatgggaatctcggtcaagggaatggacatcgacctggtgtagttgatgcgcataagaaaaccgagtttgttgcctcagaaaggaaagagttttattcgcaatctaagcaagaaccttctagagaaagacatcaacctatttttaatgatggtgacactattgtaatgaaggtcaagcatgagaaccacgttcaagggaatggacataaaaatggtgtagttgatctgcataagaaaatagaggttaatgcttcagagaaacttaagtctagcagcagcaaaagagctgacaagttagttatcggctttaaacaagagagtttctttcaagggtacaaacatgagaaaaatgaagagcatgcacatcagaaagtggaagatagtacctcaagacctccgaagccaaatagcaagtcaaagagagcggaatctatcaatccaggttcgagacatcataatgatcgggagagtaaagaaaatgcagttcttgtgggaaagagcaccgaagaagatccatctggtgataatgttaagggtggagaatacgaatatgatcatgcaaatccagcaaggaaagttgaggagcgagaaacagagagaatgaaatcacccttctacaaatcccttccacctccgtatgttaaaaaatctattgctaaagcaaggcatgaaaaagctgaagctttagataatccaaaggctcgttttgatggtgaagaaggaaatcatccagacaatggtaaaaatgtttatggggcagagagacgaaatggagcaggtcatcatgaagtgaatgacatagacaatgcatctctgaaacggcaaactaacagaagaaagcacattgtagaatcgggaggtgatgatcacataagtagccgaagaagggaaaactcaaggaaaggccttcaagtcttaattgacgaggatgagaaagacagtgaggagaagatgatggataaacttctgatgcattacagtaaaaaaccttcaagctatgaaaaggacaatgtgcaagaagaatccaaaagcagacgtacccatcttaaaaaaggtgaatctgatgaagagatgatgattcatcagccggctcggtcacggtctctacccgctgaacagttggccgggccatctgaacctgcaaaaacatttgcccgtgcagcctcgtttcagccagaacgttccagtgaagctaagcacgttcaccccaagttaccaaactatgacgatttggctgccagatttgcagagctaaaaggaaggtaaatatatgaacagttgatgcctagaaagatagaattaatgagattaaatagcctgttacacattttcttacttcttgatatagtacttgtccgatattgccccatgtatgtggtgcttgttataatagttgaaattggaagagtgacgcattgttacggagtacggaccccaagagttgttgatcatctccttgtttttggatcatcttatgtaaccatttgaaaacaaggatctgtttagaaaaagggaaagtggttaccacacagtttattactagcgagttatttgatgttaccatgatttttgcattaggtcctgaccagcactaacttacaagctagtagctaccatatacaagatataaatttacttctaaattaccatgaagtgtttaagttgatcttactgagaatattttgagtttttttttttaaatctgaacatgataataaacaaaaactattaaagggaaaagtcaacgagaaccctttttaaacgaaaaaaaaaaggtcaacgtgaactgcagagtgagcttagatgttcccaaattcgttcataaaccctaaattcaattttcccgatttatccccagcaattgtgtgatatcttctcaattctcatctttatcttcctccttacacagtaaaaaaaatacgttgtctgattactacttacactttttctcaaatctatcgctacgattccttctctcataaagcctcccaaaatcaatcatagacaatctcattaacagttttgtgttgatctctaactccatcgtcttaggagtaattaagtgaaagaacccaaattcgtttgtcatagaaaccacaatttcgagggatccacgcactttcacagtttgctacactttcaaaacaagccctggtctttgaaattggtgaaaatg

SEQ ID NO: 33515 - DNA, 3000 bp, Unknown; identical to SEQ ID NO: 3025
  misc_feature (1)..( 3000): 2750-1469P.txt file - cDNA_ID_3070637; gDNA_ID_1620621; Annot_ID_162299

SEQ ID NO: 33516 - DNA, 3003 bp, Unknown; identical to SEQ ID NO: 33514
  misc_feature (1)..( 3003): 2750-1469P.txt file - cDNA_ID_3070637; gDNA_ID_2926202; Annot_ID_201913

SEQ ID NO: 33517 - DNA, 3000 bp, Unknown; identical to SEQ ID NO: 3049
  misc_feature (1)..( 3000): 2750-1469P.txt file - cDNA_ID_3070660; gDNA_ID_1620622; Annot_ID_162361

SEQ ID NO: 33518 - DNA, 3 bp, Unknown
  misc_feature (1)..( 3): 2750-1469P.txt file - cDNA_ID_3070677; gDNA_ID_1620622; Annot_ID_162336
gaa

SEQ ID NO: 33519 - DNA, 3000 bp, Unknown; identical to SEQ ID NO: 3072
  misc_feature (1)..( 3000): 2750-1469P.txt file - cDNA_ID_3070694; gDNA_ID_1620623; Annot_ID_47081

SEQ ID NO: 33520 - DNA, 3000 bp, Unknown; identical to SEQ ID NO: 3072
  misc_feature (1)..( 3000): 2750-1469P.txt file - cDNA_ID_3070694; gDNA_ID_1620623; Annot_ID_162396

SEQ ID NO: 33521 - DNA, 3000 bp, Unknown; identical to SEQ ID NO: 3072
  misc_feature (1)..( 3000): 2750-1469P.txt file - cDNA_ID_3070694; gDNA_ID_2926200; Annot_ID_141497

SEQ ID NO: 33522 - DNA, 3000 bp, Unknown; identical to SEQ ID NO: 3072
  misc_feature (1)..( 3000): 2750-1469P.txt file - cDNA_ID_3070694; gDNA_ID_2926200; Annot_ID_201813

SEQ ID NO: 33523 - DNA, 3003 bp, Unknown
  misc_feature (1)..( 3003): 2750-1469P.txt file - cDNA_ID_3070698; gDNA_ID_1620623; Annot_ID_162387
aacaatatccaacttgaccaatatatctttattgttcgtcaactgtcatcgatctatatcactttacgtataggattaatgtggcgtaaaaagataaagaagtttggtccaaatttcaatatcaaacttctagtgatgagaaatttctatttggtctacatcggggaacagatcattccacttatgaatccccattactaattttccattcctattacagacgttttacgtagtagggaatctagtttattaatatacatatcacatagattaatcttgattgtttcgcaaattttaatggttttcggaaacaaaaagggggtacaaagtgagctttccgaaatagtgtagttcccagcatccaaatctctcaaaattccttccacaattagaacgattgttcgttcgttcgttttcacaatgtatctcgacctcttttagcaagagtttgctactaaactcgaaccaagtggaaacatgtgggttttgcaatctaaattgaatttgttttgtcaaaaaaggttcttatatttagtacactgtaaaaaatttcgtttctaataacataaatacctagtatagtgtaatggtgttcagagttagcatgcaaacttgtgttaggaaaggatatcaaaagtctcttgtttcaacaatttttattttatattcaaaaattattatgatttgatctttcaagttgattcaattcatgaagatcacataaagcttcttctctgaaatgaatgtcacatggaataattatgtattgaagagcaaaaaccgcatatagtaacctagcttaaaccgaatatacccgaagtcaagactttaatgagaatcagactaaatcctgaatttatttgaaaacaaatcatatgatttggtcttcggtccggtaaaaaaactcagataagtttgaaaacaagttttaatatttatactatatgattccgtcttaatcaaaattgtcaacttacatcaataaaatcaaaactcattttaactagattctaagaatctcatcgaacaatcgatctttgtaaatcttcatggaatagtggttagcatttgtatcattgagtttgaaagaaacggaataattaaagatgacactaaattcacaactttgaacaaacaaacaaaaaaaagtgacaagaaaaatagaggtcggtgtcggagccgcccaaggtggcaacttgttcacacctcataataaaagcttctcacaagttggaagtcgcggtcgagtccagtcaagattttgttgcccttttcccgtgtgggctcaccaccctctttgtcttcttctccccaaaaattttccacgttttttgtttcactctctcaatttatttatattttttttgtcggctcatatttaatttgtgttaattaacacttccttgattagaaagtttttttgtaccgacttaaatttatcatgcaatgtgattggtcgctttcccaaaacaatctctcaacgacaaaaaagtagtaattagtaattaaatacattatattttgttgttaaatagtactcattctatttcaaaatataaaatatttaagtaaatatcacacggttaatgaatttaaatatataactcaagtatagtactaaaaagaatactttaacaaacaaacagaaacctattgtacagtaaaatatcaatcagtgaattattaatcaaatagtaagggaaactaggatataatagaaaaagaattgccgacctacaaatcagagtcaatggtcaagcaagtcaagggaaagttcgtaattgttatggatctggagtctggacaaattaaaaaaaatttgttaaatagaagaggatataaagggaacacagatcctacatattgaaatttatgtatgacgtccaaatttttcttcagcatgggacactgccccgccgaaattattgatttttcggatctttcttctacttgcttcttttttgtttgcttttataagttttgcatagctaattcttaatttcttatcatttatttctagttggtagagacttataaattgaacgtttcaagtctttggacggtatttgagatttcttgtaatttcacttgtaattgtaccacctaacagtgactaaagcagaataaattacgattcgtatacaacaaagtattcaaatttctaaatgtggatatattattgattttattttgggaaacatgtttatgataatcacctatatctcctctatagtctactagaaacgatatttgtcaccttcatcgtacaagactataatgtataattctatccataatgaacgatctagtttttaacatgtactatagagatgaatgattacgacagtaaatttaacccatgcatacgaaaatacataccgatagatataacacaattcagaatgttttacacaatcccatatttttagccaatcagtgtgattttaatagacagctttctatgtcttgttgtgctttttcttcttctttttttcccaaagtctttaatgtcttctggactttatagaagacagctttttatatgttatcttcactttcgaacgactttccttcctaacatatcccaaaacctatctctttaatttattcctatcgtacttacagcttttattaaaaaaactttcttattttaatcactaaacaattaataaaacatttatttatgatttttcattttcgttaaagctcttttattaaaaacttaatcacaacaaatttattaatcttaaatttgaccttaggataaaatttatatattaatcttatatctgttatacattaaataaactttaatttctgcgcaacaaactaatttattatttatttcttgtctctgtctttgtagttttagtataaataaagccattttgctccgaggaacttctcattcagtcggaccaacttgtgaccgaagaaagcaaattgagactacgcaccaactagtcctttggtttgtatcttaagataaaggtttcttttatg

SEQ ID NO: 33524 - DNA, 3003 bp, Unknown; identical to SEQ ID NO: 33523
  misc_feature (1)..( 3003): 2750-1469P.txt file - cDNA_ID_3070698; gDNA_ID_2926200; Annot_ID_201805

SEQ ID NO: 33525 - DNA, 3003 bp, Unknown; identical to SEQ ID NO: 18837
  misc_feature (1)..( 3003): 2750-1469P.txt file - cDNA_ID_3070714; gDNA_ID_1620626; Annot_ID_162484

SEQ ID NO: 33526 - DNA, 3003 bp, Unknown; identical to SEQ ID NO: 27871
  misc_feature (1)..( 3003): 2750-1469P.txt file - cDNA_ID_3070718; gDNA_ID_1620626; Annot_ID_162476

SEQ ID NO: 33527 - DNA, 3000 bp, Unknown
  misc_feature (1)..( 3000): 2750-1469P.txt file - cDNA_ID_3070722; gDNA_ID_2214706; Annot_ID_189840
caacgagaagatgatcaaacctaattcgaatttcaatacaaatcccccaaatctatgggaaattgaaacaaatcgacattcaccgaaaatcataagcaatgaaatcgaaaacgaacctcgacaccttctttaccagaagcagcggcggaggcagacgtgtaaccggaatcaggatcgagacttaggtaaaggaagatagcgagacagaagaatcctaaagccatcacgaatagcagaccgataaaccagttctgctgccaaaatgggtattccggactcggtttcttcgccgcaggagctcgaacaggtgaggaagacggaggaggagatgatgaagatgatgatgatgatgataatggctttcttctcgagagagcttgttgttgcccggacgtcgacgccaccgtgaaggatcaaattgagatctcgccggagacagtaattggtagctaaattctgttaagtttccgatttgatccttcctcgtgcttttgagagggtcttcttcgtgcagtgtaaaaaaagttcattaacttcctcagtttatgttgacacgcaggtgtacgtttagatagcgaatgatattttaacacgtgtcattttgatgacatgtcgtcttatcagtggtgtatcaggttgcattgaggcacaatcaaagctaaactaattttaatggtttttttttgttgttcttttgaattcacactttagtttgatttaactttatgttttatgggtactagatccggcataaattgtgaaagaaaagtgtgaatcactttggtttgaattcataatattagaaaaatgatcgtgtcttgaatgaattgaaaattgtctaacttgattataaataaactatttccggttttatgtattcttctgatataatactccaacaacattgttataggctcatgattaaatatatagaattgatataaactcaacaagatttcaagagtattcatatgaaaaactaaaaataaaacaaaaatgaaagtatcatttaagtaaatacttttaaatcttctgtcattgcatatatccatataagagaaatgatctttgttgggtattaaaaataattaacaattaacaaaacataattaactaaaaaacagaaatccacaaaaatatttagaaaccaaacattgttgaaaatatttattttttatatgccataatctcgtaagttaattttacatcatggaaattaattttaaatgagttaaaattaataaataaaaatattctcattaaaagtaattgaaaagttaaatcctataagcagtttttctcaaaatattctattttcacttatgattacatgagttaaaaattttagaataaaacataggtatagtaacacatcaaaggatgcaagacgctccatcgtacgatgcgttaaaattcttaggttaaaacataggtattcaaaaatttattcttataattaatattttgtgttttgatttaacgaatgaaaacattatattacattgacaaatataattttatccaactaaactaatgttaaataaattatattactattttaaacttcaatggtctttttaattagtattattatccatactaaattatttaaaaaaaaaaataatatgtgctacatttaaatgatcaataatacatgtaaaaacaaatttgttaattttccttttgttgaataaaagttaaatatatatataattatatatagagacatataaattagtatatgtaaatttgtttacttttttagattttctatttttttaagagaataaaaaagttaaatttttaatgacacatgtaaacatctgatcgtttgacttgacacatgacacgatcttatgaattagtaactttgaaaaccatactttatataattcaaatactatctataaaaatatatttttatagatagtatttgaattttgtatggtaatcaatatatttttcttcatatttaatttaataattattgttttaaacaaaatttcagtcttatgtattctatttcaattatacacactcaatcttatcagtgaataagagaaatgatcgcgtattaaattatttggtaggtcttatgttttaaaagtttattatagtgtattaaaaaaatttagtcattatagagtagtgattattgttataaaaaatagtaataaaaagaatataatgaaagtagtgcttaatttattaacatatttttttgttttttatttttattttaaagaaatcaattaagagtaagattgatgatacatttaatttgcttatttaattttattaatttttagtttaaaaaaaatcgaatgacacatgtcattttatggagagagttgaccaactttcatatatataattcacaatttagactactatcaaatttatatccacaaaccaataacaaataagcagctctagatagaattactttgaagatgattaaaactttcgaatgaatagcagaataggaactgaaaatatgaatattacaacacaagaaacatgtcacttaatatcatttatctatttatagagatgtaaaactcattgacattgtttttatttaaatattattttggcttttgggcaacacctactatgacacattttaccaacattgctacgacaaaacggcaagcagtgtaaattagagaagagtaccgcgaagctcccatcgatattgttcgccggtaatattttctccgatttgcttacctctcttgatttctggtgagtttcattctcctatcatgtcgcacaataaccagaaaattaactcttgtaacccaaacctgctcaaattattcactatttcctcagttgtttcatgtaaagttcgagtttatctggagtagcttttcatattcaatagaaaagtccaatgctttaagttttgaaacctacccagaactcaatgtgaccaaattaggtgagaattgaggctaaaaccctaatgtatatgaatgttttgttgaaggaatg

SEQ ID NO: 33528 - DNA, 3000 bp, Unknown; identical to SEQ ID NO: 33527
  misc_feature (1)..( 3000): 2750-1469P.txt file - cDNA_ID_3070722; gDNA_ID_1620626; Annot_ID_162475

SEQ ID NO: 33529 - DNA, 1872 bp, Unknown; identical to SEQ ID NO: 13437
  misc_feature (1)..( 1872): 2750-1469P.txt file - cDNA_ID_3070726; gDNA_ID_2214627; Annot_ID_187852

SEQ ID NO: 33530 - DNA, 3000 bp, Unknown; identical to SEQ ID NO: 3120
  misc_feature (1)..( 3000): 2750-1469P.txt file - cDNA_ID_3070726; gDNA_ID_1620626; Annot_ID_162470

SEQ ID NO: 33531 - DNA, 3000 bp, Unknown
  misc_feature (1)..( 3000): 2750-1469P.txt file - cDNA_ID_3070754; gDNA_ID_1620627; Annot_ID_47164
ttcaacaaaatattaatcattttatttgtctttaattaagtaagtgagaccacaacgaaaggtggtaataagaatcaacatgcaaatgggtttcataagtcaatcattttcaaacgcttttttatttcaaccatacattttctgtttctcttttgataggtaaataatatttgttatattttaactttttcacatttttaatgaatccattatgtgaattgatagtataggcttataaactaaatattacttaactgaagttccctttttttaatctctaatttgcttacaatttgattaaaatatatattaactgtatgtgacaacaaaatttaataaccaatttcacttattaattatgtttttacagagaatacatcacccgaactgtttggtgtcgagtaaacaaaagttttcagatttgccaagtttagagatctcattgttggtaaaagagtttggtgtagagaaaacaagagtttagatttgtgtaagatctaagatttagcattggctgtacgtgtttgctgctaaagttctgttacatttttgtaactcgttttatttttctttgacattttctacggtggtcttgggaatgcatgaatgctatacaaaatatcaaataattgatggtacgtaatttaacccttgtgacagcaccccactttacacaaattgagtatggttttgaagccactcacaacagtatctgtcacaggttatattgtttgccaaaatgatgattttttgactgaattatttcattagatatcgaataatatattgatgtgttgatgttatatatataaccaagtatactgtatagcaattgttacgaataagaagttttacatgaaacatgttaattttcagcatatttagcaacagtgacatggtccattttgtttttgctacgcatgtaaatatcattagaaatgaacaaacaggttttacaagagttgttaacctacacaattgaatccttggcaataaaagtttaaaaacaagggagacagcaataatgtctgggagaactcttgggagagatcatggtgatatggtccatgtgccccgatcggttaatgttgcataatcgggaccgtcaagatactatatcacgccaggtgatattcgaattaatttgcatttacctaagaatctgtcttggaatgctaaaggacaatgaaagtaaattgtgactagctcattttgaccaactttgcactttatactttacataaaaacacgtaaaaatctgacggcggtcatgaggcatcacctggccatactccctcaaagtagtggtattgattacaatattcatagcttgaacttctaactcaacattttaacatgccacctttcatttccctagtgtataattactctctataagtggagtgagaagttgtattacggtaaaattaaagcttaattacaacctagacatatcatagtataattaattccaaaagcttaactagttgcatattactaatttttgttaaaattttggttcggttataaaattatattattatagaaatataaagcatgattttttaaaattagttgaagattggtgttggatacgataatatttgtgtagataataagattaacatgaaagtagtcaagtggagcatcaagaagcatgatggtgaatcttaccctatacggtttacacacgcgacagtcgcgtctaagatgaaacgcactattctttgttttatacaatttatattgtttgctttcttctcgacgcgtttatatacattatcacagggacaagatattatttgttgttatgagagctaataaaataaaattagttacggacctaattttggctgcctaatcatgaagttcaagagtgctcggagacaacataaaatatgtcacacgtggcggacacctaaacgttcatttttactggtatgatgaacaaaacgagcaaacacgcatggttaatggaacttaattcggtatgtaacgattcgggttggagatggaatgggaactagaacttttgcaatcaatatttttgctccaggagtgtattaaatttaagtgatacatgaattgaatttttatttttaaaatgagatgcatttttataaaatattcttatgttgtgtttaataatttttttttcttagttattatcaatagtagaaaacgttgaaacgtgtttatagtatatatattttacaatgcaagcttggatagtttacataacgcgcgtagttatatgatggcaacaaaaagatgtagttatatcttacatgtgtacggagaacaaatatctaaactaattaattagctagtttgagtcctggtagaatattggaaaattagattacgttttttaatacaatgatgaaaaccatcaaaattaaatatattatttatttggatggttagctagaaagctatcagccgatcaatggtttaattatattattggtcatgccaaaggaacaaattaccaataagttttaagggtttctttgcagtttagtaacgcctatattaaaagctcatttatttttatttggtttaaaggaaaaagaaaggtcacttaaatgactacgataataatataaaccaaggtttggcataaaagtttgacaccaaaataatacacgccaagagtgcataccacataaaattatcgaatattttccatttttaaaaaccatagaaatatctgagaccgtcaatctgcgatgttcttctctctcttttaccacgaaacgacgacgtccctagcatataagcatggaaccattacacatattaccatgtctctatatatagtgaaccattggcctcgctagttaattcatatcgaagaaaactcaaatagaggaatcaagagtcgaagatctctatatattttcccttctcttgtttccttattagttttctccgacactcccattcaaaagtagaaagatactgaagagctcgctcattcacaaaataaccaaaatg

SEQ ID NO: 33532 - DNA, 3000 bp, Unknown; identical to SEQ ID NO: 33531
  misc_feature (1)..( 3000): 2750-1469P.txt file - cDNA_ID_3070754; gDNA_ID_1620627; Annot_ID_162519

SEQ ID NO: 33533 - DNA, 3000 bp, Unknown; identical to SEQ ID NO: 33531
  misc_feature (1)..( 3000): 2750-1469P.txt file - cDNA_ID_3070754; gDNA_ID_2926186; Annot_ID_140808

SEQ ID NO: 33534 - DNA, 3000 bp, Unknown; identical to SEQ ID NO: 33531
  misc_feature (1)..( 3000): 2750-1469P.txt file - cDNA_ID_3070754; gDNA_ID_2926186; Annot_ID_200650

SEQ ID NO: 33535 - DNA, 3000 bp, Unknown; identical to SEQ ID NO: 3173
  misc_feature (1)..( 3000): 2750-1469P.txt file - cDNA_ID_3070797; gDNA_ID_1620629; Annot_ID_162616

SEQ ID NO: 33536 - DNA, 3000 bp, Unknown; identical to SEQ ID NO: 3168
  misc_feature (1)..( 3000): 2750-1469P.txt file - cDNA_ID_3070801; gDNA_ID_1620629; Annot_ID_162612

SEQ ID NO: 33537 - DNA, 3000 bp, Unknown
  misc_feature (1)..( 3000): 2750-1469P.txt file - cDNA_ID_3070821; gDNA_ID_1620630; Annot_ID_162661
tatgttacttacttaattttagattttatagtgctatatccttaaataatttatgaaaataggttacttttgcaattcacccattattattttcgtattagaaatagaaatcgtctacttattgtgtcgaatttgtttttaacctttaaataaaataatgggcctctaaaataaagacaattagggggctaggttgttgagcccaggaccgattctagtactactagactagttgttacaaaattagttttattataggatataattttttatatattttaaattcttaaataattaatctttcaattttttgaaaagaaaagtactaactcactcgtattaaatagctgaaaattttgaagatgagacacgtccgaatgagacacaagtacaaaggacatgattcatcatcatcccatgcataaaaaagacgacaatcaaaaaagcaaagtaaaaaacaaacactcacacgggagctggaaagagatataaatggccaaaattttaagaatatatcaaaataaaacgtggagaaagggattaaaaaagctatgtaaagatataattgcattgtaccaaaaaagaagaagatataattgcacacatacgtcatattgtttatcaaaactcaaaccaatattctttaaaaaaaaaaaaaaactcacaccaatcttatatcctaaatcattcgtgttgcgagaaatcttacattcagcttttaaattcttcattgattcttgacatgtatttctatatttggtgaaacaaatataagttgttttaagttggtctacgaagtttgtgctcgcaagagagaggatatttgcaaatttaagctgtgattttgtaggaaaatgattgtattgggggatattttgcaaattgcaatggtatgtatcaagttagagacaaaaatcacaaaagtgggctacaatatgactttgagtattaatgtcggtatcttcgagaaccatatgattcccttatctagtcagatactgcactatttatatccattcagattatgccacgtgatggtcaaactggatgttcagtcaaacctttgactcagtggatccaatatacacatgcatgtcacttaaattatgatagaaagataaatttattaccatatctataaggttagattctcttttgttgaaacaaaatttcctagctttttagtaaaattttcagtcaactaataataacatttcaaactatggcaagattagcattataaagaaggaactaaacctaataataatacttattaaatggtgaaattttggtttgtattctccaaaattctgaaaatttcatagccattattggagtcatctgcttttccttttttgttcttcatttttttttcctagtcaatagagatattttctctttcttactgcatcgatccatatcttgactgaataaatacgtcaaaagaaagcattaacgattacacactctcatacttatctcctcttaggtttctcatttctctcgtctctttggaaaataaaaattgttgatcagaaataaaggagaaaagaataaatggcagatcaaaatccaagaatcatcgtcgagcaaaacccatctcaagctcgtcttgacgaactaaagttcaagtcatggcccaagtaagatcgactcttgtttttaatccttacttgtgggtgagagatccatttggtaaagttgcatgagatagatttagaaaattgagttttggttttctttgttgttcaaggtggggatgttcaccagggaagtaccatttgaaatatgaagcagaagagatatgttacattttgaggggcaaagttaaggtttaccctaaaccaccaccatcatcatcgtcggatgcagaagttgaatggtgtgtagagtttggggcaggtgatattgtcacttttccaaagggactttcttgtacttgggatgtatctctctctgttgacaagcactacattttcctctcttcttaatttttgtaaaagttttttttattattctttattttttgtatttctaacattgtgtttcttattagttgttgtaattggtgttctgtttttttttttttagtaagaaatatagatgtgtttgcatttataatcgcataatgaaacaatgttcttcaccaatcaagcttgagcaaacctcatcaattcgaataatcctgagatgaatcttcaagaaaatataaaaattatactcattaatcctataaaaagtggggcatatacaaaagccttcaccactagaaccccaacccttttttctagattgaaattcaaattcatatgagttgttcaaatgtttggaaattaagaaacggtaaacgttggattctctttagtcaacaagaggtgatcttctttacttgtccatttacgcttctattatactactactaaatttcctttctttaagatccgctgaccagtcaactttccatcttgtttatctttaactagggtaagcagagattttaagatcaatattggaagagaaatttaatagaaagatgcatactgtaaaaatttcacacgttcaaatgttatttactcctttgttaaatcaatgctggttagcattttcaaaagccaatcgtcaacataaatgtagcattaagtccactatcataagtcataactgtttaacatgttaccattcaaaaccaacaacatgtcacataacatcatcaaaagatatgtgatcatcatgtgagatacactttggacacaaatttgacaaaagccagaagaaaaaccagttaaatgctttcaataaggaaaaaaagaaaaaagaaaaacgttccaaaaccaaaaccttctaactcatcgaaaagatttcggtccaaaccgattgaactggccggtttatgaatttaaaaacaccgtccaatcgaataacatctggattttacacacacacacacactctctcacactcgttgaccaaaaaaaaaactctctctttcactgagaaatg

SEQ ID NO: 33538 - DNA, 3000 bp, Unknown; identical to SEQ ID NO: 3180
  misc_feature (1)..( 3000): 2750-1469P.txt file - cDNA_ID_3070825; gDNA_ID_1620630; Annot_ID_162660

SEQ ID NO: 33539 - DNA, 3000 bp, Unknown; identical to SEQ ID NO: 3201
  misc_feature (1)..( 3000): 2750-1469P.txt file - cDNA_ID_3070840; gDNA_ID_1620631; Annot_ID_162690

SEQ ID NO: 33540 - DNA, 3003 bp, Unknown
  misc_feature (1)..( 3003): 2750-1469P.txt file - cDNA_ID_3070844; gDNA_ID_1620631; Annot_ID_47251
aaaaaaaaataattatctaaaaatcaagataattataagattaaaaatccattttattgtttaactaaaactaagcagaggacatatacactaagtgtataaagttcttaagacaagtaaactaaaatatgcatcctccaggtcctccaaataaaatagctcttgaccaaaattcaccaacacctaatattttttggacattataacagtttggactgcttgcgaatgtctttaaagctgaagctaacggactcgaaacttcttttgttatatcagtgattatttttaaaccattcacataggctgctttcttgaaaccctcttgtgggaaatgtccacttcccatgcttgggctcttctctttcactgaactgtacacttctcctccccaaaacacggcactcgctccatcagctaaaccttgacgtgtgaacaatgattttggccagtatccaattggctcgttatttagcacaaaccaccaatctcttgtaacatgatcctgcttaaatcaaaagttgttaacataatcttgacttttcgatattagtttgaagaaagctaatgttgtatatttatatatatacctgatatatgctgacttctagttgatattgttgaccatcataaatggaaactggttgggcgagcattccaattgcatacttggtgctcacgtgtacaaacccaggacgtagtgtattgtagcaatgagtcttattatttccatccgcctatttaaatcaaagatagtagccataatatgaatgccacatttaagagtcaagactttaagaagttttgaaaaacttacagtccagtaagtgaacaagtgactttgattattctgatttagccctggatacacctaaaaacatattttggaatgttagttccaaatttttgatttagaaaataagtaaaaatagggtctagcttgacttacaatccatccagcagaaatgctttgaaatcctttgttgcctgatacagccatagccgcaagactaaattgatcaggtgagacgtttggattccatacgttaatgtttccttttgctccatagtggtcatctttgtaactaattgtggcaaactaaaatccgaagagaaaaagaatagataatcaaaaaatattataagcattgtggacaagttacaaggcgatctcaattcaactacgtgtaataagaaatgattcttacatgatgaccagttaaatcaattttcttgtcctttgcagacacttgtcctggatagttgaatcgtaaggattgcaaacgttgagctcgtataagatcttcaagtataattcttttgacaatgactgtcccaactggacaacttatgtcatcttgtcgaaatggcagagaactagttttatgagaagcgttgttatctttggtccatttaggtatagttgtgggtttcaactgcatttatatttcaatccatccaaacattaataagaattttatttatagatattttttcgtggtttgtaggataaaccttaatagaatggttcttgagcaaaggatgatcaaaagctagctgtttttgaatgtcgatgcagtcaaatatataaccatgttcagtctgtcgaaatcaaaagcaagaaaaaattggtgtggtctgaaaataaatgtaacttgatgatagttgtaatattgttacaatagtcaacaatttttgtaatgttttatgaaaatttaagaaaagaaaggctaaatttacttggaaacttttgactgcaggtttattgagataggtaagtagcttcttcatctcttctttctcctctttcgaaggtattgttttgtgactctctccaactaaaatgagagctattgttgataaagttagcaagataattagtttattggaatacctcatgatgaatcaaggatcttaatctatatttttcaaaagaaaaaatgaagcagaacaactatatttattgtgtcacataaatctgagatcatttataaccaccaaagaacctatacacagtaaatgacaaatgtatctccctctatctctattgcccatatgtagatgctaaagtaagatttctcttttttttaatgtacttttttttgtataaagtatattccataagaaaaaggaaaagcttgtttatggatcaattgaccccaaaaaaagtttttagatcaaagcccaatataaaaaaaaaacacagtagtgacacaaaggaacttaaataaaccatgaattgatctataaacagtagagatcgataaggcgaacattttccatgtgaagtgtcttctttcatctataatatttttgacatccaataatttcctctataatatcattcacataattgatagaaacattatgttagaattgtccacatcatttgagctgtaatatattctgttttaacaaattatatggtagttgcttaatcttatgtccatcttcttctatgcatcgttttcgcgcctagttgtccagtccatttcaactacctacctctaattcttatcttaaaacaacattttttaatttaagtattatgctcaaagactaactagatagaaaaccgttattaaacattaaacgaattaaaagtcttacatggaaaatgtaggtttataaaccacgagttatgattgacaataaaaaaaatgcaaatcatcaatcaaaagagacttgagtgcgactctatatcaaccattgcaattaaaattatctatcacaaaaattttagacagattaagttaatttagtctaaattcactaatttattttctataattagtaattaactatatttatttatttacacattttctgataatttagaaatttgcatgaataacaaatataagattttggaaattagtagcaaatttaattaataattatttttgcctaaatgaaccaaactataaaacctccacatacaccagtcatcaaatttacagagacaacaaactaaagttggtggtgatagagtgagagagaaacatg

SEQ ID NO: 33541 - DNA, 3003 bp, Unknown; identical to SEQ ID NO: 33540
  misc_feature (1)..( 3003): 2750-1469P.txt file - cDNA_ID_3070844; gDNA_ID_1620631; Annot_ID_162684

SEQ ID NO: 33542 - DNA, 3003 bp, Unknown; identical to SEQ ID NO: 33540
  misc_feature (1)..( 3003): 2750-1469P.txt file - cDNA_ID_3070844; gDNA_ID_2926182; Annot_ID_140607

SEQ ID NO: 33543 - DNA, 3003 bp, Unknown; identical to SEQ ID NO: 33540
  misc_feature (1)..( 3003): 2750-1469P.txt file - cDNA_ID_3070844; gDNA_ID_2926182; Annot_ID_200329

SEQ ID NO: 33544 - DNA, 3003 bp, Unknown; identical to SEQ ID NO: 18911
  misc_feature (1)..( 3003): 2750-1469P.txt file - cDNA_ID_3070852; gDNA_ID_1620632; Annot_ID_162743

SEQ ID NO: 33545 - DNA, 3003 bp, Unknown; identical to SEQ ID NO: 18911
  misc_feature (1)..( 3003): 2750-1469P.txt file - cDNA_ID_3070852; gDNA_ID_2926154; Annot_ID_198287

SEQ ID NO: 33546 - DNA, 3003 bp, Unknown; identical to SEQ ID NO: 18913
  misc_feature (1)..( 3003): 2750-1469P.txt file - cDNA_ID_3070854; gDNA_ID_1620632; Annot_ID_162739

SEQ ID NO: 33547 - DNA, 3003 bp, Unknown; identical to SEQ ID NO: 18913
  misc_feature (1)..( 3003): 2750-1469P.txt file - cDNA_ID_3070854; gDNA_ID_2926154; Annot_ID_198283

SEQ ID NO: 33548 - DNA, 3003 bp, Unknown; identical to SEQ ID NO: 18915
  misc_feature (1)..( 3003): 2750-1469P.txt file - cDNA_ID_3070862; gDNA_ID_1620632; Annot_ID_162731

SEQ ID NO: 33549 - DNA, 3003 bp, Unknown; identical to SEQ ID NO: 18915
  misc_feature (1)..( 3003): 2750-1469P.txt file - cDNA_ID_3070862; gDNA_ID_2926154; Annot_ID_198275

SEQ ID NO: 33550 - DNA, 3000 bp, Unknown
  misc_feature (1)..( 3000): 2750-1469P.txt file - cDNA_ID_3070879; gDNA_ID_2926147; Annot_ID_197816
tatggtagaatagatatgtaattaaagaataagatggtgaaattagttagaagaaagaatgttgtttaaagagacgcgaaaattgattgtacctaggattgaaatagtaggtgatgactgatgatgaagggtacaaagaatcatcaaaggaaaaaaaacattgttagggttacaaagatgcaaaatgtagttaaactgtacattcaagctgaattaaagctatagttaccaagattttttaattttatgttaaatggacgagacaattaccttccaattccaatcgacataatatacaatacaaacacaaaagcaaataggacacgctgaatgttagcattatgagcttattattattttaaaattttaaactacgagtagagacatcagaaaaatgaattacggtgaaggatatcgatgaaaaaatactcatttttgattcaaaacataaaggttgtaaaatgtaaatgactatggtaaagagaatagataggtaaattaaacaattaatagtactctctgtttctaattaagtgtagtttaaaggttttttagttttccccgtaagtgttgttttcacttttgtatgcaaatattaaatgtatttaatagtttttaaccaattatattttacatcatatttttttttggttggattagttgtaattaatgatatatttataggaaagagataaattaaatgaaatttatatattttcttaatttgtgtgcaaaaaccttaaattacaaatattcagaaagagagagagtaccaaataattttttaaaaaatttctacatagaaatgatattatcagaaagattttttttttcaaaattttggtcttcgactcgaagtaatcttttttctaccttatttatctttttgggaatttaatgaaaaaaaacctcaactttggccagatccatttttaaaccctaaactatgtttttagtaaaacaaactctgaactaaaacctgttaataaacttaaccccacagtattaaatattaatgggatattaatttccaaaaaaaacaacaacgagacatttgtatttagcgcaaaaaccacatgatgttctttaaaactgttttgaatttattacaaaaaaaacgtttagtgttctaaatgattttgaattgcttaattagtttggattttagaagctgaaagaaagacacaacaacttaaaataatccaaagagtcatgcttaaataaatccaaccaacataactatcgaagctgttgcaacacaacaatatttgtcacaaaaaaaaacaatcgtttcagagggacaagatattttaaagtaaagacttgtcaagcattcactttgaagagaagattgtattggttgagtgatagggttctcttcatccattgttttctgttttttctttggtcgtccttgaggtttcttgggtggttttggcactgctttacgcttgcatgaacgtttgttgtgtccgacttgttgacagttgctgcaagtctaaatatgcaaagattaaattaaataatttgaaaaggaagatcttatgaaacataattcattgttctctattttaccataattatatcaatgttaagtttattaacatgtttaagtttattactgtggggttaagtttattaacaggttttagttcagcgtttgttttactaaaaacatagttcagggtttaaaaatggatctgaccaaagttgaggttttttttcattaaattccctatctttttttggttctcttatatctcgccagcctcactcatctatcaccatagacagccacaccaatggccatcgataagccaatacaaattggtgtgacgggatgcgccgaaatcgctaggaaggtctcccgtgccatccatctcgctcccaatgcctaaactttaaactggaaatcaaacctcgaattcttattattttctaaatcataaaacctacacttttaatcaaaatcaaaaatattaatttaagctctaaaagccaaatgttaaaactctaaaactctaaaccataaaagttatggcatttcttcagttttaaaacaattagcctaatgtttttttccttagtttttctaaaaatagattgaatattataacttcttgatatataagaaaaaaagttatttaaaaatgagtaaatttggaaaaatgacctatttttgggttttcatttgaaaaataccttattattttttctttttttaaacaattaattttcaatatataaaatactaaaacagcttcagtaaaattagggaataacaaaaaaaaaaacttaaaacaaaaaaaaatcataaatacaaatttgatgtaactaataattttaaagataattattatcttaaatagttttaaacaaaatgttgtccaaaaagtaaaattaaactttatcaactgatagacttttatagaaatatttgtaaatattgtttcataaaattttaatataaaaaataaataaaatgatagactttatatgaattcaaatttaatttttatcttaaatattttaaacaaattttcgtccaaaaaaataagcaaataagttttattaggtgatagactttagaatatttttccgtattattttgttaaattttataatatctaaaacaaataactttttatctcaaaaaatagttgaaaacataattaagaattcgaatttattttacttgaattttgtttttctaaatttcgaattttattttaatttattaataaaacaacgtttataatctggataaatttatcatcttatatattaagaattacaatttttatttaaaatagaaaaagatgtattttccaaatgaaaactcaaaaacaggtagttttcaaaatctcccattaacaatttatctcgtcttgttgtaacaacttcacctatttcattcgttctttatcaacaacactctctctcttctctatcaacactttctttcatctctcgccggaaaaacccataaccacaacaatg

SEQ ID NO: 33551 - DNA, 3000 bp, Unknown; identical to SEQ ID NO: 33550
  misc_feature (1)..( 3000): 2750-1469P.txt file - cDNA_ID_3070879; gDNA_ID_2926147; Annot_ID_139148

SEQ ID NO: 33552 - DNA, 3000 bp, Unknown; identical to SEQ ID NO: 33550
  misc_feature (1)..( 3000): 2750-1469P.txt file - cDNA_ID_3070879; gDNA_ID_1620633; Annot_ID_47290

SEQ ID NO: 33553 - DNA, 3000 bp, Unknown; identical to SEQ ID NO: 33550
  misc_feature (1)..( 3000): 2750-1469P.txt file - cDNA_ID_3070879; gDNA_ID_1971919; Annot_ID_177176

SEQ ID NO: 33554 - DNA, 3000 bp, Unknown; identical to SEQ ID NO: 33550
  misc_feature (1)..( 3000): 2750-1469P.txt file - cDNA_ID_3070879; gDNA_ID_1620633; Annot_ID_162755

SEQ ID NO: 33555 - DNA, 3000 bp, Unknown; identical to SEQ ID NO: 33550
  misc_feature (1)..( 3000): 2750-1469P.txt file - cDNA_ID_3070879; gDNA_ID_2926265; Annot_ID_204908

SEQ ID NO: 33556 - DNA, 3003 bp, Unknown
  misc_feature (1)..( 3003): 2750-1469P.txt file - cDNA_ID_3070911; gDNA_ID_1620634; Annot_ID_47321
aaagaaagaaagaccttgttctagtgcccttagtgttctcagcagtttctcctttccggagagccaaagcagaaggtttcagattaacctttgctctctcaataatagcttggcattgttctgcagttgcaaaattcggaaaatatatagccctaggtctccaactaagtacctgccaattttaaaccaaataatccataaagatgaagtactaaatttcactagttgactaattgctaaaaaacacaatactctcactcacactcatggtcaccacacatgaacaaaaaaacaaagttcaattagataatcaaatgcacaatcttgccctaactaatcgatttcacctaatttgccaatccaaacatcttaaaagtcaaaaaattagcaacaaaatcagacctgaaaaggaatcgatccaatagattcttctccagtaacaccatgaggcatcgagctagcttcttcttccccattctcaaccatatccaacattctcaacctgggtttaacacgaggcacattctgatcccaaacatagaaccctcgattagtcacaaaaccaagctaaagactccaatcacatctaaagagtacagagtaaaagatcagagagtttccacacctgagaaagtagagtggagccatagaaaccgaagaggaaacagagagaacagaagacgataactgtggctaaccctagcttcttcctcctgtagctcttcaatctgctcttcatcgagccttcttccttccgatcagattaagtttccgatggaaatcttcgccggcgtaaacgatcagataagtttccgatgaaaatcttcgccggcgtaacgaacctcaatatcgggacgcctttcgtcgatccaatgaagcaccacaaatttctatttactttaaaatatattgttttatagtttaatgatcagatctcgttgaccagtttgtcattttcttcactggtcaacaaatacaaaaaaatgcgccgaatttatccttttttttggttgaagtttggttgcgtagagtggtttaagttttggttcgatggaacttgaacgtttttgtgatttgaattaggtgggcttcttttgagttgttttgcttcattcaggctgtcgataatgacttggaatcgatcttagaatgtaaggtggatatgtagtccaacattgaattgtgtttatggttaaaaagtaaagaatgattatttattaattatatacagtcaaattagagagtcttaagccgagatcaatacattatccaacgaaatttcaaatgagtttattttcttaactaatagtctatattcttgcaacttctttttgataaccaaataaaatgtgtaaccattctacaaatgattttcatatagagatttgagtttagaaaagaataagcaagaagaagattcaagtagcctttgtgtcgagaagaaggttcaaggagctctctttgtgggctatagaactgttgtttaagaaagaaggtgactcatttaatgtttggttcttggggttcacagagcattgttcactgaagagagatgtgatactagagagattcttagtgagcattgacagaaataatagtagtactaattaagtttttttttgtttgatgaatcttgtatgcatcggtataatatgagtggatatgcaaatgttaaaaaaaataaaatgaatggatctatatatgttgaaaatcaccctatgatccataacaacgataaatacgcatccataatgttataaatgtaaaggtaaacatcatgatcaaaaaagttcgacaacttgggccaatgaatttccagttgcttccgcgtatatatataagtccttccacgtcaatttcttaatcccaaaatgcaaacctttttataacaaccaaataaaaatgtgccacttgtaattaaatataaattactccataagcaataatattcatcgttttaatagtatgctctagaacacagcacacaaagatttgttttgaccagaacatgttttttttcttataccggaaacggtaacgtgataataaaattaggttaataataatatagatactaagatgactagattattagcaagaaattgtattcagttgttatccgtctttcttagttgacaagcaaatatatcagctacacgttggctacaggttactcatccttacccattcattattcgctcattataacaatttcccactgatatattcaaatacaaaatatataagacacaaaatagaattaatttattgctatttgcagacgatgtaaacatttttgtagacatgaacaatttaattgattctttactcatcgtagacatgaatttatatttcaaaagggtctactatttctaaataatattcaaacattgactctgtaaatcacatataaataaatatatatattatacactacattaatataatatctcctatttcaaaaagaaataaaagtagctgttgaatttagatatttttttgttggaccgaatcagaatttaagtttttgaattgttccagaagaaagatattttagtataatatacggcaatgacgtttatgtttgggccaaaactttgtctatttattgagaaaaataaagctaaatggagaagaataacaaaaataaacaacgcgttgaaaaaaactgcaaaaaaaaagagaagggggagggcgaaattaaaacaaaacgacgcgtagtctacgtagccttctaagaaacggcacaagtacaagtcatctctatcaatattcttcttcttcttcctcacgcggttttcttttaccaccaccaactcaacacacacacgaatcccttaaaaccgatcagatcaaacaaaaacgaacgaatcaaaattcaataaaaaaaaacctttcgatttctctcatccaatcgaatcgaaaatcttgttatctctttctctctaactctactgcactcagaatctctctgtatagaaaaaccctaagtaggttgtgatg

SEQ ID NO: 33557 - DNA, 3003 bp, Unknown; identical to SEQ ID NO: 33556
  misc_feature (1)..( 3003): 2750-1469P.txt file - cDNA_ID_3070911; gDNA_ID_1620634; Annot_ID_162815

SEQ ID NO: 33558 - DNA, 3003 bp, Unknown; identical to SEQ ID NO: 33556
  misc_feature (1)..( 3003): 2750-1469P.txt file - cDNA_ID_3070911; gDNA_ID_2926206; Annot_ID_141741

SEQ ID NO: 33559 - DNA, 3003 bp, Unknown; identical to SEQ ID NO: 33556
  misc_feature (1)..( 3003): 2750-1469P.txt file - cDNA_ID_3070911; gDNA_ID_2926206; Annot_ID_202211

SEQ ID NO: 33560 - DNA, 3000 bp, Unknown
  misc_feature (1)..( 3000): 2750-1469P.txt file - cDNA_ID_3070915; gDNA_ID_1620634; Annot_ID_162814
ccctgaaacaacgcttccaagaacggctctcgagtccccaagattagcaacatacagtgtgtcattagagattgcaccaacaagacagcaagatcctacagtagccatttgcggtttcatgggaagggatcgtttaaccataccacaaaactcttcttctgtttctttgaatgcctttttgataacatctacagataatcccccatgttctcttgcaaattctgcaatcataaaaccaatcctgtaaatttcactaacaagaacatgactacaaaatcaattcaagaggcaatttacaaacctgaacatgttcacaaagaccaaaacttcatagcaaaattcgaatcttttaatattgaaatgatcagggtaatagagatctcataagttttgaccatcaaaaacgtagtcaaagagtcaaaagaagaaagaatcctaaaacaagtttagggaaggaagagtgggattataacttactgtgcatataaggaaagagatgtctgttaacgaatctagaagcttcaggtccaccatgaccatcgtatacaccgacgtaagtagcagaagaagatgtgaaaacctgactctgatcttcaagcctggaattggcttgaaccaccgcgatcgaataatcaccgccagcgtgaggtctcaattccgattgccagagtaaaccatcaccactagctctgcttcccaaacaccgttcgagaggccgtgctaaagctcgcaacatcacaacctacttagggtttttctatacagagagattctgagtgcagtagagttagagagaaagagataacaagattttcgattcgattggatgagagaaatcgaaaggtttttttttattgaattttgattcgttcgtttttgtttgatctgatcggttttaagggattcgtgtgtgtgttgagttggtggtggtaaaagaaaaccgcgtgaggaagaagaagaagaatattgatagagatgacttgtacttgtgccgtttcttagaaggctacgtagactacgcgtcgttttgttttaatttcgccctcccccttctctttttttttgcagtttttttcaacgcgttgtttatttttgttattcttctccatttagctttatttttctcaataaatagacaaagttttggcccaaacataaacgtcattgccgtatattatactaaaatatctttcttctggaacaattcaaaaacttaaattctgattcggtccaacaaaaaaatatctaaattcaacagctacttttatttctttttgaaataggagatattatattaatgtagtgtataatatatatatttatttatatgtgatttacagagtcaatgtttgaatattatttagaaatagtagacccttttgaaatataaattcatgtctacgatgagtaaagaatcaattaaattgttcatgtctacaaaaatgtttacatcgtctgcaaatagcaataaattaattctattttgtgtcttatatattttgtatttgaatatatcagtgggaaattgttataatgagcgaataatgaatgggtaaggatgagtaacctgtagccaacgtgtagctgatatatttgcttgtcaactaagaaagacggataacaactgaatacaatttcttgctaataatctagtcatcttagtatctatattattattaacctaattttattatcacgttaccgtttccggtataagaaaaaaaacatgttctggtcaaaacaaatctttgtgtgctgtgttctagagcatactattaaaacgatgaatattattgcttatggagtaatttatatttaattacaagtggcacatttttatttggttgttataaaaaggtttgcattttgggattaagaaattgacgtggaaggacttatatatatacgcggaagcaactggaaattcattggcccaagttgtcgaacttttttgatcatgatgtttacctttacatttataacattatggatgcgtatttatcgttgttatggatcatagggtgattttcaacatatatagatccattcattttattttttttaacatttgcatatccactcatattataccgatgcatacaagattcatcaaacaaaaaaaaacttaattagtactactattatttctgtcaatgctcactaagaatctctctagtatcacatctctcttcagtgaacaatgctctgtgaaccccaagaaccaaacattaaatgagtcaccttctttcttaaacaacagttctatagcccacaaagagagctccttgaaccttcttctcgacacaaaggctacttgaatcttcttcttgcttattcttttctaaactcaaatctctatatgaaaatcatttgtagaatggttacacattttatttggttatcaaaaagaagttgcaagaatatagactattagttaagaaaataaactcatttgaaatttcgttggataatgtattgatctcggcttaagactctctaatttgactgtatataattaataaataatcattctttactttttaaccataaacacaattcaatgttggactacatatccaccttacattctaagatcgattccaagtcattatcgacagcctgaatgaagcaaaacaactcaaaagaagcccacctaattcaaatcacaaaaacgttcaagttccatcgaaccaaaacttaaaccactctacgcaaccaaacttcaaccaaaaaaaaggataaattcggcgcatttttttgtatttgttgaccagtgaagaaaatgacaaactggtcaacgagatctgatcattaaactataaaacaatatattttaaagtaaatagaaatttgtggtgcttcattggatcgacgaaaggcgtcccgatattgaggttcgttacgccggcgaagattttcatcggaaacttatctgatcgtttacgccggcgaagatttccatcggaaacttaatctgatcggaaggaagaaggctcgatg

SEQ ID NO: 33561 - DNA, 3000 bp, Unknown; identical to SEQ ID NO: 3242
  misc_feature (1)..( 3000): 2750-1469P.txt file - cDNA_ID_3070924; gDNA_ID_1620634; Annot_ID_162804

SEQ ID NO: 33562 - DNA, 3003 bp, Unknown; identical to SEQ ID NO: 18943
  misc_feature (1)..( 3003): 2750-1469P.txt file - cDNA_ID_3070944; gDNA_ID_1620635; Annot_ID_162874

SEQ ID NO: 33563 - DNA, 3003 bp, Unknown; identical to SEQ ID NO: 18943
  misc_feature (1)..( 3003): 2750-1469P.txt file - cDNA_ID_3070944; gDNA_ID_2926178; Annot_ID_200027

SEQ ID NO: 33564 - DNA, 3000 bp, Unknown; identical to SEQ ID NO: 3254
  misc_feature (1)..( 3000): 2750-1469P.txt file - cDNA_ID_3070958; gDNA_ID_1620635; Annot_ID_162857

SEQ ID NO: 33565 - DNA, 3000 bp, Unknown; identical to SEQ ID NO: 3254
  misc_feature (1)..( 3000): 2750-1469P.txt file - cDNA_ID_3070958; gDNA_ID_2926178; Annot_ID_200011

SEQ ID NO: 33566 - DNA, 3003 bp, Unknown; identical to SEQ ID NO: 23878
  misc_feature (1)..( 3003): 2750-1469P.txt file - cDNA_ID_3070962; gDNA_ID_1620635; Annot_ID_162851

SEQ ID NO: 33567 - DNA, 3003 bp, Unknown
  misc_feature (1)..( 3003): 2750-1469P.txt file - cDNA_ID_3070966; gDNA_ID_1620635; Annot_ID_162849
tttactaaccgggggaccgtatatatacggacagctcatatgaattaaagttttatgggtgagtgatcctaaaaagaaaaagaagatgtaaagtttatgtactgaaaacacacatatatagatagactcattattgtaattaattattacatgatatccgttgacttggatggaatgcatcctaatgattcatctattaccttcaatgaggttgaagtatatatgctcaacgacaaaatgaatctgatcaacatcccgaacgattgtttctcctcccaaattatagctgtcaccataatgaacttattcatagtaattctgtagccacaccgacaatatatttcgatgtaaaaatctttgatccatcatatttgtcctaaaattatttctaatttatttcttatttttatttgttatctaaatatacctaatctcatagctctattaatattttgacgttaaatcattgtataataaataaattgatgtacgtaacatgttcaaatatatacatttattttcagtagacttttagacacacaatttatatgattagagtcgaatgcataaaatctcaaacgcgaaaaataagcggttaaacttttaaacacaaaataatataaaaattgagcggttaaatcccaattgcggcggttgaatagtaccgatcaaaccaaagattttggaatttgacggaacaaataaaccgtggagcattggtcaataacaacactctttactctttcttccgtttgctcgaaccatctagtctaagagaaagaaaaaatactaaagagaaagaagaagaggacttgaatacggaagcttgagagaatgaaagcgatcgtgatctcggagccaggtaagccggaggttctgcaactccgtgatgtggcagacccagaagttaaagacgatgaggttctcatcagagttctcgctactgctttgaatcgtgcagatactctccaaagacttggcctttataatccaccacctggctcaagcccttaccttggtctcgaatgttctgggaccattgaatccgtcggtaaaggcgtctctcgatggaaagtcggagaccaggtagatatatattcctgtgatttcgtttctggaaattagggactaatcctcaattttggttttagggtttggtgtctctgtgttaagttatccgagcttggatttaggatacagaacatttgaatacactgctcagtgctcacactcatgttcttaatgatttaggattcataacatctgaatttgaatgacttggtttctgtctagttgcaattcgtttacatttgtttagctgttgaggcttcttatatttttgtgttggattggatttagttttactctaggcttaagcaagtaaattacttttgaagtataaagttattgtcttggattacttctgactgtctttgtctcaggtgtgtgctcttctttctggaggaggttatgcagagaaagtttctgttcctgctggacaaattttcccaattcccgctggtatctctctaaaggatgcagcggctttccctgaagtggcatgcactgtttggtctactgtcttcatgatgggccgtctctctgttggtgaatcattcttggtatttcaacttctcttctctttttatgtataaaaacagtttctatggtctggtaaaagccaatccttttacggtcaattctagaggcttttatctattactttgctttgcatttgtcttctctcttgggctgttttgttttctttcttgtctatgtccttgctaatgtttgatagtatctgaaattttagattcatggaggttcaagtgggattgggacatttgctattcagatagctaaacatctgggagtgagagtatttgtcacagctggttggtctgagcttcaatatattgataacctttatgtacttttttccgaaattgttcaaattttcttttaactaacagggagtgatgaaaagctagctgcgtgcaaagaactcggggctgatgtttgtataaattacaaaaccgaggattttgttgcaaaggtaaaagcggaaaccgatgggaaaggagtggatgttatcttggactgcattggggcaccgtatttgcagaaaaatctcgacagcttaaactttgatggaaggttatgtattatcggtttaatgggaggagccaatgcagaaataaaactaagtagtctgcttccaaagcgtctcactgtcttaggtacttaacacaatcaatcaatcatctctcaaaatcaatactgagagtctgagacctattgataattcttgatctgttttgttcctacaggagctgcattaagaccaagaagccctgaaaacaaagcagttgttgtaagggaagtcgagaagaatgtctggccagcgatagaagcagggaaggtaaaaccagtgatttacaagtatttaccattgtcacaagcagcagaaggtcatagccttatggagagtagcaaccatattggtaagattctccttgagacttgattctctgcaaagggagaaatgttcagagacaagagtcatggtcaataatcaataaaatctggtcgattctgttcatagatatctctttacaagagttctgtttgttggcttttatgtatctctgatttggtcaaaaagacactgtaactatggaacatatatagtatcaaataagctgttgtataccaaacattgatttcgaagtagaatatgattttgtaagaagtttttatttattttgggcttaaaaagtgtatttatttttgttaattgtttgatttaataaggatttttaccacctgaggcaaagaccatgaatatcaaaggcaacaacagttttgacttctctcgttttcatcggtccgtttgtacttcttctgataaaaacaaaaattttgcaaaatctaacaacaaaatctttgattcgacaaactttgtaacaaaaaaaatcgaaactttgcaatttttacagaatg

SEQ ID NO: 33568 - DNA, 3003 bp, Unknown; identical to SEQ ID NO: 33567
  misc_feature (1)..( 3003): 2750-1469P.txt file - cDNA_ID_3070966; gDNA_ID_1620640; Annot_ID_163034

SEQ ID NO: 33569 - DNA, 3000 bp, Unknown; identical to SEQ ID NO: 3309
  misc_feature (1)..( 3000): 2750-1469P.txt file - cDNA_ID_3070980; gDNA_ID_1620637; Annot_ID_162950

SEQ ID NO: 33570 - DNA, 3000 bp, Unknown; identical to SEQ ID NO: 3309
  misc_feature (1)..( 3000): 2750-1469P.txt file - cDNA_ID_3070980; gDNA_ID_2926156; Annot_ID_198453

SEQ ID NO: 33571 - DNA, 606 bp, Unknown
  misc_feature (1)..( 606): 2750-1469P.txt file - cDNA_ID_3071019; gDNA_ID_1620639; Annot_ID_162996
ttcatttttcttctttgaatcgaaaatatacttctttaactcttttctttcttaggtatatatagatgaaatattcaagactttgatcgatgaagattaatgatctcttgaatgatacttttatagagatgcaaatttcattttggataggaattcatcatcacatagatattttactcaatacgtgttggccgacatcgtaaaagtaatatattcaattcgtaattgattaagagtcacacacacatggcaagtaagacgtcggtgtagtagtggttagcgaccgacgtaattttaacttatatgggcctgtgggcctttagatatgaaaggcccaataatgcatatcttttactaaactaaaaaacgatgtcgtttggtatgtttcttccacctttgttgttcatcttttgattttttgaaattgttagtaaagaaaggaaaaaagctttgatttcgatttctcaagctgtgtttttttatttttcttcttcgcatcaggaaggaattgaaaaaggtatgattttgaagctttagctctcatttatctctgaatcctaatgcttttttcatgctgttgtttcagatttttggtgttaaaagatg

SEQ ID NO: 33572 - DNA, 3000 bp, Unknown
  misc_feature (1)..( 3000): 2750-1469P.txt file - cDNA_ID_3071036; gDNA_ID_1620639; Annot_ID_47439
acgcgtgtgtatgattgacactgaagatctccttagtctttttctgaagaatttatatcttattattgttattatccaatctcatgtttattttacctcaaaaaatgttcgcgattcaaaatcaacaacgtttataaccatatagacaaaaaaaacagctggagggtttcaaaattaaaatgttgtgtttggttacaaaatattacacacatattcaacttttgatactaataacaaaatacttaaaaaaagacgaaactctatattaagaaaaaaagttttgggaggttcttctccgctaacatgctctttaaggatactctctgccaagtggctttggcatgctcattcttgctgacgtactccgagacaaaccctctccatcagtttgtttatggagaattttcctcacaactttctcatatgatcttatccgcaaatttgttatcgaaaaacccgaccgaccttttatttctcaccactttggacctcaattactcatttataataactttattttttatatgtaactacactatcttatagtgttcattacaaggaatccaaaaactccataatccggtcatttcggtgacggacatcaacggaaaagtcaccggaaaattggccggagtcacatatgtaaaattgagttccaacagttaactctccagagatcgaaccatcgtacgtggtctatatttataaacgtcaataattgttttttatataataaaagtgtcatggtaggttaaataatttacgccatattagtaattaattagtggctagtcaaattctgttccataaaatataatagtatgaacacacattattgtactgtattcatcaattgggactagttctttctgatgatcatatataaaggacagcagaaatcggacaaaatcagtgttattgtcttcatttatcatacgcacaaactaaaaaataaagtttggccgaaacgtgggtgttcctaatcccaaacatatatgaaaagcagagaatatactatatctactttaatcgttacattaatgttagtttaactaaaataggtttcttttgagaaaaaaaagtataaagtggtaggaaataatagaggttcataacttcatataattgaagcttatgatttgatatattggtttggttgttacacaagtatccgactttagatactacaaaacaattctaaaaaaaaaaacttcaacggaaagcgatattcttcaacaaatcaatcctacttaaaatatttaaaatgtaacaaaaaaaaattcgatacagcgttgatggaccgtaataccatatcgacacacaataatttcgagttgaattcacattattgatgcacacgttcatacccaaattaaattaaactaaaactaatgaatgatgcacgtatatagacttaaagacccgaatctctcgttaggtgaccggtgacccatgcaaccgaatgaatctaaatgggaccattagaccggtttggtccctacccatgcttagtcttattggccttcacgtgaggctccataagccaagcttcatgcaccccatccgccggaaattaaacctccggccacctaagcttgtctgctttctgattttgtcccaagtctctaatgtttgcacgtggacactttcttcctttcttctctccttcttcgccacgatttcatctccaattttccaaatctaccccttacattaaccaatctaaattactccttctaaattgcatgatgagggtatatttgtagtttcagtaagacaaataatattgcgtgagctgtgtcctgtctgattatgaacactagacgacaaaaacctaacgttacttgaagtttccgaatcacgaggctcactcattcttcttcttctttcttctatatatatataaagccccacgagtagtttgtatctctttcaaacacacagacgagatcttctctctatctttctctatctacaaactttctaaaagtcacgagtcaactcaacgagttacgtacaaagaagtactaaaacaatgggagcttgcgcttcacgtgaatctcggagaacagagacggcgaagctgatattaccagacggaacattacaagagttttcaacgccggtgaaagtgtggcagattcttcaaaagaatcctacaagctttgtttgtaactccgacgatatggatttcgacgacgccgttttagctgtccctggaagcgaggatcttcgaccaggagaattgtacttcgttttaccattaacatggcttaatcatccattgagagcagatgaaatggcggctttagcggttaaagcaagctctgcgcttgcgaaaagcggtggaggaggtttgagttacaacgatgaagatgttggtgagtgtagagttagaagagttaaaagaaacggttgcggcggaagaggttgtggtggtggtggtaaagggaggagaaagttcacggcggagttgagttcaatagctgagtagaggggttaaattggttagtcaatgtgtaaattttgtaaattgtaattagaaaatttgacttttacataatttttaccataaaaaatataaagttgatttcgttatttaatacaactaatacatagaaatgaccaaattgggagactttcacgtggatgaagtgttcaaaagctactaataaattgcatttagtcatttagtggtaaaaatatcaaatcctctctggcttttcttggtcaacaccgcgtaatggttacatgaaagacacagtgtacagttgcaaaaagtggggataaaagcccaaggcccattgttcctacgggcatagccgcatagggttgaaaaatgtagtcgctgtaagtaaggatgattttgttataataatatatttcaagggctttgattgcaaattagtttagatttcccgaccacataaatgttgctttgttttttcggttaggcaaattcgttgtggttaccaaaacgacgacgtggtgaagcaaatg

SEQ ID NO: 33573 - DNA, 3000 bp, Unknown; identical to SEQ ID NO: 33572
  misc_feature (1)..( 3000): 2750-1469P.txt file - cDNA_ID_3071036; gDNA_ID_1620639; Annot_ID_162977

SEQ ID NO: 33574 - DNA, 3000 bp, Unknown; identical to SEQ ID NO: 3313
  misc_feature (1)..( 3000): 2750-1469P.txt file - cDNA_ID_3071040; gDNA_ID_1620639; Annot_ID_162976

SEQ ID NO: 33575 - DNA, 3003 bp, Unknown; identical to SEQ ID NO: 23878
  misc_feature (1)..( 3003): 2750-1469P.txt file - cDNA_ID_3071047; gDNA_ID_1620640; Annot_ID_163036

SEQ ID NO: 33576 - DNA, 3003 bp, Unknown
  misc_feature (1)..( 3003): 2750-1469P.txt file - cDNA_ID_3071051; gDNA_ID_1620640; Annot_ID_163029
catctggtagtgataagacactcgtataccaaggacctgatagtaaacttgaaaatctggattggagagaaatgaaaggcccatttgtttcagtatggcttcataatgttccctggggtgctgagaacactttggctgctcctgacgctaaggtcagttaaacattttgaaaccacgaaaacacgatttttttggaatccttttgcgtttacttgctataaaatcttgaaagcttcatatggtctgattaacagttttctgatggcttcctggatttgattgtcatgaaagactgtcctaaactagccttgctatcacttatgacaaagttgagtgatggaacccatgtccaatcaccatatgcatcatatctgaaggtttgccatgcgaacccaattttatagttgtaatatttcatttgatgactttgatgtctcttttcgaaatgaatcggaattttatgattgactaaaaagcttacacgttggtttttactgttgaaaaggtgaaggcattcgtactggagccaggtgcacgcatagacgaaccagacaaggaaggaatcatagattcagatggagaagttttggcaagaggaagaaaatcgtacaaatgtgatcaaaaggctttgatgtcttacgacaagcttcaaataagtgttgatcaaggtttagccactctcttctctcctgaataattctgactgatacatgagatgtgatgagatgagatgaagttgtcccttgtggctataatttgattgatggacattacaatacaaaaaatgagaagatgattcgagttatatagtaaatccctaaagattaccattgagtgtattgtttattgttgtattgctgttgtattgcagttttgagttttttgttagaaagttgtgtgaactaagatattgagaagaccataaatactaaatgtgagatttttttgaactcttggtgtaaagtgtaaacatatttatgttgggggatggtagtcctaaagcttaaagctttgtggcaaatataaaatgaagattaatattgtcaactagcattagtgtgacaaaaagttgggagagattttatgaggcaagcaactaaaaaattgatgcgacatatcatataactaaaatgataaaatattgtccctggaatttaatttggacctaccatactaatgatgacttggcgttatacattgaatattttaattaaaaaaggaataaatatcatagaaaaagcggaaataaataagtaaagtaaatgttgtgagagagctttctttttcagagagtattttgtttagctgatgaggcaaaaacaaatagaagaaattaattacccgaaacaacaacacttcactatttctcctttctcagctgctttcaccattttctctttttctcctccatcaatctttctcacggttttctagggttttatatatgctttcctcttcatccatgtcatcgtcttcgttatctgctagattttgcttcaaccacgaatgttttgagttcaaactcgaccattgccgtcctggttggcgtctccgttctggcgatttcgtcgacctctgtgatcgttgcgcgtaagcaaccttttccgtacttcttttcttcgcttatttttactctccctgttccatttttttgagttgatcatttttttttttttcaagtgtgcttgtctttgattttggaaaacttacttggttgtttttttcctacttctttctttgtgtaatttgggtctgtcttagtaagatgtggcagcctgtggtaatttctgagtttttttgttgtttgctttgttttggagtatagagtccccatgtgttgactacaagccgagaaattaggagccactcttttcggatgttttggaattgtttaacagtgttgaatttaagtgactggaatatagagttttaagcattttgatgggcgtgtgaggactaattcgtttcacctgaattctttatgtggcatcgatgttgtgtaacaagtttagagtctagaggtccaaagtccaagtgacacgaaagagatagaagaagtgatactaggagacaaaataattaaagcaataggaagctactttgcattctgatccattagattcgagaatttgttcactagtggccggttttctgaatttttatattctgcttcatcaaagttagaaattagacacatgattagtttcttaggcttactatgatattttgtgaaataataaattgggtatggtaatggtttctatgtaaacaataaggtcaccttcatgggattgcaaagccttttgagtatcaggaattaactaggaatgagatacttttgctcttactacttcttgattgtaaacatgcatacatgtgttctgtctttgatgggtttatttttggaaaacatgtatcagtttgatgatataatcttcaataattttcgttcctgtatgtagatcttttcttaaaaatgctttgattctttaactatggatgcgtggagactatatagtgtatagtttccttaggcttctgtttttgttctgaaacataaacttcatcagagctgaaaaagtatagttaaagcttacaagttctagttgcattaggcattaaccaacacaaatagtctggtttttctttgtttgatttcagtactctgcagacacgattcttttacctgctctttgcatcaatttcattaacttgttagtgtattatcgattttgcaaatatctaatgattgtattctggttccagctctgcgtatgaacaaggaaagttttgtgacgtatttcaccaaagggcttctggatggaggtgttgtgagtcatgtggaaaggtaactatatgatttactagttaaaattttctatgtctccttggcatcccaaaatcatacatggggtttccagatgtgaagtctctcactaatagcatttcgtgcagcgaattcattgtggatgtattgcgtctgcttctgcttatacgttaatg

SEQ ID NO: 33577 - DNA, 3003 bp, Unknown; identical to SEQ ID NO: 19028
  misc_feature (1)..( 3003): 2750-1469P.txt file - cDNA_ID_3071059; gDNA_ID_1620640; Annot_ID_163019

SEQ ID NO: 33578 - DNA, 3003 bp, Unknown; identical to SEQ ID NO: 19030
  misc_feature (1)..( 3003): 2750-1469P.txt file - cDNA_ID_3071063; gDNA_ID_1620640; Annot_ID_163018

SEQ ID NO: 33579 - DNA, 3003 bp, Unknown
  misc_feature (1)..( 3003): 2750-1469P.txt file - cDNA_ID_3071066; gDNA_ID_1620640; Annot_ID_163017
tcatagcggatatattgagtaaaacctaaaagtttatatcttagttggcttcaataattaaacgaaaacaaaactaaagattggtggtatattttcgcatggcatgatgccatgatgtgaggaccattggccgcttatacgaaccactagtttttcgactcgtgttctctacgttattttaattttttttttttttaaactatcattattatatatttaaattatcttacttaagaaaagaaattcatttattttccttcactcatacatagtacgatttctaaatattgaatttcatgggccgaacatattattcacatagacagttatgcaaaaatctcataccttgactatataaactagctagagaatgacatagttataaactaataattgatcaaaaccttcaaattattgaaaataacaagatttgtgaataattaatttgcattgagagcaatagtcgtatgcatcactttcaaatcaataatattattaattacatatagctacggactaaatctaatgtaagcatcatgaaattatatcttaatatcttcttcttatcaatcgcaaattattaggaacatcacacatacttaaatatagctgcctgctctttataatcattgttaaggaaatcttataacctattttagcgatttttaatgaagattaatagtataaaccatccgtaatattagggttatgtctccgcgttagagattgaagaatctgtcgggtccaacgacaaatgaagtcgttacaaagtgcgaaattatgaagttgaaccaataacaaaatcagttaattacattaaaaagaataaggttgcagagtaggtaggtgttaatgctattataacatgtccaaaatctagcttggggtttgcttgcgcatgtatcatttgccacaacgagaagtccacgtgttagtacagttgaccaaatctcattagctgattagcgttttggagaattaattaatagactgattgtatacactcagtatatggactgcatgaaataatagtaataaaacttaatatgattatacaaaggattattaatctgtataaaaaactactatcttatggttagcacgaaatgatttctatcattaatttcggaaaaaaaagttgcgtacgttgattcaatggtaactggtagacagttgatgtaaaactttttttttaacagccgaacgcattcttatatacaacatactagtaactagtacttgagtttccttagaacatacaccattcttacaatagttttgttattagatgttcccgttttgtgtataatttgattcttcttctatatggtcttgtattgtggaaaacgattattggggagcaaagaaacatacaccaaaaaaaatatgatcaaaatttttagtgtgtggaacctttcgaaaaccctacgatgttcaagtaagaaattgcaattatatgagatattatatatatatgcaattgttcttagtatttaggtgtttagaatatatactttagaccgttttaagatgtttgttaaaagttagtcttcttctaattagaaacatcttcttttgtttttatgaagtaagtgataagatatacatataatttacctcgaccaagtttgaatacttgctaggttaccatgtcatgtttaatcgtccacatgagatatctgtgtgactgtgtcttcggttcgatgtggctaattttctagaacatgttatcaaaagcaaacgttgttgtaattggctgatactgaggaaaatgcagtttggcaatgacaagaaccacacatatatacaatattgatatctattgaataattatacaatattaaattcctttgcattattcatttgtttcgtataaactaaaacctttgaactctaaatagttgaaaggagcagagtcagcagacaaggaccaaagatcccttcgaccacacatataaaacgatataatttgatacgaaatcgtaatggttgtgcagttgatgttgccacttaagacacttacgtaagacttcatgcaaatataatttaatatacgtacctcttgaatttacgtgttagtttgattatatatatattggtcatttttttggtatttgctcgataatagagttgatgggaaaccttgataatattaaaaattatcatatgaattttggaggaaagacagcaacacactcgagaactctctggaaaattgcgttttcactttttttgttttccaggattagttgatctaaaatctataatatatattaataaatacaacctaataaacaaaaattatttatgtttcagttaatgtaacccattaatatagaagtaatctcgtaaatatggagttgattaaaaatatgtacttaatcaaattcatctatatatatatatatgtgtatatatatatatatatatatatatgaattatattacgatcaaattatcttagcttttaaaataaaatttttttatcttagctcttattcaaaagtctttattccatcacaaggttatgttatcttttgtatttttattttattttatacaaggacttccaagttccaacatttcaatttctaagtacatgcatatcttattaaatagtgatttaaatacacaaaaatatgaaataaattctaaacaaggtccactctataaaagaagaaaacccacaaattccaaagcccaaattaaaacaccaaaagagcccaaaatacaaactcattcttcaccactaaaatattccaaagcaaagcaacgaacataacggataagtgttatcctcatctagtcatcttcaccctctaactcaccgagaaagaaaagtaaagagagtttggtgtcactatgaacattgccattcataattaccgtcactcaaaattcatcgtaaatcctcacatagacaagacttttgcaaggactcgacaggcaagatcaaataatattacattcatgacaagtactcatggaagaagaagaacgatg

SEQ ID NO: 33580 - DNA, 3003 bp, Unknown; identical to SEQ ID NO: 33579
  misc_feature (1)..( 3003): 2750-1469P.txt file - cDNA_ID_3071066; gDNA_ID_2926178; Annot_ID_199989

SEQ ID NO: 33581 - DNA, 3003 bp, Unknown; identical to SEQ ID NO: 19084
  misc_feature (1)..( 3003): 2750-1469P.txt file - cDNA_ID_3071077; gDNA_ID_1620678; Annot_ID_164328

SEQ ID NO: 33582 - DNA, 3003 bp, Unknown; identical to SEQ ID NO: 19084
  misc_feature (1)..( 3003): 2750-1469P.txt file - cDNA_ID_3071077; gDNA_ID_1620643; Annot_ID_163100

SEQ ID NO: 33583 - DNA, 3003 bp, Unknown; identical to SEQ ID NO: 19084
  misc_feature (1)..( 3003): 2750-1469P.txt file - cDNA_ID_3071077; gDNA_ID_2926213; Annot_ID_202780

SEQ ID NO: 33584 - DNA, 3000 bp, Unknown; identical to SEQ ID NO: 23955
  misc_feature (1)..( 3000): 2750-1469P.txt file - cDNA_ID_3071096; gDNA_ID_1620714; Annot_ID_165551

SEQ ID NO: 33585 - DNA, 3000 bp, Unknown; identical to SEQ ID NO: 23955
  misc_feature (1)..( 3000): 2750-1469P.txt file - cDNA_ID_3071096; gDNA_ID_1620644; Annot_ID_163164

SEQ ID NO: 33586 - DNA, 3000 bp, Unknown; identical to SEQ ID NO: 23956
  misc_feature (1)..( 3000): 2750-1469P.txt file - cDNA_ID_3071096; gDNA_ID_2926217; Annot_ID_203062

SEQ ID NO: 33587 - DNA, 3000 bp, Unknown; identical to SEQ ID NO: 3386
  misc_feature (1)..( 3000): 2750-1469P.txt file - cDNA_ID_3071099; gDNA_ID_1620644; Annot_ID_47564

SEQ ID NO: 33588 - DNA, 3000 bp, Unknown; identical to SEQ ID NO: 3386
  misc_feature (1)..( 3000): 2750-1469P.txt file - cDNA_ID_3071099; gDNA_ID_1620644; Annot_ID_163163

SEQ ID NO: 33589 - DNA, 3000 bp, Unknown
  misc_feature (1)..( 3000): 2750-1469P.txt file - cDNA_ID_3071099; gDNA_ID_2926217; Annot_ID_142279
tttctttcctctatattcacgatcctgccattgtacacccaatcatacgctcctgagatcctcatgacttgttcttaccgtactccgcgagacatgcgattgatgattcttgactgtattcattgagaaaaactgttcgcaaaaaccttgagcttcatcatcgtccattactcacctttcagtttcagaatgcccaagcaaaaagctccaaggaagcagctcaagtcctataaactcaaacacatcaacaagagtattcaaggtacgtctgacttgttcatcctcaatttgaaattcgtggatattgaaagtgaatcgttcgatgttgttttgtggttaaaaagagggagatgctgtgttgatgcggtcgtcggagcctggaaaaccgtcgtacgtagcgagggtagaggcgatcgagacggacgcgcgtggatcgcacgcgaaagttcgtgtgaggtggtattatcgccctgaggaatctatcggagggaggagacaattccatggagccaaggaggtttttctctctgaccacttcgattttcaaagcgccgatacgattgaaggaaagtgtaaggttcacagtttcagtagctacaccaaacttgactctgttggaaacgacgacttcttctgtcgtttcgagtacaattccactaccggcgcgtttgatcctgacagagtcaccgtgtatgtgttcctacgactctctgttactttattcgagaagaaaatactgattgaatgatggaactattatcggttgaattgaggcttttttggaaattagattgtgttgctttagtgtaggcattgattgttaataattcattgatttgtcatctaaattggtttcatgaagttgtttttgcaaagagaagtaatcaattgagtttaaattgattttttctgtttgcaggttctgcaagtgtgagatgccgtataacccagatgacttgatggtgcaatgcgaggagtgttctgagtggtaagtgttcacttatttgaaactctgttttaatcttcttgagtcacaatctggaattgctcgtatgtttttcgtgtatccatgaggtcctagttgatatgctattgaggttgcttgagatgaatgcttttgtcatgctttacttcggtgatgctcttccttactcatgttcatgttttgtcttatctgatattgtggaaactgcagatgaataggaacataagctgatactctagtctgaacgtttgtaatatctgtgattaacattctaatgtatatgttgcggattttcaaattttcttacacgttactgattgagtcgctgttaaggtttgggtttttctgcagcttcttagtttgtgccttgggtctttcacccatgttagcttgctatatgacacaagtaacgtaaatgaagtcatactgaaacaaatagtgatcgtttgatcttggaagttggaactgttaagtgttaagcttaatctttttacttttttttttgtaaagagaggattaaggttttttgtttcgaatgtctttgtcagttgcctttgatgttacagcaaactaacattggctcaggtttcatccttcttgtataggaacaacaatagaggaagctaaaaagccagataacttctactgcgaagagtgttccccacaacagcagaatttgcacaactctaattcaacttccaataacagagatgctaaggtatttctctatttctcatttcagaaaatatctttagtttttgagggatggtcaaacccgttgcaaataggcttgaataaatttaaggtatttaagttgaccgttcgttccacatataaagctagccttgccaacaattgtaagctcttggactgataaaatataccaacttaaggcagaataaacacataaacccaaagtatatgtgtcattaaggtcaaagacaaccttgtgaaatgttttgtcctaactaacaggtgaatggaaagcgcagcctggaggtaactaaatcgaagaacaaacacactaagcgaccaggttaacataaacttgtaaaggctatagatatctggttggtgagtctgagtatcaatcgtgtaatctacaaaggtggttttgttttctttccctctctagttttttctttcttaaaaaatgagggtttaggtttgttggcttgattgttgtataatttatatgtatagcgtatggtggtttctcatctcctttagttgtcacatataaaatttgggtaaaatggtttgtttataataagaaaacaaaacaaacaaacaaacaaagagagtgttggttccttatttgtttgttttcattgtgaactctagaaacccttcattctttattagtttttcattctttattaattctaaaacgcatattcaaagagacatatttgatcatcgtgtcttcataatttggttcaaagtacagccaaaaaccaggaggtacactaaaaatcaataaaattacattacaaattatttttagtacactgggaacataaataaatgaatcagagaagagaaacatggcaactaccgatcatgagcttctacatttgtctcagaaaaagaggaagatagaactattttttaaagtttttagaaaagagagaattaatattatccaagacaacacggcactgctaacaacaagttgaacctatcccattccattactccatacccattcaatgattaacacgtggttctacatcattggttaactctctcctttccccttggataaggcatcttaaaataataataaataccataaatatcttccgattttttctccgactataataatgatgacaacaatatcttttaaaattatcttaaaagaaaccgaaagctaatctccaaagggaaaaagacgtgtagcagagacctatacatacacctatacattcacgttgcgtgtgataatctactgagggttctatctatattaatccttctctgcttccttcaatctaattgcaaatcaaatg

SEQ ID NO: 33590 - DNA, 3000 bp, Unknown; identical to SEQ ID NO: 33589
  misc_feature (1)..( 3000): 2750-1469P.txt file - cDNA_ID_3071099; gDNA_ID_2926217; Annot_ID_203061

SEQ ID NO: 33591 - DNA, 3003 bp, Unknown; identical to SEQ ID NO: 19095
  misc_feature (1)..( 3003): 2750-1469P.txt file - cDNA_ID_3071102; gDNA_ID_1620644; Annot_ID_163158

SEQ ID NO: 33592 - DNA, 3000 bp, Unknown; identical to SEQ ID NO: 3391
  misc_feature (1)..( 3000): 2750-1469P.txt file - cDNA_ID_3071108; gDNA_ID_1620644; Annot_ID_163150

SEQ ID NO: 33593 - DNA, 3003 bp, Unknown; identical to SEQ ID NO: 16295
  misc_feature (1)..( 3003): 2750-1469P.txt file - cDNA_ID_3071112; gDNA_ID_1620644; Annot_ID_163145

SEQ ID NO: 33594 - DNA, 2495 bp, Unknown; identical to SEQ ID NO: 4820
  misc_feature (1)..( 2495): 2750-1469P.txt file - cDNA_ID_3071116; gDNA_ID_1620734; Annot_ID_49457

SEQ ID NO: 33595 - DNA, 2495 bp, Unknown; identical to SEQ ID NO: 4820
  misc_feature (1)..( 2495): 2750-1469P.txt file - cDNA_ID_3071116; gDNA_ID_1620734; Annot_ID_166211

SEQ ID NO: 33596 - DNA, 3000 bp, Unknown; identical to SEQ ID NO: 3395
  misc_feature (1)..( 3000): 2750-1469P.txt file - cDNA_ID_3071116; gDNA_ID_1620644; Annot_ID_163141

SEQ ID NO: 33597 - DNA, 3000 bp, Unknown
  misc_feature (1)..( 3000): 2750-1469P.txt file - cDNA_ID_3071116; gDNA_ID_2926217; Annot_ID_142259
ctcttacttctcatgaaatccgtgtcttttgtttttctttgttactagtactactttagagtttacactgtcttgctcgtgtcaaaaaagaaaaaaaaaagtcgtcgtctctatcgagtttttttttactattctctctcgagaaaaaaaaaatcaaaggggagagaaaattgcggaggaaaaaagaaaagaaagagaaaatggctctgtgattctccaatttctatagagagagagagaagaagaagattgattagataagtttcttaattcaacgttgagagacagagagaaaaaaaaaaaaagattttgtcattcttcaaaatacgttctcgccatttgcgccattgattaattcaagtgcgttgaagttagaggtaaccaccaacttgcattttactctccaaagctctgatttttctgtcaaattcttttgaaaactttgatgcttgttttcttctcatcattgattcttttttgatgataggttagttctacacaaagcttgatcttttaggggttttctctagttattggagagtggtgagaattagaaactgcattatccgatctaaaaatgggtgatacagagaagtgtaacagtgatatgatccagagacttcattcatctttcggcactacttcttcttccattcccaaaaatcccatttctcagctcgatttaaaccctaatttcatccgctcatcagctcctcaattctccaagcctttcagtgacagtggcaaacgaatcggtgttcctccgtcgcaccccaacttaatcccaccgacttctccgttttctcagatcccgaccacccgacaacccggttcgcataattttaacccgggaggagctaatcattcacggtcaatgtcacagcccaactctttcttctcttttgactccttacctccgttaagcccttctccgtttcgagatcacgatgtttcaatggaggatagagattccggcgtgtttaacagcaaccattcgttgcctccatcgccgttcacgaggtgtaattcgacctcttctagctccttgagagtcggtgagagtttacctccgagaaagtctcatagacgctccaacagtgatatccccagtgggtttaattcgatgcctttgatccctccgagaccattggagaggtctttttctggtggggagtgtgctgattggtcaaagtctaatccttttgtgaagaaggaatcgagctgcgaaagggaaggtgtcggagagagagaagctatggatgatctcttctcagcatatatgaatcttgaaaacattgatgtgttgaactcctctgaagctgatgatagcaagaacggtaatgagaatagggatgatatggagagcagcagagcaagcgggaccaagactaacggtagtgatacggaaggagagagcagcagtgtcaatgagagtgccaataataatatgaattcttctggtgaaaagagagagagcgtgaagagaagagcggctggaggagatattgctcctaccaccagacattacaggagtgtttcagtggacagttgtttcatggagaagttgtcttttggtgatgaatctctaaagccgcctccttctcctggatctatgtcaaggaaagtttcccctaccaattcggttgatgggaactcgggtgctgcttttagcatcgagttcaataacggtgagtttactgcagcggaaatgaagaagatcatggcaaatgataaactagcagagatggccatgtctgaccctaaacgtgtcaaaaggtacaaatattgaatcttgactaacattaccggtttataatcaaatattctgatgtttaaggaatgatcctcttttcagaatcttagcgaaccgtcaatccgcagcacggtcaaaggagaggaagatgcggtacatagtagaattggaacacaaagtgcagactcttcagaccgaggctaccacattgtctgctcagctcacacttttgcaggtgcgttgtttacaatgttataaaagcgcctagattggtcaatttttgttttgttctaacgatcttagttactgcattatccagcgcgatatgatggggttgacaaatcagaacaatgagcttaagttccggcttcaagcaatggagcaacaagcgcgtcttcgcgatggtatacatttctcttcacattgtatcaaatttacgatattattaacatgactttaacaaaaaatggaaccagatcctatatgctttaaaaaaatctccatttttgcgcttaacgaatgtgaaatgacgatttttttcccccgctttgcagctctgaacgaagcactgaatggagaagtccagcgactgaaactggcaatcggtgagagcagtcagaacgaatcagagagatcaaagatgcaatcactcaacgctgagatgttccagcaactcaacatcagccagttaagacagcagccacaacagatgcagcaacagtctcatcagcagaaccaccagaatggaaccatggcaacaaaatctgaatcaaatgaatagagcagagaagttgttgcggtggatcaaagggttggagtttttcaacaagttacatatcaaatcaaacattatatttcatttatgtgcagagtcagttgaatttacatatatatcatataagtccaagaaatttaattttacaatatgttgttatcttagaaagaaaaaattcaatttatagtagatataggtatgaactatgaacacaagttatatgtaatgggattgattgagcttcagacaaaaagattctctgtttgttttgtttttagtttttaatttagtcttggattctgtctctttttgttggtttgtttattttaacattatgggccggtttttggcccattaaacagcatcccaaaacattgttgccttcttcgtctctctctgtgaataatatctaaaaccctaacaaacactatcactcacttcattttcgtgacgacggagcttgaccgctatg

SEQ ID NO: 33598 - DNA, 3000 bp, Unknown; identical to SEQ ID NO: 33597
  misc_feature (1)..( 3000): 2750-1469P.txt file - cDNA_ID_3071116; gDNA_ID_2926217; Annot_ID_203040

SEQ ID NO: 33599 - DNA, 3003 bp, Unknown; identical to SEQ ID NO: 19035
  misc_feature (1)..( 3003): 2750-1469P.txt file - cDNA_ID_3071141; gDNA_ID_1971811; Annot_ID_175762

SEQ ID NO: 33600 - DNA, 3003 bp, Unknown; identical to SEQ ID NO: 19035
  misc_feature (1)..( 3003): 2750-1469P.txt file - cDNA_ID_3071141; gDNA_ID_1620645; Annot_ID_163184

SEQ ID NO: 33601 - DNA, 3003 bp, Unknown; identical to SEQ ID NO: 19035
  misc_feature (1)..( 3003): 2750-1469P.txt file - cDNA_ID_3071141; gDNA_ID_2926175; Annot_ID_199787

SEQ ID NO: 33602 - DNA, 3003 bp, Unknown; identical to SEQ ID NO: 19038
  misc_feature (1)..( 3003): 2750-1469P.txt file - cDNA_ID_3071145; gDNA_ID_1620645; Annot_ID_163183

SEQ ID NO: 33603 - DNA, 3003 bp, Unknown
  misc_feature (1)..( 3003): 2750-1469P.txt file - cDNA_ID_3071158; gDNA_ID_1620646; Annot_ID_163256
tcactactcactatatatatatagaaaatgatatcaagagattcaagcattacaactaagcatatacaccacgagaaaatcaaggtttcgatgtttgttaaaataaattgatccataattcacgaatatttttcaagcttcaatctgaatttgtgttttttttaacgttaatccgaatttgttttgtgtggaaagttctcatgttttttcgatttttgtttttccggacgtggtaaatgtatggaaatgaggaaagatgttcaagaaactgtagaagcaataaaattatgggctgaactctacacaataaggcccttttcaaatagtcttcagctttatggaccaggctacacaaattcatcacatttgaagcaattggtccgatgagtttttttttcattcaatgaactttgtattgttttcgtagttgatttctatagtctcatttgcatttcctcgacaatgactttggcatgtgctcacttgatttgatgttgtgacttgtaaaatttatgtcacagtcataagttgtcatcagttgtgttgtgtatttatcgaaaagaaaacataaaactatggtttgagatagaattcatttggagctactaattaaactgaattggaagatatacattatacagagtatagaaaattcaatcgcatctttcgtttgtccttctcttatctttcagtgattttgatgcatcaacctacaaaaaatcgttaggatttacataattgaaaacttgtaacgttaatttaatcttttttgctacgtataactgtctgacttgattagctcaactactcatcaaaatttaagttttccatgtgatttataacaagtcttgttccaaagaagttaagatttcatgaaaatatatatacataaatagttaaaacttacaacagtaaccaacacactgaagttttttttctatataatgctcaattataaaatagatatacgttatttaaaataatccaatacaaggtcacgggatttcattccatggaataaagtctctctttcaatacattaaaaaagcaatactgattcttcctaataaccctcatttaccccacattgagttcatgtgtttttttttagttcacctatacaatacaaaagataagaaattatacgatatataaaatgtaaacgaatgaaactacatgaatgtgacaaagtaacataaaactacacgaatttatggtttccagtgtccggcgaattcatttattggtaagacgtaagagacaaattatatgattctaccattcaaattcaaatatcgttctaaactttgtataaaaacatatagaatgaaaaaccaagaaaaatctcgttctaaactttttttgtatcaaagatataatgaaaagatgaataaaatgggggaaaaaagttgatttaatatatcattgatgttctattctctgtcaagaacaagcgggcgtataagctattagccagattggatccacacatgatttcactttgagctttaagtagagtctcttttaaatgtgtattttactcattgattaacatgagaggaataatagttttcataagagtacaaaaaaataaagtatataacatgagaacaggccaaaaggtaacattatgctcgtggatttcatgagtggacaatactatcttttactctatgtagtctattattagtcgttttcacgaaactatcccacatttcttttgtccatctatatcctgtcgttttcctttttgctgctatatcattttttagaattctctcaaaatttacatttttttttgcaaaatacaaccttcacgtattcttttgtgtgttctaaattgtaactctgttttataaaacctcaatttgttttgtgtagttgaatttactagccaactaattaagccgagtgtttctaatcgtcaaatcatttttcagaaaaaagtcagccaacttactttctcaccaacaataagccaatttggttcttatatactcactcaatattcaactataatttacaaaatacttttactattatgaaaaaaactcatgcatagtgtcttcaatgtaagtatgtcctacaaaatgttttagagttggctggtcaataaatgatagattcagaattcgtaaagatgatgatatatagaaagagcttttacagtagcaagtacaaataattgataaccaaatgggtagaatttaactcgaagacgtggcagagaaggtgtactataaggaatttaagaacacaagtagaggattaacaaaagaagaaaaggctttggaaaaagcaaaacaaaactgatagcgaaagccaaatagcccaaaaagaacgcgagtcaaatgttgcctcccaaaatttactatttttttactctcatattaaaatcactctaaatatacatagaaaattgttctccaaaacattaaaatatgttgaaaaaataaaatgaaagcaaattccaaactcccaccgacaccaacacaaacacacaagtcagtaagtcagattcaattatcaaatatggtcaagaaattcaacaatctcatatcaatcacacaagataaagtataaaaagacttatataaatgattgaatcagtgatattaactactattaacaatcttgtcttatgagttaaatgaagtcttaaatacgttttaccaattaatgtgaatgaatctacggagaaacagaggtttttagtataataatcataaaataaacctgaattaaaatattatatactaaaaaatagtttctctctcttcataactcagagcaagcttggaatcaatctctcaatctctcactctctcactacctatccttttctttaatggcgatgtctctaactactactatccccaacacacactgttactcttcttcttcttctctgtcactgtctattctctcttttggacctttcatggctatgtttctctgcaatggaagtccaagctcgtgatcaccaacaccgacacgctaatg

SEQ ID NO: 33604 - DNA, 3000 bp, Unknown; identical to SEQ ID NO: 19127
  misc_feature (1)..( 3000): 2750-1469P.txt file - cDNA_ID_3071165; gDNA_ID_1620646; Annot_ID_163252

SEQ ID NO: 33605 - DNA, 3000 bp, Unknown; identical to SEQ ID NO: 19127
  misc_feature (1)..( 3000): 2750-1469P.txt file - cDNA_ID_3071165; gDNA_ID_2926179; Annot_ID_200093

SEQ ID NO: 33606 - DNA, 3000 bp, Unknown; identical to SEQ ID NO: 21188
  misc_feature (1)..( 3000): 2750-1469P.txt file - cDNA_ID_3071169; gDNA_ID_1620646; Annot_ID_163249

SEQ ID NO: 33607 - DNA, 3000 bp, Unknown; identical to SEQ ID NO: 21188
  misc_feature (1)..( 3000): 2750-1469P.txt file - cDNA_ID_3071169; gDNA_ID_2926179; Annot_ID_200091

SEQ ID NO: 33608 - DNA, 3000 bp, Unknown
  misc_feature (1)..( 3000): 2750-1469P.txt file - cDNA_ID_3071174; gDNA_ID_1620646; Annot_ID_163221
acttattttaagtaagtccactattataatgtttactatactaaatttaaatatcttaattaccgcttatccaacgaccaacatcaacaattttaaatttaagttatgatgtcaaaacttgacctacttatgagctgagaaatattgattaataatcttctttttgttttcttcacgtccactagactctattttattcctaaccgtgggagagctcggtcgagtcaatgagctgctaagtctaggtgggagagctcggttagcttttaggtctttgtttgctttattcaaaattgtacaaaggttaaaccgtacgatttctgtatggagtgagaacaattaaataattaatggttaagtttctatgtatctgtatctgtaaggagactcagaaagctcttgagcttgaacatcggagacaaagagaatactaaattgttcttgtacggttcccaatccgataaaattgtagacatcacataggtccaatatttaggataaaagacaaagatttgagacatcttagtgtactcatccatatttttggatcactaactaattactccagaaataattagtgatccaaaataccacataatttatttatttttagttgtaagaaagttgatttaaatttagtaaacatatcgaaacgttgattaattttacaattttctagatttcagtgttatgcataaatcattgaatggtacggacccaataaggttggtgtaggtaagatttcacttacaagttgagtttgtgatttcataacgcttttgtttgtttgtgtaattcagctgtagattagatgaagaacttaaaataaatagacaagaccactttagcaaacaaaaaaataaaaataaatagacaagtccatgcctattttcgtggtgcaaacgtcgctcgcaagtagacaattgttgggtcactatcatatcattgatatcaagcaaatattacttacgatcatttattcatctcatcgcttttgcatatctatttatgtgcaatattagacatttacatatgttcggtacttcggtattttagacggaataacggaaccagaggaaactaccgagagtttgagtaagtaataaaggctaaaaaagggtatagaaaatgtacatgtactttgactacgaatataagaaaaatgatatagtgattagtttttaactttcaatactctttgtctttttctatttgaatttagcaataaactaaagaagaaactgtttagaatgatataaaattggagacttttgcttgagttgtctaatttttaagataatctcatattacccatatgttattattaagcttaaatgcttaattatataaaaatgttaatttttagcaaaatttttattttttacaaaataaaaagctcgtcttgttcttattattatttttctctagcttctccaaatcctatttatttatttttctattttttatatttggcgaccgtaactctaattaatatttttgtaactcatttttatgtgacataaacatttcaacatcggttatatccactttttaatgctcctaaaagtatatttaggttaaactttgagtttgaatcgtttgtttacggtttcagattttgggttcattcatgaatttaattccaaaatttggtgacttctttgttgcagccattctagagacttttttttgttttgttttttatttggtgcaaaaccattctaaagacgcatgtgatgtttttagccaaatggcatacatcggttataattgacatgtcgatatactataaagtatccactcatatcttttgtttaatttttttagttctttccatagtttctgtaatatttcgcgatcatagctataaaattttaatcaaataaaatcttataatttgatcatctcatttatttttataaagtatatgatgctgtatggggcgcagtcactgaatctcaaatcttttacgtataaatcattactgttttattgataaagtaagctcagtctttcgcacgacatcaagattttatacgatatagagtttttggtaccacgatcgcaacgtataataagatagtactgtaactaacagtcacgtgatggaatttgaaattagttaaactctaaccaattaactatacgtacattttacacgtggtaaaacaaaactaaagcaagaagattcaattgtttcttttcttcacgcttgtgacactttataacccaatagtccttgtctttatagtttgattacttttgtccgttagtgttcaccttaattatggcgtttgtaaatttgcggagatggaaaagagtgaagtatctaatcttgacctacatgaaaatcatcaatccactataataaaatcctctagaccacacttaattagtcaaaatctaagtttaataagtgacatagttatgtttaaactaataaatattaatatatttgtcaattaatgtctatatatcaagaaaatattatggtcctaaatattaatttatagattttgtattgaatatatatttaatagtatttctttattagaatcatttcagttatgttctatgcaatgtgtctaaatattatattttattgcctctattacctatatagattttatttatataaatatatagtaattcacaatcgtgttttacttaatccctggatcccacccgcagtttcgtgtggccctcttcagtcttcactcatcagaccgaaagaaggaaaaaaaaagagagttaaaaagcataaaacccattttccaataagagttttctttttctcttcttcttacgtgtacgatcccaatctaacaacacaaaaagggttcagttttcttatctccattttgatcatgtcaaaaaccccacatgtccacccataattcctcctcagtctttttataaacaaaccattttcttgcttttgctcgcaaaactttaaccttaaaaaccaaaccaaaaaaaacaaactaaattaaacttatg

SEQ ID NO: 33609 - DNA, 3003 bp, Unknown; identical to SEQ ID NO: 22336
  misc_feature (1)..( 3003): 2750-1469P.txt file - cDNA_ID_3071183; gDNA_ID_1620647; Annot_ID_163299

SEQ ID NO: 33610 - DNA, 3003 bp, Unknown; identical to SEQ ID NO: 22336
  misc_feature (1)..( 3003): 2750-1469P.txt file - cDNA_ID_3071183; gDNA_ID_2926188; Annot_ID_200813

SEQ ID NO: 33611 - DNA, 3003 bp, Unknown; identical to SEQ ID NO: 19151
  misc_feature (1)..( 3003): 2750-1469P.txt file - cDNA_ID_3071196; gDNA_ID_1620647; Annot_ID_163280

SEQ ID NO: 33612 - DNA, 3003 bp, Unknown; identical to SEQ ID NO: 19151
  misc_feature (1)..( 3003): 2750-1469P.txt file - cDNA_ID_3071196; gDNA_ID_2926188; Annot_ID_200796

SEQ ID NO: 33613 - DNA, 3003 bp, Unknown; identical to SEQ ID NO: 19155
  misc_feature (1)..( 3003): 2750-1469P.txt file - cDNA_ID_3071199; gDNA_ID_1620647; Annot_ID_163275

SEQ ID NO: 33614 - DNA, 3003 bp, Unknown; identical to SEQ ID NO: 19155
  misc_feature (1)..( 3003): 2750-1469P.txt file - cDNA_ID_3071199; gDNA_ID_2926188; Annot_ID_200792

SEQ ID NO: 33615 - DNA, 3003 bp, Unknown
  misc_feature (1)..( 3003): 2750-1469P.txt file - cDNA_ID_3071205; gDNA_ID_1620628; Annot_ID_162575
ttggtgagaccttatggaccaaacctgatacattttctgcttgaactgattagattggatattaactgtaatccacctttaacagatgatgatgaaggaccagtatggaaactatgtggtgcagaagatattcgagacatgtacggctgatcagcgtttaacattgttcagccgagtgagaatgcatgcatctgcattgaagaaatacacatatgggaaacatattgttagtcgtttggaacagccctctattgaaggtatgaaattccccaatgtaagtcaagttcaaaagtgaggtgaataatcacaatctttaggaacaaaagggctttgctgttataccatataagctgaaacagggcgaagtacacaatcaaatatattttctatgctaaaaaatggtcggtgaatcgctcaagaatgacatgtcacatgtgcatatagaaatgtgtggtagcacaagactgaatagaataagatgggattggtagcacaagactgaatagaataagatgaggattggtatatggatcaggaagagttacacattgtgtttgttgtttctgcagaaaaccaagaattgaggagatgagtggctcttctgatttcaagacagtgggctgactcagattcactcaatacaattcgctttttcatgaaagctggatattcattgggaaggtcttagatgattgtgaaggacatcgatattgttgtttacttggaattttatcatagccgttgtgatgattgtgtggcatgttctgtaaatattcataactgtatcagtagtttacttcagatctgtaactggtttgtggaatttcacatggtattcgaaactttctagatactagagaatattattattgaagccaaacattacatgctaatcctgaaatagcctcctcttcctcaaatttcatgagctacagattcttatcacatttcaacactgttttgagactttctttcattcatctgacatgaggagccaaagtataggatcgaaagagaaacttgtcattactcacgaaatataattgaaagcagtgtagcatatcacacttgacaatggaagaaacaccccacacaaaaatggaaagctcaaaccaacacctccaaaatactatttcaatcttaaccaaagagatcgaatccgaagtctccttcttcctcttctgattcttctttcttcttctcatcttccttaggggcagctgcagcttcacccgcaccacctccacttgaggcagctcctccagcagagaatcctccaccaccaccaccaccaacaattacctacgccacaagaaattgattccaattgataaaaattacaatgcaaaacaggaattatacacaaatattgatttgtactagtttccggagccatgtaaactaaagtcacctactaaaacagagaaggcaaccaaaaacaaattgagtgatttagctattacaaagctgtaacctttaggtatcattgttaacctataaaacaagctacattgacgcaaaatcacatttgatgcaatgataagagaactatagtgagccatgacacttgtatcactgatcaacgaccataattactgtgaatgaatcattcatctgaaaatgcaagctctgattctcacacagtattgccaatttcaaagatgcacgatctcaaactgtaagcttgttcgagcaagagagacttatacctggaatacggcggaggtaggggagacaagagaaaacgaagactgaacgccaccggaggaatcagcggagagagatacctgaacgagcttacgctggagctcgtaggtagaagaagctgaagattcaagttctccttcgtgttgcttcgcgctccacgcgccgcctccattcttgcatacgaatgtgaatactcccatcttcttcaatgtctgctaaaatcgatggcgatagtgagagatttctggaaaaagtgacgatcgagagtggttttgtttttatatacgatgatgaacgaaagctcaaaaagaagttaagaaccctagttttttggaggtctctgagtaaaagactgttttacccatagtggacttataggtcttaaatgggccacttttgagagtaatgaatatatataggcctagagtgaatagcaacaacccaccaaggttctttcacttctttgaaaaaccaaaaaagcaaagatcaacaaaatttatcagattctacgagagtcatttcctaacacatgagatgatgagattattagagtatcacaactctcaactatgtttttccataaactatgcatcgcaccattcaccacatgatattgtaactcttaagtctaagccatgaaatcaacattgaagtaaaagaactcacatagtaaattggttttctattggtttatattttaacaaaattatactgtactcatgtcatctttatgtcaccaaatcacaaactaattttctacttttaaaacaaaacatctaccaattccaccacatatcctaaaaactgactcaaatctctcaaaatctaaaatttcctaaattccacaaaatcatccataatctttaatcctccttagttatgatatcaaaaaaccattttattttaagtatctaatttccttgccataaattttattctctagtttagctaaacttaattggaagtaaagtttattgttgctgatatataataaaatattttcatgtttaaaaatctaaatatagttgaatggactctttaacaagaaagtaaatattggcgtctataaggtcaagagatgtggcgtaatgactacttttgagcaaatcagtggacaaattaagactttccaatctttcattggtcaagtctaaatataaatgattggatttctaagtttcatttcctgtttttaggctcactcgtggactttttttaatttctttcctttgccatatttataaaataaaagagagagaaagaattttcaataattttcaacaagcaaagttcatg

SEQ ID NO: 33616 - DNA, 3003 bp, Unknown; identical to SEQ ID NO: 33615
  misc_feature (1)..( 3003): 2750-1469P.txt file - cDNA_ID_3071205; gDNA_ID_2926188; Annot_ID_200784

SEQ ID NO: 33617 - DNA, 3003 bp, Unknown; identical to SEQ ID NO: 19267
  misc_feature (1)..( 3003): 2750-1469P.txt file - cDNA_ID_3071232; gDNA_ID_1620648; Annot_ID_163362

SEQ ID NO: 33618 - DNA, 3000 bp, Unknown; identical to SEQ ID NO: 3486
  misc_feature (1)..( 3000): 2750-1469P.txt file - cDNA_ID_3071236; gDNA_ID_1620648; Annot_ID_163358

SEQ ID NO: 33619 - DNA, 3000 bp, Unknown; identical to SEQ ID NO: 3514
  misc_feature (1)..( 3000): 2750-1469P.txt file - cDNA_ID_3071240; gDNA_ID_1620648; Annot_ID_47679

SEQ ID NO: 33620 - DNA, 3000 bp, Unknown; identical to SEQ ID NO: 3487
  misc_feature (1)..( 3000): 2750-1469P.txt file - cDNA_ID_3071240; gDNA_ID_1620648; Annot_ID_163357

SEQ ID NO: 33621 - DNA, 3000 bp, Unknown; identical to SEQ ID NO: 3514
  misc_feature (1)..( 3000): 2750-1469P.txt file - cDNA_ID_3071240; gDNA_ID_2926215; Annot_ID_142163

SEQ ID NO: 33622 - DNA, 3000 bp, Unknown; identical to SEQ ID NO: 3514
  misc_feature (1)..( 3000): 2750-1469P.txt file - cDNA_ID_3071240; gDNA_ID_2926215; Annot_ID_202899

SEQ ID NO: 33623 - DNA, 3003 bp, Unknown
  misc_feature (1)..( 3003): 2750-1469P.txt file - cDNA_ID_3071244; gDNA_ID_1620648; Annot_ID_163355
gtctaatagcaacaaatgtgaagtatgaaaatgttaaaaataacatattgaaaaagccatacaaaattgaatctagcaatgttatagtctctaattttgccttgctccagaataatgatctaactccgtctctcactactgtattttctcctgttttcaggtagtgacggatctctaccgaatccatcagcagtcattgttggcatcgcacgttactgttatactggagatactctcatcaatctcatcacatgcccaccagttaaattctgatttgatattgcagaagaaagtgaggagagcgtgctctatcctggagctctctgaacctcccatgcttcatttcgaaaatgacacgtttcagaactacctggacattcttcaagccatagtgacaaataatccaggagtgtcgttggagctaaacgtagagtctcagctgatgacagtgtgtatgcaaatactgaagatgtacctgaaatgcactttgtttcagggtgatgagttggaagaaaccaggcagcccaaaaactggattctacccatgggagcagcctcgaaggaagaagcagcagcgagatctcccctagtggttgcagtgctgaaggctctgagggaactgaaaagagattcattcaagaggtatgcaccgaatttcttcccattgttggtggagcttgtgcggagcgagcacagctcttcacaagtcccacaagtcttaagcacagtgttccatacatgtatgggtgcaatgatggatgaataatagggtggttataagtgggttttgacattcgagcacctgaaggatattgattaacaagcagacacaaatcactcttttcttcttttgttttttcttctcgacggagatgcgagatttacaggttttgtgctgttgattgatagtgctgatataaagtaattgattactgtttgtagaaactaagaaaagaatggtgagattaggagggtcattgcattttgtctgcaatgcctattttcttccttccagtcgtgatcaatgtgcataatatactctcacacagctaaatgcggtccaagtaaggattgtgaaggatatattatataaaaagaaaaaagaaaagagaagacaaagatgagccactcgtggaaagtcatttatacctccttgaaatgaagtgatgatatctaatgactccaaagtcataataaagtcaccgaaagtgaatcatgatttgaagaagataaaggagtcaggagtggaactgctttccttggtatgtcattccgaagcgccaatacggaggagccacatcataagaggcaatggttttgccgcctttgagagtaacctcgaaagagagagactgtccgatgagatcgagagaggagtgccagttctgtccccagtttctggccattgggatccaagccgttgtgtggcccttcactttcacaccaaccacttccccgtcgaggcccacattgcttatcaacacctggaaaaagtgggagctcccgctcaagctgaatctcaacccgcctctccgcccacacttgaccctcctatactgtataggtatcatctcagctctggtttctgcgatccctgtgaaggcggcatgagatagttccaagtgttcctttgggaagttgcaccaacctccgtaatcggaggagagtcccgaattgggaggacagaaatcggtggcggtgaccaccacggaggggctgccttgaagacaccaacggatgtggttcacgcaccgcacttctagacaagctccgcagctgcttcccctgttgaacagcttcccgctcaggcctgcgctgtagccggcaaagctgctctgcctcagatctccatacccacaagcgcctcctatcagaaccaattagtctagttagtcctgatgaaagaagaaagaaaaataggggggagagagagaaaagagaaccagtagcgacggaggaggagccgtctctgtctctagaaagcgtggctgtggctatcttccagtcatcttcggcagtggcttgaaagaggcggcagagaatgaagaagaggcacaatgcgagttgctgaagcccagaatccatgaacaagaagtgttgttgggatcctcacagtcagtcacaggtggcagacaaaagtgatgcgtttgagagagttttgggggttccttttgatcatcaggctccgcttttcaagacttgtggggatgcgacaaaagattgctctgacatgttttgactttgacagtccgtttcagaccaattataataaaaaaacaaaaaagggaacaactatacgttttccaggcccatctcattcggaggcccactttcaatacgacacagaatcaagacaagagacgcaagacgaacttcttgagcccttttgttaattcaatgggccctcactaagaagcccataataaaataaaataagttctattttcaaacattgtactattactttttgtaccggccgtgtttattcaattctcgtatttgtaagaatttataaacaaaaagcaatgattaaaacatttacaatgacattatgacaatgaattcgaatgtacttttcaagtcactcgtaaaagaatataaattttttaagagataacataagacttttaaatcgataagtgaataacatagagtttgtcattttaatacaaatcactgccgataattagactgaaatggaagaaaatcagacggagacaatgatgtccttaaggggaagaagagtgaaatgaggtagcggtttgaggtggatgagaacatgtgtatacgatgatgactcttgtttgatgggacaaccgtgagtcgacttatccagcgtcccatctctatagacaaacacattttcgtcctcttccatgcgacgccactttctgttgttatctttggcacgttgcagcggcattcccctgcatcatcaacattcattatccatctagatgtaaatgagaaagtgggcatatatccacgtgtgtacctgacatg

SEQ ID NO: 33624 - DNA, 3003 bp, Unknown
  misc_feature (1)..( 3003): 2750-1469P.txt file - cDNA_ID_3071248; gDNA_ID_1620648; Annot_ID_163349
ctcgccgaggggaagggagctgctctctgctttgctttcagattttctttcacctctgactgaaactgtagcctacttactcttctcttccaactttttctactttcagtttataatggaaaggcccacttttaatctgttatggtttaaaatgaggcccacttttaatgtgttttaaaaataaggcctattaagttgcctttagcccgtttacttaatggtcttacgcagagtaacaaatcaattaggaaacagagcactagagcagcagtaggcactaggcaaggctggtaaaactaaactcgtgctgcttttgtctctgtttagtacagtatatcataaaactgagtaatccacaaaatcttgattgaaaaggagatggagacaatatgtgcttggaaactaagacaaaatacatgttaaataaagaatgggtgtgttaacaaggaagctaggctacaagtatccaagtagatggagaaagatacagaaaaagaagaagatagagagatacaaggtggaagaggagtgtgcattattgacattttgtgtaggaggagttggagccaatacaaatgatctgcagagagggcaagtgaggtggccacggagaagccaaggttctatgcaattgatatggaagagatgagcgcatctgggaagatgggtcaccgcatcctcagcctcaaactccaccaggcatatggggcagcaaatttcctcctccttttccttgtccccaaacatcactcccactaggttgtaaccgtcatcatcatgcgcatccgcatctccaccattcttcttcaacctccccaagggaatgcacacacatgtgtagaatactatggctgctgtgcacaaaggcgaccgcggaaacaacattgaaatcatctttctccagctttctgcttctttacctcattccttccctctcttttatagactaatatcatcgagtagggacggcgccgaccccacctcccatctcttattatattcttttgttgtttttctttaatcaagtcagcgattctcccaactccaagaaaactcttggagaggttatggtcaacatacgagatgcacatgcttccatcttaagcactacctgatacttgcatttaacaatagtaaacaatacaagaatcacatgacgccaaaagtaaacaaacaaaagatggcattcatatccagtgtattatttatatatatattaaaagtaaggagtcattcttccatcaagacaggccttgacttccgagttcacgaatataatacagccgaccaaatcaagtaaagatctccgagtgaatcataaaaactattttaatgttgactccacgcattttgtattcaatatagcgccagcttctacagaacagacctccacgtccctgagatcagcagtgcctttggaggatgatgtagttttatgcctggtgtatgtaaccaatgatactattgttcatatttgttcatgaagtcggccacatttgcaatagacagtcacatacatcattggtaatgactgataagcgtcaagcataatttgacaccctataccgccaacacaacgctattcattgaacttgcaatcaatattagaatgcatgaaaacagggaactacatctacaactacacatttttaaaggacataggaaaaaaaaaaaaactcgatacctgactccaagcagaaaaaggaagactcatattgattttcactttcaaggttgttattacaagtcaagaaaacatcttactgagacggcatacttaacagcactgcgtaagtaaatcagaagggtttctcggttggtttcttcttgaagatggcttcccaagccaaagacggaaatggagcccttttatccatgaactccttgacagccttaacattaacggcaaatcctttttggtttaaggtatcaatagcggactgggcttgttcaaccccctttactctgcacaaggcatcaaccaattcaacgaaagtggggacgttaggagagtgaccagactcaagcatctcactacagaaagcaacagcatcgtcaagcatgttgcaattatacaatccctgaaccaacacaccgtagctgaaggcattaggggcaatcccattgttctgcattttcctgaaaatcctcttagcgtcttcaattttatgagccttgcaaaaggcctcaacgacagcagtgtagataacgacctcagggattgtacccttgtcacgcatcaatccgaaaagcttcatggcctcttgtacaagcccatctttgcagaggccgtcaagcatggcgacggcgttagggatgagacctccttccttcatcttcttgaagatctcatcggaatcctcaggcggcggtaagggctcctgcgggtattgttccggtttgggggtttcccgtgaatcctgattgactccaagcttgaactgttcgaggaagccatcgtcagacagagtagtatcactctttccaaggttgtgggcttgtctagcgggtggttctctgtgagagttggaagatctctcccctcgcaagggtctgttgggtaagggctctggagggttctgctgctcgtctacttgaccattgtcgcccgttgagagaaagcgtgttgcggacatcgacggcgtcgtaacacgaatctgcttcgccatctgccttgcaaaaacgacggctttggaggaaggcaccatcgttatctgccgctgattcgaaaagttagggttttgcagattttgacggagagagaagaaggggagggtttagtcacgcgagaaggattgagggatataacagtcatttactctacagggggtataagaaagaaagaaggtcctcactcctccgtgtggataagcttctcactttcagttcaattggatagccggaaaggctctcctccaaggtaaattcctctctacttccttgttaaagctcgaatcatctctaagttaagcaaaattggtgtgttgtagtggcgtttatatg

SEQ ID NO: 33625 - DNA, 3000 bp, Unknown; identical to SEQ ID NO: 3479
  misc_feature (1)..( 3000): 2750-1469P.txt file - cDNA_ID_3071268; gDNA_ID_1620648; Annot_ID_163324

SEQ ID NO: 33626 - DNA, 3000 bp, Unknown; identical to SEQ ID NO: 3479
  misc_feature (1)..( 3000): 2750-1469P.txt file - cDNA_ID_3071268; gDNA_ID_2926214; Annot_ID_202850

SEQ ID NO: 33627 - DNA, 3000 bp, Unknown; identical to SEQ ID NO: 3480
  misc_feature (1)..( 3000): 2750-1469P.txt file - cDNA_ID_3071272; gDNA_ID_1620648; Annot_ID_163323

SEQ ID NO: 33628 - DNA, 3000 bp, Unknown; identical to SEQ ID NO: 3480
  misc_feature (1)..( 3000): 2750-1469P.txt file - cDNA_ID_3071272; gDNA_ID_2926214; Annot_ID_202849

SEQ ID NO: 33629 - DNA, 3000 bp, Unknown; identical to SEQ ID NO: 3473
  misc_feature (1)..( 3000): 2750-1469P.txt file - cDNA_ID_3071276; gDNA_ID_1620648; Annot_ID_163319

SEQ ID NO: 33630 - DNA, 3000 bp, Unknown
  misc_feature (1)..( 3000): 2750-1469P.txt file - cDNA_ID_3071301; gDNA_ID_1620649; Annot_ID_163409
tttgagattagatttcttctcaagacttgaaacacaaaagaagaagaagaagagcatttgatccacaagagtgattgagccgagccaaattattctccctgctgagatcggcagcgagaccactcttctagactctagacatgggatgcagagaaaccaactttttttatttaaacggctgcgttttaagtcatgttctcaaatgataccagttttttttttttttttttttttgctaagcacaagtttgatttgttgtttggcactttacgataacatcattttactcctatactttctcacggtaagtgattaagataaaaacatgcacatttttcgaattataagctaaatttaaagggatctattttctatctctcaataatttttaaattttactcattttctatttctcttataaattaattacttggtaatttagttttgtaatcgatactcaaaaatcgatatccaacaaaggacaatctctttgcggtcaatagtcttctcaaattacttcatacaattatcatactgtttggtaaaatttgtgaatctgcctcataaaatgtacgtggaaagtggaacaacagttaatgcttattttgaccacaagattgagaaaattttgaaaagagtatattgaccagttgctgacgttgcatgtcattctttaatgttgttgttgactgcaacaaaaaataaaatacaacatacaaagtaaaaaaataaaaataaattaattgatctttgtttctctattccccagagagctagcttttcagatctaaaatcagaatctgacggctgatatccctcgtgaaaaacaccccaaccgtccagatgcaactgcttgctgggccaatgatccattctctttcccgaaatggattaatcaatttaagccttatcacatgctggcccattttctaactcctcttttcttttttaacttacttttctttcttttaatattttagttgcagattcattttcgaaatcaacgaaatttatgtttttttaattttctgggtatcttaatcgcgagattttttattttaatatcacgctcgaatatacaattcggaatgtgcagatgttttttttgaaggcaatttagaaaaatagacaaaaatcgaacaaacatatatagaaatagagatctaaataaaaacatttattttatttcctcttggaaacaaggaaaaaatgaattggggtgggtgacgtggcagtcatacccttgccacacccttcctatacgcatataaacagcagctgcgaggagagagagatttcagagtattttctagggtttcgttttttttaaagatttagagaaaaaagtgagttattaagagattccaatcaaaatgagcggagacaacggcggtggtgagaggcgcaaaggctccgtcaagtggtttgatacccagaagggtttcggcttcatcactcctgacgacggtggcgacgatctcttcgttcaccagtcctccatcagatctgagggtttccgtagcctcgctgccgaagaagccgtagagttcgaggttgagatcgacaacaacaaccgtcccaaggccatcgatgtttctggacccgacggcgctcccgtccaaggaaacagcggtggtggttcatctggcggacgcggcggtttcggtggaggaagaggaggtggacgcggatctggaggtggatacggcggtggcggtggtggatacggaggaagaggaggtggtggtcgaggaggcagcgactgctacaagtgtggtgagcccggtcacatggcgagagactgttctgaaggcggtggaggttacggaggaggcggcggtggctacggaggtggaggcggatacggcggaggaggtggtggttacggaggtggtggccgtggaggtggtggcggcgggggaagctgctacagctgtggcgagtcgggacatttcgccagggattgcaccagcggtggacgttaaaaccaacgccggttacgcggtggagaagagtgagttggttatctcacaagtgatcggttctttctcccgccgccttctatctctctattatccactttttgcttattatgatggatctctatctttgttagttggttttttcttgatggtttcggattaggactcttcttttggttttgctacttatggttggttttatttatggtacttgtgatatgggtgaaatgctctacttgttgctctgtttcaagtgttcataatatgcgaacaaatattctgggttttgtttcagtcatctgaatgaatcgtaagatctggatacttaaatcttgagagatcatcgttttatggttgaattatttatggattatgtaacgattcccatagatacaaaatctatctgctcatgttttgcatttaatggcatttaagttccatggactggaaggaattgaatactaattgcagtctccatcattctcattattagactttttatcttcgatgtcgtttgtattttcaatcttttgtatatcttcagaaaatgtaatcttctcaacttctttccaccgtttcatcatgatcacactggcattttactgtagctcacacgattcggattggattaagtaaataaaagcagatatgggaagattttagatctgttgttgttgttgttaccttggaaatcggagtgctctctataaattatcaacttttatcatgtttgaactttcatggtccacaaccaaaataccacgtgcgcatcgctaaatggataaccgtaaaaccggttaattttcggttcaccaacccagtttggaactagaataatccggtttcggttttattgtttcaaagaaacagagaagctcttctcctctatcgactactctcactctctttctattctctcttccgccgctttttccatcgttcgaaagtaaagttgctcgctttactcgttcaagcattcaactttagaatccgatcgaatcctcctgtaacagcaatg

SEQ ID NO: 33631 - DNA, 3000 bp, Unknown; identical to SEQ ID NO: 3527
  misc_feature (1)..( 3000): 2750-1469P.txt file - cDNA_ID_3071309; gDNA_ID_1620649; Annot_ID_163402

SEQ ID NO: 33632 - DNA, 3000 bp, Unknown; identical to SEQ ID NO: 3527
  misc_feature (1)..( 3000): 2750-1469P.txt file - cDNA_ID_3071309; gDNA_ID_2926215; Annot_ID_202940

SEQ ID NO: 33633 - DNA, 3000 bp, Unknown; identical to SEQ ID NO: 3524
  misc_feature (1)..( 3000): 2750-1469P.txt file - cDNA_ID_3071317; gDNA_ID_1620649; Annot_ID_163399

SEQ ID NO: 33634 - DNA, 3000 bp, Unknown; identical to SEQ ID NO: 3524
  misc_feature (1)..( 3000): 2750-1469P.txt file - cDNA_ID_3071317; gDNA_ID_2926215; Annot_ID_202937

SEQ ID NO: 33635 - DNA, 3003 bp, Unknown; identical to SEQ ID NO: 19223
  misc_feature (1)..( 3003): 2750-1469P.txt file - cDNA_ID_3071326; gDNA_ID_1620649; Annot_ID_163387

SEQ ID NO: 33636 - DNA, 3003 bp, Unknown; identical to SEQ ID NO: 19223
  misc_feature (1)..( 3003): 2750-1469P.txt file - cDNA_ID_3071326; gDNA_ID_2926215; Annot_ID_202925

SEQ ID NO: 33637 - DNA, 43 bp, Unknown; identical to SEQ ID NO: 3516
  misc_feature (1)..( 43): 2750-1469P.txt file - cDNA_ID_3071330; gDNA_ID_1620649; Annot_ID_163384

SEQ ID NO: 33638 - DNA, 3003 bp, Unknown
  misc_feature (1)..( 3003): 2750-1469P.txt file - cDNA_ID_3071360; gDNA_ID_1620650; Annot_ID_163431
ttcagacgggtgagatgacgagctggttgagacgggcgatctgacgagttggtctttgtctctaagtgtcctcgcggaatcccccccctttgacaagacatgctattccgtatttatagccttctgcgtgtagggcactcctccagggttttgacgagcctaccctcttgacttaacattctgcttaggcctttgacttggatttgggccttgggccaagcaagcccaaatctaacccctaacagttgccccccaatcctgatgcactgttgatgacgtggatcaggatttcaagtgttcgactcttaaccgaaggaaacgaaaggtcgcgcatggggaaaacgcgatgtccagctttcttttgcatttttcgaggctccaatatctaggcgttgcatggccgttgtggcataggtgatcattacaacgctattcccataggcgtaatgagcttgtctcgggaattgcttatgcgtcttctataagtactgtcctcctttgatcgtttcacccttcaatcgctttagcagaggtacgagttctttctctcttttgtcttgttttgattcgttatttctttggtttcgatgtcgttgggttcgaattcttctcggctcgtccccggtcggactcatactggcgccctgggcgattcgtcgactcgatcggccaagtgtgaagacgacggctcgtcgttcgtctagaggtcgatctcgtcagaatttaggtacgcacttcatcaaatgagacttcacttctattacgatgctgtggcttatccgccgttgtcttttcctttgcttatagcgactcgttggaagatgggaaggataaacctagacgcgatccccaactactcgaggaaatacaaggagaagagagccgtttcggagactccgcagccgtctctttccgagggacaacagattgcagaagctacaaggagaagcctcttggatcaggtcggtcgtcgtgtgtttgagccgggatgttcgaatcctactggaatggcttctgagaagacgcgagaagaggttgaggttgtcgtcccttccgagatgcgaggcgatggtcaggttgcaaggagggagctcgtacttggtcttcagaattcgtctggcacgtttggtgcaaggagggttgctcctgaagtgggtcgtgcggatgcttctaaacgaccgcgggtaagcgaccatagatggggctttcgttacgacgatatggctgctccctttacttctaattctgtcgcttgtgctgagcttcttcgtgaaattggtcgtggctcgggtattccttcgatgcccttagacttgaaggaggagaaagttttcgccggagcggccaggaagtcgatcgaggtatgctcaccttctgggtttgattccaattttttctttgaattgcattcgcttgacacgctctttgtccaggcgatcgccgaatgggatcgtttgacttatttgtacgagcgttgtgttcggagcctttccgtagacgctactaacgcgaaagatgcccatgaggctttggccgttgaaaaggaaaaagtagctcaggcgctggccgacctggcaaggtctcaagacgacgccaaggagatgaagaggaaatatgacgagttagctggtcgcgctctttcggagatgaagaggcttcgagaacgtcgacttgaatatgctgaatttgtccggagatcggcccttgataagatggcggagctcgttcagaagcgattggatcgtattaaagctcatattgacgatacgaaggcggcagaaccaaagtttcttgaattcaaccaagtatctgggaatatcaagactctcgaggcgttggtcgaaggtggcgaagtggagatgaagtcggatgacatgatgttaagattggtagcggatgcagaggaattggaggccgaggtgaaagcttttggtatcaccgatcttatggacggcgacttcgatgttcgtactttatttgccgagctgagtcctgataatcgtaattccgttccaccgccgactgaaggggaagatctcgcggatggacgaggtgagtgcgaaggccaagctggtgaaagaatcgttggtcaaactgaagttcgagacgagatcgcggatgctagagactgatattccaggaggctaagccaaagggaagaagcggagctcagatgcctaaagagatcccaatatggcaaaacaaaaaatattctaaaaactgaataatcaacgaattttatattatgtgaccaaaaaatgaaaacagaaactatgtaacaatcatcaaatacagtgttttcagcatttatttttttctaaattttccagcaacatacaaacataacgttactactagacataaaaatactccctctgttccaagttatttgatggtttggatttttttatttgttccataagattgatgttttgtaaaaattaaatatgattattaatcttgtttgttgccaatagtgaaaggagagaggtaatagtaatattattaaactattaaaatagtaattaaaattaaatagaaaagttactttttcttaatttatgtgcgaaacttaaaacatcaaacttacagagagagtaatatataacatgatatgagatgaaactgtacggtgtcgttgcataattacataaactagttataaactcacacactgccttcatttcaggtcgagacagaacttattgtgtgatttaaatcagacaaaccttcgaactttgactttttcatcgcctcctgtcccttcgccgcaaaatactagtctaaacgctcaactcctctctcctgtcttataaacttttttttttagaaaatgagatgatcaatcgaattttgttgtgtgtgacctcaaactgacaacttccagtaattgtaatattaccaattttttttatcaaaaagatgaacttcactttagagcaatagcaatccctcgagtctcccctatataaagattccaactccttaacgattcatctaatg

SEQ ID NO: 33639 - DNA, 3003 bp, Unknown; identical to SEQ ID NO: 33638
  misc_feature (1)..( 3003): 2750-1469P.txt file - cDNA_ID_3071360; gDNA_ID_2926176; Annot_ID_199879

SEQ ID NO: 33640 - DNA, 1245 bp, Unknown
  misc_feature (1)..( 1245): 2750-1469P.txt file - cDNA_ID_3071370; gDNA_ID_1620650; Annot_ID_47710
aaccaagtatctgggaatatcaagactctcgaggcgttggtcgaaggtggcgaagtggagatgaagtcggatgacacgatgttaagattggtagcggatacagaggaattggaggccgaggtgaaagcttttggtatcaccgatcttatggacggcgacttcgatgttcgtactttatttgccgagctgagtcctgataatcgtaattccgttccaccgccgactaaaggggaagatctcgcggatggacgaggtgagtgcgaaggccaagctggtgaaagaatcgttggtcaaactgaagttcgagacgagatcgcggatgctagagactgatattccaggaggctaagccaaagggaagaagcggagctcagatgcctaaagagatcccaatatggcaaaacaaaaaatattctaaaaactgaataatcaacgaattttatattatgtgaccaaaaaatgaaaacagaaactatgtaacaatcatcaaatacagtgttttcagcatttatttttttctaaattttccagcaacatacaaacataacgttactactagacataaaaatactccctctgttccaagttatttgatggtttggatttttttatttgttccataagattgatgttttgtaaaaattaaatatgattattaatcttgtttgttgccaatagtgaaaggagagaggtaatagtaatattattaaactattaaaatagtaattaaaattaaatagaaaagttactttttcttaatttatgtgcgaaacttaaaacatcaaacttacagagagagtaatatataacatgatatgagatgaaactgtacggtgtcgttgcataattacataaactagttataaactcacacactgccttcatttcaggtcgagacagaacttattgtgtgatttaaatcagacaaaccttcgaactttgactttttcatcgcctcctgtcccttcgccgcaaaatactagtctaaacgctcaactcctctctcctgtcttataaacttttttttttagaaaatgagatgatcaatcgaattttgttgtgtgtgacctcaaactgacaacttccagtaattgtaatattaccaatttttttataaaaaagatgaacttcactttagagcaatagcaatccctcgagtctcccctatataaagattccaactccttaacgattcatctaatgaaaaaacacacacaccaaaaatatcagatatctcaaacaatg

SEQ ID NO: 33641 - DNA, 1203 bp, Unknown
  misc_feature (1)..( 1203): 2750-1469P.txt file - cDNA_ID_3071370; gDNA_ID_1620650; Annot_ID_163427
aaccaagtatctgggaatatcaagactctcgaggcgttggtcgaaggtggcgaagtggagatgaagtcggatgacacgatgttaagattggtagcggatacagaggaattggaggccgaggtgaaagcttttggtatcaccgatcttatggacggcgacttcgatgttcgtactttatttgccgagctgagtcctgataatcgtaattccgttccaccgccgactaaaggggaagatctcgcggatggacgaggtgagtgcgaaggccaagctggtgaaagaatcgttggtcaaactgaagttcgagacgagatcgcggatgctagagactgatattccaggaggctaagccaaagggaagaagcggagctcagatgcctaaagagatcccaatatggcaaaacaaaaaatattctaaaaactgaataatcaacgaattttatattatgtgaccaaaaaatgaaaacagaaactatgtaacaatcatcaaatacagtgttttcagcatttatttttttctaaattttccagcaacatacaaacataacgttactactagacataaaaatactccctctgttccaagttatttgatggtttggatttttttatttgttccataagattgatgttttgtaaaaattaaatatgattattaatcttgtttgttgccaatagtgaaaggagagaggtaatagtaatattattaaactattaaaatagtaattaaaattaaatagaaaagttactttttcttaatttatgtgcgaaacttaaaacatcaaacttacagagagagtaatatataacatgatatgagatgaaactgtacggtgtcgttgcataattacataaactagttataaactcacacactgccttcatttcaggtcgagacagaacttattgtgtgatttaaatcagacaaaccttcgaactttgactttttcatcgcctcctgtcccttcgccgcaaaatactagtctaaacgctcaactcctctctcctgtcttataaacttttttttttagaaaatgagatgatcaatcgaattttgttgtgtgtgacctcaaactgacaacttccagtaattgtaatattaccaatttttttataaaaaagatgaacttcactttagagcaatagcaatccctcgagtctcccctatataaagattccaactccttaacgattcatctaatg

SEQ ID NO: 33642 - DNA, 3003 bp, Unknown
  misc_feature (1)..( 3003): 2750-1469P.txt file - cDNA_ID_3071370; gDNA_ID_2926176; Annot_ID_140343
tgttccagtgtcgcggcgactcctactggtccaagtgccccccttgcattagcaccgccgtctctggggtaattgtgacttcaatattataaattagcagtcatatagttacatgtaaaaattacgatgagcacacacgtcggttaattttttctgtcaaatcttaaatatgtgggcaatgatcctgatactttatataaatgattgaattgagacaaaactgatagacattaaaggctagttaaaaaatactgattaaacaatgcaatattgttcttgatatatatatgtacgtatatgtatgtgacagcttcgtaggagatgtccaagaaataagggagcaataatatggtatgaccaatgtcttttaaagatatcttcagttgcctccttcaataagatagattatgagaacgatttctatttgtccaacccaaacaacatgagtgatcgggggttgttcaacaaggagacgtcggctctcctggagaagctggcatataaagcctccgatagaaacaacttggatggtaaacaattggtgttgtacgcagcaggggagaagagaattgggacaaagaaggtgtatgcaatggtgcagtgtacgaaagacttaatatttacaaagtgctttgagtgtttggaagggattttgaggaagtttccacagtgttgtgacggtaaacgaggagggagagttttcggtacgagctgtaactttaggtatgagttatatccttttcttagaaactaacagcaacaacagtacaatgagagctccatattaaatgaaagggttctagagataaacagtcttataatatacactgtgttgcattttagtacgtgaacttgagcgaataaatgtactttcctctttgtgatttttgttttttttttgtgaacttgagttattaagaggaaatcttcaagtaaagaatttatctaatagtatatacatcccacatagaataccaaatagctcagctcatacaaactctctcataatgagagaaaaaaatcctgaaataagggtaagaaaaactcttatgcctcaaggttttagtaaatctcataattttggccgaaccacaaaaagagacgtgcgaaacaaaatagtagaaaattgatttcccgaatcgacaaacatggactaaactatatgtatgatacataactggtcgtacttacaatgatgatacttggtttcacgaagacgagggagcctggagatgaatgatggtgataaggccatgtgtcatcaccaaaaggagggttgctcctgaagttttcgccggagcggccaggaagtcgatcgaggtatgctcaccttctgggtttgattccaattttttctttgaattgcattcgcttgacacgctctttgtccaggcgatcgccgaatgggatcgtttgacttatttgtacgagcgttgtgttcggagcctttccgtagaggctactaacgcgaaagatgcccatgaggctttggccgttgaaaaggaaaaagtagctcaggcgctggccgacctggcaaggtctcaagacgacgccaaggagatgaagaggaaatatgacgagttagctggtcgcgctctttcggagatgaagaggcttcgagaacgtcgacttgaatatgctgaatttgtccggagatcggcccttgataagatggcggagctcgttcagaagcgattggatcgtattaaagctcatattgacgatacgaaggcggcagaaccaaagtttcttgaattcaaccaagtatctgggaatatcaagactctcgaggcgttggtcgaaggtggcgaagtggagatgaagtcggatgacacgatgttaagattggtagcggatacagaggaattggaggccgaggtgaaagcttttggtatcaccgatcttatggacggcgacttcgatgttcgtactttatttgccgagctgagtcctgataatcgtaattccgttccaccgccgactaaaggggaagatctcgcggatggacgaggtgagtgcgaaggccaagctggtgaaagaatcgttggtcaaactgaagttcgagacgagatcgcggatgctagagactgatattccaggaggctaagccaaagggaagaagcggagctcagatgcctaaagagatcccaatatggcaaaacaaaaaatattctaaaaactgaataatcaacgaattttatattatgtgaccaaaaaatgaaaacagaaactatgtaacaatcatcaaatacagtgttttcagcatttatttttttctaaattttccagcaacatacaaacataacgttactactagacataaaaatactccctctgttccaagttatttgatggtttggatttttttatttgttccataagattgatgttttgtaaaaattaaatatgattattaatcttgtttgttgccaatagtgaaaggagagaggtaatagtaatattattaaactattaaaatagtaattaaaattaaatagaaaagttactttttcttaatttatgtgcgaaacttaaaacatcaaacttacagagagagtaatatataacatgatatgagatgaaactgtacggtgtcgttgcataattacataaactagttataaactcacacactgccttcatttcaggtcgagacagaacttattgtgtgatttaaatcagacaaaccttcgaactttgactttttcatcgcctcctgtcccttcgccgcaaaatactagtctaaacgctcaactcctctctcctgtcttataaacttttttttttagaaaatgagatgatcaatcgaattttgttgtgtgtgacctcaaactgacaacttccagtaattgtaatattaccaatttttttataaaaaagatgaacttcactttagagcaatagcaatccctcgagtctcccctatataaagattccaactccttaacgattcatctaatgaaaaaacacacacaccaaaaatatcagatatctcaaacaatg

SEQ ID NO: 33643 - DNA, 3003 bp, Unknown
  misc_feature (1)..( 3003): 2750-1469P.txt file - cDNA_ID_3071370; gDNA_ID_2926176; Annot_ID_199875
gctacaccgaagaaggtgaggatcccaataacgtctttgtcatgttccagtgtcgcggcgactcctactggtccaagtgccccccttgcattagcaccgccgtctctggggtaattgtgacttcaatattataaattagcagtcatatagttacatgtaaaaattacgatgagcacacacgtcggttaattttttctgtcaaatcttaaatatgtgggcaatgatcctgatactttatataaatgattgaattgagacaaaactgatagacattaaaggctagttaaaaaatactgattaaacaatgcaatattgttcttgatatatatatgtacgtatatgtatgtgacagcttcgtaggagatgtccaagaaataagggagcaataatatggtatgaccaatgtcttttaaagatatcttcagttgcctccttcaataagatagattatgagaacgatttctatttgtccaacccaaacaacatgagtgatcgggggttgttcaacaaggagacgtcggctctcctggagaagctggcatataaagcctccgatagaaacaacttggatggtaaacaattggtgttgtacgcagcaggggagaagagaattgggacaaagaaggtgtatgcaatggtgcagtgtacgaaagacttaatatttacaaagtgctttgagtgtttggaagggattttgaggaagtttccacagtgttgtgacggtaaacgaggagggagagttttcggtacgagctgtaactttaggtatgagttatatccttttcttagaaactaacagcaacaacagtacaatgagagctccatattaaatgaaagggttctagagataaacagtcttataatatacactgtgttgcattttagtacgtgaacttgagcgaataaatgtactttcctctttgtgatttttgttttttttttgtgaacttgagttattaagaggaaatcttcaagtaaagaatttatctaatagtatatacatcccacatagaataccaaatagctcagctcatacaaactctctcataatgagagaaaaaaatcctgaaataagggtaagaaaaactcttatgcctcaaggttttagtaaatctcataattttggccgaaccacaaaaagagacgtgcgaaacaaaatagtagaaaattgatttcccgaatcgacaaacatggactaaactatatgtatgatacataactggtcgtacttacaatgatgatacttggtttcacgaagacgagggagcctggagatgaatgatggtgataaggccatgtgtcatcaccaaaaggagggttgctcctgaagttttcgccggagcggccaggaagtcgatcgaggtatgctcaccttctgggtttgattccaattttttctttgaattgcattcgcttgacacgctctttgtccaggcgatcgccgaatgggatcgtttgacttatttgtacgagcgttgtgttcggagcctttccgtagaggctactaacgcgaaagatgcccatgaggctttggccgttgaaaaggaaaaagtagctcaggcgctggccgacctggcaaggtctcaagacgacgccaaggagatgaagaggaaatatgacgagttagctggtcgcgctctttcggagatgaagaggcttcgagaacgtcgacttgaatatgctgaatttgtccggagatcggcccttgataagatggcggagctcgttcagaagcgattggatcgtattaaagctcatattgacgatacgaaggcggcagaaccaaagtttcttgaattcaaccaagtatctgggaatatcaagactctcgaggcgttggtcgaaggtggcgaagtggagatgaagtcggatgacacgatgttaagattggtagcggatacagaggaattggaggccgaggtgaaagcttttggtatcaccgatcttatggacggcgacttcgatgttcgtactttatttgccgagctgagtcctgataatcgtaattccgttccaccgccgactaaaggggaagatctcgcggatggacgaggtgagtgcgaaggccaagctggtgaaagaatcgttggtcaaactgaagttcgagacgagatcgcggatgctagagactgatattccaggaggctaagccaaagggaagaagcggagctcagatgcctaaagagatcccaatatggcaaaacaaaaaatattctaaaaactgaataatcaacgaattttatattatgtgaccaaaaaatgaaaacagaaactatgtaacaatcatcaaatacagtgttttcagcatttatttttttctaaattttccagcaacatacaaacataacgttactactagacataaaaatactccctctgttccaagttatttgatggtttggatttttttatttgttccataagattgatgttttgtaaaaattaaatatgattattaatcttgtttgttgccaatagtgaaaggagagaggtaatagtaatattattaaactattaaaatagtaattaaaattaaatagaaaagttactttttcttaatttatgtgcgaaacttaaaacatcaaacttacagagagagtaatatataacatgatatgagatgaaactgtacggtgtcgttgcataattacataaactagttataaactcacacactgccttcatttcaggtcgagacagaacttattgtgtgatttaaatcagacaaaccttcgaactttgactttttcatcgcctcctgtcccttcgccgcaaaatactagtctaaacgctcaactcctctctcctgtcttataaacttttttttttagaaaatgagatgatcaatcgaattttgttgtgtgtgacctcaaactgacaacttccagtaattgtaatattaccaatttttttataaaaaagatgaacttcactttagagcaatagcaatccctcgagtctcccctatataaagattccaactccttaacgattcatctaatg

SEQ ID NO: 33644 - DNA, 3000 bp, Unknown; identical to SEQ ID NO: 3555
  misc_feature (1)..( 3000): 2750-1469P.txt file - cDNA_ID_3071384; gDNA_ID_1620651; Annot_ID_163471

SEQ ID NO: 33645 - DNA, 3000 bp, Unknown; identical to SEQ ID NO: 3555
  misc_feature (1)..( 3000): 2750-1469P.txt file - cDNA_ID_3071384; gDNA_ID_2926182; Annot_ID_200315

SEQ ID NO: 33646 - DNA, 3000 bp, Unknown; identical to SEQ ID NO: 3554
  misc_feature (1)..( 3000): 2750-1469P.txt file - cDNA_ID_3071392; gDNA_ID_1620651; Annot_ID_163469

SEQ ID NO: 33647 - DNA, 3000 bp, Unknown; identical to SEQ ID NO: 3554
  misc_feature (1)..( 3000): 2750-1469P.txt file - cDNA_ID_3071392; gDNA_ID_2926182; Annot_ID_200313

SEQ ID NO: 33648 - DNA, 3000 bp, Unknown; identical to SEQ ID NO: 3562
  misc_feature (1)..( 3000): 2750-1469P.txt file - cDNA_ID_3071400; gDNA_ID_1620651; Annot_ID_163467

SEQ ID NO: 33649 - DNA, 3000 bp, Unknown; identical to SEQ ID NO: 3562
  misc_feature (1)..( 3000): 2750-1469P.txt file - cDNA_ID_3071400; gDNA_ID_2926182; Annot_ID_200311

SEQ ID NO: 33650 - DNA, 3000 bp, Unknown; identical to SEQ ID NO: 3563
  misc_feature (1)..( 3000): 2750-1469P.txt file - cDNA_ID_3071404; gDNA_ID_1620651; Annot_ID_163466

SEQ ID NO: 33651 - DNA, 3003 bp, Unknown; identical to SEQ ID NO: 19245
  misc_feature (1)..( 3003): 2750-1469P.txt file - cDNA_ID_3071412; gDNA_ID_1620651; Annot_ID_163463

SEQ ID NO: 33652 - DNA, 3003 bp, Unknown; identical to SEQ ID NO: 19245
  misc_feature (1)..( 3003): 2750-1469P.txt file - cDNA_ID_3071412; gDNA_ID_2926181; Annot_ID_200296

SEQ ID NO: 33653 - DNA, 3003 bp, Unknown; identical to SEQ ID NO: 19247
  misc_feature (1)..( 3003): 2750-1469P.txt file - cDNA_ID_3071414; gDNA_ID_1620651; Annot_ID_163461

SEQ ID NO: 33654 - DNA, 3003 bp, Unknown; identical to SEQ ID NO: 19247
  misc_feature (1)..( 3003): 2750-1469P.txt file - cDNA_ID_3071414; gDNA_ID_2926181; Annot_ID_200294

SEQ ID NO: 33655 - DNA, 3003 bp, Unknown; identical to SEQ ID NO: 19249
  misc_feature (1)..( 3003): 2750-1469P.txt file - cDNA_ID_3071418; gDNA_ID_1620651; Annot_ID_163460

SEQ ID NO: 33656 - DNA, 3003 bp, Unknown; identical to SEQ ID NO: 19249
  misc_feature (1)..( 3003): 2750-1469P.txt file - cDNA_ID_3071418; gDNA_ID_2926181; Annot_ID_200293

SEQ ID NO: 33657 - DNA, 3003 bp, Unknown
  misc_feature (1)..( 3003): 2750-1469P.txt file - cDNA_ID_3071426; gDNA_ID_1620649; Annot_ID_47689
ttaagtaaggaaaccatcggaagaaagcaaaattagtgatgcggcaagcaagaaaaaaaaacaaaaggatttatgcggcagattccaactggttcgtattcgctaccaaaaaaaaggaaactttaccttgcaagatgttggaagcaactcaagttgagcaagaaaatgaatgaagagaaggatctcaagaggacggaggagatgtgggcgtggaatttcagagcttgtagatctactacgactacggatggatcaaccaaacacaaaatttatacttttatataaaaatgaacaccgatttttattattattaaattaaatataagcgagcggatgaggaagaagaagaccaattgacaaaaaaaaaaactttttaagaagaaaaaaaaatggttatcccctcagaaactaatgatctttctttcaatgtctggaaacagtgaacaatgaaggtaaaagagagagagagagagaggtcaagtcgccgaacgagacatcctccttcgacgtttttatgtaaaaaaaagaaagaaagttggagttgttttttttatcttctctctttatctctctctatagtcttaagactaagagtgattcttaccagacaagacccataaaagaccaacgatggcgaggtcggagccagcacatcaaaggtcccagctttcgggctccacttccctctcgtccttttttgcctcattagatggacaacaccaaacagtggcaaagaataatattacagtttttttagggaagaaaataaaatagttgatattattgatataataattcattcaagtctcctctttattttaaaaatattcaactcttttactttagacattatcataaactggggtcaaacggaagatttttcttcaacgtttaataaaatctcttaacacaaatcaaagaagagtaaaaatatacggtttcgataaaatttggttatgtggcggtgttacatgactacgactgataaaactacacgagtacttttgtttttctgtcaccaagatttatttcttttacttactccatgtgtttttttctttcttcgttaaaactactcctcgtaaattataatcaagattttaagcagtgtgcatataaaataaaatacatgtacagtctagaaataatatatgtggattcatgaatctttcatttttaatttccccacacaatttgtatcaaacgtttaatgcccataaaagtggtggtccaggaccctgagattaaaattttaaaaaaatatatagagaagaggcttgggcttgaagaatgaaaaattgaataacaaatatttaaaaaaatttgggacccgaaagtgattgggataaagtgagatatgtcactttacctaacattatttaattttatattaatgtatgtaccactaaatttggcccttttctccccatcgactctttgtagttatttatacttttgtagtaccaataatagaagaatcaactataaaaatttcagctcaataaagaaaaacagaactatgaattaagtgagaaactcaaaagcctgcttctaaaacatgaatacgtccacgataattatcactaagttctagataatctaattttgcgggaccaaattgatgtatatgcgaactttttcatacttttttcaccaacaaatgtatatacttcccatcatgcatgctcccatggtatctcgccgagtgtcaatatatgtgaacttacataaccaaaaattgatttataaagataacaataataagggagacctaaaaatagagaaaagggtggtgtggactgtggagaaggtccctacttacagaacatagcttccatcaatcacacaaaaatccaaccactctgaacctttcacttcaggaccaacttcgttatccaatcatctcccaatatgccaatactttcacttatatatgaacgtgtatatataaacccttcacatttacttcacaaaaatatcttttaaaaaaagatcataatcacaactactaagctagaattttttagtaaatttactactacggtaattataaacaaattatataggtttcttaaatagtagaacttaaaatataatgcaaagttatgtacgaatactatcttttaattaaaaataacgataagaatgttaaaaaagaaaaaaaaaaaatcatgttgatgatatatatgttgaagtaaaatttagttattaggtttaggtatacgtcaatcattcatgatacatggatcccaaacccataatatatcatgcatcgatctctgaaaatcaccaaagcaaaaaaaacccatgtaacatgatatactatattatgcatcatttcgccaatgtaacttctctgatgccctgaacctatttcacatatgactcatgggaaagaccgacaaagggatcgtattacccaaatatggttacgataacatccactgaatatcactcaaaatgaattattgtctcttactagatatattacggctagttgatgatttgtttgaaaagtttaatcttacaaaattattaatagatttgatgctgctcaaagtggtctcttttatttgcaccgcaaaaagccagtatatatccccattagaaaagacgtgacaaagtgtttaatagatcctttatgttttcctcggacccatgcatatataagtgtatttaaatcttttataaggtttttatagccataaataaacaaatttagttcaaaataagaataattaagtaattggaatagcgagacacgttccttgagatgataacacgagcatatattcttcatcacttttgtttgcttcatatcatatacgctaacttatgtgtgtgtgtaatatatgatctcagaactaacaagtaagaagaagaagaatgtcggagagtttcaaagtgtgcttctgttgcagcagaagctttaaggagaaaacgaggcagccaccagtgagcatcaagagactcttcgaagcttactcaagaaacggcaagatg

SEQ ID NO: 33658 - DNA, 3003 bp, Unknown; identical to SEQ ID NO: 33657
  misc_feature (1)..( 3003): 2750-1469P.txt file - cDNA_ID_3071426; gDNA_ID_1620649; Annot_ID_163394

SEQ ID NO: 33659 - DNA, 3003 bp, Unknown
  misc_feature (1)..( 3003): 2750-1469P.txt file - cDNA_ID_3071426; gDNA_ID_1620652; Annot_ID_163512
tcaattgttatgagtggcaatagaaatgaatctgtaggagattatagtgagactgattagtctagtgattgaacaatctaagaaacttgatgcaacattgaaaagttaacatctttaagtaaggaaaccatcggaagaaagcaaaattagtgatgcggcaagcaagaaaaaaaaacaaaaggatttatgcggcagattccaactggttcgtattcgctaccaaaaaaaaggaaactttaccttgcaagatgttggaagcaactcaagttgagcaagaaaatgaatgaagagaaggatctcaagaggacggaggagatgtgggcgtggaatttcagagcttgtagatctactacgactacggatggatcaaccaaacacaaaatttatacttttatataaaaatgaacaccgatttttattattattaaattaaatataagcgagcggatgaggaagaagaagaccaattgacaaaaaaaaaaactttttaagaagaaaaaaaaatggttatcccctcagaaactaatgatctttctttcaatgtctggaaacagtgaacaatgaaggtaaaagagagagagagagagaggtcaagtcgccgaacgagacatcctccttcgacgtttttatgtaaaaaaaagaaagaaagttggagttgttttttttatcttctctctttatctctctctatagtcttaagactaagagtgattcttaccagacaagacccataaaagaccaacgatggcgaggtcggagccagcacatcaaaggtcccagctttcgggctccacttccctctcgtccttttttgcctcattagatggacaacaccaaacagtggcaaagaataatattacagtttttttagggaagaaaataaaatagttgatattattgatataataattcattcaagtctcctctttattttaaaaatattcaactcttttactttagacattatcataaactggggtcaaacggaagatttttcttcaacgtttaataaaatctcttaacacaaatcaaagaagagtaaaaatatacggtttcgataaaatttggttatgtggcggtgttacatgactacgactgataaaactacacgagtacttttgtttttctgtcaccaagatttatttcttttacttactccatgtgtttttttctttcttcgttaaaactactcctcgtaaattataatcaagattttaagcagtgtgcatataaaataaaatacatgtacagtctagaaataatatatgtggattcatgaatctttcatttttaatttccccacacaatttgtatcaaacgtttaatgcccataaaagtggtggtccaggaccctgagattaaaattttaaaaaaatatatagagaagaggcttgggcttgaagaatgaaaaattgaataacaaatatttaaaaaaatttgggacccgaaagtgattgggataaagtgagatatgtcactttacctaacattatttaattttatattaatgtatgtaccactaaatttggcccttttctccccatcgactctttgtagttatttatacttttgtagtaccaataatagaagaatcaactataaaaatttcagctcaataaagaaaaacagaactatgaattaagtgagaaactcaaaagcctgcttctaaaacatgaatacgtccacgataattatcactaagttctagataatctaattttgcgggaccaaattgatgtatatgcgaactttttcatacttttttcaccaacaaatgtatatacttcccatcatgcatgctcccatggtatctcgccgagtgtcaatatatgtgaacttacataaccaaaaattgatttataaagataacaataataagggagacctaaaaatagagaaaagggtggtgtggactgtggagaaggtccctacttacagaacatagcttccatcaatcacacaaaaatccaaccactctgaacctttcacttcaggaccaacttcgttatccaatcatctcccaatatgccaatactttcacttatatatgaacgtgtatatataaacccttcacatttacttcacaaaaatatcttttaaaaaaagatcataatcacaactactaagctagaattttttagtaaatttactactacggtaattataaacaaattatataggtttcttaaatagtagaacttaaaatataatgcaaagttatgtacgaatactatcttttaattaaaaataacgataagaatgttaaaaaagaaaaaaaaaaaatcatgttgatgatatatatgttgaagtaaaatttagttattaggtttaggtatacgtcaatcattcatgatacatggatcccaaacccataatatatcatgcatcgatctctgaaaatcaccaaagcaaaaaaaacccatgtaacatgatatactatattatgcatcatttcgccaatgtaacttctctgatgccctgaacctatttcacatatgactcatgggaaagaccgacaaagggatcgtattacccaaatatggttacgataacatccactgaatatcactcaaaatgaattattgtctcttactagatatattacggctagttgatgatttgtttgaaaagtttaatcttacaaaattattaatagatttgatgctgctcaaagtggtctcttttatttgcaccgcaaaaagccagtatatatccccattagaaaagacgtgacaaagtgtttaatagatcctttatgttttcctcggacccatgcatatataagtgtatttaaatcttttataaggtttttatagccataaataaacaaatttagttcaaaataagaataattaagtaattggaatagcgagacacgttccttgagatgataacacgagcatatattcttcatcacttttgtttgcttcatatcatatacgctaacttatgtgtgtgtgtaatatatgatctcagaactaacaagtaagaagaagaagaatg

SEQ ID NO: 33660 - DNA, 3003 bp, Unknown; identical to SEQ ID NO: 33657
  misc_feature (1)..( 3003): 2750-1469P.txt file - cDNA_ID_3071426; gDNA_ID_2926215; Annot_ID_142192

SEQ ID NO: 33661 - DNA, 3003 bp, Unknown; identical to SEQ ID NO: 33657
  misc_feature (1)..( 3003): 2750-1469P.txt file - cDNA_ID_3071426; gDNA_ID_2926215; Annot_ID_202932

SEQ ID NO: 33662 - DNA, 3003 bp, Unknown; identical to SEQ ID NO: 19251
  misc_feature (1)..( 3003): 2750-1469P.txt file - cDNA_ID_3071430; gDNA_ID_1620652; Annot_ID_163502

SEQ ID NO: 33663 - DNA, 3003 bp, Unknown; identical to SEQ ID NO: 19251
  misc_feature (1)..( 3003): 2750-1469P.txt file - cDNA_ID_3071430; gDNA_ID_2926215; Annot_ID_202922

SEQ ID NO: 33664 - DNA, 3000 bp, Unknown; identical to SEQ ID NO: 3594
  misc_feature (1)..( 3000): 2750-1469P.txt file - cDNA_ID_3071434; gDNA_ID_1620652; Annot_ID_163498

SEQ ID NO: 33665 - DNA, 3000 bp, Unknown; identical to SEQ ID NO: 3594
  misc_feature (1)..( 3000): 2750-1469P.txt file - cDNA_ID_3071434; gDNA_ID_2926215; Annot_ID_202918

SEQ ID NO: 33666 - DNA, 3000 bp, Unknown; identical to SEQ ID NO: 3576
  misc_feature (1)..( 3000): 2750-1469P.txt file - cDNA_ID_3071442; gDNA_ID_1620652; Annot_ID_163493

SEQ ID NO: 33667 - DNA, 3003 bp, Unknown; identical to SEQ ID NO: 21092
  misc_feature (1)..( 3003): 2750-1469P.txt file - cDNA_ID_3071446; gDNA_ID_1620652; Annot_ID_163490

SEQ ID NO: 33668 - DNA, 3003 bp, Unknown; identical to SEQ ID NO: 21092
  misc_feature (1)..( 3003): 2750-1469P.txt file - cDNA_ID_3071446; gDNA_ID_2926215; Annot_ID_202910

SEQ ID NO: 33669 - DNA, 3003 bp, Unknown; identical to SEQ ID NO: 19269
  misc_feature (1)..( 3003): 2750-1469P.txt file - cDNA_ID_3071453; gDNA_ID_1620652; Annot_ID_163482

SEQ ID NO: 33670 - DNA, 3003 bp, Unknown; identical to SEQ ID NO: 19269
  misc_feature (1)..( 3003): 2750-1469P.txt file - cDNA_ID_3071453; gDNA_ID_2926215; Annot_ID_202903

SEQ ID NO: 33671 - DNA, 3000 bp, Unknown; identical to SEQ ID NO: 3486
  misc_feature (1)..( 3000): 2750-1469P.txt file - cDNA_ID_3071457; gDNA_ID_1620652; Annot_ID_163479

SEQ ID NO: 33672 - DNA, 3003 bp, Unknown; identical to SEQ ID NO: 19290
  misc_feature (1)..( 3003): 2750-1469P.txt file - cDNA_ID_3071473; gDNA_ID_1620653; Annot_ID_163550

SEQ ID NO: 33673 - DNA, 3003 bp, Unknown; identical to SEQ ID NO: 19292
  misc_feature (1)..( 3003): 2750-1469P.txt file - cDNA_ID_3071477; gDNA_ID_1620653; Annot_ID_163549

SEQ ID NO: 33674 - DNA, 3000 bp, Unknown; identical to SEQ ID NO: 19293
  misc_feature (1)..( 3000): 2750-1469P.txt file - cDNA_ID_3071477; gDNA_ID_2926185; Annot_ID_200577

SEQ ID NO: 33675 - DNA, 3003 bp, Unknown
  misc_feature (1)..( 3003): 2750-1469P.txt file - cDNA_ID_3071489; gDNA_ID_1620653; Annot_ID_163543
cggctaggaaaatgatagagtacattgaactcaacacgattggggtttcaaaggactcacagcttagagtagccaaggttcttaaggttgtgtcagacagttgtgggaatgtaacgggcaaatctttctttgaccatagttatgatgctatgtatgagaggtggaaactattgaaacaagcagcaaaggatactaaacgtttcagtgttcctgatttcgtctctcaacgttgcaatttctttggcagggtctttgagccacaaccaggtacgtataaagaaaaacaaaagtagaaatgattgtagaaccacttcttttgtttttcatttggtttggtgtgttttgtgcagcatttgcatggtttaagtgtgaagaagggatagtggattgtgagaagtttcttagagaggagaagaagattctaactaaaagtggaaagtacttcggagatgagctaagtaatgtgaggataagcatgttggatagagatactaactttaatattttccttcacaggattacatcttcctttaattcaactttgtaagtgcatatgcatgtgattatgatcgattgtcataacttgcaacaagtgttttgctccataaatattattggaaatttgaataatgtgaaggatcaatcaaagacctattcatcaaaccatctctgatgatatgaatgagcaaacattcattcactacgacacaaccgagagtttgttcaagcgttgtcagcattttggtctggaactttgtaatctcgaaggatcagatccaacatctcatagctttttcagtattaaattccagccttaggtaatccttcagagtcatatcaacatttttgctacggaaggatcattgtcgctaccttccattttacatttgtgtcagctttattcacagcaccgttttttagccgcatcaactttctttctttgtataattcagaagaatgaaatcatccaaaatcatttatatttcataacaaaaatgttttaaaaaagttgaacataaaaaaaaaaaaaaaaaattccaaaacaccaactaaactctcaaaaataccaaattgtgaaagttttcaaaatataatctcttgtcactcattcatcatactctaaaagtttaactttcatggtttgtatgtgaaaaaataaattaaaacattaaaataaagcttttagaaactaatatgtatccacaatatacatatggatgaggacaatggtggatgtgcacaaccacacaaaaaccattcacgtgattgtatctgcaaaattcatcatcaactttctcctgactacgccacatcatatttgtttgtggaactattccatcgtcaaacggccgttcgtcttttgtctttttccacaaatctactagctcccttctctatcaacttgatcgtctacataactctacttgtctttttccctattcacaaattagtctttttcttgagattagtaattattttgaggccaacttgatcagaatctgagtttgaattccaattatacccattcttgaatcttaattgcatgttatatttgtttccaaacctattcatatccttactcaaaacaccatgtttgttgttttcactttgtttgatgcatagctcataaaacatcagcgacacaatttcttcacacaaaaagataaaagggtttataaccaagatataagtttcaaaaccttcaccataagcaagaagcataacaacttcaacttgtatacatttttttctagttttgtactaactagatatagagacacaaaaagagagaaaacatgattaagagttggaattaatgataagttgtaaatatatctcacataaaacgtgtttgaattccattttaaggataaatgatagtacttcagatcttaaatgaatttgttgcaacttgcaccatgatttctttcaaaccaaaaaacaggtctagaccgggtggtccacagatttttggctcacaggaatattcctacatataacactacaactgtacaacatacatatagagcagtagatagtaaattataccgaataaaaaaatctagttacatttcaagtcacacgaactgttagaacggttcatgttaggctcagcatatttctaagtaataaattttgaaatcgaaaaggcttttctaagtatagccggactgaattactatatgagtcgtggacttaccggtccgacggtgaacaactattggttccgagaatggtatttctgcgttcagaattctgtgagtacggattaataatatatttatactgtcaattgtcaaagagccgatttccgatttaagaaactaatttgtttgataatgaacacaaacaagaaaccaaaattaaggccggatttatacccatgacacgttatctctacgtccaatgctcttgccatttgctgtgatccgtaagttcccaaagacactttttctttcaccacagtcccacttttgatctttttttttacagtaaagtcagaactcagaagtaccttgaacaaaaccctaaacgcacttttaatattaatcactctcaaaccaccatttaattattgtaaatcatatactccaatggaacatactttttttactgtacttttcatcaaactctaaaaaggttatggcttatgggtgttctttttggatgaaactatctatatatgaatattattctaaaacaaacaaaaaaaaacgtaaaaagttgagactcccttttattaagcggcagggtttgttgaccacactctcatcatctatctctttcttatcttcactgttttatcttttctttcggattaaattaaataattttttcctccataatttatactcttaactctcatgaattattggtctctctattatagttttttaagtaacaatctaattgtagtacggatgtctcttgagatgttcaagaattaagaaataaagaaagagggatcggagaatgaattttgaggatcaagaagaagatatg

SEQ ID NO: 33676 - DNA, 3000 bp, Unknown; identical to SEQ ID NO: 3603
  misc_feature (1)..( 3000): 2750-1469P.txt file - cDNA_ID_3071501; gDNA_ID_1620653; Annot_ID_163539

SEQ ID NO: 33677 - DNA, 3003 bp, Unknown; identical to SEQ ID NO: 19298
  misc_feature (1)..( 3003): 2750-1469P.txt file - cDNA_ID_3071501; gDNA_ID_2926186; Annot_ID_200612

SEQ ID NO: 33678 - DNA, 3000 bp, Unknown; identical to SEQ ID NO: 4062
  misc_feature (1)..( 3000): 2750-1469P.txt file - cDNA_ID_3071510; gDNA_ID_1620681; Annot_ID_164438

SEQ ID NO: 33679 - DNA, 3003 bp, Unknown
  misc_feature (1)..( 3003): 2750-1469P.txt file - cDNA_ID_3071510; gDNA_ID_1620653; Annot_ID_163526
gacaaaacacatatgttggtttagaaaaacttcaagttgcatttcttcttttagccaatcgcactatcttccgtgaaaaggtaaataatatatagctttatgacaatttcacaaaaatggttcgttagttttgacttagcattaagatttttttccagaaatctaagtattggtaaaataattctatatctactactaggtcaaaatacaattctatattatttaaaaaattgtaactgaggtaattgatcaaattaccaaaatgatgaaagagctagttaagaatttaacaatgtacaagttttagtgaaatggtcaaaactaaatatccattcttttggcccgttagcatcattaaaccaaccactcaatggagacatggaagatcaaaattcgtcaaccctagcgctttgtttctctacaaggatcaagtatggaacaacaacaaccacaagaaatcgaaatgtgctaaggtcgcatgagttcgctaggaataagtctataacatttcgttttgtcaacaaaataagattttagtatatatattatttacaattttaccagacttccattgtcaacaaatgacattattgttgttgtcgaagaaaaaacaaaggtgacactatttgctgttttactttttatttcatgaggacggaggacccatttttttaatttagtttaaaagagcaaccgtatcagttgattacggagtccagcagagaaaagcatgctcaactgtcaaaaacaacctaacaattagggaatcccgtaaaaccggcaaatcacgagggcagcattacattacattacattacatgtcccacaaatcactttccctcccatgcttttccacttccacctatcattaccaacacctattacctaaaggactttaagccagagagttttcaaatcccgtaccgtgattggtgcactatgaagtggaaaggaatacgatgaaaaacaaactgttttctcaatacattttcaccgacaccaatcatgaagcaaatagctgcaattaattttttctacgttttaagacaagaatatatattaaactacttattttcttctacatcttaattaagtagttagtattcttacaaacacttctgattatcatttttgtgttcaatatataaactcctttctatttaaaaaattccctcaacactataatatcattcagtccctatctaaaagttaggtgtccatagagatatacggatattgaaatttaaatgatatatggcggagatcatgcaaggacaattatcttcaatagaatcattacgacttattaaatgtgtgttcccgacattttattacatgattctactgttttctttctcatcatctcattccattatttgtttttctatttgtgtttctagattacttgacatgtacgttaaatcatttatcttccttttcccttgatatcccactcgaatgacatgttgctgtagtactattactatggttggaaatcttatttctctgaataataaaagtttatattcagataactgctatgatacgtaaactttccaatggttatttaattttgttttgcaattaatatatgcaactataagtaaagcctagtgaattctttggatcggagttatatgctatgtgctaataatacaaggaaccccgcaatattgatataaaatttaccaaactgtatcccacactttaaaagttgtcatcatactttatgtgaatgcaataggatccaaatcgtttggggaagattttacattttaaattcttatattccgcaagtgcccaatggtgccgcacgaattatttagtgtatcaaactattggtaggagcaattagtaaagcatatacagtgcaacaatctatttaaaagtatagaaatatctaactaaaacatattttgaagattccctcgtcctccaatcgtcttccatcatcgaaatatccctttgaagagctaagaaacttggtgggaacaaatgatgctattcgataattttcttcgattctatggtatatttggaaagattggaacataattaatatatatatcccacttgatgcataaagaatgttgtttaagaaacggagttctgaggtaactgactgacaagtgcttcgactcaaccattactacttaccaaatccacggctcttggcataccccatacacgcttagtggatatggttgaatcgctagttcccaccaccagcttctttatcttgacttaaaagagggcacgtcgatgtcttcctcccctacacgacaatgtagaacatgcatgttcaaacaatttgcaaatggaagatatattggaaatttgtgaaaggccatgaggtagatacacaattaaattcatgagttcataggtcagaacaaagctgaagcatgttctacatgcccaatcaagaaaaagtcaaacttttctcaatgccgactttactgttctaaaatgtatgaaaatacacattaatatacaattataaatacatgcaaatatatattgttataaactatataatggttacttgatatggatccttatacttaactaacttaacaccaactccctggatctataatgtatatattgggctaaacaggtcatgtggaagttatttgaaaagtacaccatatcgacctaattagattggaggctttttatttagttttttgtcaacaattagatttgagtaacggatgtaaccatattatttgttcctacctcctaggcattattatagtataaggtttttttttaactaaagatgatttaaaaaaaaaaaagtgggacctaaaccttaaaaattccaataacaaatagtatagaggtcctttttctctttatataaacccccaaaatttcctcttctctgtattctccactcaatacttatttcctctgtcttccttcgcttccctcttctctcaccacaatccgagagagagacagtactgtaatccaagtgagagagagagagaaatg

SEQ ID NO: 33680 - DNA, 3000 bp, Unknown; identical to SEQ ID NO: 4062
  misc_feature (1)..( 3000): 2750-1469P.txt file - cDNA_ID_3071510; gDNA_ID_2926186; Annot_ID_200623

SEQ ID NO: 33681 - DNA, 3000 bp, Unknown; identical to SEQ ID NO: 3639
  misc_feature (1)..( 3000): 2750-1469P.txt file - cDNA_ID_3071530; gDNA_ID_1620654; Annot_ID_163588

SEQ ID NO: 33682 - DNA, 3000 bp, Unknown; identical to SEQ ID NO: 3641
  misc_feature (1)..( 3000): 2750-1469P.txt file - cDNA_ID_3071544; gDNA_ID_1620654; Annot_ID_163575

SEQ ID NO: 33683 - DNA, 3003 bp, Unknown
  misc_feature (1)..( 3003): 2750-1469P.txt file - cDNA_ID_3071547; gDNA_ID_1620654; Annot_ID_163572
gctttaattgaaaaacggataatgcggtatgtcacttatcgttatgtaatttatttagatttaattttccgtataatgaggaataaaaagtccaaagagagtgtttggacagtgctacaagaaaacttcaaaccagaacaagacaattatagacatcgatcctcttccataatcaatgaaagcaatctataggtttttgatgcttttattcatttgtgcaaagggaagaagaaacctttcacatgattgatacaagctcatgcatatagaaacggtttacggttctgactacaaaaaccaaccaatcttgaaatgaataagttttggagaaagggcttgcattaaacaagatatacaacttaattggtttttatgctcaagcgtagcttcatctcacttggaatcaaattcgatcttcttagtatataacttaactcgattagtagcgattacttgaaaaatattagagaaacagattccagaagttatctccttcactcttcagattcgtaatgaatgtgattaagataacaaaagaaaagtaaacaaatggtagtatcaactaaaagctaccattaaattccattaaatagcttcacatgggatataactgatgctgaggtattagattttatggaaggtcaatggtagtatttgacattttgttatataattattttattttctgctaaaacaacatattcctagcttttttatattcttataatcttgtgaagcaaattcaaaaattaaagaggccactttcacaaatcatcccagtttaggctgttgtataattgccattaaagttttgaaaccctgttgcataactgtcgttaaattttttagtctataaatcattttaaatttgattgtcctcttaattgtgaaacatttaatacacgagagattcctaagttattaacagctatattatgtcctcgtgaggtctgtattttagttattggcctcttgtattaaattctagtaactgtttgtttcattttttttaatttgttactctttcgtttgctattcaaagttctaaaattcaaacgttatccctctagcttctcaaataatatatataggagattttatataattatgaaaattctacttcaaatgacggtttaaaacgcaagttacaaacgtctgtttaattgatcataataaacattttgagagtactaatcaataaatcatactcatatccagttactttccattgttcaaatgaaaatcaatggctatcttgatcgtaacaatttagaaaaatgaaagttatgcaaatatgtgaaacattaaaagtacagtaataaagtttattgtaccataacctttcgtccaaataatttcctgttttaaaataaaaagacaggaaattaaagtcaagtaatttaactaccatcattagattaatcaaaggaaatgttttttttaaaaacattaatggatatccttttattcttctaaattattgctaaacattttgtgataatttttacaatgactagtgaatctggtagttagaaacatcttaatggttttcacctttgaatatccaatttaactaccagcaagcactacttacatacatctatctacatctttcattcttttatattgtcaaaatttgtcaccaccaaaaacattgatttatattcaaaatttggaaagtaactcaaagtagttgagttttgtgggtaccttcagaatgtccatttgattatcaatcaaaaagaagtttttagctggcgcatgaaaccgtcgttggaaactttgaaacggatgcttcactgtataaacgtactattattatttaatttttaataacgaaaagtaaattgtagatgaattctttttatttgattcatttttagttagtgctagccattatttctatctttaactatattcaaaattgttttttcatactataaactattattagaccattttcttgaatgaaccatactttctagacactatttctaaaatgactataaatcacaccatgtagttctatatttgtattattgtagtttattgatttaacattgaaaatttaataaattatacaattaaaaaattaataggttttaatacgtgtaaaattataaaacaaaatttataatgaaacagagagaatagtaaaaacatttatgagaaaaatatgtattggtgtcactaaagttattttagacatattttcattcaagaaatcagttgaataatagtcttactgtgacaaacaatttaatagataaaacattgagtagtattaactaataaatgaatcaaacaaacaaagtctaattgataaaatacgccatataaataaactataagtttctttaaaatatacattaaatatacaaaacgacaaatttatgaaacaaaaaagtgaagtcataagattaaaactattgtgaaatggatgacaaattcagtttcttctttattctttaaaccctaagtttaaattctttcaaacacaaatcgtagtatttgtaaaactgttattttcttgaaatataatttaacgttacattaacaaatcaaatggatgacatattacttaaaatttagattaccaataaaaaatcataaattcttcttttaaattgtaagatttaagtcttcccctttacatttagcaataaatagtttgctgcactggtttaaatgcactaatgcattgtttactgaattgtcttttgtttcatatatttgtctctactatacttttactaactttcccacctccaattaaaaaaattattacgaaataaacaaagtcatatctctctccacaacataattactttattcaacaaatattaattcctagtcatattttagctcctcttcttccttatatattacatacatacattttctttagaagtcattaccatcaacccatcccctagaaaaacacagagaaaaacaaatacaagaatacaaaaaccctctcgacgaaaccgaagtatcgaaatg

SEQ ID NO: 33684 - DNA, 3000 bp, Unknown; identical to SEQ ID NO: 3647
  misc_feature (1)..( 3000): 2750-1469P.txt file - cDNA_ID_3071555; gDNA_ID_1620654; Annot_ID_163570

SEQ ID NO: 33685 - DNA, 3003 bp, Unknown; identical to SEQ ID NO: 28911
  misc_feature (1)..( 3003): 2750-1469P.txt file - cDNA_ID_3071577; gDNA_ID_1620655; Annot_ID_163638

SEQ ID NO: 33686 - DNA, 3003 bp, Unknown; identical to SEQ ID NO: 19310
  misc_feature (1)..( 3003): 2750-1469P.txt file - cDNA_ID_3071593; gDNA_ID_1620655; Annot_ID_163628

SEQ ID NO: 33687 - DNA, 3000 bp, Unknown; identical to SEQ ID NO: 19311
  misc_feature (1)..( 3000): 2750-1469P.txt file - cDNA_ID_3071593; gDNA_ID_2926209; Annot_ID_202463

SEQ ID NO: 33688 - DNA, 3000 bp, Unknown
  misc_feature (1)..( 3000): 2750-1469P.txt file - cDNA_ID_3071597; gDNA_ID_1620655; Annot_ID_163624
agcgtttcaatattttgacaaagatggaagcggtttcataacaattgatgagctacaacaagcgtgtgttgaacatggcatggctgatgttttccttgaagacatcatcaaagaagttgatcaaaacaatgtaagcttatatgatgatctgttccacattcctcgctaggctaatgtcgaggcatcagctgataaaaagtcttatcggttcttatgttggtctgaacaggatggaaagattgattatggtgagtttgtggagatgatgcaaaagggaaatgctggtgttggaagaaggacgatgagaaatagtctaaacattagcatgagagacgcgtagaggttgttttccccggtgtttaatatgttagtgcgatcgtgactgcgaaaatgttcttattcatggaatcaacaacctcaatgctcaccacctagaaggcgatgaaagaagaccaaaccggattcatacctgtggatggttcgagttttgtttaacgactgtgtgattaatcgtcaagtagttttggaggttttttctttacctctttgttgtttgttcattatggccattgttgaagttagtgagctttgttcatcatctgccattgttaaactttgttcacttgtatttgaaaaaaacaaaaatgtctttgtatgttgtgtgatttctaagcatttttactttgaaaatctatttcttcttttctagacgatcacgacccttcatccatatcggactacacaactcgatattgaataaatttatatgagaatagtaccaatggcctatgatgtggaagatgatgagctagcaagtctcaatcatgtaaatgaaagtgctttttctaagtaatctgtatttaaactcaaataaaaccaaaactcaaagctgttccaagcaaattattcattggccacaatctgtaatttggaacattatgcaccaaaaccatttttaatgtattttacatatacaggttttttggtacttctcctatacacatggcatattcatattaacaaaaaatatttattttggtgtcacttttcatattttattagtgtaaaataacctcttcttaagagtaacgtatggcaatttggtcagctttgttatttaaaaattatatgttaattagctaaaatacgatcatttgtacccaaattctcttaatttaaaactagtccgacttgaaagtaaaagtttagtttaaactataatcagaacaataaatatcaatacgccaccgacgatttgctgccaccgacaaatgttttgtcggccacacgcgtctcagttttatggaaccgaactctcgttaatactttgcttttttacataccatttttgttgaaaaccccacaaaatgggaaaataattcggtgaaatattttagatttttagttctacttgtatcatgaaattaagagttcttcgacatagattgttgttatcatcaattatcattatgatcattgtgtatatgaaactatacaacgaaattcagaatcataattagatagaagaatctcatgttgtttttcacattaaaaccaaaaaaaaaaaagaatctcatgttggcgcgtaaaagattaaaacgaaaataacggatttttctatataatttgcatggttattaaaatacaaaaatacaactgcacagccacaaactcgtaaccacaaataaaataaataaattgattaataataatctaggcaaattaattatagcaaaatacaacatcaagtttaaaaaaaaaaagacgaattatacattcattatactccattgcacaaaagtaaaaaaagaacagacaaatcacaaaatctcaaccttatatgaatcattttatcgttgacgcttgtatttgcaagaaagaggaagagaatcttctgaagaaggtcccatgaaattacggatctgagatcggagtttgaagaaaacgtgcattatacttcctctgttttgtgaaccaatcgatttagcttcgtctttgttaagctcaagatctctgatgaatataggttttcttgaaaggatccatgaccaaccccattcccaccattctttcacagagcttcctgcttgttctcccatggcggaaacagatttggatctcgggaatctagctgcgatcgctgctggttggtttgagaggttgagtgatagagaagagagacgacggcggatgagaccaggctcatcgtcggcggtggctgctgcattagggcgttgagaaacggggagggaagtgggtttacgaatctggagagtctccatcattgagctcataacttctttgttcttctttgtgttgagagagattgaagaagaagatgaatgtgaatgtgagagattgattagtgaacacagctctaacacaggctggggttttattccactttatttttgtggggtccatttacttttatgcccccagccaattacattcattttgttgttgctgtttgtttttgtattaaataatttgtattgttatgtttatttgttgatttgtatagttagttgttttgtgtatgaatgaatgcacctataatattggaaatataacaattttatttttagtgaatatagataaacattgttttcaggtagggttccatcacaagtcacaatacaaatttaattaaaaaaattctttgtaattttattttaaaggttattttcccagtacagaaatctgttgaaattgcattggctttgatttttttataataaaaatcagaaaaatgtagcagaatctgtccaatgtccatagccaagcaaatttatgttgacagaaaaaagaacaatcacatacaaaaatccaaaaaagaaaaaagatatcccagacgggcctaatcaggtattagactaaggcccaataaatttcaagcccaaaatcgaaattaagcactttattctttctttttttaatagctatcgagtgtgtatgttcggagaagagatcacagagatctgagagcttgaaacaatg

SEQ ID NO: 33689 - DNA, 3000 bp, Unknown; identical to SEQ ID NO: 3679
  misc_feature (1)..( 3000): 2750-1469P.txt file - cDNA_ID_3071613; gDNA_ID_1620656; Annot_ID_163680

SEQ ID NO: 33690 - DNA, 3003 bp, Unknown
  misc_feature (1)..( 3003): 2750-1469P.txt file - cDNA_ID_3071625; gDNA_ID_1620656; Annot_ID_163664
actcaaaccttagatcactactctccatctgtaatcaatcttcccaatttcgtttcttcttcgattttagtttctgtttctctttcgttattgaaattcaaaattcgctgcaaaatcctagttaccagttccagctgtttctaattttatttcaggatcatcgcaaattcagacagagatactatgaatatcttgaccatttacgagttcctgacggacctatctttctcatgatttgcggcgaaggaccttgcaatggaatcaccaataactatattagtgtaagatatttttccgtgaaacatatccatttgattgattaatttattctcataatctctgaaatttgcattggttttgtttgttaaacatgttcttcaggtgttggcaaagaagtttgatgcaggcattgtttcactcgagcatcgttactatggaaagagctcaccatttaagtcgttagccactaagaatctcaagtatctttcttccaaacaggccctttccgatttagctactttccgccaatattaccaggcaagtagtagtcttatactcttatggttattactttctctaggatcaaatgtttaagaagctgcgtttattagcatgttttgggatttgtttgtggatgcaggactctttgaatgttaagtttaatagaagcagcaatgttgagaatccgtggtttttctttggagtatcttattctggagctttaagtgcttggttccggcttaagttccctcatttgacctgtggaagcctcgctagttcagcagttgttcgtgctgtctacgaattccccgaatttgatcaacaggtattcgttacaatattcaactttaagtgaagaaatgttgtgtttcttcatatagagtttagttgctgacagaatcgagatttttataccttattgaatagatagctgagtcggctggaccggaatgtgaaactgcgctacaagagactaataaactcttggaactagggcttaaagtgaataacagggctgttaaagctctcttcaatgccacggaggtctagctttactgtttctgttttcttttgtttgaatcttaaggaagtaagaagtctatctccaatctgattaagtttctgaaatctgtagcttgatgttgatgctgatttcttatacttaatagcggatgcaggagttatggcggtaagcaggttcatttcatatttataaaattttcattttctttctagttttagatgtttatctggcagattcaatacggaaacccagataaactatgtgtaccactcgtggaagctcaaaagaatggtggtgatttagtggtaagttctttgtttttttagatcgctctttacttatgcttggtgtatatatattgacattcatcatatggtttgcaaacagaagaattgtatttggtgatacataacattggatgtgttaatgcaggaagcatatgctaaatatgttagagagttttgcatgggagttttcgggcaaagctctaaaacatatagccggaaacatctactagacactgcggtcaccctagagagtgcagataggctttggtggttccaagtttgtactgaagtggcttatttccaggtggcacctgcaaacgatagcatccggtctcatcagatcaatacagagtatgcacagacccaagcttatatatcatattcagaattctgattttgtcgtttctatttattgtcccatttacacttcttttcatttcataggtatcatttggatctatgcaagagcctctttgggaaaggtgtctaccctgaagtcgatgcaacaaacttgtactatggaagcgataaaattgctggtatgtaatatcggaaaacttctcgacgatccttttagacttgtgcacattccaacagtttcttcgcatcttcttattctcaattttgtagcgaccaagattatcttcacaaatgggtcacaggatccatggcgtcatgcatccaaacaaacctcatctcctgaccgtaagtcttcatttagtttgatcaaaatcgcatagcaataactcaggcatagcctatgtcgttatgtagcagtattcagacaaatcctttgtctgggacactaaaaagataatgtttgatgacacagtgccttcgtacatcatgacttgtcacaactgtgggcatggaagtgatcttcgaggatgcccccaatctgcaatggtcattgaaggtatattaccggcttcttctctgtttccgatgcctgaagtcaatgacaagcatcagaacaactgttaagaaaatatgatgtcccattcttttcctgtttttttcctcccatttgcaggtgatgcccagaattgcagttcaccagatgcagtgaacaaagtgaggcaacatatgataaaacacatcgacttgtggctctctgagtgtcgtggataggttaggtcgtgcagagattaggagttccatgcagagtcacacgaactgcgttctgcaaataaataaaacatcagatgtacgctccaaacttatatctgtgtaactgtaacctctgaaactgagtcacgtagcaagtccactcggtatctcgattttaagctttcatccactaaggcgaatacagtagcacgagatatggccactcgggaatggaggttcagattctatctcttaatcggtggtccatcttggcttctgcctctcattgttgaagacaatcgaccttgtgtcaagttttatctgttttgccctgttttaattgtttggttgttctgttactctgtttccatctttggttttaatttctacgacgacaaaaaaaaaaaaaaaaaaaaatttaaagtccgcgttataaaaaaaaaaatgatttttgttacaaattactaattagggaaacattattctaatcattatattgtccttgcaatttataagtaaaaacatttcttttctggtccactcgttttaacttccggcgatcgattttcacggcgagaaatg

SEQ ID NO: 33691 - DNA, 3000 bp, Unknown; identical to SEQ ID NO: 3678
  misc_feature (1)..( 3000): 2750-1469P.txt file - cDNA_ID_3071629; gDNA_ID_1620656; Annot_ID_47856

SEQ ID NO: 33692 - DNA, 3000 bp, Unknown; identical to SEQ ID NO: 3686
  misc_feature (1)..( 3000): 2750-1469P.txt file - cDNA_ID_3071629; gDNA_ID_1620656; Annot_ID_163662

SEQ ID NO: 33693 - skipped

SEQ ID NO: 33694 - DNA, 3000 bp, Unknown; identical to SEQ ID NO: 3686
  misc_feature (1)..( 3000): 2750-1469P.txt file - cDNA_ID_3071629; gDNA_ID_2926211; Annot_ID_202604

SEQ ID NO: 33695 - DNA, 3000 bp, Unknown; identical to SEQ ID NO: 3704
  misc_feature (1)..( 3000): 2750-1469P.txt file - cDNA_ID_3071649; gDNA_ID_1620658; Annot_ID_163714

SEQ ID NO: 33696 - DNA, 3000 bp, Unknown; identical to SEQ ID NO: 3704
  misc_feature (1)..( 3000): 2750-1469P.txt file - cDNA_ID_3071649; gDNA_ID_2926187; Annot_ID_200701

SEQ ID NO: 33697 - DNA, 3003 bp, Unknown
  misc_feature (1)..( 3003): 2750-1469P.txt file - cDNA_ID_3071653; gDNA_ID_1620658; Annot_ID_163711
cacttgactctgggaaagaacttgggatgccagatggagtcctcatcaatgggaagggtccttacaagtacaacagtagtgtacctgatggaattgattacttaacctttcatgttgaaccaggtatacttgtttggagtttctgagaggaatttttgttttcactttgtctcatgagacctatgaatcttctcatgtgacttttcttttcatcctttaacattttgtttgaatagttgcctgtgttgagtctccattctcagttagttgtcttgttctaagatactctttttccttactcactttgagctcttaacacatgagtaactgttgcatgtagttgaacatcttgtaaagatggtactttaaaaattcacatcttcagtctttagtataagattaagaagatttgtcgagattcagtgcaaattattacttttgtattatgctataatggtgttatattttgcagggaaaacatacagaatccgtgttcacaatgttgggatctcgacaagcttgaacttcaggattcagaaccacagtttgcttttggtagaaaccgagggtcactatacttcacaggcgaacttcactgattttgatgttcatgtaggacagtcttattctttcttggtaaccatggaccaagacgccacaagtgactactacattgttgccagtgctagatttgtgaatgaaacagtgtggcaaagagtcactggtgttgccattctccattattctaattccaaaggacctgtttctggtcctctaccagttcccaaaacagatgtttctagcccgtggtcagcaatgagccagccgaagaccatcaggtttgtttttaaacttttttggaacaagtgcatagaaatgttcccttcttgttgctacaactagatttttttccagtgaagctgactcttttgatttgcaggcaaaacacatctgccagtggagctcgtccaaatccgcagggatcatttcattatggtcaaataaacatcactaacacatacattttgagaagtttgcctccaacaataattaacggggcacttcgtgctacacttaacgggatctcatttgtgaatccaagcactccagtgaggcttgcggatcgcaataaagtgaaaggagcttataagctggacttccctgacagaccttttaatagacctcttcgtttggatagatctatgatcaacgcaacatacaagggctttatacaagttgttttccagaacaatgacaccaagatccagagcttccatgttgatggctattcatttttcgttgttgggtaagcgaaacctttgcaccttgtcatctattcttgttcattcttttaatatcctatcaaaagtctggtgttgatataccatgttatccaggatggactttggtatttggtcagaagacaaaaagggttcatataacaactgggatgccatctcaagaagcacaatcgaggttaatacaccgtagcatcactcaaaattattctgatctgcaggttttcttaatggttttcttgttatttaggtataccctgggggttggacggctgtactgatttcccttgataatgtcggagtttggaacattcgagtagagaatcttgacagatggtatcttggtgaagaaacttatatgcggatcacaaaccccgaggaggatggaaagacagagatggatcctcctgacaatgtcctatactgtggtgctcttaagaacttgcagaagtattcttcataaacttttctttcactctcttttgttatacctttcgattatgagaattttaacactcttcattgtgattgttgcagggaacaacaccactcagctgcaacatctatactaaatggacacttgaagctaatgctactaatggtgttgctcgcctcggtgttcagattttgctgagcatttttacatctttatgttgatcgacccagggaagtgaagttaaatgatttttagatttatttatcccaatggatgtgaaaaactcttggttctttcgttgttttaggccaaaatggtttagaatcttgtcaattgtaatggaaacgtctgattttgatttttctgttctttttgaatcatccacatccttcatgtttctcccatcttaaaccacattatattttcattgttggattctctctatctcgatatcattgttaaacttgccatctgttttttttttttttttaattcatatgaatctcatattcgtgtcactttgttctaaatttagaattttttgcacagcttaaattttttctttttgctgattagtattttaatgtttaaaagaaaatatgatttgtacatgagcaatttccagccattaaacacctatgtataaatcatccatcagagctgcatatcatcaattctctataatgtacatgatacgtcgacctgtctttcttaataattacagaaacattatgactaaataatatcttaaacaaaaaataagttgatgtttctccgaaataagagatctggtccacgttcatgttacatgcacatcataatatcacatcacgtgctaccttgcttaaacaccggaacgaaacttgtaataatcttcaaattttatttggacacaaaaaacttctaaatattgtttggtatataatttgagacgcctaggttttgtaaatattacaaacagataagcagacggtcgtttgatttgaaacgcccatgtttagcaaattatgacaatcttctaataattgtttacatgtcaaagcataatgattagagagaaacgagactaacatagagatgtggttagtgattgggagagaaatggaccaaacagaatgagatgtcacaaggtttccaataataaattaataatccaatgtgtctatatatacatatacacataaaccatagttcacaatttgctaaaagctagcattttctattctctctcaactccgaaagtacaaaaccccaaattaacaaaacatg

SEQ ID NO: 33698 - DNA, 3003 bp, Unknown; identical to SEQ ID NO: 33697
  misc_feature (1)..( 3003): 2750-1469P.txt file - cDNA_ID_3071653; gDNA_ID_2926187; Annot_ID_200698

SEQ ID NO: 33699 - DNA, 3003 bp, Unknown; identical to SEQ ID NO: 19377
  misc_feature (1)..( 3003): 2750-1469P.txt file - cDNA_ID_3071657; gDNA_ID_1620658; Annot_ID_163710

SEQ ID NO: 33700 - DNA, 3003 bp, Unknown; identical to SEQ ID NO: 19377
  misc_feature (1)..( 3003): 2750-1469P.txt file - cDNA_ID_3071657; gDNA_ID_2926187; Annot_ID_200697

SEQ ID NO: 33701 - DNA, 3003 bp, Unknown; identical to SEQ ID NO: 19379
  misc_feature (1)..( 3003): 2750-1469P.txt file - cDNA_ID_3071661; gDNA_ID_1620658; Annot_ID_163709

SEQ ID NO: 33702 - DNA, 3003 bp, Unknown; identical to SEQ ID NO: 19379
  misc_feature (1)..( 3003): 2750-1469P.txt file - cDNA_ID_3071661; gDNA_ID_2926187; Annot_ID_200696

SEQ ID NO: 33703 - DNA, 3003 bp, Unknown
  misc_feature (1)..( 3003): 2750-1469P.txt file - cDNA_ID_3071665; gDNA_ID_1620658; Annot_ID_163706
tgaagtacttcaaaactcctgccaccgctccaccgccaccgcttcttatcttggccttgcttacgggtgactcaggcggcgtcatgcacattgaagtcgtcggagctgagctggacagaggcgtcttcatagtcgaaagtcttccaggagacaacgcccacgccgatggtgagctggctcccggctttacccctctcgatgaagcgttactacgaggactaccacgcgtacgttgctccaagtaccgagcaaacgactctctgcttctaccgttgtttatctcttgagatcttgatgcgctgtttctcgccgggattatgttctcgccggatttagagtcggatgatccgatgggtctggaggatcttgttgtggactgtgatctggttatcatcactcgtttgcttgaattggaaggcgaagaggaagaagatgaagaagtagaagacgataacgaggcgtttaaggacactgggagagagattgaagagcttatagtccggctccggttattattgggcgatggaggacggagtctccgaccggtggttgccattttcttctttaatatatgacgacggttaactatatgactatatcatacaagacttatattcggtttcgtttctcgactcacttgcccctgtccttaagactcttatagtaaagctggaattatatggttcaaggaatcgtctagtctatatacactggtttgaacaattgtgatatataatatagttaggggtatattatatttaatctgttagataacggttggggtacttgaagatctgtaggagttgacagcacgtagaggcagaggtaagaacacttctgcatgtagtgtgtctacataataaaatatagagtgtattttttacacacaccaaaaagagagattataattaatgtattatgtcaaagcatatatgaaggtcagcttagctagagacacgtcttttgtttatctctcgactaaacaacatggcgttttaataaaatcaaaacttaaaaggtccaattcagaacggccccatagtatatagtctacgttgaataaataaacctcaagatagcgtcaaactctttagtctttacccaaaaatatttttttttaaataacgtcaaaactctaagtcttgacctcaacaccaatatatatttgccttctccaatatctgatttttttaattgtttatccgagtcttcttggtcttttcgaatgtttgcccgaaccagaccttcccacgttcggtggttggtggccgcctcggcctttggttgatttctgtccacattttggtccttttcattcatgtaccatgttctagggtcatttgacttgttgaccataaatctactaaaacaggcctaataccgatgggccgtagcccgttaataaacaagacaatttatatttgtttcacttagcttgggagccacggatctctagaaacatccagagaaatatcaatctccccacttctccagaacattcactcactgacaatatcccaccttcaacacttaactcctgtatatagtcctcccctgtctccagtttcgtcgcacacagttctcagataaatactaaactcactgttaaaactttctcaacaaagcttcctgtttctctacaaatggcatctgctctcgctcttaagagactcctatcatcctccatcgctccacgttcccgtagtgttcttcgtccagctgtttcctctcgcctcttcaacaccaacgccgttaggagctacgacgacgacggcgaaaatggagacggcgttgatttatatcgccgctctgttcctcgccgccgtggtgatttcttctcaggtaacaaaccaattgtttcgcttttcctccagatctatgtctctctgttgttaacgtagcgaaaatctagtaagaaaacaggtattagcttacactgagctcaaaatcttgacatgattgattgtgtctttgtgtagatgtgtttgatccgttttcgccgacgaggagcgttagtcaagtgctgaatctgatggaccagttcatggagaatcctctgttatcagctactcgtggcatgggagcttcaggagctcgtcgtggttgggatataaaagagaaagacgatgctctgtacctgagaatcgacatgcctgggctgagcagagaggatgtgaagctggctttggagcaggacactctggtgattagaggagaaggaaaaaacgaggaagatggtggcgaggaaggagagagcggtaatcggagattcacaagcaggattggattaccggataagatttacaagatcgatgagattaaggcggagatgaagaacggagtgttgaaagttgtgatcccgaagatgaaagaacaagagagaaatgatgttcgtcagatcgagatcaactaaaaacgtcgacgtttttttctgttctagttttgttgataggtctttgaataagaagtgtgtgtagtttggcacggtcgatgttgagtcatgtagtctctaaagactaaaaggttatatgtttctttcttgagacggtggttttttgtcttgcttaaaccaaaatttgcattccaaatcaaagcactaattaaataagttcctaatcgtgtattcttttagctaactcggtcggtttacatgcctttgtggttatgagactggagcttatggaacgtatttgggtttaaaattttctgtagactaggaactaggaagactttaagacgaattctgaggctgcgtaagttgtcgacggactggtctattaataacgcgtaaaagtgttaggcccgttcgagtagaatagcgcgttggacagcccaacttgaatgaatcgatcgacttttattaaaaaaacaaaagtagggcaaaaaacaaaaaacagaacctcgacattaacctaaacctaagagcaaagcaaatcgacggcgacgggaaaatagaaccgcagatctctgtctcctctctctctcgtaactgtttgttcgatg

SEQ ID NO: 33704 - DNA, 3003 bp, Unknown; identical to SEQ ID NO: 33703
  misc_feature (1)..( 3003): 2750-1469P.txt file - cDNA_ID_3071665; gDNA_ID_2926186; Annot_ID_200669

SEQ ID NO: 33705 - DNA, 686 bp, Unknown
  misc_feature (1)..( 686): 2750-1469P.txt file - cDNA_ID_3071665; gDNA_ID_2926187; Annot_ID_200693
attaaggcggagatgaagaacggagtgttgaaagttgtgatcccgaagatgaaagaacaagagagaaatgatgttcgtcagatcgagatcaactaaaaacgtcgacgtttttttctgttctagttttgttgataggtctttgaataagaagtgtgtgtagtttggcacggtcgatgttgagtcatgtagtctctaaagactaaaaggttatatgtttctttcttgagacggtggttttttgtcttgcttaaaccaaaatttgcattccaaatcaaagcactaattaaataagttcctaatcgtgtattcttttagctaactcggtcggtttacatgcctttgtggttatgagactggagcttatggaacgtatttgggtttaaaattttctgtagactaggaactaggaagactttaagacgaattctgaggctgcgtaagttgtcgacggactggtctattaataacgcgtaaaagtgttaggcccgttcgagtagaatagcgcgttggacagcccaacttgaatgaatcgatcgacttttattaaaaaaacaaaagtagggcaaaaaacaaaaaacagaacctcgacattaacctaaacctaagagcaaagcaaatcgacggcgacgggaaaatagaaccgcagatctctgtctcctctctctctcgtaactgtttgttcgatg

SEQ ID NO: 33706 - DNA, 3000 bp, Unknown; identical to SEQ ID NO: 3711
  misc_feature (1)..( 3000): 2750-1469P.txt file - cDNA_ID_3071668; gDNA_ID_1620658; Annot_ID_163703

SEQ ID NO: 33707 - DNA, 3000 bp, Unknown; identical to SEQ ID NO: 3711
  misc_feature (1)..( 3000): 2750-1469P.txt file - cDNA_ID_3071668; gDNA_ID_2926186; Annot_ID_200666

SEQ ID NO: 33708 - DNA, 85 bp, Unknown; identical to SEQ ID NO: 3724
  misc_feature (1)..( 85): 2750-1469P.txt file - cDNA_ID_3071685; gDNA_ID_1620659; Annot_ID_163766

SEQ ID NO: 33709 - DNA, 3000 bp, Unknown
  misc_feature (1)..( 3000): 2750-1469P.txt file - cDNA_ID_3071689; gDNA_ID_2926149; Annot_ID_197926
ttccatctagactcgtctgattgtccagcaaagatcagatcatgaatgtcttgttcttttactctcctacttgtatggtttcttttccatctcttaaaactcgttttcgacagaaagcttgtttatgtataatggagatataccttgtatgtcagacagaaaagtttgagcgttgcgtaaagatgttcagctcaaagttaaaaagaagaatacaatagcttaagagttggtacttttttttgcttgcatgtgtcctttaatgtcaatttcatgttttcagagttatctaagtgtggttgtttttcttgttgccatggaacaggacaagacaagactgctcttcttttccttttttttttccccctgaaacattattaaaccttagatcttattattggggtggatgtttgcctgcatctcctctccagctctacgagataattgagtatgatttgggttgctttaaaatgtaatttttttatcctttttactaggcttggctgttgtttctctatgctgggttagctatgctagagaacatattaagagctaaggggagcaatattcgtccatggtactcttatatgtttcctcatcgttcgattatgactgttatgatctcttaagtttttctttgctcgtgttgtcaagttctttgaatttggagtgttctttgtgtctcatgcgtcgctagtgaaggccatagaatgttatttcattgtatgtgtgtatctcagagtgatgcgtcatgctatatgttgaacgtctgtcctatgctcgaccaagcacatctgtagttttatggaagtcataggacgtacctaagtctagagaatattgggtttctaagtgttgtgtcatgttactgtgtggatcttgagttctatatccacaacgcacatgctttgcagttagcaaatgatgactattgaatgttgtaaaatatcaaatgcatcatcatgtggcatggtgattggcaaacatttggatttttccctctaaagggtctctttcattttggcatagaagcatacacatagagaactttagcatacacatatatggttttgtcaagtatttcatgattaggattagagaactttagcttccacggagtcctcaatggttgggggtgtttagtattgttattattatgcagtggatatctctatatatgtattcatgtagtggtgtttcgtttggcttatctcatctgttgggagtgaattaaactctgaacttgatttggttttgcaggtggctatatcatcactattgtgccatggctctggcccttgtcagcctcacttgggaaagcaaaggtcaaccaaactgtgtccagaaacaggtaatgatcagagttatttcttttttgtgcagattaaaagttcacatagtaaatgccatgatgaagttcaatcctcgacagagaggagtccatcttttcctacaatgggctatgatgcaagaggtgtcgccatgcttctataaaacagatatcaacgccaaagattatacactcgcattgcactaggaaaggtgccttattatgtgcaattctattcttcggtccaaacttgtattcgcttttgtaaaatagctctaaagtgtgccttgtggttaaaattcaggctaagagaatgtatgttgtatggggagaaacagctggcgttggcggacaactatggctcttatgtatgctattcatattacaggtgagcttttttttttgtgtaaatatatgaatcaagtttatgcttaaacattttaaagcgtttaatgtcttccttctttttaacaactgtgaacatttctatgtatatatttgaaagtcaatatatttaatagattatctgatgtaatgagatctcttagatggcttgtatagtagaacctctttgctttttccacaatagtcttgaggttttctgtttaacttattgggcttaacaatttgttgctaaaactcaggtgtttgaagcatacgttggactgctgttgctaagaaaaacagtaactggagttgttaatgaatggcaggtatattattttcactcttttggcattgttttcaacgggtttattcccggtataggccgacaaatcctaattcaatagtgaacagagactaaaaaataggaagtaaagtaaaataaatgttgtcgcttttcaaatgatggtttgtggcattcttctggtagtgatggctgttgggaacttcataaacacaataggaacactgatgatcacaggtctcatttgttaaaatcacttttcttttcttttttttgcaattcataaatttttgttttcgtaggccacaaaattcacatcctgtgattaaaaagaaactatgtgttatgagccaatgttttagccttagctcttgttaagggacccgttgctaaagcttaagaacaagagattgaaagataagcttcctcttaaccctaagctctcttggagattaaggttaattcttggaagttaattttattcattgtttgagtctccttttatagagaaacccttacaaccgactctaagcataattatgttaaaataccaaatctaaaaaggaaaacataggaaacaattttaagaaggatctcgagtctttggtttccttctctgatatgtaattccatatcttgtatcactatgaacatcttgaagatgatagtgttaaaaaataagacagtattcttaaaagacaagaaagacagtattcctaaacctttttttcccttaatttttttattcagcagaatcatagagtttccaaaaatcttccgcagttcttgaggcggttttgatttacccttatgattccggttcagaggcggaaaaattgagaatttactgaaatagtctcattacataacaatccagagctttctagggtttgtctcctgttcttctgtgttttttttcttgtttggttggcttgagacaaatcctaagtatttattgtgttttcttgatttttgtaaagatatg

SEQ ID NO: 33710 - DNA, 3000 bp, Unknown; identical to SEQ ID NO: 33709
  misc_feature (1)..( 3000): 2750-1469P.txt file - cDNA_ID_3071689; gDNA_ID_1620659; Annot_ID_163765

SEQ ID NO: 33711 - DNA, 3003 bp, Unknown
  misc_feature (1)..( 3003): 2750-1469P.txt file - cDNA_ID_3071695; gDNA_ID_2926149; Annot_ID_197909
actctccctttgaatttctgcgcttttcgacagtcgaaaaactttgtttagataactccaaaacacacacaatcatgtcgaatttgatcccttacctttgtgtagtatctgcaacctttctctccatcagtaacaataagcagcttaagcttatcatgcataagagacaaaacaacatcatccttctccgcatctccacgcgttagaaacgttacctcatcatcgcttacctacacatcacgaaactcgaacactaagatcatcgaaaacacgagtccggttgttacaacaaaaacaaacataccttgataatatcagcctcattccaaatacttttgatgccttctatagcagcttcagtagaaggccaaagaggcaaccgaacgttcgggtcataagagagtaagactcccgcatctttagcggttttcatcgcagccatgtgagctgttctacatggctcagagatcaagctaatggaaccatagtggaaaatcttagctttcttgataagatccttgttgagttcagattctttcaagagcatgtccgcactagggttcctgtaaaacataaactctctctcaccatctttcttcaaagtcacaaaggccaacgcggttcttgcattggtatcaaagcaaacaccttcactgttcacaccgttcttcttcaatatgttaaccaacatgtgtccaaactcatcatcaccaaactataaaagacattacacaatcacatatcacttttcaccatcagttaatagattctaacataaattatacaaaccttgccgatgaaagctgatttgccaccgagtttggtgatggcacaagcaacattagcaggagcaccaccaggggctttgagaaaaccggtggactcagctaaagaaacaccagaagtgtcagggacaaagtcgataagcatttcaccaaaggaaactatcaatggagtattagccatctttactcagacaagaaatgttcacacacataaaccaaacaaaattaacctctctttattaagctggagaattagcaacagaactgcatgaaaaatgggataagcatttaacaaaatccctaacttgtagtaaaaactcagtacaaacttttgactgtaacaaacctccaatttagggtcctaattatatcaacagaaataaatctttgtcacacacaacgtaccaaattctctgtatttatattcaaagtttaagtctttcttacttagttgcagtaactgaaaaatccgatttgaacaaatcttatgaaaagagattaatcattagttcaagactcaagagtcactttacagagcaaattctatacatttttaacctttttaagggttttaaaccctaaaagagacattatcaaaactctatgattagggttttcaaatccctccattgtccattaactaggaccccaacagctcaagtacatgactgtcctcagcgattcttcagcttgcttggtcttgttggtataatcgattgatgaggaagagagcttcttagcttgcgacacggatcttaagttgttgcgtagatactgattcgcagatcggatcacgtagttccaacgacacacgcctagttggtctttcaatgcctcaacggctccgatgcttgcagcaaccatccacgttttgcttgcagagctcatttctctttgtttctttcttgtttaagtgatttggtttcgattttgtgtttgttgatgatgaatgagaagtgaatcaaagtgggttttgtttataaaagaagagaaagcagacaaaaagtgccgtgcctttggagtttgaaagtgcagacaaaaagtgggttttgtagctgctggttttcttggtttctgctgaaactatgaatgtttagttcaatgacgattttgcccatgtttagttcatcgacttgagctgctttttttttttttaaataataatatagatcctaatttttgtgtatactagaatgatctgtatattaaatctataaaaattttaaaaattaatgtactacttgaaacgaaatttattatttataaaatgactgattaaaggataaaataaaacaaatctctatattcttttttacaatctcttttttttagtaaaatgttaaattttatatcattttaaatttttgacagaagttataaagagaactgagaacggattaaagcaatttacagaaaagtaaaataatattactactctaattgtatacgattgctcaagagcgcataccagtaaatcgcaaagaaaaacaccaattccaaatctactaaactcggaaatttgtgtggttgtcacagaaccaacattctaaaattctcattctaattgttatgagcggaaatatgtttactaatttagcggaaatatttgatgatactagttttacttttgattttttgaatactcatgttaaatggtattcatcttctgtatgaaagaaagaaaaaaaaaaaaagtaagtcatcgcaaaaccatttttcttttgattgaatttttatttatttatttacattttgtgtttaatatattttttacttttttggtcggcaaatgatttttgatattatattattattcatctccaacatgcattattctacaaggagataaagaaaacatttactatatttcaaaacttggacacaacacgaaacccaaacaagtgaacaatctcaaaaccaggtgcacatgatagcggcactcgttaatccaggaactaccagaatcccaatattaccccttatccaattcgttcttaaaaggctaacaacgtcattttactatccagacagtagtaaacaaccaaaaccaacggccacagcttctagttttaactccaactacacggcaatattgttggcttcttctctcttacataaacacaccaattcacttcactttctaaacatcatcaacaaaaacaattctcaatacacaaaacacaaaacacaaagaagtttaattctctgaagaaagatg

SEQ ID NO: 33712 - DNA, 3000 bp, Unknown; identical to SEQ ID NO: 8139
  misc_feature (1)..( 3000): 2750-1469P.txt file - cDNA_ID_3071695; gDNA_ID_1621195; Annot_ID_174704

SEQ ID NO: 33713 - DNA, 3003 bp, Unknown; identical to SEQ ID NO: 33711
  misc_feature (1)..( 3003): 2750-1469P.txt file - cDNA_ID_3071695; gDNA_ID_1620659; Annot_ID_163742

SEQ ID NO: 33714 - DNA, 3003 bp, Unknown
  misc_feature (1)..( 3003): 2750-1469P.txt file - cDNA_ID_3071698; gDNA_ID_2926148; Annot_ID_197891
ttatatcacgacttcaactcacggctgttcatatatactaatgtaagcatgctggatctcgttttaatattttaataccatatatatgaattatacatgattgacaaatcaatgatttatactcaaaatgttatatggttggattcagtcaggaggacatgggtgttataatcccttatgtccggtcggatccggaataatactagtcagtcatgaagttactcctggtttacttaccaagcacaacgatttcgaactctccataattaaggtcagtttttttccaaaaactattaaagacataactctgtgtgttttaggtatttttaagtatagtatggatatgtagtgttagtgtttttttggtgagatctagtgttagggtacttgtattccattcaatatatatatcttactttttactttttcatattagatattgcaaaaacatttgcataaaaataattaaacattgataaaaatagttattaaaattaattgtaagctttttgtctataatctttgccttttctatatggattttttttttttttttgaaatccatgaggttctgggccgaaacccataatcttctcagacccaaagccaaatcatttaacattagtttcgtcccaaacgtcactcgaatcggcgacctctaagtttcgcctagggtctttaccaattgagctaacgatacttggttttctatatggattttgttgagtacaggacaaaatatacgggcattggtggcttttgatgggtaacagtagcagctcaacttggaaagaaattgggttctggccaacacataggttcaaagaaagttttggtacaggtgtcgaatggggtggtgaagtctatagccctgcgtctacaagtcctcctatgggtaatagtcattttccgaaggggagccccaaaatagactcatatgtccgtttgatcacgacttgggacgaaaattatggtttggacatggttgtgaaaaacacagagagattttcaaacagttgttataaagtgaaagatgcacagagtcgttttggccagatgtaggtcatcttatcgtttatggaggccccaggtgtacataaactttgttagtgcgtagcattattccaaaattgtagtatctgaaaatgttcaaaataaatcaagagaattacgttcttactatgaataaaaatatataagaaaaacgtaaagaaatttaaagaacatctttatattctttttttgttatcttgtttgacttggttagaaaggagaagacaaaagaactatttatatgttccaaattttaaaaacatcttacttattacatcatatatcattagaaaattccactacattaccttaaagatatataatattttctatagagatatagttctagacaaactttacttggtgtgttaacactcttaagtttttctagaacttagacttagttaattttgagtttggtccaataattaaactcttgatcatgatcccgtgattaaacttaacccaaagtcaagtttgatctcactaccggattatttgaggtgaatcaaaatataacaatataccatgtaattggtaggcaaaataaccaaaatttgaaaaatcaatccgaaccgaaataaatggttttatttggttatggttttttcttaaaactcatttggttatcatttttcttaagtttttggtttaggtttggtttggttaaaaaccaaatgatttttttttgtttttgattaaaattaagaataaccatatatactaatatattgtccaatttatattatgattagagtatcattggattttttctttactagacttatatacagtgatctcttagtaatatctgattattcttatattatttttattctacgtttcattttatttatgcatcaaacttatactttttttttgtaaaatacatggaataaccttaaaacccgtacccaaaccaaaaccaaaccaaaccaagatacatatagttttttatatgatttcaatttttacaaaactgaaaacccgtcataaattgtaaaaccgaaccataaccaaacttaattacatacggtttctttatggtttcaagttttttgtaaaaccaaaaaaaacaaactgaaactaaactgaaaaactgcacgcccaccctaatactatatttaaaaataaatctcaattaaaatcaaaaattaaagaaattaaagaaacaaaatacttatgattttaaggaaaatctaagaataattatttttatttattattttcatttgtcattctgaataatcacacaattagttttatacaaacattgattatgtcacatcattttatttatagtacatttttcttattttaatttatttataaatataatttatacaataggattataaatgcaagagaaaaaaatactatcttcaatttacacatagaaatgtattacaaatacttaaaataaatttcttattttcagattttttttagaggaaaagttacaaatattatgccaagcttgtgttaagaagttagcattaaagatatgaataaatgtcatcaatatatcgatgtaaatttaagaagaaattatgtttgacttgtatggtccacaaataattatgtcatctttgacttgtgcatggtcaaaaataacaataaatctcttaaaagcattcatggaaattagtaattacttagtttaagaagaaattttgtttgacttctgtatggttcaaagatatatatactatatttaggtttgaaggaatttaaggaaacgtatatgtattaattattttttctaacccttagctaggtgtatattctactctagtgaatcattcagaaatattacatttcttgtgagaaggtgattatcccaaatgacttcttcaaatctttctcctattactatatctcaataataactgtatatatagaagaaaaactaattatcaaatttctctagttcacaggttaatgaaaatg

SEQ ID NO: 33715 - DNA, 3003 bp, Unknown; identical to SEQ ID NO: 33714
  misc_feature (1)..( 3003): 2750-1469P.txt file - cDNA_ID_3071698; gDNA_ID_1620659; Annot_ID_163735

SEQ ID NO: 33716 - DNA, 3000 bp, Unknown; identical to SEQ ID NO: 4391
  misc_feature (1)..( 3000): 2750-1469P.txt file - cDNA_ID_3071717; gDNA_ID_1620703; Annot_ID_165138

SEQ ID NO: 33717 - DNA, 2933 bp, Unknown; identical to SEQ ID NO: 3739
  misc_feature (1)..( 2933): 2750-1469P.txt file - cDNA_ID_3071717; gDNA_ID_1620660; Annot_ID_163801

SEQ ID NO: 33718 - DNA, 3000 bp, Unknown; identical to SEQ ID NO: 4391
  misc_feature (1)..( 3000): 2750-1469P.txt file - cDNA_ID_3071717; gDNA_ID_2926174; Annot_ID_199719

SEQ ID NO: 33719 - DNA, 3000 bp, Unknown; identical to SEQ ID NO: 3749
  misc_feature (1)..( 3000): 2750-1469P.txt file - cDNA_ID_3071720; gDNA_ID_1620660; Annot_ID_163800

SEQ ID NO: 33720 - DNA, 3000 bp, Unknown; identical to SEQ ID NO: 3749
  misc_feature (1)..( 3000): 2750-1469P.txt file - cDNA_ID_3071720; gDNA_ID_2926174; Annot_ID_199718

SEQ ID NO: 33721 - DNA, 3003 bp, Unknown
  misc_feature (1)..( 3003): 2750-1469P.txt file - cDNA_ID_3071730; gDNA_ID_1620660; Annot_ID_163792
tctcgcggcggctctagggttcttccgcttaactcgagattttgcaaacactttctttatgggtattgttatattcaccgaattgttgcatatctgtttctgattttgtgtaatatttcctggattttttttttgaaactctgttattttgtctgttgcttctttgattgtttatgtagaggaagaaactctttcaacgacatggactgtaataaggaagaagccaaaaaagcaatggatattgccgagaagaaactttcgaagaatgattacgatggagctaaaacattcatcagcaaggctcaggctttgtatccaaagctcgatggtttggaacaagtggtgatgatgatcgatgtttatatctctgcatcaaacaaaatcaacggagaagctgattggtatgggattctcggtatagatcctttagctgatgaggaagcagtgaagaaacaatacaagaagttggctcttttgcttcatccagacaagaacaggtttaatggcgcggaaggcgcgtttaagcttgtgcgacacgctagggatttattatctgaccagccttgcctaatttacaatgtgtattgcacttattgtttttgcacactgtccaaaaggtaatgtcttcctcctgtttccgtggtttcttctctttccatgaagaatcaggttcagggtcagactcagactcagaagagtcagaatcacactcgtacgcgtacttgtgtggcttacgatcataagagaaaaccaaaacaagttaaacggaagaggagcagaacgcaggatccaccaaagccacacaagtacaaatataagtacgagttccggaaaaggaacagaatgcataagccacacgagtacgcttacgagtatacttctgactcttctgagtctgaccctgaacctgattcttcatggaaacagaagaaaccacgaaaacaggaggaagacattaccttttggacagtgtgcaaaaacaataagtgcaatacacattgtaaattaggcaaggctggttatcttaacaagaccttgcattgtccaaactgccgtcaagaattcgttgcgacagaggtaattccagagatgaaatatgggaggccagtctacagctttaatgctaaatttcaaccaacaagcaaaagcacaagtgatgcttcttcttcttctacaacttcaacatctgataccgcaaatgaagcacaagatagagagtcgtcacaagaagagtttgttcctgctaatgcttcacctgctgctagaggagatgcaaacgaagcatagaggctttttaacaaggtgatgacaacaagaaatgcaaactctactctcgaagcatagaggcttttcaagtaacctatgacaaatgcgaaaataataagtaagacatgaggacttagcactctatatctctattttttattttgtgtgtcattgatagttttattttattttgatcttatgaaacttggatttacagtaatggagacacttctctttgctataaaggtaagagactgatacatcattcttttttaatttcttttcttagcttgaaaacttctaataatgatttggatcaataggtttttgaacagctaatatcattggcatcggtattggatcaatagtactacactgcactatttaaagtaaaagcattgatgttggttaaaggtgttgtctatgtgctgtgcaattgaaagtagagtaaaggcttagattttgattttgaccgtgtgcaatagctgccagacatgttttgaatatgcaaggatattttatctttaacaagaccttgccgtgtcaaaactgcgggcaagatttcgtttcgaccgagatcactccagagatggtcaatgggaggcaagacatcagactcagtactaattttcagtttacaagaaaaagagaaagtgatgcttcttctacaacttcagcatctgatagggcataggctgaaaaacaagcacaagaaacaataaaaaacatagtttgaggagtcacgaaaaaagcttgatgctgctattgctgctgctagaggaaatgcaaactctgctacatttggagaagagagactttccaagaaaccgatgaaaaactctactttcgaagaagaaaggtttatgagaactcaaaagttagtaaaacaaaagacaaatggtttatgagaagaactgaaactactaaaagaatgacgaaagtcagagagagggaaaagagaaaagaaggcgggaaagggagagaggaaaataactactacactaatagtttcccttttccgtccctaaagtctaaaattatttttatgtttgccccaattgtttttaacaaactcgaaaataacccttttgtttctagtcaaaaattacaatttttacacactggatccttcttctttaatttttcgcttctccaccgtttagggcattctgttattcaatcgcacaatgttgcttggttaagaagtgggtctccatcaaaaactgggcttttacacttattggtaagatgattttgctttgcacaagaatcccaaaagtttcttccttctatgggttttgtgtagtgtcggaatcttcaaatctattttgtaattcgtacgattactttgttgctttatatacagtaacttgagaaatctagggcttgttcttttgacttggtgatttgcatgtatggttttgcctataattaagatgttacttactagtttacacgagattcttctttttatgaattgtttttatccattcttcgattgttgtttgtgaaattgtgattgattatgtgtaattatgtagtggctttggatagagtaacttcagattcagagatctgtggctaaggacttgtttttctaacttagtgattttcatttacggttttgcttctgtttttcatccttcttaatcctttttcttttggctcctccaattggttttccatagagacaaggtgcaaaatcgtttgaaggattctttgttcaacaaagatatg

SEQ ID NO: 33722 - DNA, 3003 bp, Unknown; identical to SEQ ID NO: 19398
  misc_feature (1)..( 3003): 2750-1469P.txt file - cDNA_ID_3071742; gDNA_ID_1620660; Annot_ID_163786

SEQ ID NO: 33723 - DNA, 3003 bp, Unknown; identical to SEQ ID NO: 19398
  misc_feature (1)..( 3003): 2750-1469P.txt file - cDNA_ID_3071742; gDNA_ID_2926174; Annot_ID_199707

SEQ ID NO: 33724 - DNA, 3003 bp, Unknown; identical to SEQ ID NO: 19402
  misc_feature (1)..( 3003): 2750-1469P.txt file - cDNA_ID_3071750; gDNA_ID_1620660; Annot_ID_163782

SEQ ID NO: 33725 - DNA, 67 bp, Unknown; identical to SEQ ID NO: 4545
  misc_feature (1)..( 67): 2750-1469P.txt file - cDNA_ID_3071783; gDNA_ID_1620713; Annot_ID_165515

SEQ ID NO: 33726 - DNA, 3003 bp, Unknown
  misc_feature (1)..( 3003): 2750-1469P.txt file - cDNA_ID_3071783; gDNA_ID_1620662; Annot_ID_163843
aattaagcacgataacatattgcaccaattggctaaatctgataattaaaactgacttcaagcaaactccaaaaccaatgaccagaaaagtctctcctcaatctgaatgagcttaaactccttcctttatgtcaaacctaccaccccattaaagtttaactcctcctccaaatatcctccttaaactcaactagatggttttgactcgctattttgagccagggttatacagtcatcaatctgatgagcatccatcatccaggaagggaattactatgtttgaaacacgggtttgaaacacaagtatacaaacccgtgtttccttccatagacacaccctatgataagcagcttagaagcttctcctagtagcagaaataatcgaagaccataaaaagagcccatgttaacaaacagatcagagaattatctgtagcaatctagaccttgattgattcgtattagtcatccttccaccattataaggtctaccacgcggagtagcagaagcggctttacgagcaacggttgttgttacaggaaactggtttccttggaaattagacctcttcttagcaaaagcaccctgaaaatatgatataaatcacaacaccacaaaagaaaaaatcttctaagtgacaggaaaatgaagcttagacaacaaattcaccgagaacacaacaacactaacctgtctaacatcagaccgagagtccatataacgctgtgctttcaccgcactattcttcgcagcaccactaaatttctcctttttattctgctcaaacacaatatgccaaatgttcaataaagaatcaaagagagacataaaaatgtaagctttaacaaaccaagttactaaccaatactctctgtttcttgcccttattcacattggtattgctcttttccatcttgataatctcatctatacccacatacaaatgatcatgaagctataaactaaacaaaggatacatctttatatgagtaaataaattaaacataaacacacctaaagacatgtccattttcttctcagtgagagcaacagtctccgtagtaatcggtttctcagtcgccatctacatagaagtggacacaatttaaaccaaagatttcacaaaatcaaatacataaaccctaaaaatcattagttaaggttcaacgaattttgagtttattgaacttatgagaagcaaggagatacaaaagagataaagcaaaccctagtttttgaagattgatctgattcaagaatcgatcaaacaaaaccctcaattaaattgactcgtgtgaagaatggaggagaagctttaagagatgaaatcgtttaccgattttagaaagtcgattgtctcactgagacaaaaaaagagaggctttttatttttaatccgataacgagttaaaccaaagtgaactgagtcaaaacgtttccgatcatgtatacgtggcacattttcattggaagagatgattggttgttttgcatttttttttttcttgttctctcccttgaagttgaagagtttaacttcgctaagaggaacagagatggacttgagtttaatatgttctctgtttctaacaaatgtttttttttttgagttttcacatacaataaaaaatattaaaagttaattataatttataaatgcattattatttgtaatttacgatttaccattttctataaccttaattaatatagtatacaattatttttcttgaaatttataattcatcaataataactaataactattgcattggaaccaatttttttcctaaatatattatttaggaatagaggagtagttgtttttggcaaaatggtagattattataaatctaaagtggtagcagttaaatttgaaaaagatggatggcatagtaactaaaaattatttaccacaataccttaaaaaactatgaagaattgattaattaactaacagactaattaaaacccatatttgtcctttgaaattataattttaaataattttacgaaacctatttaagattacataatattttttttataaacaataacaccttttaaaattattaaaacttattcactatccagtttcctagtttttatatattttgaagcaataatgttgtgcttaaaatatatgacatcatagtgacaaaagagtttatttgtgaaatctcaatcactcattttgaaatgccattaatccgtttagtttccatattattaccaaagcctttcatgtaattggaaacttttgtgtttaagacttaatcttgtgttgcaggagccaaaagaaaaagaaaaaaacaaaaacaaagaaattgtaaagaagtgtaactagaaaaatcgatcactcatcttcaaatgtcattatccatcaagttgtcatattattgctagacagaagtggtcgtctagacttagttgacctgaaaaaagaatagtcaaagtcttttatatgtggacctgaaattagactttgtagtttgtacgtaagtttgtgttgctagagcctatatgagaaaaaaaaaacagtggatattggtgattggtttaatctggttaactccggttatctagatactggtttaatatcatttatcttgtgtatatataaactaaactttagtttattttgttgatgaacgttgtaacaaacacttaattctgttaataaagattcagtttaatctccgatcttttctcttcttttccgttttaccggaacttcgccggtgttaatatggtatcagagcatatcatttgagcttccgcatatcatcggagatgagtctttcattgaatcatctttctcttatgagagtttttcgattcctacaatcgtttgttgcaatttgcaatttcttcgtcagctatctaattttggttctgattcttcttctttccttcgattgaccttttgtggtgacgaatctcactttcttttcatttcgtctcactttctttgatttttctttaacaatttgttaagaatg

SEQ ID NO: 33727 - DNA, 3003 bp, Unknown; identical to SEQ ID NO: 33726
  misc_feature (1)..( 3003): 2750-1469P.txt file - cDNA_ID_3071783; gDNA_ID_2926151; Annot_ID_198102

SEQ ID NO: 33728 - DNA, 3003 bp, Unknown
  misc_feature (1)..( 3003): 2750-1469P.txt file - cDNA_ID_3071787; gDNA_ID_1621151; Annot_ID_173247
gttcccaagaaatgataatctcaagcctcttttggcaccgaaagaaatgggaaactcacaaaacaatggaaaacccacagaagccagcaagaccttaccaaaaattagtgctgccaaggggagcagtgtaaaagctgctggatcaaaactgaactcaggaaacaaacagtcggatgggcaacccaatcttacatcaagtaactctaaggaaatggttgaaaatcctgacgatctcaagaaagacaaaaggaaatgggcattgcaggttcttgcaagaaagaaagctttagctggcaacaactcaacccaagacaaagaaggctctcccgagcttaaagggaattatccattgttggtgtgtaattctcatcacttactttgtttcttttaaaaattctggttttttgagatgtcattcgtttgtttctaccatttctatcaggctcaacttccagctgatatgagaccaagccttgcaactagtcgccataataaagttcctgtggcagttaggcaggtacgtggatagctgataatcaagagaaagactattacgtagaattaactcctttaggtagaaatccccaagccgtgcttttattacatttacatacgttaaactgataatacagaaaattgaggctaatctgttattgattttcctgcaaaaacattattaacatcacaacttgtgcaatagctttacttgtttttgttcctaagcaaattgctgtttctgcagacacaattatatcgcctgacagaacatttattaaagaaagaaaaccttctgactattcgaagaagtgcagcgacagaactagccgttgctgatgctataaatatcgagaaggcgattgctgacaaatcaagtagcaaagttgtgtatctgaatctatgctcacaagaaatactgcatcattcagagagcaaaacgatggataatgctgtagaaccaaattcgtcatcaccaatggctgatagtgagtcagaacgtataagtagtaaagattcagataatccagccgtccttgaagcgctcagagcagcaggtcttgctgattcaccaccaaacagcccgacccgttcagtagaagttcttccagagaaaggagacagttccttggacaagaccagggagacaggcccatataatgtatttgacatggattctgttcctgatacagacatctttggggattttgaatatgaattggatgaagaagactatttcggtgctacaatggctaaaaaagcttcagtaatgcagccggatgaaagcttgactaaggtgaaggtagttttatccactgttcaacctggaaagtctttgaatccatccgaagtcgtagaggatgaagagacaacaactgaaaacctgaacgagaccacaaatggaaaagaagatggaaagagctttgttcctatggagcttgtacctgaggctgagggagaaggagaaggagaaggagaaggagaaggagaaggagaagggggaggtgagatcctttctgtagctgaatgtgaagaactatacggacctggtacagagaaactagttgaaagacctctcatcgaaggatttgctgagaatggtgttaaagctaaagcccctgattcagagtgcgagagcaacacacagagagagttcatcgcttcaaactttgaaatcacttgcattcaagagaaaaaacttcccagaagcattcaaaagtgcaaaccaagcgaaaagccgtctaaagaggaaaaaggcaaagctgatggctttggtaactccatcaccaagaaggtactaaaaactgtaaaagtctctgtcatgtcaaaattctcattccctttgtcttcactcttcaatggttttattgttttcgtcaggtggaagcatacatcaaagaacatattagaccactgtgcaagagcggagtgataaacgtggaacaatacagatgggcagtgactaaaaccacagaaaaagtgatgaagtatcatagcaaagccaagagtgctaacttcttgatcaaagaaggagacaagatcaagaaacttgccgagcaatacgtcgaaaccgcttcctctggagctcaccacaaggataagtgcaagtgagaaaatcagatggcgtaaataagaagatgaagtaacaagtagttcagtacaaaaacgtaaatagattttaactagtatctctcttttgtcttctccacgggttttggaaactgagtcttcttctcttagggcgagagaagcaattcttgttgtaccccgaaccagatagacctaaactgtgtctgaaactgagatttacttggtcgctgacaggtttttgaaaaaatatttagagatgaaaatgatatatttattattagttacatactttttcgtcactgtgattattaaactgaactagtaaacttaaaagctaaatgtaaaagaagatgatgatagtttgtttgggtcaaaggctcaaagcaatgaaattcttaaaatgcctattgggcctaacctgacgcatttctttatatttttgaaaattgttaaacgacgacggatctgttttctatagtgactctgacgcacttggataaacatacatgtgcaatgactataatacccttgaaacttgaggctatttcctacagtgacacattttgataaacatttgcgatggtcagttacggagttggagacaaaagagcttctgaatctctctctcttctgcgtctcgccaaatttatttcccgattcaatttgtagggtttctgcagaagaaggaaaccaccattaaaccctaagtacgtcacctttcaagctccttcttctgtaggttttttctgttcttctgattcatgtttacaaagttttttttatgtctcttctaacttcttctccttctcgccgcgtaatcagtccttattgttcttcataatcgcagtaccaatcgcaatcgttttcttcctctctcgatctgttcctcggacgagaaaactggacaacaaacctatg

SEQ ID NO: 33729 - DNA, 3000 bp, Unknown; identical to SEQ ID NO: 3753
  misc_feature (1)..( 3000): 2750-1469P.txt file - cDNA_ID_3071787; gDNA_ID_1620662; Annot_ID_163836

SEQ ID NO: 33730 - DNA, 3000 bp, Unknown; identical to SEQ ID NO: 3752
  misc_feature (1)..( 3000): 2750-1469P.txt file - cDNA_ID_3071787; gDNA_ID_1620662; Annot_ID_163837

SEQ ID NO: 33731 - DNA, 3000 bp, Unknown; identical to SEQ ID NO: 3753
  misc_feature (1)..( 3000): 2750-1469P.txt file - cDNA_ID_3071787; gDNA_ID_2926151; Annot_ID_198096

SEQ ID NO: 33732 - DNA, 3003 bp, Unknown
  misc_feature (1)..( 3003): 2750-1469P.txt file - cDNA_ID_3071798; gDNA_ID_1620662; Annot_ID_163824
ggaaggaaaggaatagcagattgcatacagttctcattacaaaaatcaagaacaatcattaggtgcaaacttgatcctctcttgctctctctagagttcaagagaactctcctaacgttatatcctttttggtcacttggtttgagttgtttcagtattagcctattaggtgttcgcaagtttggaaatatgttttcccttgcttgctttcgatgctattgtgcttatttaatggaagtttagttattttttaaataaacgttatgagtaaaaattatcatatataagaaatcatccacatatatattcaatattttattttattgttattgttatattttttatctgatctattttctgtatcataaatctgaggtttatgaattaatttcatgtatagtgtttgtatttgagtttggtgaaatactgccaagatggtgtgatgcttgtttgagtctgagaatttctttaattcaatgacctttttttatacatgttataaaatattatggatacttgcaagtcttctcctatttacttgtacaaatttgatttttgattcagctactatgtgacttgtatgacaaatacagtcgaaacttaatatgatattcggtacccaaatgacaaaaacccacgtacatcaaaagcagagaggctttataagaaatctatgactatcaattttattttttcccataaattatatgcatggtagaaatattatgaaatgagtttccttaactatggttggcaactaaaaatgtctttagtgacaaaaatatgcaacttttctacaaactgcaaatattagtttagattaaatcaaacaaatcatgccttcaaaaatctgtaaaacaaatctttttatttttaacgccggtggcaccatagacgaaatcgacaattttgaaggttggagttggatttgtctgaattttttttttattggaatttggaaagcagctgaaagatgactaaatgcgcagcaaaactcttcattcaggcttggcgtaacttgaatttgttttctttcttctatttttttagtttcattctagtttccgatcaagtcttatggttaaaatactcaattatatactcatcatttaggcatcgaaaacggtcctaacaaaacaccaaacatatattcctaggctttcacgtgtttaattcttacccgcatgatacatttccctcaaatggattgacataatgctattgttgttaactttttgtttgacacaaaatctatctagcaaattttttatagttatagatttaatatacgcaatgttagcttgattttgtttctaacttaaggaaaagttgaaggatgttttaatttgcaaggttctctttcaaaaagatttcgtgtaaattcgacaacggcctcaaacctactctaatcctgactctaaataatattataggttgaaagctttgtaattattgtttactaaaataagagaagaaaacattattacttactctcctttagaaatatatgtttgcattatgctgtatatatagatgaataaatgccataaacgtttaaatgtgtgttggtagatgtcattttacttcattcttagaggtctcttctatcaaatttagttacgtatataaatatagatgtcttgtgctttcttgcaaggaaataaacagagataatatactatttcatacacatccacacacatatagatgtctttttgtttgttgcatggatgtagacatacatccattcacatttccaagtatatacactaacctaatgacctaatgttcttgagagagacttctttcacaacctcttctagaatgtgagtttcttatatttttgttggtataaagtatttgaacatctttatcaaaagttaaaatgtttgaccatattcttggtaattcaaccggtaagtaaatgttattcttctatgacagaacccttaattttgcctgttgtatactagaggtttggttgggtgaaaagtgggcatgataaaaagaacaacatttagttttcctccttgatttttctaaattagagtttcgtatcaaaatacctaaaaaagcttgttttgtggtgcttccaatttcgaaatcggctaaactttttccacatgatttcttcttttacgatagtaagatttagaagaaaataaaaactgaataacgtcagattttccttaataaaagaagaagaaaaatctcacaacattttaagttcctttatttttttgatatgtgccctaataaatgcagtgaaataagctcacaacaaaagatgcacaacgagataaagccaaatgaaatttagtactggtatacaaattttaatgacacgttaatactctttttcgttttggttttataatcgtacttaatattcataactagcttcgaatctggtatttgtatacttaaaaagcttacatcagccaatctactatcattgaaattgtagtgagaaaatctaatataattctttagtgactgtttgtcaaaaaaaaaaaaaactcatgtctaaagtacataacaaattcaaattttgatacaaaattagttatttgtatttgttgtgaccatttctattctacattttgtttgattattagttgaattattcttagttaaatagagcaaacaaattaaattaaatgatttcttaatctataattactgtaaatacttcaaacatcttttaaatagaaacaaataaaataattactaagacatttgtccttatataagtctaataaatgtgtgttttaattcaatacctccaaaaataatttcaaaaaactagagttactgaattggtgctttcacacggtgcatgcattgtattcacacctatatgcatgtcatatattcatggtctctatgatctcgctctatataaacaccacccaatcgaccaaccttcttctctgattattttctcaaattatttaattaatttcttcttcttcatcaccaccaattacactcaaaattatg

SEQ ID NO: 33733 - DNA, 3003 bp, Unknown; identical to SEQ ID NO: 33732
  misc_feature (1)..( 3003): 2750-1469P.txt file - cDNA_ID_3071798; gDNA_ID_2926151; Annot_ID_198085

SEQ ID NO: 33734 - DNA, 3000 bp, Unknown; identical to SEQ ID NO: 3780
  misc_feature (1)..( 3000): 2750-1469P.txt file - cDNA_ID_3071828; gDNA_ID_1620664; Annot_ID_48023

SEQ ID NO: 33735 - DNA, 3000 bp, Unknown; identical to SEQ ID NO: 3764
  misc_feature (1)..( 3000): 2750-1469P.txt file - cDNA_ID_3071828; gDNA_ID_1620677; Annot_ID_164265

SEQ ID NO: 33736 - DNA, 3000 bp, Unknown; identical to SEQ ID NO: 3764
  misc_feature (1)..( 3000): 2750-1469P.txt file - cDNA_ID_3071828; gDNA_ID_1620664; Annot_ID_163877

SEQ ID NO: 33737 - DNA, 3000 bp, Unknown; identical to SEQ ID NO: 3780
  misc_feature (1)..( 3000): 2750-1469P.txt file - cDNA_ID_3071828; gDNA_ID_2926203; Annot_ID_141610

SEQ ID NO: 33738 - DNA, 3000 bp, Unknown; identical to SEQ ID NO: 3764
  misc_feature (1)..( 3000): 2750-1469P.txt file - cDNA_ID_3071828; gDNA_ID_2926203; Annot_ID_202001

SEQ ID NO: 33739 - DNA, 3000 bp, Unknown; identical to SEQ ID NO: 19457
  misc_feature (1)..( 3000): 2750-1469P.txt file - cDNA_ID_3071843; gDNA_ID_1620664; Annot_ID_163863

SEQ ID NO: 33740 - DNA, 3000 bp, Unknown; identical to SEQ ID NO: 19457
  misc_feature (1)..( 3000): 2750-1469P.txt file - cDNA_ID_3071843; gDNA_ID_2926203; Annot_ID_201987

SEQ ID NO: 33741 - DNA, 3000 bp, Unknown; identical to SEQ ID NO: 3790
  misc_feature (1)..( 3000): 2750-1469P.txt file - cDNA_ID_3071879; gDNA_ID_1620665; Annot_ID_163904

SEQ ID NO: 33742 - DNA, 3000 bp, Unknown
  misc_feature (1)..( 3000): 2750-1469P.txt file - cDNA_ID_3071894; gDNA_ID_1620695; Annot_ID_164920
ctttaatttaatctactatagggggtaaaaagtaaaaaagaaataaagatacgtttatccgcatatagtacctggaaataacagaaaataaaaacacaggtaagtactttgcctgagctagtatatgaacactaaagagatacacacacacaaaaagagagcagaaacaaaacacacacacttaaagctttcgtctttacctcttcccttctctctctctatctaaaaagagttccgagaagaagatcatcatcaatggcgacttctctcttcttcatgtcaacagatcaaaactccgtcggaaacccaaacgatcttctgagaaacacccgtcttgtcgtcaacagctccggcgagatccggacagagacactgaagagtcgtggtcggaaaccaggatcgaagacaggtcagcaaaaacagaagaaaccaacgttgagaggaatgggtgtagcaaagctcgagcgtcagagaatcgaagaagaaaagaagcaactcgccgccgccacagtcggagacacgtcatcagtagcatcgatctctaacaacgctacccgtttacccgtaccggtagacccgggtgttgtgctacaaggcttcccaagctcactcgggagcaacaggatctattgtggtggagtcgggtcgggtcaggttatgatcgacccggttatttctccatggggttttgttgagacctcctccactactcatgagctctcttcaatctcaaatcctcaaatgtttaacgcttcttccaataatcgctgtgacacttgcttcaaggtttgtttgttttttaatcgttttcatcaacatgattgatatatatatagtttttgcacttgaaaaagttttgatttttatttatgtaaaaaactgcagaagaaacgtttggatggtgatcagaataatgtagttcgatccaacggtggtggattttcgaaatacacaatgattcctcctccgatgaacggctacgatcagtatcttcttcaatcagatcatcatcagaggagccaaggtttcctttatgatcatagaatcgctagagcagcttcagtttctgcttctagtactactattaatccttatttcaacgaggcaacaaatcatacggtactaagtatagtccatttattaatactcatatataggtatatatgtatataactgttgatcttatttgatttaactggtgggtttagggaccaatggaggaatttgggagctacatggaaggaaaccctagaaatggatcaggaggtgtgaaggagtacgagttttttccggggaaatatggtgaaagagtttcagtggtggctaaaacgtcgtcactcgtaggtgattgcagtcctaataccattgatttgtccttgaagctttaaatgttttatctttctatattgatttaaacaaaatcgtctctttaaagaaaaaacattttaagtagatgaaagtaagaaacagaagaaaaaaaagagagagccttttttggtgtatgcatctgagagctgagtcgaaagaaagattcagcttttggattacccttttggttgtttattatgagattctaacctaaacactcagacatatatgttctgttctcttccttaattgttgtcatgaaacttctctctccctctctctctctaaagttgtgtcagatcttggggcttgtatccattttgtgtttctttagttaggcaatgatcctgtcatgattcatgttatcacctaattaatcctcggttttcgaaacggtgtcatgcatatctgattaatcttgttatctggtgtgagataaatgtatcaaattgctcttgtttatagcttttccaattaatgtcattgcatagcatatgggatgtacagcttcgttttcgatttataaaatttatacatgtgtttggtacgtactgttttgttttggatcagaattataaatttagtacagtataaactactttaaaaattggccaatgagaattttgagtttatcttctttttataagttgattgattttgctttgtttatttatagaaaatatgaaattttatcaattatttttgggatgcttttttattgattttagttcggctaaaattagttagatgtttaaatttattaaaacagatatgcaaaaattaactcgatggtttttttttttttttttagggggataaaaatcgaactatatagttaattaaaacttaaaatgtttttctgaacggctatttcactgattttttagtagtttaaatgtttttcaccgaaaataaaaacagaataggaaacaatactatagaagtctaaccaaaaaaagttcaatatccagtagttcaatatttctaaaaagaaaatttctacacaaagtttatggcaaaaacctaagttattatggagaaaaccaagttattgaaagttatagcgtactgtatgtacaatctttcatcgtgatttcatgtattatagataaaattattcattgtggatgtaatgcaaatagaaccatccgtaaatccatgtattacggaaaaattattcatcacaactcttatgtttgaaaatagttagattcggtcttagatcattattttaaaaatacaaataaacaaatacgatcgacaacaattgctcagcaaatttgacatactgataaagtcattgtttgacaaaacacatatgggccttaatatcaaaacacacggcccattataaaagtaaactgataagataaaacagttccctatgattcctcaataagcagctgctcagcacgttctcgtaattttcaacttcttgacaatttaatacatccattatccaaacaattagcaattaattacacttataaattaatttgtaaactaattaaaactgacaaacacggctctctcttcttcatcatcatcatcatcttcctctcgatcggaaaatagtcaaaagtttctataaattgttgaatcaaagcagagaagaagaagaagacgatcatg

SEQ ID NO: 33743 - DNA, 3000 bp, Unknown
  misc_feature (1)..( 3000): 2750-1469P.txt file - cDNA_ID_3071894; gDNA_ID_1620666; Annot_ID_163932
tttaatttaatctactatagggggtaaaaagtaaaaaagaaataaagatacgtttatccgcatatagtacctggaaataacagaaaataaaaacacaggtaagtactttgcctgagctagtatatgaacactaaagagatacacacacacaaaaagagagcagaaacaaaacacacacacttaaagctttcgtctttacctcttcccttctctctctctatctaaaaagagttccgagaagaagatcatcatcaatggcgacttctctcttcttcatgtcaacagatcaaaactccgtcggaaacccaaacgatcttctgagaaacacccgtcttgtcgtcaacagctccggcgagatccggacagagacactgaagagtcgtggtcggaaaccaggatcgaagacaggtcagcaaaaacagaagaaaccaacgttgagaggaatgggtgtagcaaagctcgagcgtcagagaatcgaagaagaaaagaagcaactcgccgccgccacagtcggagacacgtcatcagtagcatcgatctctaacaacgctacccgtttacccgtaccggtagacccgggtgttgtgctacaaggcttcccaagctcactcgggagcaacaggatctattgtggtggagtcgggtcgggtcaggttatgatcgacccggttatttctccatggggttttgttgagacctcctccactactcatgagctctcttcaatctcaaatcctcaaatgtttaacgcttcttccaataatcgctgtgacacttgcttcaaggtttgtttgttttttaatcgttttcatcaacatgattgatatatatatagtttttgcacttgaaaaagttttgatttttatttatgtaaaaaactgcagaagaaacgtttggatggtgatcagaataatgtagttcgatccaacggtggtggattttcgaaatacacaatgattcctcctccgatgaacggctacgatcagtatcttcttcaatcagatcatcatcagaggagccaaggtttcctttatgatcatagaatcgctagagcagcttcagtttctgcttctagtactactattaatccttatttcaacgaggcaacaaatcatacggtactaagtatagtccatttattaatactcatatataggtatatatgtatataactgttgatcttatttgatttaactggtgggtttagggaccaatggaggaatttgggagctacatggaaggaaaccctagaaatggatcaggaggtgtgaaggagtacgagttttttccggggaaatatggtgaaagagtttcagtggtggctaaaacgtcgtcactcgtaggtgattgcagtcctaataccattgatttgtccttgaagctttaaatgttttatctttctatattgatttaaacaaaatcgtctctttaaagaaaaaacattttaagtagatgaaagtaagaaacagaagaaaaaaaagagagagccttttttggtgtatgcatctgagagctgagtcgaaagaaagattcagcttttggattacccttttggttgtttattatgagattctaacctaaacactcagacatatatgttctgttctcttccttaattgttgtcatgaaacttctctctccctctctctctctaaagttgtgtcagatcttggggcttgtatccattttgtgtttctttagttaggcaatgatcctgtcatgattcatgttatcacctaattaatcctcggttttcgaaacggtgtcatgcatatctgattaatcttgttatctggtgtgagataaatgtatcaaattgctcttgtttatagcttttccaattaatgtcattgcatagcatatgggatgtacagcttcgttttcgatttataaaatttatacatgtgtttggtacgtactgttttgttttggatcagaattataaatttagtacagtataaactactttaaaaattggccaatgagaattttgagtttatcttctttttataagttgattgattttgctttgtttatttatagaaaatatgaaattttatcaattatttttgggatgcttttttattgattttagttcggctaaaattagttagatgtttaaatttattaaaacagatatgcaaaaattaactcgatggttttttttttttttttttagggggataaaaatcgaactatatagttaattaaaacttaaaatgtttttctgaacggctatttcactgattttttagtagtttaaatgtttttcaccgaaaataaaaacagaataggaaacaatactatagaagtctaaccaaaaaaagttcaatatccagtagttcaatatttctaaaaagaaaatttctacacaaagtttatggcaaaaacctaagttattatggagaaaaccaagttattgaaagttatagcgtactgtatgtacaatctttcatcgtgatttcatgtattatagataaaattattcattgtggatgtaatgcaaatagaaccatccgtaaatccatgtattacggaaaaattattcatcacaactcttatgtttgaaaatagttagattcggtcttagatcattattttaaaaatacaaataaacaaatacgatcgacaacaattgctcagcaaatttgacatactgataaagtcattgtttgacaaaacacatatgggccttaatatcaaaacacacggcccattataaaagtaaactgataagataaaacagttccctatgattcctcaataagcagctgctcagcacgttctcgtaattttcaacttcttgacaatttaatacatccattatccaaacaattagcaattaattacacttataaattaatttgtaaactaattaaaactgacaaacacggctctctcttcttcatcatcatcatcatcttcctctcgatcggaaaatagtcaaaagtttctataaattgttgaatcaaagcagagaagaagaagaagacgatcatg

SEQ ID NO: 33744 - DNA, 3000 bp, Unknown; identical to SEQ ID NO: 33742
  misc_feature (1)..( 3000): 2750-1469P.txt file - cDNA_ID_3071894; gDNA_ID_2926190; Annot_ID_200990

SEQ ID NO: 33745 - DNA, 3003 bp, Unknown; identical to SEQ ID NO: 19476
  misc_feature (1)..( 3003): 2750-1469P.txt file - cDNA_ID_3071912; gDNA_ID_1620666; Annot_ID_163948

SEQ ID NO: 33746 - DNA, 3003 bp, Unknown; identical to SEQ ID NO: 19476
  misc_feature (1)..( 3003): 2750-1469P.txt file - cDNA_ID_3071912; gDNA_ID_2926191; Annot_ID_201032

SEQ ID NO: 33747 - DNA, 3003 bp, Unknown
  misc_feature (1)..( 3003): 2750-1469P.txt file - cDNA_ID_3071923; gDNA_ID_1620667; Annot_ID_163989
ttgtcatttactgttgaaatttacttttgcttcaggttaaaggtgaagccaacatttcttacatctgctcacgattctaccgtgcacccgagctcatatttggtgccactgagtacacaacttctattgatatctggtctgctggttgtgttcttgctgagcttcttcttggtcaggtaaacaattctttcagtaaccagcttattcaatctccatgtgtatatttgcattaggactcattgtgactatatcatgttcttatgcagccattatttcccggagaaaatgctgtggatcagctcgttgaaattataaaagtaagaatctttaaacgatgattccttgcaaattacattctttggctacaaaatcctcactgtatagttgttgtacacaggttcttggtacaccaactcgagaagaaatccgttgtatgaatccacattacacagatttcaggtttccacagataaaggcacatccctggcacaaggttagtgtcttttctctttttgcatgtgttcttgtttcagtttctttcttcacacatcaactgatcataattacgttttggtttagatcttccacaaaaggatgcccccagaagcgattgattttgcatcaaggctgcttcaatactctccaagtctaagatgcacagcggtaagcattggtcttgaggtttcttcagtctctaagaatccaactgaatccttactatatattttgtttcctcgtatttcagctcgaagcttgtgcacatccgttctttgatgaactcagagaaccaaacgctcgtttaccaaatggacggcctttcccgcctctcttcaacttcaaacaagaagtagctggatcatcacctgaactggtcaacaagttgattccagaccatatcaagagacaattgggtctaagcttcttgaatcaatctggaacttaaaagggatcctgcaaaagacaactacttttttatatataatgtaccattacacgagccacaaggtcgtagttgaaggcaaacgtggaggacacaattcaaagtttttcctcctcaaactcgttcagacaaagccagctgctagcaaaaccaactcccccaaatctgcgaaaacaaaaactctccagtgttgtatctgcttatttctcttctcttttcaagtttggtgaaaaacacagtctcctctttgcttcatttcttctttctttcccccttatgtaaatgagtttagtcagaagtttttttatatagtaaagtttgggcagaaggtgaagaatgtaatcaaagtgatactctttcaacgaggagcttctttcaaacactttttttttttttcaaacacttcatgaatggatacatggttttgctttaagcataagtatatttgtattaaattttcactcaatttaattgcacgaatcattacaaaaataatatctcgctactcatataaataccctataaataaataagtgaattttttttatctctcatggaaatttgatttatgtatttatatgttttaagattcgaagaaatttttaaataatgaaaatttacaaatatataattcttaattcagaatttcagatattgaattacttattggatttttaaaacaaaaagaaaattacatgactttttttttcttttttttttttaaatatctgttagttcaagttaaaagaccatacattttctaaaggcgggacctatatcaggttaaattcatctccttttagaaaaaaaatatatttgggaaaggctttgatagcaagcaattaaagtatccgaaactaacaaaacctatctggtcttggactcttagtctttatataaacaacatcagatagatcgagagaccatacgcaacaatttactaatttctcttctccttcgttgcttttgaaaccctagttattatcgagagatcaaacacgtacgtacacaaaagaccgatcaaacagagaaggatgcagaagcgtgagttcatggagttgttcgaggcagcacttagagcggctaagtctgtgaaaggtgatgagaattctccagaggtatcgaggtttgtcgatgccatgaatcgtttgaaggaagcacccaagtcacttgtttgtgacgtggtctgcaaaacctccatggggcagggtttggaattcttcatcgatcacaaaaaccctaaaattcgatcggaaggaaggattcttcgggatctttggatgaagtttttttacgcttcaggtagagaaaagagccgtgataatagagaagctgcggtgaagatcccgacgcacgcaacgatgaagaagactggagattcaaagcgagacaaagtgcgtgagattctacaaacatctttggctaaagtcgcttctgaggttgttgacacggagatgaagacacgagtgactgcttgtgatccttgggttgtggctgtatctgtggaaactgcaatgtttgagaacttaggttgtttcatgggacctcaaaaagcaaagtaccggtctattctgttcaacatgggagatagtaacaatccagatttgaggaggaaagtgttacttggtgagattagtggggagagattagtgaagatggagaaggaagagatggggagtgagaagattcagaaggaggttcaaaggattaaagagagagcaagatttaaggaagagagtcgcgtgaagatgctttcatcagcagatatgatcatcatttagttagctgcagagatttagtcatgagtttcattattgtatagaatcagtattcgtgtcaattttctatcacaaactcgagatattagtagattgtaatttcaatacgatgatcgttttcaagttgcttcattgaatggtgtttctaaatctgcgtttaaagaatctagtcaaagtgtttcgtttcataagagggagctctgcagtttatgcagtttaaggggtctttggttttttcttttgaatgtttgtcttctattcgcattaggactcattgttcttatg

SEQ ID NO: 33748 - DNA, 3003 bp, Unknown; identical to SEQ ID NO: 33747
  misc_feature (1)..( 3003): 2750-1469P.txt file - cDNA_ID_3071923; gDNA_ID_2926171; Annot_ID_199503

SEQ ID NO: 33749 - DNA, 3003 bp, Unknown; identical to SEQ ID NO: 19484
  misc_feature (1)..( 3003): 2750-1469P.txt file - cDNA_ID_3071935; gDNA_ID_1620667; Annot_ID_164000

SEQ ID NO: 33750 - DNA, 3003 bp, Unknown; identical to SEQ ID NO: 19484
  misc_feature (1)..( 3003): 2750-1469P.txt file - cDNA_ID_3071935; gDNA_ID_2926171; Annot_ID_199512

SEQ ID NO: 33751 - DNA, 3000 bp, Unknown; identical to SEQ ID NO: 3838
  misc_feature (1)..( 3000): 2750-1469P.txt file - cDNA_ID_3071987; gDNA_ID_1620669; Annot_ID_164034

SEQ ID NO: 33752 - DNA, 3000 bp, Unknown; identical to SEQ ID NO: 3838
  misc_feature (1)..( 3000): 2750-1469P.txt file - cDNA_ID_3071987; gDNA_ID_2926170; Annot_ID_199461

SEQ ID NO: 33753 - DNA, 3000 bp, Unknown; identical to SEQ ID NO: 3853
  misc_feature (1)..( 3000): 2750-1469P.txt file - cDNA_ID_3072039; gDNA_ID_1620670; Annot_ID_164069

SEQ ID NO: 33754 - DNA, 3003 bp, Unknown
  misc_feature (1)..( 3003): 2750-1469P.txt file - cDNA_ID_3072066; gDNA_ID_1620671; Annot_ID_164105
ttcttcttcattccgcgccgccgtcccgcgttttttctttatttgactcttctcttcgaaacgaccgtggttttggtgtttattgaaacgacatcgttttgttcttcttcttcctcagttttgattctcaaaatccacaaccctaaatccacgcttcttctctgctcttcttactcaattcttctgcctctttcttggtccttgtccactaatcgtttgttcgtctcacggcacgaattcaaatttgtaagttgagctcgtcgaattagtgaaacccgagaatagtagaattcagcagagagatgaagattgcaattgaaggttgtatgcatggagacctagacaatgtgtataaaacaattcaacattacgaacagattcacaacactaaagtcgatctcctcctctgctgcggcgattttcaggtaatcgtttgtttttttttaccttgaaaataaaaatccattcgattctgcttcctaagtctgaaaagattcgttctttgtggaaaacattaggctgttagaaatgagaaagacatggatagccttaacgtacctagaaaatacagagagatgaaatctttctggaagtactactccggccaagaagttgctccgattcccacaattttcattggtgggaatcatgaggcttctaactacttatgggaattgtaagttatctagtatttgagtttaggattccgaggcttaaaaaatgtgttcttgatggttgctggttgttgtgctataggtattatgggggttgggctgccaccaatatttactttttgggttttgctggagttgtcaagtttggtaatgtgcgaattggtggcctttctggtatatacaatgagcgtcattaccgttcaggtttgtttcttcttcatctctctgacaaagtaccaatttttcagcttttgaaatgggagaaagttggatttctgagttagtgtctatagtggaaatgtatagattagggaattcgtttgatttgtttggtgtcaataaagtgagaatcagtcatttgtgtgagtaggacactttgagcggccaccatataacgagagcaccatcagatcggtctatcatgttcgtgactatgatgtccagaagttgatgcaacttgaagagccgcttgatatatttctatcacatgattggcctgttggaatcactgattatggagactcagaatcacttatgcggcaaaaaccatactttcgtcaagaggtaaatctgtgggaacatgattctacttcttcattttggttttgagaggttttcaattgatttgaccaaaatttattacagatcgaggaaaaaactcttggaagtaaaccagcggctctactgctagaaaaactgaagcctcaatattggttttcagctcatttacattgcaaatttgctgctgctgttcaacacgggaatgatgggtcagtgacaaaatttcttgccctcgataaatgccttccagggaaaaagtttttacaggttctctttctttcctgtccacaacattatgctttgttcttttgaaacaaaaaggatatcttttaatttctttggatgttcattagattattgaaatcgaatcagagcctggaccctttgaggtcctatacgatgaagagtggctagcaatcacacgaaagttcaattctattttcccgctaacaaggagatacacaaacgtcaggtataccatcccgaacaagctacctactaagaaatgtttatatatcttccatttatctttctacctaccgtcccacttacgtattgttttactacaatagcactgctggaactatacaagagagccgtgagtgggtgaggaagaagctagaagaaaggcaatttaaaccttttgagtttgcgagaacagtacctgcatataacccatcacaacgtgtatttgattccattcctggtatgttaatagtgtactggatatagaggattataaaaagttgatggatcgattaaaagtgttttattcatatggcattttgtagagatcccgcagaatccccagacgctgtctttgttagagctccttggtctcccatatctccttgattcatcaccagtaacaggggaaagaaccgatatccctgcttcactggctccatcaggtatgacgatagttttctttgtagatgaggacttggtttgggattatcagatacatattctgtgaagttgttcatttactctttctatctgcctattgtcatgaaactgcatcaagcaccaatgacagagatgtttagtgcagtgtcaagaatcaaacatgtcttgttgtgtattgcagatcttccgacatatgatagcgaagaaatcccaattgatgacattgatgaaatagaagagatggaggaagcaaaagcagatgatcatacaagagacgatgcatgaatatctccattccagtggtcagaatatattttatcttgctaatatctgactgcttcatcgtcaagctggaaaacaaccacattagttgggattctgtgattagaaaaccaagttttcttgttcattttttagaatcagcataagttttatttgtgatattaaagaaaagtgaatcataaaaatgtcttggagaaataaaaagttagatattaatgtttcatccagtattcaagaaagttgatcaccttttcttccacaagttctctggcatgcattggcttgggaagttactcgccgacaaaacccatagataagtatgtcggattcacttaaaaccatggatgatgctgggaatgttggattcaactaaacacgaccatcaatgattcttcattgaatgcgttgactcaacttcatcacctcaactaattttctatctctgacactaacatcaaatgcaaattatgaagtgaacagttgcagtttattacaacaaccttcaagattcctctcattctcctttctattttcattgtcactttattcgagtcaaaacacagagacaataaaaatg

SEQ ID NO: 33755 - DNA, 3000 bp, Unknown
  misc_feature (1)..( 3000): 2750-1469P.txt file - cDNA_ID_3072066; gDNA_ID_2926200; Annot_ID_201801
ttcttcattccgcgccgccgtcccgcgttttttctttatttgactcttctcttcgaaacgaccgtggttttggtgtttattgaaacgacatcgttttgttcttcttcttcctcagttttgattctcaaaatccacaaccctaaatccacgcttcttctctgctcttcttactcaattcttctgcctctttcttggtccttgtccactaatcgtttgttcgtctcacggcacgaattcaaatttgtaagttgagctcgtcgaattagtgaaacccgagaatagtagaattcagcagagagatgaagattgcaattgaaggttgtatgcatggagacctagacaatgtgtataaaacaattcaacattacgaacagattcacaacactaaagtcgatctcctcctctgctgcggcgattttcaggtaatcgtttgtttttttttaccttgaaaataaaaatccattcgattctgcttcctaagtctgaaaagattcgttctttgtggaaaacattaggctgttagaaatgagaaagacatggatagccttaacgtacctagaaaatacagagagatgaaatctttctggaagtactactccggccaagaagttgctccgattcccacaattttcattggtgggaatcatgaggcttctaactacttatgggaattgtaagttatctagtatttgagtttaggattccgaggcttaaaaaatgtgttcttgatggttgctggttgttgtgctataggtattatgggggttgggctgccaccaatatttactttttgggttttgctggagttgtcaagtttggtaatgtgcgaattggtggcctttctggtatatacaatgagcgtcattaccgttcaggtttgtttcttcttcatctctctgacaaagtaccaatttttcagcttttgaaatgggagaaagttggatttctgagttagtgtctatagtggaaatgtatagattagggaattcgtttgatttgtttggtgtcaataaagtgagaatcagtcatttgtgtgagtaggacactttgagcggccaccatataacgagagcaccatcagatcggtctatcatgttcgtgactatgatgtccagaagttgatgcaacttgaagagccgcttgatatatttctatcacatgattggcctgttggaatcactgattatggagactcagaatcacttatgcggcaaaaaccatactttcgtcaagaggtaaatctgtgggaacatgattctacttcttcattttggttttgagaggttttcaattgatttgaccaaaatttattacagatcgaggaaaaaactcttggaagtaaaccagcggctctactgctagaaaaactgaagcctcaatattggttttcagctcatttacattgcaaatttgctgctgctgttcaacacgggaatgatgggtcagtgacaaaatttcttgccctcgataaatgccttccagggaaaaagtttttacaggttctctttctttcctgtccacaacattatgctttgttcttttgaaacaaaaaggatatcttttaatttctttggatgttcattagattattgaaatcgaatcagagcctggaccctttgaggtcctatacgatgaagagtggctagcaatcacacgaaagttcaattctattttcccgctaacaaggagatacacaaacgtcaggtataccatcccgaacaagctacctactaagaaatgtttatatatcttccatttatctttctacctaccgtcccacttacgtattgttttactacaatagcactgctggaactatacaagagagccgtgagtgggtgaggaagaagctagaagaaaggcaatttaaaccttttgagtttgcgagaacagtacctgcatataacccatcacaacgtgtatttgattccattcctggtatgttaatagtgtactggatatagaggattataaaaagttgatggatcgattaaaagtgttttattcatatggcattttgtagagatcccgcagaatccccagacgctgtctttgttagagctccttggtctcccatatctccttgattcatcaccagtaacaggggaaagaaccgatatccctgcttcactggctccatcaggtatgacgatagttttctttgtagatgaggacttggtttgggattatcagatacatattctgtgaagttgttcatttactctttctatctgcctattgtcatgaaactgcatcaagcaccaatgacagagatgtttagtgcagtgtcaagaatcaaacatgtcttgttgtgtattgcagatcttccgacatatgatagcgaagaaatcccaattgatgacattgatgaaatagaagagatggaggaagcaaaagcagatgatcatacaagagacgatgcatgaatatctccattccagtggtcagaatatattttatcttgctaatatctgactgcttcatcgtcaagctggaaaacaaccacattagttgggattctgtgattagaaaaccaagttttcttgttcattttttagaatcagcataagttttatttgtgatattaaagaaaagtgaatcataaaaatgtcttggagaaataaaaagttagatattaatgtttcatccagtattcaagaaagttgatcaccttttcttccacaagttctctggcatgcattggcttgggaagttactcgccgacaaaacccatagataagtatgtcggattcacttaaaaccatggatgatgctgggaatgttggattcaactaaacacgaccatcaatgattcttcattgaatgcgttgactcaacttcatcacctcaactaattttctatctctgacactaacatcaaatgcaaattatgaagtgaacagttgcagtttattacaacaaccttcaagattcctctcattctcctttctattttcattgtcactttattcgagtcaaaacacagagacaataaaaatg

SEQ ID NO: 33756 - DNA, 3000 bp, Unknown; identical to SEQ ID NO: 3865
  misc_feature (1)..( 3000): 2750-1469P.txt file - cDNA_ID_3072070; gDNA_ID_1620671; Annot_ID_164100

SEQ ID NO: 33757 - DNA, 3003 bp, Unknown; identical to SEQ ID NO: 19529
  misc_feature (1)..( 3003): 2750-1469P.txt file - cDNA_ID_3072075; gDNA_ID_1620672; Annot_ID_164136

SEQ ID NO: 33758 - DNA, 3000 bp, Unknown; identical to SEQ ID NO: 3891
  misc_feature (1)..( 3000): 2750-1469P.txt file - cDNA_ID_3072079; gDNA_ID_2926150; Annot_ID_197989

SEQ ID NO: 33759 - DNA, 3000 bp, Unknown; identical to SEQ ID NO: 3891
  misc_feature (1)..( 3000): 2750-1469P.txt file - cDNA_ID_3072079; gDNA_ID_1620672; Annot_ID_164135

SEQ ID NO: 33760 - DNA, 3000 bp, Unknown; identical to SEQ ID NO: 27349
  misc_feature (1)..( 3000): 2750-1469P.txt file - cDNA_ID_3072089; gDNA_ID_1620673; Annot_ID_164169

SEQ ID NO: 33761 - DNA, 3000 bp, Unknown; identical to SEQ ID NO: 27349
  misc_feature (1)..( 3000): 2750-1469P.txt file - cDNA_ID_3072089; gDNA_ID_2926200; Annot_ID_201783

SEQ ID NO: 33762 - DNA, 3003 bp, Unknown; identical to SEQ ID NO: 15927
  misc_feature (1)..( 3003): 2750-1469P.txt file - cDNA_ID_3072093; gDNA_ID_1620673; Annot_ID_164167

SEQ ID NO: 33763 - DNA, 3003 bp, Unknown; identical to SEQ ID NO: 19747
  misc_feature (1)..( 3003): 2750-1469P.txt file - cDNA_ID_3072104; gDNA_ID_1971819; Annot_ID_176096

SEQ ID NO: 33764 - DNA, 3003 bp, Unknown; identical to SEQ ID NO: 19747
  misc_feature (1)..( 3003): 2750-1469P.txt file - cDNA_ID_3072104; gDNA_ID_1620673; Annot_ID_164152

SEQ ID NO: 33765 - DNA, 3003 bp, Unknown; identical to SEQ ID NO: 19747
  misc_feature (1)..( 3003): 2750-1469P.txt file - cDNA_ID_3072104; gDNA_ID_2926200; Annot_ID_201767

SEQ ID NO: 33766 - DNA, 3000 bp, Unknown
  misc_feature (1)..( 3000): 2750-1469P.txt file - cDNA_ID_3072108; gDNA_ID_1971819; Annot_ID_176095
gaatttcatcttgaatattccatgactgattagaaccggacttccttttcagctgcatttggtaaccaatgtcagaatgaataagggtaaatttgagagagccattgaaaatacatataacggtatgcaacttttctttaggaatagctggaaatagtgtcccacaaattcctcgtggttatctaacataaacaatagaagttaagcagagaattttatctcataaaccaagatgaaacgacttcagactttcaaacaacatttgaccaaaagaaaagtatgcactgctggagaacttaaaattctaaccttggatgaggaaaagtttccagcgctataaggaaggggtgtcccttgcactcttgctgatgatggtgatcgaaaatctaaattattcgcagctggagatccccatggcagacgagctcgcatataagacttggccacgtccacaggcgatccagcaccatcttcagttgcctggagatttaaactaatggctgagatggtgatcatcatttaaagtacaatggaaaaagaatactgtgaagcgaagctatcagaagttgaccaaaatcatgtaagtaaatggtcttcatagtcaaaagaagagcaacaatatggatcttttgcattttaagcggacaaaaaggtatttcccaatcaggacatttcagaattaacgtcaccagatggccacacgcagaattctgaacaacctacttttgcaagagagctttaagttgctgatcacatggattggcatataacaatcaaatcattttacccaaacagaagatgtctccttctataataataatggcttagagcacggagacaagatatcacaaaaaagttgatacctgcaggctgcagcaattagaacagttaagaagcaagtttccagaacttactttatactttgaacttgatcctgatttcttctcctccaaccattttcttgcttccatgacagctgtattggacatttcacccacattcacgtctagaaataaaatagaaaagaagacgttatcacatagactaatccggtctacttgcacagtctaccatcagtaacataccgcttgtcaatccatagtcatcatgactcgtctcaatagcagaggggacgctgggatgatctacaaccctagccttgatgatatctattaacctatcaccctcttccctgaaacaacatacacatgaatgaataagcaggatacaagatcagcttagatttggtaactacacacgtctcagaaagattctttaagctatgaggtgtaaataataagaatagtcgaggaggctgctacttatgatgtccaaaaagccaggcagagaaataccttgcaaatgtttcttgcaagagaagctgctcaattacacgcttagaactgagtcgttgaatgcttggttgctgggcactcagaaggtcctattcacacaagcacaaaaactgaaattatgcttttataaaaaaaactctcagttgaaaacgtgttagcttcacgaactttacttcaaacaattatcataggactacagtggcatagcaatcaccaaaacgaacaaggtggttagtacctcttcagtaaaatcgggattgttcttctcaacatcctcatcaccatcaatatctgcaaacaaagaagaaaacatataaaaatccatacattaaaagaataagacacaacaaagctggttggtattctcaatcccagaactacattatatgaataaaaattagagctttagaattagtatgaagtttatagcttagaagtaacctaactaaatagagtacaacaatgcttaactgctcttaagtcccacatattaaaggaaagagaaaatgggaaagctttaagtcaaacttcacatttcaaacgaaacggtagctttcagattcgaccagacaataaaccaaaaattcaaattaatcctatctaaactgaaataaatggtacaaacctgaagatgaatcctcgtcctcctccgaagatgaggaagagtcggagaagacgacggaagaaatgaattttccggcgccggaagcaattacgctggcgggtttgtaaacgagcctggagatccaactagggttttgctgaggaggatctcgggatctctgaacggggcgctcacacggcgtcctgacaacagcggtgcgtcgtggtcgaacaattttcccaccgactcgaggctgacctgctccggcggcgtaaccggagacggaatccatggtgaaagtgagaggaggagggagaagttcgttgtaggaaataatgaaagtgttgaggaaaaattggtaatttctcgttatttgtcgtcttcttgtttttttttttaattgggggtgaatagttagtttcctaaattacaggcctgcggttaaaatttcttccactaataaaattaggcaaaaacaaaacattgcgattaaaaaaaattaatcgtagtaaaatcatgtattatattcttctcttttcatattttgaacatatcacatgatgtttagatcttataaatgcagtaatttaatagagagattagaatttggaagaaaaaaaagttacatgattaaacgaagtaattaatcaagttgtaagtagttattttaaaaacaatattagaaaaatgttttttggttactcatacagtaatacttaattcgtcaactgtgtcagtgttacaaaaaggctaaaagaatgggccaaatgggctactcttgtatcgggtcaggaacgggtcagttccaacccgatcggatctaaaatgggcggggcgccttccttttcattttgatggcaatcaatcatcatcaatcgacgcttttttagagacaaacacgatcgccgatccatttacgagccgtcgttgctctacacatatcaacaacaaatcttatcctcccaactatcttttctctgattttcttttcttctccagtttccatttctagaatcgatcgatattgaaggagagaagatg

SEQ ID NO: 33767 - DNA, 3000 bp, Unknown; identical to SEQ ID NO: 33766
  misc_feature (1)..( 3000): 2750-1469P.txt file - cDNA_ID_3072108; gDNA_ID_1620673; Annot_ID_164151

SEQ ID NO: 33768 - DNA, 3000 bp, Unknown; identical to SEQ ID NO: 33766
  misc_feature (1)..( 3000): 2750-1469P.txt file - cDNA_ID_3072108; gDNA_ID_2926200; Annot_ID_201766

SEQ ID NO: 33769 - DNA, 3000 bp, Unknown; identical to SEQ ID NO: 4477
  misc_feature (1)..( 3000): 2750-1469P.txt file - cDNA_ID_3072158; gDNA_ID_1620708; Annot_ID_165372

SEQ ID NO: 33770 - DNA, 2037 bp, Unknown; identical to SEQ ID NO: 3918
  misc_feature (1)..( 2037): 2750-1469P.txt file - cDNA_ID_3072158; gDNA_ID_1620674; Annot_ID_164213

SEQ ID NO: 33771 - DNA, 3000 bp, Unknown; identical to SEQ ID NO: 20095
  misc_feature (1)..( 3000): 2750-1469P.txt file - cDNA_ID_3072158; gDNA_ID_2926210; Annot_ID_202559

SEQ ID NO: 33772 - DNA, 3000 bp, Unknown; identical to SEQ ID NO: 3925
  misc_feature (1)..( 3000): 2750-1469P.txt file - cDNA_ID_3072168; gDNA_ID_1620708; Annot_ID_165363

SEQ ID NO: 33773 - DNA, 3000 bp, Unknown; identical to SEQ ID NO: 3925
  misc_feature (1)..( 3000): 2750-1469P.txt file - cDNA_ID_3072168; gDNA_ID_1620674; Annot_ID_164204

SEQ ID NO: 33774 - DNA, 3003 bp, Unknown
  misc_feature (1)..( 3003): 2750-1469P.txt file - cDNA_ID_3072175; gDNA_ID_1620674; Annot_ID_164198
tcaaagacaccatcctgaatgttctggaggatcttggcagcagtctctatgaaggcctgttggaatccagaaaaagaagacaaaagtctccatgtgattacagccaaataacaggatggggaaaaagagttgcaaggaagaaatgtcacctcctcaacgttttgagcagttcttgcagatgcttctaagaatagcaggccatgttctttggcaaactgttgaccttcctctttgctaacagctctcttgtgagcaagatcacatttgttcccaatcagcataatactcatgttaggatttgcatgttgccgagcatcctccaaccagcttgccagatggttaaacgtctctctcctgcaacccaaagaaccaagaattttgagcttcagaaagatcaaagcatgaaaaacctcaatgataaaactcttgcaattcttcatgtccttcataactttcaaaattccaaaacaatggaggaaaaatatctattttagcaagaatttaagatggatggttaacttaacatcctcccaaacaagcattgccaatattatagccaaggattttgttcagataaaagtaacttcccaatttccaaaacctttccaacagtctaggtttatcaaatcacaaatacagaaccaatcacttccaaaaccttgctggggaattcagaagttcgagctgatatatattgtcgcaaggcaaaaactaacctggtgatgtcataaaccagtaaagctccggctgctcctctgtagtatgatctggtgatggatctaaaagattcttgtccagcctaaaaaatatcatacgaaactttaatcagaaagcacaactccaacacatacatcatctaatggaagaactattgaccagaagaaatcacaacaaggaatgcactggtgaactcagcttctattacaataagcctatgaaacttaatcaagaaccgtgcaatgattaacttttttgaaattttaccccactttgagtctctggacatgattttcaaacataatttttggtattggcaattctaatgaggcattgtttatataaaaacgaagaaattgaattgattatgacaattaatcttcttaatcacatcctgccttagggagaaaaaaaaaacaatcctaatcgataaaacgtgattagttccctgatgacctaattacgaccaagagaagagagaggaagcgtacggtgtcccaaatttggagtttgatggggcgtccatcgacggtgaccatccgagcaccgaactcaacaccaatggtgagatcgtggactggttggaacctcttatcagtaaattgcagaagcagacacgattttcccacacctgaaacgacaaaaaaaacaacaacgaaaacacatgaaaatcggcacgaaatggatttaacccagaaaaataaaacaattgggaattaagaaaggtgaaagatcggtctctcacctgtgtctccgatgattatgtacttgaagagataatcgtaagacatggttgatgaatttgagcaaggtcgatgatgaattagcgcaggtcgatgggttcgagagaaggagatgtgaaagagaggaagaagagattgaagagtacaagtcaccgacgtgctttttgatttcgaggtttctcgatgaagaagctatcttctccttctcatcttttataatctttttacttaattactaaaattaaagggatctaatgacgaattatctgaataattgtttttcttttgtatccttaagtttcaacagtaaataaaaatccacacaaaatactctatagtataatttattaattattatagtcgttttagttaattatttaaaaacagagggaccagatgaaaaatatctgggaaacaaattaaagcttaaaatccatctctgcctttggctccgtccactctgactcgactagtgcatcatccattgttgggcatttgatagtttaaagtgggcttttttatttttttataatgtgggcttttttctttgatgttgaatggcttggttagtggatttcgagaccagcataagtttcttttttctattcatctgaagcatggcgcagtccataatcgctaaattgatgatacaaaagaacttgcacatcaaaactgtgaacttaccagaaatttgcattagcaaaagcttcttttattatatgatggggaatacacacgtaccttgatacaaggctactaatatcaattgtgtccggattatcacggtagtatgctctgtttcatatctcttatggaaattacataactgtgtttaagatgaatgttctagtgggaagataagaagaactcaaatcctacattagagatgagttccttacaaatgcttatagtctacaatggcaaattcgagaagcaaattcgaaacagagttccatccattagagaacaggggatgttatttcatcccaaactcaaaccgatcttagttatgttatttcgtatttttttgggtattttaccttcaaattatttgattaatttcatgctttaaggagaatttgattaaaatgaatatacaagagttatgaatttgattatattctcttattctactaatcacgaaatatttagagaatatgtaattatcgtttaaagaactatcgttttattcataaaaactctgtaaattaccaatttgatatacttctatcaaattatttatattttttagttgtgttaattcgttttttttgggtgtatttatcttaaaaagatgggattaaatttcatgatttaaggagaagaatcttttgagagattcgaaaccgcgatagcattccttgttcctccttttctatttacctttctacttttgccatcatcttcgtcgatctacttcccccaaagtctaaccctaaagcccccaaatttctcctgatcaaaaccttgttgtataaatcctgaatctctgaagaaacttcgaagatttgggtttctcaatttggttgagaaattcgcgatg

SEQ ID NO: 33775 - DNA, 3000 bp, Unknown; identical to SEQ ID NO: 3933
  misc_feature (1)..( 3000): 2750-1469P.txt file - cDNA_ID_3072185; gDNA_ID_1620674; Annot_ID_164190

SEQ ID NO: 33776 - DNA, 3000 bp, Unknown
  misc_feature (1)..( 3000): 2750-1469P.txt file - cDNA_ID_3072213; gDNA_ID_1620675; Annot_ID_164245
cctcaagctcagcaagttccttctttttcctctctttcttggaaagttgcctctctgcctccttaggaggagcacgaacttcaggagcctttttcacctcaggctctgcttctggatgaacttgtgtctctgttccctgctcgtgatcttcctccacatcatcatcatctccatcatcaagagtgtcttcttcgctttcaatttcctgcgacattgaaatcaaatgcatctctatgagaaacaaatgaacagataggcacacaaccacggtttagagaaaccattgcacaacaaacttacattgcctagaaaaatttcgataacaatgcaattagatatatgaaccttcaggagacaaagcagcttacttcacaataacattaatttccctttcagaattcagacaacacaagcctaagcctaagcgagataacaacagtagaaaaaaaggccaactcattcaattcgtggaagcatttgaaatctaaagaggcttattgcaagagacatattaaaccagtgttacaattttcaacatgtgaaatgcataaagctatgatgatgaacccaaaatcaacatatatatgaaagatttggacttgtgacctcagcgggaacgtctttagcatctgaatgggaggcttcagaagtgctccacagggactgaggtggagcagtggtagcgtaataatcatcatcttcatcatcgctatcgatatcagcccaagcctttgctttgagaggcgtaggtgcccagaaaacctgtggctcaggctccttctgtgaatcttctctcttagaggaagctttgctcttaccagccttatcagacttcttcttcttcctcgaagtatccaaagcagcaaacaagttggtgttctgaatcggcatcgatccctcatctctcctgtttccaccaccaaccatcttttttctttcctcgatcaccacacaataagtcacagagtgttttctgataaaaacccagaaacgaagtttcacaatttcagctggaagatgaatctcgagtaagttaaggtaatgaaggatgggaaaggaaaagctgatgaattgtcgctattttcttaggaaaggattgatctttaaagcaaatcccttgaaactctgatggacggcgattgaagaaagcgatggatgctataataactactagggttccagacccagaaacgacaaaatgtatactggtgattaatacaagcgtataatataggaaactgaaattgagagacaaaggagaaacaagagaatgttggaagcttcgggaagcgattcctatagaatgcgagagagagatgattagggttttcttaagggatgtggtgtgtagcaatcgtagcgattagagctactgggctacacgacaagggaaggggatctgtctctatttgggatgttatctcctctcttatggatcatcaaaccgaacatttgattacaaaattgaaccgaacatttgattacaaaattgaaccgaacattggattagactgtctaattaaaccttaatttggtttatgaactcaatattagtttttccaattaagccaattttattttatttttctgtattaaaaaagcaaattttgggttccaatatacaatccacccgccaaaatattttgtcaatttttaacgtatttttgaatcgaaaaaggaatttctgaacttttattgtttttcttcttgtgtttatacattgctctaaatcttatgatacgttaataatgaccttaattcatatttataaggaaaccaaatctattttttaaatattcttaaagcttagtttacactatataattaatcaaaaattgattccaatcaatctctctactactaattctttttgctatatgtctatatttaataaaaatatatatttaaacacataataaggtagtaatacactaatacttaaatatggtccgaaaactcctaataatatgtatatatatatttttacaaaatattggaaaattgttaagctaatggatgaatgaagtttatatattaaaagaaaataacaataatatatatatatatatataaattattaaaaagataatactgtaatgtgatgattttatacttaaattatcccctagtattctagtaataatagttgttaagttgaatgatgtctctaacaattgttggctaggtggacaaacacaagattgcggtaggttagcaacacacgtgacaacaataaattattctctctgaagaaatctttaaatcctgaccgtccaaacaaatatttcgcagctgagaatctcgaacgtccattatatcttttctgttgcagagttaaaaatttagtgcttatttcgaaactaaatatggaccgtagatatagtaacgcgtctccatcggacggtacccgtgatacgatgtttatttggaatatgttttctttataactgaaaaaaccttactctcgcggaaccagacgaaaccctagctctcccgtttctcccggttaaaaaagaaaaaaaaaagaagcaaattttgctttttttattttcggctaaattgaacgaatacttttgggaaattttcgattgtttgatttagggatccgattcgcagtccgatttaccgaaaccctaattttgattttgggattgtggcgactataaaggtccttaagagactcgatttcgtctgataaagtgatgcaggtaggcatgcaaatttctctctttttttttttaattttttgcagttaaattttgcttgattgttgaaaaaacaattgcttggatttcaatgcaaagttttttcctgaagtgggatttgatctgtttctttgggtgacttgtgtgttcttcttttatcatactttgggtactttttgtgattctgggtttggttttggtgtcacagatctgaaaaatgtttgcttgcgtatatgatggaatttgagacctgctggcttttgattctgggtattggttcgaggtggctttcatg

SEQ ID NO: 33777 - DNA, 3003 bp, Unknown
  misc_feature (1)..( 3003): 2750-1469P.txt file - cDNA_ID_3072213; gDNA_ID_2926202; Annot_ID_201944
aagcctcaagctcagcaagttccttctttttcctctctttcttggaaagttgcctctctgcctccttaggaggagcacgaacttcaggagcctttttcacctcaggctctgcttctggatgaacttgtgtctctgttccctgctcgtgatcttcctccacatcatcatcatctccatcatcaagagtgtcttcttcgctttcaatttcctgcgacattgaaatcaaatgcatctctatgagaaacaaatgaacagataggcacacaaccacggtttagagaaaccattgcacaacaaacttacattgcctagaaaaatttcgataacaatgcaattagatatatgaaccttcaggagacaaagcagcttacttcacaataacattaatttccctttcagaattcagacaacacaagcctaagcctaagcgagataacaacagtagaaaaaaaggccaactcattcaattcgtggaagcatttgaaatctaaagaggcttattgcaagagacatattaaaccagtgttacaattttcaacatgtgaaatgcataaagctatgatgatgaacccaaaatcaacatatatatgaaagatttggacttgtgacctcagcgggaacgtctttagcatctgaatgggaggcttcagaagtgctccacagggactgaggtggagcagtggtagcgtaataatcatcatcttcatcatcgctatcgatatcagcccaagcctttgctttgagaggcgtaggtgcccagaaaacctgtggctcaggctccttctgtgaatcttctctcttagaggaagctttgctcttaccagccttatcagacttcttcttcttcctcgaagtatccaaagcagcaaacaagttggtgttctgaatcggcatcgatccctcatctctcctgtttccaccaccaaccatcttttttctttcctcgatcaccacacaataagtcacagagtgttttctgataaaaacccagaaacgaagtttcacaatttcagctggaagatgaatctcgagtaagttaaggtaatgaaggatgggaaaggaaaagctgatgaattgtcgctattttcttaggaaaggattgatctttaaagcaaatcccttgaaactctgatggacggcgattgaagaaagcgatggatgctataataactactagggttccagacccagaaacgacaaaatgtatactggtgattaatacaagcgtataatataggaaactgaaattgagagacaaaggagaaacaagagaatgttggaagcttcgggaagcgattcctatagaatgcgagagagagatgattagggttttcttaagggatgtggtgtgtagcaatcgtagcgattagagctactgggctacacgacaagggaaggggatctgtctctatttgggatgttatctcctctcttatggatcatcaaaccgaacatttgattacaaaattgaaccgaacatttgattacaaaattgaaccgaacattggattagactgtctaattaaaccttaatttggtttatgaactcaatattagtttttccaattaagccaattttattttatttttctgtattaaaaaagcaaattttgggttccaatatacaatccacccgccaaaatattttgtcaatttttaacgtatttttgaatcgaaaaaggaatttctgaacttttattgtttttcttcttgtgtttatacattgctctaaatcttatgatacgttaataatgaccttaattcatatttataaggaaaccaaatctattttttaaatattcttaaagcttagtttacactatataattaatcaaaaattgattccaatcaatctctctactactaattctttttgctatatgtctatatttaataaaaatatatatttaaacacataataaggtagtaatacactaatacttaaatatggtccgaaaactcctaataatatgtatatatatatttttacaaaatattggaaaattgttaagctaatggatgaatgaagtttatatattaaaagaaaataacaataatatatatatatatatataaattattaaaaagataatactgtaatgtgatgattttatacttaaattatcccctagtattctagtaataatagttgttaagttgaatgatgtctctaacaattgttggctaggtggacaaacacaagattgcggtaggttagcaacacacgtgacaacaataaattattctctctgaagaaatctttaaatcctgaccgtccaaacaaatatttcgcagctgagaatctcgaacgtccattatatcttttctgttgcagagttaaaaatttagtgcttatttcgaaactaaatatggaccgtagatatagtaacgcgtctccatcggacggtacccgtgatacgatgtttatttggaatatgttttctttataactgaaaaaaccttactctcgcggaaccagacgaaaccctagctctcccgtttctcccggttaaaaaagaaaaaaaaaagaagcaaattttgctttttttattttcggctaaattgaacgaatacttttgggaaattttcgattgtttgatttagggatccgattcgcagtccgatttaccgaaaccctaattttgattttgggattgtggcgactataaaggtccttaagagactcgatttcgtctgataaagtgatgcaggtaggcatgcaaatttctctctttttttttttaattttttgcagttaaattttgcttgattgttgaaaaaacaattgcttggatttcaatgcaaagttttttcctgaagtgggatttgatctgtttctttgggtgacttgtgtgttcttcttttatcatactttgggtactttttgtgattctgggtttggttttggtgtcacagatctgaaaaatgtttgcttgcgtatatgatggaatttgagacctgctggcttttgattctgggtattggttcgaggtggctttcatg

SEQ ID NO: 33778 - DNA, 3000 bp, Unknown; identical to SEQ ID NO: 3943
  misc_feature (1)..( 3000): 2750-1469P.txt file - cDNA_ID_3072217; gDNA_ID_1620675; Annot_ID_48228

SEQ ID NO: 33779 - DNA, 3000 bp, Unknown; identical to SEQ ID NO: 3948
  misc_feature (1)..( 3000): 2750-1469P.txt file - cDNA_ID_3072217; gDNA_ID_1620675; Annot_ID_164241

SEQ ID NO: 33780 - DNA, 3003 bp, Unknown
  misc_feature (1)..( 3003): 2750-1469P.txt file - cDNA_ID_3072217; gDNA_ID_2926202; Annot_ID_141575
acccacggtagtgagtgtgacaatggaccagtacattgagtaagtgtaccctaaccatacacttctttccttaaaatcctcaacttgcgatcctatccatgtatccgtaggccttggataatggtaggctatccagtataaaatgcaacccgccaaatgtatccaaaatatcgttacctgaatcaaatttcacaatttgaataaaagtcatagattgacatagccaatttagtgattgtatggaccacatatagataattcaatataagtaaaacttacacatagaagtttgatgactcggatcacgaaatagttgaaatgtgcgtctttctctagtctgttaaaaaaagaaagaaaggaagtgtaaaatagacacacacatatgtactatatgataagtggatttcaatattgcatattatatagaaagtagtaaagaaaaaaccttttaaagagttcggctacacgacggagacgccagaggcggagtaaattaaggaagccgaaagcttggcctcgtccgacatctccggtaatagttttataaatgaattgaatgggtaacgttgatgctacgtccatcacaaaagccacgctcttcaagtacctataataatgcacaacatatataattcaattctaacttattcattttacttatgttatttttttaacatataaaaacaaattgatttgttaccgtttggcgatgagcttgtggtcggtgacattgaggtaagtagtattatccaagtaggaaacaaaaaaggtgaggatgatatcaacggcgaagaagaagtcaacgacgagatcaatggtcaataacgctccttcggcagctttctcgaaagccaactcgaacaaagatgcccacgccgaatacccaaccaatatcaccaaaaacaattcccacaacctaccattaatttttatatggaaagattaaaaaaaaattaagatatatgaatattaataagaaataacaattttaagacgtaaaaatatgaaaattaatgaacgaatcatttgatcattaatttatggactaatagaaacagaaaagttatgaaatctgtaaatcactatttattgtttgataaccaaaaaacatttcttcgttgtttagttagtgagaaatgaacctgtaacgacgatcaaagtgaagaacgatgaaaggtttggaagaaggattatcatcttcgatgaaagtcccaaaagcaggcaagagactgctcgaaactgacgttatgttcctcacatctttgctcgatcttcttctgaactgcagtatcgataacggcgatcttgcttccgccgtcgacgccgataacgccgtcgaagaccttcctcttctcaacaacaacggcaacggtgatctcgcctcagtagtcgtcgtagacattcttttttccttcttcttcttctctctcttcttcaagcttgatgatatatacttccctcttttgtctctttcatttataccttttttttttagttttgaattattaaagaggtgtttagatgatcaagaaggtggtgagcaaattaagttgacttttttttttactggtttttgttttccctatattttttggaaaaaaagaatataacaatactataaaacaaatttacttaaccatctaataaattataatttttcaagattgtagtatgatgaattttactctttatatattcaactttgttgttatatatgcagaaggcttcatcgacttttttgactcttatttacgtctctgtgtgtatttaatgtggcatcaggtgtagtgattacaatcgagatctacaatatcagggggataaggtttttttttttttttttcttacgataaattatgtaataattagctgtttaaatactggagttgaaaaaattgaggaactcaaaagtcaaatcttgacgtcttttttgttgttgttattaaatgagaccgtgacaggaatagtagtgttgaaaacaaaacgaacaataataaacaaatgaattacgtatcaatatctatcatcagtcagaatttagtatgtttttaatacaatcatttcagtttttttgagataacatatcatatatatatacttctttccactttccagtgttggatgtgcatgtttacaatttttttaaaaaattctaaggaaaacaatgttttgaaattctaagatacgtttaggtaatacatgaagggggatacactttgtcttcgtcccttaattagctcctatgaagaatttcacatacacaaattaagaagatgcatgcaataacaaggctaaagccatttcttaatagttcatttgtacataaagtaagtttgtgtatgttaaaaaaaaattgtgtatgtactgatgtacagtatgttgttgattgttgatacgtaaaaccaaatagtcaaatactatacatttttacgtttgctcgtataaattaggaaacgaaagcataattgttacggataaaaaaacacgaaaatcaattaatgaaacaaaacccttttgtaaaaaagcccatttttatggaagcccattttgagatggaccagttaatgaaaaaaaatccaagaaacaatgaaacgaacgtttaagatccatgatggaaatttgggccaagattataagaagatctcaccacatttcatttgggccgggtgggcgaaacattccgggtgatcgtgtagacccaattttttcggtggaaagtgcaaaaaaaatgcaattggtggatgtcgtcgcggttcgaccccaagggatttggccggtaaaattattgggagttgtctttctcttgcactctctctagttccaaaccctagcaattcctctgttttcaccattttcggagattatcaccttctccccgattcgccgccttgtgattacatctacgtaaagagtttctggtagaaattttccctcttttagctgcagattggcatcagattccgttctggatgtgtcggtgatcgattttccgcgtcggtgatg

SEQ ID NO: 33781 - DNA, 3003 bp, Unknown
  misc_feature (1)..( 3003): 2750-1469P.txt file - cDNA_ID_3072217; gDNA_ID_2926202; Annot_ID_201947
cttgcttgtgtatcgcaatatatcattgatcgcactcctctgttcagcagaagaatgattattgtacgactggtagagtaaatgaatgagtaaacaatcttttcgggtttaagcaatgaatgattatataccatggcgaatgtacgaagagcgccatggacaactagattggtcatgataccgatgatataagaagtgaggccaatgttgaaaagcatgtagaacatgttgaatgtcttctcacggctattaactgcatgcaaatcaccgtaacccacggtagtgagtgtgacaatggaccagtacattgagtaagtgtaccctaaccatacacttctttccttaaaatcctcaacttgcgatcctatccatgtatccgtaggccttggataatggtaggctatccagtataaaatgcaacccgccaaatgtatccaaaatatcgttacctgaatcaaatttcacaatttgaataaaagtcatagattgacatagccaatttagtgattgtatggaccacatatagataattcaatataagtaaaacttacacatagaagtttgatgactcggatcacgaaatagttgaaatgtgcgtctttctctagtctgttaaaaaaagaaagaaaggaagtgtaaaatagacacacacatatgtactatatgataagtggatttcaatattgcatattatatagaaagtagtaaagaaaaaaccttttaaagagttcggctacacgacggagacgccagaggcggagtaaattaaggaagccgaaagcttggcctcgtccgacatctccggtaatagttttataaatgaattgaatgggtaacgttgatgctacgtccatcacaaaagccacgctcttcaagtacctataataatgcacaacatatataattcaattctaacttattcattttacttatgttatttttttaacatataaaaacaaattgatttgttaccgtttggcgatgagcttgtggtcggtgacattgaggtaagtagtattatccaagtaggaaacaaaaaaggtgaggatgatatcaacggcgaagaagaagtcaacgacgagatcaatggtcaataacgctccttcggcagctttctcgaaagccaactcgaacaaagatgcccacgccgaatacccaaccaatatcaccaaaaacaattcccacaacctaccattaatttttatatggaaagattaaaaaaaaattaagatatatgaatattaataagaaataacaattttaagacgtaaaaatatgaaaattaatgaacgaatcatttgatcattaatttatggactaatagaaacagaaaagttatgaaatctgtaaatcactatttattgtttgataaccaaaaaacatttcttcgttgtttagttagtgagaaatgaacctgtaacgacgatcaaagtgaagaacgatgaaaggtttggaagaaggattatcatcttcgatgaaagtcccaaaagcaggcaagagactgctcgaaactgacgttatgttcctcacatctttgctcgatcttcttctgaactgcagtatcgataacggcgatcttgcttccgccgtcgacgccgataacgccgtcgaagaccttcctcttctcaacaacaacggcaacggtgatctcgcctcagtagtcgtcgtagacattcttttttccttcttcttcttctctctcttcttcaagcttgatgatatatacttccctcttttgtctctttcatttataccttttttttttagttttgaattattaaagaggtgtttagatgatcaagaaggtggtgagcaaattaagttgacttttttttttactggtttttgttttccctatattttttggaaaaaaagaatataacaatactataaaacaaatttacttaaccatctaataaattataatttttcaagattgtagtatgatgaattttactctttatatattcaactttgttgttatatatgcagaaggcttcatcgacttttttgactcttatttacgtctctgtgtgtatttaatgtggcatcaggtgtagtgattacaatcgagatctacaatatcagggggataaggtttttttttttttttttcttacgataaattatgtaataattagctgtttaaatactggagttgaaaaaattgaggaactcaaaagtcaaatcttgacgtcttttttgttgttgttattaaatgagaccgtgacaggaatagtagtgttgaaaacaaaacgaacaataataaacaaatgaattacgtatcaatatctatcatcagtcagaatttagtatgtttttaatacaatcatttcagtttttttgagataacatatcatatatatatacttctttccactttccagtgttggatgtgcatgtttacaatttttttaaaaaattctaaggaaaacaatgttttgaaattctaagatacgtttaggtaatacatgaagggggatacactttgtcttcgtcccttaattagctcctatgaagaatttcacatacacaaattaagaagatgcatgcaataacaaggctaaagccatttcttaatagttcatttgtacataaagtaagtttgtgtatgttaaaaaaaaattgtgtatgtactgatgtacagtatgttgttgattgttgatacgtaaaaccaaatagtcaaatactatacatttttacgtttgctcgtataaattaggaaacgaaagcataattgttacggataaaaaaacacgaaaatcaattaatgaaacaaaacccttttgtaaaaaagcccatttttatggaagcccattttgagatggaccagttaatgaaaaaaaatccaagaaacaatgaaacgaacgtttaagatccatgatggaaatttgggccaagattataagaagatctcaccacatttcatttgggccgggtgggcgaaacattccgggtgatcgtgtagacccaattttttcggtggaaagtgcaaaaaaaatg

SEQ ID NO: 33782 - DNA, 3000 bp, Unknown; identical to SEQ ID NO: 3950
  misc_feature (1)..( 3000): 2750-1469P.txt file - cDNA_ID_3072232; gDNA_ID_1620675; Annot_ID_164236

SEQ ID NO: 33783 - DNA, 3003 bp, Unknown; identical to SEQ ID NO: 17121
  misc_feature (1)..( 3003): 2750-1469P.txt file - cDNA_ID_3072232; gDNA_ID_2926203; Annot_ID_201971

SEQ ID NO: 33784 - DNA, 3000 bp, Unknown
  misc_feature (1)..( 3000): 2750-1469P.txt file - cDNA_ID_3072236; gDNA_ID_1620675; Annot_ID_164234
tgatcaattttgttggattttcttaaacagggaaaaaggttggtaggagtactgaattgttgaagctggaagatttgattgagcaacttaatgctagaacagtagctgcgtcacctttctcctatgatgttaaaagggaagacgtggaatcctttttcagtcagtatggaaaggtaatccactatcgattgaatcataagccattgttcaaaatttagattggttatacaagtttttggtatatgtatgtgtcgtccttgcaggttaatagtgtgaggatgcctcgtcatgttgcagagtcgaggatattttctggtgttgccttggttgagttccctacagaagaggatgcccagaatgttatgaagcagaatttggtctttgctggtcaggagttggagctgaaaccaaagtaatcatacttagacatgaaaacatgtcctgtttgctgactgtttctcattttacaagtctttccattgaatgtttggatgggttacttaaaaggtgatatattcttttcaggaaagagtttgataatgaaagggagaaggatgaagtaaaatttgctaattaccaacctcagaagggatctgcaaatcagaagaatggttctgatcacaaaaacaattctgcttatgagccagagtaggggtttgactgttgctatctaattacttgtcttttcatgctaataatcctcttgatctgattatggctattttatcgtattgtagttatcccaagggtttgatcatttcattcaccctcaagcgttcagctgaagagggtaccacggaacaaaaaagttctgaggagccaactgataagacaatggaagaaagtgaaacaaagccagcagatactcctgatgctgataaagaaaacactggtgaggttcaggccgagggagcagaggatgaagatgatgagaaagaagaaaagggtgctctagccacccataaagataataaggatgttgtcttacgtgaagatcttaaggctgttttcggaaaatttggtgatgtcaaggtactacttgagttttacttagctgtctgtcaacatgaatcagattcaatatctcatataactgacatcattttcactgattcctttattctttttgttgtgaagtttgttgatttcaagatgggatctgagacgggttatcttaggtttgatgaacctgaagcatcccagaaagcccgtgcagcagcagtattagccaatgaaggtggactagccgtgaagaattttattgctgtcctagaacctgttattggtaaaaacaccttttcaacttcaatcttatcttataactaaaccttgtgttctgctttagttaaatggtcacttgtttatattgctctctgtcaggcgaagctgaaaaggagtattggactctcctacgaagcaaagatcggtttgacaagggtggccgtggaggaaggtgagttcatgtttttgttctggtttctttgttatgattttgtttcaaatgaagtttttgtttggttcttcagataataatatacttggtctatgcaggggaggaagaagaggagggagattcgggagaaagaggggatcagattcaccgggtggtcgctggaacaaatctcagaaggtggaagcatgagagatttcgctcgtgactgcttctgtttttcaatatatttctagttgcaactttaaatttaatgtatcgactggtgactcgtgatgttataactagaaatagctgcttatttggcaaattttggtttagtcatatttggtattgttttgtttagctttatgtgccttcttatgcacacatctctttccttaattattttaaatcgatgtttaggaagcattctaaaagacaaactattaatattaactgctaaaagtatattcctgtaaattctacaactgtatcaattgactcactgatgatgacactattttacttgaagtagttaaaattaattttgaaaatcaaatagttttggtattcttcttggtcttctcgtttgactttgtctacattgttattaggtttttatgctgattttagaattagctgttactggcaatttcatcttcttcctttttaatgagaaaaaaactcttctttcatacaaagaatgctttgccgttgtttagaagaagaagcaacagagaatctcgaaagaaaaatgaatgaagaaacgtataaataaataaattgaacttttatgatatgagagactaaaaagcgagattcagagattgaaatcaacggctgagatcactttcctttttgttttgatctctctctctctctctctctctcacttcgaattccgtccgcctctccatgtttgagttttgaatacctctctctctctctctcattctctctctctctctctctctctctctctctctctctctctctctctcgacttcgatttcgatttgtgttcttcttcttcttcatctggattctcagcgtcttaattacttcagattaattttggaattcgttgatctgcaaggtgtgagctttactcgtatgacctcgtctccttctcttattatggtcacatttttgttagttttcacggagacttcttcctgatttttcaaaaatctactctttgaacttctcttactttttttcgtataaagtttcgattttcttcagatgatgttcgaagcttttttctcgaggtttttgttttgggttctgaaactaattcgggcttcttatcttaggtttttttggatccaatctcaatatctaaagctaccttcttcattctgtgaacttcttccttgttttgactttagtttgctcttttgctgtgaagctaatgctgattcttagtctgagtccgactgtgtttttaattttatggtttatctttgtttcaaattacagcaatgtgcttcgcttatgatgatttctaagacatatcaaagaaacggactttggggtttttcatattgctttccttgctaactatg

SEQ ID NO: 33785 - DNA, 3000 bp, Unknown; identical to SEQ ID NO: 3938
  misc_feature (1)..( 3000): 2750-1469P.txt file - cDNA_ID_3072240; gDNA_ID_1620675; Annot_ID_164230

SEQ ID NO: 33786 - DNA, 3000 bp, Unknown; identical to SEQ ID NO: 3978
  misc_feature (1)..( 3000): 2750-1469P.txt file - cDNA_ID_3072252; gDNA_ID_1620677; Annot_ID_164287

SEQ ID NO: 33787 - DNA, 3003 bp, Unknown; identical to SEQ ID NO: 19595
  misc_feature (1)..( 3003): 2750-1469P.txt file - cDNA_ID_3072256; gDNA_ID_1620677; Annot_ID_164284

SEQ ID NO: 33788 - DNA, 3003 bp, Unknown; identical to SEQ ID NO: 19595
  misc_feature (1)..( 3003): 2750-1469P.txt file - cDNA_ID_3072256; gDNA_ID_2926204; Annot_ID_202034

SEQ ID NO: 33789 - DNA, 3000 bp, Unknown; identical to SEQ ID NO: 21157
  misc_feature (1)..( 3000): 2750-1469P.txt file - cDNA_ID_3072260; gDNA_ID_1620677; Annot_ID_164278

SEQ ID NO: 33790 - DNA, 2381 bp, Unknown; identical to SEQ ID NO: 21158
  misc_feature (1)..( 2381): 2750-1469P.txt file - cDNA_ID_3072260; gDNA_ID_2926203; Annot_ID_202013

SEQ ID NO: 33791 - DNA, 3000 bp, Unknown; identical to SEQ ID NO: 21157
  misc_feature (1)..( 3000): 2750-1469P.txt file - cDNA_ID_3072260; gDNA_ID_2926204; Annot_ID_202028

SEQ ID NO: 33792 - DNA, 3000 bp, Unknown; identical to SEQ ID NO: 3963
  misc_feature (1)..( 3000): 2750-1469P.txt file - cDNA_ID_3072264; gDNA_ID_1620677; Annot_ID_164275

SEQ ID NO: 33793 - DNA, 3000 bp, Unknown; identical to SEQ ID NO: 3963
  misc_feature (1)..( 3000): 2750-1469P.txt file - cDNA_ID_3072264; gDNA_ID_2926203; Annot_ID_202010

SEQ ID NO: 33794 - DNA, 3000 bp, Unknown; identical to SEQ ID NO: 3765
  misc_feature (1)..( 3000): 2750-1469P.txt file - cDNA_ID_3072275; gDNA_ID_1620677; Annot_ID_164263

SEQ ID NO: 33795 - DNA, 3000 bp, Unknown; identical to SEQ ID NO: 23909
  misc_feature (1)..( 3000): 2750-1469P.txt file - cDNA_ID_3072292; gDNA_ID_1620678; Annot_ID_164317

SEQ ID NO: 33796 - DNA, 3000 bp, Unknown
  misc_feature (1)..( 3000): 2750-1469P.txt file - cDNA_ID_3072292; gDNA_ID_2926213; Annot_ID_202768
ggcaattacggtgacggtggcaacaaattatagattaaaacgagccaaaatagaagaaagtgccaacaaatccgtgtgggcaccaatccaaagtggcaaaatcaatcaaccagctgtcctctccctctaacttccgatcaaagactctctttttttttgtttacgttttcttttcctcattctccttgtcttattttgattgcattatattgaacttgagtttaatcatttttcattattaaggttatttatttatagacgcatgatgcatcaagtcataataatttcacccgtgatgatcacataataatactaatccaagactccatgtgtcgtaccccaaaaatttatctcaattatactatgtaccttatattgtgctatttttttaactaataatttcccgacaatttagtagttggaaatttctcgaccgtgtgatataatctataatataaaatatcataattattaaacaatgataaaatttgtgagcgacattggtatcaatttcaaatccaattattatgttgacacaagactagtgatttatagtataaccaatttaatgtctaacgtaaaaacaattactattaattgattttctatatctgatcatatgttcaacaaaacacatgctaatctacccaccattggcgaataaatttattgcagaatataacaggagaaaaatgccaagaaaaaaaaatccttataaaaacgcacaagaaaaaagtaaaagagctattctgtaaaataaaaatgaaaaaagtattgaatcctacattaatagatacaggatatgatgttctgtttctcaacggctacatctgtctgtgatccttttttaatccaacgatccagatctctcctcatcgcctatataaaactcacttctcttacatcaaacaaacaacacgcttggttaaactccatcagtactttaaccatcacttcaaagttcaaactcttttttttttttttgtttgatccaaattttaacaaaattatggatcgcaatttcctcctaacagttacattgatctgcattgtcgtcgccggtgtcggtggccaatctcctatctcttctccgaccaaatctcccaccactccttctgctccaactacttcccctactaaatcccccgccgttacttctcccactacggctccggcgaaaactccaactgcttcggcttcttcaccggttgagtcaccaaaatctccggctcctgttagcgagtcgtctccaccaccgacacctgttccagagagctctcctccggttcctgcaccaatggtttcttctccagtgagctctccaccggttccagcaccagtagctgattctcctccagctccggtagccgctccggttgctgatgtaccggctcctgctccaagcaagcataagaagactacaaagaaatcgaaaaagcatcaagctgcacctgctccggctccggaacttctcggtccacctgcaccaccgactgaatctcccggacctaactccgacgctttttctcccggtccttccgccgacgatcaggtacattagcttatatcaacaatgttgatatttatctaccgtcacaagttcgagtatcaatgttaaaaataaccaatgagacatttcaaaacagtgaacatagattttcaatttttgttatattgatttagtaattacatattcgattaactaaaatgaaaatatggaattgaatgcagagcggagcagcgagcacaagggtgttgaggaatgtagcggtgggagcggttgcaaccgcatgggccgttctcgttatggcattctaaattatttatcatttcacctctgatattttttagtttttatatttttgaccctaccattgtctctttctttacgaatttggtaatgagtattatttaattgattatacagtttgttttcttttattttatttatatggaaataataagaattcatatctgtcagtgatgaaaatactgttttacacattgattgttcttttcttttgcagacaaaagtcctttagtgatgggtccgagttctttattgaaaatgacacattcaattttaatgcagaattatggacatttactctaaaataaaatgtttgtgtaagtaacgtctatgtaacaataagcaaagcagttacataatttgttttagtcttttaaatgtttaaagtgttagtaaatcaaatgttgatatttacgtttgaaaccaattacatgtgtttctttaaacaaatatttacaattggagtataattatgcgagaatgaaagtgtcagctacttagttggatcttagtcttttataatgtgaagttggtaaatatttattgaattcatatctgatacccaactcaagtggccaagttgctataaatgaattgtctaaaatttattactaaacatgtatagatccaaccaatcatataatacaatgctttttattgtacctttcaaatagctagattcatatttttgtcttgttccttagagaactagatttgaaaaagaaaaaaattaatggatatctaatatggtaggcaaaaagaaagtgagaatagaggacaagtcatattccccatgcttttattaaaagtacattactcaactgtgaagaaatggctaagattttgtaagtaaagcacaagttatacttgaaccaaggtcttgtgtagagattcaagattcttggctttgcaaagacacaaacccaccaagccaagtctctgattccacacaccaatacaaatttgtatataaacataacattttcttcttcctaaagactaacttctagacaatatgggtagttcaatgggctttctcggaaaaggttttgcaattttttaacctaacaattatcgactcaaatcgttatataaccgttttgacaaattttcgtcctatatatctttctaaatagatttcgatatttggcctaggggtaccaccgacgcagatgatgaatatggtaatg

SEQ ID NO: 33797 - DNA, 3003 bp, Unknown; identical to SEQ ID NO: 19613
  misc_feature (1)..( 3003): 2750-1469P.txt file - cDNA_ID_3072295; gDNA_ID_1620678; Annot_ID_164315

SEQ ID NO: 33798 - DNA, 3003 bp, Unknown; identical to SEQ ID NO: 17798
  misc_feature (1)..( 3003): 2750-1469P.txt file - cDNA_ID_3072305; gDNA_ID_1621088; Annot_ID_170537

SEQ ID NO: 33799 - DNA, 3000 bp, Unknown; identical to SEQ ID NO: 4007
  misc_feature (1)..( 3000): 2750-1469P.txt file - cDNA_ID_3072305; gDNA_ID_1620678; Annot_ID_164303

SEQ ID NO: 33800 - DNA, 3000 bp, Unknown; identical to SEQ ID NO: 4007
  misc_feature (1)..( 3000): 2750-1469P.txt file - cDNA_ID_3072305; gDNA_ID_2926213; Annot_ID_202755

SEQ ID NO: 33801 - DNA, 3000 bp, Unknown; identical to SEQ ID NO: 4015
  misc_feature (1)..( 3000): 2750-1469P.txt file - cDNA_ID_3072311; gDNA_ID_1620679; Annot_ID_164355

SEQ ID NO: 33802 - DNA, 3000 bp, Unknown; identical to SEQ ID NO: 4015
  misc_feature (1)..( 3000): 2750-1469P.txt file - cDNA_ID_3072311; gDNA_ID_2926197; Annot_ID_201532

SEQ ID NO: 33803 - DNA, 3000 bp, Unknown; identical to SEQ ID NO: 4020
  misc_feature (1)..( 3000): 2750-1469P.txt file - cDNA_ID_3072336; gDNA_ID_1620679; Annot_ID_164360

SEQ ID NO: 33804 - DNA, 3000 bp, Unknown; identical to SEQ ID NO: 4020
  misc_feature (1)..( 3000): 2750-1469P.txt file - cDNA_ID_3072336; gDNA_ID_2926197; Annot_ID_201537

SEQ ID NO: 33805 - DNA, 3000 bp, Unknown; identical to SEQ ID NO: 4047
  misc_feature (1)..( 3000): 2750-1469P.txt file - cDNA_ID_3072369; gDNA_ID_1620680; Annot_ID_164418

SEQ ID NO: 33806 - DNA, 3003 bp, Unknown
  misc_feature (1)..( 3003): 2750-1469P.txt file - cDNA_ID_3072382; gDNA_ID_1620680; Annot_ID_164390
tgacagaacataactacatttcaaactccaaacttacgaaaacacacaagttttttctggaatctttcaagttttatttgatgtttcggaagaactaaattggggttttatctagtggtagacaaaaaggaaaaagatgagtacattttattgggcaatgtgttaactaataaagtttctagatataggcccatagaaaaaccaacttatataaactgtaagcccataaaggcccaaataaaccctaattttaaatccaccgacacatgtataaatgccaagccgtttcatatacgtctccactctgcaactcaggtaaaagactcttgctcctattatctcatgttccattgtttgttgatttcaatttgaaatattagtttctttcttcttcccttcattccttcaacttttataccattttcctgttatctattgatttgaaagttttaatttttaagaggcggtgatgacaaaaaacatttctcgatgctgaaacttactcgagagaccaaatcactcttgtaatctttcgtgatgcttgtttttatgcgtgtctgagcctaaaccaaaaaatctttcatttatgctttgattatcatagatcccaatttatgcgtttcttttattgcttttcaatttgtaatgcgagttttgctttattttgtccagccatggaagaagcagatcagttatgtttagctgctaaatccggcgacttgaaaaaggttcaaactttaatttactccggcgccgacgttactcactttgataacgacggtttaacgccgttaatgcacgccgctaaaatcggaaacgcagagatagtaacggcgttactcgaatccggagctccatggaacgcattatctccatcaaatctctcagcaggagatttcgccatggaagcaggacatcaagaaactttcgatcttcttctcaaaaccgggatccaatcagagctaatcttaggaacaatcgcaagaaaccaaacaaagaacgaatattctaatcaagaatatcttcaagacagagttagtttcagtgaagacaagttaatggatagtgaaagcaaaggtgtgatgatggcttgggaaaaaccattaatggaagctcacgctaaagctatttgtctcaacggtggtcacattcttaacgttggtttcggtatgggacttgtcgatacagcgattcaacgatacaatccggttaaacacacgatcattgaagctcatcctgaagtttataagcgtatgattgaatctggttggggagagaaagagaatgtgaagattgtttttggaagatggcaagatgttcttgataagcttgatgataattcttttgatgggatcttttttgatacttatggtgagtattatgaagatttaagagagtttcatcagcatcttccgaggctgttgaagcctgatggtgtttattcgtatttcaatgggttttgtggaagcaacgcgttttttcatgttgtgtattgcaatttggtgactttggagattgagaatttagggtttagcactcagttgattccattgccggttaaggattgtcttggggatgaagtttgggaaggtgtcaagcaaaagtattggcagcttgatacttattatctccctgtttgtcagtttagtgactgaagaagttttatgataccagcaattttgcgatattgtaatttttcttactcataaaaagtagattttttatccatttgaaaatagtcatagtcatccaataagaagaaaagaacagtaataagtgtataacataagatcccatagtcatgtgataggaaccaagagccagactaattctgttacaaatatcttaagaaacaaaagtactaattaaaacatgttatgcagaagcttcacgttttctacatggtctaaatatgtgaagactaagtgaccctgaaacgcttccattccttgtattgcaacgctcatcatcgtctttctctcaatattgaagtagtagacgtcgaaaggcactgtttgatagcacggcgacaacataatctcatttgtacgagtcactccaacaaagcgtaaattcagggttccaatcctatgctgccaccaagcgggtaatacgtacgtatgcttcgaccattccttcttttcagcatcttgtagaacccacaactcaatactcttactacgtccatcaacaaagcaatatctttcagaaacaagtgaagctaatttaccattgtagtttataagagttccatcatgcgctgctttaatgaactcttccatgactgtaataaatctaaacttctctgacctaacatcgaagcaaacgataatgtaatcccctgaagacaaattgatcgctggataatacaacacaccattgatgcatatctcagacattccaagaatgtgaggcatggaacattcgatgattctccatgacagttctccagttcctagtgtcagaacttgatgctcatcacttttatatgacaacaataccttgaactgtttctgaatcggttcatacacgaaaaatcttgacggcccaatactcgtcttcattggtttaggtaagcttaaggtatgtccagtgctgggattacatatcactgtcactgtttcgttcatttccttgcgtttaaaacagatcaagccattgacaggacgcgaaattttatagcataaggagaaattctttagagaaatggcggacgagttctcatatggattttgaagctgaggagacgagaagaagaacaagttaccatcttttttgcagcagaataagagttgcggtcgatgcaaagatcgggtcaagaacagctctgtgaaatcttgacggcaaattacggagatccagagtttcgacacgcaacgacatgtcgctatagattttgccggtaatctcaggagtatctcgatgatgatatcaactgggatctggactgacttttctgttttattcggtgaggtcttcttctccgttctacgccgggagatg

SEQ ID NO: 33807 - DNA, 3003 bp, Unknown
  misc_feature (1)..( 3003): 2750-1469P.txt file - cDNA_ID_3072393; gDNA_ID_1620454; Annot_ID_157592
gagagtaatattaatctaacataaacaaccatagttctcttgaattttgaactacgaattttggttttaaaaaacagctgagaatttgaatatcttgagcaatctgcatctgattttgatttctgacatcctgattaaaagtggtttcagatttgattctgaaccgaagaaataggcggcttcttatttatcgttaagtttaatattaaacgttgtattgctctttaagtatctttaaaacctcgtttacttcgtgttattattcaattttgttataacaaacaaattttgatacgttgctctcttcttctttgactaaaaaaacacatgttggtacgtaggttggattttgagagctaattaaatagttaagatgatggaaatagcttatcagcctcggattgattccgagattgaatcactcgtcgagagaatcaatcctccaaggttagtaccttattaatatttttatcattatgttggatattttttttttaataaagtagtattattcttgatattactggttttgtgcgctaattagggtttgtgtagacaacgactctgacccagagtgcacacttattaaggttataaaaagctcttgataatatgctttttaattataagttcatagataatgactaattagccttaattaaacatgtggttgatatatgtaggtagatagcgcgaacaagtacgggatattactggacatggttcaagtgttagccgatcttgatctcgttatctccaaatgttacatctcatctgatggcgaatggttcatggatggtaagtcgtcatcgtcatcatcattcacatgtcatcatggtggaccatatatcacatgacacctgaaatttctctttgttagtgtttcacgtgacagaccaactcgggaataagctcaccgaccgaagccttattctctacattcaacaggtgtgagattaaaatcattagtacaataatcacctaatcatttttaaggaaaatagtataaaattaccaagtaaccgaaaaaatcattaactaagatgaccaactcttataatgtgacagcttcgtttatttatgtttctttttgggtacttttggacgtatctaattagcttcttgagtttacttgtgaaattaatacatttcatttttaatgatttttggtttttacaaattcaggcaatatgttctagtagaacgggaggtataacaaaggagatgcagagtaatctaaaacgggaggtgcaacagcgccacgtgtcaacagaacacacggcctttgagataaccggaatcaatagaccgggtctactatccgaaatatctgccgtactttccgacattggatgtcacgtgacggctgctgttgcatggacccaccacgagcgagcggctatggtgatttatctagaagacgggtttaacggtgggcccattatcgacccaataagaaaggcccaagtaaaggatcatctggatacagtcatggaggcccatcacatagttggcgatgtgtctcatgtcgtcgtgagggtcgtcgaggctaaaggagttccggtcgggtgggctcacactgagcgacgacttcacgagctaatgtacggagaaggagattacgagaattgcttcgactgcgattgtttcggagacaggtgcgcttgaatttatacgaattaatcatcaatggcaaaataaaaatgttgtttagcttcgttcgatacatgtgacaggtgcgatgctttgtggagaggaagatgcgagaggatacacgtgacaatcgaagcatgtaatggctattcaatggtgaatgttaagtgtagagacagaccaaaactacttttcgacacggtgtgtgctttgaaagagttacaattcgttgtgtttcacgccgtcgccggagctaaaggctccactgcagagcaagaatatttcataagaaagaagaacgggggcacgttagaaacggaagggcaaagagagagactaaggcattgtttggttgctgcgatttcgagacgtgcttcacaaggattgaaactcgagattcggacagagaacaagatgggtttgttgtcggatgtgactagagttgtgagagaaaacggtttatcgataacgagagctgagatgtgcacgcaaggtgagattgcggttggctcgttttatgttacggatgtgaatggtggtgagacgggtcctagtgaggttgaagcggttgtacgagaattgggaggagcggttgtgtcagcggttaaaggggttggaatgatgccgaggaggattggttcgacgagtgatagtgtggagcaggacaaagctaagtcgtctattgggagaatgttttggtctaaattagagaggttgtcaacgtctataagatcgttgtgaagtgtttgattagtggtttttgcctctctggttctcgtgattatcgatcgttgtatatatagatgaactaggactatttgcagattcaattgaaattcgtataattattggttttagatgtgatctaatgagataagattctatcaatcaaaaccgttacttatcgtcttaatttgttcgaatgaatcttaatctcacaaaccaaacattataccgtcttaattgaactggaatttgttcggtttttacaaatatgagagaccaaacattatataccgttttattcaagttgtgagagattgtaaattgtagacccaatttcggtttggtttagctattgaatttgacagctggcatggataaagaacaattactttacagtaattaacaagtcaataaaagggcattacgggaaatttaaatattgaaatgaaaatagagagatctttataaaccctaatgtgacggtaaacagtaatacattagaacactctcgaattcgaagaaaatacgtagcaaaacccttatttttgaatttcagacgaattccgatttcttaatcaaaaatccgataagagctttggatttggcggcgaataagaaaacatg

SEQ ID NO: 33808 - DNA, 3000 bp, Unknown; identical to SEQ ID NO: 4030
  misc_feature (1)..( 3000): 2750-1469P.txt file - cDNA_ID_3072393; gDNA_ID_1620680; Annot_ID_164382

SEQ ID NO: 33809 - DNA, 3000 bp, Unknown; identical to SEQ ID NO: 1835
  misc_feature (1)..( 3000): 2750-1469P.txt file - cDNA_ID_3072397; gDNA_ID_1620454; Annot_ID_157593

SEQ ID NO: 33810 - DNA, 3003 bp, Unknown
  misc_feature (1)..( 3003): 2750-1469P.txt file - cDNA_ID_3072397; gDNA_ID_1620680; Annot_ID_164381
acaaattcatttacttttttgttctgttccgagatttcaaggttcactatcgattctgaaactcttggaacaatccagattcttggttagcaggtggggaagcattaatcatgtatttatgatacactgctccattattattacgagagagttgaaagtttcctttttgactcgtttttaaaggcaaggaagaagaaagactttgtttttaaaatgccaatgtttcagccttctaagaacggtgggtttgatgggcatatcttagatctacactcggcggttaaagacggtgttcttggcggcggagatgggaaatttctggtggttgttaccgatgagaagaagaaattggatttgaaggagatgatttctgagctggaattacctgaaataccctctgttttcatctgtcctatctctctagagccgatgcaagatccagtgaccttgtgtactggtcaaacctacgagaggtccaacattctcaaatggttcaatatagggcattgtacttgcccaacgacgatgcaagagctttgggatgatttggtcactcctaacaagactcttcaccaattgatctacacttggttttcacagaagtatgttttgatgaagaaacgatctgaagatgtgcaaggacgtgctattgagattctgggtacgttgagaaaggctaaagggaaagcaaaggttcatgctttaagcgagcttaagcaagttgtgatggctcacgctattgctaagaagactgttgttgatgaaggtggagtctttgtgatctcttctcttttaagtccttttacttctcacgctgttggatctgaggctatagctattcttgttaatcttgagcttgactctgattccaaagctggattgatgcaaccagctagggtctcgttgatggttgatatgttgaatgatggttcgattgaaactaagatcaattgtgctagattgattggaaggttggtggaggagaaaggttttagagcagagcttgtttctagtcatagtttgcttgttggattaatgagattggttaaagataggagacgaagaaacggcgtttcgcctgcgttaacgctgctcaaatcggtttctgttcataaacaagttaggaacttgttggttaggattggtgcagttcctcaattggttgatgttttgccatgtttggatgtggagtgtttagagtcagctcttttcgtgttggattcgttatgtttagaaagcgaaggcagaattgctttgaaagattcggttaacacgattccgcataccgttaggttactgatgaaggtatcagagaaatgcacaaactatgcgatatcgattctttggtcagtttgcaaattagcttctgaagaatgttcatctcttgctgttgaagttggtttggctgcaaagcttttgcttgtgatacaaagtggatgtgatccagctttgaagcaacgttcagctgagctattgaagttatgtagtctacattattcagactcaatgtttatctccaaatgtaaactcacaagaactatccaataaaagactgatcaagttttcacctttcgggtcaaaatcacacaacggatctgccccatcttgttgatgtatatagaaatgaagaagctcaaggagtatgagagtaagaaacgagtttcgatgtgttgaattctattttgcaatgttatttgaataataatagttaagtagaagtaaactgtataaatctttttgttgtggttggttcattattcagtagaagaatagattgaagaaaggaatcatttttttggcctcttgtaagttactagctgtttgtgagtcataataattggagaaattattgatctatgaatcgttttatttgacactcttataacccttagtgattcttgatagaacagtaggattagaaaacagatatgggtgggtttcagatttgtggaggggaataaaagtcttattttttgaacatgcattggtctgatttgtatgcactgtgtaaatgaatgaacaattgaaaagaaaggatgatttgacttatgaatcgtttcaacagttcactgtttgtttatctctgttttttatttaattggctatgagaatctgaacatatctcttggaaacattgtatcagtgagtgtgatgtcactgatgtgagagctcttgtctggaaataaaatctaaacacagttaccaaatctggaaaacaatttgtctcaagttagaaaaaataaaatataaataatttcccgaataggagctatcttaagatgggccttagttgaactatatgggctattatccaggtccagtaatattttgacagtcaatacaaaatgtcgtctttggctctaaattggattaagctattaagtaagataaagattacaatatttaaattagatattgatttagacggagatttcattatctatctctcaagtttgatttgcttctgctgtaacaaaaagatcacgatcgcaacttgtgtgtatgtgtgtgtgagagagagattcagatatggcttggttagctagatccatagcgaactcactcaagctcgatgaggaagatgaagatgatgataagcatctgaatcaacagccgtcggaatctgtatcggattcacagtctccacgaggcgttaaggaagacattagcgaacttaccaagaccttgagaacccaattttggggtgtagcttcgttcctctcgcaaccttcttcatctccggatcttcaggagagaaatcaaactcccgatcatccggaggaagatgaggatctaatcgctgggattaagaacgatttcgctgagattggtgggagattcaggactgggatttcgaaactatctgggaacttacctgtgtctgagttcacaaagatcgcttcgaatttcttacaattgagttcagaagatgtggatccgaaagattacgacgtaatcggagttacagaggaattagttgcgtttgtgaaggatcttgcgatg

SEQ ID NO: 33811 - DNA, 1207 bp, Unknown; identical to SEQ ID NO: 4029
  misc_feature (1)..( 1207): 2750-1469P.txt file - cDNA_ID_3072402; gDNA_ID_1620680; Annot_ID_164379

SEQ ID NO: 33812 - DNA, 3003 bp, Unknown
  misc_feature (1)..( 3003): 2750-1469P.txt file - cDNA_ID_3072438; gDNA_ID_1620681; Annot_ID_164455
tataattccattgaacatttaaacttcattaacaacttctaatttgcacaatgtcctttgtattgttttcctgataattttctttccacagaaaaagcttgaagagatggtggaatgcgaactaaattttccaagttttcaggtacaatttaacactagttctcgctactaataatccttacatctgcataggattttgtgataaattagatttgtttattgccacaggaagctatatcggtaccatggaaaccgattcctcggagaacagcaaagctctactttgctatgagaggtagttactagttactacagctgatttctttattactttccacaaatgaaaattgagatcccaaggcagatacatacaacaaaaattcttcactaatctttggcattctcatgaaattttcagtaatagaagtgtttgaagagagtgaagggcgtaaacatggagaatgttcgctactcgatcttgccagagtcttggaaatcaaaaagcaactctgtgaggcaaacgtaagtgtgtttagttgttttatcattatttagaaatgtcactgccaggttcactgaataactgaatattgtctctcagtctgtgagcgagagccatataccagatattctcttggagagacttatcactggtactactgaattcccgccagtttgtgccattgtgggaggaatattagcacaggttctctctctctcactttcactctcttatcgcattcgaatcttctcactagaaacttgtaatttgacaagaaagattttttgatgtggcaggaggtgatcaaagcagtatcaggcaaaggagacccgttgaaaaacttcttctactatgatggtgaagatgggaaaggtgtgatggaagacatttccgactcttttacctcttaaacaaccagtgggccttgatttagtttaaactctataatctctgagattccatgtatatctcaatcgtttgttttttgccttcacattatgaacaaatttaatgcagaatttagtggaggatcagttgtgattttccttcggtaaaatcattttcagttattgacatttgaattgttcaatttcaaatttcaaatattataattcaattcaaagactagctaagtttttaaaagtaattagtgagagatctcacagtgatataaaccacattcattttaattcatagcaaagtaaatggtaagaaatgaaaatggaagaaagagaggagagtagttcacacgaacatctgaaggagaagttgagagagcttgaggaggaatggacagccatgaaaacaggtaaaaactcatctgcggtttcatggattaccgtggaagatgctcttgagtatgtcgaaaactctcccagaaacctaatgctctctctccaacacaaaccaaaggcagagatgatacaagaaatatcgccattaaggagaaaactctttcacgactctgatgatgatgatcaaactaagaagacgacattgctttctcattcatcttgttggtcttcgaatgtgacgagttcgagtgataccacgaaagcaaagaagaagacaacgattagaagatttgtttctgttacaatggtgctgcttttgtcatgggttttagttgtgttgatgaaccactttgatcatctctccatgaatacacaaatcattactttggttcctacttgatatttttatttattttggtttgagaatgttcatcaatctcaataaataaaaaaagtttagttttgtattattacctctcgccttctcttttaattcattgaacctcttcaactttggctgtaactatgttggttaaaacagtataagtaatgtatgtatttatggttttaggaaaatcttacaaaataatactctatcattggatgaagaagcaaaaactacacccctctacatcttttctattcataaacttttttggggaaagaactacattggtggtgattaggtgcatcggtgacactaatgttgaaaatatgttttgtgtaaaattagtatggttaaagctaatcatttagttgagcaaaaaaagatgctaatcatttaaatagaaaatggactcaaacaaaagaaggccacacattcaattgttacatctttattgggttttcatttttggaagctatttttatgaatttgcagtgttttgttgcccaaaagaaaaaaagcataattccaagtatatctttcattttgaatccatcagtcatatgttttacttgaatcaactatttgttgggttttacgaagttacttgttaagaagattcaaaatatatataattagactatcaaaggaacaaaagaatgtaattgggtcataactttttccgaagcttacgtgacttgggagaaaatcaaacccattagtttcacccttaatcaaactaatcacaaattttgaactttgcaaagaaggtaaaataataatcagcaaaaagattaataaaatgacaaaagtatctctttaaaagattaataaagaaataaagaaatgacataagctctcaccgaccgacgtcttgtcttttttattcttaaggtcggtgccatgtcgacgccttcaagcttagaatctcgccacgtgtgggataaactaaccgaacccaatcgaaccagacagaccaaagacagaccagaccggactagttgtatgtcggcatcagcgttctagtacgacgttaattaaaaaaataaaaataaaatattatttatgatattccaccaataagagccaatgaaaagtgtgtgaaccaaccaacttctgtagcaaaccgtaccatttctctcttagatacctttaccttccttctataaattaggttcttcctttcacatttctttgtcttcttcttctacataaaattgattcgcctcgaaatttacacagacttgtcgctctctctttctctcttatttcacagagcccctaaacatttccaaaaatcttgcaaaggaagaaaaacaatg

SEQ ID NO: 33813 - DNA, 3003 bp, Unknown; identical to SEQ ID NO: 33812
  misc_feature (1)..( 3003): 2750-1469P.txt file - cDNA_ID_3072438; gDNA_ID_1620627; Annot_ID_162508

SEQ ID NO: 33814 - DNA, 3003 bp, Unknown; identical to SEQ ID NO: 33812
  misc_feature (1)..( 3003): 2750-1469P.txt file - cDNA_ID_3072438; gDNA_ID_2926186; Annot_ID_200640

SEQ ID NO: 33815 - DNA, 3003 bp, Unknown
  misc_feature (1)..( 3003): 2750-1469P.txt file - cDNA_ID_3072441; gDNA_ID_1620681; Annot_ID_164447
aagtatccgcaaaccagaaatccaagaagattgaagtagaatcttctgttgcaaacaatgtaatgggggcatgcctttcttcaaagtatgattcactgaacgaggtaaagtctccggctccaactgtagctgtgagtctgaatcagaagaagcagcaggagaaaggctagaagcaactcctccaccggctgacaaatccgagcttttcccttgatcaatgagctcaatactctgattgggaagcttacatgacttattagaagcaagtccatccctcagtgactcaacttccttagcagtcagagcctgcaggaaattgcagaacggatgcaccaggaattacttacagtaatctcatacccgtaatcaggaaaatagacaaataagtgtagatgcaaaaactttcctcttgtaaactaacaagcatataaaaaaaaaacagcttatatttaagtaacacatacaatatcttacccccaaaattggatagctgtcaaatattagcaatttcgcctcgaggtcacgggcaagtgctttagctaacgtctcttggtatatttcagaccctgaaacaactccaaccaaaaagcgaaaatgatgtttccggctaaagaagtacaggaaccacacaagcaagataccacaaacctgcgggaccagaaagcaatatccttggattcataggggtcatgtcggagacaaattggacatattcttttttcttcagatgtatatatgaagcatataataaggcagcctttgtatattcactgcaaaaataaagccttagtcagcatacacaaaacagagaacaaatgcaaagcgcctaaactaccaaagacaagaaagcagaattagacctcaaaattctatgatgatataaacagattcttaatggaagattcacatgcacatatcttaacactgcatgaatacctgaaaaaatatatctgacttggtcccatacctcaaataatagggaaaatttttgaatgaaacttccatgttttcgcctctaacaaaaccagcttgaatggcttctctgaatattgcagattgcagaccattgcctgatgttgaagcttgttgtgaattacttgtcacctcgtttttctcatccaatatctgataccagctttgttaatataatgcaaaatgctgttgatgacgccagggtacaagagaaacatagagtatttacctccattttggaatcttggttgttaacagaaaaaattccttccatgccgtcaacttggaccatcgactctggcgcttggtggctcttactggatgcatggatcaatctttcaagcgatgatataattgaatgacctgtcattctctctaggtctagaaactttcctgcaggaacctgaactgaaccaggttttgctgcaactataggcatttgctgatatacctggatagaaattaagggggaaacttatgtatattcctatggagatattcatctcaaaactgaaggaaaatttcttcttgcatataataaaaaaagtggaatcacatgaggatacgaaagcaatcctgcttaaaccaataaccacttcgtcaccagagtttagcacatggttgatattcccctcggcataatttccgtttatccacatatgtccattgtttcccatggtctctagaaccgctaaaacattgcctttgcgctgaacatgtgcacaaacaatgagaatacatactgaataaggagttcacatatctccacaaacaactcaaaagtagaaaaaatcatacgcacaggaattgcataggccagtttaaaatccagcagtgctaatgtttgagcgtaacattcaaggaaacaaaaatacctgaattcttgtgatcttgaacgagtatgaactgagttctccgtctaagaatttgaagactgatagaaaaatgtttatgcttggatactgaaaattcataagtagctcaattttgtcaggatattgcatccacaaaagcattagaaaaataaagacaggaagatccaatagatgcttaattcacctgtgcagactgtgatagcaatcgacaccacgggttctcaaacctactgtgtacatatgtccatctttcaaaacttgccttctcttgcaaaatcgctgttgagtatacaatccaaaccagaaaacaaagacgaattgaaaaaacaatctcaaaaggaatttaaattgggtccaagagcataaagatcgaacaagaataagagcaacggaccttgcgcaacaggtggtggttgcgacgtcgtagcagccgccgcagaggcatcaatctgggagtctccagaggttggagtagtgtcgcctaacacgcatttactagaatccgaaggaggtagtgtatcgccgccatcttccaactgaaacgaaaagtgaaatcgccaaaattgttcaaaccagaagctccagatggcactcgaaagatggataagaaataatgtctccgatcagaaaccttttggcgtttggatggagatttatctgcgggagaagatggagatctcttgccgctgcttccgtcgggcgggttattgttctcgccggaggtagaatcactccgtcccggtgacaccatgactcttctttcttccgattatttcaagagcaagatttgcgattctttgagagttgaagaatcaatgcgagagatgaattttgagagaacgtaacaagaaatgagagagcttatgtaaattggtgtatatataggcctttctcggtgggaaaaaattatagagaaactttgattaatgaaccatacctaaaccaaaccgtttagtattattaggaatcgaattttgtacttaacaaccaaaaccaaaccgatccggttcagttttacccacacctggttttaattttgaaccgcacaaccatccaaattccaaagctagagtctctcagagcgtttttaggtcgaaccagtccttaagggtccgaccaatagaacgtagttgctcgaactcttcttccaaaaatg

SEQ ID NO: 33816 - DNA, 3000 bp, Unknown; identical to SEQ ID NO: 4057
  misc_feature (1)..( 3000): 2750-1469P.txt file - cDNA_ID_3072449; gDNA_ID_1620681; Annot_ID_164445

SEQ ID NO: 33817 - DNA, 3000 bp, Unknown; identical to SEQ ID NO: 4057
  misc_feature (1)..( 3000): 2750-1469P.txt file - cDNA_ID_3072449; gDNA_ID_2926186; Annot_ID_200630

SEQ ID NO: 33818 - DNA, 3000 bp, Unknown; identical to SEQ ID NO: 4056
  misc_feature (1)..( 3000): 2750-1469P.txt file - cDNA_ID_3072453; gDNA_ID_1620681; Annot_ID_164444

SEQ ID NO: 33819 - DNA, 3000 bp, Unknown; identical to SEQ ID NO: 4056
  misc_feature (1)..( 3000): 2750-1469P.txt file - cDNA_ID_3072453; gDNA_ID_2926186; Annot_ID_200629

SEQ ID NO: 33820 - DNA, 3000 bp, Unknown; identical to SEQ ID NO: 19663
  misc_feature (1)..( 3000): 2750-1469P.txt file - cDNA_ID_3072457; gDNA_ID_1620681; Annot_ID_164443

SEQ ID NO: 33821 - DNA, 3000 bp, Unknown; identical to SEQ ID NO: 19663
  misc_feature (1)..( 3000): 2750-1469P.txt file - cDNA_ID_3072457; gDNA_ID_2926186; Annot_ID_200628

SEQ ID NO: 33822 - DNA, 3000 bp, Unknown; identical to SEQ ID NO: 4086
  misc_feature (1)..( 3000): 2750-1469P.txt file - cDNA_ID_3072480; gDNA_ID_1620682; Annot_ID_164511

SEQ ID NO: 33823 - DNA, 3000 bp, Unknown; identical to SEQ ID NO: 4086
  misc_feature (1)..( 3000): 2750-1469P.txt file - cDNA_ID_3072480; gDNA_ID_2926181; Annot_ID_200287

SEQ ID NO: 33824 - DNA, 3003 bp, Unknown; identical to SEQ ID NO: 19683
  misc_feature (1)..( 3003): 2750-1469P.txt file - cDNA_ID_3072490; gDNA_ID_1620682; Annot_ID_164505

SEQ ID NO: 33825 - DNA, 3003 bp, Unknown; identical to SEQ ID NO: 19683
  misc_feature (1)..( 3003): 2750-1469P.txt file - cDNA_ID_3072490; gDNA_ID_2926181; Annot_ID_200281

SEQ ID NO: 33826 - DNA, 3003 bp, Unknown
  misc_feature (1)..( 3003): 2750-1469P.txt file - cDNA_ID_3072509; gDNA_ID_1620682; Annot_ID_48363
tggtgatgattctcatgaatatcttcatatttctaaactattcttatttgggatattagtataactttaaattggtgatgattctcatgaatgttttgatatattaaaatatatatgttcattaaacaacaatttattcatctttatgtttgcattgcagtagtactataccagtctgtcacctttaatattagctaatctgtaagaaatttacattttgatcttgtggatgagatacaatacaagtatacaactatgataaagacttcagagtagacacaaaataccatttgaaactttaaaatctgtatttaacctacaaataatcattattttcctataccacattatgtacaccaaaccaaaccaatatttagatccaccaaaaggaaagtcctgccatttccttttcactttgtacaaactaccaaaagaaaaacttgtaatttgatatttagtcactagagtttctccggatttggagtagcaattccctcagtctgagtcccagagtaaccatttacaccttcattactaagactatgagaccatggaatcgagctaacggttggaaaacaacaactacactcgtccgcacaccgagcctcgggaagagtctcagtcttgtgaccatcaggcgaaacagcttcccaaagcggaccccaacactcgactttgttgaactcattgacattagaatggaaatagacccaaacaagagcttcttgtagctcaggatagttgttcaacaagttcccatctccatgcacaaaagccttcaacacctgtatatatcaaaacaataaacattttgttttacatgaaaccaataaaaagtttcttatgaatttgggaacttaccacaggtagttctttgcaaaagatgaaatatcgaaactttgcaaagagatctaaaaggaaatggccaccgcttatgtgacaatgaacgtgaagcgacattttccctttcactttcttccattctgccacaacttcatcccggtatagcctatttgcccatccttgcaactataaaaaacatttctatacatatcagcctctaaagtgttaagagattctggtgaatatagacacatacataggttaaaacaatcatacataagcctctaatatttgctccaaataatcaaatacataaacattctactcctataaacagagccatgtagatatgttaagaccagagagagaggtgtttttacctgagagttgtttatggattgagaaatagctaaggttagtttagctgtaatgtcactgtgagtgagtgtgtaagtcctagggagcgttgaaggatgcttcttctcatcaacccctaagaagagtactttcaatttggatgattcgaaaatcgccggtccaaacaaccttgcaacctgcaccgatcccaaaagtttcaagttccatcaataaagacagaggcatagatatatccataactgagacacataaaacaaagatatgtcaaaatgattaagagaacaaatccttacgggaacaatcgattggttcttcttcttggatcttctattgttgaagaagagtgagctgctgctgctactgttactccgtttgtctgaataagctggtttcagcttcgttggtaacaacataatcgccgacaaactacacatctctgctctcttgaaacccaaatcaaaagcttcaatatttcagaaataacaacagaacaaaacgccactaaatacagagagactcctttcacgaagcttggatacaattttttcacgcgagttcttgcgtgttcgtacactgaaaccacaatcaaaaagattgtaactttaagaaataaatatataaaagacccaaaatttgagcttttcctttgcttgatgattgcttgaagctttggttttgaattttccttttgagatcttccaggaatttagggttctttgtgatgcgtattgagttggttcttgtgtttaaaagggattgttgcttcacgtttcacacttccgtgcccaaatctgaacactcttttggaatttttctgaacacgagagagtgccacgtgttctctaatctttgcatgagcttccccatgtgtcgtcatggtggggctaacaactggctctaaccgtctttttggataactttagccatctcgttgcgacaaagagacacagattcggctctaaccgaacctaactcacgtactgtagttgtcagtcgaacctaaagcaatacggtttagtttcggttcaatttaatgtcattcgactcgattactcggtttagttattagacctgtgaaactcgagaggcttcttcgcttgaatcgtcgtgaacaaggacaacaaacgcaggtattgatggaaccggaggagtcagagagtcccatgttgatccataaggatgttaaaaagggctgaaatttgtgatcaggtccaggtccattaaaaatatcgggctaaaattgggctggcctgttacagagcttttatttttttcttcttcttttacgttaagcgacgtcgtatcttgtaaacaacaaaacacgagtactgttttttcttcttctttctccttcaatctcttcctcaaatcactctttttggggttcgttttgtttgtgttgtaagcatccctgttgtgcatttcgtttatccaggttcgtattgcttacctaaacaagttcaagttttcgattttggtttctaggtgtttaccagtttcgccattttgtggtttattgtttggataatttgatttctttggattttgctgatacccatttgtgtgtatagaaatttgattaatctggatactaaatttcgtttggagaaacattgaaccaaaggaatgcgaaatcttttgatgatgattgaatagttttagtgcctgctaatactttagaacagagtcaattttttaaggtcatgttatagaatctgagtctacttgtcatttgctttggaacaggtgaattcttgcaaagccttgagcagctttcagatg

SEQ ID NO: 33827 - DNA, 3003 bp, Unknown; identical to SEQ ID NO: 33826
  misc_feature (1)..( 3003): 2750-1469P.txt file - cDNA_ID_3072509; gDNA_ID_1620682; Annot_ID_164489

SEQ ID NO: 33828 - DNA, 3003 bp, Unknown; identical to SEQ ID NO: 33826
  misc_feature (1)..( 3003): 2750-1469P.txt file - cDNA_ID_3072509; gDNA_ID_2926181; Annot_ID_140561

SEQ ID NO: 33829 - DNA, 3003 bp, Unknown; identical to SEQ ID NO: 33826
  misc_feature (1)..( 3003): 2750-1469P.txt file - cDNA_ID_3072509; gDNA_ID_2926181; Annot_ID_200266

SEQ ID NO: 33830 - DNA, 3003 bp, Unknown; identical to SEQ ID NO: 19697
  misc_feature (1)..( 3003): 2750-1469P.txt file - cDNA_ID_3072550; gDNA_ID_1620683; Annot_ID_164544

SEQ ID NO: 33831 - DNA, 3003 bp, Unknown; identical to SEQ ID NO: 19697
  misc_feature (1)..( 3003): 2750-1469P.txt file - cDNA_ID_3072550; gDNA_ID_2926177; Annot_ID_199947

SEQ ID NO: 33832 - DNA, 3003 bp, Unknown
  misc_feature (1)..( 3003): 2750-1469P.txt file - cDNA_ID_3072552; gDNA_ID_1620683; Annot_ID_164543
aaggcgaagaaggcattcaagaaggcgatattatgacagttcaagcttggatcactctgaaacgtcccaatggactcataggcgctattcctcactcaccttactttcctttccacaaagaggaaaacttttgggttcttcttgcggattcaaaccatgtctggttctttcagaaggttaaattcatggatgaagctggagctatagccgctgcatcaaacactattactgaaacaatggaacctttaggagcaagcgtcaaggaaacaaatgatgcagttaaagaagctgttgagaaggttaaaagtgggtcaagattggtaatggggagactcttagcacctggagaaggtacttataacttgacttgcttctgcctaagcgatacttggatcggttgtgaccaaaagacatcactgaaagtcgaggttttgaaaagaacccgtgatgtggagggtgagaatgcagaagaaggattagaggaagaggatgatgagattgaagaggaggattacgaaagcgaatacagtgaggacgaggaagataagaagagagggtcaaagaagaaagtaaacaaggaatcgagttctgaagagtcaggatcagatgaagagtaaaagaacaaaaagtagttaacgttgatctgaaattattgtctgaaattatacaataatttttgttttcagagcttacacagtcgtactaaaagattttacagtatttaatctttttgctgagtttaatactctttttagttgactcttcaaatctataccttgttttgactcttaagctcagatagttcaaaacttttctggtcatgttttcgtcagaaacccaagctcagccccagaaagcttctttgaagaaccttggccgtctatctattttccttatagatgattcaacggtagatacgatctcaaaagctcatgaagagtccaaatgatcaagactgggttctctagaagtaatctgtccttgacttccacccaaaagttctttttcatcttcttcctcttcactgagatcctcaccatcttcttcttcactctcaatctcattgtcaatcttatcttcgtcgctgcttaaaccaccttcaccttcgcttagctcattcagctgctttgccttgaccttaacacgtcttcctttgatgtatctaaactcccactgtggtggaggatatttcttcatcagtttctcgtacttatccttcatctctagtttcacaaacacttttccaaccatagacacaatcgcaacattcggtttcactccaagctcctccatgtcagcaaagacctaagaaaacactcaatagtttcatacatcaacttctctgatagaatctctgccagttgcaaatacttagtaagaaagattttttaagtgtacctcgaagagcttttggtgcatatctctcttgtaatatatagagatcattttgttgaagaactttctaggagttccttctaaatgttccatgaacaatttgttccacaattcctcagcttcgtcaaggcgattatcttctgctaaagcatttagtaatgagaagtaagttcccattgttcttccttggcctttactcagcatccattttgtcacctaacaaaatccataaacattattctacattcatctaactaaaaaaagaaacacagctcttactgcttaataaacaagcatacctgaataatcttcttccattctttttcatcttcaagtataactaatgccttcttaactataacaagagggaactctaattcccaagcaatgaaggaatcaagcgctccataaacttcttctttaacattcgacaatccttttatctgcagattaacaatactcactaactctaaaagagattgcagaacacaaaaacatatgaagagagcattacacaagcaatcattttggcagctttagagatagttccaatcctcttccttgttttccatacacgaggagaccgaggtcttggacctctcgccgcacaaacctgaaagattattgaattcgaagacaacatgtgaaattttgaaaccaagagactgtcgaaatgtttagttaaagaaggtataagaaacataaatacgaaccacaacattgttaggctttttggtgaagagcttagttgatgattcccttgtttgaagaagaagataaggtaatgaatatctcaagcttagcatcctgaaaaaaatcaattcagagaagaagaagaagaagaagaagaagaagaagaacccagaaatcttaaagctttctccttttcagccactagagatatctagtgaattcaatttacaattgtgtaagttttctagagaatcgaaacacatattgttcaacttacctgtgctttcttcttcttcgttctcactctgtctgataatttgcgcttctctgtgtcctccaagttccctctgatgtctgattctcatccaaaacatacgaaatgcgtttatggaagtaacggataaggcccattaactagtaaagttaaataggcccattaactagtaaagttaaataggcccattaacctgaaaattttgacccgtcgtctgtattcttcatctctttcctcttcgccatcgattctctgagctggaaacgaattctctctctctcagcttatagatacccaaattaaggtaattttactcttcttcgtgattcttcttcgattaggttttggtttgaatctcgaatcgatgattttcgaactgatttgctcttgaaaatcatgtggttctgctccatgttaaattgagatccgaaattttagaatattagaatgacttgtgaaatgttagtatgatacaaaaaccatatctttccttcttttgcttcttcaacataagggtcttttgcttagttttgctgtaaattccttatgggtttttagcagagaaataaaagatctgatttttaacatccattacaagcgattcagattttgcttttttcttgcagaagaagtgaaagatg

SEQ ID NO: 33833 - DNA, 3003 bp, Unknown; identical to SEQ ID NO: 33832
  misc_feature (1)..( 3003): 2750-1469P.txt file - cDNA_ID_3072552; gDNA_ID_2926177; Annot_ID_199946

SEQ ID NO: 33834 - DNA, 3003 bp, Unknown; identical to SEQ ID NO: 19703
  misc_feature (1)..( 3003): 2750-1469P.txt file - cDNA_ID_3072555; gDNA_ID_1620683; Annot_ID_164540

SEQ ID NO: 33835 - DNA, 3003 bp, Unknown; identical to SEQ ID NO: 19703
  misc_feature (1)..( 3003): 2750-1469P.txt file - cDNA_ID_3072555; gDNA_ID_2926177; Annot_ID_199944

SEQ ID NO: 33836 - DNA, 3003 bp, Unknown
  misc_feature (1)..( 3003): 2750-1469P.txt file - cDNA_ID_3072567; gDNA_ID_1620683; Annot_ID_164534
ctcataccaatcttgcttcggcaccctccttttgtttcggttcttaaccctaaattttccccttctatcccaaaacacagagattgataaaccctaattgttcaccttctattactgaaactttatctagactgttctggatttatgtttggatcaaccctctgcgttgtattggatgtagccttgacgcagaaaccctaattttccggaagcgtccttgcttgttgtttcaattgcttaattgagaatctctttggaactatgaaagtcttagaatctctcgttttggtgaaagtatcccattttgcttaatttgttcctttgtttaacgttgtgaatttgcgttgtgtagaaaatgccaaaggttaaaactaaccgagtcaagtacccagaaggatgggagttgatcgagcctactcttcgagagcttgatgccaagatgagagaaggttagtttcatataaagattttgttatatctcaataacatatgcttttgcttgtttctttttcccgtgattttgctctaactatcgtgttccttgtgcagctgagactgattcacatgatggtaagagaaagtgtgaaactttatggccaatcttcaaagtttctcatcagaggagtcggtatgtatatgacctttattaccgaagggaagaaatatctaaagagctctatgaattctgcttggaccagggctatgcagatcgcagtctgattgccaaatggaaaaaggtatgtttttatatcattcttgaattaacttctgtttgtatgcctttttagttagttgtctaaggccaaattgaagcgatttggagtttctattatgtaaaatattgttgtattagtttagagagtctagtatcgccttactgcacaatgagtcttgaagctgtttctctgaaatatatgtccttagcatatgcacttacttggaatgatctcactaacgaataggttctagaattggtattgttgctttgtttggtgaagaaataagatttctggtaattatacttcgaacaaagtgcattgcctccacgatttgccaaattttggatagttctaacttctaaccatactcccacatcttaatgatggtcactcatgaatcgtttattaacaaactcctccctgtcaattctgttgcatcttctctttgtaggttatactatccagacatatacctagatttcacttttgttttctttcattgaactaagattttgtcatttatacgtgtctctatactttgtgttaagtaactctaaaaactctctgttttgtgttttgcagtcgggatacgaacgtttatgctgcttgcgctgcatacagccaagagaccacaactatggaacaacatgtgtatgccgtgttcccaaacacttgcgtgaagagaaagtggtcgaatgcgttcactgcggctgtcaaggatgcgcgagtggcgattaaattcaacatagctttattcgctatctctgactgtttgttacaatcttgtcacttgttaaatctggattatgtattattccataaaggctaaaaaccctgactaaaaatctccttgctcttacttatcaactctgggtggtattgcaaataaaaagaacgttccggtttggtatatagttgaaacttgaaagtagaaagacgtttcccggtttggtatcttactgaattaaaagagtgttttactattcccaaaagtgtcaatttctctaaattcgtgagatttgcagcaagtttatcatgacgccgtgagttatgttttggtcaaccggtgatagaacaagatattattgaagcagaaataattattaattcttgtatttatctagacgaaacttgattgcttgatccaaggaaattgttttgacttcaaaattgtattggttctcactacagttgacctgcccctatgtttccatgtggaacaagattcttcgtcttggtcatatggattagtattatttatttctaatcttatcgtgtaatgcatgtatgatgtatgttctaaacaagatgtccaccaaggtccaaaacgagaagagatgcccattacgctcgctctagatgctttgtgaaactcgatggactttcttctctttaaactcacataacatacatacatgatccaaaatccatgatcgttctttttttttttgggttcatttttcatggtttattggaagcacaaaagaaaccaaaaataggatcacagttcttggacatcgtttaatacaaaactagaggaagtaaacattaaaaaaaaaacttgaaaaattaggggaggctaaatcattttcttgacgcgcttgtaataggaggagcaattgtggtaagtggttggtgtgaattagaacccaattatcaactaagtcgagttttgtttaaaaccaataaatttcatatacaagtttgaaactgaacatataactttttctttatatatcataattttgagtataacggatataacattttacttaaatgagaaagtactattgaattatccagaagacgtgatccgatggaaaaattcgtatcacacatgatcttttctttttatggcacaccagattttgtttacatttataattcgatttcatctttttcttagaaaaaatggtcaaagaatgcagctggtgaccaactagtgaccatacaacaagaacaaaatctcatggactctatttaaggtttccataatttaatttaccgtatcacatttccagctaattacacaaaaccgtcgataaataattgtttatagaaagaaataaatacaagaaaaacgtcaaaggatagctactataagtaaggcagactttaggaacccaaaattctgttattaatttacaaaaactaaagagtttttcacttttcagtttctcttcttaccattcactctaaaaaaacagagtctttataaaaccgatctcagattctgaatctgaatcagaatctggatcaacataattttctaacaaaaaaaatg

SEQ ID NO: 33837 - DNA, 3003 bp, Unknown; identical to SEQ ID NO: 33836
  misc_feature (1)..( 3003): 2750-1469P.txt file - cDNA_ID_3072567; gDNA_ID_2926177; Annot_ID_199939

SEQ ID NO: 33838 - DNA, 3000 bp, Unknown; identical to SEQ ID NO: 19720
  misc_feature (1)..( 3000): 2750-1469P.txt file - cDNA_ID_3072613; gDNA_ID_1620685; Annot_ID_164572

SEQ ID NO: 33839 - DNA, 3000 bp, Unknown; identical to SEQ ID NO: 33709
  misc_feature (1)..( 3000): 2750-1469P.txt file - cDNA_ID_3072621; gDNA_ID_1620685; Annot_ID_164569

SEQ ID NO: 33840 - DNA, 3000 bp, Unknown; identical to SEQ ID NO: 4148
  misc_feature (1)..( 3000): 2750-1469P.txt file - cDNA_ID_3072636; gDNA_ID_1620686; Annot_ID_164625

SEQ ID NO: 33841 - DNA, 3000 bp, Unknown; identical to SEQ ID NO: 4148
  misc_feature (1)..( 3000): 2750-1469P.txt file - cDNA_ID_3072636; gDNA_ID_2926202; Annot_ID_201928

SEQ ID NO: 33842 - DNA, 3003 bp, Unknown
  misc_feature (1)..( 3003): 2750-1469P.txt file - cDNA_ID_3072640; gDNA_ID_1620686; Annot_ID_164617
caactggtctgaatgtgctgaatcatgtacaggaaaccctaagaagatgcgttcattggaaaaagaaggacagcagcaaaaggtagatgccatttcttgccgaccagaaaacaggggtggtaaatctcacgtgcaagcttccttaaacaatcacaaaactggttactgtcaaattgtcagggtaagatcaaaagggtttagtgagagtgttcgtgctgatgattgttctgatagcgatgtatgctcagttggtagttgtagtgctactagttatgatgagagtaacatgccaccttgtatgctagatggctctactcaacaggcagactcatgtagcagcgatgctgaatcttcttgtggcctgggggaagaaccaaggtggaaacattcatcagttggtgatggagcaagaaattcttgtaggtcggaactatattcttaccgcagtactctgggggaattattttcttctggtcccctaagttgggagcaagaagcatcattaactgatcttcgtctttctcttaatatatcagatgatgaacatttgatggaggtaagaaatttgatatctactggtacccgcagtcaattttgttagtatcaatcagaattcaaatttttctttttgatttctatggtcaagtctgatctacctgtcttggatatactttcctgaaatgtggaatcaactgtcatatattgttctttttccagtggattttataagtgtatagacagcagatacaagtatgtatggaaattctgattagaatgaaagtttccgaggttcttttctattgctttatcagatttcccttagattcctttattgtaattcctggaggatgttaaagcaaaattcatgtatcgatactctgagatgtcatattttgaagggctgtcttctgttcattaaatctgtaatatcaattttatagcacgattttctgttcctcgtttcgtgttaactttccacacttgtgtgttgatatacttgataacaagatgggtcaatcgtattttcctatgtggattttacttcagtgcaatatgaagtctgaatgtctcatctattgagtgctccttcctgtagctctatgaaatgtgttagtgtgagtttcctagtcattcctctgaacaatattgatttccccctgcatttttcaggaacaatgttgccttatccgggcatgcagaccttttgcttctagaggtctaactctgatgctggggtttacaccttctcccttgaccatctgagtggtgcaataccatacctgttctccctcaaaacataactgacttctatgccatttttattttgtcgctatcttgatattgcggcttgtttcaggggcttctttcaggtgtcctggagtctactttgtccacagggactgaatgctgtggtttgagcaggcttccttatttgcagtctggttggataattttgctgacatcatgtcaagttctgagtaatatttctttacactttttcgttcactcgatatatgttgcggtgctatcttttgtggtgttgtgtctcctctggttgctttcttagaagtgcatgatgtagatgctaccatatttttactattactagctctctaagcctaatacgtttagatgtagaacacaacgttgtttcagttacattggttctattttcggtgttttttccagacgcatagcctattgatgcttattctttctggaaataagtgttgtggcctactgagaggtaagtgtgcaatggcatgaatggggttaatgtaatagatgctcatccagaaaatgtgtttgtgatcggtgttgattcgttattctgatttgttctcatgacttactttcatggaaaattatcgagatgaacgggaacacatgcctgctttcttacttagtttgtcgcatgtgcattgtgatcggagattgtccaagctcactcttcagatgtctccagcaaaggtaggttgtttgcatggcagtatgaaactctgaagcagaatccattaattttcacaaaggtatggatccttttgaaagatgtgtcgtggttcttcaaagtttaacatgtttttcttgagtagtttgcttgcttatagaatcaaaacgagtttcgtatcttcaaccagactttctttggcaattagttactactgctacttatgcaatgcaacctctggcaatattgattgatttgcgttatgttttaatggttatgaaaactgactcttcgatataagaacttgtgaagtaaaaactctatgtgatgaaattatgaatgctgaggatgttgttattacgagcaatgagatgtctttttttaaaaaaaaaaatttggttgcttgcttgcaagaggacatcttagcatcaaatttgaaaccgaaagctgactcaattctggtaactactggcagtaacaagaaaacaagtcatgaacctgcaatttcattctaattctacacaagatgcaaatctcaacttaaattcacttttaaaacttgttattattgtaaattttttgaataatacagttggaagtaaaaatccaccgtaccagtgtaccggtaacgtggaagtataaaccaattcgccaatctctttcttcctatcacaatttaaagacagcgacaaaattagacggttagaatgctgagttataccgggttattaagataacctttgttttcgttaaccgaacaaacgcgactgagtttcactgggaaaaaaaaaaaaagaagaagcttctttagcttttgtgacgaataggagggaactgagttttaggttcgtcttgatacggcttactctgtgaatcgagaagaaattgaattcgtttttttcgtctttctctgcaaattaacccatttgactgtttgtagtttctttcgcagatttataaagttggtcttcttctcttctaatcggatcgattctgcttccggttaaccggttttgttccccggcgacaatcagcaatctcctccccggccaatg

SEQ ID NO: 33843 - DNA, 3003 bp, Unknown; identical to SEQ ID NO: 33842
  misc_feature (1)..( 3003): 2750-1469P.txt file - cDNA_ID_3072640; gDNA_ID_2926202; Annot_ID_201922

SEQ ID NO: 33844 - DNA, 3003 bp, Unknown; identical to SEQ ID NO: 17136
  misc_feature (1)..( 3003): 2750-1469P.txt file - cDNA_ID_3072644; gDNA_ID_1620686; Annot_ID_164616

SEQ ID NO: 33845 - DNA, 3003 bp, Unknown; identical to SEQ ID NO: 17136
  misc_feature (1)..( 3003): 2750-1469P.txt file - cDNA_ID_3072644; gDNA_ID_2926202; Annot_ID_201921

SEQ ID NO: 33846 - DNA, 3000 bp, Unknown; identical to SEQ ID NO: 4135
  misc_feature (1)..( 3000): 2750-1469P.txt file - cDNA_ID_3072648; gDNA_ID_1620686; Annot_ID_164614

SEQ ID NO: 33847 - DNA, 3000 bp, Unknown; identical to SEQ ID NO: 4135
  misc_feature (1)..( 3000): 2750-1469P.txt file - cDNA_ID_3072648; gDNA_ID_2926202; Annot_ID_201919

SEQ ID NO: 33848 - DNA, 263 bp, Unknown; identical to SEQ ID NO: 4129
  misc_feature (1)..( 263): 2750-1469P.txt file - cDNA_ID_3072660; gDNA_ID_1620686; Annot_ID_164601

SEQ ID NO: 33849 - DNA, 3000 bp, Unknown; identical to SEQ ID NO: 3028
  misc_feature (1)..( 3000): 2750-1469P.txt file - cDNA_ID_3072660; gDNA_ID_1620621; Annot_ID_162305

SEQ ID NO: 33850 - DNA, 3003 bp, Unknown; identical to SEQ ID NO: 19738
  misc_feature (1)..( 3003): 2750-1469P.txt file - cDNA_ID_3072660; gDNA_ID_2926202; Annot_ID_201906

SEQ ID NO: 33851 - DNA, 3003 bp, Unknown
  misc_feature (1)..( 3003): 2750-1469P.txt file - cDNA_ID_3072688; gDNA_ID_1620687; Annot_ID_164651
aatcactcgcttcctcggtttcctactcttctctgtctttccaggtaacgccagttttgactcattcattattcggaacgtttttgttttaaaaatttttggtgctgttatatttttcacataacagattgattttttttagaattaggtctcttgaatcgaattgtagattatatagtgttactgtcttattgactccaagactgtcaaattttgacaacaatggcacaaaaatagcaatggactatgtaaagtgaatgagttaagattacctaattgtgaacaaataggcttgtaacaataacacattgtagtgttgcatagaattcgatcttctgttatctctgtattcggtaaaagaaattcatagatgttctaaaacttaacattttactaaaaaaaaagcacattgtagtgttacttgagttgtgagcatttttagcaaccaaacatgtttttgctctttttattgatagaaatcccaaactggaggacatccctaatttagccaacgagctcaagtttatctccgagttaaaaccatcaaagatttatgaagaagaacaatgcagtagcagtacagagggatattataactctgatctgcctaaaccacgaaagctcgttctgaaacaagatcttaactgccttcctgattcagaaaccgaatccgaggaatctgtaaacgaaaaaaccgaacattcggaatttgaaaacgataaaactgaacagtcggaatcaggtaaatctctttcttcaaatgtcaatagacttgccttccagataatatataactctaggccagttttaagctctcttttttttggtacaaggtccagttttaagcattttggtgattaatttcgggttattgtaaaaacacagatgctaagactgagattttgaagaagaagaagaggacaccatcgagacatgttgctgaactatccttagaagagctttcaaaatactttgacctcactatcgtggaagcttctcggaatctcaaggtcggtctcactgttttgaaaaagaaatgcagagagtttgggattccacggtggcctcataggaagatcaaatctctcgactgtctcatccacgatcttcaggtcttctctctctctctctctctttatcaatcctaatacatcaattcactgaaagaagcattgatttgttttggtattgattagagggaagcagagaagcagcaggaaaagaatgaagcagcagcaatggcggtagctaagaaacaggagaaactggagacagagaagagaaatatagtgaagagaccattcatggagatagggatagaaaccaaaaaattcagacaagaaaacttcaagaaaagacacagggcttctagagccaagaagaatcaagaatctcttgtcacttcctcttccacttaaagactttaggtcctttaacagtaacatcggatatattagttagttaggggtttctgtgaagcgttttggtatttagaaatgttagttacaagtctaacagatgatgctaagccatgtttgtttttggtataagaagttccaagaagagaggaactcttgtatcatgattttttgtggtcggatatcagaattgaatcttttattttttcttagtgcaattaggtagcaattaagatcgaatttctttatataatggtgaaagatcaaacccaaatcatggtttaggaactgatccaaattaacccatccatagtcaagaaaaactttcaaaagtgtgatgaccagttttgtttaaggctattggttatgtgtgttcttgagtggtcccagctcgtgctttgaaaatctacgacgactctgtccacacgacgaagaccatcaattaacgtgtatcgtacaaagaagttcgaagtctacaagtgtgtatacgtgtgtgtgtgatcctacgtcaatatttacgaaaatgagaaaatgtttttctttgtttcattttccatgcaactggcattttgtacgtggtcaagtatcattttgaagtcattttcagtgtttttgatcaaaaattttttttgttattttttggtgaagatcattttttttgttttaatattaaaaaagaaataacaatactttattttctgatctaaaaggcctatatatatatatttgaccaaacaaaaaaagatctatatattatatgatcatttaaaaatgaaaagtatgatgttttgaaaaaaggccaacttacgaacatctctgacaaagtgaagaaatttttttctcttacgcattcatataaagaaaaatatattctaattttgccattggagaattttggtgtttctaattgtgaaacagctctatagactatagtagaagtcgaatgactttcatatttgtggaaatgaatgagaaatttccataaagacacaaacgtccaagcactgtgactgagaggatgacttttaagcattttgctggcacaagcaaaagtctttttacttcctaacggtttcacatctctactattttttgaatgatgtggacagtgattaaaaaaaaacatgtgaaataaaattacaaataattcaaagatttccaaagtaaaaacaaaattctcaattatttttttcagatcacacgatcataaatagatagaaaaggctcttaggctatgattcttctttttggtcccatcttcttggcattttcgtttgtttttttttaatttcttttaaatgagaaagaaatgcataaaaaatgaaaaggtagaccaaaacccttcttcggttcacgctagcaacccccaattttcctccctttattttattttgttatctaaattaagtcaaaattattttgcaacccatcgttgcctctttcaatagttctaaactcgagcaataaaaactcaaataaaccaactgacttgagatccatatccactagctcttgtctgaattggtaaaacaagaagaagaagaagaagaagaagaagaaagagaaggctcattagaaattgatg

SEQ ID NO: 33852 - DNA, 3000 bp, Unknown; identical to SEQ ID NO: 4180
  misc_feature (1)..( 3000): 2750-1469P.txt file - cDNA_ID_3072738; gDNA_ID_1620689; Annot_ID_164694

SEQ ID NO: 33853 - DNA, 3000 bp, Unknown; identical to SEQ ID NO: 4180
  misc_feature (1)..( 3000): 2750-1469P.txt file - cDNA_ID_3072738; gDNA_ID_2926182; Annot_ID_200357

SEQ ID NO: 33854 - DNA, 3003 bp, Unknown
  misc_feature (1)..( 3003): 2750-1469P.txt file - cDNA_ID_3072747; gDNA_ID_1620689; Annot_ID_164688
caagactatcaaaaagaaaatgataaatattgcatgggtggttgacaaaattcaccaaaccgtagcagtaagagcatgcactaaacccacataaccgtttggcgttttggatataaacacattgtcaaaccactcaagcgttccccaaatttccccattttggtgtttttcaatcgcaatttccgcacaccaaatctttttttccctatcaacaaacatatactcctcccaagaaatcgccatttttccaccatgatccgccaatttaacatttgaatgagaagtaggcaaactaggcaatcttcccaagcccttcaaaattgtccatgctctattcttgaggtcataccaacgtatctccccctcacagtaacggtagaacacgttctctaccacacaataagatgatgatgacgacagactccatccattattcatacatatgtctgcctctctccatttacctttatgcatcttgtaagtcacatctttttcatcagacttcacatagacggttccttgataacttacgcttaagtactcagagcctttgcatatctcctcgctagggatctgtagaaactcccaagtttgagtcttcgtatcaaaaatctccatccagttcattgtatcgagattgtcgcagcctcccgtaacatatattctcccatcaagagtacaagcagatggaaacacacggcccacccgcatgcttggagcttcatgccatgtgtgagaacgagagttcataatcataacgctagacaaagcgttataagtctttgatccagtggcatatatcgaaacgtttttattctttgatccaccgccaatggcatatacatcaggaccaaccactacaacacccggcagggatggggaggtaaaactgggagatgaaatcggaaccaaaacgtttttggagctatgtggtctgtggcacagaatgaaccaatgtagtagttcagaatcggtacggagtcgtaagcacgcgtaaagacaactctcggttcggcctaagaggattcgggtttggtaaagctccgttgaagcaagaagagagcgaaatgttttggagactaatgagagagttggataatgtaatcttgagatgcgagctaagcagtttaataccaaatcatcaggaagcattagaaaacttcttctagttcttttaatcgggggctcttctccatattccatggttgttgatcactttttttctcttaaggtttaaggttgcttgttaagtaagaagatttctataacaaaaacgtatattctgtttcgttctttgtgtgctctttctgttacaacgatatatatatcaagttacttaccctaacagatccataactttatgtgttttcctatatttgttatgtttatccaattatataaaaaatgcataacaaagttaactattatcttccgataaattcgtgagattttatgcaggtgataatgttcaataatccaatcagacacgtaatacttttttccaaagctaaataggagaagaaatctatcaaaataggatatatttttttaggccgcctatgatcatctatatatatgaacaacccacaccttgttttaacaaacaaaatcaaactttttcacaacaaggcaaaacaaaaaccctaaaagcctctcagctgctctcttcgacaatggtgaatacttgtaggaccagcttcatcatcatcatgatcctcttgctcttcatcaatcagtctgctctttcttcttctgcacgcgtccgtcatctagaaggtcgagatcatcttcctcaccaccggacacttagtgagaaggagaaagctgataaggaacgtctcagtttcatatttagaacgatcgaggctgacatcaatctggaggaagatgtttctctccgtcttccccaatttgctcgatataataggcttcataattcctatttcagttactgaatctactagggctttgaatttgttccattaaggttcattacttcgattgatactcaatgaatcatgtaatctttatattttttagactttttatcatgacttttgtaaactcttcttcaatttaattgatatattattccagaatagtataaaaataagaaagcctcttttttttttttttttttttaatattgacattcttacgctctacgtctaacttttatgtaccctttgatgtaatgcgtcacaattaattttcgtgaatcttttggattgctgatgtgataatcaatttatgtagcataccgaatgaaacagattacacatgccatttaaaagtatgaaccattgaacaccaaaatcggttggtaaatatactaaattgttgtgttttgtatatatagtttatcaatctttatccataagcgttatcaacaaaatatgggtacctctttttaatagacgtgctcagggcataagattaagactaattgcatgatccgtaatttgcgttcttaattaataaggtttatcatcttgcaggtagatctaactcatgagtatataatttaatttatttgctcaagattgaacatgaacattattgtggtgttacaaagagagatagtacgaggtaaaactatcatagaaagtgattcaagtttcttagggactataaaccaacttgtataattgaagatccaaatataaaaaggctctgatccaatttcaacagtcaaaaatcttattataaatggaccatcttacgttgacaaacgtatcttatgtgatcaccttgataagaggaaacccacgttctaccatgtagggtttcgagatacattaatatttccattcttttcttatctcgatactattatatataatacttaccacgtgaaatatcaaatcaatataaaaaaaaacgtagaaacttttactatataatctcactagtagcaatgagggtaaaatcacgcaaaaacaatcatctctctataaaaataaaagaagttggttagttccaacgctagagttaagaaatatg

SEQ ID NO: 33855 - DNA, 3003 bp, Unknown; identical to SEQ ID NO: 33854
  misc_feature (1)..( 3003): 2750-1469P.txt file - cDNA_ID_3072747; gDNA_ID_2926182; Annot_ID_200352

SEQ ID NO: 33856 - DNA, 3000 bp, Unknown; identical to SEQ ID NO: 19784
  misc_feature (1)..( 3000): 2750-1469P.txt file - cDNA_ID_3072751; gDNA_ID_1620689; Annot_ID_164681

SEQ ID NO: 33857 - DNA, 3000 bp, Unknown; identical to SEQ ID NO: 4210
  misc_feature (1)..( 3000): 2750-1469P.txt file - cDNA_ID_3072763; gDNA_ID_1620691; Annot_ID_48591

SEQ ID NO: 33858 - DNA, 3000 bp, Unknown; identical to SEQ ID NO: 4210
  misc_feature (1)..( 3000): 2750-1469P.txt file - cDNA_ID_3072763; gDNA_ID_1620691; Annot_ID_164765

SEQ ID NO: 33859 - DNA, 3000 bp, Unknown; identical to SEQ ID NO: 4210
  misc_feature (1)..( 3000): 2750-1469P.txt file - cDNA_ID_3072763; gDNA_ID_2926158; Annot_ID_139627

SEQ ID NO: 33860 - DNA, 3000 bp, Unknown; identical to SEQ ID NO: 4210
  misc_feature (1)..( 3000): 2750-1469P.txt file - cDNA_ID_3072763; gDNA_ID_2926158; Annot_ID_198589

SEQ ID NO: 33861 - DNA, 3000 bp, Unknown
  misc_feature (1)..( 3000): 2750-1469P.txt file - cDNA_ID_3072777; gDNA_ID_1620691; Annot_ID_164756
tttgttgtaaacacttgcgtctctgtctacacaagtaatttgactgtaaatgtaagtgtacaggatttaaattgaataagcatttttttcgtgtcgtaaatgtcaaaacaatatgtagccttcccccaaatcttagtaccgacgatattggtaacatccgctgaaatgtgttactatttattttattgtagtcttactctttttattaatcaatatattttgatgaaaatcttccggatagcatatttagctttcgaaactattctcgacccttactcgtattcttccgttataaatgtattaagtaatggtttatatttaggaaaaatgtcatatttagcttttgatgtttagatcacttgttaatgtacaagatcaaagacataaaaattctattattattttggagacagtttttattttattacaaaattcaaaaatatgttttgaaataaacagttttctctatagttttatttctatgttgtaattcaatcaaaacaaccatctcagatatataatctccactttgttcattttgatatagtttttttttcaagtagatgtgctaaatctccaaaaacaaatatattttgttatctgttgcgttcttcatgattatgtggaaagtggtttatcaaatgttagattatgtatgtggctttgttctttcttgttatgttatgtatgtgtccttcataattatgtggaaattgttttttgttgttgatgatttggtgactggttgaatttgaccattttgtcattttgtgaactatgcttaacggccaacgcaatggggatattgaggtggttttctctaagcggctatcaaagacattcagacagaaagaattggagtatatttggatgccactaacgaggctatatggttcgaaaagagtaatcgtctcctttgataggatacaaagtgtttggtcatactttttttccgttcacttgtatatctatctaaaaacccgattgcattacaaaatttctttgggcggtacatgggactatttgtcagcttagataacccaaaggaagatatcgaattattaatctaaagaatatccgaaaattcgaaataaatttacatatccaaaatattagctatatttagttacaaaatttataccacaaactacaaaataacaaaaatatcttaaataacctaggcttccaaaattttgtagttatatttgataaatttatacatttttttttttttgcaaaatataaccaaattttagtataatcaaaatgtttattatttttttgtttttttcttccaaacaccaatccaaattcgacagctatttgaattgaatagtcataaaatctgaatatataataaactcttctatccaaattatccaaatccaaaaatattcaaactaaatcctattcaaaatctgaatgcctaggcatagttatatacttatatacagtaaacggatttatttcggcgggtatggttcagacagagacttcacacccgtgggccgacgtggaattactcgaccaaggcttcactaaaaatgaatatgtgctactaaaacgcaccgtttcttagtttaattcaaacggcgtcttattgcttctcactctcccaatctcgattctcagactcaagacactctggaagaaccctaaagcattttcctcaatcgttattggggttttacgaattcgacatctgtttctgactccgccgggtaagtgattatttctctccgttgaacctaccttgaaactgaaaaattctcttttgattactccgttctttcactcgatatcagaagtttttttcctgtttcattttttctgtgtttatgacgaagtcctttctctcctttgatttgtctatcgaggtcatggtcttgtttttttctctgaaacccatttgggagttttcagatttttagttgaatcgagaaatttgatcttcaatttcctgaaattttgtgtaaaggtcccatttttaatgcctagtgcttgctttttccagtggtttacccaaatgcttgaaatgatataagttaagctccggtcatttgcgtcgtttatgttttttacgttaacccttttggggaattgcgtctttgggcgacaaagtcttcaacttttctggatttctgttgaaatattatctttctgtctcatttatttcattgctactttaagtgtttgaattgatgcttgtcgtatctctgattgtgtaaagtttgtctcgaagtcattatatttagagtttgtcttatctctgcttgtgtataatgtttgtcttatcttctgattgtttgtcttgttttataattgaacattcttttagtgtaatttgtcttagtgcttcttcatctgagtgtgcgagaggaagctagcttatgatccatgtacttcagatttaagttctttgtacagaagactcggtaaaatccctgaggccgagtctctctaatttttgaacttttttagagcacttgagctatttctagctttctactgtgaatgttgtttgtgaaatttttggtgtttgagcttagatagattttgagttttaattgtttgcactttggctatgtgatatctcctgagttcgtggattggtcatgttagctctgtcgttattattctttgatcatataattcatctgattggtggagtgttcttattatccactgattcatttgttgaaaaaatgaagttggttgaaaaaaatggagaaattgatgcgattcttgagttttgttatgccaattactgtgaaaagtttgttgattgttgttggaattgatgtgaaatatgtgtgctttgggaattttatgctacaattgtgaacagatgtatcaaactccgttgcattgaaaatctctgtttgggcatgtctcgttgtagtatacagttcccaggattctgacataatgtttcaactcatgacatttcttaatttgtgtaatctaatggtcgttttgactacataatgaatgcagatg

SEQ ID NO: 33862 - DNA, 3000 bp, Unknown; identical to SEQ ID NO: 4204
  misc_feature (1)..( 3000): 2750-1469P.txt file - cDNA_ID_3072785; gDNA_ID_1620691; Annot_ID_164749

SEQ ID NO: 33863 - DNA, 3000 bp, Unknown; identical to SEQ ID NO: 4204
  misc_feature (1)..( 3000): 2750-1469P.txt file - cDNA_ID_3072785; gDNA_ID_2926158; Annot_ID_198575

SEQ ID NO: 33864 - DNA, 834 bp, Unknown
  misc_feature (1)..( 834): 2750-1469P.txt file - cDNA_ID_3072789; gDNA_ID_1620691; Annot_ID_164748
aagcttcctccttcacgttattagccactgacagcatcagaaaggttctctagaactctagaacctaagcaaatgtcacaatgctctcgattatcttattactcaccaaagataagctccagttttttgaactagttaaatgtattataattagaacgatgtgagacttttgcttcaaggtcgttgagtgtgagaaatggttttctttgatgttacctggtaaagatgccatgaagcataagcatccgttgttgtttatgctcctttgacctcccaattcaagcctaattctgtttggcttcaggagctgcaaagtaacagtttttaaagcgaaatataaccacattcccaaagttctaaatagaaagaaaaaaacaagctttgaaatcaacaagataaggtggataatgggtacctctttgcaatcaagtgtctcagttagcgaggcacggccccatttttctgaatcaaggtttttgtgggctaaacgtaaaagatcttcgacatctttgatggatacaccattgtcatggaaaagcttaacaaagtcacagtcaattcaaacaccacatataagaactaagttaagtatgagcatatccatacttaactacagaataatattgtccaacatgaactttgatcacttcaaaaccttaacaagtcaatagtcaatgtatagatttcttagctacagaatcagtagctaagtatggatatgctcatatactaggttgttgtatcagaattgtaaaatttcttggcctggtttataaagtggtatgtgtttaaaagaaaaataaaagaagtaaaatgttatattcaagattcatg

SEQ ID NO: 33865 - DNA, 3000 bp, Unknown; identical to SEQ ID NO: 4215
  misc_feature (1)..( 3000): 2750-1469P.txt file - cDNA_ID_3072817; gDNA_ID_1620691; Annot_ID_164808

SEQ ID NO: 33866 - DNA, 3000 bp, Unknown
  misc_feature (1)..( 3000): 2750-1469P.txt file - cDNA_ID_3072817; gDNA_ID_2926159; Annot_ID_198653
gcgtatttagattcacttctatgatcgtaattaattctgtatgctgttgaaactgtatcttgtggtagttttaaacttggttttctgtaggtgaacattccgaaaactaagaacacttactgcaagaacaaggagtgcaagaagcataccttgcacaaggtgacgcagtataagaaaggtaaagatagccttgctgcccaaggaaagcgtcgttatgatcgtaaacaatctggttatggaggtcagaccaagcccgtcttccacaagaaggtatactcgcttttccttgtcttgatctctaattactgtcttctatgtgagaaccaatttaggatttcagaattgactctgtgaaatatgtcttataggaatgatttgttaattggaccttgctcattatttgtctttctttggaacaggctaagacaactaagaagattgtgctgaggcttcaatgccaaagctgcaagcatttctcgcaacgcccgattaaggtaatgtctgcgacattctttacctttgttaatcactctttagtctcagttctgtttcttacactttgtgtgtggtttttgcagaggtgcaagcactttgagatcggtggagacaagaagggaaagggaacatctctcttttaagttgttgtttcatctatctacttttttttgttttgtttggtacctgtcctgcttcaatactgtgatatactttgaatctaccagaaatggtcctggtttttaatttaaataggacttggtcttatggatgtcttttaatttggttaaccaatctttcttcattaggctgcccttgagtattctctataacttgcgacaaagtagacataacactctttaagttctaaaaaccactttctattttcggatctcgaaaaatcatttatcgttttgtgctgcaaatcagtgttatatatgagcttggcaaattaaaatgacatatacgtatagaaatgaattgataatactaaatattatttgttttcttcttttaacttcagccatactaactttcactaaatttcttaagagcatacagaagtttctcctcggtatattggtggttctatattccccgcaacgtgaatggaaaatgaaggttctattttggctatatgataatcatgccattagctgacccgaaactaatgtgttacaataaaaccaaattatataaatagaagaacatgtttcctggctccttattgcacaaaagagaacatgaacaactctttttatattaccatgatagtcctatgtgttttggcctttgtgttagttttaattgagagctgtgcgggcaaaatggtagatgagatgatattctcttgtgtctgctgtggtggtcctggctgctgtggtgatagaggagaaggacctgttggtggtggtattgacaatgaaccggtgaatgtagtagtggtggtggtggagccaggcagccagcggcggaagatgtggtgacggtcaaggatgctacttcagtttttctttttttactttattatacttagattctggtactatatatattatgggtatagataatttacactaaagttttatttccgttatttaaaattcgtgttttatttaatctctaattttctgtttccaagtcgaattcctctgtactaattatacggccttttaattttacaatatgaatagccattttctactaacacattcttaccttttagaggtgttaattttaaggtaagtttcttctctacaattacgtaatatcattcaaatctgttcatgctgacaaaagttaggtacttttgtgtatatttctcgatcattgacattgtctactacgctaatatctaaggaaagtggcatcgattctacttgcttgtaaaacatacatcgcgatgtaagtcaaattctctaataatgtaagaaacgaagtgagaaagaaagataaatccaaaaaatttacttgcaaatcaatagagatccaaaccaactgcgcatgcgttagtcaattgatatattgtatataatagaacaaatacaatttttgtttttataaatgtataaccaaaaacgtaagagcaatactatcgaaataaatacgtactgcatattacacgataataatagaaagagatttgatgtttgatcacttggaagtaaaatggagatagagaaacacaaagagcaatacgaccggaaacatcaagatcattggaagagatggtgcagtcaccggtcccatcatcaacggaacaaacagtaacattagtgcaacgacaacaatcgccaaaaccgaacccatcccgaatccatactcattcgccattttcgtctacttttcgataggagtagtgatcaattctgtgttagtgtctctaattggagaagttatatatacacagattcagacatcaaatctacggttgtgtcgtttccccgagaagtagaagacaacgtttcgtgtactaatgcatgaaacacaaaaactggcgagacctttcacgttaataaccacctcaaaacgctgcgtttcggtttatttgttgctgccacgtgttttaaaaacagcataccctaaacgcatcgtttcgtgtcgcaatcaactattcaactgttactgtatattttattaaaaacgcagcgttttagttaacaaaattcgtgtcgctatttctacactgccacgtgtttcaaaatgtcgcgttctgcatttgttgctatcacgtgtttaataaatttacctaaacgctgcgtttcgttaatcaatcgactttttgaacattcgcgatctccaaaaattttgagttttttttttggaaatcccgcccaaatattttgaaattgaaactctaataaatttgtcggcttgtggagttgcggtagtgatatcctccatttatcgttttgtgctttttcttcaaaaatcaaaagcttttatttttcccccaaacttttttttcaaaatcctaaatcattttaccctacgattttgcagatg

SEQ ID NO: 33867 - DNA, 3003 bp, Unknown; identical to SEQ ID NO: 19842
  misc_feature (1)..( 3003): 2750-1469P.txt file - cDNA_ID_3072823; gDNA_ID_1620691; Annot_ID_164805

SEQ ID NO: 33868 - DNA, 3003 bp, Unknown; identical to SEQ ID NO: 19842
  misc_feature (1)..( 3003): 2750-1469P.txt file - cDNA_ID_3072823; gDNA_ID_2926159; Annot_ID_198650

SEQ ID NO: 33869 - DNA, 3000 bp, Unknown; identical to SEQ ID NO: 4219
  misc_feature (1)..( 3000): 2750-1469P.txt file - cDNA_ID_3072839; gDNA_ID_1620691; Annot_ID_164797

SEQ ID NO: 33870 - DNA, 3000 bp, Unknown; identical to SEQ ID NO: 4219
  misc_feature (1)..( 3000): 2750-1469P.txt file - cDNA_ID_3072839; gDNA_ID_2926159; Annot_ID_198643

SEQ ID NO: 33871 - DNA, 3000 bp, Unknown; identical to SEQ ID NO: 4220
  misc_feature (1)..( 3000): 2750-1469P.txt file - cDNA_ID_3072843; gDNA_ID_1620691; Annot_ID_164796

SEQ ID NO: 33872 - DNA, 3000 bp, Unknown; identical to SEQ ID NO: 4220
  misc_feature (1)..( 3000): 2750-1469P.txt file - cDNA_ID_3072843; gDNA_ID_2926159; Annot_ID_198642

SEQ ID NO: 33873 - DNA, 3000 bp, Unknown; identical to SEQ ID NO: 4221
  misc_feature (1)..( 3000): 2750-1469P.txt file - cDNA_ID_3072847; gDNA_ID_1620691; Annot_ID_164791

SEQ ID NO: 33874 - DNA, 3003 bp, Unknown
  misc_feature (1)..( 3003): 2750-1469P.txt file - cDNA_ID_3072859; gDNA_ID_1620691; Annot_ID_48604
cacaaaccatctccaattagaaacctaaccaattctagcaactacacaatctttcaattggggtgaattcaaagatatgattcaacattacttaattagaaattttgtctcgataatacctaatttctgagaaaagggtgaaattaccttgacacctgagtctgaaaacccagattccgtcgcagtctccgcactaagtttccgtttaagaggattagacggcggcggacgcggaggcaacggattcttcattctcatcgacctatggtcaggcgtcgacgtgttccgatctagaggtggagcattttctttggcggatcttaatttgcgtggaggcttcgatttcgagatactagggtttggcgagtgtggctctccgccgtcgcgtaagatagcgtttcttggtaacgtaaagtgcttcttcatctccgccgtgaaatctacaattagaaacccaaagtagaagaaagagggaaagtaaatcgaatctgcgcttctacgagagcgtcagtgaaaccctagtgtttgggcaaagaaaagaggaagaagaacgagagaagagaagagagagagagccgttaaagagcgagaattttgaatttgtttttgtcagatcttgtgaagtgttgacgattcgcatcacatgaatttctaaattattttatttaaaaagaaatgaattttatgtgatcgtgactttatggccgtaggatgaatccaacggagggaatgagcaacaaaaaaagaaaaggcccacgtgtgtgtttaatggtgtgtgttttagtctttagacgtgtggtagtaatactgccgcacgggttttttaagatccaccgcgcgtaaaaatccaatccatccgctatggagcgggtatgggtttaaaacttttgacccgttacgaagcatggctcgcgagtaatcgtatcgtgggttgcagatttagtggttgtcattgggcagcagtagtactcatttctatcttcaactatattatatgtctttgactgtgaataaatgtagttcgaacgacaaaatcatcaaagcagtaaattagtcaatagcacagattttttttttttgggttaaaagtcaatagcacagatgcgaccacatttagtcatttacttacaatttagtcttaccaacgacatgaagagctaatatgagtgtcaaaaaatacaaaattcgatggtagcgatgagcaatctcttcaaaattgaagtaagtgattcttatgtcataaaattcattgaatactagacaattcattgaagatgatgcaatttaaaaattaaaaataaaaaaattcatacatgataaagcatgaattgaaattcttcatgcaatttaaaaaaaaaataaaaaaattcatacatgataaagcatgaattgaaactaatgtcaggtcctccggacttgggagcgtgtgctaaactgctaataatatcaagagagtaaacaaaaccacttgcaaattttataaaatctgccaaagattagcagattatgctgataacttggtacaatagtaggcaaaatcttattctactataaaatcttctcaagtcttcacaactattcaccatgtacttgaagtcgaaagaatgttctcatatatatatatatattttgttacgaatgttctcatatatagtatgccaataaaaccacaaaatttgtctgacacaagatagagtatcatgcttagtcaaaatatgtaaatattctcctaaagttcacaactacttgcacactttcattaagtatgctgctatgtttacatattatacaaataaaatcgtaaattttgttagaaacgtggcaaactagcataaataaataatctaaggcttctagtaatctttgcattacaacttgcataatttccataagatctattggatattgtaaaatctgccaataaaaccacgtatcttttaagaaaacacaggagactaaccaaaataaatccaaccgtattataattctctaaattttacacattgactcacgaacatttataaaatctgccatattcgaaaaatttgtcaacaacatccctataatgtttgagagacatgaaaaattagcaaaacatatgctaaatgtgctagtaatccctaatgtacgtttacataattttttttttgaccgattttaattagagctcaaaagaatcatccatgaaaaatgtacgtttacataacattttccatactttgtaaaatccgtcaatgttggataaacaatgttatgaaaaacattcaagtctacaaaacaaaacctaagtttctatggcttataattaatcccatagttttttaatcatgttagatttgttaaaattttgctagcgttgatgattttcttgtattctaaaattttaattttttgaaaaaaattaattcgagaaattttttcactaaaaagacaatgttttttttttttaatttaaaacttaaatctaactcttctttttgtcaaatatagattcttattattcttaccttttaaaatttatcttatttccttcttttttttaaaagagatttacaataaataagtaatattgaccaaagatatagaacacaccaaaaaagaggcaaagatatagaaaacatactatttagattttttataaattttggtagatatcttagattattctagcaaatctcctttaattgttttttttaacagcaaatctcctttaattacatcaaatccgtaaaggttgaaaaaaaaaataacaatagaattttagtaatgaattaattaccaatacttgacccaaacccgaacctaaacaccagatccatcgtcatcatccatccaatcaaattgactcatcgtgttgtgacctcccagtgattaagccgcgactcctcctaactcgtaatccctcacgtctctgagaattctcagtttcttcagtttcattgcaattcaattcccgatctgatccgttcctgcttagatcggagcaaaacaatggcggagatg

SEQ ID NO: 33875 - DNA, 3003 bp, Unknown
  misc_feature (1)..( 3003): 2750-1469P.txt file - cDNA_ID_3072859; gDNA_ID_1620691; Annot_ID_164786
tagaaagtacacaaaccatctccaattagaaacctaaccaattctagcaactacacaatctttcaattggggtgaattcaaagatatgattcaacattacttaattagaaattttgtctcgataatacctaatttctgagaaaagggtgaaattaccttgacacctgagtctgaaaacccagattccgtcgcagtctccgcactaagtttccgtttaagaggattagacggcggcggacgcggaggcaacggattcttcattctcatcgacctatggtcaggcgtcgacgtgttccgatctagaggtggagcattttctttggcggatcttaatttgcgtggaggcttcgatttcgagatactagggtttggcgagtgtggctctccgccgtcgcgtaagatagcgtttcttggtaacgtaaagtgcttcttcatctccgccgtgaaatctacaattagaaacccaaagtagaagaaagagggaaagtaaatcgaatctgcgcttctacgagagcgtcagtgaaaccctagtgtttgggcaaagaaaagaggaagaagaacgagagaagagaagagagagagagccgttaaagagcgagaattttgaatttgtttttgtcagatcttgtgaagtgttgacgattcgcatcacatgaatttctaaattattttatttaaaaagaaatgaattttatgtgatcgtgactttatggccgtaggatgaatccaacggagggaatgagcaacaaaaaaagaaaaggcccacgtgtgtgtttaatggtgtgtgttttagtctttagacgtgtggtagtaatactgccgcacgggttttttaagatccaccgcgcgtaaaaatccaatccatccgctatggagcgggtatgggtttaaaacttttgacccgttacgaagcatggctcgcgagtaatcgtatcgtgggttgcagatttagtggttgtcattgggcagcagtagtactcatttctatcttcaactatattatatgtctttgactgtgaataaatgtagttcgaacgacaaaatcatcaaagcagtaaattagtcaatagcacagattttttttttttgggttaaaagtcaatagcacagatgcgaccacatttagtcatttacttacaatttagtcttaccaacgacatgaagagctaatatgagtgtcaaaaaatacaaaattcgatggtagcgatgagcaatctcttcaaaattgaagtaagtgattcttatgtcataaaattcattgaatactagacaattcattgaagatgatgcaatttaaaaattaaaaataaaaaaattcatacatgataaagcatgaattgaaattcttcatgcaatttaaaaaaaaaataaaaaaattcatacatgataaagcatgaattgaaactaatgtcaggtcctccggacttgggagcgtgtgctaaactgctaataatatcaagagagtaaacaaaaccacttgcaaattttataaaatctgccaaagattagcagattatgctgataacttggtacaatagtaggcaaaatcttattctactataaaatcttctcaagtcttcacaactattcaccatgtacttgaagtcgaaagaatgttctcatatatatatatatattttgttacgaatgttctcatatatagtatgccaataaaaccacaaaatttgtctgacacaagatagagtatcatgcttagtcaaaatatgtaaatattctcctaaagttcacaactacttgcacactttcattaagtatgctgctatgtttacatattatacaaataaaatcgtaaattttgttagaaacgtggcaaactagcataaataaataatctaaggcttctagtaatctttgcattacaacttgcataatttccataagatctattggatattgtaaaatctgccaataaaaccacgtatcttttaagaaaacacaggagactaaccaaaataaatccaaccgtattataattctctaaattttacacattgactcacgaacatttataaaatctgccatattcgaaaaatttgtcaacaacatccctataatgtttgagagacatgaaaaattagcaaaacatatgctaaatgtgctagtaatccctaatgtacgtttacataattttttttttgaccgattttaattagagctcaaaagaatcatccatgaaaaatgtacgtttacataacattttccatactttgtaaaatccgtcaatgttggataaacaatgttatgaaaaacattcaagtctacaaaacaaaacctaagtttctatggcttataattaatcccatagttttttaatcatgttagatttgttaaaattttgctagcgttgatgattttcttgtattctaaaattttaattttttgaaaaaaattaattcgagaaattttttcactaaaaagacaatgttttttttttttaatttaaaacttaaatctaactcttctttttgtcaaatatagattcttattattcttaccttttaaaatttatcttatttccttcttttttttaaaagagatttacaataaataagtaatattgaccaaagatatagaacacaccaaaaaagaggcaaagatatagaaaacatactatttagattttttataaattttggtagatatcttagattattctagcaaatctcctttaattgttttttttaacagcaaatctcctttaattacatcaaatccgtaaaggttgaaaaaaaaaataacaatagaattttagtaatgaattaattaccaatacttgacccaaacccgaacctaaacaccagatccatcgtcatcatccatccaatcaaattgactcatcgtgttgtgacctcccagtgattaagccgcgactcctcctaactcgtaatccctcacgtctctgagaattctcagtttcttcagtttcattgcaattcaattcccgatctgatccgttcctgcttagatcggagcaaaacaatg

SEQ ID NO: 33876 - DNA, 3003 bp, Unknown; identical to SEQ ID NO: 33874
  misc_feature (1)..( 3003): 2750-1469P.txt file - cDNA_ID_3072859; gDNA_ID_2926159; Annot_ID_139640

SEQ ID NO: 33877 - DNA, 3003 bp, Unknown; identical to SEQ ID NO: 33875
  misc_feature (1)..( 3003): 2750-1469P.txt file - cDNA_ID_3072859; gDNA_ID_2926159; Annot_ID_198633

SEQ ID NO: 33878 - DNA, 3000 bp, Unknown; identical to SEQ ID NO: 4223
  misc_feature (1)..( 3000): 2750-1469P.txt file - cDNA_ID_3072863; gDNA_ID_1620691; Annot_ID_164785

SEQ ID NO: 33879 - DNA, 3003 bp, Unknown; identical to SEQ ID NO: 19856
  misc_feature (1)..( 3003): 2750-1469P.txt file - cDNA_ID_3072867; gDNA_ID_1620691; Annot_ID_164784

SEQ ID NO: 33880 - DNA, 3003 bp, Unknown; identical to SEQ ID NO: 19856
  misc_feature (1)..( 3003): 2750-1469P.txt file - cDNA_ID_3072867; gDNA_ID_2926159; Annot_ID_198631

SEQ ID NO: 33881 - DNA, 3003 bp, Unknown
  misc_feature (1)..( 3003): 2750-1469P.txt file - cDNA_ID_3072871; gDNA_ID_1620691; Annot_ID_164776
aatactttacaaaatccttaaccaggatcaggagattaggattcggtagtagtagggtacatgacctggtctggtctcttggaatacctttgcagagtagaaacttgtaggatcaacagatgattattcaagagggttcagtgagtgacttcacatgtttactaaggcttggtttttcgtttttatagtagcaagttcacttagattggtcctgtatgaacctggaatgcttttgtaaatagtaacttgctgaatattcttggaattttatgtcacataaggttggaatactgcgaccaaactggctagatggagccaagtaccttggtcaacagaacgtgagtgggtttctctgcaatgtatgggagaaggtagactttatatggtactatgaagatgttgaaaccaagagacccgtgcaatggatattctatacaggtgattgataccatcaacatgcccattgtcttcgatctgtctaatggttttttctagcaaaattcatctgacatataactgttgcagggagggaggctcatataatgacatacgaggtaggtgcggtcctagaggatgagaaatggcaagcaccggtttattgtttcaacaaagagaagaagagtttgtctacaaagggagctttgagtgaatttaaaggatacaaagaaaaggctgctttgtaatgttaattaacgagaccttcttttcttctagatgaccaatcaggaggagtacaagagtgaataaacgagaccttcttctctgtttgttctctttatttgaacaaggtaagatgcacattctttaacttcaaaaacttaaaacccactactcatcctcgtccacaaaacctttaagattcaaatccgacggtccaccttccgctgccgcatcaacagccatcgccttccacttctctgcattctctctcatctcctccgcctcttctccaccactcatcaccttctccaaacaccttctaatctcctccccatccacatctccttcctccccaaccttcaccttcactccaatcctccacgtatcctccacaagcttcgccgttgtacactgatcagcaaactgcggaaacgcaaccaccggaacaccactctctaaactctccaacgtcgaattccaaccacaatgagtcacaaaacatcccacagcacaatgcgccaaaacagctgtctgagaacaccatcccaccaccaatcctcgatcacttcctctgatcaattcaagaaaccgattcttcttcttctcttctggatttttctccctcacgatccataaaaacggtctgtttgtagctaacacgccgtgagtaagcgcttccatgtgtttctctggtaaatcatcggcgtgtgtgcctaaggaaatgtaaatcactgatctctcgagcttcgagtctaaccatttcgtgtaatcctcgtcggaagatttgaaaagatcggttttaccctcggaggaagaaaccaacggtccgattgggatcatcttgagtttctcaacagaggttaaagcatcgtgttccaaagcagagaatgtgttaacaagaatcttagggtttgattccgtttcgagagcttcgatatgttctcttagagtcacaagagctgacggtaatgccttcgaaggttgaagaaacgacgggaggtcaccggtggtgatcagtggcagtttcggtaatttaatcggttcaacgtcgaagagatgtttgtaagaggtgttgaagtagtagtagtagatgtctagtacagtagctggttcaatccagagaagtgtagttgggaggtgaaactcacgcgctaccgtagaaacccacgggacgagaacagagtagattaccccggtgataggctctgtttcggtggtggcgtcaagattggctttgatgatgtctctcagggcgtttgaaccacatcgtttgagttcggacatgtagattttctggtcttcgaatgacttgagaccgtcgtcgaatccatcggtgaaccaagcgaaggatagaccttttgtggaaggtggctcgcccatacgtcggtgagcagagactgcggtggagtatgtgacggttgcaccgtggtggatgaggcggttggctagttgaagcgccgggttgatgtgaccttgcgctgggaatgttacaagcaagtaatgtggacgacgatgggaaccattgacggaagtggccattttagaatgttttgaagatgttataagttttagtaaaagaaagaacatactcaagcttttatatataagagctaaaccattttaagtatcaatggtataaaagatggattaggaataattgacaatctttgcactgtctgtctcttacaagaccggtggatgagaaaagtcttatgtgacgaccgacgagtaacagccacgagtagaaagatgattaggaatatttcagtctgtttttgatcagttctcaacctccacaagaccgcaaccaaccaccatggtaaggaaatgattgttgtcttttcttttaaaaaatattagttattttagttttttttttttatgattgctaatttaatacagacacaaaactgagaatttgatctcttttaacagtttgttacttcacagtgaccatttgagaagttgcatccactgtccatccattctcatactgttaatcaaaaaataaaacaattatcgatgaatcaaattttgtcatgtttttgtaataaagtgctagtatgtatagtggagttcttaaagaatcttacaaaaagttattggtgggctatgctttttaggatatgacactaaagtaaagaaggctagcctaagaactcacactttcttctttactcttcttccctacaattacgatcgccaaaaaccctaaatttctaaaaactgcttttatctccaagtaagtttcaatattgatcttctgctctttttatttgttcaagctagcatgttgtttgatctttagcttttcggttggttttcaggaagttgaaaaagatg

SEQ ID NO: 33882 - DNA, 3003 bp, Unknown; identical to SEQ ID NO: 33881
  misc_feature (1)..( 3003): 2750-1469P.txt file - cDNA_ID_3072871; gDNA_ID_2926159; Annot_ID_198624

SEQ ID NO: 33883 - DNA, 3003 bp, Unknown; identical to SEQ ID NO: 19858
  misc_feature (1)..( 3003): 2750-1469P.txt file - cDNA_ID_3072875; gDNA_ID_1620691; Annot_ID_164774

SEQ ID NO: 33884 - DNA, 3003 bp, Unknown; identical to SEQ ID NO: 19858
  misc_feature (1)..( 3003): 2750-1469P.txt file - cDNA_ID_3072875; gDNA_ID_2926159; Annot_ID_198622

SEQ ID NO: 33885 - DNA, 3000 bp, Unknown; identical to SEQ ID NO: 4212
  misc_feature (1)..( 3000): 2750-1469P.txt file - cDNA_ID_3072879; gDNA_ID_1620691; Annot_ID_164772

SEQ ID NO: 33886 - DNA, 3000 bp, Unknown; identical to SEQ ID NO: 4260
  misc_feature (1)..( 3000): 2750-1469P.txt file - cDNA_ID_3072906; gDNA_ID_1620693; Annot_ID_164855

SEQ ID NO: 33887 - DNA, 3000 bp, Unknown; identical to SEQ ID NO: 4260
  misc_feature (1)..( 3000): 2750-1469P.txt file - cDNA_ID_3072906; gDNA_ID_2926187; Annot_ID_200748

SEQ ID NO: 33888 - DNA, 3000 bp, Unknown; identical to SEQ ID NO: 4258
  misc_feature (1)..( 3000): 2750-1469P.txt file - cDNA_ID_3072910; gDNA_ID_1620693; Annot_ID_164852

SEQ ID NO: 33889 - DNA, 3000 bp, Unknown; identical to SEQ ID NO: 4258
  misc_feature (1)..( 3000): 2750-1469P.txt file - cDNA_ID_3072910; gDNA_ID_2926187; Annot_ID_200745

SEQ ID NO: 33890 - DNA, 3000 bp, Unknown; identical to SEQ ID NO: 4255
  misc_feature (1)..( 3000): 2750-1469P.txt file - cDNA_ID_3072914; gDNA_ID_1620693; Annot_ID_164849

SEQ ID NO: 33891 - DNA, 3000 bp, Unknown; identical to SEQ ID NO: 4255
  misc_feature (1)..( 3000): 2750-1469P.txt file - cDNA_ID_3072914; gDNA_ID_2926187; Annot_ID_200742

SEQ ID NO: 33892 - DNA, 3003 bp, Unknown
  misc_feature (1)..( 3003): 2750-1469P.txt file - cDNA_ID_3072935; gDNA_ID_1620694; Annot_ID_164883
aaatgtcgaaagcattgaacaagaacatggaactcgaagatctgttgagaaaaatggaaatggagaatcagacgtggcagagaatggctcgtgagaacgaagcaattgtgcaaacgcttaacacaacgctcgaacaggttcgcgagagagccgccacgtgttacgacgctggtgaggcagaggtggaggacgaagggtcgttttgcggcggagaaggagacgggaatagtttgccggcgaagaagatgaagatgagtagttgttgctgcaattgtgggtctaacggagtaacgagagttctgtttctgccgtgtaggcatctctgttgctgcatggattgcgaggaagggcttcttctttgtccgatctgtaatacccccaagaaaagcagaatcgaggccctcattttctagggaaaatcctttcttttctctcaccggaaaaatgcttgcctttgtgttccggtgaacggagagtttttactccgggtagatgacgtggcagggtaatttggtaaaaataggggaggaaaggaaagtgagaatagggaaaggttagaaatagtaaaaggttatctcaagaagtaaattctgattagggttttcattttccctttttgttttttggttctttttccattcaatggagaaaaaaaaggaacccagctggatttgatgaacataattcatattttccttctatctaatgaattttcggatataaagtttgaatgccattctttctatttcaatgataattaacttcttaggatttttaaacacattagtattaaatatcttaatatacattttcctaatgattatatgtataagattttcctatattaaacacttcctaataagcaaaaaactagaaacttttgaccgaaagaataataattctaaactaatatgaaatccaatttaaacatatcttttaaaaaatttcatttataaaaaaatcaattaaatcaaatttaaacatatgtcttttaatttacatagaaagcaaaacaaaaaaagttatattcttttgaacaaaaaaaagaaagcaatgaaaaagtaaaaaaaaagaaaggaagcattatatattaatgggtttgttttgatgtaggaagatggtgaaaagaggtggtagtagaggccgtagacacgcgtattggaggaagctgtaagtattattgggttgctcaacaatcaatatagtacagtgacatgagagcacaatagtaagtaataattccacattaaaaaaatagaaattgaaagagaatcagagtttggcctgccataggatttgagttctcgcactttcctaaacagaaacatgtttcattgaacacttgggcctttcttcttccttcattaaggattctcgatctctgtttcgacagatctgtgctacctaggttttctagatactccctaatacctataaataaacaataagtataaccttattatgtaattagatcgtactactatcaataaacaagattgtagaaaatagtgaaaaaggcaacgcataaagattaattaaatcttatttaagtttcatttgggacaatttaagattattgtcttgttcataggatttatttcatctattagtattacaaacttttttacgcaaacattattatctctatgtatagaatgatttaaacttttaacgtaaacacaaataaacagtcagtcctatgtgctatggatgaggtgattagcattgtagggtgtttcgtgtcatatagctctactagtagagattttgtgtgtcagtgtgtgtttatttacggctttgagtcttcaagacccaattagccttaagaccttagtgattttagactctttgttgaaaagctagaaattgcaaacccaaaccgcctaatgttgctataggttttgatttccgaagtgggtaattaattatgtggattacgtataaacacatggcccggcccattttaccccccaagtgctcggcccaaattgaaagtgggactcactggattgccaactaattttatttaacacgacgtgaagtttggaactaatacgtcaggtattaaaagtacataaacatcatcattactcaatttgctaatggacgaatagagacggaatcaacaaagtaacaaacgacttcaatattttttttatatgttactatgattcgacaaaggattttttttttgttatgaactgaagattattggatttttaatcacaagatgtcaatatcaaaattcaataccatgtctcgattagggatatcaatatcatgatattttaacaactttaactatgtaatttaattcgattatcgtttttgttttaaccttcgtttgatttgtagatggtagaggtatttagttgttgaactcttctttatacacatgttgtttgttttgcttcttaaaaggataataatttttaaacttattacatgtgcaccactggtcgcattcgtagttttccatattttatgcgaaagaaatgaggatatcttgggaagatacaaattattgggattgttttgcaataactccaaaatgttatgtttaagagttttttgcttacgtatttcatatcaagccacgtagatgcatttgtaatctcataaaacatttcgattattattaacttactgcaccatattaaaaaacaaatttcgatatcgagattgtaaattgggcaattaggaattaggaattgaggtaggtaaagtttataagcagatgaggaaataatagcaaggaagagaaagaaagtggatgcgtcgtggattccatatttatgtgctttacttttccttttggtaggcgaaaattttgacattttccaacaaacatcctcatgtatttcacatattggcctgaccaactattatgcatattttatacatttgatggattaggctataacatggtttttggagtttacttttatacgttcgatcataggataaacatacgtcttttattaaaagctcgatctaactatg

SEQ ID NO: 33893 - DNA, 3000 bp, Unknown; identical to SEQ ID NO: 4271
  misc_feature (1)..( 3000): 2750-1469P.txt file - cDNA_ID_3072940; gDNA_ID_1620694; Annot_ID_164873

SEQ ID NO: 33894 - DNA, 3000 bp, Unknown; identical to SEQ ID NO: 4271
  misc_feature (1)..( 3000): 2750-1469P.txt file - cDNA_ID_3072940; gDNA_ID_2926208; Annot_ID_202404

SEQ ID NO: 33895 - DNA, 3000 bp, Unknown; identical to SEQ ID NO: 4300
  misc_feature (1)..( 3000): 2750-1469P.txt file - cDNA_ID_3072951; gDNA_ID_1620695; Annot_ID_164916

SEQ ID NO: 33896 - DNA, 3000 bp, Unknown; identical to SEQ ID NO: 4300
  misc_feature (1)..( 3000): 2750-1469P.txt file - cDNA_ID_3072951; gDNA_ID_2926190; Annot_ID_200988

SEQ ID NO: 33897 - DNA, 3003 bp, Unknown; identical to SEQ ID NO: 19914
  misc_feature (1)..( 3003): 2750-1469P.txt file - cDNA_ID_3072955; gDNA_ID_1620695; Annot_ID_164915

SEQ ID NO: 33898 - DNA, 3003 bp, Unknown; identical to SEQ ID NO: 19914
  misc_feature (1)..( 3003): 2750-1469P.txt file - cDNA_ID_3072955; gDNA_ID_2926190; Annot_ID_200987

SEQ ID NO: 33899 - DNA, 3000 bp, Unknown; identical to SEQ ID NO: 4289
  misc_feature (1)..( 3000): 2750-1469P.txt file - cDNA_ID_3072959; gDNA_ID_1620695; Annot_ID_164913

SEQ ID NO: 33900 - DNA, 3000 bp, Unknown; identical to SEQ ID NO: 4289
  misc_feature (1)..( 3000): 2750-1469P.txt file - cDNA_ID_3072959; gDNA_ID_2926190; Annot_ID_200985

SEQ ID NO: 33901 - DNA, 3000 bp, Unknown; identical to SEQ ID NO: 4313
  misc_feature (1)..( 3000): 2750-1469P.txt file - cDNA_ID_3072997; gDNA_ID_1620698; Annot_ID_164960

SEQ ID NO: 33902 - DNA, 3000 bp, Unknown; identical to SEQ ID NO: 4313
  misc_feature (1)..( 3000): 2750-1469P.txt file - cDNA_ID_3072997; gDNA_ID_2926180; Annot_ID_200209

SEQ ID NO: 33903 - DNA, 3000 bp, Unknown; identical to SEQ ID NO: 22313
  misc_feature (1)..( 3000): 2750-1469P.txt file - cDNA_ID_3073021; gDNA_ID_1620699; Annot_ID_165010

SEQ ID NO: 33904 - DNA, 3000 bp, Unknown; identical to SEQ ID NO: 22313
  misc_feature (1)..( 3000): 2750-1469P.txt file - cDNA_ID_3073021; gDNA_ID_2926208; Annot_ID_202419

SEQ ID NO: 33905 - DNA, 3003 bp, Unknown
  misc_feature (1)..( 3003): 2750-1469P.txt file - cDNA_ID_3073031; gDNA_ID_1620699; Annot_ID_165000
ttttttgtgaaaaaagaaaaaataaataaacccgatttattcatacatatcgttacaagatagtttgacgtttttttctctctaaagtaatatgatggtataaaattaggtttttaacagttgtactaaaaataggaaaaatccattttctgtttaatttgccacaaactcacaataggagaacatcttataatataaattacttaagccatatttgaccagaaattttcagtggtcaactaaagcgttttggagtagtatatgatttcattgaataacaatgaacttaaatctggtgcgttttaattcattccagttcaccagacattttataaaagtcaatgtttctgaaatttgccatattgattatacacactttcttgaaaaatgcaaagaagaatccagataaaataaaagttacactgtaatatcctaattttattaatataacagcaagcaatatatactttttaaaaatatacatgtctatgtttgtctaaatgtattaatttcaaaggcagtatgatgagctgtaaattaaaatagtaatacaacttttgtttttttcccagttttgtttcttgtgcacatctaaaattatgcctatggttgtggataacaacaaaaaaaaaagctttaacgtcaataatttgtaacaatggtgttatatggctgttttcgtttccttataatggcgtaaccttttgtagaacaaaataataggtaaactaagccattgtttgactaagaaaattacaattacttttcataattagaaaaagaacaaaaaaagtggtaaaaaatagaaccaaaaatcaaataattcaggcgttccagatgacccaactgaccaattcagtaaacaataaatttcaaatcagagaaaatagaagtaaataaccaaaaaataggaaaaagaaaagaaaaaatctgtgccctgccataattccacttggacttgtataatttttacacattaccgaaaaagccgaaaagaaataattaaataaaataaaaactagtactactaataaaagacaaaacggctctggcaaaatctctgaccttggaaagataaaagatagttcagtcacataatcagcatgtgtacgtcgtttctttagtgcttaatattataaattaagaatacttaaaaccaaatctttatataatattgattgtcagataaacattaacccaacaaagtctctctccctctcctattcaactttttcagttactttactccgttcatcttttatttttcttttcgtcgattctcatcaatactacaaaaatatatacttctatatatcgtgcagaggttacatgcattgtacaattttgttgtcccgagaaacaagcggatcagagacaaaatcagagtcggtttcctgctttttgattcctctttattaatcagcaaagatcgattccacttctcctctctctctctctctctgttctttaatttagagagaaaaaataagcattcttccttctctgttttcgagcgggaaattctggagatggctatacaagcgcagttgaattacaacgctccgaatgcgaatcaaatcggttttggtgggtccgagttttctttgatcaacaacaatggcgttatcggaatcggtaacgatcagtcttatcttgtcaataatctccagttgcagaaagatttcaaccaacatgctctgtttcatcatcagcatcatcaacaacaacagtctccttctcaaagctttttagctgctcagatggagaaacagaagcaagagatcgatcagttcatcaaaatacaggttcgttatttcgtaatccaaaccaatttttcatcgaaagtttcggtttttaagacgtgggtactgataaagattcaaccttttttgctttgttgataacagaacgagaggttgagatatgtgttgcaagaacagaggaagcgagaaatggagatgattttacggaaaatggagagtaaagctttgcttttgatgagtcagaaggaagaagaaatgtcgaaagcattgaacaagaacatggaactcgaagatctgttgagaaaaatggaaatggagaatcagacgtggcagagaatggctcgtgagaacgaagcaattgtgcaaacgcttaacacaacgctcgaacaggttcgcgagagagccgccacgtgttacgacgctggtgaggcagaggtggaggacgaagggtcgttttgcggcggagaaggagacgggaatagtttgccggcgaagaagatgaagatgagtagttgttgctgcaattgtgggtctaacggagtaacgagagttctgtttctgccgtgtaggcatctctgttgctgcatggattgcgaggaagggcttcttctttgtccgatctgtaatacccccaagaaaagcagaatcgaggccctcattttctagggaaaatcctttcttttctctcaccggaaaaatgcttgcctttgtgttccggtgaacggagagtttttactccgggtagatgacgtggcagggtaatttggtaaaaataggggaggaaaggaaagtgagaatagggaaaggttagaaatagtaaaaggttatctcaagaagtaaattctgattagggttttcattttccctttttgttttttggttctttttccattcaatggagaaaaaaaaggaacccagctggatttgatgaacataattcatattttccttctatctaatgaattttcggatataaagtttgaatgccattctttctatttcaatgataattaacttcttaggatttttaaacacattagtattaaatatcttaatatacattttcctaatgattatatgtataagattttcctatattaaacacttcctaataagcaaaaaactagaaacttttgaccgaaagaataataattctaaactaatatgaaatccaatttaaacatatcttttaaaaaatttcatttataaaaaaatcaattaaatcaaatttaaacatatg

SEQ ID NO: 33906 - DNA, 1095 bp, Unknown; identical to SEQ ID NO: 4327
  misc_feature (1)..( 1095): 2750-1469P.txt file - cDNA_ID_3073035; gDNA_ID_1620699; Annot_ID_164994

SEQ ID NO: 33907 - DNA, 3003 bp, Unknown; identical to SEQ ID NO: 19894
  misc_feature (1)..( 3003): 2750-1469P.txt file - cDNA_ID_3073035; gDNA_ID_1620624; Annot_ID_162459

SEQ ID NO: 33908 - DNA, 3000 bp, Unknown; identical to SEQ ID NO: 4341
  misc_feature (1)..( 3000): 2750-1469P.txt file - cDNA_ID_3073053; gDNA_ID_1620700; Annot_ID_165045

SEQ ID NO: 33909 - DNA, 3000 bp, Unknown; identical to SEQ ID NO: 4341
  misc_feature (1)..( 3000): 2750-1469P.txt file - cDNA_ID_3073053; gDNA_ID_2926192; Annot_ID_201126

SEQ ID NO: 33910 - DNA, 1207 bp, Unknown; identical to SEQ ID NO: 4344
  misc_feature (1)..( 1207): 2750-1469P.txt file - cDNA_ID_3073065; gDNA_ID_1620700; Annot_ID_165033

SEQ ID NO: 33911 - DNA, 3000 bp, Unknown; identical to SEQ ID NO: 4348
  misc_feature (1)..( 3000): 2750-1469P.txt file - cDNA_ID_3073090; gDNA_ID_1620701; Annot_ID_165074

SEQ ID NO: 33912 - DNA, 3000 bp, Unknown; identical to SEQ ID NO: 4347
  misc_feature (1)..( 3000): 2750-1469P.txt file - cDNA_ID_3073094; gDNA_ID_1620701; Annot_ID_165073

SEQ ID NO: 33913 - DNA, 2848 bp, Unknown; identical to SEQ ID NO: 19980
  misc_feature (1)..( 2848): 2750-1469P.txt file - cDNA_ID_3073094; gDNA_ID_2926176; Annot_ID_199903

SEQ ID NO: 33914 - DNA, 3003 bp, Unknown
  misc_feature (1)..( 3003): 2750-1469P.txt file - cDNA_ID_3073116; gDNA_ID_1620702; Annot_ID_165122
gaaaaactcgataactgtttttttttggtaattaaaaaactctaagaaaatctagaaacggaaaagtttgcatgaaaatttccaaagttcaaaaaggtgttgtccccttcacataaccacaccatcatcataattttgatcaaacatttgaccaagaaaaaggggtggtttcactattttagtttggtgtacttaagattttgaattatttaaagttcacgatatattggcatatacctcgaagaatggtgatcttgtactcaagtgctggaggagacctttaatttttaggagtgaaattctcttcaatttgcaattttctatttgatcacgttgaagatttcaaaaacattttttaatccaattttgtatgtttgaaattagtcaggaattcggcatatgattaactgcttatacacaagtattctgaaataaactaagatgttttggaaaaaaaaaaaaaaaaaaaaaaagtattttaaactcatattacattttttttcttcgcaaactagtattaccttcttactagaacaagtaaacaactatgggatcaatgaggtcatcgaatgccaaatatgaattctattattggccgtctacaaattaattaatggatataatgcaacccttggatactcataaacatcattatgcccaaaaagaacattagaggtagactttttcctctacacaagagaagctcagctgtctacagatcctatcttctccttctcataattttatagaaaactatagtatatagataaaaactatattgttttaggcgtcatatataagaaatatgcccacgcaagagaggataaaaaaaacaccacacaacagaatattttcccttataggtaaaggtaaaatgtcaatggaacataatattaaaatgattaaatttgatgcaaaaatattattttgtatattttcatgtagggcatatgattctatctttgtgatataaaaagatagcatcgagtacccagttttaaaattatgtcaacgtaggcatatcacaagtgaaaaacaaaacgtagacaaatcaaaatattaaaaatgtaaaggtcttatcataagtagaatgtgaatttgttaatagaaaatatgaaaaagtcgttaataacataaatgtgtataatatgtatcgtgggttcgtatattagatagaagacaagtcacctacgaacaagaaaatgtactatgtagtaatcttggaatattaatgtaatttctctctaacgctcaattaatatataacgttgtcacttgactcactttatctcttaaccattcattttctggtgttttgtgtaccgaataacatactgattaattattatgtatccgtccacttgttcgtgattttgtaaggtaaagtccaaacattttgtaaatagtctgaaaagaccaaaaaaattctaaaacataacgctaagtaattcacctaacttaaattatatgagacactaataatttcggaaactttgatgacgattttagctcaaacattatgtaactattttctaatgtttgtcccagtgattatgatgatatgaatatatgataatttttagatatttaaattatttcaatacttttgtagatagtgattgaatacattataccttacctaattagaaattaactcattcattcacctatagtttttacaaacacattactggtttacaaactcatattattatacgctgatgacatttatataaatcattaaactacaatgtatgttctaaaaatcttccaattttaaagtaaatagtataaaattaaatatatgcataaagtttaaacttagtttgtttccaaagcaaggaataatgtgcagggattcagaactttggaaattcttgtgagtttttttaaaattataagaactttggaaattaaactttagaagaaaatcttcatacaatcataaattcagctacaattgaaaagttgtagaagaacaaaaatagacaatgaaattagtgtttcttcaaataaaatggaacattttcttttgatgatattaattagcctttagaaaagttgtgatactcataaattgaattactcattttttctagagactccataaattgaatttaatctcataagaaatgtaaaatctatttttcaattgtttttatcacaaataaattattggttagaaagtgaattattgagatgaatatatatatatttgtgggaaaaaataaaatttaaaaataaaaaggagctatcatcttccatcatctgtctttagggcctccctctaagtctaacaaccctaaaataaaagattctaacaccaaaagagagaagcaaatctcaaattcttcccctattattatatgtgactgttgttgtttttctctcttttaccatctttggcctgaagaaaaaaaaaaggaatccttcttaatggatttggtaaatcaattaagaaagcattacacaaaataaaaaaggaaagttttttaataagcttcattgagagagagatatagagagagaaaagagagagaggccatattttgataagagaagaagaacccttatagagaaagagaaagagagagacagagagagtggatggatgtcttatagaatgaacaaaacatcctctgtttctcttgtccttgtccctttttccagatcttaaggttttccacattttatcatctgggtcctctccttaatggtgaattctccatctttacaagtttgatgtttttgttcatcaaatctggcgtttttttttctcttctaatatatattgtctctgctcattttccgtttctcttcccattgattgttctgtttcatttctgttttttttttttcaatagttttgattggatgctttgatgatccattgtcagatttgaagacactcaattcctatttgatcggggactagaatttggattctgtttcagacaaaagtagatttccctgtctctttcccgtttgattttcaataagatg

SEQ ID NO: 33915 - DNA, 3003 bp, Unknown; identical to SEQ ID NO: 33914
  misc_feature (1)..( 3003): 2750-1469P.txt file - cDNA_ID_3073116; gDNA_ID_2926189; Annot_ID_200895

SEQ ID NO: 33916 - DNA, 3000 bp, Unknown; identical to SEQ ID NO: 4371
  misc_feature (1)..( 3000): 2750-1469P.txt file - cDNA_ID_3073133; gDNA_ID_1620702; Annot_ID_165109

SEQ ID NO: 33917 - DNA, 3000 bp, Unknown; identical to SEQ ID NO: 4371
  misc_feature (1)..( 3000): 2750-1469P.txt file - cDNA_ID_3073133; gDNA_ID_2926189; Annot_ID_200883

SEQ ID NO: 33918 - DNA, 3000 bp, Unknown; identical to SEQ ID NO: 4395
  misc_feature (1)..( 3000): 2750-1469P.txt file - cDNA_ID_3073145; gDNA_ID_1620703; Annot_ID_165165

SEQ ID NO: 33919 - DNA, 3000 bp, Unknown; identical to SEQ ID NO: 4385
  misc_feature (1)..( 3000): 2750-1469P.txt file - cDNA_ID_3073161; gDNA_ID_1620703; Annot_ID_165158

SEQ ID NO: 33920 - DNA, 3000 bp, Unknown; identical to SEQ ID NO: 4385
  misc_feature (1)..( 3000): 2750-1469P.txt file - cDNA_ID_3073161; gDNA_ID_2926174; Annot_ID_199734

SEQ ID NO: 33921 - DNA, 3003 bp, Unknown
  misc_feature (1)..( 3003): 2750-1469P.txt file - cDNA_ID_3073168; gDNA_ID_1620703; Annot_ID_48803
accgagttcatggggtcaatgctccaaggtagcatcaaacttcagatcaagtgcttcacggcggctttgcttggctgcgccgtaatgtcggtcgtcgccgtgtgggcttaaacactctttcaacataatcaataaattatttgatttattattcaaggcgacaaatactttcgcctttgtatatttgagtttttgtttttaagtttgattcatttattagtttgtatagtgcatgtaagcgtttgaaagaaatttctttttatgacattgtaaatttatttttatgaatgcgatgtttactttcttctttggaatgacatgtatttaattattggagtttgttgattgtcaatgttagttagaaaaaattaggtccgaaatactagtgacacggaaattaaagctatatgaattaatactatcaattatatttaaaattactctcttcaagaaaatgtacatacagtctcttgttttaataaagaaaaatttcttactttggttagatttaaattacacaatatttcatgacaactatttaaccataaaaactcgataatgtactatatctaacacataatttgtaggtgtgaatggcttaagctaaaaagcttataaattctatgtatttcattccatttcatggttttttggttgaaaactttaagtacaataacagacttactaactaatttgtaaatttccacacatgttttgattccatacacctggaatcatatcaaatacttgtaaattctgaacctattgaaacaagttgaaccatttctttctaaagattaaatgcattatcttgaagtataagttcttagaacatactattaaataactttgaatagtcttcaattttactaatgccttaatcaagttttgaaattatctttttcaaatcatacacacttcatcctgacaattgtaaatgtttatagtttttagaataatttttactattttttttaatttgtgtcaatatctgatttggtttgattctagacttcgtttgttttctcaaattgtgcaagtaaaaaacacgaatatatctattttttattttatgttcagaaaaaaaaaaatatatatatatatatatattcgtgttttttacttgcgcaatttgagaaaacaaacgaagtctacaattaagcgaaatcacacattgacacaaattaaaaaatatttcttttctcgaccgaaaaaagaaaattatttcaccaatatggaaaatctccccaagttcattctattttctgtatcaaagttaacgaatagacatataagcattttgtcacgtcggtggagtatgagtttggcacgttttgtttcgtgctcgtccaaccatatgaaaacgtgggaggtaaaccactcaactaataatattatacctttaaaaaaactatattataaatccagtttgatgcttattttattaatcattcttcaaagaaataaaacttaaatagtgaaaattataaccgaagttgactagttaggaggcatgccatggaatattggatacatactcggcatggacagtattgaatatacaggataatgtagataactatattttctataatttattttgtgtcaactattttttctatgattctgatgattaattgcatgacaatcaatcaaattaattatgccttcttctatataaccatgcaaaaccaaaaaaaaaaagattatttcgaaacgacatgagaatcaaaagaactcataaatcctaatagacatgaaattatgtatacagttataacattgaaatatcttaataccttacctaaaagataactagattaataaccataaaaccaataatcattaagtcaataaccccataatcttataaatgaagtcagtgactatatgttcatgtaaaaatgcgtaagttcatagctagatgtcccttttttaggagcacatggattgacacattaaacattcatacccgatttcatggaattctatttgtcattatcctttcccaaaaacttagttgtttcttagttattaaaccttgaaaaaaaatcaattcaaaaatgaaaaatgacttatatgtatgtcatttttgaaaactagacatcaagctatgaaaagaggaatctatttaccgaataaaggaggaggaatctacattcatatgtagtgtttttggtgactggattgcaaccatacactgagcacaagctgtcacgtgtgatgttgtgctcgtagcataaactataaagtataaacctaattaagcttaaagttaaaaatagtacaagattaaaaagtaaacgtttgtgagagttgactaacagaactatagaagacgcatggggttgacttcaagcggtctgcaaacggcatgaacaatgcattcaaacgataatataaaccttaattccaatatagcctttttcaaatttaaaaactcgaatgtttacgaaactataacttgataaaactgattgaaataaaatgtacttacatttttttaataaaatatacttaaattttttaaataaaatatactttaaaatatacttaattttttaaaatcatactatggattttaaacaaaataaattgtcactgagtcatatttctttggataaaagaactttacataagtgattggtacaatataataatatgcaaatttaagacattttattaagtttatattatcgtttaaatgcattttctatcaacttaataaaatctagctaggtactttcataattctatcattattccttttgaacgattaattactttattttctcgtttcacactggaagcaaacgagtaatcaaataaaatttcgtcatcatcgacaataaatggcatgaaaacaaccagcacacattactatataaaccgattcatctagtaagtccaaagtcacacaaacattaaacaatctaaacacacaacaatccaaaagaaaaaagaaaaaaaaaaaaaatggcttcaaattcagcacttctcatg

SEQ ID NO: 33922 - DNA, 3003 bp, Unknown
  misc_feature (1)..( 3003): 2750-1469P.txt file - cDNA_ID_3073168; gDNA_ID_1620703; Annot_ID_165148
atggccctcgtcgaccttctagctaccgagttcatggggtcaatgctccaaggtagcatcaaacttcagatcaagtgcttcacggcggctttgcttggctgcgccgtaatgtcggtcgtcgccgtgtgggcttaaacactctttcaacataatcaataaattatttgatttattattcaaggcgacaaatactttcgcctttgtatatttgagtttttgtttttaagtttgattcatttattagtttgtatagtgcatgtaagcgtttgaaagaaatttctttttatgacattgtaaatttatttttatgaatgcgatgtttactttcttctttggaatgacatgtatttaattattggagtttgttgattgtcaatgttagttagaaaaaattaggtccgaaatactagtgacacggaaattaaagctatatgaattaatactatcaattatatttaaaattactctcttcaagaaaatgtacatacagtctcttgttttaataaagaaaaatttcttactttggttagatttaaattacacaatatttcatgacaactatttaaccataaaaactcgataatgtactatatctaacacataatttgtaggtgtgaatggcttaagctaaaaagcttataaattctatgtatttcattccatttcatggttttttggttgaaaactttaagtacaataacagacttactaactaatttgtaaatttccacacatgttttgattccatacacctggaatcatatcaaatacttgtaaattctgaacctattgaaacaagttgaaccatttctttctaaagattaaatgcattatcttgaagtataagttcttagaacatactattaaataactttgaatagtcttcaattttactaatgccttaatcaagttttgaaattatctttttcaaatcatacacacttcatcctgacaattgtaaatgtttatagtttttagaataatttttactattttttttaatttgtgtcaatatctgatttggtttgattctagacttcgtttgttttctcaaattgtgcaagtaaaaaacacgaatatatctattttttattttatgttcagaaaaaaaaaaatatatatatatatatatattcgtgttttttacttgcgcaatttgagaaaacaaacgaagtctacaattaagcgaaatcacacattgacacaaattaaaaaatatttcttttctcgaccgaaaaaagaaaattatttcaccaatatggaaaatctccccaagttcattctattttctgtatcaaagttaacgaatagacatataagcattttgtcacgtcggtggagtatgagtttggcacgttttgtttcgtgctcgtccaaccatatgaaaacgtgggaggtaaaccactcaactaataatattatacctttaaaaaaactatattataaatccagtttgatgcttattttattaatcattcttcaaagaaataaaacttaaatagtgaaaattataaccgaagttgactagttaggaggcatgccatggaatattggatacatactcggcatggacagtattgaatatacaggataatgtagataactatattttctataatttattttgtgtcaactattttttctatgattctgatgattaattgcatgacaatcaatcaaattaattatgccttcttctatataaccatgcaaaaccaaaaaaaaaaagattatttcgaaacgacatgagaatcaaaagaactcataaatcctaatagacatgaaattatgtatacagttataacattgaaatatcttaataccttacctaaaagataactagattaataaccataaaaccaataatcattaagtcaataaccccataatcttataaatgaagtcagtgactatatgttcatgtaaaaatgcgtaagttcatagctagatgtcccttttttaggagcacatggattgacacattaaacattcatacccgatttcatggaattctatttgtcattatcctttcccaaaaacttagttgtttcttagttattaaaccttgaaaaaaaatcaattcaaaaatgaaaaatgacttatatgtatgtcatttttgaaaactagacatcaagctatgaaaagaggaatctatttaccgaataaaggaggaggaatctacattcatatgtagtgtttttggtgactggattgcaaccatacactgagcacaagctgtcacgtgtgatgttgtgctcgtagcataaactataaagtataaacctaattaagcttaaagttaaaaatagtacaagattaaaaagtaaacgtttgtgagagttgactaacagaactatagaagacgcatggggttgacttcaagcggtctgcaaacggcatgaacaatgcattcaaacgataatataaaccttaattccaatatagcctttttcaaatttaaaaactcgaatgtttacgaaactataacttgataaaactgattgaaataaaatgtacttacatttttttaataaaatatacttaaattttttaaataaaatatactttaaaatatacttaattttttaaaatcatactatggattttaaacaaaataaattgtcactgagtcatatttctttggataaaagaactttacataagtgattggtacaatataataatatgcaaatttaagacattttattaagtttatattatcgtttaaatgcattttctatcaacttaataaaatctagctaggtactttcataattctatcattattccttttgaacgattaattactttattttctcgtttcacactggaagcaaacgagtaatcaaataaaatttcgtcatcatcgacaataaatggcatgaaaacaaccagcacacattactatataaaccgattcatctagtaagtccaaagtcacacaaacattaaacaatctaaacacacaacaatccaaaagaaaaaagaaaaaaaaaaaaaatg

SEQ ID NO: 33923 - DNA, 3003 bp, Unknown; identical to SEQ ID NO: 33921
  misc_feature (1)..( 3003): 2750-1469P.txt file - cDNA_ID_3073168; gDNA_ID_2926174; Annot_ID_140252

SEQ ID NO: 33924 - DNA, 3003 bp, Unknown; identical to SEQ ID NO: 33922
  misc_feature (1)..( 3003): 2750-1469P.txt file - cDNA_ID_3073168; gDNA_ID_2926174; Annot_ID_199727

SEQ ID NO: 33925 - DNA, 3000 bp, Unknown; identical to SEQ ID NO: 4378
  misc_feature (1)..( 3000): 2750-1469P.txt file - cDNA_ID_3073172; gDNA_ID_1620703; Annot_ID_165142

SEQ ID NO: 33926 - DNA, 3000 bp, Unknown; identical to SEQ ID NO: 4378
  misc_feature (1)..( 3000): 2750-1469P.txt file - cDNA_ID_3073172; gDNA_ID_2926174; Annot_ID_199723

SEQ ID NO: 33927 - DNA, 3003 bp, Unknown
  misc_feature (1)..( 3003): 2750-1469P.txt file - cDNA_ID_3073180; gDNA_ID_1620704; Annot_ID_165185
gatatcgctattgctctctttaaccattttggtccaaaacactttgccaacttttttaataaagactgatacaaattttagattgatacaacttaacattaaaaccacccaaataaaacttcgtaatatagataagcatcattgtaccacaaccacacaccaagccaataagtcaacaactactcctaacccttttaaacctaatcaatacaatttaatattagaccgactacgtgatggtgcatatgcttctttttaccaaaacatatatattcaagcaacaattaatacatatttcgattctcaatttaatcaactgaagaaatttcggtcacttgttttaatttttttttgtaaagcttataatttttattttgtaccaacatttaaaaatcaattattttggtgaaattaggatgatagataccgtcaacctacttttgttgaccaaacttgattctaaagaaagaaagcaaaagagagagaacaaaaacgaagacaactctcatcttcttttctctttctttttcctctttctccattgcttgttgattgatgatcttgaagcaaggatcatgaggttccttcacagatttctgttggaggatatgcccaaagaaaccttttcggactctctctgtaaaaataattgcatccaagagttgaaaactctaggatactgttcatcctattgtcttgacgagtgtccttccatctgcgagatcgtcgtaatttcaggtctttcaccacctgcagagatccacccgacgataacttaaagaggatcttgatcatctctgcttcatctatcatcacaactctgtttctccttactttacttgttctctgcttcaagttttactataggaggagaagatcaataacaacatcaagaagatggagtatggaagaagctaggaattgggattttgatggaccagcacctgttattgttgatcatccgatttggcatatcagaaccatagggttgaatccaacggttataagttccatcaaagtttgtcagtatagtaaaaaagatggtgttgtggaaggaactgattgctccgtttgtttaagcgaattcgaagaagaagagacgcttagattgttaccaaagtgtaaacatgcttttcatctttattgtattgatacttggcttagatcacacaccaattgtccgctttgtcgtgctcctatcgttgaggccaacacaatgattgatgatcatagtgaggggctagaggagataagtgtgatgattccagaagaaaatggagatgataccgatgaagaaatcgaggaagaaagagatggctttgttagtaatattagtagagatcatggtgagtcacaacaacagcgagtgagacgatcagtgtcgttggattcgttatcgggtttaagggtaagtgaagttgttgtgggtagagaaaaggagaagttgaagagaggcaataatattggatctgggaggtcaagtttattgaagagatctatctcttacagtggaaagtagtactagctagcttcagtgctaataataaaaacaagaagtccataaagtaagtaagtttcttgaagaagaaaatcaaatcaaacccaacaagatatagattgtattcatatgtatgaaggtgatataagattacgattatcaaagctagtcactcttgtaaagttaaaagagagttttgacaacttctactactctgcttagatactctggatttgtggattaagtataaatatacaccaaacttcgttttgtatgttacttatttattgttcctcaagaaataccatctggattttaattatttttagattcaactgtcttatgtgaatggatttacatttggcgttgtggatctctaacactaactatatgaaacgctgcgtttcattaaaagaaggtaaaaacgacaaagagaatcttcgtcttcatcgatcattgttgtgtaaaactcttgttcctcttcctcttcaacgtgaacacttctatttctcagagaacattcacctatatgtctttcttcaaggagaagtcttcctctttccagatttaggttagattcatgttataactttttctaagatttctgatttccgaatttgaattttgtttatgatttagtgtcggtgtagaactgaatgatactaatgcaaatgattgagatcgatttgatgtaaaattatcaccttctcgtgtaatttaaaggtcgaatcgtccggggtcacattgtcgcaggtttatgtttatcctctaaattagggtttcttttgtgaaattggggattttttttgtctgcttacaaatcatgctgttttatttctcttgaaattaacttcatgctgtttttgacatagaatacaacagacaaactagatttaacagaactgttaagatgaacggaacataagatgacttctaaaaatggataaattttaggtcaatttttctttccattttcagttttctgaccctaggtgagatttgttttggacttttcatgtattgtacatgtgagttaatcaaataaaatctaggttcatgcatttacaaacatagtttaggaagtaaaatcacatgttaagttttgatcttaaactcttgttgttattcttgttgttgtttgctacttgttagaattatgaatctttgacctatagcaaatttccataaaatcaatcatgttaacccttaatccaaatcctccatcaaagagtttttttgcattagttagcttctcatgaagcgaatttggttttgggaaaagaatttgtggggtggggtccaaaactgacacgacacaaaaactttggtttctccgtctttgttggagaaatgcattcacatccacttcttaccaaaattaaataaatcaatatttaatttttttaaggccttcttgttttttcagatgaacactcttcagatgccttgtgccttattgatccagattcgaagtacccaactttactctctagacctttttcatg

SEQ ID NO: 33928 - DNA, 3003 bp, Unknown; identical to SEQ ID NO: 33927
  misc_feature (1)..( 3003): 2750-1469P.txt file - cDNA_ID_3073180; gDNA_ID_2926204; Annot_ID_202078

SEQ ID NO: 33929 - DNA, 3000 bp, Unknown; identical to SEQ ID NO: 4409
  misc_feature (1)..( 3000): 2750-1469P.txt file - cDNA_ID_3073222; gDNA_ID_1620704; Annot_ID_165212

SEQ ID NO: 33930 - DNA, 3000 bp, Unknown
  misc_feature (1)..( 3000): 2750-1469P.txt file - cDNA_ID_3073230; gDNA_ID_1620704; Annot_ID_165206
aaaggaagattctgacagaaacaagagactagctatactctgctgcctaacaaaaaggagcatattcccttgcatgttgttcatcgttaacatattctataaagtatattgcatttatcaataatttaagttggaaatcagtagattacctctaccttttttaataattcttaattgggtgtgatctaaagagacctgatccactagaaaagatctcaaggttatatgttaaaacattttgcaacatttgtttatccatttcataaaatattagttgttttctctcttaacttttgtgtgcaacaataaataaatccaaaagttttttaaaaaataattatagtagtggctagtggtgagtaagactatactagtatatcaaatttgcatgcgtgtgcgaacgatcatagatttaagaaccagacaagcttatccaaatatcaatcgtcttagaaaagcacagaattagaaaggtcgtcaaatcgaggaccctatggaccaaccaagtaattgtcactgaaatatcaccctacatgaatggaagctcaatgtaaacatctaaaaaaggtttttgaccatgaggaaaacaagaatcttaaaggtgcccaagcactattacaagtagaaatcacaatcaaattgtatttgattactagctttctacaaaattagcaaatatatatgtcatcactgttagttttgtcaactatctatgcgatgatttagataggtcttaataaggcgctgggggccggtcgtgagccatcatcatggaaccgctgtcgtatatgaagaaggatgacacttaatcatatacaaaatagatcaacgaaaggtttctaagattttttctcatcaatgtttcaggatccaacaattagcaaggatcaatcatatgataattcaacaacagctgaccaaaggttttttttccaataggtttcattgtttttttacctcttttttttttttttgataatttacctttttaataccaatttgaatttgttttccgattattttgctataaaagaacacatttatggactcaaatatatatccaacatttatggcagacatcgtccattttcggttctttggaccattaggcgcgaataggaactcaccactaaaaaagatttggtgacgtaattacgtcaatcatcgaagtttctaacttttacaaccccaaggctcaaacatgcttcaagcaaatcttgttgcatttgttgtgatcgaagttggaaaatttgtcacacgaccttatggctatttacagttttgatggtagtcatgctacacaaatttacaagtactgctcgtttactgtactgctcacttgctcagtcactagttaacaataagccaattcatcgttatctaacgaaattcattatagtaataatattaaaatactcaaaatacgatttgtcagtctattgatgtatttgatgtagaagtaagtgtaattcactaaaaagagggaaaaaaaaacgaggagaatacgtggaaactatagccgctttttagtgtatttgacaattgtaaaaaaaaaaaagtatatatagttttaattttgttgtcgcttgtacttttcaagttgcttgtaatatggtttcatcttgagaaaaaaaaaaacagaaagagaaaatacaataaatgtattcagaaaagaagaataaccaaaaaaagcagcaaatctttgggaacgaccatgtcactgtagcatctgtttttctgcaaattattctctctataaatatatttgatcatcagaccaatctctccctcaacatttcctcatctcatctctctgatttcttgcttcgaattttgatttatctctctctgtctctctctcggtctcgtgctctatctcgtttgtaggcagtgccaatttcaccacttgtgttgtgtgtcagcggatatagaatctgagaggaatatttaaagattctccctttgcttcttcttttttataccgtttctattaatgtttgggactcttgcttccggcgaaatcgaaactgccagactgaaccgtaatttggggattacgtccaatttaggggtttcctgcggtggatttgaagactttgctatgagattcgaaggggaaaacatggtgccatacaaaggtgaagagcaggaggaggaagaagaccaagtggtggtgaacgaaacgacgccgttccagtttcaacaacctttgtttctgcagcagcagcagaagctcgttgttgggtatgctctgacttctaagaagaagaagagtttcttgcagcccaagcttgaacttcttgctaggtaaccaataacaaacccaaaatgcttctttggagttataaagttttgatttttcattgcaaagtttccaaatttgttgaacaatcttttttggttctgctttttctttcctgagagacgactgttcctttgttggcgtttaaacataaccgacaaactcttttctactttcaaaaagatctttaggactttgacattttcttccagatttggttcttgtttccttactcttgttttggtacctattattggtttgcctgattctatgaggaccattgccacttgccatgtcttgtcacctgccatgtttttgtccttaatcggctcttttgcttagggttaggcttacactagtatactctacttgtggtatcaggatgtttctatgggaatattccttgtgtaatccttttggattagtctctattgaggtttgactctggcttttaaaaaataaaatacttagatgttttgccttttctgtggcttggaaatcttcttcaaccacatgggtgtttttgttaaagcaatcactggttctacttaatatgtcatcttctagaatgtctctaataggtcagagagaacatttcttattggtttagtttgacgtctggtctctgttttgcttctttctaatcaacccatagctttcattctttttcttctttcagcagtgttttcaagaaaatg

SEQ ID NO: 33931 - DNA, 3000 bp, Unknown; identical to SEQ ID NO: 33930
  misc_feature (1)..( 3000): 2750-1469P.txt file - cDNA_ID_3073230; gDNA_ID_2926206; Annot_ID_202194

SEQ ID NO: 33932 - DNA, 3000 bp, Unknown; identical to SEQ ID NO: 4419
  misc_feature (1)..( 3000): 2750-1469P.txt file - cDNA_ID_3073234; gDNA_ID_1620704; Annot_ID_165205

SEQ ID NO: 33933 - DNA, 3000 bp, Unknown; identical to SEQ ID NO: 4419
  misc_feature (1)..( 3000): 2750-1469P.txt file - cDNA_ID_3073234; gDNA_ID_2926206; Annot_ID_202193

SEQ ID NO: 33934 - DNA, 3003 bp, Unknown
  misc_feature (1)..( 3003): 2750-1469P.txt file - cDNA_ID_3073242; gDNA_ID_1620704; Annot_ID_165192
gctgtttcagtagaatacgtctctgattctcaagattcatatgaagttgagatgaaagtagaagatgatgatgacgatgagcttatagttactggagaatcttcagggattcatggaagcagagaaatcaagtctgattcagcatcgatcgaaagagtgaacaaaagtagagattcaactgctgcctcttgttataatgactttcttcttgtgttatctgatgatgagaggagctcagacgacaaagaaaacatcttaataagttcaaatgtgatggccaagccaaaaacttgatactttaatgaagatgaatatcgccaatctaatgcgattattatttttatggttttctaatctctttgcccataatgaatatcatgtcaaattttatattcaatagtgctcgtctcttatacgaccagtatcaaagctttgtttttcaacagacaaaaaacaaaagaatctgctgttattatccaagtgggaggatgaaaaccgagagctcacacaatgctttaatacaaaaagaaactgatgtcgtcgtccattcacattcacacgtcttcgtctctactctgatgctccaggagcaattgttccaactcttccttgcgtcgggctatctcctgcaataagggtcaatgacttagaaaccatttgagtgatgataataatgatgcagatagactatcaattgacacttgcctcaagatccttgactgcttgttctcttgaaacttccttttgctgtcgagcacgcttcagaaagccgatgcagagaactccctgaagttcagacaacgatcaaagattgacagtgaaaacataaacgggaactcagatattgaaaaacaaaggaagtgattgcccaagaagctcatttttcaagttagaaatagccctacagattcgctaaccaccacatcaagcatctattgttcagagttgggagttatccaagtgatcctaaaggtctggggacaaagtgtcaacatgagttcttacaacaaaccaagaatcgttttcaagtgaaatgcattcttataagcaagatgcaaccacaaggcacaaactaatacgaaaagattcaacaataagcgagagcagagagggaataagcagatgtgatataataggatgaatggtgatagcgtacagaaatgacatagataacaccacaagcaagaagcaagtagcttgcgatgttctgtagaagcaggagatccttcttttgagtcatatagtcagggaaagctcttgtcatcacagcaacactgaaatgaacaaagtaaagatatatacataaaacataaaatcatacagcaaccaaggaatggtctcatttttgagtacctggcctggaattagctgaagcagcactcaaaaaacacatcataaaagaacaacacgatccattccaacacaagaggtacaaaagaaggttactaagctgtatagatgtacttacaaaatttgaagcattcctctaccagcccagtattcaagaacctgtaaacagatttgcaaaattagaatcaattcatgttagaaaatcaaaggaaagagatagcaaaagatacgaaaccttggaaaatttgagaatgaaaccccattcagtctcaacgagaacaacaaaacaagcaatcaccacagcataacaccggaatattccatcgaagagctgctcggagaggaaaagataaaagctttacacagagatcatcttcaagtaatctaatgcctgcgcagcgagagaggaaaaagagagagagagagagagagattatacatcgtggctgtcacggaaggagcgaacggcagcgagaacgttaacgacaacacagagaatggcgatgagagaggtaacgaggctgaagcatctacaaacaacaaggaaaggatctgctctgtttccgagcttcaatttcgcggatccggaagaaggtccggcgggggattcttcgatttcctcagtcctatccatctaaaaccaatttcccggtgagaaaatccgccgtcttaagtggaatttggaatcgagacgcgaaaaacgaaatggagaagcttgttggttaggattcagaagtggttagtgcggaaagctgaattctttctttcaccggacgttcaagccttgtcttttattcttcttctttcttctttgggaatatttaactctgcttactatttttatatatcagatcattaagtgttgtacaaaaaaacaaaaaaaacgtcattgttgatttgttgtaatgtttagaaatatgctatttttctagatatttttgcagtaatgctaacaggtatgcgatttctatcagttagtattcatgaccacatcatactgctctctctaaataattcagggctccacattacgattttttattataaaatctactagtacttataagaaagtagagttaatgaagtcgatgggaaccacttgggagagtggttacaacactccagtctagtcacatgtaacatgttcatggatacgacctagcttcctcttagtgaggttaaataatcctatagagcccattagaagtcaatgggctaacaaatatatgactggctctagctctagctctagctctagttctaaaaccaaaacccaagaccacaacaaacaatttttgccgtaacacactactaattttcactttcatctacaataatctccaaaattttgtattatgtagagatttgagtctgaatacgctaaaattttactcaaaaactggactataaattagaaattttggtctttttggattagcattccgttcgaattgatccgcataccaaaaataaaataaacgttgcggtttggttggttaataaacggacatgaccacataacacataagtcagtcacgagtcacatattccttttggtcaatcaaaagcccatatcatcatcatcgtccacacaacacaaaactatattcgatttcttccaccaccacacgctctcacatctctccggcgatg

SEQ ID NO: 33935 - DNA, 3003 bp, Unknown; identical to SEQ ID NO: 33934
  misc_feature (1)..( 3003): 2750-1469P.txt file - cDNA_ID_3073242; gDNA_ID_2926204; Annot_ID_202084

SEQ ID NO: 33936 - DNA, 3000 bp, Unknown
  misc_feature (1)..( 3000): 2750-1469P.txt file - cDNA_ID_3073246; gDNA_ID_1620704; Annot_ID_165191
tctccacagattccagattggcaggggatcgaagtgactctttaagaggttggtttccagaaagtcgatcaacaatatcgcctatcacaaatttcactgcgatttcccttcctccgttgttgtcaatgatttcatccgtcacagattccaattcaatgtcagcatttttttcatcgatttcagccttagtgtcatcttccacatctatatcttctatatcaagatcgttctcttcatcttcttcatcagctatctgctcaataacttttgagatgaaatccttatccacccttccaggcgcagttactttcataaccttaaccttgaccccgggaatcatatctcgcaggaaactctggaaaccagaagattcctcaaggagatcagaatcatcatctgagttatcactctcttcatcttcactactctcaactgcaagattaccagtatcttccttccttccaggtgaagtcaaaaacctaccaggagtcaaagttctggagggcatagttggtacgtctggaaaaatctccttccattttaagtacacagcctgaagaaacacacatcccaatttaacatcgaaatatattctccacctagatattctagacacattggtcttgagataacgtagagaaatcacactttgctatctactcaaaaaggtcagcttcctataaagaaccaaaatgaagtaaactcccaatttcatcgaataaaccggaacataattctccaatgaataccccaatcactcaaattggacactatctaagtaggattaaggaggaaaaaacctgctttttgtagttccctttcccatcaagtgtcagaaagatttcaaaaagaggagcaccagcagcagatgtactaagttgcctgaaagagagaaaggattgttatatagcacaatctttcaaaacaacaaaggacctcgagaaatttggcgttttgatacacaaaacccacactgccacagataaatcgatgagtaaagaagacagaagtaccgaggattataacttcttgccacatatcttccatgctctgcagtaatttgaacaataagaccaaacggatctttgacatcttccgaaataccagaccaccaccctacctgcaagccatatagagaaaacaatgtaacaccaataagaagctaaaccacagttataaaagaaacgagaaaaaatacaaataatgagctcaccaacccagcaccagctttgtctcgcaagtatactgcatccttgtaacgctcttctagaagagctctctatgacaaatacaaaaatggaatctttcagaatcaaaagtaagtatcccaaacagtgttgttagaaactataatcacaactcgagttattacataaaaagtggacatgactttgccaacagcatcattagtagcagtagctgcaattgccacctttagcctcgcagcatcttcatagtcttctcgtttaatggctcgattcaattgcgactgtacaccccaaaatacaaaatccccgcattagaaacatttcttcaggactcttaacaacaatgatagatacaatcatcaagaggaaacctttaagacggagagaagacggtcttggtcatcaacttgatcgaaatgcttcttccaacggtcccaatcccaatcatcatcaatcttctcgacattctccgatccttgctcaccatcatcgttatccagagtagcgtaccagctcaaaaccgaatcgaagcgtttgatggcgctcttgagaacatcctgaatcgcagagtcccatctagggttatcatcggaggaagaggaagaggaagaattgctgccggaggaggaggagcagcgacagagagcggtgggatcggggagacgatgagggtaaaaagatcttttggaggagggagtgagtctggatgacgtggcagaagcggcaggggagaaggcgagattttgggacggcggggtggataaggaaggcatcgccggagagatgtgagagcgtgtggtggtggaagaaatcgaatatagttttgtgttgtgtggacgatgatgatgatatgggcttttgattgaccaaaaggaatatgtgactcgtgactgacttatgtgttatgtggtcatgtccgtttattaaccaaccaaaccgcaacgtttattttatttttggtatgcggatcaattcgaacggaatgctaatccaaaaagaccaaaatttctaatttatagtccagtttttgagtaaaattttagcgtattcagactcaaatctctacataatacaaaattttggagattattgtagatgaaagtgaaaattagtagtgtgttacggcaaaaattgtttgttgtggtcttgggttttggttttagaactagagctagagctagagctagagccagtcatatatttgttagcccattgacttctaatgggctctataggattatttaacctcactaagaggaagctaggtcgtatccatgaacatgttacatgtgactagactggagtgttgtaaccactctcccaagtggttcccatcgacttcattaactctactttcttataagtactagtagattttataataaaaaatcgtaatgtggagccctgaattatttagagagagcagtatgatgtggtcatgaatactaactgatagaaatcgcatacctgttagcattactgcaaaaatatctagaaaaatagcatatttctaaacattacaacaaatcaacaatgacgttttttttgtttttttgtacaacacttaatgatctgatatataaaaatagtaagcagagttaaatattcccaaagaagaaagaagaagaataaaagacaaggcttgaacgtccggtgaaagaaagaattcagctttccgcactaaccacttctgaatcctaaccaacaagcttctccatttcgtttttcgcgtctcgattccaaattccacttaagacggcggattttctcaccgggaaattggttttagatg

SEQ ID NO: 33937 - DNA, 3000 bp, Unknown; identical to SEQ ID NO: 33936
  misc_feature (1)..( 3000): 2750-1469P.txt file - cDNA_ID_3073246; gDNA_ID_2926204; Annot_ID_202083

SEQ ID NO: 33938 - DNA, 3003 bp, Unknown
  misc_feature (1)..( 3003): 2750-1469P.txt file - cDNA_ID_3073248; gDNA_ID_1620704; Annot_ID_165190
ttccccattggtacacaagctgaccaactcctgcaagcttacgccatcctttagggagaaattccatcacgctactatttctgtccattagaaccaaattagtaagttgtgcaccgtgtggtgatactaacacatcggtcattctcatcagctccacttgctcacagaatgttagattatttgaataagaaactttcaattcacacccttctacatttttacactctctcttaaagatatcgatcacggctgactcattcttgaatgatcttggtccggttctcattagcaatgtcatacctattcgtgattttgatgtctcggacaagcttatgttacaatagtgtctggctttgcatctaatgagatcaagacttccattcttctctcccttgacattccaccttcattatgtctcataacaaccgccttctcaaagcaaaccggcctgttcttatcacgaaaccgtaaaaattctgtgttctgaccgtaagtcgctgtgattatctcgttcaaccaattccccatcttgaacctgagttctccccaatggtataaaacccatctttgaggattttcgcactggtgtcttaagctccaagcaacaaatgggaccatggcggacagtccatgccacatattaccgtaatcgtaatgattatacgagacaaatgtcaatccctcctggagactggcattgacaggaagagcttgaggccaagccagtgcataagtagttccatatgatccatcatgctcatcaacccctttcaagcacaaaagccttcctttcgaagattccgaaggaaattcttgatattgaacctcaccttttgtttggttatcgtagagagagctcataaaccaagtatgaccttcaagtggtttgtttgaaaaacgaaggtctttcaggggaaggaatgttaccgactcacgtagtttctccaccaagtaagccgtctcgttctcagattttatttgttcaggttcttgttgttgttcttttagatatgtgaatagtgaaggaggaagtaaaatgggttgttgggtaatgtgaaatgaccagatttgaagaagaacaaaaactgtgacgacaagacacaagacgttcaaggagaacttaggggaggctaagcaagtaactagattccttgaaacgctgcgtttagtcatgttttgaatgggaagagtgaatgaatgtgaagactgaagaaagagaatggtttttatcagatgacatgggtgaaatgaaactcgtgaggcaaaataaagctaactttatttgccaaagatgttgatgcattgcatgtttgaaaaacgaacgttatcacatctgcgccaacatttgtggcagtttttagcatcgactaacacatgcgtcttgttttattttctaaatttgttcagaaagtttttaagaaagaaatatgtatttattttgataaattgacaacccgaaattttcatataaacttaaagaatttagatagtgttttactgcaactttaactaaaaatcatgcacttataccaacttatacgtgtatatatcaaacgtcaccaatttttttatatattactatgagtaaagaaccaagtaagcactttaacaaaccacaaacaaatttaaaatacaacatattaataatcaaaaggaaattaaaggtacaaaatacaaatcatcaaacgggggtatgcgtaattaaacaaacaaaaacacaccacaatgaaacaactaattacaacaatcttataataaaatatacatcatcaatcacatgaagtgatgatagttcaaggactcgaagtagttgcagaaggcgggggagagaagaacggaatggatgggagactagtcggcagagagggaatggatgggagattagttggaagagaaggaatggatggaatattagtcggaagagaaggaattgttgttggaaatgaaggcaaagttggcattggaggcattgccgtgggaatggtgggaagatttggttgtggcaaagctgatggcattggaaatggagacattgcagtgggcattgtggggagagttggtaaagacggttgtggcaacgtcgatggcaatggaggtagtcccattgttggaataggcagatttgggatttgaggaagaggttgttgttggagaaggcggcgtgaggctgagcaagtgttgatcatcatagaggaagagaggcacactagaaaagcaatgcggaagagcttgtatgatgccattttgctttggttgtgaatctctaattatggttaagcctttctaattgcttctcttgtattgcttgctttgtgttgatgagaaattcaaagatatgcgattgagtttatatagcggcaagagtctctatggataacaaagaccttttattcaaatatcatatatggtttggttaggtgtactttatggttggcttgagctattgttagttcaacttaatgtgtgtttaatagattattttgacaattcaaggatttttattgaagttagttcaacaatcaaaactatctaactctaatacacatgttaagtctataaccaaacttttaaatgtcattttaagcttataaataccaattaccaccgtaagtatattataaaatctgatgtaacaacataaattttgtgtaaagctatgaaatatgaaataatctccaaaacaccaaataaaacaaacaaaaattatgatcattattttgtcacagctgtaccaaaaactccaaaatggaatttcccggtcaaaccggatacatggtttgccaaataaaaaaccggaaagacgaacaactaatggtttgacggatatgaccggtcgaaccggatagacaagcaattgaattttgaaaatctgtggtcattcccgaaaagtcaacctaactagacagaatcgaaattcaaaattccgtctctttggtacagaatacgctttggaccttctcgagcccgtcggaactgtaactcagtattattctggcgccgatg

SEQ ID NO: 33939 - DNA, 3003 bp, Unknown; identical to SEQ ID NO: 33938
  misc_feature (1)..( 3003): 2750-1469P.txt file - cDNA_ID_3073248; gDNA_ID_2926204; Annot_ID_202082

SEQ ID NO: 33940 - DNA, 3000 bp, Unknown; identical to SEQ ID NO: 4429
  misc_feature (1)..( 3000): 2750-1469P.txt file - cDNA_ID_3073269; gDNA_ID_1620705; Annot_ID_165267

SEQ ID NO: 33941 - DNA, 3000 bp, Unknown; identical to SEQ ID NO: 4429
  misc_feature (1)..( 3000): 2750-1469P.txt file - cDNA_ID_3073269; gDNA_ID_2926196; Annot_ID_201470

SEQ ID NO: 33942 - DNA, 3003 bp, Unknown; identical to SEQ ID NO: 20048
  misc_feature (1)..( 3003): 2750-1469P.txt file - cDNA_ID_3073293; gDNA_ID_1620706; Annot_ID_165315

SEQ ID NO: 33943 - DNA, 3003 bp, Unknown
  misc_feature (1)..( 3003): 2750-1469P.txt file - cDNA_ID_3073301; gDNA_ID_1620706; Annot_ID_165313
ttagagacagtgtgaagatcttcaggtaaaggagcgtaacggaagatttgagccttcttgtgtttagcattctcagggaatggaaatgagaaataggtagcaactccagagaagatagcgagtgctgcgtatccggcgtatttacggaattgagcttctgaggcggtggccggaggcggaggtggaggacgtggcggtggcggcggtggtggtgtcaatgtttgaccggtggtgcagagagtacgatgaggcgaaaatgaggaacggatggtggatgaagacggagatagggttccgagagaatggccgacggagcgtcggagaagaagtgaccggagcattttttttgtttaacttcaggcgatctgaacctgagggaaatgttcttgtacaggatcgggtttagtgatttaagaaagtttccattataccctgattttatttctgttttcataatttgagccgagtaatttgttaatgaacaaattggtaactagtttgtccacattcaaaaaccaaacaaaaccagaaattttattgtagacttgtagttttgggccttttggttttctgtcccgcatgagaatcgggtcgaacggttatgctcgagtgactagacaaagtagttcactagtgagccatgcattatttatttattttttttcactaagtgttgtcttcatttcattaagttcacggttacaaaaagtgttataatggctctgccatttacagctttgaagacatacacataaacaggtaaacaagcaaccatggcatcagaaaccaacaaggttagccatgttgcataccagaaagttacaagtaaacgttaaaacataacaactgcagctatagagtatgtcttgacccaaaaagtgttatgaaggccatactactgaggcagattattccaaagcatggatctgcatctgttgaaatcaatgcagtcctaaataaaaaaaatgacagaattcatagagtgtttatcttttctttggagggttcagaatccctcccttcatgtgcgctttgtcttgttcatcatgagttcctttctcttcttgcctcttccttgtttcccttgtttccacccctcttgaagattgaccaacttcaaaaacccgacgagaacccgttgagagtgctgttccaactgaaggcgtgatattagaatcagttgagacctgttgaccttgacagagcccttgatagtaagtccctcgaccctgatgattaaggccttctcttggagcaggaaaattcggatgggctgcaagaaactctccatgattcagtggaggggtaacaattcttggtggagggagcacaggtgctggaaatgaagactccgtcatttgagactgagaattcatagacgatctaagcctttcatcatggaagacagctctttcccttccataattaggtagccttggtctataagggcaatagttcctgtgatgtgtaactctgaagcagctactacaaatcctcctcaatctctcatattggaacctgatgagagcagtttccccagaatcaaaagtgattctttggaagaaacgaagcctatcagtgattccaattctaactctgactctaatataagcaatttgagtcatcgttgcatcatggaagtccagcgtgatgatctcaccaatctcatgagcaatctccaaagctgtctcctcacaaacatagagaagaggaatgcctcgcatctgcacccaaagatctatggtagtcacaaaatttaagacaggagcaggctcccatctatgatttgcaacaaaccaattattgaaaagccacagttcccttctttgcactgaaagtaaatcaacttcattctgaaacaagaactgaacataagtagcatccagcattctaccactgaaagccatgcattatttaatctacttattcgagaaaatttatctcaatttggaaatatacgatgcatttgaatagcaatccattaatataggattagatacacccattaaacacgtgttaaattgataagcaataaataaattttaaaaaatgaaaatgatacagaatcaaccatcttagttttaaaatgatattttttttaattgataaccaaattgataaaaaaaatctcaatctaatgtaattttaaaatgatatttttttggttcatattaactaatcattaatatatatattcaatcttcaacataaagaatgaaaacaaaatattattagaaatatatttaaaaattgaatttcacaaaatgaggttatatgataagacgagtttggatcgatattaagacggtacactataccacaagtaaagtcttagaattattaattaaaatataattaaataatctttaacactaaacaaaacaaacaatcttaataaaacatatgtaacttaaaatttaaactttttagttataaaaattgatctagggtgtactgaagggtaaaatctaagggttgtacataaaataatatagaaatagagttatatatttataaaatacaaaaaatagattatatataactaatctatcaaaaaattacattttcagttttttttttaataaatagtcccgcattgtaccgcatgttaaaatctagttttaatagatagaaattagtaattgttccaaaaaacaaaacataaaatgtaattatataaaaatggtctacatcaacttggtaacataaggtagatttgaatcactctattttggatagtcactatactattcaaatgttgatttggtaaaccgaaattgtaattagcttcgtttttcagataacaataaccgcaacaagtagataacacatggtttaagcgtctcgattgtaagatatacatttcagtagcttgtcaattgtcataaatgactacaatatcagcaggtgaaaactatattgatccatacagaactaactaaacactaaatgcattaatatttcataccaaagagcaagtttagttagtgcacaattcaaatg

SEQ ID NO: 33944 - DNA, 3003 bp, Unknown; identical to SEQ ID NO: 27850
  misc_feature (1)..( 3003): 2750-1469P.txt file - cDNA_ID_3073315; gDNA_ID_1620706; Annot_ID_165288

SEQ ID NO: 33945 - DNA, 3003 bp, Unknown; identical to SEQ ID NO: 20067
  misc_feature (1)..( 3003): 2750-1469P.txt file - cDNA_ID_3073332; gDNA_ID_1620707; Annot_ID_165349

SEQ ID NO: 33946 - DNA, 3003 bp, Unknown; identical to SEQ ID NO: 20067
  misc_feature (1)..( 3003): 2750-1469P.txt file - cDNA_ID_3073332; gDNA_ID_2926173; Annot_ID_199652

SEQ ID NO: 33947 - DNA, 3003 bp, Unknown; identical to SEQ ID NO: 20074
  misc_feature (1)..( 3003): 2750-1469P.txt file - cDNA_ID_3073341; gDNA_ID_1620707; Annot_ID_165342

SEQ ID NO: 33948 - DNA, 3003 bp, Unknown; identical to SEQ ID NO: 20074
  misc_feature (1)..( 3003): 2750-1469P.txt file - cDNA_ID_3073341; gDNA_ID_2926173; Annot_ID_199648

SEQ ID NO: 33949 - DNA, 3000 bp, Unknown; identical to SEQ ID NO: 4464
  misc_feature (1)..( 3000): 2750-1469P.txt file - cDNA_ID_3073345; gDNA_ID_1620707; Annot_ID_165340

SEQ ID NO: 33950 - DNA, 3000 bp, Unknown; identical to SEQ ID NO: 4464
  misc_feature (1)..( 3000): 2750-1469P.txt file - cDNA_ID_3073345; gDNA_ID_2926173; Annot_ID_199646

SEQ ID NO: 33951 - DNA, 3000 bp, Unknown
  misc_feature (1)..( 3000): 2750-1469P.txt file - cDNA_ID_3073353; gDNA_ID_1620707; Annot_ID_165333
taaatgttgatgtaataatatgatattgaaatgtatgaacacaatttttttttgttggaattcattgccttgcttgcaattatgattgacatcaaacctcaaggaaaaaaagcaggtgtaattcagccgaacacacaagaatttttttttattgctacattttcaacttttcatactttatatggtttttgagtattctttaattaagaaaagagagtgatgagattggtgtaaaagacctaaatgacacatgggaagatgatgcaccattaacagattccacatgggagaaggtgagtttccattttccaacttattagacttattcaaaagtatttggctcttaagtcacacaacactacaaattacgttatgacttctcacacttctgatcctatatacttcagttttagtagtaattggtttcttactttgactagacaaaaactttccaattccacgttgagatacaaacaaaaaaacatacacaagtgaccggttttatataagtgctaattatattccttccaataatataatttctttagctaagagaccgatactacactatgtacgacgatgaatttaaatagctagataacagtacagtatggaatatgcaaaatacagtagtatactgttggaagaggaattaaatttaaacgcgtctcaattagtcaacacttaataataattcagtcttgtcgtggaattcacaagtgacaaacccaccgactaaaactcggctaacttcaactaattaattaaatttggaatcttttaatattttcgtgttattttcatatattgtggttaatcagatagttaacatagtcatttttttttgttataacgttgttccgattttcatccaatcctacttttttttattggttgtgtaaccaaaggaagtggaaattaaacataaagagctaatttgatgaatgagaatattttagttaagattatacactaaatcgtatttttgctatttaaagtagtcaataataactgaaaacaaagtgaaaaaaactcgagccttgaaatcttaatttatgtgatttgtttttttaaactattgtggaatgtaaaaaaaaaaaaaaaagtaatttatatcatcactccaagaatatagggaaatatgggtatttgcatgggaggattgatataaggatagtcgtgacgccgacggtgaatcgttttgtcggtggtgggttccattttcatctctttttttttttacttatttataaattttaaaaaatctaaattagaactctaaaaaacgattggtgactttagtaaaaggaaaaacaacttgctactttttggcaacaaacctaaaattccgggaactacaatctataataatcttttacgattttctagagtggaggatctatcaatttatagaattttcgaattttcacagatttgttttctataacaattttttaaaattctcataattgttatattagtactagatattttagtgatgatacctactgaaaaataaatatcttgcaatagaaaacgatttttccatcatcattattaacaaagaaacaacatgtgactattattttgttctttgtttcatcaacattcaataacaaataaaattcatgaaaaataataattaaataaaaccaaaacaatagtgtaattatgtgaaaataatagttagattttaaaagaaatgaaaaagatagaaaacgaaaggagagacagagagtgaacggaaagaaaaaaagatggacgataaaataaataaatatttttttttttttgcacacccaaaaattgcagaaggaagctatatatgttaacgttagcttctctgcaaatctccttatctcactctctcgcgtccatttttttttctcaattcgtcttcaaaaattcgttagatagagaagaatctaaaagtctctctcggtcatcggaatatcttcttctcaggaattcgacgagactattcgaaatcggaaatcgcgctttgaatctgaaactcagaatttagaggacgcttactccaaagaatctagggtaaattctacgttcctttcgtctctataatcaaattatatatgcacagatcgagtttactgttttgttttccttcatgaagctcgacgaattttggtaaaaaccagatctggatttcgtaattttgctttctctgtttcgtattcttcatttgtcactgattcaaatagcatttgcttccgtataaacaaattctatcttaatctcctgtaagcaaatctgtggaataatctggataatctccagtatatagttttcgaatttggattcatttcgattttttcgctttgtgtatgtgcacaattccagattcattgtttttgattacattttgttgtttgtttggtgaaatttaagattaaagacgattccgtctctggcaagtaatgattaatgctaattctcttcatcttacactttttttttgaagtcctttatgctttttagctgtctctctgcaagctttttttttgggtacagatttgttttcagactttaaatgcgaaagtgaataagactttaaatagagattcattcatgtgtatgcatttattgttatttcatcgattcattgtttattgttctcgagttttgatggacaaatgtgagagcatgttatagcggtcgaatctgggtcccaaaacgccatgtgagattacattaaagcaacaatctattattgtcggcaatgttgtttgttccttttagatctcgattctatacatcctttgtttcctcaactttcgaaatactcatttgtcaaatagtaacacttggcccatcatttgtttattcaatgaattaaccaaataaagttctattttctaactttttcattaatggcagaagcttgtttgctgctcttgtctactgacttatttattcaatctcatgttgctaattttgtaggtgttaactttctaagaaaaggagtttgttaaaacaatg

SEQ ID NO: 33952 - DNA, 3000 bp, Unknown; identical to SEQ ID NO: 4465
  misc_feature (1)..( 3000): 2750-1469P.txt file - cDNA_ID_3073357; gDNA_ID_1620707; Annot_ID_165331

SEQ ID NO: 33953 - DNA, 3000 bp, Unknown; identical to SEQ ID NO: 4481
  misc_feature (1)..( 3000): 2750-1469P.txt file - cDNA_ID_3073372; gDNA_ID_1620708; Annot_ID_165386

SEQ ID NO: 33954 - DNA, 3003 bp, Unknown; identical to SEQ ID NO: 20130
  misc_feature (1)..( 3003): 2750-1469P.txt file - cDNA_ID_3073414; gDNA_ID_1620711; Annot_ID_165437

SEQ ID NO: 33955 - DNA, 3003 bp, Unknown; identical to SEQ ID NO: 20130
  misc_feature (1)..( 3003): 2750-1469P.txt file - cDNA_ID_3073414; gDNA_ID_2926156; Annot_ID_198408

SEQ ID NO: 33956 - DNA, 3003 bp, Unknown; identical to SEQ ID NO: 20132
  misc_feature (1)..( 3003): 2750-1469P.txt file - cDNA_ID_3073424; gDNA_ID_1620711; Annot_ID_165432

SEQ ID NO: 33957 - DNA, 3000 bp, Unknown; identical to SEQ ID NO: 20134
  misc_feature (1)..( 3000): 2750-1469P.txt file - cDNA_ID_3073428; gDNA_ID_1620711; Annot_ID_165426

SEQ ID NO: 33958 - DNA, 3000 bp, Unknown; identical to SEQ ID NO: 20134
  misc_feature (1)..( 3000): 2750-1469P.txt file - cDNA_ID_3073428; gDNA_ID_2926155; Annot_ID_198374

SEQ ID NO: 33959 - DNA, 3000 bp, Unknown; identical to SEQ ID NO: 4505
  misc_feature (1)..( 3000): 2750-1469P.txt file - cDNA_ID_3073432; gDNA_ID_1620711; Annot_ID_165424

SEQ ID NO: 33960 - DNA, 3000 bp, Unknown; identical to SEQ ID NO: 4491
  misc_feature (1)..( 3000): 2750-1469P.txt file - cDNA_ID_3073448; gDNA_ID_1620711; Annot_ID_48990

SEQ ID NO: 33961 - DNA, 3000 bp, Unknown; identical to SEQ ID NO: 4504
  misc_feature (1)..( 3000): 2750-1469P.txt file - cDNA_ID_3073448; gDNA_ID_1620711; Annot_ID_165408

SEQ ID NO: 33962 - DNA, 3003 bp, Unknown; identical to SEQ ID NO: 20146
  misc_feature (1)..( 3003): 2750-1469P.txt file - cDNA_ID_3073478; gDNA_ID_1620712; Annot_ID_165493

SEQ ID NO: 33963 - DNA, 3003 bp, Unknown; identical to SEQ ID NO: 20148
  misc_feature (1)..( 3003): 2750-1469P.txt file - cDNA_ID_3073482; gDNA_ID_1620712; Annot_ID_165491

SEQ ID NO: 33964 - DNA, 3003 bp, Unknown; identical to SEQ ID NO: 20148
  misc_feature (1)..( 3003): 2750-1469P.txt file - cDNA_ID_3073482; gDNA_ID_2926185; Annot_ID_200560

SEQ ID NO: 33965 - DNA, 3003 bp, Unknown; identical to SEQ ID NO: 22710
  misc_feature (1)..( 3003): 2750-1469P.txt file - cDNA_ID_3073486; gDNA_ID_1620712; Annot_ID_165489

SEQ ID NO: 33966 - DNA, 3003 bp, Unknown; identical to SEQ ID NO: 22710
  misc_feature (1)..( 3003): 2750-1469P.txt file - cDNA_ID_3073486; gDNA_ID_2926185; Annot_ID_200558

SEQ ID NO: 33967 - DNA, 3003 bp, Unknown
  misc_feature (1)..( 3003): 2750-1469P.txt file - cDNA_ID_3073490; gDNA_ID_1620712; Annot_ID_165487
ttcttcgcttacattacttatataaaaccctctctcgcatccttcctcagttaatcatcactgctctcttctccatctcgctttcactcgctctctctcttgccctagcttcccttttctcctgaatcggcctcacatcacggctttttccgactgttttccgtcgaatttcaatgggatctcgtgacggcgatccgccattttcgaaattcttgagctgactcgtctccaatagttcatcggttagtctgattccgtgtatatctattcttaacctgcaatttgatttgattgtacacattttttgttgagtcgtttttgtgatatttgtttttatccgtgagattagtttcgtagttatggcgtttatcatcgatagatcagctgcatgagctttaagattatataatttctgagctgcggatctaattttagtaatgtatggaatgattttgagtactaatgtatcataatttggttttgcatgtccagatttgtgagagcttttaaaatctttaagtggacctgtctcatgtattgaggtttgttttctcatctatattatttgtgtttgatgcatttacatatatgtatatatcttatgatctgttttattctacaagtattgtgagtgtcatttgttgattgttacttagttagtctatatattccttttacttagttagttatgagcataagataaaaacaaataatagactcgactcaattgatctgaagaaacacagaaaacaaatctatacccagatatttagttactgtggttattgatatctgcaccttctttagttagctactgtgaataagagactcgactcagttgatctgaagaaacatagtttgttactgtggttttttatatctgcaccttctttagttgtaattcctgagaagattttgaaagcatcattagattcttacttgagcccactttaaggtaaaaaggagctcgtggaaagtctatacccaaattatatgaaattaagcaaaatatgcttgttcgttcttcttcttcggcaaactaacactaattcacccactaaagagttttcgagtttgtctgagtatggtctttttttgtttaacatggtctgttaagtaaaaccctcaatatggaaccttctgagaattcaagcgtgatcatgatatccttgtcactcaactttgattcttggtcaaataagacttttcaaaaaactatatgataggctccttttagagaccatttattggatagcttcatctgtgtttgcagtctctaaatgtacaaaaatgcatttgcacaatgtcttcaaagaagagaaagtgaagaaaacttgctttactatgaggagattaagaaaaattttattgattgaatgcaagacaattttgtctcaaatcattaaaataaaaaatactactttgctgttgcataaactagcaatgcataaatatcaggtttatatctgcatatctttgtaattgtatgctgttcgttgtttttataatatgaattttaaatctgaaaattcatcttcccttgttaatgcagtggaaaactgctacagttgactgagataaggttctgacagtccagctgagatgctgagtatcaccatttgtacttgagttgtctctcatgtctagaccatttgtgagaagggagtttttgtttacaccaataccccccagtctctaaatttgtaagaagtattatgctcaattaaggaacatagctagttcgacataccatactaccctttttaaaactatcctatatgtttgatgctagcatagcgtaattttgtgttctcatggtgcagcagggttagtttattgtgtacctctagatatatattctcttgctgcgtagggttcccaagctgccaaaaacttttaaaaattagtgatctgttccccaaacccccattcaataagaaaggtctacctgtagctcacagtcacagctattagagctgtccttgcttctttgggtttactgttttagttaattagttaccctatgaaagtctgatccttcagaagttaggtatagaagtaagtcgattaagttcattcatgacttttccagatgttgcatacataactttttttatttgtattcgaactagtccaagccgattctcaaaatcatataaaatcatttacaccttggtcatggtagctaagaatattgtatctaaaattggggagtggggagatgtttggttatattcccttctcatcgatggtctagatgtgcgaggtgactctcatggaggtaaagaacaatggtgattttgtgaagaacccaacgtaatggtaattcctaaaaaggttagaagttttttcagcttgttgtattgctaaaatggggttgatgtactcaacgacatccaagtgtacttgagtgagcttttttggggttgagtacctcgacccattattcaaactaatgtaaatggtgaatgcagcagtgactttgttgccttttgcaagaactaaagaagacagaaacaggttgtaaaagagagccaagtgtgtgtttatggtagaaagagcaaagtgaacgaaaggtgtacctttttgacttgttgtcactggttttctcccacttcatccgtttcatgctgcatcagaaaacaacataaggaatgaatgacgtaacgcgaagcattaggagttgcttgtaaattaatacattgccattactaacgtaattcagtagattctaactacaaatgaagtcaatgtatctatttgtctactttagccaatgtatgataagaccaaatagtcttctcttttttcagaaactctctaggattaaaaagtttgtgggtgaaagaaatattatcgtgtggatgataagaataattgatcttgtgttagtaaattaggaatagatatacaagtaggtttctctctaaataaaaaataaaagagtttaaattgcatgcgtataaaagaaaaaagtaagaagaaaatatgttccggttaatg

SEQ ID NO: 33968 - DNA, 3003 bp, Unknown; identical to SEQ ID NO: 33967
  misc_feature (1)..( 3003): 2750-1469P.txt file - cDNA_ID_3073490; gDNA_ID_2926185; Annot_ID_200556

SEQ ID NO: 33969 - DNA, 3003 bp, Unknown; identical to SEQ ID NO: 20150
  misc_feature (1)..( 3003): 2750-1469P.txt file - cDNA_ID_3073497; gDNA_ID_1620712; Annot_ID_165483

SEQ ID NO: 33970 - DNA, 3003 bp, Unknown; identical to SEQ ID NO: 20150
  misc_feature (1)..( 3003): 2750-1469P.txt file - cDNA_ID_3073497; gDNA_ID_2926185; Annot_ID_200553

SEQ ID NO: 33971 - DNA, 3000 bp, Unknown; identical to SEQ ID NO: 4519
  misc_feature (1)..( 3000): 2750-1469P.txt file - cDNA_ID_3073501; gDNA_ID_1620712; Annot_ID_165477

SEQ ID NO: 33972 - DNA, 3000 bp, Unknown; identical to SEQ ID NO: 4519
  misc_feature (1)..( 3000): 2750-1469P.txt file - cDNA_ID_3073501; gDNA_ID_2926185; Annot_ID_200547

SEQ ID NO: 33973 - DNA, 3000 bp, Unknown; identical to SEQ ID NO: 4514
  misc_feature (1)..( 3000): 2750-1469P.txt file - cDNA_ID_3073522; gDNA_ID_1620712; Annot_ID_165459

SEQ ID NO: 33974 - DNA, 3000 bp, Unknown; identical to SEQ ID NO: 4514
  misc_feature (1)..( 3000): 2750-1469P.txt file - cDNA_ID_3073522; gDNA_ID_2926185; Annot_ID_200531

SEQ ID NO: 33975 - DNA, 3000 bp, Unknown
  misc_feature (1)..( 3000): 2750-1469P.txt file - cDNA_ID_3073533; gDNA_ID_1621138; Annot_ID_56587
gaaaatcgacgtttttgaaaaaactcaaattatcgtcgttttgttctcagatttcttctgctctcttcttcttctccttcttcttcgttccaccgcctctgttgctttatcttcttcttccttccttcgattgttgattacgtcggtggatctttgttctcctctgtgttgttttcattgctagatttcgtcaatgattggcttctcacgattcgatttttccggctcctgttcttaatttcctctgaggtagattagtaaaactctttgtctcgtaaacattgttcgatgatgaaattagaaagttctcactcttgtttgccaaatttgggatatttctggaattgaaaatgaatcgtcatttttttcaatttctgaggattttgttacaattgttttttatttatgttagaattgagattgtgtgatgaatatcagtaaccctagacaattgtgaaatcaaagctatgaaaatcttttgatgctatgtttcctatgatacagagaatgatggatgagggatcagtaggggatgtgagtaggattgatgaagctgatgttgctcaccttcaattcaagaatagtgagcagtcgtttaaaccggagaacattgaagtccgggaagtaaaagaagtgcaggttcagagagaagctggttctcctgattgttcttatggtgtaatagcagattttttagatggtaagaatggtggtgaccatgtggagcttatagggaatgaaccatgttctagccggcagaatacaaatgatgagggggatgttgtcgaggagttgactgttaaaacttgtgagggatcgagtatggctatagttggtagaccaagtagtagagctagattagagatgaatcgcagtcagtttctgcatcgttttccgctagacggtgatttaccgggtagtagttctatgagtaagaaggtaattgacaggggaacagtaagtatcttgagaaatgctgggaaaatgtctttgcctgagacttcaaatggacaactggctattattgctgttaatggagaagctaatgaacatttgacaaatgttgaacgaaatcctgtacctgtagaggcattgtctcatgaaggcatcaagacaaagatgttatcgcagtctgggttttctcagttttttgttagaaaaacattgaaagggaagggagttactttcagaggcccgccaaacaatagatctaaagcgaggaatatggatcagcaaactgtagctagttctggtagcgctttagtaatagctaatacttcagcaaagatttctagcagcatccctttggcggcttatgatggtttgccgtgcttaccttccaataccagtaaaccatcttcttgtgctaatccttcagatacacatagaggttgtggaggtgaaggtttaagtctgagagaatggttgaagtcggagcggcaggaagttaataaagcagaatgtatgtatatctttaggcagatcgtggatcatgtggactgttctcattctcaaggagttgttttatgtgacctgcgaccatcttcattcaaaattttcaaggaaaatgcagtaaagtatgtggtttcaggttctcaacgagagtcttttgacagcaacatgaacaaagagactttaagtcaactcgaaaaccctctggttagaagacggttaggagatacttctagtctctctatccctgcaaagaagcagaaatcaagtggaccaagctctagacagtggcctatgtttcaacgagctggtggcgtcaatatccaaactgaaaataatgatggcgcgatacaggagtttcatttcagatctagtcaacctcattgtagtacagttgcctgcccttttacttcagtgagtgagcagttggaagagaaatggtatgcgagccctgaggagctcaggggtgacatgcgttcagcctcttcaaacatctatagtttgggtattcttctttatgaggtatgccatcttaattgtagcttttgacctgcaattgtaagtatgtacatccatgagttgaaatgtgaatctgcaagcccttaatgttgacacacatatatatgttttcccgtgggattatgtctttaactgggacatatcgtgtgtgggtcatgtttgggtccagatagatttagatagtgtagcatgtttgttaatgagatggtaacagtgaagtttctcgttgaaagtacagttggctgcatggctcataggtttatgtatatattgattcgactgtttcttggtcaaaacataacattttcattgatatactaatttgtttttttccgtcagttgctgagccaatttcagtgtgaaagagctcgtgaggctgcaatgtctgatatccgacaccgcattcttcctcccaaatttctgtcggagaatccaaaggaagctgggttttgtctttggttacttcatccagaatcttcatgccgaccatcaaccaggcaatgcaaaatctttagctactataattctcaaatgatataaagcgtgttattgaacttttgtatgcttgtttctgttgatagtttaaggccatgaatccctagtgggtctattggaagataatcttgttgtatatctagaaatgtacatatgcaccaaatgtggaagttttgttctcctggctgtaaacgggaggacgattgtctcgtcaacagtttcacataggattgttaggttctactctgaaaaataattagtctttgtactaactgagctccctttatgtgttgatagtctccttcctgtcataatttatctgtcaagaatgtgagttggcttaatctctaaataagtttgatgttgttctgtattagggacatcttacaatctgaagtagttaatggaatcccggatttgtatgctgaaggcttatctttatccattgaacaagaggacacagagtctgaactcttgcagcatttccttttcttgtcccaagagaaaaggcagaagcatgctggaaatttgatg

SEQ ID NO: 33976 - DNA, 3003 bp, Unknown; identical to SEQ ID NO: 20174
  misc_feature (1)..( 3003): 2750-1469P.txt file - cDNA_ID_3073533; gDNA_ID_1620713; Annot_ID_165529

SEQ ID NO: 33977 - DNA, 3003 bp, Unknown; identical to SEQ ID NO: 20174
  misc_feature (1)..( 3003): 2750-1469P.txt file - cDNA_ID_3073533; gDNA_ID_2926152; Annot_ID_198132

SEQ ID NO: 33978 - DNA, 3003 bp, Unknown
  misc_feature (1)..( 3003): 2750-1469P.txt file - cDNA_ID_3073590; gDNA_ID_1620714; Annot_ID_49089
tggttatggcactaacttaacatatatattttatattttcaatgtttttaagaaaatgaaaatagtaaataataaacaagagtaaataaaagaaagcaaacaaaaaaagaaaatagcaactgaaatgagaaacaagagccaagaataattaaagaaaagtacgtaaaagtggtaaaaattaaaatagagttcaaaaagaagtgactaaaacccatactacaactctataacctcgtttgggtctcgctagttggaactttgacttttgatggctcaatcattaggatttatgcctaaccttaattagttaactcctatgattggatgatctaattataattaatcggtaaaggcacttttatcattggaattttaattaaataactgcgtacctatattagtcgttacatgtgattactgtatcagactatcagtgataaacataggtttttcttttttcttaacataacaacatggaaagaggttaagcgccaaaaataaaaaagactttctaatcgtaaaatagctagtagctaccgacagattgtgagtgcgaaacacacataacacagtagataaaataattgaaaagtagttaaaatagttctcttctgttttttttttgaaccagttttaacacgaaagaaaaagacaccagtcattgacctatcataataatatacacaagatttggcttatttaaatgtaatcccgaagagcgaatattaaatactcctctggatagcacaataattcgattctaacaataaattagaatatattgggaaaagtttaacaataaattagtactaactttttcctgtggatagcacaataattcgatcctaacaacaatgcctgtctattttagtcgccagtttcaaaatactgcaatacagtgaaaacattttaaaacacatgcttcatcttatctttttggctattcttcacagtggtaagtttccgtcggtgccgatattatatgtttgtgctattaattaatcatgaattgtataaatttccagatttgttggtggagccttgtaggccatcaaaagcttttgatttttgaacaaataatggcccatatatcgaccgacgaatatttgtactcccatgaatacaacaatctagtttcaagtaaaaagtgttcaaaatatttcagatttttgtatcgtagttttaaaagactaaaccaattgtataattacatttctattttccagctgcttggccggctgatatggcaatttttagcaacatttatataggagcgtattgtatatttttgttcacctgtggctatcttgtattcattttgatagaaagactaactttgtaccattcaaataatgattcggttatcatttcgccatcaaataatcgatttatacctaatactgcgaagatagagacattttaacaatactatttacgatagttcggtagaatatagtaatctatgcattgatgacatcgtcggctctaatcagcttttataatgcttattaacatcattatggcatattcataatttaatcgaagtaacctagtttattttaatgcatttagatcaattagatgggggaaaaactatgtgatctttcaaatgttgtttgttcaaagcagaatgatttatgtgttacgaattcgccagaataattttaatttagccaaccaaaaaaaacataatttgtaaactttttccacgttttaaactatttgtgaaatgtctccaaaatgaaagaaaaaggttatgccaccgacaatattttctaccttgtacaaagaaacaaattgtttattcaaagttggtttggaaaagatactgatccaacggtcacggatttgaataacattgtttagttaatacaaccaaattattcttatgctatgtgtacctacttagaagcttacacagaaaaaaaaaaaaaaaaaaaaacttctaaactttggttttcttttttttcccatcatttataatattcacgtgttacataataatttggatgtatataataaatgatccaataattaacaaaataaatctgatcatccaatcataataaagttgcgcatactaaacaatattttattttcctaaacacaacttctttgatatatggattggtcgataagaataataagatatgggttttaatagaagacaatcaatcttcaggggctttcttgaaattacagcgtggtaaaaaacaatgacatcaatctggacccgatcacgaggacccggatccgtatcgataaacagtgtagctttcactaccccattttcccagaaacacctctcaaaaatttctcaagaacttgtataaatatctcagtttcgttcacgcagtgtcttttttatttttgtatttcttttttcattgttcaccaactcctcttgaaggtgggacagagtccagctccaccaccaccatagccatcgcgtcgttttctccgggacccacttatttcgtgacgtttctctctttgtatatacatacaattgttttcagtctcaatttgctgtccacattttaacacaactctatctcaggggtggtgtctgaatctcgtctctctcattcctatttatcccaatctaatctatcacaaacccttccacattgcttttgtcagtctgtaaaattctctttgaatcagtgaatcactcacttaaatccaaaacagtttttttttctttctttctttatttgcttgttgtggaatcaatagctgtctccgggaaaattcgttttttttctccttcgggatctctttttttttttttttggttttatttaataattatccccgagccaacatttattgtcgattcggtttatttcgtctccttcgtcttccactcttactagtgcatgctctgaatctgtatgtaatgggagttcaacagtctggatccattatcctagccgggtcgggtcaaggtctttgagtaagagagacaattcgttttgattcggtgtagaagacatcatg

SEQ ID NO: 33979 - DNA, 3003 bp, Unknown
  misc_feature (1)..( 3003): 2750-1469P.txt file - cDNA_ID_3073590; gDNA_ID_1620714; Annot_ID_165584
tatctttttttttttttccacatatattggtatctatatatcttatcttacactttaccaatattttcatacttaatcctatgaaattctagtttttctggttatggcactaacttaacatatatattttatattttcaatgtttttaagaaaatgaaaatagtaaataataaacaagagtaaataaaagaaagcaaacaaaaaaagaaaatagcaactgaaatgagaaacaagagccaagaataattaaagaaaagtacgtaaaagtggtaaaaattaaaatagagttcaaaaagaagtgactaaaacccatactacaactctataacctcgtttgggtctcgctagttggaactttgacttttgatggctcaatcattaggatttatgcctaaccttaattagttaactcctatgattggatgatctaattataattaatcggtaaaggcacttttatcattggaattttaattaaataactgcgtacctatattagtcgttacatgtgattactgtatcagactatcagtgataaacataggtttttcttttttcttaacataacaacatggaaagaggttaagcgccaaaaataaaaaagactttctaatcgtaaaatagctagtagctaccgacagattgtgagtgcgaaacacacataacacagtagataaaataattgaaaagtagttaaaatagttctcttctgttttttttttgaaccagttttaacacgaaagaaaaagacaccagtcattgacctatcataataatatacacaagatttggcttatttaaatgtaatcccgaagagcgaatattaaatactcctctggatagcacaataattcgattctaacaataaattagaatatattgggaaaagtttaacaataaattagtactaactttttcctgtggatagcacaataattcgatcctaacaacaatgcctgtctattttagtcgccagtttcaaaatactgcaatacagtgaaaacattttaaaacacatgcttcatcttatctttttggctattcttcacagtggtaagtttccgtcggtgccgatattatatgtttgtgctattaattaatcatgaattgtataaatttccagatttgttggtggagccttgtaggccatcaaaagcttttgatttttgaacaaataatggcccatatatcgaccgacgaatatttgtactcccatgaatacaacaatctagtttcaagtaaaaagtgttcaaaatatttcagatttttgtatcgtagttttaaaagactaaaccaattgtataattacatttctattttccagctgcttggccggctgatatggcaatttttagcaacatttatataggagcgtattgtatatttttgttcacctgtggctatcttgtattcattttgatagaaagactaactttgtaccattcaaataatgattcggttatcatttcgccatcaaataatcgatttatacctaatactgcgaagatagagacattttaacaatactatttacgatagttcggtagaatatagtaatctatgcattgatgacatcgtcggctctaatcagcttttataatgcttattaacatcattatggcatattcataatttaatcgaagtaacctagtttattttaatgcatttagatcaattagatgggggaaaaactatgtgatctttcaaatgttgtttgttcaaagcagaatgatttatgtgttacgaattcgccagaataattttaatttagccaaccaaaaaaaacataatttgtaaactttttccacgttttaaactatttgtgaaatgtctccaaaatgaaagaaaaaggttatgccaccgacaatattttctaccttgtacaaagaaacaaattgtttattcaaagttggtttggaaaagatactgatccaacggtcacggatttgaataacattgtttagttaatacaaccaaattattcttatgctatgtgtacctacttagaagcttacacagaaaaaaaaaaaaaaaaaaaaacttctaaactttggttttcttttttttcccatcatttataatattcacgtgttacataataatttggatgtatataataaatgatccaataattaacaaaataaatctgatcatccaatcataataaagttgcgcatactaaacaatattttattttcctaaacacaacttctttgatatatggattggtcgataagaataataagatatgggttttaatagaagacaatcaatcttcaggggctttcttgaaattacagcgtggtaaaaaacaatgacatcaatctggacccgatcacgaggacccggatccgtatcgataaacagtgtagctttcactaccccattttcccagaaacacctctcaaaaatttctcaagaacttgtataaatatctcagtttcgttcacgcagtgtcttttttatttttgtatttcttttttcattgttcaccaactcctcttgaaggtgggacagagtccagctccaccaccaccatagccatcgcgtcgttttctccgggacccacttatttcgtgacgtttctctctttgtatatacatacaattgttttcagtctcaatttgctgtccacattttaacacaactctatctcaggggtggtgtctgaatctcgtctctctcattcctatttatcccaatctaatctatcacaaacccttccacattgcttttgtcagtctgtaaaattctctttgaatcagtgaatcactcacttaaatccaaaacagtttttttttctttctttctttatttgcttgttgtggaatcaatagctgtctccgggaaaattcgttttttttctccttcgggatctctttttttttttttttggttttatttaataattatccccgagccaacatttattgtcgattcggtttatttcgtctccttcgtcttccactcttactagtgcatgctctgaatctgtatgtaatg

SEQ ID NO: 33980 - DNA, 3003 bp, Unknown; identical to SEQ ID NO: 33978
  misc_feature (1)..( 3003): 2750-1469P.txt file - cDNA_ID_3073590; gDNA_ID_2926218; Annot_ID_142305

SEQ ID NO: 33981 - DNA, 3003 bp, Unknown; identical to SEQ ID NO: 33979
  misc_feature (1)..( 3003): 2750-1469P.txt file - cDNA_ID_3073590; gDNA_ID_2926218; Annot_ID_203118

SEQ ID NO: 33982 - DNA, 3000 bp, Unknown; identical to SEQ ID NO: 4554
  misc_feature (1)..( 3000): 2750-1469P.txt file - cDNA_ID_3073609; gDNA_ID_1620714; Annot_ID_165578

SEQ ID NO: 33983 - DNA, 3000 bp, Unknown; identical to SEQ ID NO: 4556
  misc_feature (1)..( 3000): 2750-1469P.txt file - cDNA_ID_3073627; gDNA_ID_1620714; Annot_ID_165576

SEQ ID NO: 33984 - DNA, 3000 bp, Unknown; identical to SEQ ID NO: 4552
  misc_feature (1)..( 3000): 2750-1469P.txt file - cDNA_ID_3073652; gDNA_ID_1620714; Annot_ID_165556

SEQ ID NO: 33985 - DNA, 3000 bp, Unknown; identical to SEQ ID NO: 4552
  misc_feature (1)..( 3000): 2750-1469P.txt file - cDNA_ID_3073652; gDNA_ID_2926217; Annot_ID_203067

SEQ ID NO: 33986 - DNA, 3003 bp, Unknown
  misc_feature (1)..( 3003): 2750-1469P.txt file - cDNA_ID_3073689; gDNA_ID_1620715; Annot_ID_165617
actcataagtaacaaattaagcattcattttttttttggctagatgactggactcgtgaaaccatcatcagggtcagcttttgttcaaggtttggacatatgcaaggatatggacaaagtctacattagcatgggtgtttgcccacagcacgagtaacaaattaaattcttgtaacatatttgttgttgttgaatgaagatcattattaagtttacgtgtttcctaacaatcatatagttattttattgttctcttatagtcttattgttcgtcattgaccagcttgctctgggaaacactgacagggaaagaacatcttctcttttatggaagacttaagaatctcaaaggccatgatctcaaccaagtatgttatcattatcaatcttacttctatcttatattagtgcaagagtcttaaacgtcaattcatggttaaatattaggccgtagaagaatcactaaagagtgtgaacctatttcatggaggagttgctgatatacctgccgggaaatatagcggaggaatgaaaaggcggcttagcgtagccatttcacttatcgggagtcctaaggtacaaaattgtatcttactcatctcctaacaaaaaacttattgaagcccttatttgaatgtgatttagagagctaaagtttttcaagctttaacaattatttttggtttttatattaaataaaaggttgtttatatggatgagccaagcacaggacttgatcctgcttcaagaataaacctatggacagtcatcaaacgcgcaaaaaaacacgcagcgataatcctaacgactcattcaatggaagaagcagagtttctctgtgaccgattgggaatttttgttgatggaaggttacaatgcatagggaacccaaaagagctgaagggcaggtatggtggatcctatgtgttaacgattacaacatcaccagaacatgaaaaagatgtggagacattggttcaagaagtttcctcaaatgcaagaaagatatatcacatcgcagggactcagaagtttgagttcccaaaggaggaggttcgaatttcagaagtctttcaggccgtggagaatgcgaaacgcaatttcactgtatttgcttggggatttgcggacacaactcttgaagatgttttcatcaaggttgctaaaaccggcctttaactaatgtcttcttttgaatacttttaagattattagttatgtctgttccacgtcaatattttgcttgttcatgtttgataaattgataatgcagaggtttgattcatgtacattgttggctcttcgcctgcaagtttgcgaattagtctgaggtcttgtattagtttgtttgtggatgatgcatgtaaccacaatttttttatttaaacgtggctatatttaattgtggataaaccactgaatatgaaattttatttcatctaccattcagatcctaaatgtatatcttaccatttaattcatatagggtttacgatttaaaatttagaatttcgaaaatagtatctatattaaaagatagtaattaggtctttttttcattgaattttacttaaacattggtaaaatttcatatgccatcgaaaaaagaaaatatcactgaaaactatgttagctgccggagacaacatttctaaaaagaaagacaatttttaaaaaagactacaaaatactctgttgttcctttttgtttgattgtttagaaaaaaaatttgtttttaagaaattaattttttaagttttccatgcaatatttattggttaatattggtgaattgtaattttcaagaaaaatagttagttatcattggtttagagttataaaaaattgtaaaacactaaaaataatacatttataatcaaaatttaatatgttttcttaatatatgtgtttttctaaacaatataaaaaaaggaacagagggagtataaatcaaaactgttaaaccaaattttttaccaattaaatcttaattatatcaattggttcttctccgaaataagaaattgtcttgatgtctatgaaaatcacaaatttcactaaaaatttatggaggattcctaattaactttagaccaggaatttttcaaaaaataaatttaaagatgacattatcatgaacacattcaaactgaaatcaaaccaaagtaaatttattttccctgtaatggaccatagagtataaagtatttaaaactgctacttattaaatcaaagacttttgtgttttttattgtgtgcaaagactttttatgtttgaaaactgaaataagactgctagtaaaaatataaactgaaataagaatttttcttaggacatcataacatttttgcttcttgtccaagtaactgccacattggaaaaaaatgtttagatttgaacaaatctttttaaaatggtcaaaaaattatcatagtcaaccaaattacccgacacttttacgtgagacattaaaatagactagtttaatcgattatgttcacacgtgattacgtctgagatgacgtatgaatcatctttatacaaatacaaatatacagtaaacaaataattgaaactcacctcttccactagtcgaagaatctattggtcgtggcatcactctccttcgcagcttcctaccaaatttacattgaaaatattctccattgtcactttctcgatttcgtaaaattacctttttgttatttgaccaaaagaataaccccaaaaaaacaatactaatatattcgagaaaaataactaattaaaggtatacttaacgagaaattaaagcgtgtgcacaagggtattactgtaatttcacattccgtatctgatctctgttcttctttcctccgcctgctataaaccaaaaggcggtgactcgatttgttccttctaagttcaaaaattgggtttccattaggattcaatttttactaaccctaaaaaacagaatctaatacacagagaaaagcgaaggttgttaccttcatcaatg

SEQ ID NO: 33987 - DNA, 3000 bp, Unknown; identical to SEQ ID NO: 4573
  misc_feature (1)..( 3000): 2750-1469P.txt file - cDNA_ID_3073693; gDNA_ID_1620715; Annot_ID_165612

SEQ ID NO: 33988 - DNA, 1228 bp, Unknown
  misc_feature (1)..( 1228): 2750-1469P.txt file - cDNA_ID_3073697; gDNA_ID_1972159; Annot_ID_179563
ttccaagaaagattacggagatctctttgccatatggtttctgtctcaatgattcgcttctatgttattgtgtaagatgatttatatatacaaatatgtacgagactcaatactacacatttccttagacaactcgaaatttattgtttattttaggaatcatatgtacttaaatatacatgcgcgtgtacatcacactctcggttttatatgaaatgcatgcaaaatactaatcctgagtttgctggtgcgattccattgattaattatcctaatttggcttaaaagaatggaaacaatgtcatcaaaatcctcaaattgtttaaaacgttaatttaaatcctcaattttccacgaaacaaaataaatatcaaatttctgtcgatttttcaaatactgtaaaataccaaacttttattgactttccaaataaataataaaattttgttgatatagccatattagacataccgttaagtgggataacaaatcctgctatcaaagttcattttctcttaatagactcgttaattgaaaatgacaacgttctctctaagaataaaacatcgtctttttgtcataacgggtcaattaaatttttaatttcaagtcatataggaatttaaggttaaagattttgctcgatttggggatccatgattgattgaatttggagattttgctcgacgtcactttgttttttttttgtttttttttcgctttgttgttatagaaaacaataacgttttgttgttatagaaagcaataatgttttgaattaacgggtatgttaataaaaaattaattttgttaacggaatctgttaatctacttaacatcatgtctaatatgaccattagcaaatattttgtatttattaagaaagtcacataagtttgatatttattagaaaaatcaacataaatttgatatttatttcgtttcgttggatgttgagaatttaaacaaatgttttcaaataaaagttggagattttagtgataattttccgataaaagaatgtcatttctttgagaatgccattacagttttaatttacttgatatgttaaaaacatttttgtgggcttaaccagggcccattaatccgagttaccaaaactcgcaactcgttaacactccgagtcattgactcagtatcttcttccaacgaaatttcaatttttcattgttcttgatgaaactgaggccacgacgaatcgcaaatg

SEQ ID NO: 33989 - DNA, 3000 bp, Unknown; identical to SEQ ID NO: 4571
  misc_feature (1)..( 3000): 2750-1469P.txt file - cDNA_ID_3073697; gDNA_ID_1620715; Annot_ID_165609

SEQ ID NO: 33990 - DNA, 3003 bp, Unknown; identical to SEQ ID NO: 16936
  misc_feature (1)..( 3003): 2750-1469P.txt file - cDNA_ID_3073724; gDNA_ID_1620716; Annot_ID_165641

SEQ ID NO: 33991 - DNA, 3000 bp, Unknown; identical to SEQ ID NO: 4605
  misc_feature (1)..( 3000): 2750-1469P.txt file - cDNA_ID_3073751; gDNA_ID_1620717; Annot_ID_165683

SEQ ID NO: 33992 - DNA, 3000 bp, Unknown; identical to SEQ ID NO: 4605
  misc_feature (1)..( 3000): 2750-1469P.txt file - cDNA_ID_3073751; gDNA_ID_2926188; Annot_ID_200827

SEQ ID NO: 33993 - DNA, 3000 bp, Unknown; identical to SEQ ID NO: 4605
  misc_feature (1)..( 3000): 2750-1469P.txt file - cDNA_ID_3073751; gDNA_ID_2926189; Annot_ID_200849

SEQ ID NO: 33994 - DNA, 3000 bp, Unknown; identical to SEQ ID NO: 4609
  misc_feature (1)..( 3000): 2750-1469P.txt file - cDNA_ID_3073773; gDNA_ID_1620717; Annot_ID_165667

SEQ ID NO: 33995 - DNA, 2277 bp, Unknown; identical to SEQ ID NO: 3453
  misc_feature (1)..( 2277): 2750-1469P.txt file - cDNA_ID_3073773; gDNA_ID_1620647; Annot_ID_163304

SEQ ID NO: 33996 - DNA, 3000 bp, Unknown; identical to SEQ ID NO: 19136
  misc_feature (1)..( 3000): 2750-1469P.txt file - cDNA_ID_3073773; gDNA_ID_2926188; Annot_ID_200816

SEQ ID NO: 33997 - DNA, 3000 bp, Unknown; identical to SEQ ID NO: 4622
  misc_feature (1)..( 3000): 2750-1469P.txt file - cDNA_ID_3073792; gDNA_ID_1620718; Annot_ID_165726

SEQ ID NO: 33998 - DNA, 3000 bp, Unknown; identical to SEQ ID NO: 4622
  misc_feature (1)..( 3000): 2750-1469P.txt file - cDNA_ID_3073792; gDNA_ID_2926154; Annot_ID_198257

SEQ ID NO: 33999 - DNA, 3003 bp, Unknown
  misc_feature (1)..( 3003): 2750-1469P.txt file - cDNA_ID_3073796; gDNA_ID_1620718; Annot_ID_165725
aagaggttgattggtagaaatagtgtcagttgaagaagaaacttgaaaagacaagaacaccaacactccgtagtataataaaaacacattcttcttgcaaatctgcatgtttgttttgaaaataaaagacagaaagagtcttcttggctcacgagtcaactagactacagagtagatgaataacaagttgttcttgcaggtctccacgtttctacaccacacgatagtttgaagataaaagaggtttatgtaacataattacataatgaaagagtcttcttgaccctcgagtcaactcactagcagcgtaagtcaagagcaaacttccaaatttcagggaaataaatgggataataaaaatctcgattaaaggataatttgatatagatgatatgtccccttgttattttctcaacaaattcttattcactcatagccaaaaaaattttaacaatatgccacggaattaaaaataaattaaaataaaaataaaaagataaaataaattaaaataaaaaaataaaaaaatatgtatacttttaagcttaagtacattccgcatgggtttataaacgagtattagcgtttagatttttacaattaaagaaaactatatgtcggtttgggtttataaataaagattaaatttagattttacaactaaacaaatttatatgttagtttagagttatcaaaaaatgataagtttagattttataattaaacaaaattatatgttggtctggtttgggtttataaaaaaagtaattaaggtttatatgtctatttggatttataaatgaggttaatcaggatttagatattaaaattaaacgaattatatatcattttagatttataaaagagtagattgagtagtggtttaatttttataatgaaataaaattagatgtcggtttggatttataaaacaatggttaagattatagtttttatttagattatagtatttgttttagtaaatttaattagattacataagaaattttgattggctacttaaaagggggtgaataagagaagttcactcctaggggagaacccaagaactattctattttcttagtcatttttaagaaaaaaaattgccagctacctgaattgttacaaaatgcatggctagatatatcaagtaaactaaacgatgctgagctacctgacctatatgtattacataacgatatatacgcgatatataacgtcatgtggtcaacatcgtaaagatagaatttatgttaaccggtcgactaatattaatattttttatttggtgttgtataataaaaaaaaacagattctatattcaatatatatataatttgcatctatatatacatttttgcagccattttgtgaaataaatcctggagttggaacttatttacaatggctgccactggcttttaattattagttttttcagcaataaattgattaacaaacgaaaaacattccaaatatattccaatcccatatatcacgcagatttttccaaaatttgaactagatttcggcaactatttaaaacaaaaaatgtttgataacccaaaagacaattgcaatcccttaaaatgagcaaaacgcaactaaatacatttcttatcaattcactaaatcttatttctccaaaatttgaactagatttcgacaactatttaaaacaaaattttgtttgacaaactaaaacacaattgcaatcccgtaaaatatttgttttaattataaatttaaattagcggggtatcgcagtttttttacaggacgggtttggcgaaacgggtttggagggacgttacttaataacaattgtaaactataaaataaaaatattttatagatagatataatttgcaaaattttatatatactaatttaaaaaaaaaaaattgtctccacggtgtatcgcggattaaaatctagtatatattataatagttagctttttatttttaaaactaaattaaaaatgtgaaaaatattaagagatttgcaaaattactttttctactacttttttacaacaatagcgtgactctttttaaaataaaaataaatgagcaaacagatttgtttagtaaattagtttagatatttctacaatttgctacccctcatttttttatcaatagtacaaattattattaattataatattataaactatacttttacattaaaataaaataaaattattatattattattttatcaatatcagttaatttttacattaatctaacttaaaaccaataaaatttattcatttataacgtttattaactttatagaatattaattttaaaaaattctactgtagtaatattttattacttgcaaatagataagttaatcgagttggatcaatcattgttaactcaattaattcaatgtatttttgagaaattaaccgattcataccagaaataaccgataattaacgtttaaaccagtcaaaaccggagcatacggataacatttaaggtaatggcaaaaagtaacattttggctaaaaccggactacttatcatgttcgtaaacggtgaacagttatccaaaaaccgaactataaccgcaattaaagccacgtgtgaaccttaatctcacgacacatgctaagctcatgcagtgaagaagctgaacaccacgtcctcgtggcactctcagtctcacctgttcaaagagatctttgaagaactgagaagaagtctagaaatagaaccaaccttcgtttaaacccgtatatatagttatctaacccaacacgcaacaaaaaagagaaagaaagaaaaagtaaaccgaaagcgaaagcaagcttgatatttcgtgggtttcaaagttacaagttttgattacgaacacgcaagaataacgcgagatcttgattagagagagttcttgcaaaaagggtctctgtatttagttattaaattcttcaatcttgtttctgtaaatttcggatatttttgagaacaagcaaagatg

SEQ ID NO: 34000 - DNA, 3003 bp, Unknown; identical to SEQ ID NO: 33999
  misc_feature (1)..( 3003): 2750-1469P.txt file - cDNA_ID_3073796; gDNA_ID_2926154; Annot_ID_198256

SEQ ID NO: 34001 - DNA, 3000 bp, Unknown
  misc_feature (1)..( 3000): 2750-1469P.txt file - cDNA_ID_3073808; gDNA_ID_1620718; Annot_ID_165714
agtcatagcttagtttaagtagtaactactggaaggagttcgctatgttttccctcgtaacttgttggagccaaggagttgcaacaagtcagacaggaaaaactcaatacaattattagaatagggaagcagataaggatttgttgacttgctcttctctatgcaatttgtcagcaaatgataataatgtcaagattcttgagattttcttcttccatttgatcatgagtagattcataagtttgcagacatttttccgaattttttttacttacatccccattttctgaaagtgttattacattttcttgcagtggccatggagcattcaacgcgtcacaccatcttttttcctttctatcttctctgatctatctatattatctctaaaagatttgagagatggtgttgaattcaccacaattctgcattccaacctaaatcaacagatcaaaaaaaaaaaaaaaaaaattgaataaaaattatcttttatacaatatctttttggtcatgacatatatccctatttacaagttttgttcctttataagaactaagaagtgtgtgtctttttttttttgtgtgcaaccaggtgtgtgtgtctttaggttagagttatttggtatgttaagaggcgatgacgtgtcgatacaccattggtgggattataatgacaaaacccaaaaaaaaaagtactcacgtgacaaattttgtttgtttccccatttcatcgtctctctctttttgtcgaccttcaacgcgaaatcactcgatccgatgaattatgaggagatatgcgtcggatccgatctgtcgttatattcatttcaacgtcggtggagaccctcgacgatttcaaatcggagagtatgctccaatctatttcccatggtacgtatctctctgttttcatttttttcagttccttttagccgagattgatgattggaattgaaaccatcaaatttcgaaactgggttttcttagatcttgtcaattggaattaattttagtgagtctggtagttaacgatagatttgggtgatggtttgtgtttgaacgttctccttttcctgcttaagcatgaaccttacttaatcaagctctgtaatgctggcatttattttggtgaatatattgattcaatgtttctttatctctctgagtgatctgtatttgaagtcgtaaaattttgtttatctttcatcggtttttaggatgggaatcccaggttgtcttgctttggactcatgaaaagtagcagagatgggaagagttatatagcactaacttggcatttactcctacagagaaatttgctaacgggtaaaactctctctgcttcatgtttatatatgtccaaaatatttcagggcacaaagttcccaaagctaaatccactttcttcatcttgtgtcaggtagagttacaccagagagtgtattatgttttcagttttggaaccgttttgctcgatctcattagtggaaaacatattccaccgagccatgtaagttctctactaatagaagatatataaactttagatgtaatgtaggacctggctctttgtttcttgctggatagttcttggaaggaatctctagttcagtccttactaaaatctaaatgatgatcatcatcgtttttcctgcctcattctttctcagacatcctttggtgatgatgcatgcttaagagtgaatcttacagccatacaggaaatactgcttaagaatggatcttacagccatacaggaaatacttagtaagattggatacaaggaattgccattgaggtgttaatctattccttcctctcgcttactacttagtcttttgcattagggacttgttttgaatatgattttatttaccttcttctgcagctctcgtttcaaatgtggacaacccagatgcaggaatctctcttttcaaagaagcaaggggacttagctttccgatccaaagattttacaaccgcaatcgattgctacactcaggtaatatctctaaatgcaacatacctctttaattacatgccaagagccatcatagggctagacattcagtcatcatagggctacacataactggaatgattcatgggccgaaaaggatgaaaaaagtttgtatggttccttgtattgaaagacatctaaatacaaaaatttgatttttgtcccttatgaaccttaaccattggaggactatttttataagatactctcattttgttcttagcttagaaataacaaaactttaatagaaataattgttaagatccaaggttaaccattagagatgctcttagtttacatgtctaatctgggatccaaaaagacatagtagcaaaaaaaaaatttaaagcttgtaactgatttcatttaaagaaaatttcatgctttatttattaattacactactatatgatttaatttaataattatgtcaatcaaattgaagttacatcaaaagagggaccagagagaaagagtttcgtgagcagctaaaaaccaaagtggggaagtcttctttcttagtcgtcgttactaaaacacaaatagtttatttggcatttgtgtttaagtaaagatgaaacatcttatatatgtgtcattaatggctaaagttagacgattccacaacggcagccaaaaatccttgaaattttccgattcttccgtttcaagtcaacgttttccttcgctccctctcaccttcttcttcacaaaaacctgaactttaatttgaatttgcccatatttttagatccacatttattcattgatttgctctgagtttgtattatctcaaagttttatccttttgttgaatcttgatctctcgattattccccaccaagcaccaagtgatcgatcttttgtctcactgaactgggttatgcttgagatttgatctgacaactaagagtttcctacttttgcgttttgagttttgtttttcatggcgtatcatccagtttataacgagactatg

SEQ ID NO: 34002 - DNA, 3000 bp, Unknown; identical to SEQ ID NO: 34001
  misc_feature (1)..( 3000): 2750-1469P.txt file - cDNA_ID_3073808; gDNA_ID_2926153; Annot_ID_198232

SEQ ID NO: 34003 - DNA, 3000 bp, Unknown; identical to SEQ ID NO: 4628
  misc_feature (1)..( 3000): 2750-1469P.txt file - cDNA_ID_3073812; gDNA_ID_1620718; Annot_ID_165712

SEQ ID NO: 34004 - DNA, 3000 bp, Unknown; identical to SEQ ID NO: 4628
  misc_feature (1)..( 3000): 2750-1469P.txt file - cDNA_ID_3073812; gDNA_ID_2926153; Annot_ID_198230

SEQ ID NO: 34005 - DNA, 3003 bp, Unknown; identical to SEQ ID NO: 20223
  misc_feature (1)..( 3003): 2750-1469P.txt file - cDNA_ID_3073819; gDNA_ID_1620718; Annot_ID_165709

SEQ ID NO: 34006 - DNA, 3003 bp, Unknown; identical to SEQ ID NO: 20223
  misc_feature (1)..( 3003): 2750-1469P.txt file - cDNA_ID_3073819; gDNA_ID_2926153; Annot_ID_198227

SEQ ID NO: 34007 - DNA, 3003 bp, Unknown; identical to SEQ ID NO: 20238
  misc_feature (1)..( 3003): 2750-1469P.txt file - cDNA_ID_3073833; gDNA_ID_1971690; Annot_ID_175076

SEQ ID NO: 34008 - DNA, 3003 bp, Unknown; identical to SEQ ID NO: 20238
  misc_feature (1)..( 3003): 2750-1469P.txt file - cDNA_ID_3073833; gDNA_ID_1620719; Annot_ID_165745

SEQ ID NO: 34009 - DNA, 3003 bp, Unknown; identical to SEQ ID NO: 20238
  misc_feature (1)..( 3003): 2750-1469P.txt file - cDNA_ID_3073833; gDNA_ID_2926191; Annot_ID_201076

SEQ ID NO: 34010 - DNA, 3000 bp, Unknown; identical to SEQ ID NO: 4642
  misc_feature (1)..( 3000): 2750-1469P.txt file - cDNA_ID_3073839; gDNA_ID_1620719; Annot_ID_165742

SEQ ID NO: 34011 - DNA, 3003 bp, Unknown
  misc_feature (1)..( 3003): 2750-1469P.txt file - cDNA_ID_3073913; gDNA_ID_1620721; Annot_ID_49209
tgtacatgtgaatgggctggtgcagtaaatgcattattacgtgttaatgtacatgtgaatgggctggtagcagtaaacgcataatctcaaaaccaccggtcaccgatgcgtgtgcaagtctcagtcagaacgtgattggaccaagtctcggtgtataaagacacacagtccatcaccgctaaataatgaccacacggatgggcccatcaatatatcaaatttgtgggtcttttaatcttgtttcacaagtgaattattcaaatgggcctttatttatacaccataaatggcccattagtccaacaacatacaataatgcaagtggtcggggtcaacgcactagaaattccacaagaactaaacgataagaacaaataatcttcatagtctctcatccaatcttacaaactttctgatttcctttctacattcatcgaccaatggcagcaaacaaaactcttcctacgtatttttgcagaaactgcgagaatccactagctctcggtgaagatctcatctccaaaaaatttgtggtaacaaaaaaaaaaaactaaagaatgttatagctttaccaaaaaaaatcactttttcatttcttatcggatgattttctagagatgatcaagtctcttcataatctccattggttataaaatgcaaaatgtttttgaatatggattatagggagcttcagggccagcgtttatgttttcacacgcgatgaacgtggtggttggaccgaagattgggaggaaactgataaccggatcgtatgtagtggcagatgtgatgtgcagtaagtgtggtgagacgttgggttggaaatatgttgagacattcgatcttaaacagaggtataaagaaggcatgtttgtcatcgagaagctcaagttgaccaaaagatattgaaacctagtcaagaagaataatactcttggagggttaagctaataaataaatgaaggaaacttgaggattgtatatgtatatataacctttgttgtataaatgtcatcactatattggttgttctctataaagggatttgaaaacaaagtaaaaaagatttaatctaagataagattttttttttcttaaactatatagaaatttacagtaagaaattaaataattatgaaaaagtataagaaaatatgaagagattccacatttccattattcatcactgctgatacgatttactttctcaatttaccagtcataaagcaaaaacccagaaagaaagaagtcacaaggtagtcgctacacggcatatatgatcagagactaaagatcaaaactttcatccaactccaaccttattctcctctcaattttgtcttgcgtccttgttcgatctgttaaacccttgtaagatccctctgaaatttcctcagaaaaattcatttcaaagatcaaaatcgaatctttcgtctgatttttctcaatttcgttgaaccatatatcttactgcgtaatttcctctccggtaatatctcattttgtttcccttaccctaccaaatatatataatctgtggtctcttcttttgacccactcttatttgtttattattgaaattgaggtactatcgtggaatctctagtcttgcacgctaacacctgcccactgttcttatcctctatttttcagacattgacgtttgaagcttggtgaatttttggattctggtaaggtttagaaaccctgatttctggttttccatgtgggttctggatatattgatggatttttatgtttttggtgaaaaggtgagaacttggttggagcaattgatcacgccttgaaagtgtttgataaaatggctcaggcaattggtccaagactgtatagttgctgcaactgcagaaaccatgttggacttcacgatgatatcatctctaaggcttttcaggtgaatcaccttgatcatttcttttgttttgtttgtgtcccatatgattgatgtagaaaattaagtggagaatcgatgtaagactagctgcagctgagcttagaatctaagaaaacctgtgactttattgtctttcctgatcaacgatcgatgctactgatcatgattcagttttcctactaagttacatgttggtgttagagtcaaatcaaaacttgaaagttgatccttggaaatggaaacaaaacataagacacaaagtagcctttgactcaaattgttacaaatcacaaaagtagtcattctttgagtatgcttgtggtaggttgtggactcaattcaaaatcttatgttagacagcccggcttttgtgtttcttgattgtgaataccaaattcttaatcacggttcttcattaccacttaccagggaagaactgggcgagccttcctgttctcccacgcaatgaacattgtggtaggacctaaagaagaccggaatcttctaactggtctacacaccgtggctgatatatcttgtgttgactgtaacgaaccattgggttggaaatacgagcgagcttatgagacctcacagaagtacaaggagggcaagttcatattcgaaaaggctaagattgtcaaggaggattggtagagctgaggaacatgatgaattcattattggattggctcaaaaatgtatatagataaaatttggctttgtgatttcacaagtcatcatcagccatttttccagttcttcattgtctctctctgtatgttaattatgtcgtctcttgtgttcaaactatggatttgttcgaacaaggtttctctgttaataaagatgttaatagcttctcttgtgtttcgcctcagaaccttcctttgtaagtgtaatatgaatctccatactttgtctttgagtagcttggaagataacttactagggaaaaagaaaggtctgccgtttaaaatttagactacgtgctgctttatgtttaccaaagctaagtggttgtcgttttggcgcaataaatgtgattaccagaggagagggagagagaaaacggagcgagagagatg

SEQ ID NO: 34012 - DNA, 3003 bp, Unknown
  misc_feature (1)..( 3003): 2750-1469P.txt file - cDNA_ID_3073913; gDNA_ID_1620721; Annot_ID_165835
atatttgcagtcgcaggtccactcttcctagtttagtaccccatctaggcacatatatcgaaatagtttaataaattgaatcaaatactgaattgttactgatatatatactctgtatgtttctcgaaaatacttaaatttggtgtcatggagttgataaatttctgtaagaaattgaacgtctacagttcttatggtttagggtttctaagatggatccaaaaaaatgcaggaaccgaactatatacggcttttgagaacttaggttatcctttagacgtgactttcaaataagtatgtcgatgatttgataagacatgtcgttttatgatatgtagggacagggaaataaaagcacaatgtgaattaagactttagattcaaaaagatgcttcatgcttgtagaaatgatgacgattgcgacttgggacaatggacaagtgctatgtcattacatatactgatacacctaacctaatgaccaaataaggactctttacacgggttaactaaacaaatatatcccaactaacatttccaacaaaataagccgataaatgtaacatgtaccgaacaaaacattattaatcatcgtaacttttttttaggtttgaattaatcattataatttaaaaccctaaaaccaacttataagaaccataattgatcagaatccagtttaagtaaataacatagaaaattttgagtcagataaaaaagaggaaattgtatggttagcaacatttacattttacagaatatggatatggtaaatgagaagtgtgtggatcacaagaagtgaatgtgctttttctgctttttaaaggatgaatatgaaaacgaggctaccctcgttattttatttaatgtgaccactgtttagctggaaatcacttggagacgactttaaagtaggctccaaaatctaaagctagacaccagacaaaagactttctatattgtttgtcttaagataattctaaaaatatcagcatcgttactttattgaatgaatacttataagaattgacagtgaaaatgaaactagtgttgaaaagagatgtttggtcattaaaatcaaacaccgaccttaaactaaaaaagaatatcacttcatcggctcctccttttttcacaacttatatacaatatacacacacacaaactgagaattagaatgtacatgtgaatgggctggtgcagtaaatgcattattacgtgttaatgtacatgtgaatgggctggtagcagtaaacgcataatctcaaaaccaccggtcaccgatgcgtgtgcaagtctcagtcagaacgtgattggaccaagtctcggtgtataaagacacacagtccatcaccgctaaataatgaccacacggatgggcccatcaatatatcaaatttgtgggtcttttaatcttgtttcacaagtgaattattcaaatgggcctttatttatacaccataaatggcccattagtccaacaacatacaataatgcaagtggtcggggtcaacgcactagaaattccacaagaactaaacgataagaacaaataatcttcatagtctctcatccaatcttacaaactttctgatttcctttctacattcatcgaccaatggcagcaaacaaaactcttcctacgtatttttgcagaaactgcgagaatccactagctctcggtgaagatctcatctccaaaaaatttgtggtaacaaaaaaaaaaaactaaagaatgttatagctttaccaaaaaaaatcactttttcatttcttatcggatgattttctagagatgatcaagtctcttcataatctccattggttataaaatgcaaaatgtttttgaatatggattatagggagcttcagggccagcgtttatgttttcacacgcgatgaacgtggtggttggaccgaagattgggaggaaactgataaccggatcgtatgtagtggcagatgtgatgtgcagtaagtgtggtgagacgttgggttggaaatatgttgagacattcgatcttaaacagaggtataaagaaggcatgtttgtcatcgagaagctcaagttgaccaaaagatattgaaacctagtcaagaagaataatactcttggagggttaagctaataaataaatgaaggaaacttgaggattgtatatgtatatataacctttgttgtataaatgtcatcactatattggttgttctctataaagggatttgaaaacaaagtaaaaaagatttaatctaagataagattttttttttcttaaactatatagaaatttacagtaagaaattaaataattatgaaaaagtataagaaaatatgaagagattccacatttccattattcatcactgctgatacgatttactttctcaatttaccagtcataaagcaaaaacccagaaagaaagaagtcacaaggtagtcgctacacggcatatatgatcagagactaaagatcaaaactttcatccaactccaaccttattctcctctcaattttgtcttgcgtccttgttcgatctgttaaacccttgtaagatccctctgaaatttcctcagaaaaattcatttcaaagatcaaaatcgaatctttcgtctgatttttctcaatttcgttgaaccatatatcttactgcgtaatttcctctccggtaatatctcattttgtttcccttaccctaccaaatatatataatctgtggtctcttcttttgacccactcttatttgtttattattgaaattgaggtactatcgtggaatctctagtcttgcacgctaacacctgcccactgttcttatcctctatttttcagacattgacgtttgaagcttggtgaatttttggattctggtaaggtttagaaaccctgatttctggttttccatgtgggttctggatatattgatggatttttatgtttttggtgaaaaggtgagaacttggttggagcaattgatcacgccttgaaagtgtttgataaaatg

SEQ ID NO: 34013 - DNA, 3003 bp, Unknown; identical to SEQ ID NO: 34011
  misc_feature (1)..( 3003): 2750-1469P.txt file - cDNA_ID_3073913; gDNA_ID_2926191; Annot_ID_141058

SEQ ID NO: 34014 - DNA, 3003 bp, Unknown; identical to SEQ ID NO: 34012
  misc_feature (1)..( 3003): 2750-1469P.txt file - cDNA_ID_3073913; gDNA_ID_2926191; Annot_ID_201067

SEQ ID NO: 34015 - DNA, 3003 bp, Unknown
  misc_feature (1)..( 3003): 2750-1469P.txt file - cDNA_ID_3073921; gDNA_ID_1620721; Annot_ID_165829
atcatattgaaaaagagagagaaaaaaagcaactcaccaagtcaccattatgtgtgctaacttgcagaaacatatgagaaatggaatgcccaagtaaactaaaaatatatatctacgggagaaattagaaaattttgtctagtttgatcatatcagctacacgtatgtcatatacagtatcaaacaggcttattagcttacgtataaactatctatagcatgttgaattgttcaagtcgttttttttttttttttctttatcacagaattgttcaagtcgttttatataataattgttgtacataaattatacaaatagcatgacatgactctatattaattttgattggtataaaattatacaaaatttaagctctaatctattaatccgcaatccgatcaaatgttcaatgatccaaaagactttatgttttgtgtatagatttggttttagaaacattgaatgatttttctctatattttcaaaaggctgctagaataagatcagatgatgtaatagactaaaaaagaaaaaacaagacacacattgaactgatataagatgatgatgatgcaatagtacctacaaaatctagtggacgccgaacagtactttaattcggttttagaacattctgaattgaaggcctattaaaggcccttcttgacacaatctagttacacgacttacgacggtgcagctaaggctatttcggtaatttcagcttctcctttcctcgatctccaagtattcgagaaacccccaccaaggcaaaagctctgtcgtcgtccacaagaacaaccaaatttgtttccgtcttctgctaacatatcctctttttcatctgggaaccctaatttcttgactaacttagggttttatttatccatttgagatactctgtaattgaaaggttgaatttttagaagagacatgggaggttcgtcggagacaaagatcttacaagaactcatactttacgcggcgagcgctgctttcagctgcttggttctctttgcgggtcttcgtcatctcgatcctaatcgtgaggcttctaaaaaagctctcgagcataagaaggaaatctctaaacgtttgggtcgtcctcttgttcagaccaatccatacgaggtaatctactatgaattaagcatcttagaatcctcactggttggtagctacctgagaatgcgatatgtggtttcgataaccaatttgtattggtctctctgtttaatattgaaatttggatacttttgagttccaatcgtctttttgcgcaaactcatgaaatgagctcgagaaattgctcactagtttctaattttgtgaataggatgtaattgcatgtgatgtgataaatccagaccacattgatgtggagtttggttctattggagggttggagaccatcaagcaggctttgtatgagcttgtgattttaccactgaaaagacctgagctttttgcttacgggaagcttcttggacctcaaaaaggtgtcttgctctatggacctcctggtactggaaagactatgcttgctaaggctattgccaaagagtcaggagctgttttcattaatgttagggtttcaaacctgatgagcaagtggtttggagatgctcagaagcttggtaagtgcatattattattttgtgtgtgataaaggaacacactttgagtaggcctgtcttcatgctcgtcgtgttttcttcctgtgcttttatcagcttcacattgtgcaactttgttggcagttttttgttttttgtgtgtggttattatatcaattacactttttttggtctgttgatggtgtttctaatctatgagctgctctgttctgtttcgttctctcagtttctgctgtgtttagcttggcctacaaactccaacctgctatcatttttattgatgaggttgagagctttcttggtcagcgccgttcaacagatcatgaagctatggccaacatgaagactgagtttatggctttatgggatggattctctactgatcgtaagttgaattcttcactgttcggcttactttgccatgcagactagtgtaacctggagtatgtgggtttcttatgaatagaaatggttgcttttgtagcgcatgcaagggttatggttcttgctgcaactaacagaccgtcagagcttgatgaagcaatattaaggcgtcttcctcaggcctttgagattggaatacctgatcgccgggagagagctgagatattgaaagtgactctgaaaggagagagggtggaacctgatattgactttgatcacatagctcgcttatgcgaaggctataccggatcagacatttttgagctatgcaagaaagcagcttacttccctatcagagaaatcctagatgcagagagaaaggggaaaccatgtttggtaagtttaaaaagaaaacatggtccactgaaatgttcagtgttgcatccactagtttcaaggtactgatgttatgagtttgtcacgtttgcaggaccctaggccattatcacagttagatttggagaaggttcttgcaacgtcaaagaagacacaagttgcagcaggcgagtactcattgagctcgcagtcctcggcttggagaggctcaagggaaccagatgaggtccaggcagcgataagtgggatctcgaagcttctagtttctcagatcattaacctacagtcagaatctcaggattcatggcagcgggatcccgaagaagattcccgatgaaattccggatcacttttataaacgttctggtgttttcattggaagtttagaatttgtcacacacttcagtttattctgtaaaacttttcttttctttttggtaggatcatttgataacttatgactgtactaaaaagtctctcaagtttctacattactgaatctctcttgttcataatatggccactgttctcactcatgggttacttaagtgttaactctttcttcactttacttaatcgttaatg

SEQ ID NO: 34016 - DNA, 3000 bp, Unknown; identical to SEQ ID NO: 4676
  misc_feature (1)..( 3000): 2750-1469P.txt file - cDNA_ID_3073925; gDNA_ID_1620721; Annot_ID_165820

SEQ ID NO: 34017 - DNA, 3000 bp, Unknown; identical to SEQ ID NO: 4676
  misc_feature (1)..( 3000): 2750-1469P.txt file - cDNA_ID_3073925; gDNA_ID_2926191; Annot_ID_201053

SEQ ID NO: 34018 - DNA, 3000 bp, Unknown; identical to SEQ ID NO: 6743
  misc_feature (1)..( 3000): 2750-1469P.txt file - cDNA_ID_3073941; gDNA_ID_1621103; Annot_ID_171496

SEQ ID NO: 34019 - DNA, 3003 bp, Unknown
  misc_feature (1)..( 3003): 2750-1469P.txt file - cDNA_ID_3073941; gDNA_ID_1620723; Annot_ID_165879
acaatttataaacatagacaaccatgattagtttcggaagtcaaaataaaaagcatgttaatcaattgtcttttatctcgtatccccaattttacttctcaaagtactaaaatagtctaaaaacaatcatacgtacgtaataagaaaataatttacttcctgctgtgtttaaacaaaacttctatgagatgtaaaaaaagaaaaagagtctacgatggatgatcaagcgtaattgctttgttacgtctaaaaggtgtttaacaaaactatagcgcagaaaataatcagtttaattaactaaacaaaaacatgttagtggattaagccaagaattagtccgatagaactataaaatctacaaaatatctcaaatctcaataatacgtatataatatctcaataatacctatataatatctcaactccaatcagaaagctaaataaaatatcagcataagttatattcgcttccaaaaaaagtctgcctcgttacctacctctcacactcaagtctctcacgttatttgagatatttaggagaagcaagacgacaacgagaagaaaaaagagtgggtatggtcaagaaaaagacaaattatgattttagtggaaaatagaaagtaaagagtgaagtgacgcgacacgtggtacgagactccacagcgagccacgtaaggggggacaaagaagagaaggtatggacaatggtttccgcggtcgagccacgctttcagaattctgattggcactgggttatcttgtggaacccatctgaaagatatttttggttgtcgtacggatttgtttatttcgggtttgttgaattagtttgtttcggttttatacactattttaggaaacttttttttatattctttatagtgaactgggctgaatttttttggttgctagattcgagacgagccaatttatgtaatattttgtggctttctgttgctaaattgtaagatctgtaacttacatgagatagaataaaataatgtaatgcaggttttgtggcatatttacaaacatcatccacgtgtaatgatctgtccacatattttgccttgaaagcaactacaatatgacttttaatatcttttttgttaaatatttgacttttaacttatgtgaagcaaagaagtagaaaacgatttgttttgtattgaattattttccactcgtttctacaacaataaaataaaataaaatgaaggaaccattctaaaaaaaggaactagaatattttcaaactatagtacaaaaatggaaacgactatcgaatattagtaactccaaagcgacacgtcaccatctccttcgccgtcataattatgattccattgaacagacggcggcggtaaaagcatgccttcagccatattatccaacaaagtcggcatcccaaacattgtctcctcatccatataaaacgcaccttcgctctgttccggtgtataaatagcttccaccatcgtctcctccatgtccaggccatgattcgtggtcgtcgtatcacacgtctcatcttgaaaagccaacgccgcttcagcagccgctttttggatatccttggcgcatgttgactccgggattcgtagccgccaagccgagtcagcgaagttgagacatgctgatcggccacggagggctaatgcagcgacgtcgtgagcacgagctgccatctcagcggtttggaaagtcccgagccaaatcctggttttcttgtttggctctctcacttcagaaacccacttaccggagtttctttgacgaactcctctgtaaattgggtgacgagtctcacgaaacttcttacggcccgccggtttcttcggacaactcgtggccaacgtcggacaataatctccgccttgaggctcgtaatcggagccaaacatttcagaaaaagctgaaaatgagttcattgatcagagtactctgtttcaagaaactggataaggtttaagtagtacgtagttactagagttctcagtctttttggattaataaaagatagtatatctgtcttggtaaagctatttatatctctctctcttttttttcttttcaggtagattctttttcaagtgtgtagttagtataaaaagtgagagtgagaattggtgtttatattggccggaggagagataacggatatgtggggagcacacggagtttttgtctctgtgaatgacacgtgtatagtacatagcgaagcaatcccacgatgttccactcgctgtctgacgtgtgtcctttgacccttgtaaagagacttttgactcttcactcgttaacctttatgagttctttaaattctatcgagtgtgtgcctgtgtggttggctggctgctgttgttacaatcgtttttaaattcctatgaataaacaaattgtcattaattgtcacccgtctataacataatagacataaatatctctgtgaaatgatattttaaatactcatgtagtatttgtattggaagtagatgtcctaatatttaaccaaaaataatactacaatatagaaaagcttgattttttaaaaaaattaatcagatttggtaatggataattatcaatttcgatggacggttaaaaatgagtcataaatgcatatgatgaacaaaattattcagtttaaacaaactataaccaaaaacatgtaaatggaccaggacaggactaagcgaaggattagaccaatacaaaatagcaagttatcttgaatcccaataattcccacaaaatatctcaatctcaataatagctatattgtattgacaaaaaaaaggtataaaaaatcttcacaataagatatgcatgaaatatattcgctgacaaaaatatctctctcgttacctctcgctctcacgttattgacatttaggagaaaagaagacacaacaaagagggaaaaaaagagtggtaaggtgaagaaaacaacaaaattggctttagtggaaaatagaaagtaaagcttgagagtgacgtatg

SEQ ID NO: 34020 - DNA, 3003 bp, Unknown; identical to SEQ ID NO: 34019
  misc_feature (1)..( 3003): 2750-1469P.txt file - cDNA_ID_3073941; gDNA_ID_2926187; Annot_ID_200728

SEQ ID NO: 34021 - DNA, 3000 bp, Unknown
  misc_feature (1)..( 3000): 2750-1469P.txt file - cDNA_ID_3073948; gDNA_ID_1620723; Annot_ID_165873
ttttagaatggatcttcttctttttttggttgtgagaaacgaatgtaaatggtaaaagttgttgtcaaatgcaaatgtttttgagtgcagaatatataatctttggtctccccataagcaacaaatcaaaatataatactattacgtaattcagtgaattgaaaacaaaaagtttgggctcacctgtaaaattaaagttagatgattctggcatttccgtgtctaagaaaagttctaggcacttatgtaaatagcaaaagttccaggttggttgatagcaacagtttctgcctttctgctaattcagcaaatatcaagactcaaggacgtttggtaaatatccaaagttccgtgagtttttgtaaatatgataaattataggcactatatagatatctaacgtttcaaaaaatgtttgaccccaaaaaaaaaaaaaagggtttcaaaaaatgtctgcaaataaaaaaaaaaggatgcggagacacttttaatttagtcaaagctttaggcagtaatgtaactgagaaacgatcctatgtaaatagcaaaagatacaaaaaaaaaataaaaaaaaaaaaatagcaaaagatacaagatagtgatagtgtataagtagtatcaagagatttatatacagtatttatggaaataacaaatgtttcgagattgtaaagagaaaatgatccatatagtaaaaatctacgggatattttattggtgagtagcagtaaaatccgaacacttgtatatagcaagatacctacccggcaaagcacttcacataagtttcgggtacttcgttgaatatcaaaagatctaaggcagtaaggctctttggtaaatagaaagttgggtaacgctttggtaaataaaattttgggtaacttgggttatattcttctttgaatagcaaaagaagaagtgagcaactggggtaagtagtacagttttgatgatagcaaaagttccaagtgctatttggatttctcaattaggagacatgatgatcaattttgatgacagctaaagtttgcatcgagtccataacccaagaagaactttcacgtaaaccttttcttttggaaaagaaaaaagtgtaactatcatgatttttgtttttctttgttttgatgacaagtatttctcctcgtgaaatcagttttttttttcttttaatgaatataaagaataaatcagattattgagattcacaaaaatccatcatcgcaagttcttacgtattcgaaagacgttactacggttactaacttactgtatatgtatgtgatgtcgaaaaagaagaagagaagacgttacgtcactacttgtatgttcatcgatcagtccacgtggctttttgtaaggtccgagagaggaaagtgaaattcagacgccgcttttttttttttggatgaagttccaaaattagccattttatacagtggttaagctcgttggaccaatatcaatggcgtctgcaacgactcttctcttccaccacggttccactcgagtcctcgtcgctcgtagacggtgccaagcttcagtccttagaccctacggcggtttaaagccctttctttccttctgcagcttacctaactccactgcgccgttccgggattcgttgagagcaaaatccgatggattggctcgggcctatgttaccggagcgccgcctatcgtggaagaaccagacccaaagattgaagaatccaaatctgaggctgaatcgaaggatttaattagttgggggcttctgtggagcttgatgagcaagcacaagctcaggctcagtgtttgcttattgactctccttggatgcagtacttgcactctctctatgcctgttttttctggtaatcggttcttcaatccactctcccaccattagcaaattgtaactgtactctttttttctctttgggtttgatgtagtttaagtttgggtatgatgatttagcttgtcatctgtgtttctctttatcttggtgaagctgttttataatggtaagtgttattgttttgagtaaaggtagattctttgaagtactgattggggtgagaccggagcctttgtggcggctgctgagcaaaattgctgttttgtactcgttggaacccatctttactattgcttttgtgaccaacatgactgctatctgggaaaacgttatggcaatattaagagctcagattttcagaagggttttgatccagaaggtatgttttgtttagtatgatcaaagttcgcttaagctatattgttggctgtattgaaatatcattgatgggtttcttttttttgtcttttatatattcaggcagagttcttcgacaaatacaaggtctgttccttttattcttggtttgctcaggtttgagacattttggcacaaaccttccttatgttagattgagttcatttgttttaggttggagagctaacggggctactcacgtctgatcttggtgctctgaatagcattgtgaatgataacatctcacgagatcgtggatttagggcatttacagaggcaagccatttctttactatgcaaatgtgagatttttgtgtttgtacatacatttttcataatgaatacagatttaatcttagcctggtgttggtgtctgctgttatttttggagttctataaatgacaaagactatcctgttgcatctcaagaatgcccagttctcatggcttatgcgttatcccttttgtaggtttttggaacaatatgtatcctatttactctatctcctcaacttgcacctgtacttggtctattgatgctagctgtgtcagttctagttggtaaattctctatgtctttttcattctcctaaactttttatttttggtaattactttggtcatctttgcttactttgcttacctctacatctactccctcggtcaaatctcaaaagctgtgtacaagagatcgactgttcctgtttataaatcgcatggattagctcaagcaacaatg

SEQ ID NO: 34022 - DNA, 3000 bp, Unknown; identical to SEQ ID NO: 34021
  misc_feature (1)..( 3000): 2750-1469P.txt file - cDNA_ID_3073948; gDNA_ID_2926187; Annot_ID_200722

SEQ ID NO: 34023 - DNA, 3000 bp, Unknown; identical to SEQ ID NO: 20995
  misc_feature (1)..( 3000): 2750-1469P.txt file - cDNA_ID_3073974; gDNA_ID_1620864; Annot_ID_170431

SEQ ID NO: 34024 - DNA, 3003 bp, Unknown; identical to SEQ ID NO: 20287
  misc_feature (1)..( 3003): 2750-1469P.txt file - cDNA_ID_3073974; gDNA_ID_1620724; Annot_ID_165910

SEQ ID NO: 34025 - DNA, 3003 bp, Unknown; identical to SEQ ID NO: 21047
  misc_feature (1)..( 3003): 2750-1469P.txt file - cDNA_ID_3073978; gDNA_ID_1620724; Annot_ID_165908

SEQ ID NO: 34026 - DNA, 3003 bp, Unknown
  misc_feature (1)..( 3003): 2750-1469P.txt file - cDNA_ID_3073985; gDNA_ID_1620724; Annot_ID_165896
ggcattgcagcttcagagggaaagagtcaggtggcaaatgaagctgatacattgttcttctccaatttgaacaacatccaaaagactactggcgggaaggcatcatcgcagccaaagcgcacgccagtttcaaacgaagaaatggaagccattttggtatgtaacttcattttgacatgtataacaacacttagatgaacatgtatctaacagtataatgtgtgaccaactactaagttataattatgtgaccaattacaagttgagagaacccttttcatgatttaataatattgttctgtttctaacttccttatccttttctgaattttttttacagttgggaggctgcatctgatcatttcaacatgatctgttgacaagaatggtggatcacttctcatctttaccatttacagaatatactcgatagtcaagaagaaactgatatggttgatgtttacaacaaccaatgataacaataaaactactccattgcagtttttaacttctatactgattcatcattgattgagtgcatttgaatctctattattaagtgctttatgattgaaattcatcgtttattcttttttttatatcacatgatgaagctcttttagaaccagtcagaaatattgtagcctaaaacgcaaaggtacgttacatatacattcacaggaacttacatacagagaagagaagatcacttatggtgctgcctcttccttttgcatctgttcgataagaggctcgagaatacaagactttggattcttacccggtggacctttttctcttcgttcaagctcttcaagcctgaaagtaatgagacggtcccagtttcctccttcgaacaagacaccagcttttccatcagtgatcctctgcacaattccacaatacatgtgatacggactgttctggttcttgactatagcaatcatccccggcatgagaaggggtagcttgggcgctttcggcttcttatctgtagcaaccgcggatgcatcgcttccttgttttgcaggtggtggtggtggaggaggtggtggatttttttcgataaacgtttttaaacccttttcgccaccgggaaatcctcctgtgagacccatcatctctttctcgaaaccatcttcaggtactttaaaagacaagttactgtcatcgctctctctctctgtctcgttgttctcagcctttgatgtctcttgctcgtcttcaatgttcctctggagctccttctcaatacctttctctccgttgcataatcctcttcctcccatcacttcccatagattgaatttacccatggcctttacttgatacagttttgactgctgttttggaggcgggaaaaccgaccggtttacagttgaaaattgatgtgtttggcctagaaattttgatcgatgaatcggagttctaatggtcgggatagtgatcgaagaagtcgccataactatttttgcctgcagagtagagtagaggtgactaagggagatatgaagaagatggaagaggaaggaagaagcgtgtgattgattcgcttgttataatgaccacatatcatgatttcagttagatgagttctatctatttccaaattaccagtggacctgaaccggttaatgcgtaaccggtgtttggaataatgatttaggagaaagagtaggaacatttgggctttgtcataagtttaacctggaccaagtttgaatattcttaagagatatgggcctagattaaaaacaatggtaatgtaattaaacatattgctaaatgctaataatgtggatttgtttgtttattaagaaaaaagcagcaagaagaagataaatcatttgggtcaacgacattaataattggaatcccatactcccaaatcataattagacatacacttttgtcttaggctgtcctttacactcatcggcatcaccaaatacttagttggcaactttgatcaattaatgtattaagcatgaatgaaaacaacttttacattgattcgataaattcattatattgtagataagattagtcaaaagtttacaaacattcgttaacaaattacaaaacttgtaatatctgcagcaatgcccatgtgggtagagctggctgacgcaacctaaccgggggataaaagcgtctttttggtaccaaatttaaagtttctttatgagtaaaattcccaaacccaacatcttcttcctgctgaagcagtaagcactcaaccaaaaaaccaattgcgtaaacactttcccttgaatacagagatcacattcgatcaggtaaaaacaaggtctcgatcttctcttcagtcaattttttcaaattattcgaggttcccgtcattcgattccgacttccgagcttctatttctgctcaatgtttttgtattttgttagggtttccagaaaattcgattctgttgtttttaatttgagctaataaaatctagaatgggaaaaagaaagagttcattttcgtcctctttctttttgtagaagctgaactttgtttttcttttacagcgagctgatttctcacaagggatatcaaaatttctggtgaagtgggattgtaaaattcggcgttgaaagatatataaagaggtatgtttgatcctcagtgaggaataaggatttttagtagttatatatctctccaagtgatgatacatacatacttgtggattagatctatgataagaataagcataagatagagactgagagacaagtcatttagggagattaaataatgttcatggaatgctaaagttcatataggagtttgtctcatatcagaatctagattagatcatgctcagatgacatctcttgaatggacaaaaaagtttttaactatgtgattttttcgacttcttttggggaatcaatgtactacaagctgagagttttagagtagtttcatctctggctaagctttgattcattttctagtggaaggttctggagtcgtttcaattcatg

SEQ ID NO: 34027 - DNA, 3003 bp, Unknown; identical to SEQ ID NO: 34026
  misc_feature (1)..( 3003): 2750-1469P.txt file - cDNA_ID_3073985; gDNA_ID_2926184; Annot_ID_200483

SEQ ID NO: 34028 - DNA, 3000 bp, Unknown; identical to SEQ ID NO: 4708
  misc_feature (1)..( 3000): 2750-1469P.txt file - cDNA_ID_3073992; gDNA_ID_1620724; Annot_ID_165888

SEQ ID NO: 34029 - DNA, 3000 bp, Unknown; identical to SEQ ID NO: 4708
  misc_feature (1)..( 3000): 2750-1469P.txt file - cDNA_ID_3073992; gDNA_ID_2926184; Annot_ID_200476

SEQ ID NO: 34030 - DNA, 3000 bp, Unknown; identical to SEQ ID NO: 20306
  misc_feature (1)..( 3000): 2750-1469P.txt file - cDNA_ID_3074020; gDNA_ID_2926149; Annot_ID_197946

SEQ ID NO: 34031 - DNA, 3000 bp, Unknown; identical to SEQ ID NO: 20306
  misc_feature (1)..( 3000): 2750-1469P.txt file - cDNA_ID_3074020; gDNA_ID_1620725; Annot_ID_165925

SEQ ID NO: 34032 - DNA, 3000 bp, Unknown; identical to SEQ ID NO: 4743
  misc_feature (1)..( 3000): 2750-1469P.txt file - cDNA_ID_3074040; gDNA_ID_1620726; Annot_ID_165964

SEQ ID NO: 34033 - DNA, 3000 bp, Unknown; identical to SEQ ID NO: 4742
  misc_feature (1)..( 3000): 2750-1469P.txt file - cDNA_ID_3074044; gDNA_ID_1620726; Annot_ID_165961

SEQ ID NO: 34034 - DNA, 3000 bp, Unknown; identical to SEQ ID NO: 4742
  misc_feature (1)..( 3000): 2750-1469P.txt file - cDNA_ID_3074044; gDNA_ID_2926153; Annot_ID_198212

SEQ ID NO: 34035 - DNA, 3000 bp, Unknown; identical to SEQ ID NO: 4740
  misc_feature (1)..( 3000): 2750-1469P.txt file - cDNA_ID_3074054; gDNA_ID_1620726; Annot_ID_165956

SEQ ID NO: 34036 - DNA, 3000 bp, Unknown; identical to SEQ ID NO: 4740
  misc_feature (1)..( 3000): 2750-1469P.txt file - cDNA_ID_3074054; gDNA_ID_2926153; Annot_ID_198208

SEQ ID NO: 34037 - DNA, 3003 bp, Unknown; identical to SEQ ID NO: 28078
  misc_feature (1)..( 3003): 2750-1469P.txt file - cDNA_ID_3074057; gDNA_ID_1620726; Annot_ID_165955

SEQ ID NO: 34038 - DNA, 3003 bp, Unknown; identical to SEQ ID NO: 28078
  misc_feature (1)..( 3003): 2750-1469P.txt file - cDNA_ID_3074057; gDNA_ID_2926153; Annot_ID_198207

SEQ ID NO: 34039 - DNA, 3003 bp, Unknown
  misc_feature (1)..( 3003): 2750-1469P.txt file - cDNA_ID_3074083; gDNA_ID_1620728; Annot_ID_165994
tggtgcatgacataaacatccctctctctaagagtatatgcaacttctgttgacatgaagtatacatgcattaagcttaagtagtactcatcaacaagctaagttcgtttctatacacccactgacactgagcctctaaaagatcaacacaaaattcactctaataaaaaaatagcactaattggcataattaatcaaaacacgaatgcaattcatttgtaagagaataaagaaaagaaatatgtttaatttatgcggaaaatagtgtggtttaggttcaattttgtatactaattggcatgaatcaaacaaaacacaggcagtttatttggaggaaaaaaaaaaaaaaaagtttaggaggaaaaatcggtgacgcttaggttcaatatgtttatgtgctaattgatggcccatgaagcccaatatgtagcaacggcacatcatttgcctctcgtataaatctcattttcacgtaatattctaaattaattaacaagagattgagagattgagaaagagcgagagagagagagagagcgagagcaagaaactcgagaaagatttactaaaagagcctttattctccccttgatcttcccgcgatttccttcggctgaagaacaatataatggagcgtgagacttcgtcatcttcaactcctccggaggatcttgttacatcgatgatcggaaagttcgtcgctgtcatgtctaacaacgacatacgatacgaaggcgttattagccttctcaatctgcaagattcgaaattaggtctccaaaacggtaacaattcgattccaaaccctctccaagatctactgtttatgattttcttcttttcaagttcttcatatttgtttctttggtcgttgttagaatatttccgtgaaaactatacgtttcatatatataaaacagtatcatgtgatagattaaggcctcaaatttatgtatgcagtcgttagggtttatggaagagaggttgagaatgataatgagcaacgagtgttccaggttcttaaagaagttcacagtcacatggtatttagaggaagtgacattaaggttagttttcgttaattttttgggttcaagattcctcgctagtcttcttcctagttagttgcttgctgcacaagaaacacttttcttgaagcttaaactggttattttaattgcaccaatagcagataacgaagcacacgttactgtgtttagatttcgaggttagttagtttagggtttgagggtcgttaatgataaatcatctacttggttacttgctatataagataagtttttttttatataaagttatatatattcagtatttgtgacattagtttgttggtttttgtgtccatatgtttcagtcagtcgaagttctctctctgccgccaccagctaggcataattctgctatagggcacgtaggtagcttgattactaccgaagacgtgaggattgagggggttatcagccatgttaaatttcatgattcgatgatattcatgaagaattgtgagaacctttttttcctgatttctattctactaataaataaatatatatataatgttgattcattttaatttacaggtatgtgttatggtactgaggggaggacgaagagaagacgttcaatagtagcttgcaatcaattagctggttcaatccacttcaaattcagagacattaaagtacgtggaccaatacttactcatgcatacatatttgattaattagtttgtgtactgtacaatttacgatcaatctacaatttacaggctctcgaaatcatctttgttcgggaacttctacacaatgatgatcgtgagtttgctgatcagtttcctctactaagtagatcacacatttgtcatcgccaaggtggcgtctgatagtctcatgccaaggcacagcctctttcacatgataattagagacgacgagagaagaagtattagagaggctgctccttgatttgtgtagaataaaacatatacctaattattaatggatttacatggtttttctacgtgtgcattatttggttgactccaattatttaacaattgcatatttgtctcaggtctcatttagcaactaggtaatgtaggaatttaaatagctctataacctactttttaattgtttttttggtgaaacttttttctcataacatggtttttttttttttttttggtttaacggatatcttctcgtaacatatgttcttctcacatgttaacactaaagcagacacaagaaaacaaattagtacgttacgttgttgcatgtgttattttgatggctaactggaaaaatacaagtcgttgtgattagccatccaatgggcctctaaaaataatgacttggtaaaactagacaacccaaaatcacaaaacaaatattctcttcttctattaagtaaaaaaaaaaatcttattaaaatctggtttaaatgtttgttcattcaaataaataatggagtgtattttagaatcaaataaaaaaaaactttatcaaatgatttatttggtagataacaaccaaatcttgagctaaaaagggtgaaaaaatattgagaattttgttaataagtaaatagttatggttttgactgggtataggagatatatctaggctggtgaaaaaaaaaagaaaaaaaaggatatatctaggctttaaaatattcacatgcatacaatcagattttcatcggtgttcgataagaaaacaaaaagcaagtgtttgttttgtaaaaaactaatggcatacttaagcttcaagtctaatatggaaccaccacggggatataggagatatatctaggctggtgaaaaacagaaaagcaaaaaaaaaggagagttaatctaggctggtgaaaaaaaaaaggatatatctaggctataaaatattcacatgcatacaataagattttgatcggtgttcgattagaaaacaaaaagcaagtgtttgttttgtaaaaaaactaatg

SEQ ID NO: 34040 - DNA, 3003 bp, Unknown; identical to SEQ ID NO: 34039
  misc_feature (1)..( 3003): 2750-1469P.txt file - cDNA_ID_3074083; gDNA_ID_2926173; Annot_ID_199665

SEQ ID NO: 34041 - DNA, 3003 bp, Unknown
  misc_feature (1)..( 3003): 2750-1469P.txt file - cDNA_ID_3074102; gDNA_ID_1620728; Annot_ID_165983
cgtcgtaaagatcggaagtgatggtcgacggtgaagcacctgggaaaaacacctgccagcaatgaagctcgtcgtgtgtcgtcgacgttttcaccggaaaaggcacaactgatggtccaagagaatctcctgccatcaacgaaatccagtgagaaggaactaaaggcgttaccgctaatagggcagatctggagccaaaggatgtgtcgatgaaaaactgctctagaattttggaaagggcgatgatgaagaagtgcgattcttctcttgtcgggttcaaaggcggatctgcgtctgagttatgattcggggcaaggcttgtagagtaaacattcactcttccgtcgcaaagaagaccctaagagaagaagactaaaggaaatgaaagttttggattttgcacgagagaagaacttaacggagagaaaaaccaagaccagaagcttaagaaagactgaaacaggctaagaagattttgcaggtcccgacgccagcgaacatgagtctcaccggcgccggaaagcatgtttacagaagatgtcttgattaccgtgtctgggagagaacgaagctttttatttttacccatcataatctctaaattatacaaattcttaaaatttattactataaatttttaaagagactctctcaagggcttagagcaaccccaatggtttagaaccaattggttcttaattttcaattttaaccttattttaaattaaaatgttacttttactaagttaagaaaagttaagaagaagctgaattaatttttactccaatggttaagaactattgaattcctaaaagacaacaattcaaactatttcaaaacaatgtctacccactcaaaacacaacacatatactcttcttaattttaagaaaacatcttaactaagatgtttatcttagctaagacttgttggtttcattaaatttaatcagttttatagctaagaattagttaagatacaaagttgaggttgttcttaccattgaacatgctctaagattaccttgtaacataaaaagacacttaccttgttaatattattattatattccttcaatatcacactcaacattcattttttaacaagtatatatgtgaggtgcactaaaaaaaaaaaaaaaaaaaagaaaaaacaagtatatatgtgtataaacactcacacacgaaatgatatcatttctctgacattaacattaatcactttaaaatttgatagaacaaaccatttatctatgaagtgtgatgattcatatggtcggtagaaagtacacaatcacaaggggttgtttgttgagtgacttgagtcccagtcatccattactaatgtctactgatacaccaacagtttgattttatttattcagaaagaatatagatcattttactattttagggggaaaatatgtgtaaagtcacacgatgatcatttctcaacaaatcttatggttgtgataaaagtcacaatgtgtttgtttatctaataacttatgaacatcttttctaaccttctacaatacgtttgtatgaattataaaatcgaactaaaaccaaagtgtgctcatctttttttttttttttgtcgaaagtgtgtactcatcttaagcattttttgtgttttgttttgttttaatatgtttttgcatgtttttttgataattaccttaatcgaaccagttaaccaaaacacaatgaaaaaaaaactggtttaatccagcttctcagtagtgatttacacagtgaagcgatctagagttgttactagattgataagactctaataaagcaaatatacaaatgcagggaacgcaaaagcggcaaacacacactttttcattgcaattgtcttgaaactatttctcggagaacaagtgcaagtgtgtcggggaaaatcaaaaacgattaatcaacgttcaaaatcctcaaattcgttttgaaaacaactacatcaagacgaatatcatggtaatataaaagtcgccagtttagttctcacgtttctcacattcaaaaagaaaattaaatcgaaaaccgttttaacagaaagaagaagattgaaatagtaacggtcaaaccggtttagactgggttggatatattattttagttaaataaagggattggtgtacaagttgtcggaaattgatcctatacttaaccctacttgagagacgagagtggagaagatgagaagagactgcaacaaagagagaaaaagagatcgtagaagaggaagaagaagaaaaaaaaaaagaaaaaaaaagaaagaaaaagaaaagaaagctttgtcgtaggaagaagaagaattagaaagaagaaagagacaaatggccgatgtgttatatgttaagtggactgttttgtgtgttgttaagacaaaactatagtttgagatgatcaagaacacaaagatttaagaataactctctttattagtttaggaaaattactcaaaacctaaactctcttgtttctcaatctctcaactcataagttatgcaacacacttgcatctccttatatagagatctcttaaacaatcctaatcataacttaatttagataactcttaaatattctctagatatctccaagagtttatagtcctaacctctctaggatttaatgacttagtgctcaagtcatattcaaacttaactcaacaaaaacaattaagctaagtaagttaaaagtagaagtagtataaatatgcttctaatgaatcaagacaagttaaggttcctaccttggaacccgaaaaccatgtgtttatgtctgccttcaatctcccacccatccttttgatcgtagatggttcggtctctggataaaaccctatgatcatcagcccctaacccattggacgatcgacatcaagtgtaccggacattggttgctaccgatgccctctccctattctcgttgcttacaaatagtccacgaaactgttggttcagaacatacgaaatcggtggacaaaacatg

SEQ ID NO: 34042 - DNA, 3000 bp, Unknown; identical to SEQ ID NO: 20341
  misc_feature (1)..( 3000): 2750-1469P.txt file - cDNA_ID_3074135; gDNA_ID_2926148; Annot_ID_197875

SEQ ID NO: 34043 - DNA, 3000 bp, Unknown; identical to SEQ ID NO: 3853
  misc_feature (1)..( 3000): 2750-1469P.txt file - cDNA_ID_3074135; gDNA_ID_1620729; Annot_ID_166057

SEQ ID NO: 34044 - DNA, 3000 bp, Unknown; identical to SEQ ID NO: 20343
  misc_feature (1)..( 3000): 2750-1469P.txt file - cDNA_ID_3074137; gDNA_ID_2926148; Annot_ID_197874

SEQ ID NO: 34045 - DNA, 3000 bp, Unknown; identical to SEQ ID NO: 3858
  misc_feature (1)..( 3000): 2750-1469P.txt file - cDNA_ID_3074137; gDNA_ID_1620729; Annot_ID_166056

SEQ ID NO: 34046 - DNA, 3000 bp, Unknown
  misc_feature (1)..( 3000): 2750-1469P.txt file - cDNA_ID_3074141; gDNA_ID_2926148; Annot_ID_197868
ccccagaagtttatgtcctactcaagaatctcaaactttagtatcgttgccattgaaatgtgatcaaatcacgatacaaacaccgaagatacacataccagcaaatgtggaaacacagtcgtgtcactcacttcctcaaagtaaaaagtgtgtccaagactcgctgtattcactagatgatccactgcatcgaattcatcatcaagcacaaacaacattttcgttaaaaccaaaaatattgcttgacctacaagttaacctatccttcgcattttatgtggtaatggcgagaaagtagtgtaccgcggccgtaatagttgacggcttgggtgataaaacggcggcagtcatcttctttgatgacatcagcagcgatgatgatcacatggttggctccaatctgtttagccttattactcacaactctcagtctctgctctctcctcgccaccaacaccaaattcgctcctctttttgcatattcatatgctatttgctgcgttccatttcattaccaagatcatcagcatccatgcaaaattgagaaactcatgataaacataatctcacttaacctatgatcggcctttgacaacatatgtattatgacctccctctccaaaaacatatttgctaaccaagttattcatcgatttgtttgtaattaagaattttaacaaagcaacaccatatattttgaaaatacaataaccattttgtaggaattaatatggttttaaagaaaataattttgcaggagagtaagtagttttattcttaattttagtacctctccaatggccgatgaagctccggtgatgacaactactttatcttccatattttcggtggcgaaataagagttgtaagcccgttcggagaagctaatgaaagacagtaatggccatgcaaaggccatcaccaccatggtcgctggaggcgccaccaggttcatcaccgagttcaatagatccaccatttttctcttcactttcgaaaataacaagagatgtttagtgaggctatagaaacgaagaagaaagataggaggaatgcagttaaattaaaatggagtttttttctttgttgagaatatgaaaatattaatatttgtggggcggattttgacgtatagtgatggatggtgaacaacatggctgcatgcagactgaggtacagagccacgtgcttgttcctttgagttttagataagataaaaccgtgaagctcatgttccggtttaatccgggttggctgttttgcatctggttgactggttcaataagttcgtgctacgtacacatgctccatttgaaataaagattcggttattggtttcttggtcttataagtgtaacccaccaaaagtatttaacaatttttcctgtaacgtttttaatatatgtttccttggtcttagtcggatattgatttatgcatacgtacaagctccatttgaacctcacttttagtgggtctatgggcggccataagtaagacctagtttatacttaattagttaatgttggttctctctactgttaatctttacttaacaagaaactttgatcagacagatcataggttataataattctcttaaaatgttgcaaacaagagactatcccaaggccgtgcttaatgtgatacaaaataaggcatgagcttctgaaatctggacccaatcagtacatatatgagttttgaaatgatcattgctacaacaaaaggttttagaagttcttattatttttattttgtttcaaggattaagttttatggtgtttgatttgaaatcaatgcatgatttctatagacaaagagatcatgagcttctagaagatatagatacattatgaaggtgtttttctttttctattttgcaagagtctctcacttcacaagatatccttttgaaaatttccacctcgtagtttataactagttgatattttaaaaaaaaagaatcatataactagttgatatcaatgtcgttatgcagtctcttatcattgtgcaacatacatttattttctaataatctactcgacgatgtcgaggacaatgtagatactttgtgggagacttgaacttagaagagtctttgggataaatgttcttgcaggtagatgaaaatatatcaagtgggacccacgatctccgacaaaacatcctacgtgggtcattgtcgtaacaacaacaaacaaaacaacttcattttcgaccgttggatcaaatcttcacttcatgcaaattcgttagtctgtttcctaacatttcaaaaatagaaaaagatgagatattgtgagttgtcttcttccggagaatctagggcttctccataatttccggcgacacaaaaaccaaatcccatctctcctgattcctaaagaaatttccatatcagaattaactacattctgttcgtcatttttctctttccgcattttccgttatcgacgaacagaatttgctgcaacgttttttctatcttgcagtgagataacggaaaaaaaaacacagaggatttctgaaatttctcttgtttcttgaatcacaagtcttctcttctctgatttttaatctctcttattgtattttggtgtttagctttctgaattttgctattgctttgcctccaaagtctttttaattctctccttcctctgcttcttagttctttctctcatcatctctctcgtttcttgaaccacaagtcttcttttctctgcctccaaagtctttaatcctcattgtttctaggttttaaaagatcttcttcctattcatttgggatcatataagatcaaaagatccctgacacataacatttgaagagaattgcattaattttcttagaggaggagcaaaatctgatcgtcctcctctgtgtctttagctaataaacctgagattcctgagttttatgcttaggaatcattcaggataagatttgttcttgatgcgaaaaaaatcgtgaaacggtctttgagtattatg

SEQ ID NO: 34047 - DNA, 3000 bp, Unknown; identical to SEQ ID NO: 34046
  misc_feature (1)..( 3000): 2750-1469P.txt file - cDNA_ID_3074141; gDNA_ID_1620729; Annot_ID_166044

SEQ ID NO: 34048 - DNA, 3003 bp, Unknown; identical to SEQ ID NO: 21111
  misc_feature (1)..( 3003): 2750-1469P.txt file - cDNA_ID_3074179; gDNA_ID_1620730; Annot_ID_166098

SEQ ID NO: 34049 - DNA, 3003 bp, Unknown; identical to SEQ ID NO: 21111
  misc_feature (1)..( 3003): 2750-1469P.txt file - cDNA_ID_3074179; gDNA_ID_2926158; Annot_ID_198540

SEQ ID NO: 34050 - DNA, 3000 bp, Unknown; identical to SEQ ID NO: 4776
  misc_feature (1)..( 3000): 2750-1469P.txt file - cDNA_ID_3074187; gDNA_ID_1620730; Annot_ID_166096

SEQ ID NO: 34051 - DNA, 3000 bp, Unknown; identical to SEQ ID NO: 4776
  misc_feature (1)..( 3000): 2750-1469P.txt file - cDNA_ID_3074187; gDNA_ID_2926157; Annot_ID_198528

SEQ ID NO: 34052 - DNA, 3000 bp, Unknown; identical to SEQ ID NO: 4774
  misc_feature (1)..( 3000): 2750-1469P.txt file - cDNA_ID_3074193; gDNA_ID_1620730; Annot_ID_166091

SEQ ID NO: 34053 - DNA, 3000 bp, Unknown; identical to SEQ ID NO: 4773
  misc_feature (1)..( 3000): 2750-1469P.txt file - cDNA_ID_3074199; gDNA_ID_1620730; Annot_ID_166086

SEQ ID NO: 34054 - DNA, 3000 bp, Unknown; identical to SEQ ID NO: 4773
  misc_feature (1)..( 3000): 2750-1469P.txt file - cDNA_ID_3074199; gDNA_ID_2926157; Annot_ID_198521

SEQ ID NO: 34055 - DNA, 3003 bp, Unknown; identical to SEQ ID NO: 27500
  misc_feature (1)..( 3003): 2750-1469P.txt file - cDNA_ID_3074203; gDNA_ID_1620730; Annot_ID_166082

SEQ ID NO: 34056 - DNA, 3000 bp, Unknown; identical to SEQ ID NO: 3325
  misc_feature (1)..( 3000): 2750-1469P.txt file - cDNA_ID_3074219; gDNA_ID_1620732; Annot_ID_166129

SEQ ID NO: 34057 - DNA, 3000 bp, Unknown; identical to SEQ ID NO: 3325
  misc_feature (1)..( 3000): 2750-1469P.txt file - cDNA_ID_3074219; gDNA_ID_1620640; Annot_ID_163010

SEQ ID NO: 34058 - DNA, 3000 bp, Unknown; identical to SEQ ID NO: 3325
  misc_feature (1)..( 3000): 2750-1469P.txt file - cDNA_ID_3074219; gDNA_ID_2926178; Annot_ID_199984

SEQ ID NO: 34059 - DNA, 3000 bp, Unknown; identical to SEQ ID NO: 3324
  misc_feature (1)..( 3000): 2750-1469P.txt file - cDNA_ID_3074222; gDNA_ID_1620732; Annot_ID_166128

SEQ ID NO: 34060 - DNA, 3000 bp, Unknown; identical to SEQ ID NO: 3324
  misc_feature (1)..( 3000): 2750-1469P.txt file - cDNA_ID_3074222; gDNA_ID_1620640; Annot_ID_163009

SEQ ID NO: 34061 - DNA, 3000 bp, Unknown; identical to SEQ ID NO: 3324
  misc_feature (1)..( 3000): 2750-1469P.txt file - cDNA_ID_3074222; gDNA_ID_2926178; Annot_ID_199983

SEQ ID NO: 34062 - DNA, 3003 bp, Unknown
  misc_feature (1)..( 3003): 2750-1469P.txt file - cDNA_ID_3074235; gDNA_ID_1620732; Annot_ID_166113
agacacccaccaagaaaattagccgttacatgggctaacaccaaaaggatgcacgcagctaaaccgtacttgaaggctgtgtaactcgggtctctacactcgaatatccacatcttcaaatgcttcacctgcacccgaaaataaacaaattagtgaaatctgcatctcctatcgacttgtggctgtgtaatgtaccttgttctgagctatttcggcttcaatgccgagaattccagccgaaacatccatggctaggatcaagatgcagatgaagaaccctacattcctcgccattgtcgatgaaacaagttcttactagcaaacaaagaagcaggaagtattgttgttgaagtaataacttgttcttgtaatttataggcaattagagttttaagctttgagagactctcttcgttggatggaataagaataaagttcaacataagtttccttttcttgcatttgtactaaagatcatgttaagagaataaaatttagctgggatcctctctttttcaggagaaaattttaacttttataaaatcatatttgatgtttctgaggaattgaagaagtttattagtaatgtgcaatgtcctcgaaaagatttgttttctttattcctctcttccattccatgtttaataataaaaccttttcaatattcgattcttgacagagcagccaagcaaagaagaggacgtttgcgttttgaatcgctgttgaagacaaaaatttcgttttccagtcgctctggcccaataaatttaagtgggcctttacagagacttatcctaaatcccgtctcgttgatgataatgacgtggctacgtacaaaagagtaacaaattcgagaacatgacgtggcatatttctctagaagcagctccattcttcgacttggacatttgtcttcttaaaagttttcgagaaatgttcgattcttcgagagttcgaattctcaggagaagaagaagaagaagaagtgaacagagaaaatggcggcttactacagatggaagagtttcgaggagaacgaagatcgtccagagaagcctcgccgttacggtgttacggagatgcgaggtcctcattactccgttctcagccagaaccttcttcaggtccctacacgttaattattccggttatgattcacaattttgcttgagattaaaccgaacatttagcggatttaggctcttacaaatttggttaatcgttttgttaggaaatttttgaatcgatgggacagtttgttgatgggttaaagttctctggaggatccaacagtttgattccaaaatcattcatcaaacaagctattgaaatggctcatgaacatggtgtttatgttagcactggtgattgggctgaacatatgcttcgtagtggtccttcagctttcaaagactatgtggaggtaaaaatctttgacattccataggaaatggttggtattggagaagaattaggtttttgtgaggttaaattgtgttttatggcgcaggagtgtaagcagttggggtttgacactattgagctgaatgcaaatttgcttgaagttcctgaggaaactcttctacgatatgtacgtttgattaagaacggtggtctcagagccaaaccaatgtttgctgtgaaattcaacaagtctgatattcctggtaggaatagagcatttggttcctatgttgttccagaacctcggtcaagcggtaagaagaaacaactaggagttatttgttggatttgcagtgagagtttcagatttatatgcttactgtgagaatgcctttgtttcacagagtttgtggaggacatagatctcttgatcagaaaggctgaacggtgtttagaagccggggcagacactattatgatagatgcggatgatgtctgcaaatacgcggattcccttcgagcagacataattgctaaagtcataggacgtttgggaatagagaagactatgtttgaagcatctgatgcgaagttggttgagtggttcatcaaacgttatggtccaaatgtatttgctgatactctagtcctctctattatttttaaccttctgtttgaatggtcaccctcacaagattcatatctcttcgtcttggtttttcaggtgaatctctatgtggatcattctcagattatggatctcgagtgcctccgtggtcgtcatctgggtaaagatcaccaatctgttctcagttcctcctacttcttgttttaaagtagtagctctcgcactacatctagtgttgtgtgaatttcctatatatgtattatgtcgtatgtgtctgatgttatgtgcttctttgatgctgtaagaatgcaaatgttttgagaataatgtgatatgcgatttttcggtgatcacataatatcttggtccatctcctaagttaagtctctcagaattgatacaacctagtatagtaataatcgtaagccttggttgttctcgtatgtcttatattattaagagttttactcactgaaacacgtgagcaataaaataagctgttcattatcctttaagttatgaacccaagatatcaattctgtaaccatgctttgtactattttgatagaaacctctctgtaatatcttttgaaaatagagaagactcataaattcctaccaatcataatcagtggcctaattttaccccaacacatgtgtcatgatgaaatttcagtatatttttttgcaactattgtaaccatagtcatcataattatattctaaatatagcttgtgcctaactgtcatatgacaatagcacctattttcgtacgttgatttttgtgcttgttagtagttacaacgtttatttactgcaagatacaatcagtatgtgtattaattggttattctgtcattttttggagccaaagtttgttaatcagtttagcttaaaaagtaaaaacaatggagatctatctataaaacaaggaaaatcttttgagaacgaacactttcgttgaaaaatg

SEQ ID NO: 34063 - DNA, 3003 bp, Unknown; identical to SEQ ID NO: 34062
  misc_feature (1)..( 3003): 2750-1469P.txt file - cDNA_ID_3074235; gDNA_ID_2926177; Annot_ID_199960

SEQ ID NO: 34064 - DNA, 3003 bp, Unknown; identical to SEQ ID NO: 23190
  misc_feature (1)..( 3003): 2750-1469P.txt file - cDNA_ID_3074263; gDNA_ID_1620733; Annot_ID_166148

SEQ ID NO: 34065 - DNA, 3 bp, Unknown
  misc_feature (1)..( 3): 2750-1469P.txt file - cDNA_ID_3074273; gDNA_ID_1620733; Annot_ID_166138
aag

SEQ ID NO: 34066 - DNA, 3003 bp, Unknown
  misc_feature (1)..( 3003): 2750-1469P.txt file - cDNA_ID_3074273; gDNA_ID_1620635; Annot_ID_162875
ttgtatagtttgattgattgtttctgtagtttatttctgggtttagttagttgtgttgcaatttctgaccttttgtttgaaatgggattatgattggtaggttcaactgataaggatccaaatgagagtgcctgagtatggttggactactcagaaggtgtttcatcttatgaactttgtcgtcaatggaggtgattattgtgtgtttctattgaccaattgatagggtttttgtgtttgtcagcacctttgggattatgttttgttgaatttctctgttgtgtgtgtgcagttcgtgcggttctgtttggatttcacatgcaagtatttcttgttcatcccaaggtgagagtgttctcaacttagttctggtttttgcatgtttgatttggaaatggtggattttgaaagctgcatctttttaagtatctaatgtttctgtgaggtaatgcaggctctttgctgggtactattggatcttcctggccttctctttttctcggcatacacgctgcttgtgctgttctgggcagagatatatcaccaggtacctaaaaagaaatttttgatgtgtgttgactgtcttttaaacctgccaacaagctctgagtatatattttgttgccactaatgagcaggctagaagcttacctacagataagctgcggataacctatatttctgtcaacgtggctgtatatttggctcaggttcatatctgatttttagcttcttttttttttaattcccgtttatgttgtagttgctgagtttcctgagatccatttatatacatcttttgcaattattggtgtttcgaaactgtagattgtgcgtgtttcctaccttgtccttctttcattaactctgtaaccattctttgctaccaagaatctgtgtgaccttagtcactagacattttaggtgaatcaaaagatgtagaataagtttgacatgtatttgatgtctctatcagattggtatctgggcatacatctgggtacatgataacagcactgtggagttagttggaaagatatttatcgcaggtaggttctttgtctggtcaagcaagtttgctaaaacctttactgcttaatctataatattccctctcttatctaaaatctatattgacctattcttttggttaatcttcttcttctagttgtgtctttcatcgccgcattaggcttcttgctgtatggaggaaggtctgtgtttttgttattttcatatgtctcatcatcaaaatgtctgcaagttcttcattggctttactgggccgtcttttcttatgtgtttttttttatgccatagattgtttttcatgctaagaaggttccctatcgagtcaaaaggaagaaggaagaaactccacgaggtacttagattcatatatctgtatgtgaataatttgtcttatatagttccataaaactttgaacccaaacatttctaccttcaaatattcgtctcttttcattgcaggttggatctgtgacagctatatgcttcacctgcttcctcataagatgcgttgtggtaagctcaaaattaaatctttagcttccgtcattgttttagttatcctgtgatgtgttatttaatgtattccatgcaaacatcaggtggctgtatcagcttttgacaaggatttaacacttgatgttcttgatcatccggttctgaacttaatctactatatggtaagtaacactacatcttcattctttctctttcttattctcattcattaactcgaaaaaaaaaaaactacaggtggtagaagtacttccatcggcactagtcctcttcattctccgaaagctacctccaaagagagtatcagctcaataccatccgatccagtagaaacctttgtcactgaaccatctcacacggtgagtatgatgctgtttaagagaagagtaaagattaaaaaaaaaattggggcaaaaaatgaaaggtgaagaagaaatcggtgtggaatctgcgtgagtttttggaatgcacgttcatataaatgattttacagcttttagttgttgtagcccgccgtgacttttggtttggtagtttatgtctgttaaaattataaattgctcttctgctactttgaaaaatctggtcagtagtacaagaggtttaacatttgttgcgtcgatggttgattgttatgttatgtttggtaaaaaataaacgaatgctcttctccagtttcctttatgcttttgtcaactgttacatcttcttctcctaatgatttgtatatacttaagcttttccataaaactaagtcccagtgaagaaagaaactacgtaaaccgagaaaaccaagcaaaaagagggtttacacaacataaaatgattaaattgagaatcatttgcattacctcggtattacatgggctggaaataacttattgggccttggacctgattttccaaaaatggtcgctcacattaatatttatatgtgattttacagtgacaactccacaaatcagccctaactctgtttttgttttcttcgacgactgaggtcttttctctctcgctctcgtcttcctcttgattctcttcttcttttctggagtttcgctgcttttttagcctgtaaaaatgacgaaaattttgtatgaatttgtgtgctgatatgctcgaatccacatgttacgcttgtgttgaataatcatatcatttggttatcgaatcaattctagttccaatttacaaaaatctatcaaactctttacgttttctggagtatgttgagcttgaaactagtgacatagatgaaacattaaaaaaacatggaattgttaagtttgtgaaaattggattcgtctttgtgattctttattctttgtctttgctgtgatatataaagattttgtatagaacaacaatttgggagatggagacactgaaattgctgtatttgggattattggcagataaaagattcatacaagaaaaaagcaaatttcgccactgatg

SEQ ID NO: 34067 - DNA, 3003 bp, Unknown; identical to SEQ ID NO: 34066
  misc_feature (1)..( 3003): 2750-1469P.txt file - cDNA_ID_3074273; gDNA_ID_2926178; Annot_ID_200028

SEQ ID NO: 34068 - DNA, 1242 bp, Unknown
  misc_feature (1)..( 1242): 2750-1469P.txt file - cDNA_ID_3074273; gDNA_ID_2926179; Annot_ID_200052
tcgaaaaaaaaaaaactacaggtggtagaagtacttccatcggcactagtcctcttcattctccgaaagctacctccaaagagagtatcagctcaataccatccgatccagtagaaacctttgtcactgaaccatctcacacggtgagtatgatgctgtttaagagaagagtaaagattaaaaaaaaaattggggcaaaaaatgaaaggtgaagaagaaatcggtgtggaatctgcgtgagtttttggaatgcacgttcatataaatgattttacagcttttagttgttgtagcccgccgtgacttttggtttggtagtttatgtctgttaaaattataaattgctcttctgctactttgaaaaatctggtcagtagtacaagaggtttaacatttgttgcgtcgatggttgattgttatgttatgtttggtaaaaaataaacgaatgctcttctccagtttcctttatgcttttgtcaactgttacatcttcttctcctaatgatttgtatatacttaagcttttccataaaactaagtcccagtgaagaaagaaactacgtaaaccgagaaaaccaagcaaaaagagggtttacacaacataaaatgattaaattgagaatcatttgcattacctcggtattacatgggctggaaataacttattgggccttggacctgattttccaaaaatggtcgctcacattaatatttatatgtgattttacagtgacaactccacaaatcagccctaactctgtttttgttttcttcgacgactgaggtcttttctctctcgctctcgtcttcctcttgattctcttcttcttttctggagtttcgctgcttttttagcctgtaaaaatgacgaaaattttgtatgaatttgtgtgctgatatgctcgaatccacatgttacgcttgtgttgaataatcatatcatttggttatcgaatcaattctagttccaatttacaaaaatctatcaaactctttacgttttctggagtatgttgagcttgaaactagtgacatagatgaaacattaaaaaaacatggaattgttaagtttgtgaaaattggattcgtctttgtgattctttattctttgtctttgctgtgatatataaagattttgtatagaacaacaatttgggagatggagacactgaaattgctgtatttgggattattggcagataaaagattcatacaagaaaaaagcaaatttcgccactgatg

SEQ ID NO: 34069 - DNA, 3003 bp, Unknown; identical to SEQ ID NO: 20400
  misc_feature (1)..( 3003): 2750-1469P.txt file - cDNA_ID_3074285; gDNA_ID_1620734; Annot_ID_166201

SEQ ID NO: 34070 - DNA, 3003 bp, Unknown; identical to SEQ ID NO: 20400
  misc_feature (1)..( 3003): 2750-1469P.txt file - cDNA_ID_3074285; gDNA_ID_2926217; Annot_ID_203030

SEQ ID NO: 34071 - DNA, 3000 bp, Unknown; identical to SEQ ID NO: 20402
  misc_feature (1)..( 3000): 2750-1469P.txt file - cDNA_ID_3074289; gDNA_ID_1620734; Annot_ID_166200

SEQ ID NO: 34072 - DNA, 3000 bp, Unknown; identical to SEQ ID NO: 20402
  misc_feature (1)..( 3000): 2750-1469P.txt file - cDNA_ID_3074289; gDNA_ID_2926217; Annot_ID_203029

SEQ ID NO: 34073 - DNA, 3000 bp, Unknown; identical to SEQ ID NO: 4825
  misc_feature (1)..( 3000): 2750-1469P.txt file - cDNA_ID_3074293; gDNA_ID_1620734; Annot_ID_166198

SEQ ID NO: 34074 - DNA, 3000 bp, Unknown; identical to SEQ ID NO: 4825
  misc_feature (1)..( 3000): 2750-1469P.txt file - cDNA_ID_3074293; gDNA_ID_2926217; Annot_ID_203027

SEQ ID NO: 34075 - DNA, 3000 bp, Unknown; identical to SEQ ID NO: 33630
  misc_feature (1)..( 3000): 2750-1469P.txt file - cDNA_ID_3074297; gDNA_ID_1620734; Annot_ID_166191

SEQ ID NO: 34076 - DNA, 3000 bp, Unknown; identical to SEQ ID NO: 3528
  misc_feature (1)..( 3000): 2750-1469P.txt file - cDNA_ID_3074301; gDNA_ID_1620649; Annot_ID_47699

SEQ ID NO: 34077 - DNA, 3000 bp, Unknown; identical to SEQ ID NO: 4828
  misc_feature (1)..( 3000): 2750-1469P.txt file - cDNA_ID_3074301; gDNA_ID_1620734; Annot_ID_166186

SEQ ID NO: 34078 - DNA, 3000 bp, Unknown; identical to SEQ ID NO: 3528
  misc_feature (1)..( 3000): 2750-1469P.txt file - cDNA_ID_3074301; gDNA_ID_1620649; Annot_ID_163404

SEQ ID NO: 34079 - DNA, 3000 bp, Unknown; identical to SEQ ID NO: 3528
  misc_feature (1)..( 3000): 2750-1469P.txt file - cDNA_ID_3074301; gDNA_ID_2926215; Annot_ID_142202

SEQ ID NO: 34080 - DNA, 3000 bp, Unknown; identical to SEQ ID NO: 3528
  misc_feature (1)..( 3000): 2750-1469P.txt file - cDNA_ID_3074301; gDNA_ID_2926215; Annot_ID_202942

SEQ ID NO: 34081 - DNA, 3003 bp, Unknown
  misc_feature (1)..( 3003): 2750-1469P.txt file - cDNA_ID_3074336; gDNA_ID_1620735; Annot_ID_166227
ccaatgaccgattgattgtatcatcatcaaaatgaaaaatgcgtggatattgtaaaaataaaaattttagttgacaaactcatgtcatgcgacataactcattgggtcaggcaaaatactacattcgaatccaaatctggcaattatagctagcactattccttgtatcaaaccggtaataaagctagaggtaaagttggcaaacatagatagtttataaacaactatgctttcggatatcattggtcttctttttgacttacattcatattatataatgttgttgcaagtatatgatatgtttcgaatgaaaagaaaaaaagtttcgaatgaccaatcttctcttctcgatcaataattggattttgctggtaaatgaattatttactatatatcttctttgatacgtctcttcttatttaaatgacataaaacaaatacaataatccaaattttaggcacgtcaacattattaactcttaagtggacataaataatctcactcttgacggtctttcaaaggtattgtattagcatgaaattctatattaattcttaacatttacctttatcttgtttttgttcctaagaacgttttctaaaattctccaaaatgggcccaaaagtatgaaatccaaattgagcccaaagttgtgatccagtgaaacgataaagctctcacgaggttcaagctcccacaagctcagatcgtgggcggtaaaagaaacggttaactaattgtaaaaaatgatttttttttttctacttcactaaaatattacagttttttttagcaaaagtaaaagtttcgagaaactctgaaaaagcagttttcaatcttaggagcagtgtatgtgtcatgtacatcgagatggagaattttcgttacctgaaatttttcttcttcttcatctttgtaatattatctccttctgaagcaggaaatatagtagacaaaagctctgttttccttgttgatgtccgtagctttggtgctcgagctaatgaccacagagaccacaccaaggtttttttcaaacaacattagatctgtgttttttgtttttgtttttggtagattcatctgtttagttacaataaatcagctaataacttgatgttttaaaaggcctttgtagcagcatgggacaaagcatgcaaatcatcttcaagctctgtgaatcttataatcccaagaggtgaattctctgttggttctctcagattctctggtccttgcactaatgtatccaatctcactgtccgagttaaggtagttttatcaacactctccaaaatctgtctttgttgcgttgtgtgcttgatttaatgctttctttctgtccacgtaactgaaattagggtcatctcaaggcatcaactgatctgtcaaagtatagatcaggcggtggttggattcagtttggatggatcaatggcttaactcttaccggaggtggaacatttgacggtcaaggcgctttagcttggccgtttaataactgtacttctgattctaactgcaaactccttccaactgtgagattaactctacaaacattgaatttgatcttaaggttttctccttttttaaagtatattaattgatttcagagcttgaagtttgtggggatgaacagaacagttgtgagaaggataagctcagtgaatagcaagttctttcatatagcattagtagaatgcagagacttcaaagggacaagactcaacatcactgctccttctgatagtccaaatacagatggtatacatatcgaacgcagttcgaatgtgtatttctcgcgttcacatatcgcaactggagatgattgtgtctcgataggacaaggaaattctcagattacaatcacaagtatcaaatgtggaccaggacatggtatcaggtaaaaatataacagaaccgcttcttttttttggtctgtttctgctgttgagtttattaaacggtttgatttcttgcgtttcaagcgttgggagtttagggagatatccaaatgagaaagatgttaatggactggtggtgaaggattgcaagataagcggtacgacgaatgggataaggatcaaaacttgggctaattctcctggtctaagtgctgctaccaacatgacttttgagaatattattatgaacaatgtgactaatccaatcatcattgatcagtcttattgtcctttctcttcttgcatttcaaatgtgagtcttctttaacactcaaataagatttttttactgaaatgggtatgagagatttgtttttgatatattttgttgttgtaggtaccttcaaaggttgagctgagtgagatatacttcaagaatataagagggacatcatcttcactggtcgcggtgcagctgcattgtagcagaggaatgccatgtaaaaaagtgtacttagagaatgttcatcttgatctttcttcgtctgatggaggaagaaaacagagtagtaacagaggaaatgaagctgtctcttcttcttgtagaaacgttagagctaattacattgggactcaaatcccacctccatgtcactaatcatcatcatcatcattactatcgtcaattcatcattttgaagtttatctagtacttaaacttttgtgctttctttttggacacgttatcttcatatggtcatattaagtttgctacttttgttgtctatagataaagtgctactacgctaaggaatatttttggctaaataataaaagaaatatgacaagaaaaaactggttggtaataaaaatttaaatttggttcgtgtttaacggttgataatactggttggtaagtttgatacttttgtctatagataacttgctagtaccctaaggatttgttttggctaaatataaaatatggcaagaaaattctggttggtaataaaatttggttcgtttaaagataggatcctacaaaaatggaggagatgattcattccaagagtgccatttaacaattcacgggaaatg

SEQ ID NO: 34082 - DNA, 3000 bp, Unknown; identical to SEQ ID NO: 4852
  misc_feature (1)..( 3000): 2750-1469P.txt file - cDNA_ID_3074356; gDNA_ID_1620736; Annot_ID_166273

SEQ ID NO: 34083 - DNA, 3003 bp, Unknown
  misc_feature (1)..( 3003): 2750-1469P.txt file - cDNA_ID_3074378; gDNA_ID_1620736; Annot_ID_49482
cacgactatcaatatgttatttgacacatctcgttcatcttaaccctcaaaccatgggttaagacatcatagtcatcatgacctatcacaatgacataatgatattagcataatgttacattttctcaattagtgtcaaaaccatatttaaatatatatacattcataatcgttgtatataatgtgtctaatataggaaaattagtaatattaaatatcatatataacgaaaatggaatttgtgaacaatatatatatgaaaatgatttcactggtcaattctcgtttttcattttctaactggcctattatttctccttaagaaggctaacatcatcatatatactatatgcatatacgtagtagagtcaatataaggtctgtatttttaacttcttatataactcatatttttttcatctagttggaacaccgtaaattttattctaaaataaaacaaaattcttacgggttcatttattaatcaaattgatacattttcttcccacacacatttttacagttagagtcatgtaagacttatcgattcctatgctagaaaaaaacgtgcgactataccaaattatatggagaaaaatatgtggtcaacttaaaaaagtattccctagtttagtggtgattaaatattaccaatactttagcaaaggatataatagtgctttataagtcattattaatagtataatagagtgatgccaaatcaattaacatacctactagataacgatgacaactcattttttattttattttcaattgaaacatgcattaacattagacagataaatgatatatttaacataatttacttaatgactcgaattgggaaatttttcttctaaaatacagattttaacatatagagtgatgttagatttagctctttaaaatcatcaacacgttggaaaacaaataagctattataccaatttatatggagactaatatcatgaacggtacttcgttatcactcgtgcccgtcaacagtgccattggatatatgatgtattacatatcatggtattatgtaaaatgatcgagatcaaatatcatggacattctataagtgcatcgaggtcagttagacttagtatcgtggagcatacttcttgaccaccttactgtcggctaaaatttatatgtaaatattctcttgatacctcataatgatgtgacgtacgattctatttatgatgttgcactgttatttgttagatacacagtcattattttcctttgatatggttgtgaattcctctaatatgattatgtttttcttatatgacttggtctgaggtaactgatttgaacaagctgctgttagatttatcaccaactttatagaagaaaagattctgccactatgagaaattggcaaataatatagagaaaaatgtagtcaatttaaaataattattcctttatgagtgcttacaaattaatgatattttggcaaaacaattattagtattttataagtcaatgtttattagcaaagtattgtaaagccacgtcaattaagattatctaaatcaagtagcatgttcattaccattagatggattaaaaatatatttaagtttattttgttgggttgtgcataacttccacttccaatattgttccattttaaaaagtataatatgcatatagtagaacatacatcacaattacctagagaaattgttcagaaatgaatatttattcaatacatttttaagaatatttcaacaggaaaacaaaaaaaattgcagtacgaatttcattggttaattagaaatatctccttttttgtcttcatctagaaggaatacctaaacttgatctgaaaataattattttttactttaattttaaaaaaaaattagaagtcaaactgaaaacatttgagtacaaagttttttatttagagtgatggtaaattttctcaagcaactatatcatagaagataatctgcggcttgtcagaaaaaataataataatctgccactatgccaaattaccgaattatatagagaaagaattagttagtattaagaaacttgttccttagataagtagtgcttacataatatcagtattggcagaaaaagagaattagtgacataatattaatattttttcaaaaagaatattagagttctaaaagtcattgtttaatagtatataaatcaattaacacgtgcattatcattagatagataaataatatatttaagcttgttttatgtggttatgcgtattatttcacttcgaacattgttccatttaaacgaaaatatgatatacatataagaaatacatcacaattacctaaggaaattttgggcatatttttaaaaactatttgttatttaatttttttttccaaaatttgtcatagacccttggtttttgcccatgctgccaccccctagagacgggcctggttctatggtataatagagagtaaacatttgatttatgcttcaaactccttctatttcctttcaaaaaggtaaacaatagctgatgtagttttacattcaactaaaaaaaaaaactacttcaagcgaaaaatattataacttggttttaaattttgttcatcgagcagtatgtggagggctcgtaggacgttggcttgattgttaagtgttgtgattgttggtcaaaaaaagatatagaaaaaaagtcttatcaaattagccaccagacgaaagtgaaatttacggtccgagaacatgcgtttaccacaaatggttgtagtcagggtgtcatatcataagaaccacaacatgaggatccatagtgatgtgaattgttgactttgcctggctacatggtttttttctgtctgaaaaaaaaaaggccaaggaaaaaacaaatgtatccaaaaccctataaattacaaagtagagaggaagaagaaatgcacaaatttcagaataacatatattcactaaatacttacatgagagattgaataagaaatggaaatg

SEQ ID NO: 34084 - DNA, 3003 bp, Unknown
  misc_feature (1)..( 3003): 2750-1469P.txt file - cDNA_ID_3074378; gDNA_ID_1620736; Annot_ID_166256
tctcaccacgactatcaatatgttatttgacacatctcgttcatcttaaccctcaaaccatgggttaagacatcatagtcatcatgacctatcacaatgacataatgatattagcataatgttacattttctcaattagtgtcaaaaccatatttaaatatatatacattcataatcgttgtatataatgtgtctaatataggaaaattagtaatattaaatatcatatataacgaaaatggaatttgtgaacaatatatatatgaaaatgatttcactggtcaattctcgtttttcattttctaactggcctattatttctccttaagaaggctaacatcatcatatatactatatgcatatacgtagtagagtcaatataaggtctgtatttttaacttcttatataactcatatttttttcatctagttggaacaccgtaaattttattctaaaataaaacaaaattcttacgggttcatttattaatcaaattgatacattttcttcccacacacatttttacagttagagtcatgtaagacttatcgattcctatgctagaaaaaaacgtgcgactataccaaattatatggagaaaaatatgtggtcaacttaaaaaagtattccctagtttagtggtgattaaatattaccaatactttagcaaaggatataatagtgctttataagtcattattaatagtataatagagtgatgccaaatcaattaacatacctactagataacgatgacaactcattttttattttattttcaattgaaacatgcattaacattagacagataaatgatatatttaacataatttacttaatgactcgaattgggaaatttttcttctaaaatacagattttaacatatagagtgatgttagatttagctctttaaaatcatcaacacgttggaaaacaaataagctattataccaatttatatggagactaatatcatgaacggtacttcgttatcactcgtgcccgtcaacagtgccattggatatatgatgtattacatatcatggtattatgtaaaatgatcgagatcaaatatcatggacattctataagtgcatcgaggtcagttagacttagtatcgtggagcatacttcttgaccaccttactgtcggctaaaatttatatgtaaatattctcttgatacctcataatgatgtgacgtacgattctatttatgatgttgcactgttatttgttagatacacagtcattattttcctttgatatggttgtgaattcctctaatatgattatgtttttcttatatgacttggtctgaggtaactgatttgaacaagctgctgttagatttatcaccaactttatagaagaaaagattctgccactatgagaaattggcaaataatatagagaaaaatgtagtcaatttaaaataattattcctttatgagtgcttacaaattaatgatattttggcaaaacaattattagtattttataagtcaatgtttattagcaaagtattgtaaagccacgtcaattaagattatctaaatcaagtagcatgttcattaccattagatggattaaaaatatatttaagtttattttgttgggttgtgcataacttccacttccaatattgttccattttaaaaagtataatatgcatatagtagaacatacatcacaattacctagagaaattgttcagaaatgaatatttattcaatacatttttaagaatatttcaacaggaaaacaaaaaaaattgcagtacgaatttcattggttaattagaaatatctccttttttgtcttcatctagaaggaatacctaaacttgatctgaaaataattattttttactttaattttaaaaaaaaattagaagtcaaactgaaaacatttgagtacaaagttttttatttagagtgatggtaaattttctcaagcaactatatcatagaagataatctgcggcttgtcagaaaaaataataataatctgccactatgccaaattaccgaattatatagagaaagaattagttagtattaagaaacttgttccttagataagtagtgcttacataatatcagtattggcagaaaaagagaattagtgacataatattaatattttttcaaaaagaatattagagttctaaaagtcattgtttaatagtatataaatcaattaacacgtgcattatcattagatagataaataatatatttaagcttgttttatgtggttatgcgtattatttcacttcgaacattgttccatttaaacgaaaatatgatatacatataagaaatacatcacaattacctaaggaaattttgggcatatttttaaaaactatttgttatttaatttttttttccaaaatttgtcatagacccttggtttttgcccatgctgccaccccctagagacgggcctggttctatggtataatagagagtaaacatttgatttatgcttcaaactccttctatttcctttcaaaaaggtaaacaatagctgatgtagttttacattcaactaaaaaaaaaaactacttcaagcgaaaaatattataacttggttttaaattttgttcatcgagcagtatgtggagggctcgtaggacgttggcttgattgttaagtgttgtgattgttggtcaaaaaaagatatagaaaaaaagtcttatcaaattagccaccagacgaaagtgaaatttacggtccgagaacatgcgtttaccacaaatggttgtagtcagggtgtcatatcataagaaccacaacatgaggatccatagtgatgtgaattgttgactttgcctggctacatggtttttttctgtctgaaaaaaaaaaggccaaggaaaaaacaaatgtatccaaaaccctataaattacaaagtagagaggaagaagaaatgcacaaatttcagaataacatatattcactaaatacttacatgagagattgaataagaaatg

SEQ ID NO: 34085 - DNA, 3003 bp, Unknown; identical to SEQ ID NO: 34083
  misc_feature (1)..( 3003): 2750-1469P.txt file - cDNA_ID_3074378; gDNA_ID_2926157; Annot_ID_139556

SEQ ID NO: 34086 - DNA, 3003 bp, Unknown; identical to SEQ ID NO: 34084
  misc_feature (1)..( 3003): 2750-1469P.txt file - cDNA_ID_3074378; gDNA_ID_2926157; Annot_ID_198490

SEQ ID NO: 34087 - DNA, 3000 bp, Unknown
  misc_feature (1)..( 3000): 2750-1469P.txt file - cDNA_ID_3074382; gDNA_ID_1620736; Annot_ID_166255
ttcagtttgacttctaatttttttttaaaattaaagtaaaaaataattattttcagatcaagtttaggtattccttctagatgaagacaaaaaaggagatatttctaattaaccaatgaaattcgtactgcaattttttttgttttcctgttgaaatattcttaaaaatgtattgaataaatattcatttctgaacaatttctctaggtaattgtgatgtatgttctactatatgcatattatactttttaaaatggaacaatattggaagtggaagttatgcacaacccaacaaaataaacttaaatatatttttaatccatctaatggtaatgaacatgctacttgatttagataatcttaattgacgtggctttacaatactttgctaataaacattgacttataaaatactaataattgttttgccaaaatatcattaatttgtaagcactcataaaggaataattattttaaattgactacatttttctctatattatttgccaatttctcatagtggcagaatcttttcttctataaagttggtgataaatctaacagcagcttgttcaaatcagttacctcagaccaagtcatataagaaaaacataatcatattagaggaattcacaaccatatcaaaggaaaataatgactgtgtatctaacaaataacagtgcaacatcataaatagaatcgtacgtcacatcattatgaggtatcaagagaatatttacatataaattttagccgacagtaaggtggtcaagaagtatgctccacgatactaagtctaactgacctcgatgcacttatagaatgtccatgatatttgatctcgatcattttacataataccatgatatgtaatacatcatatatccaatggcactgttgacgggcacgagtgataacgaagtaccgttcatgatattagtctccatataaattggtataatagcttatttgttttccaacgtgttgatgattttaaagagctaaatctaacatcactctatatgttaaaatctgtattttagaagaaaaatttcccaattcgagtcattaagtaaattatgttaaatatatcatttatctgtctaatgttaatgcatgtttcaattgaaaataaaataaaaaatgagttgtcatcgttatctagtaggtatgttaattgatttggcatcactctattatactattaataatgacttataaagcactattatatcctttgctaaagtattggtaatatttaatcaccactaaactagggaatacttttttaagttgaccacatatttttctccatataatttggtatagtcgcacgtttttttctagcataggaatcgataagtcttacatgactctaactgtaaaaatgtgtgtgggaagaaaatgtatcaatttgattaataaatgaacccgtaagaattttgttttattttagaataaaatttacggtgttccaactagatgaaaaaaatatgagttatataagaagttaaaaatacagaccttatattgactctactacgtatatgcatatagtatatatgatgatgttagccttcttaaggagaaataataggccagttagaaaatgaaaaacgagaattgaccagtgaaatcattttcatatatatattgttcacaaattccattttcgttatatatgatatttaatattactaattttcctatattagacacattatatacaacgattatgaatgtatatatatttaaatatggttttgacactaattgagaaaatgtaacattatgctaatatcattatgtcattgtgataggtcatgatgactatgatgtcttaacccatggtttgagggttaagatgaacgagatgtgtcaaataacatattgatagtcgtggtgagagagagatgtcccaaaccatctatttgagggagtgatgactaaattattgcgaatcaagagttctaggatcgtgatgactgatgactaagttatgatgaaccaaagggtttgagcgtcacgataattaatatattacaaacctagggttctgatatcattgaccaagatttgtcgaatcaagagtttgaggatcatcgagatgaccaacatgtgtcaaaccatcaacttgggagtcgaaataattgatatcagagagtgatgctgagcatgctacttgagggctgaatggtagagatagtggcctgattttgacgtagatgtttgagggtcctaaatataaatgtttgaaatctctgaaaattctagtaagaaatataaaacgatgtaatattaatggaaatatatatcacccaatatcggtgtgggagtgaccatccttagtgaataatttgtttgttttttttttggatcaaaagtgaataatttgttacttatgtctttttgtgatgcagatgaggattagtatgttgatgtgtgtgcgagattaccattgatggtctattggtcttcaagattatgatgaactaatttatgcatttttaggtttcacgccttttttccacactgatcgagtttttcgttgcgaataaagtatcgtattttcctaacaaagcttcggaataaacctagatataaaaatcattttgccatttataaaatgttgtgtattatcatagttacgatgatacaatgtatgctttgtcagtttaatcaagtatacaatgttagttgatgtggcaattatactttcatattaaacattgaattatataaagcactaatatactttttccaaagtatattaattttgtgtaagcactcccaatctaagaattttttttagttgactacatttttctccatataaattgattttacttttcaatattctaattattaaccctattttattatccacttgtttatctaaaaaacactatttcattagtatatattttagtttttcccacactgcttctttaactctctaaactctatttctctcgctctctatctctctcaaacactatg

SEQ ID NO: 34088 - DNA, 3000 bp, Unknown; identical to SEQ ID NO: 34087
  misc_feature (1)..( 3000): 2750-1469P.txt file - cDNA_ID_3074382; gDNA_ID_2926157; Annot_ID_198489

SEQ ID NO: 34089 - DNA, 3003 bp, Unknown; identical to SEQ ID NO: 20432
  misc_feature (1)..( 3003): 2750-1469P.txt file - cDNA_ID_3074386; gDNA_ID_1620736; Annot_ID_166254

SEQ ID NO: 34090 - DNA, 3003 bp, Unknown; identical to SEQ ID NO: 20432
  misc_feature (1)..( 3003): 2750-1469P.txt file - cDNA_ID_3074386; gDNA_ID_2926157; Annot_ID_198488

SEQ ID NO: 34091 - DNA, 3000 bp, Unknown; identical to SEQ ID NO: 4844
  misc_feature (1)..( 3000): 2750-1469P.txt file - cDNA_ID_3074390; gDNA_ID_1620736; Annot_ID_166253

SEQ ID NO: 34092 - DNA, 3003 bp, Unknown
  misc_feature (1)..( 3003): 2750-1469P.txt file - cDNA_ID_3074395; gDNA_ID_1620737; Annot_ID_166294
aacggaatgaatagtccgtcctatcgattcttcaacgccgcctcaatagactggaaagccgatatccaaaactgtttaaactgggaagctcacagcttgctctccacaactatgcctactcagtttctcgacactgcggctcgggaactcggctgtactatatccttgtcccaataacgagcacccacttttgtttttggtaaattttagttctctagacaaaacatttggacgtagaccaagaagaatatatatatagtttgttgtatgtaatgttgtaatgatgagtgactgacgcaatcactcccaccggcgttggatttgctctcgctcggtgtcttatataactcaacctcttctctgtacattttaaatgacgaagtagctcaatctttttttttgtgcgtctggtgtttagtcttcagtggattctaaatcgtaatgtatagaagtgaaaaatttacaaatttacttatttccgaatactcttaaaacagcaaaaattaatattgcaaaagataatttatagtattttaatctttttcctccaaaaaaaacattaaagggtaaattagtaattaactacaggagcttcatattaggttggaaaaccctaaatatgccgcttataacagacctgagcttaagctgtggtggcgcctccagagtctggtaaaagagcttaatcctcctctcgcgatctttctcggcatccaaaaatggtacgattatcgttcttcaactcttgtctggttctccaattgctcgtgcttcattttgcgtatcgctcgtttttcattgctggttttgggattggagttttaagctcaaatgttttttgtattcccttacacgatttgcgactgacggatctgttttttttttttcgtattcgtgtgtgtgtagtctctagttgcgaacgaggagtttcagcatattctgcgtgtgctcaatactaatgtcgatgggaagcaaaaaattatgtttgctttgacctcaatcaagggtattggaaggcgattggctaacattgtgtgcaagaaggctgatgttgacatgaacaagaggtttgtttcttagcttggttcttaatactttcagttacttaggaattctatggataaggattatgaatcttgcgaggttttggatgttagtagaaaatgtagctctttgactagaattgtacctgctcgatctggtttgattgatttctaggaaatcagatatttaggttttctttgcacatagaacttctctagattgatattcttgaagaagtttggtctagtgtgtgtttttaaatgttttttcctttgctggtatattcagggctggagaactaagtgctgctgagattgataacctcatgacaatcgttgctaaccctcgccagttcaagatcccagactggtttcttaacagacaaaaggattacaaggatgggaaatactcccaagttgtttccaatgctcttgacatgaagttgagagatgatcttgagcgtctcaagaagatcaggtaacaaacaacacatacagacactctcctctgtagtttttagataccatgttaatagtataatgatgcccatcataactttctatatggaagaagctaagtacacaactcttgtgttaaatcatgtatacactcattttcggcaacaaaacctaatctgtagtgtaatgatttactgatgcatcctttgtttctctcttgttgttctgataatcgatatagaactttgtttgtactgactgagattgtcactgtaatgtaaacagaaaccatcgtggtctgaggcactactggggtctccgtgtacgtggacagcacaccaaaaccaccggacgccgtggaaagactgttggtgtttccaagaagcgttaaaaagagtttgagcttggttcaatggctttgttttgttttttttgtattgttgttttttgcagaagagatagtttaagagatgttgtttcatcaaaagacggtcttagcttttacaatatataattgaatccaaaaactagtctctatttattacattctcttctctcaaaatctgctttaaacaaagttaataatagcacactcctccatacgcaagaattatataattagagaaaacttttaagtgtcacaagcggctgtctctataatgcgcaaatacatcgttatcagttttaatcactatcagtaactttactgaacttaattgatcattttaatttttcatgttactctctccttcttcttcacttgttctctttctcatcgcctcttgattcacgcgaacgagaaagcgacgatcgtaaccaccggcgctgaccaaaaagtaatcgattctcttcccgagctgatctctcaggtgcgtgaattcacttttttttttttcgatttttcccgagaaaaaaatccagcaaagagtagtagcgatgaagaagacgaggtttgaattgagattcgtattctttcggtggcttgaagtagcttatgcatgtttaaactcttgttcagttgtttgctcatgattcgaaaatggctttgtagatcttctaatataatctcttctctttatcaattcactagtgttctatatctgaagaaatttacggctacagatccaatctcatttcgtttcgttacactatctctactaagattttgttttttgttttttttccctctttttttgcgttttagatctcctccatgattgaagttgatccatgcttttgagtttaagtgatttatttaagatcctctaaacttttttttcttcacttagtggtggttccagtcaatttagcaagtaagatgttgtatgtgtcaatgctataactgtgaattttcagctattgtagtttgatttttgtctttgttagcttcaggtgtcttgaatctgaatctgtggctatatttggtgctcggtggtgagcaggaagggagggggatattgtcagggttttaatgtacgtcagatgaatagagcaactaatg

SEQ ID NO: 34093 - DNA, 3003 bp, Unknown; identical to SEQ ID NO: 15740
  misc_feature (1)..( 3003): 2750-1469P.txt file - cDNA_ID_3074398; gDNA_ID_1620737; Annot_ID_166293

SEQ ID NO: 34094 - DNA, 3003 bp, Unknown
  misc_feature (1)..( 3003): 2750-1469P.txt file - cDNA_ID_3074402; gDNA_ID_1620737; Annot_ID_166292
agtatccgaggctttggatgttctcaggctatctgttgatccaactgatcatgatcttggtttctctaccaccgactgaaatttgcaatgcgtttgctcaactctgttttcttcttttagttttgatatcgactccttttcttttcttttttgggttttagtcttcctttactattttagcagtttttttttgtttacttagtttatggtttttgtgtctttaacttagtttatggtgtttttctttttctttggacaatgatgatttcttaataatctgagtagacttcttcttccgaatccccaaataatccatctctacttgaaatttaagttgttcggtattcatggtcagcaacaagggacaatccttctattatggtagcagccttctattatgaatttattcgaatgtgtctactcataatttgtggtttgtatttcaacttgtagttgatatcaattatatgcacacagactttttctttttgaggggttggaagcaagcgattcaatgattgtaccactcatttcataatagtgtttgatatgacgttaatttgaatggtttatgttgatcgaaaatactctcagtcacaacaagaatctaattcgattaatttatttgaaaaacatatgttggcatggtacatgaaccagctcgttcatatgaaaatattttaaaaagtcaacatcagtgctaatttcaaattgaccatacattagcacacaagaagactaacaaaaaaaatgagtgaataaagaagagagtgagtggggttgatacatgtcaccgtccaaaatgtgtctgacccttctcattggagctacaagagccgaccctttgcctcatcatttgttgacttcactctccttttacatatttaaattataacttgctcatatttccattcattgtgttcggttctagattgttccatccactttcttttttctcttactttgaaatttagaaatatatgaatacttgacaaatatttgaatattgtaactgatttgtttgttcgtaatacttgacaaacttttttgaatatacacctttacatatattttgagttgagataaaaagggaattatgttagtttatggattatattatgtaaataccacatctaactatgatcggatgaaaactaaaccagcatatctctaatcagtaatatttactaaatttatatatcattaaagattttttgaatttagcaaaaaaagaagaagatatcattaaagatttttaaatttaaagtataacataatgaataaatcaagtgttgagcttagtttcgcgttgcaaagatgttcatttgatttttttttttttttttccatttgatttttcttatactaaattgattgatgtcacggtccttctgtgaaaaaagtatattgtactgtataaatttataatagtcatacttgaagataactaatatcattttctaaaggttttgttgacatgaaatgggtgaatgatgaacatctcgtttgctaaaccacaaaagaaataattcgttggactataacttaaacttataatatatcaactgaaatgcctacaatttgagaatacgccttttcaaaaagttttagaattttataaaaatttctccaccataatattactttaataaaagcttgttattaaaatgatatattaacaaaaaaaaaagaggtaggcaaagtagcttttattaaaattaatgttttccctaattggtaaatcataaaccaaaaaattgaggtaattcttaatatatttactatgattagaatgatacattaatgtaacattttatcatcttcattaataatagtaagttctcctcaaaattacaatttgatatcaaaaaatatatttgtattacaagcaattactgaaaaattaaaattacaatttagcccagttacataactccacgtaaggtttgagcccatcacatcacatggtacatgaccaaagcccagttatgttaccatggagtattcttcagacaagagccatccagacagaagtggaccacacaatcacgaatcgtatggagatcattacaatatattgctcacatcttattgcgccacgtctcttatttggcgagtgatcaacgtccacagatctcttgctccactctgattggtacacgtcatcattttattgtgctacttgtttatgtggtacagtagagacaagtggtaagattttaaaatatcttaaaagatgtgtgaggcccatttagatattttctcaacgggctgttcctcaaaagctgcccgtttatctacaaccatcgaacggctcgaaactattctgggctagctgcccgaaatctcttaaaggaatttgttgagtgggcttgaatcaacggtggataattcgaaggtgtacgtaacatctcgtagcatctgaacttagctcccctcaaaatatctgtggacatatgtcactagctttttttttgtgtaatgaaactattaattaattaggcaatcacatgagagatgttatatacttaaattaataactcaataatacaatcatgaccaccaaaccttgaaataaaataatctctctgattacttgtacaaattctttaccaatatatgccatactgtgaatgtaatggtttattttaaaacagccaaatattattgatataattatatgtttaagtagattttaaacttagctcatggttaaaaatagacagaattttggagtaaatctgagtttacaaaatttatttattaggattaaaattaattacttaaattggcaaacatttttcttggtgattgtaacatacaatatacgaatttgaattcgcattgtgattccaaaacaacactaacataaactaccagtaaaattttttaaaataaaatttcatatatatatgcttaaaaaatgtaacaaaaatatggtaaattttttaaccatggtatgggtggagatgtatgtgggatgatgatggttatatggtaatg

SEQ ID NO: 34095 - DNA, 3003 bp, Unknown
  misc_feature (1)..( 3003): 2750-1469P.txt file - cDNA_ID_3074412; gDNA_ID_1620738; Annot_ID_166310
tgtgaacacaaggacatggaattcttaaaattggttacctgttttggaagatgttggtgagatttgttttggaaacaaggctttcatatggagaatcagaagcgttggtttgtgctggactagggcttatacttgctactgattgtatattcactgagttctcactatcaactgaatctataagaatgaaaatgaagaagattcttatgttagggcacgacaggagttttctctttatagtattttagattagaaattgaagatcatttagggaaggattcaaaaaattacttctgctgggagtgcatgaatacattgtagaagatgatctatctggagagtttgaagctgtcttcataaacttagagctattgctgtcaacagagcctgcaagattgaccagaaagtgtatgtagcattccatatattctttcttggtggtggactacagtaaagagaagaagaattggtagggagaggtttacctcgtgatgtgaagctgtcgtataccgggattaattcatcaattgaacctgcagggcagttgagaaattaattgaggggtttgatttataagctatgaacttgattattatcactaataagaatagtgagacatgagatgcttaaactcaccatgacacgagcctttcacttgtaaaccaagcattaagctgtaatccatgatgccttcatcttccaaaagttcacaatctagcttcgtttgcctgcacaattgaaagttcacatctaaatcattctctacgacaagaatcaatataagaagagagagaaaaagactgacttaatgagacggtgtctggccaaagaatccacatagaaacaaaaatcaaggtcgatatccttcaatatggttttatctctcactttgatcttcttgttagtccgaccttgagatgaaccctttagatcatagaccttgttcataaaaacatccgactgcagtatgtttgacatgacgacaaaatatgtctgctcacaccaaaaaaaacttttttgttttaatagtttctcagcgaaacatcagatcaaagataagttccattacataattattactagtttaccttaacacctccaataggcttcacagagtgagctccataattcttggacaacaaggttgacctgtatttatggatatgacggaagtaaccaggcaacatctctagtataacctacaatattgaaaaagattgatacataaaaacatgaaacgagagatgagaatattaaacatatattttagcaaattagtaaaaaggtaccttgatttcggatttgcgtagaatcttaatgagaaaacggtcatctttggaaagaagaaacatgttaccaactttgctagtagaaagcttccttaaggtctcatcattacagatagacttcatgtactcatcatgattgatatcctcaagttcctgtataagtctgcaagaaaagaaccaaccaaaagtaaagaaaaatgagacaatgagaaatcctcaaagacatacagagagagagagagggaaaagaacctgaatcccaagggacaataatccttccattcgaactcagtaatggttccaggaggaagatgttttatgtgtttggaagagtatcgaatcctgtttttctcagtggctttcacgtcctttgctgttatctcccgcgtaaacatttccaaattaccctctctctctcaacttctcctgatatcaaatctcatctatgcccacatcttttaatttgtatactcctatacattagaagaaataatcccacatttttcaataagaaattgacataaatctgcagatatagatccaaaatttatggaattgagggacaacatgaaaacggagaaccctaaaaattgttcggctcaaaaccctagaaatcgaacacaataattgatcataccaacacaaatatatcatgatcaaattcgcataagatccggtaaacaaaaaatgagaggaagaggttgttacctgttccaggagctgggtaaacgagagaggaggaggagaagaagaagagtgcgttgaattttaaaagaaacaagaaattttaaaaatgaagaagaagaagaattctgttttgtttctttatttgtttgtgttgagaaaaacaattgttttgccaaatttggccgtcgaagttcgccgctcgatccaactcattttcctctgttttcaaagacgggaaaaaccaattcccgcgtcttctgtttcattcatttccgttactcgttttagttattattatattactcacaaggcccatagcttaagacaaggcccataaacaaaaactacccaatcatgtctttaagttcaacttagccaaatcttgaccatgattcaacaatgcttattgagaagttatgcaacctacagactggctacaattttcccatttatttattttcccctgaagttaagttattgatcggccccaaaaaaaacttggcttgtggcccaataatagtcagagccggctctgggagaagtgtaggacgtgcttccctcacgtatttaaacgtgacggcgatgacatgcatcatttaccgactagcgacgagatgatctttttcatttagatagatatcgttagataaaaaaaaagtagaggtcaaacatacgagctgtatactttcatatatacatggtggtcactatcttaaactaagtcccgatccatatattgtcatcacaaagacacttacgtacagcacaagaaagcaaacggggatgtaaaacgctgagcagtttgcattccataaatccaaacggcacgcatgttgtagtaacgacgtgggcccagtttcgaatgaatcatatcgattctgtctttgttgctgttacgtagaagaatcaagttatattttggtgaaagaatctaaaaccccacacatataaatctgtcatttttggaaacttctcaaaaagttctaattctgaaaaccctaaagtgttttagttagggctaaacatg

SEQ ID NO: 34096 - DNA, 3000 bp, Unknown; identical to SEQ ID NO: 4876
  misc_feature (1)..( 3000): 2750-1469P.txt file - cDNA_ID_3074429; gDNA_ID_1620738; Annot_ID_166302

SEQ ID NO: 34097 - DNA, 3003 bp, Unknown
  misc_feature (1)..( 3003): 2750-1469P.txt file - cDNA_ID_3074443; gDNA_ID_1620739; Annot_ID_166373
agcaccggctccacgaagtctgaatcgaatctttctgttggctttcccaaattcattcgtaaatcaaaatcaaagggctagaagcgagcgcttctagctgcttcgcctgcttcttcttattatggcggccatgttggcgtggcgaaaatgaacgaaaagcgagatgaacgtgctattttcaaatcggattgatagattgatctgttctgatagatctaaagagtagaaatagatagagaatagagagggaatcaataataaggtctttgagcctatttctatctattgatgagacaactatctattcttgatccatcagaaagaaattatttatccatcagaaagaaatcgatatgtatctgatggagtcttctacatcgtacgtagagcgcccaagcgctttttgggccagctcagttctcttatccatcggtccaatgcactgggctcatctcatggagggaaaagccaaaatgtagttgtcttgttgttgttcgccgcctcgacgcattcccttctctccccggcatcgtcccacacagaaagaaagagcgcggagccccggcccgagccgtaggtccgctaacgtaaagcgaggagttgagcctgaactggcgaaccgaagtcactttcggaaccatacttcctacagctgctaacatgtgcccagtcctgcggaaaggcgcaaacgaacgtgagctgctataccggaatcccccgctggccatcggggaccgagtggtaaggccatgatctgcaggggaacggatcactcattcttccattggggacaggtgcacgaacgacaactccaaacgtcacacatccgccgcctacttaccgtttaggtggcaccagcgagatccagctaaggaaaaagagtgtcgcggctgctccactccgccgcggtctcatgaacttcacttcgttgccttcccgcgcgcaaagcgaatgggcgctgtgctgtgggtcagtttcggggcggggggcgcagagataccagaataaatgattcatttgtttggatcgacgagctttttcagccccaaaactcagaatcaatggaatgtctgtccataaacatctattctatctgtatatataggggatctctctatacatatcaaagtcttttatggcattgatatgatcgcctagctgtagccgcatatcacagctgcactcaatatgcggatttctgttggatcagatcttttctttcgctttgacggaagctttttgacctagcgaaaagcactttcgcgcaagcaaagtagaagctttgccagaagcaagacgaggaagtggagctgtcgtataagcggtagcttcccccgaccgactaaaatacaagagtcgcggcctactttgattgcgaaggggtttggcaacaagcaaacggctttctatcatagttgcaagggttcaaaaccttagttcgctgcttttcccagtaccagagaagggcttatactgctcgcctttgtttggtttgatatattcattcagtcaaaatacaaactacaacaaagtggaagtggaagggccgctatagaagctagaacttgctttataagtcggcctaaccaaagcgtcacgacaacaaaaaattatccttatgaatggaatcttaagtagggggggctttgaccgcccgcctaccaatcaaagaggcagagagtaaacgtaagctcacccgtaagctcgaagagagcttcccttcattcgcttcgcgggagccgcacaagcacatagctggaagtcagagggcccatactacctgcctaaccctttgttccgagggaccgtagatcggaaagcaccccatttatccaaaagagaagggaaggggcctatgtatttgcatgacccctgcggatttgaccctatcccggagccaatcccctattggtcctgccaccacgccgcagaacgagagctcgtgtggaaccttttctttctggcgtaacagccggtggaacgtaacaaaagattacggtcgcctaacattaacataagggcggggggtacggtaaactcggccaaaatatgacacccgaagggcccgaacgcacaatcctatcccatccgagtccgagtttaccccttgcacttcggacagccgaccgtagcatcataaggaggaccccctttcgaggtaaaaaaaaaaaaaggtacggtacatataggaggttggactttctcaacgtggtgtatagcacgaaaaacttttcgatacaagaaagggccgttctcacatgaaagaagagaagaaatcctttcttctcttctttctctttctcgagaaggaaagaaagaggatggggggagggggggaatggggccggtgcccttcttttacggccgtcactcttatttgtcagccgtgaggaactaccggctcggtctcggtgggaaaggaaaggcttgggcctacctatcccgataagacctcataaaggaacggcgggagtgataggttccatattgccgagctgaagggcaagacttttgtacgtgatcgtagtatgtgacgtcgtctcgtccacgctgcattgaagagtacctacgcactaagttccggttcactgataaggaagatagagttgggcgggggtctacgatgtgatactcaagtatatgacccggggagatacatgctaactatgggtaggaagcaggaacccttatgtaaataatttcgggggggggttacagatctcttatactaccctcgatcgacagagcggaacgaccagaaaaataagtgatgttagaaagccgtatgataggtggtaactatcttgtacggttcggggggtaatcggcgtactccgggagaaatctttcgctctatcgaacatacagggaattggaggtagcattctaccgatgttaagtcatggactggttccttcagccctttttctatgtgttggtgttttatatgaccgacataagactcgacttgttagatattacggaggtttagtgagcaccatg

SEQ ID NO: 34098 - DNA, 3003 bp, Unknown
  misc_feature (1)..( 3003): 2750-1469P.txt file - cDNA_ID_3074466; gDNA_ID_1620739; Annot_ID_166350
gcgacggagaagccagcactgagagaagacctccctttcaaagtccatcgcctgcacttgaaccggatacctactatttattttattgaactagacgatcagcggacttttatatcatatcaccaacaacgggtttcgcccacagtacagagatgatctcaatcgcatcggcataaaggtccggattccaactttcaaaaaggatttacgcgcgaattcaactatagacaaaggtccggattccacttcaaaaggatttacgcgcgaattcaactatagacatatctctttggcgacccagggacggggattcatcaatcccggggttcgagggagactttagaacccctatatatgagtctcgaaaccattatttatacatttctcgatgacagagatcatctttaaggagaataaacattggtcctttatttaataaccccgatattatcaaaaccatgatttccttatttctcgatggcataggttccagggaaggaaaacagtccggtcctttttcaccccgaaattcgagagtagccgtataaaccaataccggcagaaccacccaaactcggctcaaagcaggaacaaagacatctagaaagcccacatcacgtggggacttggccttggtgggacattcaaccgacatacacaaccaaataataataggttttagccatgtattccgctacaccgccctattgatctacgctttcgaagcaaccaccggtaccattttcacacaacagagccgacttacttattacatttataggacagggaacccgtctcggtaggacttccaaatcctacctcaagcaaccgacatctctttacttacttgaccgctagccaggggcttgaaaccccttacaaccttccttgcttgccgggcttacatcgctatcatcgctagccagggactggaaatcccttacaatcacatgcctgcgctcgtcgtgcctttaatacttatttattaaccaaaccctccttggccccaattggtctaagactcaccaacatcttacgatgagacatcgggctacctggcaagagtcaataaattggtgaacctatgagagacgcttctaattcttttctttctcctgacactcactatcctacccgatcctgctaacaggaaatttgatgaaataaggaaacttaggctgttgttgaatcaacttagaatacaaccggtacccacgtcgcaactaaagcactcgtagcatacgttccatccacatccggccagttgaagtgaagatcgagaaaatgttcttcaaagcttgctaataaccaaaaaagaattggactagtgtaagggacttccttttcaagctagcattttagaccaatgcaatcgagtgaaagtgcttcctatcatttgtctgcttgaaaccttgcattgagtgtgcaccttgggaatacttgagtttggaggtcttcaagcctttctatgggaaaggtttccaatacgtattcttgccgttgttcgagcttaaaagcggatgatgatcctaatcaagagtttggtctagcttttcgattcatttgagtctgtcctcgcaaagatatgaagggcgctttcaggacggatacggatacaggtgacccctttttcccctttgctttctttattacttctcgtacgtgcccagtctcaacgtcacttccaaaaccgcctttcccagatctatgaaaggtgaaaggttgaaggtccacaaaaggtaacataaatgaacaagtttattttgtattcgagctgctgagggccggagctcgtatggatacattacttcattgttctatgaggccttgcacaaagcccatactcggataaggatcgcgaagtgcaaagatccggtctttgacaacccaaccgtcgtaaggacaacaaaacctatacttatgtgtgttcgacactataggcgagaccagttgtcagatgatcgccgagtggcgttctgcttgattaggcgaatgcgagtgaggtatctaatcccgttcgctaggagggaaactcaggaagagttcgggcagaaatagatggtgaaaagccctttatattatataataaagcgcgctccttgcatgactccatatcattcattattaaagcgaaagcacaacgtgtcaccctaaccttcaaatcgataaacgggaatgcgttacctaataataatgagcaatgctgctaagagcaaatggttcctaacctcataaaaaaagagatagtcatatccgactatccggcaacacgcttggataagtaaggcgatgaaccgtacctttatctctaggcgcctatgatgtcttattatgtagatcatgtcttgcttgagagttccaaacctcgcccttctaaaaaagtacaaacccacgtctagggatatacgagcgccattcttcagatggatcgctcttcgatagttatttattgtagccgggataagcaggggttcctccttccgtcctagtttttttttagtacaagtagctaagggggctgggttgcgtctttcttgtgaaagaatacttctgcgcacctgctgaaaggaagtcaaacggagattaccggttccggagggaccaaccattgtacttatagggtcaggtctatcttgcccttccaaatcacccatgtgtagctccaccgcacgagtcagaccttgtacgggcttttccacaggcttgaggcagactctttccttattgggcttcaatccgtttgtctttgcctcctctactgagtcagtgacagaagtgcagcagccaataatacgtatataagaagaggactgcttacgggatcaaactatcaatctcataagagaagaaatctctatgccccctttttcttggttttctcccatgcttttgttggtcaacaaccaaccacaactttctatagttcttcactactcctagaggcttgacggagtgaagctgtctggagggaatcattttgttgaaatcaattaatccaatatg

SEQ ID NO: 34099 - DNA, 3003 bp, Unknown
  misc_feature (1)..( 3003): 2750-1469P.txt file - cDNA_ID_3074501; gDNA_ID_1620740; Annot_ID_49574
tagatttaatatttggacacctgaacatactaaccgatttaagccatcttatttatcatgcatatcaaattatgtcttaaccagaatcaactttaagacattgatgtctccattatttgcaaattcattacaagttgttttcttttcttgcatgtttgtgtcttcacttccatatatttattcctaaaaactaaagtttttttgctaagaattcctaaactaaagttgcttactctgaagttccaaataaataaataaaactctgaagttctaatgaattttgttgccatatatgcggtaaattcttgtgattcattttttctcatatgatctatattttttttttgggggcaaaattaatctgtatatattgtttacataacctcactaatcaaagcttatttgtttacatggtcaaaatatgaataaattttaaaactttgactagacaaccaatattaaaattgagcatcttttattttataagttctttttttttttgtgcaaaatttttataagttctttatacgaataaatcaaagaaaactacatatagtaaaagtacgaccaactcaaataattgtaggatgtgtgataaagtacatatagcgtatctagtttcttttttgaagtacagagtataatctattaaccaaacatttttaaagtaatatatagctatgttcaaaagaacgaaataatccgtagaccgtgattgtgccgagattagtgggagacattcggacgaagttggctttatactattacaaaatcattatttacgctactaaatgcaagtaatcaacatcaagtgtatatttatttcgtccttatacacccaattgcttgtttaaatattaataatcattttgactttggaatgataattataaagttctgattatgatgttttaacaattcagaaactaaataatcatacaaaatctgttatcatgtaaaggttattagagagaagcggtcgctactcgatattggaagagcagtacttacgcatgacacaaaaatgtcaaatatttatttaattcatatccatattttaattacggatttacataaaactgagagagtttttaggaaatcttccagatttagttgacaaaatttccaaaattagctagcgatcaagagaatcatccgcttcctttgggaaacacacaaatacgaatatctctcttaatccgattttctcttctcatttgtgtgattttggaacaataacaatatgttcaacaaaaaccaaggatccaacggtggttcatcttccaatgtcggcatcggagctgattcaccttaccttcaaaaggcacgttcaggcaaaacagagatcagagaactcgaagcagttttcaagaaattcgacgtgaacggagatggtaagatctcgtcaaaggaacttggtgcaataatgacgagtctaggtcatgaggtaccagaagaagaactagagaaagcgatcactgagatagatcgtaaaggagatggttacataaactttgaagagtttgtggagctgaacacgaaaggtatggatcaaaatgatgttttggagaatctgaaagatgcgttttcggtttacgatatcgatgggaatggttcgatatcggctgaggagttgcatgaggttttgaggagtcttggtgatgaatgttcgatcgcggagtgtaggaagatgattggtggtgttgataaagatggtgatggtacgattgattttgaagagtttaagattatgatgactatgggatctagacgtgataatgtcatgggaggtggtccgaggtagagtttctttcgtggacactgctgaaactgaattctccgtttcttcttctttttcgtgttcttccttttcgtcgtcattgtttattattccaccattgtttcaatcttttttttttttgttgttgtctttgttctttgggatttgtaattcccttcaagataacgtgattttaaaattttaatttatctctcttttttttgtattcagttctgctttgggacttgattaatttgaatgcatatacagtgaaaattatgtgaataaataataaccacaaatctcatttcttactctacattataagctaatttctttgacatatgtctattgcatttgtttcgaatgctagtttttgggtttgtttttacacctaaaaattatccctttattattaaaagggaagtacaaattgaaattttgtctaatttggcctcaattttgattttaattttggattttgttctttgctattccaaatcattaagggtaatttggtcttaacaatcttctaaattttatatgattcgattcaatttaaaccgttcaataaaattaatttccttcaatctaaaccgctcaacaaaaataaggaatttatgtcgtttttgaaatcaaaatatgatcacatttcatccctaaaaacactattcaatctcaaaatcaataatcaataatattcaaatcatatattacgattcttcactaatcattagaaatttatatttataagtttagggtaccaaatttattcaaatatttagtataagaaccaaatatgttgataatcgaacatcaaaatgtaacatctgttcatctttgtctttaagtttttacaaatgctttgaatggttccaaatttgcaatgaacaaaacgatttttatttaccgtttatgaattttggttcgcaacaaactaacataaaaagatgaactcatttgtaaaatttttggtgtatgcatattaaaaaaaaatgatttaacataactaaattttgtaaatttttaatacaaacgcaaacgttatttttttcaaaagcccatttacgacgaaaaactaactaacaagcccattagttttagtattccttttaacaatggacccaggcgccgaataaaaactaaacccggtccggatcttaatcctctagcaacagtgaaccgggtccgcttcgtcggaactcatggccaattcgaaaatg

SEQ ID NO: 34100 - DNA, 3003 bp, Unknown
  misc_feature (1)..( 3003): 2750-1469P.txt file - cDNA_ID_3074501; gDNA_ID_1620740; Annot_ID_166394
aaacgtcgaccaaagtagatttaatatttggacacctgaacatactaaccgatttaagccatcttatttatcatgcatatcaaattatgtcttaaccagaatcaactttaagacattgatgtctccattatttgcaaattcattacaagttgttttcttttcttgcatgtttgtgtcttcacttccatatatttattcctaaaaactaaagtttttttgctaagaattcctaaactaaagttgcttactctgaagttccaaataaataaataaaactctgaagttctaatgaattttgttgccatatatgcggtaaattcttgtgattcattttttctcatatgatctatattttttttttgggggcaaaattaatctgtatatattgtttacataacctcactaatcaaagcttatttgtttacatggtcaaaatatgaataaattttaaaactttgactagacaaccaatattaaaattgagcatcttttattttataagttctttttttttttgtgcaaaatttttataagttctttatacgaataaatcaaagaaaactacatatagtaaaagtacgaccaactcaaataattgtaggatgtgtgataaagtacatatagcgtatctagtttcttttttgaagtacagagtataatctattaaccaaacatttttaaagtaatatatagctatgttcaaaagaacgaaataatccgtagaccgtgattgtgccgagattagtgggagacattcggacgaagttggctttatactattacaaaatcattatttacgctactaaatgcaagtaatcaacatcaagtgtatatttatttcgtccttatacacccaattgcttgtttaaatattaataatcattttgactttggaatgataattataaagttctgattatgatgttttaacaattcagaaactaaataatcatacaaaatctgttatcatgtaaaggttattagagagaagcggtcgctactcgatattggaagagcagtacttacgcatgacacaaaaatgtcaaatatttatttaattcatatccatattttaattacggatttacataaaactgagagagtttttaggaaatcttccagatttagttgacaaaatttccaaaattagctagcgatcaagagaatcatccgcttcctttgggaaacacacaaatacgaatatctctcttaatccgattttctcttctcatttgtgtgattttggaacaataacaatatgttcaacaaaaaccaaggatccaacggtggttcatcttccaatgtcggcatcggagctgattcaccttaccttcaaaaggcacgttcaggcaaaacagagatcagagaactcgaagcagttttcaagaaattcgacgtgaacggagatggtaagatctcgtcaaaggaacttggtgcaataatgacgagtctaggtcatgaggtaccagaagaagaactagagaaagcgatcactgagatagatcgtaaaggagatggttacataaactttgaagagtttgtggagctgaacacgaaaggtatggatcaaaatgatgttttggagaatctgaaagatgcgttttcggtttacgatatcgatgggaatggttcgatatcggctgaggagttgcatgaggttttgaggagtcttggtgatgaatgttcgatcgcggagtgtaggaagatgattggtggtgttgataaagatggtgatggtacgattgattttgaagagtttaagattatgatgactatgggatctagacgtgataatgtcatgggaggtggtccgaggtagagtttctttcgtggacactgctgaaactgaattctccgtttcttcttctttttcgtgttcttccttttcgtcgtcattgtttattattccaccattgtttcaatcttttttttttttgttgttgtctttgttctttgggatttgtaattcccttcaagataacgtgattttaaaattttaatttatctctcttttttttgtattcagttctgctttgggacttgattaatttgaatgcatatacagtgaaaattatgtgaataaataataaccacaaatctcatttcttactctacattataagctaatttctttgacatatgtctattgcatttgtttcgaatgctagtttttgggtttgtttttacacctaaaaattatccctttattattaaaagggaagtacaaattgaaattttgtctaatttggcctcaattttgattttaattttggattttgttctttgctattccaaatcattaagggtaatttggtcttaacaatcttctaaattttatatgattcgattcaatttaaaccgttcaataaaattaatttccttcaatctaaaccgctcaacaaaaataaggaatttatgtcgtttttgaaatcaaaatatgatcacatttcatccctaaaaacactattcaatctcaaaatcaataatcaataatattcaaatcatatattacgattcttcactaatcattagaaatttatatttataagtttagggtaccaaatttattcaaatatttagtataagaaccaaatatgttgataatcgaacatcaaaatgtaacatctgttcatctttgtctttaagtttttacaaatgctttgaatggttccaaatttgcaatgaacaaaacgatttttatttaccgtttatgaattttggttcgcaacaaactaacataaaaagatgaactcatttgtaaaatttttggtgtatgcatattaaaaaaaaatgatttaacataactaaattttgtaaatttttaatacaaacgcaaacgttatttttttcaaaagcccatttacgacgaaaaactaactaacaagcccattagttttagtattccttttaacaatggacccaggcgccgaataaaaactaaacccggtccggatcttaatcctctagcaacagtgaaccgggtccgcttcgtcggaactcatg

SEQ ID NO: 34101 - DNA, 3003 bp, Unknown; identical to SEQ ID NO: 20458
  misc_feature (1)..( 3003): 2750-1469P.txt file - cDNA_ID_3074511; gDNA_ID_1620740; Annot_ID_166420

SEQ ID NO: 34102 - DNA, 3000 bp, Unknown; identical to SEQ ID NO: 20460
  misc_feature (1)..( 3000): 2750-1469P.txt file - cDNA_ID_3074516; gDNA_ID_1620740; Annot_ID_166414

SEQ ID NO: 34103 - DNA, 3000 bp, Unknown
  misc_feature (1)..( 3000): 2750-1469P.txt file - cDNA_ID_3074521; gDNA_ID_1620740; Annot_ID_166401
tggtgccgctgatggagaacttgtctacttctaagagagtctttgatctacaagatttgctcctgcgttttacctttgataacatatgtatatcggcctttggtgtttacccaggatcgttagagacaggtttaccggagattcctttcgctaaggcttttgaggacgccacggagtatacacttgcaaggtttctgatacctccttttgtgtggaagccaatgaggtttctagggattgggtatgaaagaaagctgaataatgcagttagaatagttcacgcgtttgcgaataagacagtgagagagaggaggaacaagatgaggaaactcgggaacttgaacgattacgctgatctcttgtcacgccttatgcagagagagtacgagaaagaagaagataccactagaggaaactacttttctgacaagtacttcagagagttctgcacaagtttcataatcgcgggtcgagacactacatcagtggccctcgtgtggttcttctggctagttcagaaacatcctgaagtcgagaagagaatcctaagagaaatcagagagattaaaaggaaacttacaacacaagaaactgaagatcagtttgaggctgaagatttcagggaaatggtgtatctgcaagctgctttaacagagtcactgaggctatacccttccgtgccaatggagatgaaacaagctttagaagacgatgtgttacccgatgggacaagggtgaagaaaggcgctaggattcactactcagtctactctatggggagaatagaatcaatttggggaaaagactgggaagagttcaaaccagagagatggatcaaagaaggaagaattgtgagcgaagatcagttcaagtatgtagtgttcaacggaggtccaaggctgtgtgttgggaagaagtttgcgtatacacaaatgaaaatggtggctgcagcgatcttgatgaggtattcagtaaaagtcgtccaaggacaagagattgttcccaaactcaccaccacattgtacatgaagaacggtatgaatgttatgctccagcctcgtgactggtaaggtagttcggtttaaaaacaatatagtactaataaataattgatgttgaacgatattctaatcgttttagtatctaaatttgtttgtggaatatggttaactaaaaagactattttaactaattcggtttggattttatgtgcaccaaccctagtttacttcaagcaatggacatatgagagtcacgaattgtatgtacatgaaatgtctatttaaaaagctctaaatcttataataatgaaagctgatcacatgaacatgatactgccctccactttcttccacaatcgtcatggccctttcgataatgggtgcaaaagaagtcggccctgtgacagaagtaaccaaagatcaggtaacagaacaaacaaacacagacacagcagaaaaagaaaacagagattcttaatctcaacctacaagacgcagctgaggaacaatctctctgtaccgtgaaacgacatcttcaaacccacttaatctcaatcaaacagagattgtttacagaatatatcatccgggtaaaaactgaagggattctgatcatgtgttgtagctgcaagaatcaaacatacaaacccataaaaacaattaaatgaaacatttctcttaacacaagaaagactaacaagtctatgttctgcagtcattaccatctccaaatccataacatggaatcaaattatcttcatcgaaagcatataaagtctttccaatgacagatatcgcttgctggtacgggtttggacttgttccaatgtaatgcaagctttgcctgttgaatgatctcgctcctaaattcaaaaccaaacccaccaaaacattactttaaaaaccttccaacttcaaacacaattgcttaacatacataaataaaacttctaaaacttttgatttaattgccacagttgccacagttgggcctaacaaataaaacgggcttaacttttgccacagttgggcctaacaaataaacagttagcctaccaaagcccaaatattttaattgaaataaattaattaagagagacatagtaaactaacccgacgagattgctttcttctgtcttcttcgccgtagaatttgaagttcctccgtcgtagaagatcgtctcttgtttcacctactccgatatagcccctctctgaattctccatcctccgagcagagaaggctgttggtagaaagttatattctcaaattttctaattttgcctcctccttggcgaagcaattgcgtcaattccttgcacgccactattacgactacgaaaatctagatcggagagaagactaaattatcttcactgatcgcacggtgagatggctaacggagccgatgaggatgctgtcctcagcgatgtcgagtccgatgaaccagcgcctgttgttttaaaggattcgccgcgggaagaagcatcggatgagaggataacggagctaatagcggagcttgatcgagagaagaaagctcgagaagcggctgagagttcgaaatcggagcttcaggtttcgttcaatcggttaaaagctcttgctgtagaggcaatcaagaagcgcgacgagtctaagcgagaacgtgatgaagcattgaaggagaaggagaatctaacaaatgagcttgagaatgttaataaaggtaaggatgagatgtcgaagaaacttgatgaggctttgagatctagagatggtttaaaagcagagattgagaattcctcgcatatgttggtttctgggattgagaagatatctggtaaagttagcagctttaagaatttttcaaatggtggtcttcccaagtctcagaaatatacaggtttgacttctgtagcttatggagttattaagcgtactaatgaaatcgtggaagagcttgttaggcagattgatacgactgcaaagtcgaggaatgaagctagggagcagatg

SEQ ID NO: 34104 - DNA, 3003 bp, Unknown; identical to SEQ ID NO: 20468
  misc_feature (1)..( 3003): 2750-1469P.txt file - cDNA_ID_3074532; gDNA_ID_1620765; Annot_ID_50108

SEQ ID NO: 34105 - DNA, 3003 bp, Unknown; identical to SEQ ID NO: 20468
  misc_feature (1)..( 3003): 2750-1469P.txt file - cDNA_ID_3074532; gDNA_ID_1620765; Annot_ID_167328

SEQ ID NO: 34106 - DNA, 3003 bp, Unknown; identical to SEQ ID NO: 20468
  misc_feature (1)..( 3003): 2750-1469P.txt file - cDNA_ID_3074532; gDNA_ID_1620741; Annot_ID_166435

SEQ ID NO: 34107 - DNA, 3000 bp, Unknown
  misc_feature (1)..( 3000): 2750-1469P.txt file - cDNA_ID_3074539; gDNA_ID_1620741; Annot_ID_49609
gaaattatctacaattttcacaccagagttcctaatgctaaagacggtcgagattcaactgatattgaaatatatggaatgcaaggaattccaccccatgtcttgactgctcattatggagaagaaggtatgcatttgagatagtgagagtactgtttagattatgagcaattgatttagagaagtaaggcgataaatttgtatgtctcttcatcaagtgttgtagatctattgcatctagtggtcatgaattcgttttgattttgcatgcggctttttgccttatcaaagttattatatattattgttatgtttgcttgtttcatatggtaccttttgaactgaagtcatgttttctgcagaggatgagcctccagccaaagttgcaaaagttgagattccttctgcccctcttggtggtgtagttcctagaccatatggaatggtatatccgcctcaacaagtacctggtgctgtacctgcacgaccaatgtatgtactaattatactatactctctctatggccgttacttgttgaattcttagatgttgtctctgtttttaaaaatccgatccatgctaaatgatggggaactttttttcttttagttctcttgatgcaaaaggttcttggtttctttagtttgtctctgtcctagaacttttctacttttgttcttctataagaccactataacacccgtagtaaacattttttgaaatagatcgttatctaagatattgttgcacttaaccaactatgacccataaggttcttagtttccctagcttgttctcgtgatttttcaggatagaactttgtcctagaaccattcttttgctcctcttcaagaccacaataacacctgtagtaaacagttttttgaaatagttcatgatcttagatattgtaatatgtatggctattgaccatgataaaatatttcgtgttagcaggtattatccgggtcctcctatgcgtcatcctgctcctgtatggcaaatgccacctcctcgtccgcaacaatggtatcctcaaaatccagctctttctgtacctccagctgcccatttagggtatcgaccacaaccactttttcctgttcaaaatatggggatgactccaactccaacctcagctcctgccatacaaccatcaccagtcactggagtaactcctcctggaattcctacatcatcacctgcaatgccagttcctcaacctctgttccctgttgtgaataacagcattccttctcaagctccaccattttctgctcctctgcctgttggtggggctcagcaaccatctcatgcagatgctttaggatcagcagatgcttatccgcctaacaattctattccaggttcaatcccaagttcgtagaatcattgacttacatttggtttagctgttttgtatcaaattgtaatatctttttcatgttttgttgccgtaggtgggactaatgctcattcttatgcctctggcccaaacactagcggtccttcaattggtccacctcctgtaattgcaaacaaagctcctagcaatcagcctaatgaggtctatcttgtatgggatgatgaagcgatgtctatggttagtttattcctaatttcttatgcatcatgttggaatggttacaattggaaaagtttcgagtaatgaaccatttggttttccaatctgacgcaatgtgtctgtatctgcaggaggaaagaagaatgtccttaccaaaatacaaagtgcacgatgaaaccagccaggtaagttctgatttaccctttttaaagttaagaagagtttgcttttgcaagtctaacccattcggtaggctttatttatacatttctgttccagatcctattgtttctgtgctaagaggtaccaccgtattattcagtttataatttcttcccttagaatatgataagaaggacttaggcaagaaacttgagcattttgaatcaatgttcgaaaggtatcatttgtagcttgcaatagtaggtagtgagaaacatagcgtttgtatctgtttgtttttcattatatttcctgtctattgtattgtattaaaaatgtggtgattggttccacaagatcatactctacaggtttggtttcaaacccaggtcagctctttttatattcttaactctgcaaagtttggtacctttgcacaatctcactgccttggggaaccaaaacaatacgcacttaactctttcaaaataaagcatccaacttcttaactcaacaccaagtttgtttcttttggtttgcagatgaactcgataaatgcagcgatagacagacgaatctcagagagtaggcttgctgggcggatggcgttttagaatttggcaccaaaccaaaccagcgtcaaagaaaaggcgatatggatgaaggctttgttacaacaacaagtcttcactcacttttgttcagatactgaatttatgatctgattttaagttattaactttccatctgttgtattctttagccaggtgagttagtttaccattacattgtttagggatctcagagatgttttttctcagaagtttagtcctttttttttttggtcgttggagacttggaggaagaactttgtctccttttcttctgaattgatcaaagtattatattatacagattcacccaaaatgtttgcaccatgttgttcaatattttgccaaaacaaaattgactaatattccttccattaactgtatattcaaactccaattgatacgattagtatgaatttttgttgtattgctactttgctagtagtaattatatcgaatacaaagttagggactacgttggatttgtcaaaaagtgaggggcctatctgtaatattgagttactttgtcaccacttccccaaaacatcaaaacctctaaaaccctcggaagcctcttctgttacatttcgttcaaatctgtacttctccgagatcgctacttcgccattgttacaaaaatg

SEQ ID NO: 34108 - DNA, 3000 bp, Unknown; identical to SEQ ID NO: 20466
  misc_feature (1)..( 3000): 2750-1469P.txt file - cDNA_ID_3074539; gDNA_ID_1620741; Annot_ID_166455

SEQ ID NO: 34109 - DNA, 3000 bp, Unknown; identical to SEQ ID NO: 20465
  misc_feature (1)..( 3000): 2750-1469P.txt file - cDNA_ID_3074564; gDNA_ID_1620741; Annot_ID_166463

SEQ ID NO: 34110 - DNA, 3003 bp, Unknown; identical to SEQ ID NO: 20467
  misc_feature (1)..( 3003): 2750-1469P.txt file - cDNA_ID_3074602; gDNA_ID_1620741; Annot_ID_166439

SEQ ID NO: 34111 - DNA, 3003 bp, Unknown
  misc_feature (1)..( 3003): 2750-1469P.txt file - cDNA_ID_3074638; gDNA_ID_1620742; Annot_ID_166506
aaatctccaagaactttcattacgtgactgccgagagctcaagcgtcttccccctcttccatgtaaactggagcagctaaacctagcaaactgtttctcattggagagtgtatccgacctttcagagttaacgatcttgacggatctcaatctcacaaactgtgcgaaagtggttgatattccaggcctagagcacttgacggctctgaaaagattatacatgaccggatgtaactccaactactcccttgcagtaaagaaaagactttccaaggtgattccaaaaactccacagaatctcatcatggcctatttaaaaaactttcttacaccacttttgatttgttactgcaggcttctttgaagatgatgcggaatctgagcttgcctggaaacagggtcccggactggttctcgcaaggccctgtcacattctcagctcaaccgaacagagagctcagaggtgtaatcattgctgttgttgtggctcttaatgatgaaaccgaagatgacgactatcagctgcctgatgtgatggaggttcaagcccaaattcataaacttgatcatcacaaatgcaccaacacattgcatctctccggagtgcctagaacaaataacgatcagcttcacatctgccgatactcagcttttcacccactggttacgatgttgaaagacgggtacaccatacaggtgatcaaacgaaacccaccaatcaaacaaggcgttgagctaaagatgcatggcattcatctcgtttacgagggggatgatgatttggaaggcagagaaaatactttacccgagactcaacaaaccgtttctcagaaacttgccaattttttcagctctttcgaagaagaagaaggtgaaaccatctcagaaagtgaatctacagttatatgatctgctagtgcagataggttaagaaactgctcacaaataatcttaatcgatacaaaatgtttgttgctcatatacgatttggtgttttggcttttgtgtttttctttgttccttgtctctttagtctttaccttttgataatacaaacaatataaataaataaaaccaaaaagaagaggaaactcttgtttccaatgatctcgggcattctttaataacaatccaacagaactgtgaaggaatcttcttctgtgttttttgttttgacggcttccatctttaagaaagtcaatggatagaaaagaataaaatagaacatgttgcttgtgtgtcctatagcactaacgaaaaagaacactgcatctgcgtatcctttttgtctttcaaaaccttaattagcagtgtgtgccgttctgatttaagatagatatggaactgcctgacgttccggtgtggagaagagtcatgtccgttgtttgggattatataaaactgtttgcgtgtgatgtaacactaaagcctaaagactctaaactataataactatataacttctttactgattgtcgtgaaagagtttctgcattctttgaggcgttgactttcaatattgatatcgaagaagaaagatcggagataatgatgaagaccggtgctgttgtttccaatccacgttcgagggtcaagtgggacgcattcctgagtttccaaagagacacgagccacaatttcacggatcgtctctatgaagcgcttgtcaaggaagagctccgggtttggaacgatgatttggaacgtgtggatcatgatcatgatcatgagctacgtccaagtctcgtggaggctatagaggactcggtggcttttgtcgtcgtcttatcccctaactacgctaactctcacctgcgcctcgaagaattagctaagctctgcgatctaaaatgtttgatggtaccgatcttttataaggttgaaccacgggaagttaaggaacagaacggtcctttcgaaaaggattttgaagagcattccaaaagatttggcgaggagaagatacaacgatggaagggagctatgactacggtcggaaatatctccggattcatttgcgggtatgtatgacttcaatttctcatctctagttttgtttccgcatttctaatctcttttatacaagtaagtttggtagagatactttgacatatgctacatcatcatctaaaacttctaagcatcatctttatgtttcttgaaatcatctctcccattcaccatttaatttactacgaattttcgaaaattttggaattggaaaagactctggttctcttattgtctttcaactactaaagccaagtttttgttcagagatcaaaactatatgagtaactataggacataggcaaaatattcattagaatttctttgatctgttatttgctttgattcgattagaaaatttcggatagatgtgactacacgaagcaaatcaaaatactaaaaatcaatatcggttaaactgtagtgctctgcaatacgtatatagaaatagacaataattacagatataagtattcatatatatatatatatatatatgtatataagttttgtgtatatttattcatcaaattagttatttaaatattaaattttaaacaaatcaagaaaagtatatttgaatataatgttgttattattggtttaaaatttgtttttaacataatttatttttataattaattaaaaacttttaagaagtaactcggatacaccaaaaatctaggatatcattttgtgccaaggtactactaattaatctaagcttagagtaaaaaagatgagtcaagtaatttaacactgcgtgtcgttctgattgactacagaaagaactgtgtgtcgtttcagaaataagggaaaaagagagtcaaatgcgaagttttttttttcttttttaacaaaaccacaaagtgttgaccttttcccacaaaaatcgaaaagcttggtcgtcatcgttgtaatgtcccagattctggaatccgagaatcgaaaagcgtcatgaagtgaggtttgcaggagatccaattggagatg

SEQ ID NO: 34112 - DNA, 3003 bp, Unknown
  misc_feature (1)..( 3003): 2750-1469P.txt file - cDNA_ID_3074642; gDNA_ID_1620742; Annot_ID_166505
tgatacgtttttgagtcactatgtagcttaattacgatcttgtgggtagtttctgctctgtttctggagtattattcttaaagtttccatctttgtaatttcatatcagtgaatattgttgatcatgttctgtggttgatgaaggttcttagttatgggaggaagaggaaagtgattctagaagcaccactctacgataaagattgtgttttgggcagcattttagctgctcatttcctttcttcatctgatccttctagagctaattcctatgttgaagctgcggcatctaatctcgtcagtttattatatccactgtctttgtatttcagattctactttggttttgaggaaacttcctgagtttagtttgttggcttcaggaacaatctacaccttatgagaaagcggtttacgaggctgttacttacctaatctctgaggatagggatgacgacttggcttttgaaatgcacaccaaggttggttatcactttcattgttagtttatctgaaatgttattctagaatctagttttatatttttgtatctggcacccaaaaaatggttatggttcagaatgtaaagttctgtgcctttttgagtcacttgtttttgaattttaattgtggtttgcagctacttaaaagattcccaaaggacttggcttctttgaaaagagcgcagcttttaagtttctacatgggtcaacctgatcccttcttgggtcttgttcagcaggtacttaagttcttattgatagtgatggtcactgaatgattcacctgtctaagactataaaagttgcttaatattgtaggttctacctgcgaatcaagaagaaagttatattcatggtttacttgcgttcccattgttagaacttggtcgaatggaagaagctgcggcagcttccagaaaaggctatgagataaacaaagaagacgcttgggcacatcactgtgtgagttacataacattgagcatttgcatcctctattctcagtttccatgtaataattatcactcagtagtttttactaatgatgttttctatctatcttacttatttgttgcagttgtgtcatgttcttcaacatgaatgtcggtttaaagaagcagtggagttcatggaagcactcgcaggaacttggccctcttgctcatccttcatgtaaagcattccctcttacctgaaggctctcacagattatcaagttcttctcttattgttaacaatccctgatatattatttttttaacatgtccataattttcaggtatacacacaattggtggcatgttgctctctgttacttagaaggagggtccccaatgagtaaagtagaggagatttatgatcatcacatctggaaagaattggagaaagacgatgctgttcctcctgaagtaatcctctttttgattaacaaatttatgcttttgcgtcatctattcaatattcaactgtctgcaactctttaggtttatctcaatgcattgggcttgttgatacgtttagatgtaagagatgctcttgatggttttgaagaccgtctcaaaaaccttgcagttcgtttaactaatcaggtaagccatacactagttttatatcatcccaaaacggttgcagttatacgagttatcttgttgaataagtttttatttttcggccacttgctttaacatttcaggcaaactggtatttggagtggcaccttgatatattgatagtttgggcactagcaaaggttggagagacttcaagagctcatgaattacttgagggccttaagttccggttagtgtgactttcttttattctgcagtttctaaatgataccgaatttgtcatgaacttgtgttgttcttgcagattatcaaagaagaacaagaagaagcaacaagtgatgcagaaagggattcaggtttgtttattccccctccctctttgatcgtctttctttatcattgtaactagtactcaatatcagtcttgttttcatataagcttggggaagctgtgtatgaatacgcaaggggtaactacgaaaaggctctagaactactgggttcagagttcaacgccattggttacaaggtaaaccgttcttcagcgacttgctcaaaatactctgaatcaaacacatttctggtggatcttttaaactgttttatggttaataatagatcgttggggcatcagacgaacaaatagatgttttcaacgaaatgtggtgccagctgctgctaaagacaggccaatcctccacgggtaaggcttgttgtagagtcttactaatttggatactcgtcttgcttagtatgatgataaacaatcgtggttctgatgtatgcagccaaagaagtaatcagagagaggattaaggccagagatggtattcctttcatgtggcgtttgctggtatacattcaaaagcagaacatcactttgttttagtgtactatatgtgtttttgctatgagaaaatgatgtcgttgtggttgcaggagaaaagttactccatggaaggcaatgcagaggctgagagtagtgcacgagagagagctaagaaacttgaatcttgttatttctaactttgcttcaaaaatccaataatgacatgtgtgtatacatgtttttaaataagtatagaataaaatattttgctactcgtgtcctacttttttgtttaccaaaaggtaaatgaataagggggtgtattgaaagtggaagtttaagagatttgtgtagaatttataaatcctatgttattcaaacatgaattttaaaaagtttcatgaaattcagtgttattgaactaatgatttaaaaatccaccttaaaatccactgttattaaaaacaatttgtggatttgaattttaatgattttggaggatttgagaggatttctttagttaaaaatacagaaatccaaattccatggctaccgccagtggtgtaacaaactgtggaatgctgtcagatttgcgatgatg

SEQ ID NO: 34113 - DNA, 3003 bp, Unknown
  misc_feature (1)..( 3003): 2750-1469P.txt file - cDNA_ID_3074646; gDNA_ID_1620742; Annot_ID_166504
acactcaacgcagaagtctctagattagtcatctcaagggttttgttttatgtttatgaaacagtgttttgcggcggtggatgcggtggtcggagcaaaagacgacgaagggaaaatggcggcggtgggaaagctgatggagtgtttggcgatacttgaagaaacgtttcagaagagcagcaaaggattagggttctttggaggagagaccatcggctaccttgacattgcttgttcggctcttttaggtccgatctctgtgatcgaggcgttttccggcgtcaagtttctccggcaagagacaacacctgggttgatcaaatgggccgagaggtttagggcccatgaagctgttaagccctacatgccaaccgtcgaagaggtcgttgcattcgcaaagcaaaagttcaatgttcagtgatgcgttttttgcttttaaaagcaaaagcaatgttgttgaatacgaataaaatgatgtttgttgtctttgagaaactttaaatttgtctgtgttttgtgccaaaacttctgattaattggtttttggtctttgtgcgttactattatcaattttattcttattatttgccatagcttatgattaaattgatcatagaagaaacatagaggctttaggttcttgtgctgaaccaagtttggcgtattcagtattttacattcttgtataaaattgaatgcatatgtcataattctggtaatacttgttaaattttgttgttcctgattaacattaccatacctattttgcaatgttttcatgacaaatattgccatactaaaattgctggaggaaacctcacctttcaatcgatttgactaaagtattgattgtaccaaactattcatgcctcaccttaaatttggaaacttaattgtgaaacatgtcaaatatggaatatatattgaataagattacaacaactcagtaaaacaacaaggtccttaatttgaaacagttaagcagccatgaaattatcgcaaatagctctgatttgcatagttatagcttccctcttcgctatgcatgagtgtacgtacagagcttttctaatatagtatacacacacgtatatgtcaaatgtctttttttaatcatcaaagttttgtgtgtctcaaatcaactttgtaggtgagagattggaggctacagaggaagagaaatcgagcaagatctatgtcccaccatgttacgaaaccatttgctcgttctcacttaaaaaggattgttggtgctgcttcgaacctttagttcacaaaaatctttgttggggagtacatgattttccgaacgccaaagagctttgcttcaacgaatattcaaagaagatttaaatcctttttattagagaataataatgtattctctgtttcgtgtagaaagttttttttcctcttgagtgcacaacaagttatgtgtttgaatctgcaaaaatttactggtcacatgttcatgctcttatcaacgagaaacacgacgtctaattccacttgcctccctcattcactctcttctatataaacaaattccactttcttccctctcactcactctgtcatctataaacaaattccacttccctccctctcactcactcactctgttataaatgaaacctaaaaaaaaacttgagagatcagatcaacaaaaccaagagaaaacatggctcagaacgatacagtgaagctgataggttgttcggatgaccctttttccattaggccacgagtggctctacacttgaaatctatcaagtacgagtacttagaagaacctgatgatgatcttggggaaaagagccaactccttctcaaatctaaccctatccacaagaaaacccctgtcctcattcatggtgaccttgcaatctgtgagtccctcaacatcgttcaatacctcgacgaggcttggccttctgatccatccatccttccttctaatgcctatgatcgtgcgtctgctcggttctgggctcagtacatcgacgacaaggtaaaacagtttagagactcacttctacatgctctgttttgcttcttgtcaaagtttgatactttagtctctgttattaataaatctgtttagattagtcaaatcaagagttatgtgtctgaaacagtgcttcgaggcggcgaatgcgctgaccggagcaaacaacgacgaagagagaatagcggcgacgggaaagctgacggagtgtttggcgatactagaagagacgtttcagaagagcagcaaagggttagggtttttcggaggagaaaccatcggctaccttgacattgcatgtgcggctcttttgggtccgatctctgtgatcgagatgttttccgccgacaagtttgtccgggaagagacaacacctgggttgatccaatgggccgtgaggtttagggcccatgaagctgttaggccttacatgccaaccgtcgaagaggtcactgaattagtaaagcaaaggattgaggagggttttaagcgaaacttcaaaagcaatgtttcgacttcggaatatgaatagttgatgtttgaatattttaatgctttctgtattactattttgtgccaaaacatatgcacttggatttttctttcttctatttgatatctttgtgtttttattgattttgaagcctcatttctcttagttttctttatttcacattcatgttttagcatatagtttcatattattatttggttaattgtttatatatactgaaaaaaataaaataatcttaattggtttatccaaaaggcgagaaaagccaaaaagggacacgtcatactactcactcgtaacaagacacgagttttttttaataacaaaatgaattgagtgattgatgacgacgacaagcaaaatgcaaaatcgctgtctccttcatgcttcgatcaatcaaaccatcatcaaacccataagaaagagaccaacagtgttcctgtaggaagcggcaaacttgcagctctgttctcttgaaatg

SEQ ID NO: 34114 - DNA, 3003 bp, Unknown; identical to SEQ ID NO: 20471
  misc_feature (1)..( 3003): 2750-1469P.txt file - cDNA_ID_3074650; gDNA_ID_1620742; Annot_ID_166501

SEQ ID NO: 34115 - DNA, 3000 bp, Unknown
  misc_feature (1)..( 3000): 2750-1469P.txt file - cDNA_ID_3074662; gDNA_ID_1620742; Annot_ID_166498
gactcattactagagggatcaaaagacacttatcagttatcacgcacacaggactgtaatcacatccataaaaccttatactataaccggataccggtttaaacaaagaaccaacattgaaccacaacctaagacattttctatcaaagtcttcacatcacgttctttacgcgcgtgaggtaaaatgttcaacaagttacgtaggtggaggagaaccttcgtaatactttttcattagtcttttcttcatttgattttgcgaaatttctaaataattgcgagctgcataatccctccgactattaacttacaaagtacccttttagccaggctttttctgtcttatttttttgtcattaaactatataaccaaacacaaacatcatctttctccttcatttcacaaacttaaaattctctgtttttgtttcttcttctttcaaaatctcaagcaaaagaaaaaatggagctattcacaaaaggtaacaacgttaagttacgtagccacctagataagtttttagtcgccgacgatgaccaagaaaccatccgtcaaagccgtaaaggagatgcacggcgtgccgtttggacggtggagcccgtcgtcgataaacctaatctgataaggttaaagagcagccacggcacgtacttaacggcgagcaacaaaccgttattgttaggtatgaccggtgagaaagtgactcaaacggcgtcgtttaacaagctgatggattggcaaacgcagtgggaaccggagcgagatgggtttcaggtgaagctaaaatcttggtgcggtaagtggatgagggctaacggtggaacgccgccgtggagaaactctgttactcacgatgagcctcatacgtcaaagacaaagaactggttgatttgggatgttataactattgatggttctgatcttgaaaacatgtctgatggtgatgaaagctctgtttcttctccggtcgggtctgaattcggatcagaacccgggtcacctgtttctgccaggtctacgaagagtagtattagccggtttgcttctcttggtttatctacgtctccgagatggtcctcaaaaccggtaagtttgactaagtcttttattcagtgtgcattgattagtttttcttaatttctgtgtttaaattaaggctaatatagaaatttattattgtgagttgaacttagacaattctgtatataagaaattagttggcatgcatgaacatatggaaaaaaagatgaggattacccgtattagtatctacaatttaaagaaaattacatgatctgtatcatttcttttctccactaacatagataatgctccacaagcacacacatcgttttaccaacctaataccaccaaaatgtataggattttttaattgtatagttttgattagtttatctattataatagactatagttgaaaatatgacacttaacaatccaacttaagtttacttcaatgattgaaggatagttttgaaatgcttgtagtagaacctctaaaatgtaactaagtgactgtatatttcttacaaaagctatacctaaggatgattaaagaagaaaaatacgattattattccttaacaataaaaacttgtacctaatggcttaagataaacaaatctagtgccagttaacataagacaagtgtaacaaaaagtaaggtaaaaaagttggtagttatgatttagtgatggagcatatggtccagggatgcaattaggagagtcccacactcatgaatttcctctcttggtctttcttgcgggcaagggtttatagatttattttctaaatattcgcttaaatcctatcttttcgatccattcttttatggcatagggacactattatttttggggaaaagggcatatacttttatctttttaattatttatttatatttttcaatattttccatttaatattgatttgcttataccacataattgcttataatctaactgaaaatcacatattattcatcaagaattacgtccattagttccgattttgatcttatcatagaactaaatacgtactgaaaaattaaaagataatggaaaaagtatagagtaacaatgtaaaatgatactttattgggaaatttggttacctatctctatcgtaatttattctcttcatatagattattatatacatagcaaataaaagtttaccaaatgtatgtaccataccttttattattatttcaaatgaatcttcaatagtcaacattgactcctagtattatgtttaaatcttctatgaattgaagaatctgaaataaacatcatgaatgattggaagatatgtaagagaaaattgttccaactgataaaagttttcacaaagtcattgtagtaattaatagatatatagaaaaataaaacacaatttaaggccaatttttttcatcttctcctataagatttaacaccaaattttttaaagaaaaattcaaagcattgatttttttatatataatcaaatacaaactttagttacaatctaaatcctgctttgtttcttgaaaatctgtttaaattaacaatagttggtgtcttggaatcctcgtaattaactttaatctcaagatttacaaacattacaaagtaacaaaatccaaaacacgtgaaacaacaacgcgttacaagctctaacaaatactaataaggaaagaaatccaaatcataaatttctgctgacgtggatattagatacgcgctctaatccagctagcaacgacttttccagatttcttaccttacctagtccgcgtaaccgtaaaaaactaaaaaacccaatttagaccagtccagtgtcagatccaccacacatataaaataaccatatctctcacttcttcttcttcttcttcttatcactattcgctcatttccccttctctgttgttacagaagtcgacggcgagtagcttcaaccaaaaagaaacaccagtatctgtctcagcaatg

SEQ ID NO: 34116 - DNA, 3000 bp, Unknown; identical to SEQ ID NO: 16982
  misc_feature (1)..( 3000): 2750-1469P.txt file - cDNA_ID_3074665; gDNA_ID_1620742; Annot_ID_166497

SEQ ID NO: 34117 - DNA, 3000 bp, Unknown; identical to SEQ ID NO: 20473
  misc_feature (1)..( 3000): 2750-1469P.txt file - cDNA_ID_3074671; gDNA_ID_1620742; Annot_ID_166494

SEQ ID NO: 34118 - DNA, 3003 bp, Unknown; identical to SEQ ID NO: 20474
  misc_feature (1)..( 3003): 2750-1469P.txt file - cDNA_ID_3074679; gDNA_ID_1620742; Annot_ID_166491

SEQ ID NO: 34119 - DNA, 3003 bp, Unknown; identical to SEQ ID NO: 20476
  misc_feature (1)..( 3003): 2750-1469P.txt file - cDNA_ID_3074683; gDNA_ID_1620742; Annot_ID_166489

SEQ ID NO: 34120 - DNA, 3003 bp, Unknown
  misc_feature (1)..( 3003): 2750-1469P.txt file - cDNA_ID_3074727; gDNA_ID_1620766; Annot_ID_167351
tgttattccatgactttgatagaacaagatgttatcaaaaacatatatttgttccggctgtgtttaaatatatttcaaagtatagggtgatcattgaaaacttgaacattctgtacatcacatacaattaaaaaggttcgaatagagccagaatatgtgtactgtgatatctagttaatcttaatgattataaacctttgaaaaatattttcttttttcttttgtcaacagctttaaaactttggaaaatcttactaactaaataaatatgaaaggaccacgtaacttagaacatctaactttttcttcttttaaaagacatagaagattagctaatttaatatcggaataattatgtttttcatatttagtattaaaataatacttttaattagtttgttaattttcttaattttatttatttaaacatataagtaaatctaaaagaagtcatcgaagaaaattataagtaaaattattttttaatttaataataaaatatttgttatgatcccgacaactgcctagtagttttgtgaggacataaaggagaacagtgtggacaggaaatgaaaaagaaaaaaaaaaagaaatatagaagttgaaaattgtacgtgatcttgaaaatatctcttacgacgcaacttatgacttatgattccatattcttaagattattttaactagttagaagcatgaaacatgtgtagttgtgtacatcaatatgcaaacagctatctcatacgttttttcttttggttacagatagccgtaaaaaagaaatatatatccatcaagttggtaaaaattggtgagttttctaattcttgattcgatcgtaatttgtgagttttctaattcgtgattcgatagtaatttgctttaaacaaaaactacggattggttgaaacaaaatcactccattttaactagtatttagtctgttgccgagagactttatgatttcgtaggctttgaactaaaagaagcagagagtcataagatgaatttgttggaggtaagtcctcggtcataaaccaagcacaagagggaacaaaatcaatattcaagttcttaatgaaattagggttaaagcttacaaaatcttagaattgtatatgtatttgttgtttaagacaggtttcattttttgttattaatatgcataattactagaaccaaaactctttttaatccagagaaaagcaaatgttcttgcaaactttctcgtaaaactgcttttcagtcttatgactcctattgatgctaccattgtttaagcttttggtcttttaaataaatacggttggtcaatctatatatttatcaaccatcgaagggtctacaaatcaacaagtcatctctgtaaatggattggctaaacctttgactactttgcaatttgcattcgattatatggttagatattccatgttatgaaactttaatttacattggtcaaataattatttgattttgggccttataattgttgcagtggtccttaatactattcatttactataattaagactagcaactgactttattttaattctgattttgttaccaagttaagcacaccatctccaaagttccaaaaaggtaaggaatttattattaagaaactaatataagcatttgattgatgcttcatgcgatcgtattctaatcatgattctaaattgtaattgattttattattgtacataattagatacgatataataattaatgtgtaaactcacttatgttaattttgaaaaattatggagtgtgtgtgttatatgtgtctataaaatttgttttcgtgttattttagggtatttcttttaaattattgaccaaaatcacttggctttgtctcaattgtgatcatgtatattagatgtgcaaaataacccttacttaaataattaactctatctctcgtggtctcatctaaatgaaccgcaaggatgctcgccgcgacatcaagtttatatcacttttcgtggagaacagctacgccacaacttcgttagccatctcgtggaagcccttaggcgaaatgcgatcaatgtgtttatagacaatgatcaagagcttagaggtgaagatatcagcattcttttgaagaggatcgagtattcttgaatctccattgttgtgttctcgagcaggtacacagaatcgaggtggtgcttgagagaggctgtgaagatcaaagactgatgtaattttaccttacttgcctttcttgcctgttggcacaatccattagtcaagtttgatagtgaaagcaatgccaatgatcatcgtcatgttacttaagtcatctcgtatcgttcgattcaaattagttgtcgtttaagtttttgaagcatatactaaaaaaacatttaagttttcagttgtcaattaataataataaaaaaaaaaggaaaatgatgatgggtgagttttataatagttacggtgaacttggtcacattggataatttgtcattgttcttgggcggaccaataaaagcctctcttttgaatcccccacacagatctatcgcctcttcttccctcgtgtctgccagaatttttgtttcccgttgataaaggttaaacctttcttcttcttcttcttgtttcgatttcaagttcttctctttcgtgacctacggtgccgtttcatattccctaatttgattgaaaagggttgcgcaagggctttgaagtgaaacacttttgattcttgttgttgcttcaagttttcatttttatcaattgggttttggagaaaacactatgagctgtgattgaattgtctagctcgaagaatcttgattttgtttacacagagaattggtttcttctttcttgatgatagtacaattggattctgaatgttgtgtagagtttttggaattgctcattggtgtatgcttttgttatgcagggtttatctttggtggatgattagtgaaactttttaaggagataatagttcacatgttttagttaaaaatg

SEQ ID NO: 34121 - DNA, 3000 bp, Unknown
  misc_feature (1)..( 3000): 2750-1469P.txt file - cDNA_ID_3074727; gDNA_ID_1620743; Annot_ID_166549
tattccatgactttgatagaacaagatgttatcaaaaacatatatttgttccggctgtgtttaaatatatttcaaagtatagggtgatcattgaaaacttgaacattctgtacatcacatacaattaaaaaggttcgaatagagccagaatatgtgtactgtgatatctagttaatcttaatgattataaacctttgaaaaatattttcttttttcttttgtcaacagctttaaaactttggaaaatcttactaactaaataaatatgaaaggaccacgtaacttagaacatctaactttttcttcttttaaaagacatagaagattagctaatttaatatcggaataattatgtttttcatatttagtattaaaataatacttttaattagtttgttaattttcttaattttatttatttaaacatataagtaaatctaaaagaagtcatcgaagaaaattataagtaaaattattttttaatttaataataaaatatttgttatgatcccgacaactgcctagtagttttgtgaggacataaaggagaacagtgtggacaggaaatgaaaaagaaaaaaaaaaagaaatatagaagttgaaaattgtacgtgatcttgaaaatatctcttacgacgcaacttatgacttatgattccatattcttaagattattttaactagttagaagcatgaaacatgtgtagttgtgtacatcaatatgcaaacagctatctcatacgttttttcttttggttacagatagccgtaaaaaagaaatatatatccatcaagttggtaaaaattggtgagttttctaattcttgattcgatcgtaatttgtgagttttctaattcgtgattcgatagtaatttgctttaaacaaaaactacggattggttgaaacaaaatcactccattttaactagtatttagtctgttgccgagagactttatgatttcgtaggctttgaactaaaagaagcagagagtcataagatgaatttgttggaggtaagtcctcggtcataaaccaagcacaagagggaacaaaatcaatattcaagttcttaatgaaattagggttaaagcttacaaaatcttagaattgtatatgtatttgttgtttaagacaggtttcattttttgttattaatatgcataattactagaaccaaaactctttttaatccagagaaaagcaaatgttcttgcaaactttctcgtaaaactgcttttcagtcttatgactcctattgatgctaccattgtttaagcttttggtcttttaaataaatacggttggtcaatctatatatttatcaaccatcgaagggtctacaaatcaacaagtcatctctgtaaatggattggctaaacctttgactactttgcaatttgcattcgattatatggttagatattccatgttatgaaactttaatttacattggtcaaataattatttgattttgggccttataattgttgcagtggtccttaatactattcatttactataattaagactagcaactgactttattttaattctgattttgttaccaagttaagcacaccatctccaaagttccaaaaaggtaaggaatttattattaagaaactaatataagcatttgattgatgcttcatgcgatcgtattctaatcatgattctaaattgtaattgattttattattgtacataattagatacgatataataattaatgtgtaaactcacttatgttaattttgaaaaattatggagtgtgtgtgttatatgtgtctataaaatttgttttcgtgttattttagggtatttcttttaaattattgaccaaaatcacttggctttgtctcaattgtgatcatgtatattagatgtgcaaaataacccttacttaaataattaactctatctctcgtggtctcatctaaatgaaccgcaaggatgctcgccgcgacatcaagtttatatcacttttcgtggagaacagctacgccacaacttcgttagccatctcgtggaagcccttaggcgaaatgcgatcaatgtgtttatagacaatgatcaagagcttagaggtgaagatatcagcattcttttgaagaggatcgagtattcttgaatctccattgttgtgttctcgagcaggtacacagaatcgaggtggtgcttgagagaggctgtgaagatcaaagactgatgtaattttaccttacttgcctttcttgcctgttggcacaatccattagtcaagtttgatagtgaaagcaatgccaatgatcatcgtcatgttacttaagtcatctcgtatcgttcgattcaaattagttgtcgtttaagtttttgaagcatatactaaaaaaacatttaagttttcagttgtcaattaataataataaaaaaaaaaggaaaatgatgatgggtgagttttataatagttacggtgaacttggtcacattggataatttgtcattgttcttgggcggaccaataaaagcctctcttttgaatcccccacacagatctatcgcctcttcttccctcgtgtctgccagaatttttgtttcccgttgataaaggttaaacctttcttcttcttcttcttgtttcgatttcaagttcttctctttcgtgacctacggtgccgtttcatattccctaatttgattgaaaagggttgcgcaagggctttgaagtgaaacacttttgattcttgttgttgcttcaagttttcatttttatcaattgggttttggagaaaacactatgagctgtgattgaattgtctagctcgaagaatcttgattttgtttacacagagaattggtttcttctttcttgatgatagtacaattggattctgaatgttgtgtagagtttttggaattgctcattggtgtatgcttttgttatgcagggtttatctttggtggatgattagtgaaactttttaaggagataatagttcacatgttttagttaaaaatg

SEQ ID NO: 34122 - DNA, 3003 bp, Unknown
  misc_feature (1)..( 3003): 2750-1469P.txt file - cDNA_ID_3074754; gDNA_ID_1620743; Annot_ID_166534
gttggggctagttgcgcgttcacatggtcaaatttcttctgatggtaatgatactaactaaatctcagatcccttttttgtctcctagttgtggcttttgttctcgtcgtgcatgtgttgatgttatctgttaatattagtgtaacatagtagggacatgtaacatgttgtatttcgatccgatgttcactctgagccatttagcagtaaaacttgtaccttttctaatggaaaaattcttgtctttcttatcctttgcagttgaaaacatttactacaaggtaggtctgcctcatcttttgtatttgttcatatactacaagctacgaattcattttatctgatcaagtttcattttcacctgaaaaaggttccttttgaagaggttcctgaccttgtagctagtcggagagtattattacagaaagggtttgcctttgtagctggtactcaggtaagtaatgctttctatttcaatttgaaacaaaacttctcttatgtagatagtagtgtctctttcgtttaactcatatttccttatgtctttgagcagttggtttcccttgttgtcacacaatttcgatctcatctatcaaaggccctcattctaacaaacaggttattctggtttatatgaatatttaaaagttcttctcatatatgtcacaccttagtaacaagattttctttttgtttgcagaaagtggacaactaccattcgagaacgagaaaaagacagactaactccagtaagcacggacctgaaatcaatcaactgcttaatttcatgtcccatgtttccttaacttatcattgctctcattcagatcgtagaagcgttatctacaagctacttgggtcctgattattctcaagtgaggattgtcctttgaaacttgtttatacatttatagaattggaatcattgaagttgttaatatgtctctacagtcaaatgagtacgctgacatatcacttaaggatattgatcaagtttccaagagttccttccccctttgtatgaggcatctatttgaaaaagtaagctgcttcatggattgcaaatcttctattcttcattaattacataaactgctcctatgcaattgtaacatgtgaacgtttcacatagcttcgagaagatcaccatctaaaacatggaggaagaatgcaactgggtctctttttgaaggtttctccttaaacactactcccttgttaagttttgttgcatttgaatgcgacgtgatgcagatagattcacatctagatttgaggctagaagtaataacatttctattggtcaaacatcatagtaaataagccaccagttctttttcatgtttttctccaatttgtacctctttgaagttgtattgccatgtagggtgtgggtctgaagttggatgacgccttagcgttttggagagaagaatttacaaaaaaggtaatttgattcgctaaagtttctcgttctcctcaccctttttccatgtttttgtgtgtgctagcaaatttgaataactaagtaagtaatactgagctattagatgcatatttctctttccgtttttatcctcaggttggctctgagagatttgataaagagtatgcgtatgccattcgccataactatgggaaggaaggcaagagaacagtaagtacctaactgtcctttctaggccatttttttccagagttctcatctcttatttatgtcattgaaagtggcaatgatcagcttctgataccaaattcacattgcaatttcaggattataccccttatgcttgttcaaagatcatcacatctgctcctggtgctggggatcatcacggctgcccttatcgacatttcaggtcagttttctcagcaaaaatatgttctctttccctgaaagaaaagggtaaccgttatatattattattcaaatagtatctcttatccatcaccaacatctcatatcaacacaaccagcggctgaaaataatggagtttttgtatatattttgattagtgaacataagaagatcatctttatagagacagaaactccttccttggaattatatatataattatgtgtgcaaaagcgaatccgagcgcattgtagcttgcttcatttgctcagcagaagttgttgcctttggcctttgtctagctataaagagaaacaataattacatatgtgtagatgtgtgaatgattaggtgaatcccaaagtaatgtttctgatacattctgctgctttgatgacagtgaggataacctgaaagcagcacttagtagaatgggattgagttctcgtggtatggaagacgtaatggataaagtgcggaacagacattatcaggtgattaatcttaactaagacctcaaatctttttggcgattgtagcaataactaacatgctcttcttcatatgcatttatatggtaaagctcgcatgcaccttaacctttgaagctgtttatggtacatcatgtgatactggtatcaaccatcccaaccaatactttgaagaaagtcagaagattctgaaatccaagactccagctgctccggtttaatctccttatggtttcaatgtaatccgtgacataatattaaaaatttaaatctttaagttgatgccaaacctgtttgatgatagtaccatgtttttaaaagccaagcatacctatatcaagaaaaaaaaacattacgcatatgttaggcatatgcttccttttgttccaatattgtcatgttgtgcgagtttaaatcatgaacatgtttctttaactattcaaagaaatcaatgaaactgaagtgaatctcttactcacactatgactgacacatctatcctcgtgactttttaataaaatattcaactgtatgatataagatttgaccacaagccattgttattgtagttattatggttgttgttgctactactatcttagatgtacatttttgaagtggacaatgtgagtgaaggtgaatatgaagagatg

SEQ ID NO: 34123 - DNA, 3003 bp, Unknown; identical to SEQ ID NO: 20480
  misc_feature (1)..( 3003): 2750-1469P.txt file - cDNA_ID_3074762; gDNA_ID_1620743; Annot_ID_166532

SEQ ID NO: 34124 - DNA, 3000 bp, Unknown
  misc_feature (1)..( 3000): 2750-1469P.txt file - cDNA_ID_3074766; gDNA_ID_1620743; Annot_ID_166531
tttatgatatctgaattaaccagtgccctagagttcacaataatgtatatgttcgctctacgggacagtcaaacacaaaaaaaagcagcacaaacctgagaaccaggctttggagtgttgcacttcctcatgttacatacagttctgaatgagaagtttacattaccacaattcggacatgtccaatcattatcgcgagttgaatctgtaaaagaacacaacagaatatatcaagttgactatcactataaaataaaggccagctttacagctgacatgttctagaatgggaaaaggcctaactcttctagcacatacctctcttttgtgatttttcatctgggtaaaaccttggtcttggcatctgcaaagaagcgcgcatatattgtgaaaagatttcagctcatgttacaaatccaaggacttataagatcttgcatgtgatcaaaaccaagcatcttactgttttacataccatggcagcggcagaaccaggacccattgccataccaaggccatacctgtctattggtggaggcattccatacataccacctgacaaaagaagaaacccaacaatgcaccagccaaattagatacaggtacaatgatggtaaatggaagacttgacacctattgggaaatagccagacaccaaaaactgattaaaaatacataccacttcccatcatagatccgccatggtatggtggtggtccagacatatgtaatggtctgtaatgagctccggcaggcattcggctattatagttaaaatggtaaggcgaacccccagaaaatgggacgtcataaggaggcatagacgatccattaaagagaggagatccatatggtgacccgcccatatatactggagggggacccccagatcctaagtatgccccgggtgatgagaaaccttgttgatgttgcataggtttgggagcagacttctgttacagacgtgcaacaaataggtcatcaaaaactaagtagataattgtttaaactgaatacccactggtaatcttcgtattgctgctcttgttggaagataacaaacaaatgggttctagatttgaaagaatctcttctatttccttaaacaaaatctaagtacaaaagccaatagactggacaaagcactaaggctaatcttccacttcattccttattttcataacaaacacctgaaaatcctaatcaaaactactcaccatcctaagtctctatacatgtttgcctcaaagagctctatctactaaacccgccaagaagtcaatgactgttttgcacacaaaactgtttcaaagcagaaagacatatattcgatattgcaacacaaaataacttactccattatgatctgcaggtctaggctgagtgcaattacgcatattgcaagttgtcctgaatgaaaagttgacattgccacaacttgggcagatccaatcatcttctctacgcccccctatccacgaccaaaagaataaaccaaacaactattcatattggtagtctaaaatcaaaaaccctttataaacatatacgctgaaagaaactgactatagactcaatataaccgaaataacacaacattgccaatgttacacaggataaaattttccactactaaaagcatgcaagacattggaaacaatgtacacacagaaacactatcttcgggtatatatggattcaaaggtaagaaatgtcataccgtcagttctagcacgcttggctgctgatgaatttctgttgtctacctaaaaatccagaggaaatataagtcaagaactacactaatcaaaaccagatcaaacgatacgaggaaggatctacaaaactgattaagaaattgaatgattcgatactgttctagtaattgtaaccatagaatcaatcacaaagcaaagctccggtgacgattcagtgtcagatctgcgatattcactataagacgggaacaaggaatatagtgggcagtgttgttacctgtgacatagctgtggaatagtctgattagtagcgagataaccggagaaggaggcggtgcggtggctagacgtcactcggcgatttcacctgtgccctaggatttagttcgacggtaggagaaataggaggtgaaattagctcaagatgtttttatattttaacgagaaaaataaaaatgaaaatatactaatttactctcatatgaaaaaaaaaaaaaaaaaactttaaaccaagaagatttattggtttttaaagagctaaaaaaaaaactctttaatgtttttgacccaaaaataaatggactttaattttattcaatcttgaacttccaaaactctattaaaaatttaaaattgtgttgattgttttgtgattttttaaaaaaaaaataatcatctaacctacatcaaatgaatatattattttggtcagctatatgtaatcatgtctagagttaaaatcaaattcaagattgaaagttccaatcacagacaatatagaaaaacagcagacaaaaattttaaagagattttccagaactttgaataaatttgattcttaagagtttgtatatttttataaaaagtcaaataatatttcttgtcttctgcctatttttcgtaatacaaaattttttatattttgttgtctatattgtagatttgtaggatggaaatcggataacatatagaaattatacatcttataaacacattagttaataaatagtatacatcatgaggtatgtttttgcttttaaagaaagcctccttatactttcattgtggcaaatgtgatttgtgtaatactgtttgtcatatatgataatctcttttgtacttgctgttaattaaacttttttgctttatatataggtgcgaatatgataataagagtaaactcaccttgtaataccattagttgattaccataaagtaatatgaatacagttcgtcaatcagcaaggctaaggtaattcgatctctattcaagcatgggatg

SEQ ID NO: 34125 - DNA, 3000 bp, Unknown; identical to SEQ ID NO: 4902
  misc_feature (1)..( 3000): 2750-1469P.txt file - cDNA_ID_3074810; gDNA_ID_1620744; Annot_ID_166577

SEQ ID NO: 34126 - DNA, 3000 bp, Unknown
  misc_feature (1)..( 3000): 2750-1469P.txt file - cDNA_ID_3074838; gDNA_ID_1620745; Annot_ID_166636
atcaggtatgcagaggggaaagtagagtttaagggagatcctgcttatgtaagagctgcgtgtgaggctagtttaatgcgagtagatgttgcctgcattgatctctattatcagcatcgaattgatactcgtgtccctatcgaaatcactgtaagcactcttcttgtcaatcttccttcatggttttgcaactttcaaatgaaatggaagttatatagttcctctcacttctcagtgagcttcacacatgtggctagagacatgttgggactaatatagagtcgaagagtttagctttcagaactatgttttctgcttgggtcactctttctgaaattactagcttattcatgaagaaccattgtctggtgaaatgatcttatcatctcccttagaatttttcgtttgaatagactcctttaggtttgactctgagctcacacttcatgacctatattgaaagccagcaactttagctgaacttgacaatctcttttgtctgtcaatttcaaagattggagagctgaagaagctagttgaagaaggtaaaataaagtatatcggtttgtctgaagcttcagcttcaactatcagaagagcacatgctgttcacccgataaccgctctgcaaatagaatggtccttatggtcgagagacgtggaagaagatataattccaacctgcaggtaaccagatttcatttcatcctcattcttgatgcactatctattaaatatgtaacatcttctctctctttcttcagggaacttgggattggaattgttgcttacagtcctctgggacgaggtttctttgcttcaggacccaagcttgttgagaacctagacaataatgacgtcagaaaggcaagtacacaggctttatatgacttgtttgattgatgaactgttggtaatcaactcactgtttatctgttcaattctgtttcttatcgcagactctaccaagattccaacaggaaaacttagaccacaacaagattctctttgagaaggtttctgcaatgtctgagaagaaaggatgcactcctgcacaactagcccttgcatgggttcatcaccagggagatgatgtttgccccatcccaggaaccactaagattgaaaacctcaaccagaacattggagctttatcagtgaaacttactcccgaagagatgtctgagctcgaatcccttgcacaaccaggttttgtgaaaggagaaagatccattagcatcctgaccacgttcaaaaactctgagactccaccattgtcttcttggaaagccgcttaaaatcgtctgagtttctctgattgttgtggggttcatgtcatttaagtggtctaagttatgtcagctagatcaaggtaataaaagtgctgtgtcttcgagagtggattatggtaggttcattcccagggaaagccaaaactatcaagggttgatgcctttaagagtaaataatgtatagagttccccaagtgagaacttcaatttacatttcatacattttgaccaaactctataaagaaagttatgtttagactttttttttgctaaaaatgttaattttcattatatgaataagaggcttttacaaaaacgaaaggcctatacaagagtagccgaggcaaaaaataaaacaaggctacaatagagatttagggaagatataaggttagcgaatccaaagcaccatgaggttgcgccatctctttctgtggtaacgagaggagatgatgttacgaatctcgcggtcgacaatcttgaagatgataataggagcgatcctaagattgttatggaggacattgttgcgctgacgccaaatgttgtagatgatagcatgggctgagacttttctgaggagggaaggcgccgaagaagaggaagaacgcatccaagagaggagctctgcccaagagcaaaacagcctctgacgcggacataagcgagaaaacgctaatctccaaacttgagccgcaaattcacaggaaaaaaggagatggtctctggattcagtctcaatagtgcataagcaacaatcgaaagactggatatggccccaagaggctagcctttgacgagttgggagtctatccaactgactaatccacatgttgaaggcatgcttaggaacagcacccttgaaccaaacagcctttgcccagtccaattccggtgctcttggtctaatagcatcccaagtccttgccgaagagaaaccttgacaaacaacaccaccaacaacccaatcaaaggagtcttcaattgtagcaggagagggggtcgtgatggtagagatgtggtcatggatggcttgagctggagcagaccgagaaagggggagcttccagccattaaccccaagagcctcaaccaccctagcgttaagagggatgcgaagtgatctggagccataatcacccataacctttatcagcgggccaagggaagtccaactgtcatgccagaagtgagctatgcggccattacccaagttgcatttaacaaattgctccgccaaaggtctaaggaacaagagcatacgccaagaccaaggatctgatggggaaggagccacatcccaaaaagacctgcttctaagatgtttagactactgatacaaacttaaataacccaactctatatcgtcaaaaaagactatctatatcgtcacccaactctatgaaggatatgtgcgactaattgtatcggttccttctctttcgttcttgaattttttttttttggaggtttatagtttctcacaagtgagacatgttatttattattattttattttttcccccgaccaaatcacaagtgagacatgtaccaaccagacaaaagcgaccacacggctttttcttcatcatcacattcacaccatcaccaccaacaacaacaactccactaaaaaattcatagctctacaagagtcacctcatagagaagtgaagagacagagatagttgtgacagagagattcatg

SEQ ID NO: 34127 - DNA, 3000 bp, Unknown; identical to SEQ ID NO: 4925
  misc_feature (1)..( 3000): 2750-1469P.txt file - cDNA_ID_3074850; gDNA_ID_1620745; Annot_ID_49700

SEQ ID NO: 34128 - DNA, 3000 bp, Unknown; identical to SEQ ID NO: 4915
  misc_feature (1)..( 3000): 2750-1469P.txt file - cDNA_ID_3074850; gDNA_ID_1620745; Annot_ID_166628

SEQ ID NO: 34129 - DNA, 3000 bp, Unknown; identical to SEQ ID NO: 4916
  misc_feature (1)..( 3000): 2750-1469P.txt file - cDNA_ID_3074861; gDNA_ID_1620745; Annot_ID_166624

SEQ ID NO: 34130 - DNA, 3000 bp, Unknown
  misc_feature (1)..( 3000): 2750-1469P.txt file - cDNA_ID_3074865; gDNA_ID_1620745; Annot_ID_166623
gatcgctgtgagcctgtgataatgatttcttttaggtttgtaggatctgaaggaagctacggtttatttttttttatgggcaatctctaacaggtacaaatcttctcttagcttctctcttacaagatctttaggttatgtcttgttctttggagttgctatctttcttccatgttccagaggtttgccttattttatcacttttgacataataatttattttgcctgttttttgttacttggtttaatattcagatgaatctttgaccatgatctctaaatttggttcctaggcaagatcaaagaaagttcatcacataggagttgatcatgaaccatagtttcctcaaagatctcaactttgtctctagttggattgtaatctgtattgcttaggacagttaaatcttattacatcttggctcgtcatgtcaaaagctgaagatatttgagctttcatatcttacaactaattagtttcgtatgtctacaggtttcttactgtaatttttctgtttcagttctttacgggtatatatatacacataaaacggttaagctctagagaagatgttgggaggcaacaatgataaccctgtgccgcaggttctaatgaacgacagccagtttcggtatcaatcaaacacatcgttgaatcagcttcacttgcttgggacgagtaagtttctgaattttgttattcatttggtttgaatgttgttagaactttatagagctaaaagcttgttcctttgtatgtggttgcagtgagagctggttgtactattgatcctgtaaactactttgctaatgataaccttgctcctatgatgcggcttaatagcacacgcggaagggaaactgaaaacaacaatattatgcagagacagcagaagctgcagatctctttgaattataactacaacaacaataatactgttgttcaagatgaagtcccaaagcagaacttagtgtcaactggtctgagactatcttatgatgatgatgagcgcaactcttctgtaacttcagcaaatggaagcataacaactccagtctatcagtcactcggtgacaatatcagattggacctcaatagacagaacgacgagcttgatcagtttatcaaattccgggtattaattttatctacaaagcgtatgtttttgcttacatatcccatgtcgttgaaattgttctctcttggaacaggcagatcaaatggcgaaaggtgtgagagatattaaacagagacatgtcacgtcctttgtcacggccttagagaaggatgtgagtaagaagcttcaagagaaagaccatgagattgaaagcatgaacaagaagaaccgggaactcgtggataagataaaacaagtggcagtggaagctcagaactggcattacaaagcaaaatacaatgaatctgtggttaatgccttaaaggtaaatttgcaacaagtgatgtcacatggaaacgacaacaatgcagtaggaggaggagttgctgatcatcatcaaatgaaagaagggtttggggatagtgagattgatgacgaagcagcttcttacaattacttgaacatcccggggatgccaagtactgggatgagatgtaagttgtgtaacgtaaagaatgtttcggtcttgctcgtgccatgtaggcacttgagtttgtgtaaagattgtgatgtgtttactggtgtttgtcctgtttgccagtctttgaaaacttctagcgttcaggtcttcttcttctgagttgtcttcatactcttgaaaagtaaatggtggatgaacatatttgtatgtgatggtggtgatgaatgaaaacttggtcgagtctttctttgcttttgccattaaacctatatagcatgattctgctatttcgtagttattaagcagccgttctttgaacacgagataataattgagttccgtgtcgtgtgcgatatgtcaagctgtggattacattgttagaagaaattattaaacttgttttggctgatttttttcttcttaatatttttgctgcaaaacttgtttcccaagtaaggttatttatgtactaaaacaatatttttttaatgtaaaggattttgatcaatatttccgttagaaaaatactaataaagttgatattaatatacatcatattacgtttgcaaaaataaaaaagacgcagttaatttccccatctgaatattaatttttggcattaatattaatttggtttaattataaattatgtcaacattgtttaatttgtaaatcatgcaaatctagtttacttgtagtagtttgtaccaaccaaaccctcaaaggctcgaaagtaatgggccttaaaggcccacctttctacttgtatttaaaattggtcaaagacacgtgaacctcacgtgattttatcttccaacgagggagcttctgttatccacttcatcattcacgtctcttccgcaaaacccaacattcaaattcttgtctgaataacgaaatcccaacatttgcattgcatagattccttcacaaatcctctgattctgattctggtcactcaattttgcctgtttattggcataattcgggcacttttctctcagtttttgtataaggttcaatgagtttgttctgtacttctgtgtgcgttatcttctccaaattaagattccagattcgtgggttcatgaaaatctcgttgtagacgagccaagttgaaatatttttcctcaagtgaattttgttatgatcacgtcgtggttttgatctgactccacttccgtcgctaactctcttcgaaagattcgtgttaaaaaaggtaaagttccaaacttcatactttttttacttcatcttactcattttccattgtctctgattcatgccagaacaaagattttagttatagggttccagaatctcggactttaactcggaagtagtgttcttcctctgttaactgaaattctttcttttgttttatgcagaaacctgaaaatg

SEQ ID NO: 34131 - DNA, 3000 bp, Unknown
  misc_feature (1)..( 3000): 2750-1469P.txt file - cDNA_ID_3074909; gDNA_ID_1620746; Annot_ID_166683
atttacattaccaaataataatttatgagatataagattgttatttctatattgcgtgtatgatttctaacaaattcgtaaaagaacctgtaatcaaaaaaacagtcgaatgttttataaaataaaatgctatgtttttattttaagcaatcctaatattttaatatgtaaaaatgaactatatattgcattcatatggttaaaaatgataaatatatatatatatatatatatgtatatatatatatatataatgtagaaaaacaagagcatacccattagatgtatcaaacgtgagtcctacggtatattttgcttcctcgagagccaattgaaacctccggatctcggcagctggacgtgtcttgtcgtcttttacgcagagttccgatggcttgacatcgcaaaatatagggatgactcttttcttgttcttcacgagcaatgcgagttcatggagacagaagtaagagtcacagtaacgaggagagaaaaccgcaataccaaccccgcatgctttgattgccatgtcgatctcgacaaaaagcctgtctccaggctttaaactcttactatccaagaaagcagtcaaacgttgtctagtgaaacaatcatatagtaggcctgaaatagtcttcttggtatcgatcccacgatgattgatgaaaatatcacatgggtttgggtaaggtagggttggatttgcaatgtatcttgttgtgtatgcgatttttgagcaaggtgttaacaaacgttgcatcgaagagttttgaatagacgaggaagaaatgaaatgattgaattaagcgaaagagtgatttagagatgaagactggttttgatatatttttgataattgcttttagtattgtggaagaagaaatgattttagattagtaagaaatagatatgtgtctctatatttataagtgatcgttttacgcttatagttagctatggtttgtgtctttgtgaataaggtccgagaactccatgtcggatcttggatattttgccactttgtttttgtaaatattcataaaaattgtgattcttctcgcgctaatactcaaggaagaattcaaacttctttttctaacatttggacttcaagaaaatactagtgtctatttgaaaatacttcaagaaacgagtgaatttattcttatctttgacttgcaagcatttttgtcttttctcgtgtggtttgaagaaaagattaaaaaaaaaccttcaaagacgtacatatacttttgaatcaaaaaatatttgttagttatatttgcgtcaaaaagtattcgctacttttcctttgttcttttttatactaaaccccgttgaaagaagtaagtaaaagtgtaaacatctttgaaacggtcaccatctcaaaaagtaacatagtaaaagcaaagagaaatgaccaactgtatctagaataaagatattaaatcaaaatacaaattcatcaataaaattaaatttcatattaactcagatattaaatttaaatagacacaccaatttcttaggaagatatatgttttgatgttttcagtttagtcaacagcttatatataaataaaacggtttaaaaaaagttataaaaaggtggtacaacgtaacataactaaccagtccgctttgatatgttttgatgtttatatttatttaatctttaatggccatttgtattatatcgtagtttttactctcgttaattttataagtgaaatactaaactattttgttcgtacagaaaaaaaagagacgaaatatatatagaattaatgttcgagatgtcggggctgggctgggctgggagtggacagtaatctgaaccacaaccgtgtgtaatactaatatatgagtctcctcgaatcctctcatggaacagttggaagaagaagaatttggagagtttgctaacatagtgtcaaaaagaattgtcacaactcacaagaatgaagagggggaagaagaagaaatttctcaaaaatttagccattagaggcctaaaatcctagcctagtccatatctcagaagcaaatcctcaattctatcacccaaactcttaaagttaggcttcaaaggaatttagatgaaaggatcatgggccttaccttttgagtcttagcatcgcatgcatgcctatggccgggcctactactataggatgaggtccactagattcaatctatatcaaggtgagccagtctttttataccacgtcctagtgatgtccaccgaaatgtaacaaaacatcctagcagaccccatgacctcatatctcctgactcctgataaagtcacctcaccatatctcttgaacaatgtccttcgacgacgaagaatcttcgtacacctcgtgtagttccatgcaacgagtcgatcgattcctaaaaacatcatcagtaatttgaaactcttgattattgataatattactaacttggaaaattatgctagtacccaaagtttatacatgtatatatatatatatatatatatatataactactacagtcgactatttggattttctttgtattaattatcttcatagtttactagagttcaattgcgaacgaaaaacacattttggtaacacgataattttttaaaatatatttatagagaattcccacatttctagtttttataaaatcttacacaaaaaccaaaatgaggtatgtgcgtgatgtgtagcataagaaaggcatgacataaggcagttcgaaaaaaccctgccttttctccaaaatttaatgcccattggccgctaattttgggccctacgattagccacgtgtaatttcctcgtcgagggacccagttcggtactcatatgctcacacaaacctaacacctatttcttctcgcatcttatatgaaacacattcactctccaaaataatctatacttttcctacatattctcttgacgatcatgagactgatttcgtgaaaatatcgtcattatatcaaattagaagttgatg

SEQ ID NO: 34132 - DNA, 3000 bp, Unknown
  misc_feature (1)..( 3000): 2750-1469P.txt file - cDNA_ID_3074915; gDNA_ID_1620746; Annot_ID_166677
cgactgagactcacttactccactctcaacatcatttacagcttcttctttattaggaaagaactcaaacgcgaaattctgaacagaattgggggtatggtctgacaaggatgtaccacttgtattgtagcaatcttgtgcagaagagacatagttatccgcactgtcactgagggaattggaattattaaaaaaaacagacatggcagacgaattatgattggctcccaaccccactccgtatccagtcacgttgtcaaaatatggagtcaacatagctgcaatttgatgtaacaaaaaatgaggaatatggaaattagcaacagatagattagtgtcaaacttttaaaaaaaaaaataacctgacatttagtagataaggtgcatacatttggaatcgattatcttatcatcctgcttggaaacagtgtcaacgtcacaattcacaggattgaaggccatcatattgccatcaggatcagagaaactagacgatatactacaactagtcatctcagattgagatactccacatgtttccacaggctgctcaccctgacttaacgaaaaccaatctttaagacttgcagagcaagtatgagcaggtgaaggactcagcccggcttccattttcacatgttcatcaaatgaacctggcacaacaaaaaaaatccaagcgatgttaatacgatgtacctcaaacagctcaataaatactaaatgactatgtaacaaggcaccctttccaacaactactaaccatttagcaactgtgaatccttgagctcgtcagcagatgaaccaactggtgataagttttcttggctaccctaaaagtagtcactctcaatgttagtttcttctctatcgaaaaaaatagtcaattagagattagtgtagctacagaattgtgaaatcacacatacataaactttataacaaaatacaaatccaaacatctttgtagcagcattcaaataatgcaatgaaattcagctaaatcaaaacgatgaaattgaagttagagaagcgtgtaatcaaaattctcaagctaccacaaaagccgagaaaactacctcagcagaatcaggcttctcatctagaatccgataaagcgtttcgatgtcaatagtctcgtcatcatcttcaaactcaaaaccaccatcacaatcatcaaccggaaattcacctcccagaccaaacattgaaccttcctcacccatcaaaaatcacaaaaaaaaaaaaaaaaaactaacccgagaaagaacgagaagaggaacaaaccctaaatcagaaaacccaaaagtcacggaatttcagctcccgggaaacccaaatcgaaattcagaagtagacgcgtagatccagagattgtagaattttcaggtacgacgaagaagaaggcttgagaattgggttttgaaggaattttcgaggaaaggtagagagcagttgggatagagaaaataaaaatcgcgactttttgtagcgacggtggcttctttttattgccttgttctctcttttggctttctccgaattggaaaaagtaaacaccacaaggctatgggacttccggctttaaataaggaacggtcgaacatttgtttttctttttctttcatttttttccattttttcattatttaataatgcatgattatatataattatattttatgcgccgtcatctttattgttaaagcaaaatcacaatttaaacaaaaggaaacaactttaattagtagtaggaaactgaagtgtttaagtaatggagatttttttgaagtgtttgctaatcataatttattgtaaaaattatttttaattgtgtgaaaattagattttctacactaacaaaaaaatttcatatgttaaagaaaacaaatatgaaactaaatcacaaagatcaattggaattagacatgtggatcgactcattagaaaaataatcatctcaatcaataagaagagataaaacatatatttgactaaatgatcttaccaatcttgtggtcataaaattctacaaagcactatattgctaatttctacaaagcacatttgtaatcttctgaatcatttgttagccctaaaagaagactagtattatacgagatcaccatttttatgattgatcaaatatcttgtagagcgcaaaactttgtaggtagtttgatgagaaagagcttgcttattatgtgatcaacaattccgttcttgccatgtctcaaagtagttgcttgccatattaattgatatgaagagcctttgattttgcagagataggaattgccaaaagaaaccatatgaggattgactcgagaagttttagtgtaacttcttcactaagtccttccaaaccagttgggaaaaataatattaaagaataagtggtccattgattcttagtcggtcaactagctagaagacctcaaattctgcaatcgatcctttgtcttattgtggttccacacaaacaaccatgtgcaaagaacaaaacatgttttgggactttagtttgaagatgcaattaaacatattgttagattgttgaccaagaaaaaacatattgttgagattgaaagatatattttgcatcggactgcaaaatgtttatgtcacatatttgttacctaatagttgattttaatagagtataatagagtatcagttattggttttaaattgtgtatcaaattccaaataatatagagatttttaacatcagtcttatttaattatgattttaaccaagtgtcgttagctcaattggtaaagaccttatgcaaagcttagaggtcgccggttcgagtgacgcttgggacgaaactaatattttatgctgtggtttcaggcctgggggattacggactttgacccacaacctccaagatttaaaaaaaaaaataaaaaaaaattatgattttaaatcgaaattttgttcttcaaaggtaaaatagtttaaaaatctttgggtattaaaatcatttggaaatg

SEQ ID NO: 34133 - DNA, 3000 bp, Unknown; identical to SEQ ID NO: 4938
  misc_feature (1)..( 3000): 2750-1469P.txt file - cDNA_ID_3074922; gDNA_ID_1620746; Annot_ID_166672

SEQ ID NO: 34134 - DNA, 3000 bp, Unknown; identical to SEQ ID NO: 4937
  misc_feature (1)..( 3000): 2750-1469P.txt file - cDNA_ID_3074926; gDNA_ID_1620746; Annot_ID_166670

SEQ ID NO: 34135 - DNA, 3000 bp, Unknown
  misc_feature (1)..( 3000): 2750-1469P.txt file - cDNA_ID_3074930; gDNA_ID_1620746; Annot_ID_166667
ctatgatgacgagtctacagccattcaagcacttcaattcaaaactaacataaagacttctgagctgctaggatatgaaaagggtaagaagttttcacttgcagacaagggaaagaaaattattgggtttcatggatatgctgagaagaacctcatttctcttggagcatatttcacaacagtttctgttactaaatcggtatgtcacggtagtaagataatcgagtcttgggatgatggtgtttttgacggcataagaaaggtgtatgttagttattctatcaatcatgtagcgtgtatcacgtttgagtacatcagtaatcactcagttgtgaagcgtcagcacgggaataacacatcattagtagaagaggtcagattccttgatagcttatacttgttgattatatacttcttgttcttgacttgtatctaaaataagaagtttaatacagtttgagttaaactatcccaatgaatttatcacatctgtggatggtactttcaaaaactctggcatgaggaaagtgatgtgcgttacgtctttggttttcaaaacatcaaaagggagaatttctccgacatatggaagcgtgactgggactaaatttgtgttggagaccaaagattgtgctctagctgggttccatggatggacttttcttggttttcttactgctattggtgcatatttttctctgctgccttgtcctcctaatgcggagaaactagaagcacgaggttatgatcgaggagctttttgggatgatggtgtttacgatggtgttagaaagatatatgtaggacaatgtgaaaatggtatcgcattcctcaagttcgtttacgacaaggacactcggatggttattggagacgatcatggaaacaaaacaccacttgaagtcaaagaggtaattctaattatcaaacttgttcttacatttatctttgggaacatattagcttaatatttttgttgatctggcacagttggaccttgagtatcctggtgaatatgtcacagcggtggagggctgttacaataaaggaattgagggtgacgtggaatctataaccatgcttaagtttaagactaacaaacgaacatctatatcctttggattcgaatctagttcaagctttctactcgagaaagaaggcttcaaaatcgttgggttccatggaaaagcaagtaacatgattcatcagcttggggttcatgtcattcccatcacccactgatcatcttaatactatatccttaatctctcatgtaataagaatcatcctagtttttattttgttttttctctttttatatcaacaacatgcaaacgtaatttgctgcaagtccttgttaaacatcacataaaaattattttttaaaaataactactcaattataaaaaacatttgtctaaataaattgatagcattaaacattaatttcctgaattgtctaacatccaataaaagcagtatttttcaatccaataacaagccaagctggtttactccggtttaacgtttagcatctttgagagctaacaaactttaaacaaatctgaaaaacaaaagccaatacgaatctagttagtgccaataagtcatgttctagttgaacaacccaagaagtagaaaactttttggagctttggatttggagttgcttcaagagcaaaccagacacacttatatgttctgtttcttattgaaagttgttgtaaactaaaataattaaggaaacgcaaaacatggtaatcaaaaatacattttttattttcttataaacaaatacaccacacattactaaacttattttttaaaaaatcattcctccaattctcgtatttggtcgcagaatccaacttaataaacaattaaattaattattactattatatttaggaagagaaagacagagatagattcagcagatgacacgaatcactccaccatagcttcttctctcttttttgttttcttctgattccgcgtagaacatttgttgttgggtttggtttcgattgattcttgaaattggttttggtaaaaaatctcacctttaaagtgtaaacactttactttctctcaaaagtaccacttaccatctgggttttgcttcattaaccattacagtgactctgcaatctttcaagttttcagatatcttctctttaaggtttgtgtctgtttttttatcttttcttcttactcagtttcttttatgttgtctatgctttaattaaagattacctcttagaaatttatcgcaccgccattaatttttcattgtaatttgttgaacagttcgtgaccagatttcttcctaaatataagctttaaatgactaatttttgttgttgttaattaatgtcttaaccaaagcaactttttttctttttaatttcatatcattagtatttagagtttatttactttccctagatctggagaaagataacaaaactccaagaaaattttaatgaattgtttctattcgtttatttatacgaatccttagccgtttcgctttcaacagtggcccagattgtgttcgtctgtgtctgtgagagtgagtaaaactctgtaagaagccatctttgtgtgtctctttaagctttttatcttcttataatctcattgttccagaaaagatatctcatctttgtagaacagatttattagaatacatgctaaaaaagtttcgatttttatttggtatgtggagcctctgatttttgtgttcttttgtagatttttcgaaaagatacattcttgcatgtgcgtagatcagccttgtatagaactgagattttggtgaagctttgttgaattggtttctttgttctttctgttcttgtgaagggaacaacacaaagacggtggctttggtgagtttttcagatagtggaaattttgaaatgtctttgtgtttgtatgggaattgatgaatattgctttgtgtgtggttttttgtagctcggtaaatagattatg

SEQ ID NO: 34136 - DNA, 3000 bp, Unknown; identical to SEQ ID NO: 4934
  misc_feature (1)..( 3000): 2750-1469P.txt file - cDNA_ID_3074934; gDNA_ID_1620746; Annot_ID_166666

SEQ ID NO: 34137 - DNA, 3003 bp, Unknown
  misc_feature (1)..( 3003): 2750-1469P.txt file - cDNA_ID_3074947; gDNA_ID_1620748; Annot_ID_49751
tgatagaaaagtttggtctcgttcaatatgtaagtcaagtgattcggctcttcttgcaacctaattattgcatgtttttgagtttttgtgataattgtgtcagatgatcctcaaaaccttttgtgccttcttgacatttttgttggagcttcttggtgtctatggtgatggtgaattcaaatggtattacgggtatgtgaattaactattatatcatagtatttgttatttcatcagatggaaagacaggtgatgagtctttgattctgtagatatccatacatagtggtggtgctaaacttcagccaaatgtgggctctgttttgcttggttcagttctataatgtcactcatgaacggcttaaagaaataaaaccgttggctaagttcattagctttaaggctatcgtgtttgcgacttggtggcaaggcttcggtatcgcgttgctttgttattacggtatacttccaaaagaaggtcgattccaaaacgggctgcaagatttcctcatttgcattgaggtaacttaaaagctctttcccaagtgccactcgaactagcgatctctattctatatgagctctttccaaacataattatgtttctaaggattctactacttcttggggtgtacactggcagatggcgattgcagcggtggctcatctctttgtttttccagctgaaccttaccactacattccggtatcagagtgcggtaaaatcacagccgaaacgagcaagacggaagtgaaactagaagaaggtggtcttgttgagaccacggagactcaggttgaagcatctggcacaagcattaaggagagtgtacaggacatagtgattgacggtggccaacatgtcgtgaaagatgtagttcttacaataaaccaagcaataggaccggtagagaagggtgtaacgaagatccaggatacgattcatcaaaaacttttggattcggacggtaaagaagaaacagaagtgaccgaagaagtgaccgttgagacttcggtgcccccaaaagagtgatcgttgaaatttgccctttgttgtgtagttttgtttcacagttttcttttaacgatttgtatcttttataaaagatagtatattagtacttgcactgatttttatttatttttacaactctcatacttatcttatattgagaagtagaacaactactctttgacttctacaataaatctatcttccgtaagcctgaaaatcttcaataaatctatcttccttaatatgcataattcacagatcaatttcgaatttggtaatacaatttcactggacttctagaaaatagaagagcttcaaagtgagaatcatatgcaaatgagctaaatatggtatacgacttcgacttattcctgcaaccgcgggagaagtcacatgcaattgccatgctataagtctcttaccaaaaacgacatttcttattaatgttatcacatgcttggactgtgataaggtctcaattattatgtttccttgttcactctccatgatattattagtcctaaatggttttctatttttatcatatagcactaatattattttgaccaatagataaatgatcatgatgtatatataatttttatatatgaccgacgcaataatttggttcgtattgctaacgttatcgtgtcacctaaaattaaatcgacataattattaatgttgttagaataattaagtttataaatatacattaagcagatgtaatggtccgttagatttggaaacacttgaacatgtcgtttgtgctttgttgaaagtatccatacgatcaaagatccataaacgatcgaacggttgatcttgatgttaaaaaaaaaaagaaaacgatcgaacggttaagaataattgccatcacattggaaactctcgacgttgatcatgaccctccgaattaaacggccttgataatggagaacgtgagaaacgtccgttcgagaacaagacaaaacaaacaagaaacgaaagcacatgtgacatgacatgattcatgaacatgattatttgattagtcagctttctttgccaaatctgaattcgacgttttacttacagacttctcttgtccaagttcctcattcgtgctccaaagttacttcatcaaattcgtatactactctctgttttttaatgctctttgctccaacatacggactcttttaggtatggttttgattttgggttctttatttattttcttcgacaaaaagatattaaactctgcggacattaatctcaactcgtcgaacattttactagattatataatggcgggagaggtccaagatccgtttaacctaagccttttggtaatttttgcaactttattgtttatttcatttccagatgatatacgttcaattcaattattattaattatgaattgaacatatataatctagggcacccagaatacttctatagtagcttgatatacacgaaacttatttccagtttatatatgcatagacgtttttcagcaagaagagtgttcctcatctttttctaaatgatttcacaatcttaaacatcttgaaagaaaaaaattcacttttgattcgttcggagctttctttattcagattagctaggagcggctgataagcctaacggttctaaaactattttgcaaaaacagtttattcgagtttaaaaaggaatcattttatttgtatgtgtgtgtagatcttttagtaactctgttttatgaaaaacagagaatgttttctattccaatagtatgatttccttttcaagtttttttatacaaacgaaaacattgtgtttgaaacaatgatatttattttgaatgggctctgcaggagaattctatacactcgggatcagtatcatttggaagattcgagaaggaatctttatcatgggagaggagatcatccttctctcgcaatatatatcttgaagaggcagagagattctctaaaccaggctctgttactcagatg

SEQ ID NO: 34138 - DNA, 3003 bp, Unknown; identical to SEQ ID NO: 34137
  misc_feature (1)..( 3003): 2750-1469P.txt file - cDNA_ID_3074947; gDNA_ID_1620748; Annot_ID_166725

SEQ ID NO: 34139 - DNA, 3000 bp, Unknown; identical to SEQ ID NO: 4955
  misc_feature (1)..( 3000): 2750-1469P.txt file - cDNA_ID_3074958; gDNA_ID_1620748; Annot_ID_166707

SEQ ID NO: 34140 - DNA, 3003 bp, Unknown; identical to SEQ ID NO: 20518
  misc_feature (1)..( 3003): 2750-1469P.txt file - cDNA_ID_3074971; gDNA_ID_1620749; Annot_ID_166765

SEQ ID NO: 34141 - DNA, 3003 bp, Unknown; identical to SEQ ID NO: 20519
  misc_feature (1)..( 3003): 2750-1469P.txt file - cDNA_ID_3074979; gDNA_ID_1620749; Annot_ID_166757

SEQ ID NO: 34142 - DNA, 3003 bp, Unknown; identical to SEQ ID NO: 20520
  misc_feature (1)..( 3003): 2750-1469P.txt file - cDNA_ID_3074983; gDNA_ID_1620749; Annot_ID_166755

SEQ ID NO: 34143 - DNA, 3003 bp, Unknown; identical to SEQ ID NO: 20521
  misc_feature (1)..( 3003): 2750-1469P.txt file - cDNA_ID_3074994; gDNA_ID_1620749; Annot_ID_166747

SEQ ID NO: 34144 - DNA, 3000 bp, Unknown; identical to SEQ ID NO: 17448
  misc_feature (1)..( 3000): 2750-1469P.txt file - cDNA_ID_3075018; gDNA_ID_1620749; Annot_ID_166737

SEQ ID NO: 34145 - DNA, 3000 bp, Unknown; identical to SEQ ID NO: 17448
  misc_feature (1)..( 3000): 2750-1469P.txt file - cDNA_ID_3075018; gDNA_ID_2926287; Annot_ID_205467

SEQ ID NO: 34146 - DNA, 3000 bp, Unknown; identical to SEQ ID NO: 31872
  misc_feature (1)..( 3000): 2750-1469P.txt file - cDNA_ID_3075050; gDNA_ID_1620751; Annot_ID_166808

SEQ ID NO: 34147 - DNA, 3003 bp, Unknown; identical to SEQ ID NO: 20527
  misc_feature (1)..( 3003): 2750-1469P.txt file - cDNA_ID_3075055; gDNA_ID_1620751; Annot_ID_166800

SEQ ID NO: 34148 - DNA, 3000 bp, Unknown; identical to SEQ ID NO: 4981
  misc_feature (1)..( 3000): 2750-1469P.txt file - cDNA_ID_3075060; gDNA_ID_1620751; Annot_ID_166798

SEQ ID NO: 34149 - DNA, 3000 bp, Unknown; identical to SEQ ID NO: 4979
  misc_feature (1)..( 3000): 2750-1469P.txt file - cDNA_ID_3075064; gDNA_ID_1620751; Annot_ID_166794

SEQ ID NO: 34150 - DNA, 3003 bp, Unknown; identical to SEQ ID NO: 20538
  misc_feature (1)..( 3003): 2750-1469P.txt file - cDNA_ID_3075064; gDNA_ID_2926183; Annot_ID_200438

SEQ ID NO: 34151 - DNA, 3000 bp, Unknown; identical to SEQ ID NO: 4988
  misc_feature (1)..( 3000): 2750-1469P.txt file - cDNA_ID_3075067; gDNA_ID_1620751; Annot_ID_166791

SEQ ID NO: 34152 - DNA, 3000 bp, Unknown; identical to SEQ ID NO: 5002
  misc_feature (1)..( 3000): 2750-1469P.txt file - cDNA_ID_3075104; gDNA_ID_1620753; Annot_ID_166837

SEQ ID NO: 34153 - DNA, 3003 bp, Unknown
  misc_feature (1)..( 3003): 2750-1469P.txt file - cDNA_ID_3075108; gDNA_ID_1620753; Annot_ID_166833
gagtactcttatatgtcgtcgtacgtactatagaaactgattgaaaatgatatcgaggaaacataatttgtcgatcggtgttggaaccttccatgcatgactccaattagagttctggaacttttggtttctcattagtcatgactctgattggacaagttctagtttttaacgactcatgactcttcacatgctccgaaagttcatcaaaacatttatcaaagttttacatgtttttgtgaacaataattatcttataaaaacatcaaaacatttatcaaagttctataagataattattgttcacaaaaacatgtaaaacatcatatcattttgtgggtttatattcaggtttaaagagtgtatatactatatatatatatatatatatatgtcataaaaactatgaaaaaagatccggcgacaaagacgaggaacgcttgtctttaggaaaataacaaaagtgatttgttttgatgatatattttcgtaaattcaaaacagaaagaatacgttatgtaagggagctaaatgagctcttaagatgcttaagaaaatggaattgtgatcgattgcgtacaaaacgtaaattcctatctaccatttctagtggtcggtttagccatagaatggccaatgtgattaagacaattgttgaaaactggtcacatgtatgttacaatttccggtactatgttcaaacagagaaaccagaatggattggttacctacgtatacatacttttaattttaaaagtttagagagcgttagatctaaacagttaatataacttaaacgtaatttggaatgtaacatcaggagtcacaaatgaaatgagtaaatagatagtataattaaataagaagcaagatttatttagtagacttaatagccagatcgattacaataggacataataactcataaatccatataggaatgaagaggtaaacattattaacctcctaaatatcctaaagcagtagccatagcaatggcagcctgagccatcattgaaaaacatgatacgatcaccaagaaacatccccatttcaacattttcacgatatttataaactcagcttaaatatgaaattattacaaaatatctttctggtttttaggtggggctgaaatgcttctagcatgatagatcaatttatagttgaaccatgcataaatgattaaatgatactatcagactcttcaaaattctttctcttctcgtaagttggaaattaataaaggacagtcaaagataaagaataaatgatttggaaattggaacattttgtcatgaaagtgcgtcgaaccaatttaggcttaagctcaaattgtatatgagcttattatagaggcccattcattttgtcaaaaagaaatttttttaaatatattttttacttcctcctctgcaaacatgtaaacgtgggacgagtagtcttacttgccgtgtaaacttaaatattggccatgtttggtccgtatcaatacaagaagtcaagaagaagacgtgttaagaaagaaattgaggaaacaaagcggtcgatgtggaaccttccgtgactccaattagggttctgaaacttttggtctctcatgcatgactccagttatcattagttcaataccaattctagttcttgacgactcaagtcaagatcattcagacggccttttaaaatctctttaacgttcgagacaaagataaaatccttttattttttcatagagaaaattgtaaaagaggataacaaaatagagagaatttgcttttaggaatttccgattgaatatgtagttggtaaagcctagttttatataattatatgtggacggaaaaagattcattatctcgcttatataaaaacataccaattaattatagtctatagtcacaattcatcatatattctagactttaaaagttgattttagaatttctgagaatcgagaggcaacaaaaaaagtctacaaatttgactaagaagaagcaggcacatccgccttgacgaagaaaacggtttggttgggaatgatggagttgaccggtagacaagtttcgtcgaagaaaacaaaaaaaaatagaaacacaaaatcgggtttaattttgcaatttcgcttcagtagaagacttgttgaattcaataacaatttagtttcgttcgacgagtgtaataacgcgttgagcattaataactatcgaggggccattaagcattaaattaccatttaattacgaattttaggggttgtttccttcatcgtagcttatcaaattacacacactcatacgttcacaccttcccatttttccaagaaaaaacttggttcatatttcttctaattcatacgttttgtgatagtattttcaacttttgttttaaagtttttcaacatgtattaccaattcaatttggtaatccaccatcatatatttatatattgctcgaaagatccggtagcagttgagtctgtctgacaaattaaaacactattcacgatttttttctacagttttactttaatcttaaaaaccaatattattacaaataaccaagtcaaagataaggtcaaccccaccagacaaaacttagttcacggcacaacaagactaagcactgaagtctttgagaggaagattttgaaaatctcgtgcaaagactaaaacatccttctttactatatatatctttcgctccactacgaaggttattttcgtaattcgacacaattccttacagagaataagcgaacagatcaacaactactctgctcttacaggcgacgacgtcaacaacaacccaaaataccaaaaaccctcaaaagtctcaaacaaaactcaaaacccaacaattaaagaaacaacatttcaatatacagatttacttccttttacagattttcctaaaaaaccgaaattgaaacaaacaaaaccaaaagacgttaccttttttccattgattcctcaattctctaaacaaatgagttaatcttccatg

SEQ ID NO: 34154 - DNA, 3003 bp, Unknown
  misc_feature (1)..( 3003): 2750-1469P.txt file - cDNA_ID_3075116; gDNA_ID_1620753; Annot_ID_166831
caacatcccgcatcgactaaaatatttagacaataattcataaataagatcaatattaataaaataaatggtttttttgcaggacgggttttgcgggacgggtttggcaggacgttacttaataacagttgtaaactataaaataaaaatattttatagatagatacaatttacaaatttttatatatactaactttaaaaaatcatttgtctccgcggtgtaccgcgggttaaaatctagtaccacttaatttcatacttaattttcaatgtgatatattgttatccttaatacataccaacatgtcgtcttccctctcatttcctctcctcaattttgtttatatagatgcgtaatctaaaatagtgtcgaagtgaactttaattattaagatctcttcattcatttgcctttttcttctcatgtttttgctttttatagatgaacaagcccttgcaacccaagcagaacaccgcaaactcaatgagtcacttacttacatatactttcgttattttatttatgttattgttttgttgattttcatggtttaatacatcatgtcatatgtatattatgctggtgttgtagaagagacgataaccatgagaaggaacttggaaggcataggcgaaaaagctcccaaattggggttattccgagcacttcacgtcatgccgagacaaaaacctctaaatagcaacgagaaagagtgtccttttatagaaagactaagtcttgtcagtgccggtccggtaaaatgtggggctaaaaattcaaaactgctaaattttgtttttgttgctaactatagggcatccataatttttatttcttaaattttcttaattttgggggtactgtttgctaattttggaatatttttgctaatttcatgattttttttgttaattatgggacttaataataatttaaaaaaacatagaaaacgtaaaaatttgagacccaatataaatgtttcaacattatgcgtaaaaggacaggccttcctaaaattagaacattttatatgatatcctcttaagtcttaagtactatcgaagccggagatttctaagttttacttttactaattaagctattgacacttgataaatgccatatttttgcattccctaaaacctcaaaactctctaaacacgtttttgtggacatattaaaatagtgtattttgtagtctcttccaggtttcttccttcttgtcaacgtcgcacaagtccgtttacggatatgggtgaataattgaatattatccatgtttccttattagcagtcgctattgtgggtttctttttggtagtctaatttattatttacttctttaaaatggggaaacagatacaaagttgcattacatatataacgcaatacaattagatcccatttgaccgagtaaacgctaagatccacacaaactcaatcgtcaactcctctctcttctctattctatatagttgcgtgaaatgtaatgaaagtgatcatcattcacttctaagatggcggtatctatagtttcttccatcattttctttcttctgtttatcatactttcacaatatgtagatggaaacggttttgctgcccaaatggaacatcgcaaactcggtgagtcttctacctgtataaatatatatatatatatatatatataaatagattacttttgagtcatgtagtcatgtactgttatattttattagttagctagttcaatatagcttatagacaaattgtttttgaaggtactaagcctaattaaaggcttgacgcgctatatgttatgtgtaacgtgcaggtggaccgaaaaaaacaatgaccatgaggagaaacttggaagaaaatgggcgccaaggctccaaaattgcaactcctgggagcacgtcacggcacagtggacaaaaaaacattgaaaaagagccgtcaaaaacaatttatggtcatcaattacgtcctgatcaaatcaaaaggggaagcccttgcaaaatctacacccgatgtaaacattcatcctcacttccacaacctcctccgcttccaagctcttctatagacacacaaggacttggtcactgatcgcactgtagcttcaaatgccaattctggatcgataaaacggtgtatattttctagtcttcttttctcgatacgactatttgtatattgatacatggaggtttatataactttggcgtgacatatgttgcctttggaatgtttaactatatattcttaagacaaagagaagctcgatgcatctgtttggctaaagctataatgaatctattccacgtacaaaaaacaacgaatgaatccctttcgaggggtttgaggaagacagatgataaacagtgttaagtccccacgtggctgagtaaactaaaacattgacatgcttgagcatgaagccaaaaatattgggatttcctatgtaatatcgcacgttcatatggttcactccttttgatagatggctgtgcgttcaggtcttggtcttttgtctctctcttacaattattaacgtatcttatcatttttgaacgtctgactattcttttcacattgtttcttcgtgtcactttcttaaaccttgtagaaatccctctccttaaagactgatcctttactgaaataaaaagaaacaccactatagtaattgtgatttttttttttttttttttgtacaatagttctcaagtcaagtgtcaattcctttattttgttatttaaaaataaaactattccgtggaaaaaaggattggacatgtaaatatggaatgaaatccacttgatcatacggatacatggtgtgcggagaccataactcaaaaccccacaacaaactaagtcctcatctcgaccaccttctctattctatataaatgcgtaaacgtgagtcggattcagacacatcacacatacaaagtaaattaggtcaattttgtgataagtgatcattaagtaacagagtgattattaagatg

SEQ ID NO: 34155 - DNA, 3003 bp, Unknown
  misc_feature (1)..( 3003): 2750-1469P.txt file - cDNA_ID_3075123; gDNA_ID_1620753; Annot_ID_166829
ttgtgccgtcggacttccacgtagcttttgctactaaagagagtcttgaagcggtcgttcatcgtcggaagagtagctacgcacttgtacttctgacctctgcgattgctctcgtcgatgatcttccatacacgaatcttgtgatcttgatgagcacttattagcttgtcgccaagaatcaccaacgatttaacccctccgtttccgttggcaactacgttacggtcatcgccggtggaatattccggtgagaacggaggttcacgaggccatacacgtatctcactgttggaagagccagtgtagagtaatttatctgagacagcgagagaagatacgtacgaggatttatctttgagcgtggctaagcaatggtgatcgacgctggagctctgatgctgaaaagacagcgaaggaaccaatggaagacttggctgagacaaaagcgatgatgacgttgaggattctgattggtgatgcgtcgatttcgtttcacattctgatcttgtttcattgcaaggcagaggacaagaacacggaagcaaacccattgttcttgaccaagctagagagagttttatgttttgtttgttttgttgttgtcgggaataatcgtggatatgctttgctttataagatgagttttcgtatcccgaggtagggaagatctggggagtttaatggagaattatatagaaaggtaaaagataattaaaagaaaattaaagtttagggtagtgtagggtgggggaactgattgacccatgtgtcgttactgtgatagtgtgatgatgtgtttgtaattaattaacatatctttgtgttcctaacttacctttttgtaattattatatttcccttataatcagttttggcttattataaagttatgtgtgttttgagttgagagatcaaacccgatgcttccaaagttatgttaaattccctttaccagggtcaaattgtaatcattatttctagttataatggtccccatcaatagtgatttccatttaaaattgttattgaatttgagtttaaataaaataatttgaactttactcctaaaaagttagtttgaactttatactttgaactcataaatttcatctcaaaattaattagtaacaaaaaaaaaagtatactattatgttcaaaaagagaaactatgcatgaatgaagaaccaatctaggaaaaataatccaaaccgtgtcttaataatctgtaaattaatgaactaatccaatcatctacactaaatacaaaaataatccaaatataatccaaaaataatactgaagtagattagtcaaaaccgatctagaaccgtcgcttctaccaggagcaccagaatcgccagtgtctcgttgttgagtggacggtggtggagatctagaaccattgaagttaggattcgcaccgtacaaatattggactccttccacgtcatcggtcgttaaatcaactttacgcctacccgtcctgatggttggatacatgatcgaaccttctaccgaggaatggcctaaccctagaagatgtccaatctcgtgaacagccaccgattctagatcaacagcctcagacacggagataaaaccgtcgcctccttcgccggagacgatccagttctcttctccgtctagatggaagtgtcccgtcgggggcgagaacgcatgtgctagcgttctcattgggccgtcgaacggttctccgtctccgtgctctccggagtagaatccgatgctgatgtcagaggtcgagaacctctccacgcgtgtgaacgttagtggagtcacctcctcccaacgagtgaaagcgcgtgagaacacgctcttgacctcttcggtcaacgcgtttcgcgggtcgaaagcgtaggttagatcacgacgatttctcggccaccgtggctctccggggaagaaagagtagtgtttaacggcgtggaagcgttgtccccgcccggcgaaggaaacctcgaaggttttcctaccgctatgcatagttgaggtgccgttgactacgtcggggttgccgcaacgtgggatcacaacgtgtttgagagtgagctcgtcgagtactccggtgacgtttagctggaagtttctctggtacatttcgacggcgttcttgagaatatcgtcgaagtcgtcagtgaagtttccggagagattagtttcggtgatgtagccaaaatgttgaaaatattgtttgagcatatagagaccatcgtacttcttgccggcgtgacatccagtgaaattcaagaatgagttccaggggttcccggtggcgtttcggagaagctgcggcggaatggctgaggagtttgtatagaaaccagcggagactggagaaggagcgaagaacaacaagaaaaccatgaaaacacaaatcctcaccatccaaaagagaaatattaaaaagattaagtgaagaggtattattgagatttacaagagaattagagagatgacatagataaaactaaacaagtttgacgttggagaaagcagaggtcatttctgcgttgcgtttggagaattttctatgttgaaaatgctgcattattcaaaggaaacttcctccgtcctcgtttcaaagggtctcacgaagaaaaagactaatgaagcttctgccaatagatagtgtcgttttatggataattaaagttgattggtggcttggtgcaatagattaggcccgatttagtcttggatgactagaaattgtgattgaccggtggtaaaggaccggttaaatgcaaagttggaaaaagaaccatgcaacaaaaatggttgaaggcggcagaatcaactaaattggttgaaagtgtttttgttttttttgggtcgttgaatgtttgaattggtcttttttctttttgtgataatttttccggaggttgttgttattggttgaaaaaatcaacgtaaaatctccaccttacacgagtaacgccatgacttgtttgttaggctatctaattttttcctgtaatg

SEQ ID NO: 34156 - DNA, 3000 bp, Unknown; identical to SEQ ID NO: 5005
  misc_feature (1)..( 3000): 2750-1469P.txt file - cDNA_ID_3075149; gDNA_ID_1620753; Annot_ID_166857

SEQ ID NO: 34157 - DNA, 3000 bp, Unknown
  misc_feature (1)..( 3000): 2750-1469P.txt file - cDNA_ID_3075165; gDNA_ID_1620754; Annot_ID_166907
cacctcaacttctccttctgtaaaggcagcacagagttggttagttttctgtattattttgatccgacattgtcaaatgcagagaaaagaggagactaggttgtctaaccgggaagacggacagccaagtttgcctgctcatccgcatcagcatttaaattctacaaagaaaaatgccaataatggcagaaacttgcattagtatctttctcacaactcacaagcatgagacgagaaatatgtgatatcattcatttacacagagagagacacacatagacatacccttagtacatgactgatctcaaaagagacacatttgttgcaaagtagttttgcttccttgtggagctttgcgagtacctcatggtttaccttccattgacctttaatctgttgtttctcagaaagtgttgagaaagtgagaagataaaagcgtatatgattcattaaacttacctagttgcacaaaaatatataacgttttaattgacgaacctgcatacagaccagcttggagtcacctttcactttaatattcttgtaacctttctcaatagcatacttcaatcctaggattaacgcatggtattctgctgcattgtttgtggcaattcccaaaccttgacgcactctacaaatctatgttgaaaattgatacttagatacatcactgcattctttaattagtaacagtgattcaaaaggatacataccaagctcccgtcctcagttttcagtaccgctgctgcgccggagagaccgggatttccctttgatgcaccgtcaaactcgataaagcaagtttcctaacacatgaggagataagagaaacagaccaacttgagcacaaaattttgcatccagtccattgaaacatgagtaacggtatatacaaacataatcacaactcacgtctgatatataagcagatggctccacctttgaaagcttttccaaaggatcataagatatagaagctgaaggaagttgatcctgcgaaaaatgaatacttaagcaacgagcttaatcgctttgtctcataatcattaaaattcagctaagcaactcaataagattccaaagaaacttgttcttatagcttacttttttgtcatcttttgacttcgtctctgaggtagtctcatcttcagatactttgactgtacaaggagctggctcctagtgaagaaatttaaagagagatagttactatttcagtttaaaatcccacatcacaaatcatggcagatgcagatattctccaagaatgcatcataggagagaagagaaatacagtgaaggccattttatgatcttacctggaaaagacatggtgtaagagcaccaaacatatcatctttcaaatctgaagctcttaaactatatagtggtttcttcaacccaacagaagagagatattcctcagtgtctttaggcaaagagtatcccttataaacactaaccggaagatcaaacacctacaccattattaagaaagctcttatattcccatcataaagagagtatctattatacacaacagactcttaaggccaaaacataattaccgaagatccaacttgagcctgacaatcactcaaatccttataaattccaataacatcacccttccgaacaacgaaaaaggcgtccttttctttatccacagccgaaacaacggttgatgataacatctttgatttaacagcctttgatcttgaggaataagaatgaacactacagattccaaacacactactcacagctacaggctttaaacatgattttgaaggcatatagaagaaacattcattccacggaatagaactgacatagcttgatctcttaagcagtcccaaggcaatgtatgaacgcgcatgagacagacagttcattacaatgtaagtcaccacacactgagatttatcacacaaaaaaaaacacacgcacaactttagataagcttcagagattcaagaacaaatgtcaaattacaaacatgaaatcaaagttgaaaagtttaacactttcgcagaattcgtaatctgggtatctatgattgaagcggataaagtgaaatttctcgacggcgaaacaaaacagaaaatgaaaaccagaggactgatgaaaatgagtaaaaaactgattagtagagtcaaattaaaatcttacgaagcacagagacgtgaatctctcgattaatttgtgagaacttgccggtgaagaaggaagacgaacccactcggtgggtttaagctgggttttggtctcaatcctcaaaagttagggtcaatgggagttttgaagtactatcaatttctaatttaggtttaagtattttgtaatgttatctatgttcagacaaggtttcgtggtgtagttggttatcacgtcagtctaacacactgaaggtctccggttcgaacccgggcgaagccatatctttcgttttttatcttatattttttataataatcaaaatgggcttttaatggacctaaaatattgacccaataaaaatgcaaatgcatgagacacgtacgtttttagtatctaaaatccatggtcattgttgttatcattgtcgacgttgacaaaaaccagtacaattgcaaaattcatcacgtgataattacggatgaaaaatatagtgagaggagttaacaaaacttttttgttcttttttgacaatgatttgaaaaatgaaaacactttttttttgggttctttttctcttttgtgtggttggtttaaagttgtgatatactgctcgtgagtcatcagcatcttctccaaacaatcagcaacgtacactacactattaacgacaagtcgagaaccaaccaaactaaagaaaaccaacaaaaggtctcaactaaaaaaaaacaaaaaacaaaataaatcaatgtgctagcttaaagatgcaaatgcaccattcaatcagagtctctcttgaagttagtcactgatgagcttaaactagacaaaaagaaaatg

SEQ ID NO: 34158 - DNA, 3003 bp, Unknown
  misc_feature (1)..( 3003): 2750-1469P.txt file - cDNA_ID_3075177; gDNA_ID_1620754; Annot_ID_166902
cctagtatatgaatatatgcaaaatggaaacctgcaagatcatttgaatggtaagtcaacaaaataagagcccaatccactaaaaccaattggcgactaaaccgcgtctttatcacaggaatcaaagaagcaaaaataagctggccaataaggctcagaattgcactaggagcagcaaaaggactcgcgtatctccattcaagttcttctgttgggattccaattgttcacagagacttcaaatccaccaacgttctactagactccaattataatgcaaaggttcttatacagttaatagaaatggagggtttatgcagcactaataccaagcatagactaaaactaagatgtgagtgtaatccttgcagatatccgactttggactagcaaagttgatgccagaaggaaaggatacttgtgtcacagcaagagttctaggaacattcggctatttcgacccagaatatacatcggtaaagattcttacttatatttcacacatgattctcttccgatagggtaaactagacactacttaagaaaaattaaaacttgctagtaatgacataaaatagcctggaaaaggaactttaatcacactcacatatcagagccaataggcaacggaggacaatttttagcataatttttgttcccttcttctgtggcagacaggtaaacttactctacaaagcgacatttatgcatttggggttgtgctgctagaactacttactggacgcagagcagttgacttaactcagggcccaaatgaacagaacctggtgctacaggtaaaatggaccttttaggttctatgattcacaaacacaaaaagttcaaagatcaggaaacttaacataggaataaactgatcaattatctctacgtttcaggttaggaatatactgaatgatagaaagaaattgcgtaaggttatagatgtcgagctgcctcggaattcatacagcatggaagctataaccatgtttgctgatctagcatcacggtgcatccgtatagagagtaaagagcgaccttcagtgatggattgtgttaaggaactgcaactaattatctacacaaactcgaagggtggtttgggtgggacgattcctacattcagaaggctctagacactgaattcttcgaaacaagtaaaatggattactgtcatttttcctaaaatgagaggtcactgataaaaaaacacttgataaatataaacaaacaatactaattatgaattaccggataatttcaattcaacttccagctaggaaactttgatcaagcgatattatttggatatatatactataatttcactaagaaaatcaagcactagatgtatccgtatagtatgttgtatttgctgctatgaatgttttgctttaagagaaatgagtacataaattcaggggtgtagtcttgttttttctttccttctttcgcctaatgcctaaagaattaaccacatgtctatgaacaagaaatacaatcgctgccaatacaggaagcagataacaaagataagagtgtgtgtggagtacctctactaagatcatataaacaataggtcgaagcaaacgggattatcaacccgacccttggtcatgtcacatttagctcctacataataaagccaatcacaatgtttgttataaattcagaaaaggttgagaagaagactaaaagctaattggtacactgatggaaaaactgtacccatgtttacacatttgcagaggaggtcagctcattatcagaccccaccatttctactataggattggtgcatagtggaagaagtttcttccgcatcaaatgcttacgccgctgtaacatcagaaggaccaaaactgtatctgtcttaacaacctcgtatcctgccttcttgtacatattgaaaggagcctcatcaaccatcctacaatgcaagtatacatcttttgatggactaatctgagatatcagttcctcactcgccttcaacaaatgccacccaattcctctccttctaagatcctctttgacagtcatgttacagatataaggtgattccttaggaggagttggagaaggaggagaagcattagcgcctcgtttctccaaacaaacctcaacagttccagccatcacagcctcctcctctccatcatcactaaactcatcaacttttttcctaaagaaaccaactaaagtaactgcgtgtggcaacacttctcttctctcaatcaaatactgcttaatcaaaaaccgtaacacagactgataaccagaaggtaataacatcgattcaccaaatgactcagccaatagatgcaccgttgaatccatctcttcatgtctcataactcgaacccacatcgatccagattcaagctcttgaaaatacgcaaatccttcaagagttttaagcttctctaactcatcgttactcaaaaacctcccggtacgaaacgattcctctagaaacgcgtaattcccggtcgatttagagttttcttctccagtttctgtagctgtcgaaactgaagaaggagggaaagcgaatctgagattggagcggtgagatttacacgagtagagtaatggatatctatgtgaagaagacgagaagccaaacttcgttgattgggttggtttgagagaatcaacagagaaagctagtgagatgcttaaagccgccattgacacacacacacacgattttctccgatttgattgtggttcagtgttcgctaatctgtttataacgaaataaaatggataaagtaacagtcatacactaatctttaaaacgccgcgttttgaactaatcatgaagctcagtagttattgggcccttatggcccatatactgatataaaaatgaggaaactgttataagccagtagctatttgggcttaaggcccatattgcgatatatatagttttaatttttccgaagttcggcgatttcagaagacggaggaggagcgaggacggccgccatg

SEQ ID NO: 34159 - DNA, 3000 bp, Unknown
  misc_feature (1)..( 3000): 2750-1469P.txt file - cDNA_ID_3075181; gDNA_ID_1620754; Annot_ID_166898
tcaactttgctagtccaaagtcggatatctgcaaggattacactcacatcttagttttagtctatgcttggtattagtgctgcataaaccctccatttctattaactgtataagaacctttgcattataattggagtctagtagaacgttggtggatttgaagtctctgtgaacaattggaatcccaacagaagaacttgaatggagatacgcgagtccttttgctgctcctagtgcaattctgagccttattggccagcttatttttgcttctttgattcctgtgataaagacgcggtttagtcgccaattggttttagtggattgggctcttattttgttgacttaccattcaaatgatcttgcaggtttccattttgcatatattcatatactaggaaccggtgtttcccatctgcacaatagccgatcaaagagaccagatttgggtggtcgagtctgctcaagatatccacctccacacgaaattctctttctccgtcagcctttttaaacgtaggtaaatccatcttcttgattgcaacaaccttcaaataacaagggattaagatatgtatcctactctaatagctcctcttcgatagaaaagtttttgtaacattacaaagcctgtaaatcacataaatgaagctatatagttcctacctctcctgtttttaaagtgccttggtaaactcggccaaagcctcctttaccgaggagattctcatcactgaaagaacttgtggcctcctccatctccttgagggtataaactgatgacccgaatcttcgcttccttggctgagaagcctgatcttcgatttgccagcattctgctgttctgtagacccctgagaagaaggttagtttcaaacagatggtgattcagttttacctaaaccctttatattcagtagtagtaatgtcgaaaaacaaaaacagtaacatacttttatgccatctggcgaagatgatggagaaaaggaacgtacatggatccgtatcatatgatttgcttctccttctcttgttccaagccgaaacaagtggaaaatgcatagctttagtttggatttggttttttcttatcctttgtagaccattacaaagccgatagaagaagcttctggtctcgtccttaagacagaagggtatgtgtctttctagtcgtgaagatgttctttgtagttagttgcttccaaagaaacagaagattgttgtggttgaagatgataaatatagagtgcaataaagttaattgattttgagggttaggtttctgaaatactcaacagcagtatttcaactaccgaaagttcaagagagagagaaagagacggtagagctgaagaatacgtagattacatgtacgtgaagcaaaagaaattgagagccatcttgagaaagtaaagacttgatgtttccttaacttttctaagctcaaattctcggtttggttctcttgtctgaatctatctccttctaaccagtttgtgtacgtacgtatctctgtcgatcaaatagagatgggaagctgctttcagagtgtttccttacccttttcgtctcaacttttttctctagacttctatattactatttactaatgttgttttcatagttcgttgagagagagattataaaagttaaactttataagtggagaaaacctataattttcttaaagcaatcttagttttttttaataagattgacaaatcctaggatactgtaactttaacgtatccaattgtatattaaggatttgggttcggatgaacttttgcttcgaatagaaatgatgactcattcttagaacatttttattttacgattgaagagtggttgtcgttttatatcaatggaaaccaacatgctgttttctcgcacaatggtgaaatcaaagtacctaacgatgaagaaattgttttggctttattgcattgcacctaaccatgccagtgccaccaagaagattattgtagaaaataaagaggaaacattcagctctttatgattagaaagttttattcttatgaaatgcaatttgcaattattaagttgttatgtttgactaattgtgtgacgtgaacgtttactgatttatttttgatcaatgataatacattatttataaccatttaaatctcatcatgtttcacatattggcccacagttattatgagaggtcgtaaatgagaaccaattatgtaaaatatgctacttcacttacttggttcttcagatcgattgtgtgacattaccattgttcaacaaagaaccaagtaagtgatctgaaaaaatggtaatctcacaaaatcgatctgaagaaatacgaacaagggattagtttatctctaggccataaacactctctatgataaatagtttttcaaataaatcaaacaattgaaactttgatctaaaaaccttgaaagaagagaaaccaattaatcaagtgttaaaaagggtagatataatcatgaaaagttgaaataattttgtttcctaaaaatttaaatccataataagaaaaatatatatgtagatgagtgtagccataaaaataacgtgtatgaatatatgaaaaatatctagattttttttttttttttttttggccgatagactctcaatactatatgtttttcaacatttatcaccgacaattttgttttaaagcagtacaaaaccagttttaatttctttgtactgaatgttataccatgcatcgatttattgattcatccacctctttgagtgggtgagatagcaatgaagaatggcaaatgtataagctttaggttaattttaaaaaggacccataggatgaaaaattagttggatgagttgctccacatagttaatgcaatttatcatatcactaaaggctttaaaacctctctatatatagacacgttcattgacaagttatacaaacaaatcattcaaagacatacaaaataattgagttttttttttaattagaaacaaatg

SEQ ID NO: 34160 - DNA, 3000 bp, Unknown
  misc_feature (1)..( 3000): 2750-1469P.txt file - cDNA_ID_3075185; gDNA_ID_1620754; Annot_ID_166890
tcgaaggggtgatgagtgatgacaggctttttcactatttttttttaccgattccaaattccaatgtttacaatctcgaaactttttaaaaacattagttgacattaccatgtgattaatcgttacctccaaattcaaaagtaaaatccgtttacaatattttttctttctgttgcttcagtaaaagtcctcaagtcccctagatattgaaaatctactgacacaaaaaaatagtaagactgctacttgtgtactatttaacttcactttaagttgagtgattcttttcaggaactaatgccaacgaacgatgaacgattattgtggattgttcccgtttttcgttgttatttaacgaccttgagacctaccactggataattaaatgtagtattattactccttttagataactacaataaattaagaaagacaaaacatattcggaaaaacttaattctatatttttcgaaattgctaggcaccagatccctgaatcaagcatagggctccacaccatttttttttttaatatcatttttcaatagatttttcaaaaaaatttaaaaaatgttggtgacctaattagagactgaccctgcttaataactcaataattaaaattttctaatgtaatgacaatatagctctctctggtcgttccaaaatctgtttagcaatcatttcagattccaaaatactcgctacattttttttttactacaaagtcagagattagaatttacatttctttttgagggtttatgattaagaattagagagtgttgtcaagttaaatggtgtctctgttcttcttcttcttcatcaaaaaaaaaaaatgtctgagaggaggattcattattcccagctcaaaaacgacaacttgaatcaaatctcgccttcttctgctccttctccaatcaccctgaatcatcaattaaccgactcttcttcttcttcttcctccggtggtaataatcgaataagccccatcattctcttcatcatcgttctcttatccgtaatcttcttcatctgtagcattctacatttgttggtcagatattacttaaagaagaaaagatcaaacctttcgtcatcaccaaacgaatctaatcaaaacccagaattttccgactccgatacttaccaaagacagcttcaacagctctttcatctccatgattcaggtctagatcaagctttaatcgatgctcttcctgtgtttctttacaaagagatcaaaggtacgaaagagccttttgattgtgcagtgtgtctctgtgaattctcggaagatgataagcttagattgcttccgaattgtagtcacgcttttcacatagattgtatcgatacttggcttctctcgaattcgacttgtccactttgtagaggaacccttttctctttaggtcatcaatttgaataccctgatttcaatttcgggtttttcgccggagatgatggaggaggaggagttagggtttctccggttcagaaaccagctgagaatgagattgggaagagagtgttttcagtgaggcttggtaagtttaggagcagtaatattgtcaacaatggtgaagtagtagtaggaggaggaggagagacaagtagtagtagtcttgataatagaagatgtttctcaatggggtcttatcagtacatagtggctgaatcagatctggttgttgctttgtgtcctaataatgaaggattgaagaataataaggatgttgaagggaagaagattaatatgagaagtaaaggtgagagcttttctgtgtcaaagatttggcaatggtctaataagagatcaaagtttcctaataatcatccatcagagactaatcttgtggttggtggttcttcttcttcttcttcttatgtttgttctggatctgatgggttatcattgaatggaaggagatttcagggtccatgagattttaagggtatagatcagagggtagctttagttctgccattgatttaattgaattattgattttgtgtgttttggtgaattcattttgcttaacacgatatgaccactgtagtgttgttttgtgtcctctgtagctgaatctctctgtttgtttaagggaataagcttttgttctttgatgatgttatagtggtacactcttatatgtgatgtttctagttctaaatcgaactttgttcataaatcagtcacaaattctgagaaagttagaattcttaaaacattttgagacaaaagaagattatgtatttgtgggacaaatattttaaaaatgaaggttgtaaaaagagaagtcaaatatattattttctttggtggggtttttaaacttttaaagagtatccaaaaatgggatggaatcattattggtaggggaaaataatgatgacccataatttgtattattctcccaaaagagcattcgagtgagttaggtgaggagaactctcacgatgatctccaaagtcgccttctaaataataacgtcacgatgatctctcaagtcacaagttgtcttcaaaatcatatccaaccaaatcaaatgaacattcactatttggtaaaaaaagcatctacaacacatgtttgaatgtctttatgtcgctactaagcagtttctatcagaaatttatatttggcttcaaataagggaggtgttggttgatcaagcaatactagtaacaccaaaatcttgagaaaattaatctgagtttgttagtttgaagtagatgagattctgagttggaacctcaatattgcactattttcttagagacaatgtgtgaggcaatcttatgaaagaaattatctatgtattaaataatttcattcattatgtatgggttcttaaattctaatcataaaattgaaaaagcccaactgaagcccataaatgaatacatcgaatcccacaaaatattaattcacttcaatataacgtaatcgccataacaaaaaaacacaaagtattcaccgacgagaagaatatg

SEQ ID NO: 34161 - DNA, 3000 bp, Unknown
  misc_feature (1)..( 3000): 2750-1469P.txt file - cDNA_ID_3075189; gDNA_ID_1620754; Annot_ID_166885
ttagtatacctgttgtggcttgtactggtcaccaaattgataatgcaggtagataatgccaaaagaaaacaaagaacagaagaattagataatgccaaaaaataagaataaaatgcaaaattttgtgtcaaatgcttaagatctgcttgccacccaatcgaaatagaagcacatatgatggattactctctgaaatttaatccattaattttgatgtgtttttggaaatcattaggaaggctagttctattgaattttatttgttgtgatgaaatttagaagacgaaaagataatctggaaaagaaagagaggcgaggaggtcaaacgcttcagaaacctaacttttttttccgtttacttacaccgattggatccttaaaatattaagctgatgtgacaatctgaggataaagtttgagaaggtaatgtgacaatctgaagttaaagtttgagaagctcatgtagatggtctgagagtcctcaattagcatcttttattagtaagagattctttatttccaattttccaataatttgaaacaaatcttttgtctcttcgttttttaatattacactttggggtaggaccgtaagagaattgttttcgtatgttgtggaagactcaacgcgataaacttcaattttcatcattgcatatttattttggtactatgtaaatttcatcttatttttgtcaattttattcaaccttatacgatatatatgattttagtgtgacatattacgtttgaagttgtgtagactactatttaaaatttaaatatcattaataagatatagtcaaaattattaagtgtatagcaaaatgaaaattgtaagattaaaatttgattaaacaaatttactaatttaaatatttataaaatagggattatcatttactatttagaattcaaatactatcggtaaagatttataattgttttttaaacttgcctatctaggcgggcctaacctagtacatatatatacttgtactttgatttttttttccggttgaaaagctactaatttttacaatttgttaggagatctcagatattaacagatatacttgaaagaaaattaagatttgtataatattttcttattgttaaataggtgtactttttaatattatatatataaagaatttgctaattaagtcataaaaagaaaaagaaaaaaaaacgtatttttcattcatgaatgaatgtattgactttgtttcataaatcagaaatcagatttgggttaagaaggctcaactgaagcccataaattaatccatgggatggaagtttacgacggtttctcctattcaagtgctacgagaaagacatgtggcatatttctttgtgataggtgtcatctctcaatttaaatatactattattttatttcattagttttaacaatgtatcttattttttttccaaaactatcttacaaagacaattttcctactaatttttgtcaacatttaaaataaaaatttaaaatttaaactttacacttaaatacaaaagattctaatagtgggtacaaaagaaacaaatatagcttattaaaattggtcatttttttattaaaagataacatttttaatatttatttactcataaaatatttgtatatatattattaaattagttataatcttatataataaagaatggtttctcctattcaaaagctactgaagctgacatgtagcatctctccttgtgatatgtgtcatctctcaacttaaatacactactccctctatttcacattatttgtagtttaaggggttttcacacaaattaagaaaacacaaattttttatttaatatctcttttttataaaaacattattaactacaactaaatcaaccaataaaaaatatatgatgtaaaatataattggtataaaactaaatgttgcatagaaaaatgaaactaacacttattaaaaaaaaaatcttaagactacaaatatatagaaaagaaggagtattattttgtttcattagttttaattatatgtatcattattttttctaaaactatcataaaaagacaattttcctatttatttttatgatcatttgatataaaaattaaaaattttaactttacacttaaatacaaaagattctaatagtgggtacaaaagaaacaaatatagtttattaaaattgggtcttttttgttaaaatataacatttttaatatttatttactcacaaactatttttatatattattaaattagttataatcttatataataaagaaaggtttctcctattcaagagctaccaaagctgacatgtagcatctttctttgtgacatgtatcatctctcaacttagatacactatctcctctgcttcacattatttatagtttaagggtttttcacacaaattaagaaaacacaaaatttttatttaataaatcttttttttttaaaacatcattaactacaactaaatcaaccaataagaaatatatgatgtaaaatataattggtttaaaactaataaatacatttaattcttgcatagaaaaatgaaactaacacttattttaaaaagaaaacaaaaatcttaaaactacaaatatatagaaacagaggaagtgttattttgtttcattagttttaattatgtatatatcattatttttctaaaactatcttaaaaagacaattttcctactaatttttatgaacattggatataaaaattaaaaatttaaactttacacttaaatacaaaagattctaattgtgggtacaaaagaaacaaatatagcttattaaaattgagtcttgctttttattaaaatataactttttaaatgtttattttactcataaaatatttttatatattattaaattagttataaacccacacacttcctagtttatatatatttatcacttggaatggatcccaaagaaaaacacaaagcagcatcaccgccaccaagacgagaagaatatg

SEQ ID NO: 34162 - DNA, 3003 bp, Unknown
  misc_feature (1)..( 3003): 2750-1469P.txt file - cDNA_ID_3075193; gDNA_ID_1620754; Annot_ID_166880
ttctaatgtaggagaagaaggtcagaacttgttcccccaatttggttaggagaagcttccatgtcatgatgaacgagaggtggttcacttcttcctgtctataacgatttggtttaagagatttgatatgttgattatacactagtatgtaatatgaggatagattaaaaaaaacttacatgacggatgacgtaagggcgaacagcaaatccaatggctaccccgagaatgcaggaaaggacaatccctattgaccaaagagagtatgtccccaaatctgaaacagtgaaagaagaatcgttgaagtttccaaaggcatggttagtcaaatccacaaaagattacttatagaaaagacatactagaatgagagttttcgaggcaatcctcctccttaagatttatctggcgaatcatttcatttccatgatcagaaacaagcaaacaacatctttgaggaacaaaagttatctcgaaatcgctagagaaagtagcattctgtgcaggtccatctctgtgtccaaatgcctttgagatccctccagcaatggtggttacagaacctacaaagtccagtaaataaaacatgcataatcaaaataaactaagtggctctttcaacaaactaagattagacaacaacaacaactagcatttatacaaaaggaatacaagaaatggattaaacaaacacctgaagagctgatcttccgtatagctttattactcttatcagcaacataaacattccctttagcatccacagcaaaaccacggggtttgctgaaccggctgttaccagctttaccatctacatgacccgaactcccatccccagcaaaccggtttatcacactatctgcacaaccacacacacatactcaaagtgagctcaaacttcaattgaaagaaagataaacaaaattttcacttatagtaaagtttagaacttttatttgcaggttgatcgtttcacacacatacacacacatattagtattgtggtccaatttgagattacggagaaagaaaaaatgaaggtcaagacttgcaatcaaaatcaacaagctctaaacatttacttatgcatccatgaatttacaactcatatacaaacacaattataatgatccgattaatagatgagacaaaagagtggttttgtgggtgtttaccaacggacaaaggaaaggaagtagtgtaaaatgtactgccggaagaatcaaggacgatcagattagaagatcctggtaaagcatgaatcgtgtatggattcagaccagacttatggccatcgaccaccgttgtgacttcgtacccttcttctaaaactatcttaccactcactgtaacaaaatcatgaggaaaattaaaaattcgaattttgggttgggaaattcaactgaattaacagatttttgaaaatatacccagattgaaaacgacgaacaagaagagagacacggacgaaaatccccaagccatgtcaaaatcgagaggagaaagcgactgttctgtgtaacttgtgttgtgttacttatttttgctgcttagcatctttaaaggttttaaaaagatactagggcctgagcgatactatgatgtgttcaagtgtaggggagaatttgtgtaacaaccaatgaaagagcgcgtatcatcgaccctctcaaatttgactaataaaaacggcccaagtagggcccatttatgtgtttaactataaagaaacggcccagtctatgtttttgttttgagaggattgctggtcgaaacgttaccgtttaggtggaaatggaagtcatgtttatacaacgcatttaatttggcaattatggtttacgaagactgagaagaaaaaaacgagcatcgtccatcgagatccaaatcctcagtttcattttcatctctctctctcgtattgatcagctactcgaaactccggtaacggattttcacaatcccggcggcgaaactcttcttcccggctaagttttcattttcttcagattcctcgtaaagttgccggtggaccaaggtccaactcttgaacaccccaaatcatgaatcccttttcttctggtactcgtttaaggtaaattgattctcttctttcctttttatcgtttctgtttcaggtttcttagtcgttgatcagcttacaaatgaaatttgaatataacatgatgtaattgagctcgttttcatttgaggattgaattttgttgattggcctgtttcgaagatgaatttggtattggtgtttctgattccatttagaattttgattttagtctaagaacatgatcacactaaggatttttggtaatccttttgcttaatttaattgaatattggattggtcatgttgctgttggggtttaatagtggaatcagatcggattattgtatatggttctgaagttatagtggacatatgagtatgattcagggacatgatccgtgccataagagcatgcaaaacagctgcggaggagcgagctgttgtaagaaaggagtgtgccgatattcgagcattgattaatgaagatgacccgcatgatcggcaccggaaccttgcgaaactcatgtttatacacatgctgggttatcccacacactttgggcagatggagtgcttgaagctaattgcatctcctggatttccagagaagaggattggatatctagggctaatgttgcttcttgatgagagacaagaagtgttgatgcttgtcacaaattcgttaaaacagtatccttactaatttctagtattaaatcttgataccttggcctttgaatggattcttcttctatgttaaaaaatactagagaacacttgatttttgattgcattgctgttatgggaattaaggagaaaaatatttaaatagatttgttcctgtttaaccttaagtcacgtgcagagatcttaatcactcgaaccagtatgttgtaggacttgctctctgtgctttagggaatatttgttcagcagaaatg

SEQ ID NO: 34163 - DNA, 3003 bp, Unknown
  misc_feature (1)..( 3003): 2750-1469P.txt file - cDNA_ID_3075201; gDNA_ID_1620754; Annot_ID_166876
atgagcaagtttcagttgcttaatggcccatatgagttggttttggttttcaacttttgcatcagtacttgtatcttcttaaattttcaaaatatagtaggctgattaaatctaagtttggagttggcaagtgtaacaattgttagttttacatataccttaccaatttacacatgattgggcacctaattcatgtgaacaagtctctaaacgattgcacacacacaaaaaaaaaagagtctcattgtttaaaattgcgtcgacgtaaatagaaaaggtttcatcatcccaccaaaaacaaaaagacacttatccattggggaaaacattctgaaccaagataagtcatgctgggtcccacttacatcgactcctctaagactgtgtctttgacacgtgtttagttatgattcgtttatttgcagccactgtgtagaccccacttacctccttttacaaaatcgacattcaatttacacgtgtcgctattccctggcttgtcccttaagctggacatgggaggaataagatactctttaatttttggatggctatggctaaatagatggctcagaagaaataagatggccataacttcattcgttatccaaagctaacattaattggttagtatcaaaatttctaaaattgtgaaatatttatagaatattagtatttaaaattatatctaattgtataaaaattttggggagtgattattagtgtcatgttacttattgtaactatcgttgtgcatatcaataaaaatatacggatttcaattttaaacctcacatttacagatatttagttagatatttaaaagggatatctgcaaaatggacaatatagatattcgattttttttatcgtagttaacaaatgcatgatatcatgtatcatatttacacatactattcttttttttttaagtctagtaaaacggataacgggttgaagaaggataaaaacatttgtatccagccaagccctaaattggtattgtcaagtggaagagcaagaaaagtaaagaagaagaaagtgtcaatctgattcggatccaattacccaatcctcgttggcttcctaaacaacgtgaaaacaaaacacggcttatatatgtcaacgttatttacattgacacttggaaccattaacaccaaatggggataatatcgtaaaataacacatggttagtactttagtgacaatcctaatgctgctttgtcccttggggggtttgagaggccaccctgacctacgtggtgcccttttaatatcaatacattcccgataatgtgtgcttacatgttttaattatcttagtttagtcatataataatgacttcgcttttaactatattatatttactatatgtaatatgtacatgcatgttgcattcccaatgatgtttgttccatttttatgtctttatctaagacttttagtaagacaagataactctaatgatctttcttttttgttaaagtaagaatatatatcgattcaattcatcttatcaatatggatatagtcttagatcgtgtgtagaagttttgttttttgaccaatacattaaattgttttagtctttttttttttttttttgccaacggattatgataattatttcttaaaacgttacctgcactttgtagagatgtgactagtcggtattttttttgttaacatgaaacgacttgtcgtcaacattagatttttgtatacatggacaccgccactttgatataaatttctcatgtcttaccaaatcatagattcaatatagctacttaaactatacattgaaatatttttaaaatacataaaaacaaaaactggaaccgtaaacaaaattgatgggatgtttttttatttgtttcacgggaaaagtttgtagaatttaagcatgctacatgcaatgttaaaaactgttgtatattgtaatttatttacaccattaacattttatattgtgtaaacttaatgatttggcaccagagttgagtttttcttagagtcatgtttacggaaaatctgattcattttggataaactcgtaaacgatagctcattataaaactaaccaaactatcattttattaaagtaataaaaaagttgaccagtaccaatatacgacctatacagagtaggtttgatgagatctcataatctcttaaattaaatacaaatttagcattacctttagattggattaaggattaaaattatttcatttgtttcagccgaaaaaagaaaatggtccaccacattatctagtcatcatctgatctactaccaaaccctacaataagaagataataagaggattgagggtaataatgtcatttacatacacctttatattattttattgccaaaattagaaaaatagatcgtaagaaaacgtgtatatgtgcatttggtattatgttattcggtttttatatttttcttgtctctcattaaattttcttctctatccaaactctgtatagcctgtccccaaagagtctcgagtccttatcgtgaacttttttgttcattcatctgttccacgaagaaaacaatttagatttctccgttgaagtttttcgccggcgatttagtgattctcggagaagaaggtgagtagcaatagtgtgatttttttcttttgggtttttgtggaaaagttttttattttcgtttcgttttgaactgtttcattcatgggtacagattgaatttgtgtgaaaacgtgttcttgagctgtttgttttcgggatctatatgtggcaagaatctcaattttgtgtttgatttggtctcgttgttttctgaatcatcttttggtgtggcattgtttgttttggtgatatagactcttgttgtaagatcattgtttcatcagttttaatgaaatgggtttgttttattttcaggtattttgacgcttgtaagtgtttagacgcgtgttggatttgtaaaaatccattctttggcttgattcttctctatg

SEQ ID NO: 34164 - DNA, 1177 bp, Unknown; identical to SEQ ID NO: 5026
  misc_feature (1)..( 1177): 2750-1469P.txt file - cDNA_ID_3075224; gDNA_ID_1620755; Annot_ID_166945

SEQ ID NO: 34165 - DNA, 3000 bp, Unknown; identical to SEQ ID NO: 5022
  misc_feature (1)..( 3000): 2750-1469P.txt file - cDNA_ID_3075236; gDNA_ID_1620755; Annot_ID_166939

SEQ ID NO: 34166 - DNA, 3000 bp, Unknown; identical to SEQ ID NO: 20558
  misc_feature (1)..( 3000): 2750-1469P.txt file - cDNA_ID_3075244; gDNA_ID_1620755; Annot_ID_166936

SEQ ID NO: 34167 - DNA, 3000 bp, Unknown
  misc_feature (1)..( 3000): 2750-1469P.txt file - cDNA_ID_3075269; gDNA_ID_1620755; Annot_ID_166923
tttgataacatgcatgtcgccccatcaaacacactccaataatgtcgcaacatctctctcctcctccttgccgcatgctgtgaataattcaccaaatcaatattgatttgtgccaaagaaggagagtatacatcaaagaaagagcgtcaagtaggagaaagagttgcttctttatcttctactgcagaatacaacgccattatagagctcaaagaactaaagaataaattcaagaagaaaagactatgttttcctctgcaactgatccctcaaaaataaagagagtgagcgtgactagcaagcgaaaagatctagaattcaagagaggcaaaggagaacgtatcttgttccttaactcggtttattgaatctctatgtgtagcatctttctggtttcttgtactcgatattgaaacccttaataagatactttgtgagctggtcagtaagctcaccaagacgtaccttagccattttggctttgggaacttgtaaatcttgtgtcgtctcttttctttttctttttctcatctcttcattctatttacttattcggcaaacaaacacaaacaaaataagagttaacatgtgagaagatggactaaaggagggaaaaccgacaaacataattcacaacgctactttgtattcggctcatagaaaccttttattgataatgattgaaaattctatatcaaaaaaattataggattgaaaatgatactaacaaatttgcacgtagtgattcatgcttaatgttatattaagagtttatgttttctcctattttcgttgtacataaaatgcattcaacatttaaatctaaagagtggaaaaagaacgtcaacaaaacgaatacaaaatgaaataaaaatatataatagacggaagatgtttaagctctaatggaggtgacttcaacttatagtcttatataaccaataacacctccttaaatataacaaaattatgtccaaaataaaaaataacattaaagttatttataaagaatttatcaaaaatcaaataacatctttaccaaaaaaaacactatatatgtaatgtgtcttttttttcttctttgaatttgttaccattgggtgtgtttgctttgttcgggtatgaggtctatgtagtgtatgtagaacttcaatatctttgtgtgtttataatgcttagttagggtgtgaggtttaccaaaccaagttctatacttgctacattgattccacaccctaactaagcataataaacacacaaaaataaattcaatgacactatgactacgagtaacaaacaaaattctcctcttgctacatcaaatcacaccctaactagcataataaatacacaatgataaattcaatgactgagtgaagtacaaaccaactcaagaaaacacagggaaaaaattgcttttctttgtaattacagaaatgagcgtatcaaaaacttgcagctttaagatagttgatttgatgaatacagttttggaaaaatgagaatgttttcccaaatgcaaaacagagcaaactaaccaatcaatgtaaactaagcaaactaattaattttaagcagagtttctgaccctgcacaaatctgcacagcggaaaatgggctgtgagatataaggattgacaagacgtacccatcggtgcaattgtcacttgcctgttatttgcatttttctgttcttcgctcccatccctaacaggacttctctgtctccttccaccaggacttctgcttctcctcttactcctccgtcctctcttgcggcgaggactattgctcccgtatcttctgctcctgctacggctctccccatcatcatgaccatacttctactgcggttatgcctttcatgagagcgatcttcgtgactataatgcctgtaagggctcctatacttccgcaatggctatgcctgtttttgtatcttccatataactgcctcctcaatccactgtcaagagagtcaggtggttttagtacaacataggaaatctatatgaaccacacatgacaaaagaagaaacatgtgacatgctaatgctttttactgttgaattttgggatgatttatgtacgaagctacttgtcaacagtacgaggaagatacttgcaaacaagtagcttcgtacataaatcattcccaaaattcaatctcctgaggaagaaaaagttacaaacctcgaaatctttttgcatacatcaacaccaggagtgataatatcgggacgttgattgatgattttgctgcagatcatgtacaaagaaaggctttatttacttgaacgattatgcaatgaatgttttgaaggatgttctgttgtcctctgttttttttagttgtcgatgttctcttttcatcagattaattaggaatcgtttttatcacaactaagaaatgtaattttcttaagttaaaatttttttttagggtccttctctcgtgattgtactgggtccagaaattgtttgagccggccctgctgatacgtattcgaaaggagaagcgttgggctgatacttggtttggtgtagagacgagagcatcgatctccgttacgacaaacgccgattttgaagtagaaaggacaattcacgcgatctttctccgttccgtatattgacgctaagtgctcgaccatcttccgattgctttttgaagaacacgaaactcttttcttcttcttggactagggtaggtctctctctgatacttgctatgcctatggatgtttcaagagatttaagtttatttacctttttaccccttctgttttaactattttcaatccaaccacaaacttatgttaaatttggccaaaatgcgattgggctgaagcccataatctatataagtgaagaagacgagcgctgcaagaacggttcgacacaacagtgtcagtgctagtgaacagtcaggttatagggtttcgttgctttggtcgtccttaactttaggctttgatagtttggttgtgaagttcaatg

SEQ ID NO: 34168 - DNA, 3000 bp, Unknown
  misc_feature (1)..( 3000): 2750-1469P.txt file - cDNA_ID_3075278; gDNA_ID_1620755; Annot_ID_166920
tatacaatccttttcatttaaatatatataccattaatacaattatcactttttcttataatgtaactaaaataatttttatttatttattttccatctaactataaatattacatcaatttcaagttagagtaattatgtttatatttatctaatatatattataatataaatacaaattaatttatccaagtttcagtttgttttatataatttagaaatcaataatttttcaaatatagaagaaactaacatagcaaattaaataattgaaatttccaaatatttatttagggtaaatatatttaatatttgtgtatatttggttgttgattttatttagttttgttatttttaataaattgcagatatttaattaattgtatattattatgttttgtgtagatatatatatactatgtctgtaagatattaaaatgttaatgcagctcaatggttgaatatcctctattagtccagaatgtcagcatttcgattcacttgaaatggaatcgaaatgctgttttctttctcattttctaattttcaaaacgacgtcgttttgatataagagagattctaacggaaagttaactccgtgattgtttggttgacggaaacttaatgacatgccctaaatggtcaagtcaacaatttttgattattttatcaaaagtcaaactaaactttaggatttaattgtcttcttgaaacttcatacttttttcgtcccaaatttgaaagttcgcgatttttttgacatttttcccatttttttatacttaatttttttttatttgttgatttatatcttctacttgtaggtgacattgaagaaaactttaatgatggaattgaaggtactacatcgatagcaagtacctctggagtatgagaagatgttgtttagattttttttcaactacttttgtatttcagttttaaattgattttcagatttttgattactttttaagtttctcttgtttactttgaaatacaaattattattattttgcagtaaaacgaaatttacatgatatatttacataccagcttactttataagcaaaatatagatacaacatacatataatagtatattagcagttaaacataaacactaagaaaatgacataaaccaagttgggtacccacgggtagtctcggaataatcggttttttttggcttttacccactaaatcaaaaacccatctgggttttctaaagttgagtttttggtgaacgagtttattttgggttcaggtcgggctgggcttttttacccaccacatcatctctatacatgtgcaagaacattagaggcagaggatataatgttcttagtatctctagtccaagacttggatcgtatatgcttgaggaagacatgaaaacaacgttgggttcgttaatttgttgctactataacaagaaaacagaaaaaaaataagtgaggatcttgacacatttcttgatctacacgtcatatatctgtaacgcccgtgaaccggaaaatcggttaggatttgtttttaaatcatccggtttaattggttgggttaattagaaaccttagagtgtgcctataaaagaaggaaactcgaaattagggctttagttagccacttttcgtttataaaagagaaaaagagagaaaaggagaaggagcagaatcgttagggtttgggagaaatcagtttcgtcatatcaaatcgtggtaaaaggtaacgaaatttggtagagttattctcaagtcctttatcgttattctccagtttacagaattggatttggaataaaattggttgagttattcgcagtttcgtgagacacgttttctcagacgcgaattaggaccagcggagattgaaactgagatcgtggtctagtctgttttccgatcggcacgagattttgtgggcagcttttgacgtctgtagctaggatttcaccggagagattgaatagttaacggttaacttgtattttagggtttcgtctttgagactgcttgtttttggtttttcctgtccagtttgcttcaaggttgcttttggttgtggacttgttgtaggacgtttctggactgtttcagacgcaaggagagtctctcatgtgtttaattgctattagaatcaatttgttaaggtgagtgcgtgaccatgagcttatctgagcgattgagttgtgtgatttgttttgggtgatgatatgtaggtgtggtgaatgtgttttgggtgaattgttcaatgactggtttgtttgtattgtattcgtgattatacccttttatttgcttgtgtgtatagctcgtagatgggaggatcgcctcactaagtatttatgataatacttacgcatctcattgtgttgttgatgcaggtaaagataaagtatgatcgtgaaatcatggcaaggaagagaggatgatctaggaactcgtttgtttaatttttggtgtttttggttattggaacccggttaggattgtcagttattcttggttttgttggtcgaattatttatttattcataaaatagtatttttgacttgcggtttaactattatgttattggttggtttaattagatatttatgggaatatttaattatatatatatattttttttttaaaaaaaaggtcgggttgttacaatttggtatcagagcgatcacggttctgggatgtgtagaataattaattgatgaatttttttcatgatgattgatgtgggatgagctacggtgttagcatagtgaggattgactatggagtgtttagtcaattttgtgttgttggagtcctagcatcatcttctccgagccttaaatgagatttcacggtaagttgtttgtgatatattcgtttgttttagtttcttagccatttgttcttgagtagcgcagatggttataagagctggagttcgtggtcgtggtcgtggtcgtggtcgcgataggggacgagtcctcaagggtaccggcgagagtgatg

SEQ ID NO: 34169 - DNA, 3000 bp, Unknown
  misc_feature (1)..( 3000): 2750-1469P.txt file - cDNA_ID_3075325; gDNA_ID_1620756; Annot_ID_166990
aacatcaacccagcattggtcatggataacttgaagccctccgatattgtcctgaagaagaatggtgataaacgagaaatcggtgtgcttgcttatgcctaaagtaaggtcaggctgagggcaaggtggatagtattggccaaacatgatatgagacttggcacagcccatgtccttgaggtgattagggtttaatcccaaagcctcagatagaagctcaaagagaaattcacctaaagtcattagttgctttgagtactccatcataatctccctgtcacatcaaaatatttgcaagagattagcgtacgtctagctattcacaaggcacatataacaaatctattcaaaataactttggtatttaactttttgatttatttatctttaatttaatatatacattgaaagatctgttaaaatccaatgtgaaataaataaataatttattaaaaaccaatgaaatcattaaaaggttataattactatttagaaatcaataactcatgataaaatcaagtgtagaatccactaacttatgtagttattaattattgactttttatgctttttcaagtttaaattttgtaataaccgagttaaaacacacaagatatccgatctagtagacccgaagcaagtagatgagaaatacgccaattcgtacgtggaaattctttctcataattaaagtaaaagaatataatctctatcatcataaaccaaaaaaaaactaaagagaaatgaatcctagctagctaggtgtttggtatggaaagggaaacgttacccgcaaaccgcgggcaagtcctgtaacttgggaggatcgggggccatgtaacaggcgagcgtatctctccaatttgcagccttattacaagtgtggagatcgatgttgctgtagtaaagcacatctctagtgtgatccctagagtagaaccgtttcttcacttccgggtcctgctcgtgaaacctgcgaatcccttctttcatcctctccatcacctccaccgagatcccatgattcaccacctggaagaatccccatctctccgcagcgtctccaatcttctccaccacgctccgccgcgatatcaaatccatgcttcctcctttcagatccaccgtggggatcgtcagctgctgcgaaggtggtgctgtttgtttcaggcttgttagagtatccggaggtgtatggaacatggctggaatctctttgattcccgaagccacaagccctttcacgccggtttttgtctcgtcgaaagcttttgcttgacttgaacgatcacttgactccatcttgcttcttctttcttttttttgcaatgcacagatttgcataagtgctattattccacatcttaatgcacatcttaatacaattaaataacaaaaggaatcgtgacccatattaagataacaaataaagaaatgaatcgccaaaaacaaggtccattagtttatttcaattcctatattaaaatttggattcttaattggtcgtttgtctttacaagtaagaatagcatccggtttgaacttttgttaattaactacacacttaccatattaaatctcatcgccattgttgctcgcctagctctcgaaacgccactaattagcaaaacaacatttaaagatatctcgtttggaggactttggacaatcgttccgctactgttcattttctctctctttgaagttttttccagtttttacagatctagttttttctgcctctgttcttcatcttaggttatgaatttgcaagacaaagcaggagtaaggcaagctatcttctccggcattggagtggtgtggtttttccggtaagcgtggcagcggtggccctttctcggtggatgagaggcttctcttccgtttcttcctggttatggacgtcggtggagatcggtgaagtctttcttggttcaaccacttggttagacgctgtagctgtggcggaagacgctgtggattggtgggttttcagtgcgtgtttgatggttaacaaactggatctgagatggctgttgcgggttccggttgctgaagggttgtctgagccatcacccttctttagcctccgttttttgtctccatcaatccggattgaaggttgctttgcttttggaaaattttcagatctaaggttttggaggtcagaggcttggaaatgcgtggtcgttttgcgaggttggggactcgaccaaattgggtggcggagtgtcggaaactgggttttttccgttaggtttgttgcaggtccggccagctcattggtaagagatttgcggcaggactcgtatacttcggccaatgatctcgttccggtggttgtgttgcaaagtagtgggccttgtatacgacggtactaatagatctatttgctgcctccgttccactgcccaaatccacctctggttctctttttccggtgaccggatttttcctgttttgtaactgtggacgattgtaattccgggcctaagcccaattgggactggacctttttttttaaaaaaaaaaaaaaaagatatctcgtttgtggagaacgcatgctagcaacttccctatctataaaatcagatttgcaccccacaaactaaaatattatttacgtacttgattaattcctacaatatagtcatttacaaaaataaccctccatttgatatttaagtcaaaatcagtcaacggaacgtggaataaattataactttcgacgctccgatcagattcatcatcatctctctctgtgtcgctccgattttgaatttggaatctcttagttaagttggaagtttgttctttggtcttttcgcctagttgttgttggatctgttttaaattaagccaaaaacctccgattagatcgatctcggaaccgtcgaaatacagttcaccgtatccgttgtttgtttttggtatatgtatgtttgagaagctcttaccatctttgtttacaagtctggttcttggtaaactttagctatg

SEQ ID NO: 34170 - DNA, 3000 bp, Unknown; identical to SEQ ID NO: 20563
  misc_feature (1)..( 3000): 2750-1469P.txt file - cDNA_ID_3075340; gDNA_ID_1620756; Annot_ID_166982

SEQ ID NO: 34171 - DNA, 3000 bp, Unknown
  misc_feature (1)..( 3000): 2750-1469P.txt file - cDNA_ID_3075344; gDNA_ID_1620756; Annot_ID_166975
tccccaaaaaaaaacaaaaatcgatcgtttgttttgttttatgaattaaacacagtaaaattgatgaaagagtagagtaaaattcacgactaatcaatcagtgatctgggtagaagaaagagacgagagaaatagagaaaacaaagaacggttttacgatgagagaaagagaggaaagtgctatcgaatggatctctgactctggatttctatttataaacagttgggctttgcaagtgcccaatgggcttcgacagtttttgaggcggttagtggagactgattctttcatgaaaataaaatacgttgttgttgaactgtctattttcttatttaataataaaatcgtacaaatcgagaatacaaaatacaagcttacaccaagacctacccatatactaagccatggaagtaacaaatggagagtcttgttctctccggcgatgactggaatcaaacgccgacaacgttttgttgttctgaatcttcttcatccttcaaattatcacgaagattgagccttgttctctccggtgatggggttttatgaagatataaacgcaaacaattcttaaaactcaagagtcaaaacaagtttcaagtaaagtcgtaaacttgacacgccttttaacactacccattctttcataaccaatcccaattttgctatgcattagcttcattgctaaatctgcttttcccactttcctcaacgcattgatcatcactgttctgatcctccctggcacttctcttcctctctctgttatcccatcagctaatttacaagcttcttttatccgaccagctttacacaatgtatttatcatatcttcacaagctgcatcaagaatcacacccattggtgctaactcatccagtatcttacaagctctcgccacttttccggacaaacatagcccagtcgacaacgccctgaagcaagctgcggttggtgtaatgcctttatcgatcatcatgtcccaaagctttaacgcctcctcgtttctatgttctttgaacattccggataagagtatcgtgtatgtataaaccgtttgatcacaaccttcttcttcttccattctcttaaacagggctatcgcttcatcgactttccgatgctttgtaaacgcatcgatcagtgcattgtaacagtatgaatcccttgtgcatcctttctcagacatctcttcaaaaagcctctcggcttcatctactctgcccgcttttcctaaaccatcaatgagactagaataaaacattgaattgatagccaatccgtcaaaccggcaagtatggaaatagtccaatgcctcttccactctcccgtttttacacaaaccattaactacgacagaataagttaccacatcgggtttaaacccttcgtctatcattctatgtaaaagccttatcgcgtcttcaacacttccacttttcgcataaccatctatcaaaaccgtgtatatagctacatttggtttagatcctttacgtatcatattctcaaaaacagtatacccttcattcaatttcccttccttacaaagtccaccaatcactaagctaaacgcatgaggcgggacttgaattcccttctcatccatctcttgatacaaagccacacaagaaccaaagtcgctatctgcataacaagcctggatcatagtcatatacgtaatcttatcagcctcatgacctctcgtctccatatctctaagcttctccatagctttctgtgtctgccctgctttacaataacctttgatcattgtgttataagtcacaatgtctggtttgatcctgccactctccataacctcaaaaacacgctctgccgaatcaacgaacatggcgctcactaaaccgttcatcaaaaagttataagtgtacaaagtcggctcaatcccattctctttcattttacgccaaacccacaacaattcctccaccattccaagcttcccaaaactcttaatcagagcattcgccgcagaaacagtcataggaaactcaaatttcttaatctcactgcttacaaacctaattctatccacatcttttgccagagccaatacatcaaccaaggagacataacactcgaggttatgagtatacttcttctgcttacgagaccaacagaagaaactccaagcaatatcaggtttttcgcgaatctcatcggatttcaacacaaacgaaacaaaattgggcgatagtttgataagaaacttacggcagaaaccatctagattcgattccatagaagccgaaccatctaaaaggttgagaatttggcttacccatggcgacggcaggagattacgattcgatttcaccaaatcggagacatcgttaaaaggttctatccattcgggaggaggaagtgagctgctattgaacacccatctaacactcgtccttgagctcgataaaggcgagcactttgaatcatccgacaaaaagtctccatttttgtacaaacagtgagattgtgaagaacaatgcggacgattcagaagcggtacagaaaagggcttccggtaaaatcttcgcatcggtaatttcttcaagcagccgcaccggcagcgacattggtcatatagtactcgaacactaagttttaatttttaaattaacatggagaaatcgtaacgaaatggtcccatggtctagtggtcaggacattggactctgaatccagtaacccgagttcaagtctcggtgggacctttttttttgttggcaatcacgtaaaataattgcgtaattacaacaagttttttttggatcttgtctttatttgttttctctgtacattggtgttacaaaaaattattatgatagctttattagggttttttttttggtcaacgaattacgttattagattaaaaatacaaaaaatatattcaaatgtatttgaaggatttttgttaggagctgtaaagtttttgtctttagcctcctacacacactacacttggaagtcagatg

SEQ ID NO: 34172 - DNA, 3003 bp, Unknown; identical to SEQ ID NO: 20566
  misc_feature (1)..( 3003): 2750-1469P.txt file - cDNA_ID_3075346; gDNA_ID_1620756; Annot_ID_166974

SEQ ID NO: 34173 - DNA, 3003 bp, Unknown; identical to SEQ ID NO: 20568
  misc_feature (1)..( 3003): 2750-1469P.txt file - cDNA_ID_3075350; gDNA_ID_1620756; Annot_ID_166971

SEQ ID NO: 34174 - DNA, 3000 bp, Unknown
  misc_feature (1)..( 3000): 2750-1469P.txt file - cDNA_ID_3075367; gDNA_ID_1620756; Annot_ID_166961
cagtttctgtagccccacatgtttaaagactacaaactcaatattatttcttcttcttttaaaacgagcaaagctaatcattaatacattaactacagactaaacccagaggttacacaccgtacacctaagttaggacaacgcttcaaaacagattttttgttcattttattatgtcatcaaattaggaattatctctttaacaaatgaaatttgagtaataccgacatattattaatctataataattaaagaatattagcttgaaaaacgtctatggttttactaaaaatttagttttcattattctttggcttttttaatatcttgaaacaaaaagataaatattgcatgaccggtggagacagttgaagaaaacccaaccaacccatccaacacttgaataacatattcattttactttggtttatatttcgtgattttgttttcttaattatctctctctctctctccctctccttttctcttccatagttaaattctacagttttaaactctttggagatccaagaaactaaactgatggtgaagttaacgcagagattgggtgggttggtactgcgatttgcggcattttgtgccgcgttaggagcggttatcgcaatgatcaccagccgtgaaagatcttccttctttgtcatctccctagtggctaagtatagcgatttggctgcgtttaagtgagaatttttcttttctttctatttgacgtgttttattagagtatttagagaagtgtatatgtattctaatgatatgttattgcattcgcatgtgtggcaggtactttgtgatcgcaaatgcgattgtgaccgtttatagctttctcgttctgtttcttccaaaggagagtttattatggaagttcgtagttgtgttggacctggtaattaattatattacctctttaattacattcaacttctttctatcttgacagttcaaaaatatatatatatatatatataacaatttagatataaacattccaggaaattacaaaattgatttgaatcatgatacttctaaatttgtctatattttgaatatgtgtttaatcattatgtatttgtaaatgctaaattaatcgtgaagatggtgacaatgctgctgacgtcaagcttatcagcggcagtggcagtggcccaagtgggaaaaagaggaaacgcaaacgcaggatggttgccaatatgcggtcaagttccgagattttgcgatcagataaccggagctctaatcgccggtttagttgcattggttctctacgtattcttgctcatcttctctatccaccatgttgttgatccttttcttcttcgaaaatcatgaatcaaagtaatataaaatttaaggctaaatattcatggaaccacatgtgtttttgtgattttagtgttgttcatttaaaattaagtcacgtgtcataatttcatatggttaatcatatcatcattaattaataaataatactatcttttctatagataagattatatttaaagttatgttactagataagattaaactgacaatatattacatgaaattatgacacgtggatttttattagtgtagtagatagattgatcatataaaattatgtaataatttgtttaataaaataaaaattatgtatttttttttgtttatgtatatatatgagaaatgaacttcaatacattttcaaaaaaaattgtgttgaaatataccttagtcgttttatgaggttttaaccttgagcaactcgtttttccgcatgtgtttttgaacaggttgaatattattaagtgacaaaaatctttttgtgggctccattacttgatgatgattgaccagctcacactacatcacgtgatcaacatctcttactcaattgatactataattcgaatagaaagtaattcagttttttttttccctataaattctaagacatgcatgcttgtactaaaatcatttaaagatttcgtagtatatgcataaaatgatattttaatatatgcatgccatacaacgaaagtgtttagaaattgaatgattgtattacttgtagtttcaaagatccaacaagaatgtgtagatgccctatacaatacataacattaattagaaatggatgatttattagccttcaaaatctaaccgttacttttacattccacactgacacactggtctggttaataatttcaaattgccattcttatttttacggaaactaaacaacaaaacaataaaatgtaatggctgtcaaaaaaaataaaaaaaatgataaaatgtaatgtgtaattgcgattttacgtaaaacgacaaaacaaagcattttaatacacaagcaattgaatatatatattttttcaatttttcttatttatatttttttttctgttttcaagtatttaatttatacttaaattttgttattaaaaaagttatatcatcgttggtcaattggacatgatttgaaagtattttaaaatatgatcaccacacaaaattgaagaataacttgaactttaacataatgtcaatatactttcgatcacgttggaaggatatctacaaaatgaacttgatattttttttgctatgatctatcgttttatcagctatgtttgtgggtttaatttcgatgtggttaacagtgtctagtagtacatatgccatctataactcgaaaaagctacatctaagtggatatgatagcttacaaaatctaaatcgtaaacatgatcgctaacctcacaagtgttgtcgttttccatcgctctgttatagtcataggttgtttttttatttattggtacaaaatagaatgttaatttacttagcccaacaattaaattttctattgatttggtgggccaaccaaatctttttactaagggttagccaatcattcattccaccacgaaacttttcttcttctcaaactagtttttcagaatttctagggtttttgaaattggggaaaaaatg

SEQ ID NO: 34175 - DNA, 3003 bp, Unknown
  misc_feature (1)..( 3003): 2750-1469P.txt file - cDNA_ID_3075380; gDNA_ID_2926144; Annot_ID_197615
ggagcccaaacccacctctttaggtccacgtttttttacataggctctaatatcaattgttggactctccaagcccaaatatttttctctaatatgatattgtccgctttaaaccaagaggccaagcccacacgaatttgtttttgaactcgtaaacataaacatgaaaagaacactattttatatttaaattaatttaataaatgctcttttctataaatggctacacatattttttctcagaaactataaatcagtatttcctcttactgatatgaaatagaatataatttatttcaaaaatatctaaacattacttaatatatacaattatagctagttttctatattattataataatatgaaatataaataaatcaattacaactacaaaagaatttaaacatttctcaatatataataaacaacaattaaaacttattttacaatattattttgaaccattcccgtgtgactgtctctagtatgatatatctaaggttttttaaatcatatgcaacgatttcaattatttttttctaggctatatgtatgacttaatatattcgcttagaacttctcttttggtttttgtcgtcaaccattaaaaacataattttatgaactgaacaaagtgaaccttgaatattttttacggggtttatatgcttaagcttcatattgattatatagcaaacgttgcaaaggctgtttctataaacgaaaccctacatcaagatgatgaagtcatctctataactataccaatgtgtacgacttagagtttcgtttatagaagaagcatgttcatgtatcggatcatacatttcaaaaacacggtttgatacggcaacgacgacgacctttgaggttgatgaagaagaacgtgtcccaatcgattcaggtgactttgagtttgtctcctacatggactgagcttaattttgatagttgcacatattcttcttataagaacgtttatgatgtcctgtaaatccctgtttcatgtgtcttttgtgtttatcaatatgttttgtgtggattagtgactagttctttttcttcacaacgttttatatagtaagagtcatgtttttcacaatatggaagttagagttggagctttatatgtggcaggaacatccagagttctcctatgtgatcttttgtgcttcaccatcacaaagctctaatactaaggtaaacatgttacatatctctgttttgtaatgtttttttactttagaaaatctagctaaagtcaagtgttttgtaatgtttttgacatgttacatatctctgttttgcaatgttcaagtcaagagtttaagtttcagttcaactcttgacaaatgcgacaagatttgacatgatattgttggtgtctcacaggaaaagtcaccaagcagtctgtaacttgaaaaacgaatttaaaatcaagaagcaagactctgagatctatgctgctaaggtaaacatgtcacatatatatgttttgtactgttttagaatttctgttttaagtacttttgacttaaatgttttaagtacttcaagctaatacataacgtttcacaatattccttgaagctaacacttcatagaaacaaggtacaacttcgtcaatcaaccaaacataagttcttctgcctctaaagaccgtgggccggtctgtctaactgttgggctttgcggggcgggttaggactcacttttcaagaccgcggtcgtctgcggtccggttcgtcgcggatcaatggaaaagcgagcatgttgcggtcggtccgttcggtcgcgggcacgcccgtctaccatctctaaagttatgtaaaccaaaattcaattcttttgtttcacaattactactcaaactacatttttcatagtttttttttaataaaactcggtgttattagttatactatttgtaaatatcttgtaatcttaaggttatggaactaataaaacctcatataaattaataatcgataaattaatacccgataaattaatacattttttctgtcctaaattttgtttttggatcaattgataaattaagaaaataccatagtctcatctatattaaattattaatttatggaaattttactgtgtatagttttaggaaaaatataaaaataataacaattttcttaatttcacaaaaaattactaaaattcacgtttagttggaaatttacgaaccgaagtattgggccttaatggtcttgggccaacatcaatctctcgccgtcaaggttacatttatcgccgccgctgagaccgccacctaagggccgtctcctccgcaatctctaaccgaaactctctcatctcctggtaagctcgattttcttatcaattcgatctcatatgatgtcgatctgtttctactgaagctaaatcttgcgaaatcgatctttgttttgttctgagatttagggtttcacgaatttgtattctagggcttttctcgattaatcatttctattgttatttgttcttattggttcttatgcttttgggtacagaaagatatcgactttttgttgactctgtatgcaaatttgtcaaaagacaaaactttgtaacagtttactctctttcgtgcttgtgtttatgtatgaacaatagcttcgctattgggattgttgatttcaccacacttgattaagtatgtacatactattgaaaatgttatagttcgttaaaatgtgcaatcttcgaatttctctagcgtccattgttcatgttggtgtgtttatgttgatatactcacccacacacacatcaatgatatgcattgtacataatgcattttgttgttgtctctttaagattttagctattgaggatcgattaggggaagtagctcttttcctttccttttctggtgaatactaatgatgcaaagcttgaatctaatccctgtattattttgtgctgcagagacagatagctaatttgattgagtttggttacttgcaagtgcaaatatg

SEQ ID NO: 34176 - DNA, 3000 bp, Unknown; identical to SEQ ID NO: 5030
  misc_feature (1)..( 3000): 2750-1469P.txt file - cDNA_ID_3075380; gDNA_ID_1621164; Annot_ID_57174

SEQ ID NO: 34177 - DNA, 3003 bp, Unknown; identical to SEQ ID NO: 34175
  misc_feature (1)..( 3003): 2750-1469P.txt file - cDNA_ID_3075380; gDNA_ID_2926144; Annot_ID_139041

SEQ ID NO: 34178 - DNA, 3000 bp, Unknown; identical to SEQ ID NO: 5030
  misc_feature (1)..( 3000): 2750-1469P.txt file - cDNA_ID_3075380; gDNA_ID_1620757; Annot_ID_49922

SEQ ID NO: 34179 - DNA, 3000 bp, Unknown; identical to SEQ ID NO: 5030
  misc_feature (1)..( 3000): 2750-1469P.txt file - cDNA_ID_3075380; gDNA_ID_1621164; Annot_ID_173784

SEQ ID NO: 34180 - DNA, 3000 bp, Unknown; identical to SEQ ID NO: 5030
  misc_feature (1)..( 3000): 2750-1469P.txt file - cDNA_ID_3075380; gDNA_ID_1620757; Annot_ID_167042

SEQ ID NO: 34181 - DNA, 3003 bp, Unknown
  misc_feature (1)..( 3003): 2750-1469P.txt file - cDNA_ID_3075423; gDNA_ID_1620757; Annot_ID_167016
tgccggcgccgggttttctctcctctccgacaactcgttttcaaacactctctcatctatttctttctttttcatggctttcttctacttttttcgaagttgtacccttatatccaacattatcacgaccgatgcaaatgaaatctttatcaaaactgtctctagatcaattttctttaaaatcttcgcgattctcgtcgttcgtccctctcacaggttctcctcgaagtcaagaccagcacctctatgctcctctttctgggactcagatcccctcaccaagtgttttgcttggttgcgacaggaacggagctctgcgttgacgctggagccgatgaagtacatgacggtagaagaatcatcccaaaacggcaccacaaccacagatccgccgccgcagtcagaaaagaagtcaaaggaagggttaaccctaaccctaattctactatttttcactcgtaatgggcctggcccaagaagtttattttctccatccagcccaccttacaatctatcccagctcagacataaactaaggggcataagcccatctattataaggcacaggtttgttttttctcttcatcgtgctaagtacaattctgaagatctcttacttatttggactcctacctaagaaagtagcgatggatttagattggacttgttattatccttctcgaaacctggtggattgatttgctcgttttgtattcgatgtaagattaatctcgaaacgttttggattgtggttagacatgtttgaattcaagctgaatcatcttgcgtcatttgctttgaggagcaatgcatctcaactctttcaaaccttactaaagaacacgcctccaatctctcaaaccttaccgaagaacaagcctcaacgctctctaactttattgaagaacacgcctaggtactttcaacctcacactttctcaagcctttttgaatcattgatttgtggctgcgatttgattgaacgacaccaatctagtctcccaatgttcctttggttatggccttgtgattatctttggcgatttcgacaaatcttatccggcatttggaatatctttccaccggcagtctcctcgatggagcattctaccaaaagctcatttgcgtcaatcgcgcaagccgtctatcaccaccagttggtcgggattttctcgaagcttgtcttcgaatttgaatctcctatggcatcaaaagatttttcaaacattgcaagcttctccaagttgagcatctttttaaaaacacattgagcctttagctttcttttccatgcattatcttaatttcagtttgtatgaattttcctctttttgaggttttaagtgaatgaaagttcttttgtccaaaaaaaacccgacatattatgtttctttcctataattgtttcaaataaatttaaaatatatattttctaaaggttatgaatcaagataaacacaacaactaatcaatctccacaataactagtatatagtttgacaaaaaaataaataaagataaaagtactttttacggggctttatagatttgggtacatttaagttaaaaaagtcagaataaatcactttttgtttggtttatagagataagcattttctgttagacaaaattaccattttgccctcaatctccttcttctttctttattctttctttattctttctttctttcttcatcgcttatttctcttcttaatatttccagaaaatctcaattttttttttggtttttttttgtttttgatcacaaaaatccaataataatgaaatctataccctaagggatagtaaaaagtgaacccaaacaaaataattaaaccgatttgataagaatataagaacgctaaaacaatttccaaatttgataaaagtttaagattttgagattttggttttgcaattttgttggttcgttgtctaggtttagagatttatttgggttttgtctaatctatttatttttgaaatttatttcaatttaatttgtttgtatgttgttgatgaattttgttggaaatttccggattttcttctatatagaaaattcttcaacatgaattagctagagaatccaaaatcataacaaaaatatcaattttcagttccttaatccaaaacaaaagaactgctattaaaaatcagcttgaattttgatctggttcgggaagggaaagagatagtgatataatttgtaggtggaaaagatttgggggagactaagattaaaacggtaaaacagaaagtagaaaagtacatgaagctgtaaggcacaaaaaaaatgccgatacttacaaagggacaaggttttaagtgtttttctcataattgatcctactttatacaactataaacaaggagaatcacaagtatctttaatttgaaagatgatatatgaaatattttagatctacaactatgtatctatatatttatttagttattgatgttaagaaaatactttatttagttttattttaggtttaaaatttaatattttattggatatcatctaagttacaatttacactttgaatatatcatttaatattaatataatctaatttaataaaattaattaatatatttatctatatatatatattacgcttatatatatatatatttttaataattatatattttatttttaaagcctgcaaataacccgtaaacacacgggtttgaccctcaccaacctcacggtagagcagtcagggtgggattagaaagctttagttctgacaaacctaacaattaccactaaaattggaaaaaatgtcaaaacaaatcacaaattttaaaatttgggacgaaaaaaccatgaagttttgacatgtcatttaaatctcaaagtttaatttgactttacaataaaatggttaagttgtgttgattgagtcattttaggcatgccgtttttttgttatttaaaagataacaaagttaattttctataacatctaacaaaaagtaacgacaatg

SEQ ID NO: 34182 - DNA, 954 bp, Unknown; identical to SEQ ID NO: 5049
  misc_feature (1)..( 954): 2750-1469P.txt file - cDNA_ID_3075447; gDNA_ID_1620758; Annot_ID_167085

SEQ ID NO: 34183 - DNA, 3000 bp, Unknown; identical to SEQ ID NO: 5048
  misc_feature (1)..( 3000): 2750-1469P.txt file - cDNA_ID_3075451; gDNA_ID_1620758; Annot_ID_167083

SEQ ID NO: 34184 - DNA, 3000 bp, Unknown; identical to SEQ ID NO: 5041
  misc_feature (1)..( 3000): 2750-1469P.txt file - cDNA_ID_3075485; gDNA_ID_1620758; Annot_ID_167054

SEQ ID NO: 34185 - DNA, 3000 bp, Unknown; identical to SEQ ID NO: 5042
  misc_feature (1)..( 3000): 2750-1469P.txt file - cDNA_ID_3075497; gDNA_ID_1620758; Annot_ID_167047

SEQ ID NO: 34186 - DNA, 3000 bp, Unknown; identical to SEQ ID NO: 20581
  misc_feature (1)..( 3000): 2750-1469P.txt file - cDNA_ID_3075512; gDNA_ID_1620759; Annot_ID_167120

SEQ ID NO: 34187 - DNA, 3000 bp, Unknown; identical to SEQ ID NO: 5068
  misc_feature (1)..( 3000): 2750-1469P.txt file - cDNA_ID_3075516; gDNA_ID_1620759; Annot_ID_167118

SEQ ID NO: 34188 - DNA, 3003 bp, Unknown
  misc_feature (1)..( 3003): 2750-1469P.txt file - cDNA_ID_3075520; gDNA_ID_1620759; Annot_ID_167115
attttatgcatgaatggatttgtaactagtatcggaaaccatccaaacatgtgatgttgtagactagatcatctataaaattgtatggtctaaactatacaagctatgtaaatggtgtctgtttctaatactatgtaaactagttaacaagatttcgttaaaataaactataataaccaatgaatcaaatcggtaattggaactaattgagtgtccaacgctcacaaagccaacccctaaatctcataaacctacaaaaggacaaaatgtattagaagattgtgaatcgcaattttgacaaaaaaaaaagagtgagaaaagaagaagtatagttatctttctaagtctagttaaatgatctacttgttggaacttcaattctaaaccaatgacttctggtgaagttcattaccaaaatgatcggatcttgaagtcattagattctctgcaatgaacattataaactaatgtaactacatgtaaaaattgaagtcatattacataagaaattgaggtcttagtttgaaagcttataatagcaatgaacaaatataaacatttatttcacattggaaaatgaaatattttcctctatatatattatacacttactacaagtttcactagctttgtgaagaggacattatggtataagtgatgaatagacatgcaaaacaaacatcgggttttggtgaatgtgcccacaaaagatttatgaaacatttgttttttgaatttaatgctaaattatattcaaaataaaaaaaaacgttttttacacaaaactggaaactgattgaaactttttatgaaaaaaaaacttctcttctctaagctctcgatgcaaaccaaactctcatttcatccttatacttcaaaacaccacaaccactcatcgtacttaaacgatttctgacgtttttgtctatcatttttataagtctctccggcagggatgggctcttcccgtgtcttctttggttcctttcattccaaattgagtgtatgaaacattcgtcacatatttttggtccaagatcaaactgttttctcttcggatttttattcaacatttgtcacatatttttggtccaagatcaaacagttttctctaacggaacaagattctacagcttctcagcttccacgtggtcccgatcatggattgccacgtgtacgattccacttggtaaacatgatttttttttggaaagacaagttgtatctgtaagattaaataattcagtacgaaaaggcatcgaatcctcactcacggattgttcacaaatgttgtctccaagtagtgtaaaatatttcgctttttacacattgccaaagatcatctccatccattaacgttacgtttatctccgaatatactttatgaaacagtttgttaattaattaagttctagatatcaggtagaaagagagtttatgacactttctgtcatttttagtcatattttaagggaaggtttttgcagagactagaaaactgcaaatcatatagtgtttctaactttgatatattgaagatttttttttgttgatatattgaaattttgatgtaatattaacatgtcttatttatgtttctttatctcattcggatgtatatattttttatgccacaaggttttctgtgacctaatatcttatatgatcaaatcaatagtttctatatccaaatataacatgatctaatggtacaccaataaaaatgctccaacgatgatcgtgaaaaccaataagaatgtgatctgaatttggtttattattacggtgtaattttgttattttactagccagtgttgtatatggatgaatcaaagtgtaattttttgtgtaactaattattcgtcgatcgcgacaattcccttttaagataggatagtttattgatatataaaataatcctaatactaaaatagaaaaagacggtcagataacaaatattttcgcagtcgcgtctaatggtttttacgaagttgaatacagtgtgatctttggattatttttgaagtcaatcttcatctataatttttttttaaataatattaggataataataggttgaagagaaataattatatccataattttctgtaaataaatacagctttactttatatttattatcatcatcgaaccaatgatatgaagcaattttagtcggtaacttggcgagtcgttaattcagttcgaattataaaaagacttctaaacacgaaccgaacacgatttgatttgttctcaagagaaaatatataaatagatttataactctttacttctcaaaaggctaacttttgaaccaagcaatcacgagaaacctttgaaaatctcttactttggatccgttcccttattcacttggtttcttctttaacttccaaaactcaacttgtaaccaaaactttctggtgcttttctttcttctcgtgtcctttatttccccggaaaatttaagctcctcttcgttagtttccccggaaagtttcatcattgttatacactaggaaaaaagaagaagatgaaacccatttgtttccttctctgtttctgcttccttcctgtgaaagtctcttccttttgacacaagtctcttctgtttcaaattttctctgttggcttatttcttcttttccctgattctgttttgttttccctagaaaattaatgaaacgacggttagattctcgggagatcctatcgaacccatgtttttgaatcagttcatgcacttcctgaaatctattcatactttcagaaggaaaaacctagtttaacatatctttaaccctaatttctctgctttcaaaccctaccttgtgaaccaagcaaaactctcctttgatcaatatgtctggtttatgtttcaatccgtttcgtctacgttggtctctaagatccaaattacctttagagccgtccctcccgaatttaccctgtaacccatcttcctccaaaaccaaccggtatgcagaagcagagacgatg

SEQ ID NO: 34189 - DNA, 3003 bp, Unknown; identical to SEQ ID NO: 20586
  misc_feature (1)..( 3003): 2750-1469P.txt file - cDNA_ID_3075538; gDNA_ID_1620759; Annot_ID_167102

SEQ ID NO: 34190 - DNA, 3000 bp, Unknown; identical to SEQ ID NO: 5083
  misc_feature (1)..( 3000): 2750-1469P.txt file - cDNA_ID_3075548; gDNA_ID_1620761; Annot_ID_167162

SEQ ID NO: 34191 - DNA, 3000 bp, Unknown; identical to SEQ ID NO: 5075
  misc_feature (1)..( 3000): 2750-1469P.txt file - cDNA_ID_3075567; gDNA_ID_1620761; Annot_ID_167136

SEQ ID NO: 34192 - DNA, 3000 bp, Unknown
  misc_feature (1)..( 3000): 2750-1469P.txt file - cDNA_ID_3075573; gDNA_ID_1620762; Annot_ID_167202
caggaagagaaggcgtcattccaaatggaggctttgcagaacctgaggatgatggaggagcaagcagagtacgatatggaagcaatacagagactgaatgatttacttgttgagagagaaaaactaatacaagatttagaagctgagattgaatacttccgggaccagacccctcagaagaagaataagctagatgttgcagaaaaagtgaccgagatggattcccctagtgagggaatgagcaacaagatacagagttgtttagttgggttcgacgaagagagattatacatcaccagttgtctggagaagattgaaaacagagtaaatggcaaggctcatgacgataatctaccagcacaagaatctgtttctgagctacatgagagagtagaaaggctgaagggagacttatacttcctagaacaagttatgaattctcttggccatggaaatgaaggcgtgcaatttgtaaaggaaatagcttctcatttgcaaactctgcggagtctcagcatgaaaagacaagatcagactgagtgttgatgtcctgagtaacaatcttcacaaaggtatgttctttcctcttccctgattgttgtgttgattttgttcttcagataacttcacctgcggaaattatagctctttgtacaaacatcttattattcatatgtcgttctggttttttaatatgttagacacctttgtggagaggatattgtagaggaaactaaaagaagttcaagattcaagaagcttaaagaaactgtatagcatcgtcttcattgccttcccctttcgtatacgataatctcagaattctttacgatttcatttttgggtttggtgttcataatttccttatgggttttcatattctttgtgtttattttgcatttttcttctagttttgagtgaagagtgaatgtaggttttgttctgaagttctcatttgattttttttattaggttggttgatacttttgtttagcatgtcaaaagtcatgcaactttgttaaacttgttgtacatttcttcgttataaactacttatacgtaatgtcctttgttaaactcatatttctttgttggtgttaggacctcgaatttggaaaataacaagaaggttgatacgcataatacaaacttacaaaagacaattaaaagaggaagagaagccaaaacctaatatctaaaatattttcttactgttaaagtagtgatatctaaaaaattaaaaactgtctttggcgaaaaaaaaaagggttcaagaataataacatgtaagaccaccatgcatcattcttatttcttcttttagtttgaacttcaataatccgtcctcctctgtcttaaccaactccttaattaatctgtcttaagcttccttaatttctacaacacttcctttgtctcaaccaaatttgtgtagtatcattcatgtcccactcttgtacatctctcacttctatgcttaattggaagattgtatcacagaacatgccacagcttgtgcccaatgcctcagtctcgttttaacctgttgaggatcatctcctgcaaatttatagaatataacatcaaaacacaatcatattatgaaaatatcaatctgacgaaaaagtttaggttgctatgttacctggagacataaccttcaaagaatcagagtcgcttattggactaccaaaagaggaagatcggtctccgagggaagtaggacgggaggatgaagaagatccaccactgcctggtgtagaaaccggcgagatctgacgagtcacagcgaagtaaaggtccaatgcaggcaatgtagttgtaagatgttgcccttgctcctcgttaaacccgaaccctaactcaatagatcctttgagctcactcaagtcctcgtccgtcaagtcatctcctccttcgttatgcttctcaaggtgatggagcatctggcgacggcgacgctcccatgcgatgtctctacgggtctctaacatggagagttgcttcgagagacgtttcttagccttagctttcggtggttccaatggcatcttttgaagctcttctacttcgctgtcgtagaaagatgacgacgatgaggttgatacactcaatgcttctccaaccctcaccatctttctctgttgttaatataagaaatcgcaggcacgtttatgattatcaacaaggggcagaatatttttgtgatgatgtgccttgttgtacaagttagctcatgtaagcgaggaaaaacagaagaacttgaatagattagtgaaaatcccagaactctgattccctttaaaaaatgttcatcccggaagaagaaaaggggtaagaagttttttctgtttggtttattttattaatgtacagaaggagatatgttttctggtgaactttaatggtgtgatattacaaaacacagaaacaatgagtttcttctaccacacatttggtgttgtttaaaagtagggtttgtagaatttccatttgccatttttaaagggatctctctgttaattccctggggagattctggagcttgattgattatggagacagaatccaaaaacaaaccttggtggtttttgttggaataactaactcttacttgatataggttttgttctagaaatttttggtgttgttgttggtcgaaacatattactaacacttgcaactaacaagatggtataaccactaaactagtacaagtatcatttagttaattaaacatgttagtatgttacaaaatttacgaatcaataacgaaataagcaaaataaccaattccaagccaagtgggacaaactcgaccgaaaagaccaaaaatcaatcataatttggtatcaaaaccattataccgggaagtaccagaataactcggttgggcctagcctctaataaaaatcggtcgggaaagaaactcacaactctctctcacacagcaacgttctattgaaatttggcctgaatccccagagtgcgacgaaaatg

SEQ ID NO: 34193 - DNA, 3003 bp, Unknown
  misc_feature (1)..( 3003): 2750-1469P.txt file - cDNA_ID_3075598; gDNA_ID_1621148; Annot_ID_173150
ctcgagtcttgtttgttgttcttctacattggatggtcgttatacacgtgtgaaaattcaaaaatgttgttcctatcttgcacttttctgccgccaacataaaagtgttatataagagactaattcaactagaggtggcattttctctgagttatgcagtgagttcccaaaaaattccaaggaagtctaaatagcctacaacaaatattaagcctaaaagagatttgaaaagtaattgaaaagtaatgagcagtgacttgcttgggatttcagtttcaaaatagtttgtcatatgttttgttttttccccatgaattgttggatttagtttgtctctcgctgaatcaataaggtttgctaggaaaatcgaaatcaaacactaatttcagcacggacacaacaaacatttgttttctaatcgagataaattttaacatcaattccgttatcaataagggactggacaacagctctgattttcccttcaaacttgtcttggtcccttggcgtataagaagccgtgtacacatcagcttcttttgcacgctcagacaagatcctccctatggacatacatgccgggatatcacatcttgacctcagaacagcttttacgtctttagagtttgttcccgcaacagcaacttgcctacatgtaacacggtgcgtgagagatgccgaaacaaagcgctttgagatgaagacatctagagtgaacggctccatgtatgcaactgttcgttgcttgaacgacacatgcttgtctggattcttcgactttttctctttttggtatgtgtatggccggcttgtgtcgtcatccacgtagtcttctacaccaaagaagcttcttggtgcaaaaacagtctgtcaagaatggtaaagccaagtcaaaatagaaacagatacaaaaagaccaagaaacgatagctgaaaagactcaatacttagaacagagctgaacttaatgattgcaaagtaggctcagtaaatcttataaaatccagctattgcatactgactcatctaaatggccagactaaaagtattggcactatcaaacaccaacaaaccattgagaggtggaacaatccagtcaattactttaatgagctacaatttatctaactcaccgtttaactaatttgggttctgctcatacaattcatctaacctctttctagcaaacagcaactaaagctaaagggagtggtctaacgtcggataaatcacattcaacatcgtttccaagcagatctagttatgagatttcaatcaaacaggagtcacaaggaactgcacaagacctgattcaaaagaatacgcttcctctactaattctactaaaaatcaaactattcagtcaagtaaacaaagtggaagaacggtggagtgtacccgtccattgtggaatcgacaactggtttggcacatgaaaggtctaagcttttctctgttacttccataaatcgccgctttacctatagaatacttggcaaccacttgcttcaacattatatctgcaaccacctacagaaaaattcagtcactaggaataatagtgctcataaagacgttctatgttctatgatatagctaactgctaaaactaaattaaaccggaggtcactagtcaataaggatagtagctttgtcacaaaagtatgctttcttttagtgtccattccattactgcatcccaacatattgaagacttcttattgcccagaaaacgaaaccatttgtaataagcaatagagaggcaaacaagttgacttctctcaataacaatccaaaagatagagagcagctaaaagcttgtgccaagaatttataatttctaattgccaacatgatatcaaattagcagctcgtaagctatggaaatgaaaagtattgaaaagattaacgaatatgatgaccttaaatcatttgaagaacacaccccacgatgtgatcataacaaaattcacttcttttatagaaaatttgactcgtcttcaattcaaatgccatggattctgtatctggaagctcaatttgaaataaaaatacactaacgcacctggaaatcgatggctagagcacgacgggttgatattgcagaggatactacactcaaagaaagctgaaaacccacccacggagatagaagaaactaaaattaagattcagtaaacgaaataggttaggtgcttcgcaatggctgccaaggttgaaacgggcaattgttcttcggagctccaaacattgaagatgaagattttctaaaaccctacaaacgcaaaatttggtcttccgtcctcggaaagttactcgtttttcattttctccccataaaaagctaattcaactattaacacccaagggtcaccggttttattatggttttcacaccgggttaaggacattaatttggaatcttgaccgacttagctggttgaaccggaccgtttccggtttaagaagaataaagacgcgggcggggttgaattaaattgattttcagaggaaccgaaccttcacctcacgactctctcactgcctcactcaccgtcaccgtcgccgtcgccgtcgccattgctttctacttcgccgtgcctggttagttttcggaatctgattttcatttccatttcgttccttctgaattctcaactttgtctgcgattttcagaggtagcgaagttcgtttatggaagcttctgctgagtctaggtttgtggaagctccattaattttggaatttactggaatttccggggattcttcgtcaactactttcaggacttgttgttgattctcacagcgtgatcctgagaaaggtattttacttttatgctttgttcttttgaatttcagattaagatatataagaatccgttatacaaaattacaatgaagattatatgaagtttcgaagtttcaaggcaaagttaatatgcacgaagtttatcagctccatcaaaatttcagggtgccaagtattagccattggaaatg

SEQ ID NO: 34194 - DNA, 3003 bp, Unknown
  misc_feature (1)..( 3003): 2750-1469P.txt file - cDNA_ID_3075602; gDNA_ID_1620762; Annot_ID_167208
aaacaatgtccaaacgctgtttaagtccaagggacaaaggacagatctatacatatattccagttcatttcccgccccatgtagacatcatgcaacagtttatcacatcggcctaagaacgtcggtgcaagaaattcaagcattgctgggaagaatataaaaagtaggcataccagtgaattcacaggttgatttaggtgcaacaacaccaacatttggacgaacacagtacttctttggtgatgtggttttaacctgtcaaaaaccacatctagtttaggtttgtatacagaaagaatactttttctcagaaattttataagatattcgaaatcctgaagccagaaagaaagagaaaaagtttgagaagaatcttctttagaccttaaatgcaacataatgatgggtagtattggttagctgtaccacgcaggaagtttgcttcttcaggtcaactacaaaagatgaaaccagttagtattacaaggataacaatgccaaggcaaagatattccttttacaacttccatattttattatagatcctcagaatcgatatgagaggtaagaaaccacatcacagaatgtcagcacatacaaatccagtagcaggaaagagttagaagattcctccaaacaacagccacattaacatcacatcaattcatcttacaggagaatagacccacaaacaatagcaccactatgatagaattctaacgaaatagtgagaattcagaaaactcggtattcataactggaacatgttggccactttgcttaaggaataacacaccctcgctatgaaatccacattttacaaaaaaataagaaactattaacgggaccacagtgtctactcactggaacttaaaaatgatcattttacaattgataagaatcagtccccttatatcttacctgcaaactgcaacgttcgtggttgaatatccaacagcggcatattcatgttgctgtgacaaaatgactcaagtatcaaacagctaccacttgcagcaggattctctccacccctatttcaacaaaaaaataataagagaaagatcagcccagaaccattcaagtatgaaactgtcgacactagagcgaaaaacaaactcagatctatactctatttgggacaatcataaacccgctctcccattgggaacatgacgaaatctaaccaaacagtcaacaatcagaaaagtttctctgttacactctttcgagtccggattctcgtcttccgtcaccataaacaaaccaccgcactaactcgtcgacgacgcgttctcaaatctgacgatacgaactcgcccgaagactcaaacgtgactatattttaccttaatgcgctcgttttttctcagcgatccgaccgacacaattttttgggcaacgcgctttcgactagccggaaaaccaaatcgtcctagtcccccagtgtgatctagttacgccaccacaggcctgatagtattaaaacaaaagggcgaaataaaacgacgacgtttacgaggagcgactcctcgggatccggtagccaatagtaaactcagatcacatagatcttcccgagccctagcgatttcgatttctaaagcagattctaaagacaaaaatcaggaaactcgaggaagaggaacctagtttcgaaacaaaaacaaaaaccagagaagaagatgatcaacgagaatgatgaaatcggaaggaaaccttaccgtctctccgacgaagaactaacggaacggagcttgagattgagcgacgaagaagcagcgatcgagagaaagagagaagtgcaaaaactaatcttagtgaaggccaagtatggaaatgtattaatgtgttcaaacacattaaaattgaatttttttttaagaaaaagtatggtactgagattcagagatggtgaatatctgttgtacctaacagcaatttagtaaactataatttctgacgactatttttcgatacttttgtaacaattatcgtaaaaaacaaaaaattaagtgagattacattcgacgttagatgccagaaataatatatatatgtgattgtgaatatgtacctttttttcttttttcaatgagtgtaatatgaatgctttgagaggattacacgcgtgattctgattcggatcaccaacttcttttgcttcccttttaatttctttcctatcttttgcttttcccattcatctctctcgctttccacaaaggcgagatttgaatacgtaatcctaattatactctcatagagatttggtaatttggcccaaaatatctttctactttgtaatatgtcgatgcatagaaaacataatcttattctaacattcacaaatctcctatatttccatattgaatctctcagtctggatcggtttgtaatctctgtccagctacctcttacgtttcaggtgtttctatgatttatccattggcttcattggctgcctataacttatatatcatgttgcaatctttgtgtgtgttgtgttggggagagcttatagccggccgctcctccattagcttccaaatggttgaatcagtctgtatcagatttaaactcagtgatagcacccacgttatgcatgatttttaagatttgataagcagactgtttttaacttcaattcaagagcatcatccactttcggcttaatatcctatattaatttctttaacaagctaaaatgaacataatgaaaataactacactcactgattggcaattactaatatctcaaaacattaagaagtattttttttttttttgggtgaaaagtcactgtctttttcttaaagccaaaatttatacggaacgacaaaacaaaaaatatgactaaaaacttcttaagcgcaatcactgaccatgcagcctattttagtttttaagtcttttatatacattggctgttatagtcgtaaaacaatcaggtatttgttatggagataacaatttgggaacgcataaatagtgcctctgatg

SEQ ID NO: 34195 - DNA, 3000 bp, Unknown
  misc_feature (1)..( 3000): 2750-1469P.txt file - cDNA_ID_3075605; gDNA_ID_1620762; Annot_ID_167207
ttctgttagcataatatgggtaaataaaatctcaagaaaataaatggtcaaaggtcattaccctttccgaggtcatcagggtctgcatggacaacaacagccctaccaacaatagagtttggtccagtaagaggaatctgttaagccaacacaaaatgtatcttaagagattggttcactacagcaggtttggattaggaaaaaagcataaaaaggtacacagctataaacctggcaatcagtgattgtgaaggtggcagttcctgagaaaagcaaaacaaaagcttttatgtaaatccatgaacactaccgctggtcaaaggtgacaactgtactatacaactaagactgcaaaatcaaatttgagagagtagcgaaatttgatgcaaaacagctctaaataagcttgagatgagggatacaaatgttgagaaggcataccatcatctccaacagtgatgtttcctagatcaccagcatgtcgattagcatcctcaggggcaccgtgtgttttaccatcggggttgaaatgtggacctaaaataggaatttaataacaagttcagttacttttggcgataattaaagttcccaatacgaaacataaatataagctccaaaagtttctaatccattgaaaatttgcagagaggtatgcataagagttaccagtagacatgcaaccgttagtggtgtcaccaagagcatggacatggaaaccatgaagaccaggcttaaggccagaaactgttccactcacagtggtcacacctgcaaaaaacccaaacaaagaactcaatcatttgagaggaaggaaaaaaaagataggcttcaaagatcttataaagcactcttataaagaactaccatcgccttcctgggtgaaaaagatagtccccgtaacaccctcactgctgttcaaaactgcaactcctttcgccattgttacttggcctttgtgatctgtaaaaacataaacataaaccaatacatatacaaataagtaaagatccagaaaaaaacaaatggttctacacaacattaaattagctcaacagacaagaaacagaatttgaaaacccaaaaacatcaatctcaactaagctttaatacgcaccaaaacatagatcctaatcccattataagaacacatataccagatattcaacgatctaagccataataactcttactagttcacataaaaaggtcaaggcatcttcagaagagtgtgatacatccaaagaaaacaagcaaaggaatcggtagatccgccgatcataaatcgaaaaaaacatttcctcaaagatctatacgtagattcggcggagttggaatcggaaaagttcgaaatcagcacagacgaggacaagaatcgatttaagaatccaaagtgaagaatcgatctaagatttgaaacaaattaaaaccaaaaaggaaagcaaacatacctcaggaaacccctttggaaagaatcaagtgcttgagctatcaaaaatgctgaattttctctctgaatgtttttgcttcgtctctctttggttacttgttttctatatagcccacgaggtccaaaagctgggtaggtacgtacgtgattagcattaatttatttcttacttgaaaaaagccacgtcaggataatccaagatagacttttcctaagtttgactcttctctgctgatgtggtaaaatttgattggataaatactgtaaaacattaagtttaagtcatcgtcattgaatttaaattacgtatgtcgtataattatttctaagacgttggctcaattataaatttcataaaatcttaagaactaattttaacaaaatacagaaaatatcatttgtatttttaataatataatctataaacatatatatatatatttatgagagtctgtcaaatttgtatgtagctaatttctttggagaagaagaagggaacctttgatggatttgtaatgttagactatatatgcctatctagatgcatgcatctcctaattaacctagctagctacaagaggttaaagataatggatgatcacctataagtctagaacgttgatatataaactctgttatgcgtattatatcaaaattttggcatattattctctttgcaggtgacatgatatttgtatgttgtttatacactagaaaaaaatattgtgattttgttccacttccaaccatcagaggcactatttatgcgttcccaaattgttatctccataacaaatacctgattgttttacgactataacagccaatgtatataaaagacttaaaaactaaaataggctgcatggtcagtgattgcgcttaagaagtttttagtcatattttttgttttgtcgttccgtataaattttggctttaagaaaaagacagtgacttttcacccaaaaaaaaaaaaaatacttcttaatgttttgagatattagtaattgccaatcagtgagtgtagttattttcattatgttcattttagcttgttaaagaaattaatataggatattaagccgaaagtggatgatgctcttgaattgaagttaaaaacagtctgcttatcaaatcttaaaaatcatgcataacgtgggtgctatcactgagtttaaatctgatacagactgattcaaccatttggaagctaatggaggagcggccggctataagctctccccaacacaacacacacaaagattgcaacatgatatataagttataggcagccaatgaagccaatggataaatcatagaaacacctgaaacgtaagaggtagctggacagagattacaaaccgatccagactgagagattcaatatggaaatataggagatttgtgaatgttagaataagattatgttttctatgcatcgacatattacaaagtagaaagatattttgggccaaattaccaaatctctatgagagtataattaggattacgtattcaaatctcgcctttgtggaaagcgagagagatgaatg

SEQ ID NO: 34196 - DNA, 3003 bp, Unknown; identical to SEQ ID NO: 20612
  misc_feature (1)..( 3003): 2750-1469P.txt file - cDNA_ID_3075617; gDNA_ID_1620762; Annot_ID_167195

SEQ ID NO: 34197 - DNA, 3003 bp, Unknown; identical to SEQ ID NO: 20613
  misc_feature (1)..( 3003): 2750-1469P.txt file - cDNA_ID_3075621; gDNA_ID_1620762; Annot_ID_167194

SEQ ID NO: 34198 - DNA, 3000 bp, Unknown; identical to SEQ ID NO: 21209
  misc_feature (1)..( 3000): 2750-1469P.txt file - cDNA_ID_3075628; gDNA_ID_1620762; Annot_ID_167192

SEQ ID NO: 34199 - DNA, 3003 bp, Unknown; identical to SEQ ID NO: 20614
  misc_feature (1)..( 3003): 2750-1469P.txt file - cDNA_ID_3075636; gDNA_ID_1620762; Annot_ID_167190

SEQ ID NO: 34200 - DNA, 3000 bp, Unknown
  misc_feature (1)..( 3000): 2750-1469P.txt file - cDNA_ID_3075644; gDNA_ID_1620762; Annot_ID_167187
tcgaatactcgaattttgaatttgacagagatgatagagagagagaaaaagaaagcttttttatcctttagtttgagaaaaggggaagaagaaactattcacatgttttccattaatactccttttctgtgggcttttgggctgacccacatcataataattattcaatctaatcataaaaaattctatcattagcaattacattgcatataatatatgaacaaaaactatattcgattttaacgatatagtaagttatgatggttatatcatctacgaggctaaccatactcgcaccaagaaaaaaatgacgtttgactttagactaaaccgaaggaaaaggtaaaaaagtaaactaatgtgatggtttagtggttgatgatagagtctaattgttaatagcctaatttcttaaagaagtcttcattacttgtacaataatatcttaacacctctatagatgtgggtgggttggagatgcccttagtgcatctaaagatgctttatttaacttggttcacaaatttcatttttcatttgctgcaattgcacaagtaagaatgtttcctttttgtttttgtttttttgtctaaagtaagaatgtttccttatttcatggaatataattatagaattacaagttgatcatatctcaacaacgttatctaggttttcaatcaatcgtttcatttgaatcaatactaattcgtttaagaccaaatccgcgcgatgaaaaattcctcaaccgttttcggaataaatttataatcttaaaatagcttaatcaagaattttttcacgtaggttgtaaaatatttgagaaagaaatagttatagacttaaagatgacatcatctagaagataaatcgaagaaggcaacagaaaactaaaagataaaagcatccgtttctcaatctccgtttcttgtctcttcttgctctcttgatctcttccattgtttattaatttacacctttgacgttcaaagagtgggtgatcttttttttgttctaggtatagtggagttgttgttcttcttacgtactacaattctgataaggtactccaatatatattgaagacaggagaatgatctatatagatgcttattgatcgagcagaatgtctaagcttatgcagaatccggtgttacatgaattgaagaagcaagcttctttcttcatcaaggaaaagatcaagactgctcgtcttgctgtaaccgatgttactgcagaagaactgtgagtaaactttactaaagttataaacctatttcctgctaaacctaaatctctcatattttagaaacctttacaagtattatcaagtgtttttgcaatcaaaacttgtttttgtggtatttttagcatatctctctctctcttgtactaattgagttgaaatataaactgtctaatgtgaagattgacagaagaagttacgggcagcgatcactcatccatagactcacgctccatggcggccataacaagagtttcttttgaggttgatcaattccaaagaatcgtgaagattctacgtcaaaggttattttgcctcactgttatataagcaaaacaacttagaaataaatatcacagattcacagaaccatcaatgatttcatcaacacaatactacaccaaaaataaaaatcaccatatttttttttgacggcaataaaattaccatttaagcatcaaaaatcccgaaaattttatagtaattcatcataatagtcaagaatcagattactgtttagtgtctatataatttattgattggtaatttttttttgtagaatggtagtgtttgatagaaaggaatggcgcggcatgtgcaacacgttgtcaatgttgaaccacttgttgctcaatggcccactaagtgtattcagtgagtttcaacatgagagagctattattgaagatgctataaagatggagtggattgatgagagagggttcgattgtggtctaaaggttcgaaacatagccgagaaagtactaagattgcttgaagacgacatgtttcttaaagatgagcgagaaagaaaccgtaagcaaagcattggtcggatcacaggatttggaaactcgagttttgtcatacattctgaaacgaacaacggacgagacggctcgttaatgttgagtaaccatcaaacttgtgaaaatgattgtatcgcggatgatcatccattcgtcgaaaatgagcacaagactgctcaactcttgctttcttcttcgacttagagttagatttcccttggttgtattattatgtttgctctatagaattacttatgaccaaagaacaaagttttggaaattctgagacgatgaactcacacaaatacgttaatcgcgacgcttacatgcatcggtgattgattatctctgtatggagaaaagaactgcatcacgtattagaaaagaaatagatgatagatttttgtttttaggtttgtttctcgaagaagaaaaaaataatagagattttgatttcttaacaagaagaagagtatttataagccaagggtacacatgctacagtatatgctaacatttatgcttaacctaaaataatatatcactatttttttatttatttttcttacaaaaaaatatatttattagaaacatatgaaaaatatctacataaaatagaaatacagtatacaatagcgaaaaaaacacatgttatgcgagattagatatacgagtaaatgtataaaaactctatttattgaattagatattcacatagaaatatgttacttaagtatgtatttgttttgtattttcagtaaaggtcacgtgggatttattttttgcatatttagtccttgggatttagatctcgtaaacggcgtcgtactaagagtatcctccggcggcatcagttttggagtttcttggatcatcacactcacctgcttcgttactcttcccttggattggattggattggattcgctctttcatggttgaagaatg

SEQ ID NO: 34201 - DNA, 3003 bp, Unknown
  misc_feature (1)..( 3003): 2750-1469P.txt file - cDNA_ID_3075648; gDNA_ID_1620762; Annot_ID_167186
aaccatgggtatggagtagcccatgtactcgatgccatttaagaacccagtgtatgcctgcaaaacattgttcactgagagttaaacataggtatacacaattaaaagaactcctgacatatctaataactagatcaaacaatcaggagcatccataaaataacgcttggacacatttatatcacatatgccgctctctttgaataaacctaatactagatggtgcaacataaaacggattctttaaaataacggagtcttgatggatatgcataccaaagatgctaagagtatagagccaaaaactaaggaaagagaacgaagaagcctctttcccattctcaatccccgtccactttcttcgccttcctcctgcagccagtgtcaaacatcagtgcacatcaggattaaaagagccactaagtgtacggacatcaaaacataaggcttcaaaaaaattcaaaactcacgttatatattggagatgaaggtgcttcaaaggattttaatttctcaaaaattctgtaaacaaatacaaaagacatgaactgcagcggtttgtattcaacattacgttttatcgcaatccatgcactctgcaaaagaaagaaacagaaagagtgggagaggctcatatctgattgtacttgaaatgtcatatatgcataaatgtgtaagaaacaagtcactttttctgcaagaattcagtcatttatgcatgatgtcttgattcataaagggtacagataaaaaaaaaaaaaaaactgacatttctaataatagcaaacctcatatttcttaaaaactacttacaaacacaactgatattgctaggttgatcaacatatcattcttggaggacctggaaaacctgtaacaacaagggtaaatcatgagtagtaacagatcctgcttttgaatgatgaaaattaataatgcgagtagactcataaagaatctctaccttggaccccatggtataatgggctgcttatcagcatatttaatgtccttggaaacctgaattatgaaaaattcaccaaggattgagaaagaaaggtcatagagttcaagacagcatatgacaagaaagaggatacgatacacaccttaaacgaaccaaaagtcacaccctttttcctattcatcaactgggcatacatgagcttatcatatgccttctcaagctatcaaaaggtaaaacagagacgtgttaacaagaaaaaaaaaaaaaaaaaatcacttacaggactccaaagaaagagagaggtaacgtaacttactagagcagcagtggcttcatcaccgctcctctgagcatctttaagtttccttccataagtttgcttgatcttgtcaaatccctctatagggttaacaccaagaacctgagaaggtacacacactcatgtcatgagaaatacacaacgaccaacaaaacaagtcctttatagggctctaacgatcaattacctcatacggattaaagtcagcatcagactgtggattaccagccgcagacgaagcagcacgtatcacaatcctgctctgtaacacctttccgaggggaagcctgagaatttcaatcatcctcattacaatgataacgtgtaccaaatggtctgataagcacaacaatggaactctcttaagtgcaattgaaagttgtaaactttataggcaacagtaagaagctcatccacgaattaagccgtcggaattcaattgacaatgtttatgaaggaagaagataacggttacccacaaaatccgtaagtttacacaacaaaaagaactatcaaacgatgattcttcgactttaaagccaccgaagagaagtggaaaacaaaaaagcagcatcaagagaaagtacctgacaaaagaaggcgatttgggagcgcgaagagagttcctgagagaaatttgaggatgatggtaacgaagcgcgtttgatgttgagaaagccatgacggaggagcaagaagtagatagtgcgggagccatggcagagcagagctctagtagggttaaaaggaaactagaaggttggtgattgatgtttggaagctaatcattcaatactcaatagtttgttaaggctaaaaactgaggcctgaccaatagttcgcgtggcccaatggataaggcgctcgcctccggagggggatattctcggttcgacctccatcgtgaacgaattaggtaataataaagacggcctgctttcttcagcccaactgatttatcggcccaatccagtgtctttattagtttgttttcgtgggatctctggtttacttacttgcagggattatctcccaattccaatccaaacatgccacacttttcttatctctttttcagatttcaatctcgtccaagaaatcgtttagtactcacattcaatttggaaatgtttttgcataaattggggttggatttcctacctctttttcactagattgtgcattatcaatttatgaactttttctggaaacatattaaattgtagatccaatattttatcttaacaaatctggatctgttgagaatgtttttctgtaatttagagaggattgtaattgtgtagtacatttgataataaacttaaatgtgaattttagactaccaccaagtaattatcatttcaaagaacaaaccaaatagataataaagaactgttagaaagtaaaattgtatataataagataagaaaagacattacaaagtacaaaccttctccaagtaaacttctaacaaaacaaaaaaatagatttggattgggaaataatatctaaaatcctatttaaaacaaaataaaaacaaaaaagatataacgttaaggaaaaggaaaatactagtagaaaaaaaaaacatgtaggcatcaaaaggaatattctcaagagttttggctataaaaaaaggtagagccgactcaagaggtcttcttaactcacacaagaaccaacacaaaacaaaaaatattaagaaagtgatattatg

SEQ ID NO: 34202 - DNA, 3000 bp, Unknown; identical to SEQ ID NO: 20616
  misc_feature (1)..( 3000): 2750-1469P.txt file - cDNA_ID_3075652; gDNA_ID_1620762; Annot_ID_167185

SEQ ID NO: 34203 - DNA, 3003 bp, Unknown
  misc_feature (1)..( 3003): 2750-1469P.txt file - cDNA_ID_3075658; gDNA_ID_1620762; Annot_ID_167182
atatgctgaataaccgaagccacctcttccaaattccctcgcctgcagttatagttaaccagagaattatatgtgacaatgtcaggatagcaaccttccactgccatgtcttctaaaacttctatagctcgagcgcttccacagtacctgcacacgagttcgaccaaaaccgtgtatgtaatcataaatggagggcaaccattctgcagttgatccttccaaaacctgatggcttgctcagcattcccataatcaaacatacaccgaatcactgtgttatacgtgatcacatcaggagggctcccactcaaactcatatcttctaagaggaccaaagcagttcttatatgccctttcttgcaaagatttccgatgatcatgttataggtaatagtatctggaaccccaccagacattaccattactctcaagatacacattgctttatccagttgatcaattctggctagaccacggactaagtttgagcaagaaggaaaatgaggaacctgattatgtcgtgccatcacctcgacaagtttgcacgcatctgttaacttcccattgctgcacaggttatgaaggatctcattgttggtctcttcgtcgttctctgtaattggtccatcagatgataaaccaaattgcttcataggtttcactctggctctcaagttagtaccgacaccatagtgatggaactctgagcttctctcagcatgatcatttacattgtcaatgcacacactacttaacaagccgtgacatctaaaaaaaacatcctttttcagcccaatttcttgcttccaatctaaagaagaaaactttctgcaagataaaggattcgcctgcttttgagacagactaggaatatgcaagaactgaacctcaagtagcaaattcgacgaagccatttctcagaatccagaagctattttaacaaaacagagatctttccttttacaaaagcttatcaaactcaatgaagaagaagttagaccaataattatttgctggtatgatgttcagtctctgctgctttatctcataacctattcttgagtgaatggagaaaccaaacctgtgaaaaggaaaggtacaagttatagagacagagaagcagactgaaacagtttccaacaaaagaaaagaagcagaaaaccttcaagttgcggttaagtttgagaaaccctaacaaatctggagaaatgatgagtgtgagaaactcactgttcgttgttcgaagccgacgcgggttttgagatgataagtagggtttatcctaaatttacaatgtgcaccctatatgtctcgacatgtttcatttattcccacaaacttatgaaacatctaacattaacctcctctgtttttattccctttgtttttgtgaatcggtttaattattttgggccaattcagctatcggattgggctttttcaagttttgggttgagttacaaccaaattaaaaatcaaacagagatcaatttctccgcatagaaaaataacatgttacattaccattcgaaaacaagatgaatagtcatttatacacgcctctcttacacattataatgtctaaataattgcattatcatattcaaaatttagatatgttggtcaaaaacagaattaagtattataaattgtgtataccaaattagttgacgctatcattgcatatcatactcacatactacaatatttattacatgaactaagtgattgtattccagtggctattttcatttaactataacaaaaaaatcgaatgcgataaaactacttcgaaaataatcgatggctcttggaatttttataaaatctagttcttgaaataaataaaaatttctatgcaatatttttcggtaaatttttgttctctattacaataaaattttattttaaagaaatgaaattgttatttagcgtatatttgtaaccaaattagcaggcgtaaatacaaatcctttaaataactctgttgttgtgtggatatgcggtaatgtccacccgtgaataaatgtttacgtgttatatgacccaacaaagtgaaccaattatattactcctctctaacgcacttgtttattgcatttttatttatttgatggtcgaaacaaaatagtaagagtagttgttgcataggaaattgcatctgcttgcttttgaagcgttaataacttataaccaagcaagacatatatcatacagagcaaaaaattaggcaaacccagaaaaagccaccacatgttcctcttctcatgatcttaaaattgaaaaaaagaaggtgataagtttaatctaatcttgaccagtgaaatagctttttgttgcttgttgtttttgttcattcttcacagatttaattgtcacatacccaacgtatatggatggacctgtagatttaattccagttttacccttttcttcttcctttcatctgattttgtttgctgctttttttttgttttctggggaatatggaaaaggttaggtttcatatttggacctttttttttggtgttgaatttttcttcttaatttttatgcaaacatggaaaaggacatgcgatgataatcctgaatctactagtgcttagatctgatgaatactggattattaaaaaaaaatattactaaaaatttcaatgatctagggtttcttcagatctttaaatttgttgctgattttactcgatttctcttagtctgggtgcagttgatggagctccagctattttgaccatccaatttcaccagaaaccctaaatcacaagactatgtaagcattttccttatggctcttcttcctgatttttgattcagctaatttggtgatgaaccgtttatatatatctgtaatcgtactttaccctgaaaatatgtacctaccatatgtgtcatgtgtatttttattattttataaatggttgtgatattattgagacatgaatgaatgatgcttcaattgtatgtagtgttggcacagaagtaatg

SEQ ID NO: 34204 - DNA, 3003 bp, Unknown; identical to SEQ ID NO: 20618
  misc_feature (1)..( 3003): 2750-1469P.txt file - cDNA_ID_3075666; gDNA_ID_1620762; Annot_ID_167180

SEQ ID NO: 34205 - DNA, 3003 bp, Unknown
  misc_feature (1)..( 3003): 2750-1469P.txt file - cDNA_ID_3075670; gDNA_ID_2096295; Annot_ID_195535
gatattatgtaagaaggcagatgcagtgattaaaaatgcgggtgttgtgttgtttaggatgagattctggaagttgctgggaagatatacaaggcagggatgtctcttctagtgattgataccgagaacaagtttgtttcaactggttttgcaaaggagatcgcaagagttgctcaaggttgggtctctgcaattgattttgagatatttttttttgtcatttcaaagcagaaaataatcacattgtgttttgattgttcttcttcctcacaggaaaatattattacttgccaaatgcttcggatgctgtaatctcggccaccactagggatgcactatctgatctgaagaattcttgacctcattttgtctgcaataccttgattctggatcaaagtgtatattctaattgtgcaacacatcagtcactaaacatgaaattataagaaatgaaattttgttttaacatactcttaaaatgaatttccgattttattccgttggtcggtaattgacgactgatatgatgatgcattagtgacagatcactgtttgtattaagaagaagacgatgaagctgcaatattcacaattgatacaagaattaagatagtcggtataatcccggtttgcagtaaaccctactctaatgtctaaaccacatcacaacatcaaatagatggttcggtggtttagttacggcagatacaccggcctgaaccgaataaaagaaaactggacttggctcctggagaagagaagactgtacagctttctgaattccgaaagaaatgaaatctctctgcttcatttctacagctccattgattcgttcgcctccatttctcgatctttctccaacaagcttgaatcgatttacccttaaaattccagcttctctctatgtatctcatccaacaagatgcagcatttcaaacccgtcgagctctgaggaattgttgaattccaatggtggaatgtctagggcatcgattagtgtcttcggaggtacttcccttaacaatctcaagatgcaagtgggcagtccaatttctctgcattcaatcaatccattagcaaagctgagtttgagtgatcaggcatttcttctcttggccttcatcgtttgcacggtaaaaggagtttgctcgtgttttgttttgaccatttttgttgattcattgataaaggtttagactttttgatctcttttgatggtcctctgttacagacttcagtggcttttacaagtcttgtgattacagctattcctacacttgtggtaagtctccacatttgtctcaattcttttgcttcagctatatcctaaccgcatcactaattttaaaactgtttcaagtcattaccaatgaatcaacaaaaatggtcaaaacagatgaacaaagaattgattatttgtaatatgctatcaacaatctgacatataccttttcaaactcagtgagaaactatgacatgatctatgttatgagtgtagtcctctgcttgaaatttctactccacacttgctgttagcaccaactgaaaggataaaaggctaatgagtaacacatgagtacagtcactaacagataaaagattgaactataattgttgaattccacacttgactcttctttatatgtgtcctagatttggttcagctatatgatcatttctatttttggatttggctgaattcaacaaagcttggtggaatttttcagtttaatatgtctgtctctttgttcttggattgatatctattcagtatgtcctatatttacttacacaccttcaggccatgggtagagctgcaacttcctttgcaaagttagctgacacagctcgcaaagaactccctagtacattggcagcggtaaggctctctggcatggaaataagcgatcttactcttgaattgagcgatttaaggttatctctaaagctcttttcttttcttttcttttctggcttttgatcatctcaactctaaaaaaagtgaatgctacatgtttcaaagcaattagttcacaattagttcttccgagtcaccttgttatctgtccggaataagaaactttttctaaatcattattatgcgatgcaaatggtttcagccaagatataacagatgggataaacaaatcagctaaagcggttcaagcagctgaagctggaatcaaacagattggaacacttgcacagcagcaaactctctgtaagcttcttctaagcttttggataatctgtaataaaagctgctgttcatggtggcaacagttcacactggtaaaaaaaaagcggaaaatatgatctgatgatgaacttgatcttgtgattcagcaatgattgaagagagagcaaatttaccagaaatatcactacaacctgttgtggctggtgcagccgaaaagacttctcacgcaatcggcagtgcaaccaagagactaatgaacattataaccggaggaaacaaggatgaagattagacatttagaagttttcacttggagtgtgtttttggtccgtctttgtttgaagggattagtacaaggtaaagtccatttagggaaacagagaatctatgaacaagaagactttttagtaaaatttggtatatttatgaaacctgaagtgtaactgtgtaagacacaaaagaagaaataataacagccacagccattttaagatgtacaacagcagataaaatagtttacataacaagccgacaaaaaaaaaaaactattctattcttacatatgggttgactttgcaaagatggtaatagtgtgattgggattgggccaaagttaataggcccaaaagaagtggaaaattagaagtaatgaatcctttgattgagatagaagctttatcctcttcttcgtcttcatcatccgcgcatcaccagttttttctctctctctacaaatcttcttaacggcctttcatcaatggtcagcagacttagctttcgaatataggctaagaacgagcatg

SEQ ID NO: 34206 - DNA, 1386 bp, Unknown; identical to SEQ ID NO: 20622
  misc_feature (1)..( 1386): 2750-1469P.txt file - cDNA_ID_3075670; gDNA_ID_1620762; Annot_ID_167173

SEQ ID NO: 34207 - DNA, 3000 bp, Unknown; identical to SEQ ID NO: 5110
  misc_feature (1)..( 3000): 2750-1469P.txt file - cDNA_ID_3075696; gDNA_ID_1620763; Annot_ID_167251

SEQ ID NO: 34208 - DNA, 3000 bp, Unknown; identical to SEQ ID NO: 5110
  misc_feature (1)..( 3000): 2750-1469P.txt file - cDNA_ID_3075696; gDNA_ID_2926194; Annot_ID_201301

SEQ ID NO: 34209 - DNA, 3000 bp, Unknown; identical to SEQ ID NO: 5108
  misc_feature (1)..( 3000): 2750-1469P.txt file - cDNA_ID_3075702; gDNA_ID_1620763; Annot_ID_167246

SEQ ID NO: 34210 - DNA, 3000 bp, Unknown; identical to SEQ ID NO: 5108
  misc_feature (1)..( 3000): 2750-1469P.txt file - cDNA_ID_3075702; gDNA_ID_2926194; Annot_ID_201296

SEQ ID NO: 34211 - DNA, 3003 bp, Unknown
  misc_feature (1)..( 3003): 2750-1469P.txt file - cDNA_ID_3075709; gDNA_ID_1620763; Annot_ID_50059
atgatgatgagagatatttcacgcgtgggtgttgagagaacataaaaacagagtcatcactctaatttttgttttgttctctagggaaaatcaaaaagaccaaacaaaaatttcagtcaaataatggatcatgattaaacccacaagagaatttcgattacaaaactcattagataaaaaaagtttgagactttatataaacaagtgtgtgatcgtatgtctctgacaagacaaagagagagaggatgactcacctgagatggtaaggaaagaagaagatattgttgttttagtagaactgagaaaggttgtacttggaatggagtttagaacatgatactgaagagacatggctttaaaaagctctgttttctctgtctaagtatttagtgaagaagagatgatgaaactatttggtgagaaagagagagagagagaagtcttaatgggtatttataaggacagaaccgacttcacatcagagattgtgtttcattttactctttgagaaagaagagagagagagagaaggatatgatgcatggaatgtgtttttgtgggatcttccaaagctacggaattgaagggtaaatttggctttttcttctatttcctattctcttgtttatatctcttttacaacttgatttttttttataaaaataatggcataaggtcgatatctttgaaagtacacacacacatacacatacgagggcttctaatcatatcatatcacaaacaataatttttaaggtcgtaaaagataattaggaaacaatatttgtcgtgtgacaagtcatatatgactattgcaatagaattattataaatttgtcttggtgtaaaaaacaaaaaaaaggatggtacttatctagtgtcatatggtactaatctatttgggattcctttttttgtcaagtttaagattattttgttttaatcttaagtaacaaattagtttctgtttaccggaaactctaaatacatggattgatatatttgtcgtgtggacaggtaacaatacattactaatattgcagtaaatctttataaatggtatttgtctcggtctagataagaattagaagtagatggtatattacaatctcttgtcaaaacagtatcaatctggtagtaattcctagtttgtcaagttcaaagaggagttttacgatttcttccttttacttacatcttatcttaagactctagactctctctatctttttccagtttttcatggattccatacttataaaattaggaagtagaaagtacacgtgtagttatattattgcatgtataactatttgaaatttgaattactaccagtcaaatatagagttgagacgttttttttgttacgtgacaatagctttaaaaataattacagtagtcttgctactcatcaaatgcctaaataaaataaaataaaataatgcctaaattatttattcaaacatatatatatatatatacgaaatgatataatttacatatagttatatcaggaaatgtatttgtaaactgtaaaaatctttcaacagatgttatcatattttgtgatatataacgaaatgatatactatagttttggaaaacaacaaatcactaaatgatacatggttgatcgaatttgcaaaattatcaattttaggagaaattatttttgataacggtttataacgatactcataaataattgatcgttaacgtgcatacaataaaattaacgaattccaacatttctataaattacatttgactcaaatatgtcaaacatgaatctcacttaatgtcaaacaatatgttattgaatgaagtactaccgttcggaaaaacgataaatcattaaatgacatgtggtagattaggtttgcaaaattaacattttcaggagaaaaaatttctaataacggtttataacgacaacaataaatacttgatcgttaacttgaccatacatagtattaacgaattcgaacattccaacaaaacgcatttgatgcaaatatgccaaacatgaatctcatttaatgtcaaacgacatgtaatgaaatactacagttcggaaaaacgacaaatcactagatgacatatggtagatcaagtttgcaaaattcatattttcaagagaagaaattcctaataatgatttataacgataatagtaaatagttgatcgttaacttgaccacacttaaaattaacaaatttgagcattacaacaaaacgcattttatgcaaatttttcaaacatgaaccttatttaatgtcaaatgatacgtaatgaaaaataaatactacgtacgattctagaaaaacgcaaatcactaaatgacacgtggtagatcgagtttgcaaaactaatttcaggagaaaaaagttataataacggtttataacgacaataatatataattgatcgttaacttgaccacacataaaattcacaaattcgaacattccaacaaaacgcatttgatgcaaattagtcaaacatgaaccttatttaatgtcaaacgatatgtaatggaaaataaactaccaattttgtgttttaatttatacttgaataaattcagaaatactaatttcgatcatcggtgttcacctttcttctaaaattgttatacatattattggagatctttgtttaatatatagatatatagatatctatatatctatatatatatatatatatatatatatactagattttaactcgcagtacaccatatgacgatttattttctataagtagtgtatttgaaaatttaatgattatatattatatataaaattttacaaattgcactaatttttgaagatccaattgtaccaattctataattttacaaattagtgaattttctaagcctttaagataactgggcctaagagtctttaaaaaagcccagaaaatgtcatcgtccaggtaatggggataaggggttttagattcttttaattttgtttccgagtttttcagccatg

SEQ ID NO: 34212 - DNA, 3003 bp, Unknown; identical to SEQ ID NO: 34211
  misc_feature (1)..( 3003): 2750-1469P.txt file - cDNA_ID_3075709; gDNA_ID_1620763; Annot_ID_167239

SEQ ID NO: 34213 - DNA, 3003 bp, Unknown; identical to SEQ ID NO: 34211
  misc_feature (1)..( 3003): 2750-1469P.txt file - cDNA_ID_3075709; gDNA_ID_2926194; Annot_ID_141183

SEQ ID NO: 34214 - DNA, 3003 bp, Unknown; identical to SEQ ID NO: 34211
  misc_feature (1)..( 3003): 2750-1469P.txt file - cDNA_ID_3075709; gDNA_ID_2926194; Annot_ID_201290

SEQ ID NO: 34215 - DNA, 3000 bp, Unknown; identical to SEQ ID NO: 5105
  misc_feature (1)..( 3000): 2750-1469P.txt file - cDNA_ID_3075713; gDNA_ID_1620763; Annot_ID_167234

SEQ ID NO: 34216 - DNA, 3000 bp, Unknown; identical to SEQ ID NO: 5104
  misc_feature (1)..( 3000): 2750-1469P.txt file - cDNA_ID_3075717; gDNA_ID_1620763; Annot_ID_167232

SEQ ID NO: 34217 - DNA, 3000 bp, Unknown; identical to SEQ ID NO: 5104
  misc_feature (1)..( 3000): 2750-1469P.txt file - cDNA_ID_3075717; gDNA_ID_2926194; Annot_ID_201285

SEQ ID NO: 34218 - DNA, 3003 bp, Unknown; identical to SEQ ID NO: 20639
  misc_feature (1)..( 3003): 2750-1469P.txt file - cDNA_ID_3075736; gDNA_ID_1620764; Annot_ID_167299

SEQ ID NO: 34219 - DNA, 3000 bp, Unknown; identical to SEQ ID NO: 5130
  misc_feature (1)..( 3000): 2750-1469P.txt file - cDNA_ID_3075740; gDNA_ID_1620764; Annot_ID_167293

SEQ ID NO: 34220 - DNA, 3003 bp, Unknown
  misc_feature (1)..( 3003): 2750-1469P.txt file - cDNA_ID_3075744; gDNA_ID_1620764; Annot_ID_167292
gacaagctgatgtggtaacctacgaaacatattactcattacatgtttggaacgaaaattaaacttcacatcaaatgctctttctctgttatgcaggttcgtaaacgcaatgtttgcctcaagttctcaggtttagatcctagcgaattgtctggtgcaacggtgaagatcagacagacacgtaacagtttcccactcgggtcatgcatcagtcggagcaatatagataatgaagactttgtcgatttctttcttaacaatttcgattgggcagtgtttggttatgagctgaaatggtactggacagagccagagcaaggaaacttcaattaccgggacgcaaacgagatgatcgaattctgtgagagatacaacataaaaacccgaggccattgcatattctgggaggtagagtccgctattcaaccgtgggtccaacagctgacaggttccaagctggaagcagcagttgagaaccgcgtaacagatcttcttacccgttacaatgggaaatttagacactatgatgtgaacaatgagatgctccacggatcgttctatcgagatcgactagactctgatgcaagagcaaacatgttcaagactgcacacgagttagacccattagcaactctgtttctgaatgaataccacatagaagacggatttgactcgaggtcatcacccgagaagtacataaaactcgtacacaagctgcaaaaaaagggtgcacccgtgggaggaatcgggattcaaggacatataaccagccccgtcggtcacatcgttcgttctgctttagacaagctaagcacactcggattaccgatctggttcacagaacttgatgtgtcctcgactaacgaacatataagaggggatgatctagaggtgatgctatgggaagcctttgctcatccggcagttgaaggagtgatgctttggggattctgggagctgtttatgagcagagaacactcacatttggtgaatgcagatggtgaggttaacgaagctgggaagaggtttctggagatcaaacgcgagtggttgagttttgtggacggagagattgaggatggaggaggattggagtttagaggttatcatgggagttacacagtggaagttgtcacatcagagagtaagtatgtgacgaactttgttgttgacaaaggcaattctccagttgatgtgattatagatctttaacgtttcataatactaaagatctaaacattacaagtctttatctttattttcttctgaagatgggtttttgctgaaatgatagttcttctttatttccgatacttgcatcacaagaaaacattactaccttatttaaacagaaaaattatatgtattaaatttgaatttcatcaaaatatttcaaaagaaaaaaaattaccttatgaaaatgcgtacaaggtttactataagttatcagatgcagtggacgaaagaatatgatccgttagttgagtcgatcattctaataagagcaatcacgaatgatccacaccacctacaatctcatacgtacttgtccagcttcactgcacctaccatatccttaatttagttggcagatattatgtagatatatgtatatttcaacttggtgttctccacaaccacccatacatacaactttcgacaattgatgagacaagtatacaaataggttgggttttaaagcatttagtactatcctaaatagaaacgagaagggatcatttaatgatgaccttgaggaaataaagttggtttgcatttagtttcccattgatatttatgtgaatagtgaccatacgtaactgtaccatacttttatgtttccaccatcagggcaacacaataaaattgaatgccatctaaaacaaagcaaaaagatttactataattattttcttactcatgcatgtactcccaatctcccatagatattttcgaaggtatttttgtggtaacgtacaagtcttggcttcgtaatctaaataccgaaaaagaaaatgcctctaacttcccttcctctctctatatatttcaaccactctctgtctctcttcctctttgtagtttctcaaatattttcttcagagttggcacgacctcattaataataatcttctctacacctatcaataagagatatattttagagtttcactttggtgcacaaacaaagctcgtacaacattcttcgtatatggctcttcgtcgctgcttacctcaatattcaacaacttcatcttatctctccaaggctcgtactttctccaatataccatcatactgttcttttttctttttcttttttctatacagtaaggaaactgtacaacttacataattttattttatttttatgtaatagtaaaaataaaagacatttgctttgtttgtaataacacagatctggggatttcgtatgcatgggaccaaggcagcagcttctgttgtagaagaacatgtctcgggggcagaacggtaacagtaacctccaatcaaattcaacatttgtccgttcttattcattgttaccatttacaagaaatatgcaagaaacaaaatggggaaaaaattaaaggaaataaaaaaaataaaaaatagatgctaaaattgtatacttttagaaaaaatattgcgtgacggaaagcgcttattggtggtggttgcacaatgcagctcaagcccgtgatcgtttcgatggagtaaacaaattttgtaaaaaaaagtgtagtatgttttttttttaaaatcagtaaaaatagtgctttacatttccaaccattaaaagttttaaaccaaaaaaacaaaagtttaaaagttagtgttttgttaggaatatgaatagtccttgtcttggattctagttatcatataagaaaataggcttcaataggcaaaatattcttcctgtgatgcagtgaggatgaagaatatgctgatgtagattgggacaaccttggattcagtcttgtacggacagatttcatg

SEQ ID NO: 34221 - DNA, 3003 bp, Unknown; identical to SEQ ID NO: 20642
  misc_feature (1)..( 3003): 2750-1469P.txt file - cDNA_ID_3075752; gDNA_ID_1620764; Annot_ID_167290

SEQ ID NO: 34222 - DNA, 3000 bp, Unknown; identical to SEQ ID NO: 5122
  misc_feature (1)..( 3000): 2750-1469P.txt file - cDNA_ID_3075760; gDNA_ID_1620764; Annot_ID_167286

SEQ ID NO: 34223 - DNA, 3000 bp, Unknown; identical to SEQ ID NO: 5121
  misc_feature (1)..( 3000): 2750-1469P.txt file - cDNA_ID_3075762; gDNA_ID_1620764; Annot_ID_167281

SEQ ID NO: 34224 - DNA, 3000 bp, Unknown; identical to SEQ ID NO: 5135
  misc_feature (1)..( 3000): 2750-1469P.txt file - cDNA_ID_3075789; gDNA_ID_1620765; Annot_ID_167313

SEQ ID NO: 34225 - DNA, 3003 bp, Unknown
  misc_feature (1)..( 3003): 2750-1469P.txt file - cDNA_ID_3075806; gDNA_ID_1621189; Annot_ID_57478
acgacaatcaacattttcccgccaaaacgcaattcaacattttcccgccaaaaacgacattcaatattttctcgccaaaacgcaattcaacattttcccgccaaaaacgacattcaatattttcccgccaaaacgcaattcaacatttttccgccaaaaacgcgattcaacatttttcgccaaaaatgatttcacattttcccgctaaaaacgcaatttaacatttttccgccaaaaccgacattcaacattttcccgccaaaaaggatttcacattttccgatcaaaaacacaattttaacatttttccgccaaaaatgatattcaacatttttccgccaaaaacacaattcaacctttttctcatcaaatatatatgtaatacagaaaataaatacaatttaaaatatatttataagcaaattatagatacaacatacatataatagtatattagcagttaaaataaactctaagaaaatgacaaacaccaagttgggtacccacgggtagtctcaaaacaatcagtttttttcgggctttacccactaaatcaaaaacccatctgggttttctaaagttgggtttttggtgggcaggtttattttgggttcaggtcgggttgggcttttttacccaccacaacatctctagatcttggagtacatataccatccagtttagttagaatatattattatccggttcaattgactggttaagttagaacagttctatataagaaaattgttttacactttactctttaagaaataagaatcgaaaatcttaacaaacttttcttaatagctcagctcaattcttattttgtaatatggtatcagagtcaggtttcaatgtgtctcgattgtagaccatccgtggatgtccagtcccacaaacttcacgtttcagatgtccagtcctgagcgtgagggggtgtattagaatatgtcctacatcgagattttgataatttatggagcaatatataagtatgtggtaaacctcaactcttgagctagcttttgggtatgaggtagactcatactaatatgaaatcatatttttatcatctgttagaaaacactagtccttttaggaaataccaaaatctacaggatgtaaacataagggatagtggagaatctatttaaagtgaaatggagttggtaaattgaggcttagtactacataggtcagtttgttgacttctaaagtggctttgcattcacaagtatgaatggtcaagcttagcgtttggtggtgcgatcaataaaagattaattatcattagtattaatgtattatagtatcactatacatctcttattaagtgctatacatcacagatacccacaaaacaatttgtaactcaatttaaaggtagtaattttttataaagagatttcataaatctaaatgaaaagttaaaggacagaaagtaatcaaagttgaaccaaacaaccataagaaagaagggaatctggttattaacatagctaaatttgttagttagtgtattttctagaatccaatatttatatatatatatatatatatagctaaataattgatgatttttgaaagaaaattttcctaaataaaactattactatacctccccaacatcaatccggctaatagttacttaatttcatgcttaattgttgataaaataatattttgtataagttatacatacgatcaaaactaataatacatataagggtttttaatatataacaacgccattctaaaaaaattgaggcgacaacaaatatattctacggactatatagttttgaaggttaaaacctatatatacttgctaggaaaaaccaatttataatatttcgaatggtgtaagttttttttccaagtaattaagtaagagttgtaggctttctatttatggatcatccactatttttctacttggccactcactataaacgtaaaacatattaaacgaccaaaagtaatttagattctatcttaagagttaagactacactgttacataaaatattttccactcttaaattttctttctttgctaaaaaatttaaagttgacaaaaatatctaaaataaaccataataactataccatttagttacagaatatttttgattgagtaggattatgcaacttaagacaactctctaagatttattgtatattttattcaaatataaattgaagaaaatatattaaatttttgagccacaattactggagatggtggtgtcagtatctttgaaataatgaagaaattgtcccctctaaagttaaaacccacaaattatgacctactttcaaacaccatatatttctccataaacttggggtcttaatcaattaattataaaaacagattgtacattaacattttccttttttcattgacacgaaaattttagaaagaggttatccaatgtcaataatgtttcatttcagattcggctcaaaaatagaaaaatatacaaataatttgaattaaatataataatgactttttcttcgaactcacagtacataaggcaacaagtgtcagatttgatgcatagagataatagcatttttcgtagtttttgttaaatataagtataatacaacattccaaatttctattacagatttttaactggatcggataattagatcggcatatttttcaagctttcagcaaaaacgatcaccctaaaattattttttttgatggaatgatttgtttgaggatattgaatatatacactccaattccaaaaaggctataaagtatgaattaaacaatcaagtagtaatagccattattaatgattcgaaaatggtaaagaaataattaacactaaacaagagtcaaaagaacatgacgtaaatattacatcaactttacgtataaaccccttccctctctctatttaaacccaacacatacatatgaaactcctcaacaaacacaaaaacctcacaaccactaaacaacacacaaaaatg

SEQ ID NO: 34226 - DNA, 3003 bp, Unknown; identical to SEQ ID NO: 34225
  misc_feature (1)..( 3003): 2750-1469P.txt file - cDNA_ID_3075806; gDNA_ID_1621189; Annot_ID_174544

SEQ ID NO: 34227 - DNA, 3000 bp, Unknown; identical to SEQ ID NO: 5140
  misc_feature (1)..( 3000): 2750-1469P.txt file - cDNA_ID_3075821; gDNA_ID_1620766; Annot_ID_167341

SEQ ID NO: 34228 - DNA, 3003 bp, Unknown
  misc_feature (1)..( 3003): 2750-1469P.txt file - cDNA_ID_3075842; gDNA_ID_1620767; Annot_ID_167374
gtataattgatttgcattctggaatgtgttgtgttgttcacttggattatgtttttcattttccttttgtattccctaaaaagttttgcatcctgttcagactacatttttacacaatcaacagtttatccgtttaggtaaaatccatttgttggtttctctttcatctttcagtgtccttcttctatctgttgtttccagtatgtttgtgttgttcgattaagtgacagataagtcctaagctatctctagtgtagtggctttcttaatcttgttgcatgttatggttatttcttaatccttcttttttttaacttccctttacgttctcctcctatagattccctctgtttatgatctctaactagatttaagactcagttcgttttctccgctatcccttaagcatcaaatcaaggatttgaatatgcttcccctcagaaaagagatctaggaatctctacagagccaccacaaaaccatccgaaaccaattttaagctcttttccaacattcaaaaggatgaaaaggttattaatagaaattgactcttaccgtaaaacgtagattgcattgcatgatcaaaaacattcaccacaatcctctgtaaaagtctctgaaaactgaaacgtttattttcttgtaaactgtcttaacaaaacctttaacagacatgaaatttcataaagttataatcttaataaattctgatacaaagagagggtcttaataacatgtcccaagtcaaacacatcataaagctttgttttcttccaatgtttccatgtaccaaaaattggggaaaaaaagaatttcctctcctctcaaatttgtaacaatgagcttttatatgttcctccacaaaataagcagttttgaattcaagtgcagttcttgctggaacatcatcaaccacatgttttaaatcattcttgacaagctcaaattgttcgatgtttctaggtttagccgcttaagacactttttcttcttgataactttgttaatttttcattatccaccatacatcatatatatacactaaacttaaccatataacctatggttttatgcaaacctctaaactcatttactagttgggtcttatgtacatttgtggcccaaaagaccatttatacttaaaccgaagtcttcttcttctccctcaatcttggacgcttcttcttcttacgtcttctcttgtcaatcttcttcactttcccatctagtctcaatctctggttcctcaattcgaatttagataataatcatagtttgattccaacacaaatgtcaatctattcttttgacggtagaacattctgttttcagatgaacaaatccttgacatccataccactgtatgttcaacttctcatcttctctagcttcattccacactataaagctattggatatgcaaaagattcatgagggttccaattaaacaataactcaaaatgaaggtttcgttttcttcactagtcccttgagtcatcaaattcttcattgagtcatcaattttttcattaggcatcttaaaaccccccaattatttgcacctggtttcctcaatataaatcttggtgttcattttctaaatcattcacatctttgtcttcaacaaacaaagtctgtaaaatcttcttccatcttctttctctgatccagaatcactaaagacactacttctgaagcttagtgaaggagctgcagaccttggtcctttggagcatcatctactagttctaaccatgacgatacctacatagttaggtttggatcaacatttcggcggtcaaaggttggtgaactgcatcacttcgctgcatattcatgcttttcaagaaaagctattcaatacatcatcactggctagtatggagaatcttcatcatctctatgtcgaaagtagtcatgtctaggagatgtatagattgcaggaaagctaaatggactagtctaatttaaacaatccgacaattccatgctttaccagtcgtctctcagacgtgtttatacgtgagtgcataaatgatctggcttggcttctgtttgcctgcagattagatgttcagattatgtgtcattaatttttcaaaatttaaagaaagatgcgtattctactcttttaagttttaatgatcaaatctcacaaaaaataataatcttttcttttcctaagaataagttcagcttctttagatattgataagtaattaggtagatggggtgttagggatatttctcaatttcattcagttccacaattgtcaagtgtttttttttcttattttgcttcttcttcttctttagtgatgtgggttagtcataagttgttcactagctaaaagcagagtccatggcttcttcttatgttgttctccctttcttcttgtaatttggatttttttcattacttttcttttgcatttttttctttctccagtgtgttgttcacttggattatgtttttcatcatttccgtatcgtattacttaaaagttaaaacggattgaattaatccttttcaaactacatatttatacataatttcttttctagagttcaattctatatacaatttatttagttaaaagacttgatatcagagcgacaaaggacttaaatagttctaccaaacatgaaagatactaatttccaaacatgaaagaaagaattattcaatttttactctaacagtctacacgaaaatgaaagagttgtcattttgagaagtccttagatgccatattattgccagaaactaatttgtatggactctagctaccaaaaaaagaggagaaaaatcaaagtccttcatatggaaaatgggtggtctgaaaatcagtgacagcaatgtcttttattatcttctatctttctttgataatctcaacccacccgtactggaacaagatgttatctaaaaaacttcttcaccttcagctttagcttcgttgttgcttactgaaacttttctctctttacatcaaatttatg

SEQ ID NO: 34229 - DNA, 3003 bp, Unknown; identical to SEQ ID NO: 27875
  misc_feature (1)..( 3003): 2750-1469P.txt file - cDNA_ID_3075855; gDNA_ID_1620767; Annot_ID_167365

SEQ ID NO: 34230 - DNA, 3003 bp, Unknown
  misc_feature (1)..( 3003): 2750-1469P.txt file - cDNA_ID_3075859; gDNA_ID_1620767; Annot_ID_167364
tatgcgatgaaaaaacagagtttgagaatgcaacttatgcaaagttcctttctgttttaaatgcaaagaaggcgaaactgagagcagtaagggacaaagaagattcagtgagagcagttgaggaggaagagtcgacatacaaagctgaaagcttcgagagtggaagaagtgatgatgagcagagtggggaagaagcgtcagaaaaggcaacaagcagcaaagcccgtggcggaaagagagctgcacggagctaagacttagagattcccctgccttgagatttcaggtgggagattccattcagtgttttgtgaatctcatagctaggaaatgagagttttcgttgaaaaatcgctagaatctgtattgcttgtgaaagaaaatgcaatagacttggagataaagtaatttttaatttcggatccagtttggtttggttttttaatttccttggttcagttcagaatctggtttggtttttaaatttccttggttcagttcagaatcgagtttggtttgcaatctttcacgtgcgttcgaaattgtagaatgatcgtctcctcttctatctggtgagtcggtggcaatggtacaccaatattgactgttgaagtcagctattttggataaaaacagtgaatccctgatggttggcgttggaaatggccatagtgtgtagattggggcattattgtacaacggtatctctgaacgtttatgattatgcattacaagtgttcgatgaaatgcctgaacgagatttcacgtagtctccagttcaagaaaactggttctactgaaccagtgagaaagagtgttaatgtttaccattcgtaggttctgggtatatcaatctatggtcaatcaatgcgttcagatttgtgaattttctcatcttttgattggtgaagagtatatatataggtgcctatgtttcactggttctcggcgcaacaagcttatgtagtcatgaaaaatgacagtgttgcgttattgactgggtaaaaagttgactttttcgtggaaatgacgtaactattgacaaatttagttggttttattagatatggtttaagttgatcttgtatatcagaattttggaacaagagtactgtctggtctagtctggtcagtattgtatataggtgcttgaaaatagtcttacaagtacctgagtatttgtttccatggatttcttgttcttgttattggagagaaaaaataaacacatggggaagaagagggtcgtgttgctttggcttagcatctttataagttttagctctgcagagataacggaagagagccctttgtcaataggacaaactctcagctcctccaatggagtttatgaactgggcttcttcagttttaataactcccaaaatcagtatgtcggaatctccttcaagggtatcattccccgggtggttgtgtgggtggcaaatagagaaaagcctgttacagactctgcggcaaatctggttatcagcagcaacggaagtcttcagttatttaatggcaaacatggtgttgtgtggtccagtggaaaagctcttgcatctaacgggtctcgtgtagagcttttagacagtggaaatctagttgtcatagaaaaagtttcgggaagaactctatgggaaagttttgagcatcttggtgatactctgctccctcactcaactatcatgtataatgtccacaccggtgagaagcgagggttgacttcttggaaaagttacactgatccatcgcctggtgactttgtcgttctgattacaccgcaagtgccatcacaggggtttcttatgagaggctcgaccccttattttagatctggtccatgggctaaaacaaagttcaccgggttacctcaaatggatgaatcatacacaagtccattcagcttaacacaggatgtaaatgggtcaggatactattcgtattttgatagagacaacaaacgttcacgtattaggttaacaccagatggatcaatgaaggcgttacggtataatggaatggactgggacacaacctacgagggtcctgccaattcatgtgatatttatggcgtatgtggaccttttggtttttgtgttatctcagttcctccaaagtgtaaatgcttcaaaggttttattcctaaatccattgaggagtggaaaacaggaaactggactagtggttgtgtgaggcgtagcgaactacattgtcaaggaaactctactggcaaagatgcaaatgtcttccatactgttcccaacataaagcctccagacttttacgaatacgcagattctgtggatgcggaagaatgccaacaaaattgcctcaacaattgttcttgcttggccttcgcttatattcctggaatagggtgcttaatgtggagcaaggacctaatggacacagttcaatttgctgcaggaggagaacttctttccattcgtcttgcacgttctgagctaggtatgacttggaatataattcaaggaccttctgtatattttgcaattatattgatattgatgttttcgatagatgcatgacttattgtttaattcttatgctaaattcctcagacgtaaataagcgcaagaagaccatcattgctattacagtgagccttaccctttttgtgatcttgggctttactgcgtttggtttctggagacgcagagtggaacaaaatggtaacacattaatgactttactatcgaaaagatctaatcatttggttgtcaataaaattgatctgttacatttattatgagatatcgttaaataaaaggttgtttttccactacatcagacctatactaaattgatcgactcatatatgttcttttggtacattggtttcgccttaaaaaactcttaatatactcacttggtactaacacacaaattctaacccaaatttcagctcttatatcagaagatgcatggaggaatgatctgcaaacacaagacgtcccaggtctagaatattttgagatg

SEQ ID NO: 34231 - DNA, 3003 bp, Unknown; identical to SEQ ID NO: 20659
  misc_feature (1)..( 3003): 2750-1469P.txt file - cDNA_ID_3075870; gDNA_ID_1620767; Annot_ID_167360

SEQ ID NO: 34232 - DNA, 3003 bp, Unknown
  misc_feature (1)..( 3003): 2750-1469P.txt file - cDNA_ID_3075874; gDNA_ID_1620767; Annot_ID_167359
ctcagggcagggcaaagaggagttcatgaatgaaatagtactcatctcaaaactacaacacaaaaacttagttcggattttaggatgttgcattgaaggagaagagaggctgttgatttatgagtttatgttgaacaaaagccttgatacttttctcttcggtgggttctttcttgcctcattcctttactatcggcagctttttttctctatatggaattgtcttttctgattgttttcacgctgtattgttgcttagattcaagaaaaaggcttgagattgactggccaaagagatttgatatcattcaaggtattgcgcgtggaattcactatctccatcgtgactcatgcctcaaggtaattcaccgtgatctgaaggtcagcaatattcttcttgacgagaagatgaatccaaagatatcagattttggattggctcggatgtatcagggaaccgaatatcaggacaatactcgcagggtcgtaggaactctgtaagaatctatttcaaaaacataattgactaaagactcaaagttataatcagatattaacttgggagaaactatttgatatatgtgcagaggatatatgtctccagaggatatattagaaatcataagcggagagaagatctcaagattcagctatggcaaagaagaaaaaacccttattgcatatgtaagtacgactttaggtatacagttgcaaatatctcaaatcgtttcttgcttttataattttaagatcaaacaacaggcatgggaatcttggtgtgaaactggaggagttgatcttttggataaagatgttgctgattcatgtcgcccattagaagttgagagatgtattcagattggtcttctctgtgttcaacaccaacctgcagacagaccaaacacacttgagttgatgtctatgctcacgacaacatcagatcttccatcaccaaaacaacccacatttgtagtgcactggagagatgacgaatcatcgtctaaggatttgatcactgtgaatgagatgacaaagtctgtgatcttagggcgttgagaaatgatgtttgattgaaactttagtctgttttgtaaacgattttttctatttatgaaaggtatattccaacagatgaacctccattttggtgcaccagtgaattactgtagagtaagaatttaccatggttaaagattaggtgactaataatagtacttagattcgaagccaatggctaaaagtttcatatttccagaaacactaatcagataatagattcatcatttcatcttccatgtaagccaaaatagagttcttcacatccatgttcttctcttccaacatccgaacttcgttttccagacgctccttctcagccaataaactcctgaattcactgtcttcaatctctctttggaatccaaaacacatcttcacaaacccttccctgtgtacaagtttccatataaatgcttagtaacttcaagattagacaaaatcaagaacaatgcagttattgatgtttaccgcttctcggttagtctttgtaattagctcactgtgctcacttcttaagcaacaaatctcatcctccaatagcttcagagagtttcttgaatcagcttttaaggaaataaaaccatagtgatcaaaattacgaatgtgaatattgaacaaatccttcggaaaatttagacacctgtaacggagatcaaaccgctgatctcgaattgagaagcaaggaacgatctagtaagctcaggttccttgagagacagagaagattcaatctcagaacacgctccgatctgtgattcgatctctcgcgtcacctgaatgtttgcttcgatttcccgattgacctgtttcattcgatcacagctcagattaagctaaagacgagagataccaatccagtgaagaagatgaagaatagtgaaacctgatcaagcatgtccttgaaaatggagatctgacatagaatcgctcctgaatcctccatctccgcagaaatcactctctgtctctctctctctctcgctcgctcttgcttccgcttcttttcaaaattcaaaatcaatatcgttatgagttaggggaagataagattttaccgggcctttatgggcgtttaccaaaatcggcccaatcggatttcggatctttcaatatttgtaaatacgaaccgactttttaatttatttcggatctagtttggttcggttcagattcgagttgggtttgtaatctttcaatatgtgcgttcgaaatggtagaattgatgatcgtcttcttctctctggtgacactggcacaccaatgttgactgttgaagtcagctattttggacaaaaacagtttcacgttgggaatggctatatgtactttcaattgtgtaatcggggcattagtgtcaaacgacattatgggagctttgagcgttctgataatgcattacaagtgttcggtgaaatgcctgaacgagatttcacgtagtctcccacttcaagaaagctcttccggtgaatccactaacatttaaaccgtgtattgtacgggtaaaaacaatgatttcagaaaccaatgtcatctgatttattcatataccaagagttttgatgtatatcattggcacgttctggatttaaagagctggcaagattatggtcaagcaatgcgttctgcatcgaaaaatttcttatctttagattggtggagagtaaatttgcacatctttcacttgttcacgtcatgaaatatgactatgttgcgtaattgactgggtaaaaaattggactttgtttgtggcatttacgtttccattgaaaaatgagtattttggaacattagtgcggtctggtcaacattgtttatagtaggtgcttgaaaatagttttgacgagtccctcgaagaaaaaaaatccctgagtgtttcttcacttggctttctttgtcttgttatatgttcgtttcttagttattagagaaaaaaaaatacacatg

SEQ ID NO: 34233 - DNA, 3003 bp, Unknown; identical to SEQ ID NO: 20661
  misc_feature (1)..( 3003): 2750-1469P.txt file - cDNA_ID_3075897; gDNA_ID_1620768; Annot_ID_167403

SEQ ID NO: 34234 - DNA, 3000 bp, Unknown; identical to SEQ ID NO: 5176
  misc_feature (1)..( 3000): 2750-1469P.txt file - cDNA_ID_3075901; gDNA_ID_1620768; Annot_ID_167402

SEQ ID NO: 34235 - DNA, 3003 bp, Unknown
  misc_feature (1)..( 3003): 2750-1469P.txt file - cDNA_ID_3075907; gDNA_ID_1620768; Annot_ID_167398
taacatgaggatgtttttggctgcagcgttaatcactcctccgaggaagaagctgacagagccaacgaggatgcttcctctcctaccgtagattctggtgacgtaagaagctccgaaagttgagattaaaccggcgaagtagagagaagaagtgaagagtgtgaggatttgattgtcgtatttgcagtaatctgtttcgtttagatgcatttgctttcttttgtagatccctgggaagaactctttcaagaaatcgtccattgatgtaacaccacctgcgtttaacaaggacgaataaacaaaaatgagcattggtcttgcataggttccttgatttacaagaaactaagcagtcgacacttaaacaaagctgaagctaactctcgtcagagagggaactgatattttcggacaaaacaggggaaatttaacaaaactgaagcaggcccttttcaaaaacaatacttggcagtttcagaatctggctatttgattggtataagataaaaccagatcgagaaagttatctaaccagagactccaagatcatagccgaaaagagagcctcccatggatccgacgatgcaagcgaagatgaagtaagaagtgatccgatgttcatagagatgagctctctttaggcctccttcatcggtaagagctccaccggccatggctttaaaatcttgaagacaaaaggaggaatattctggtctccctctttgtaataaaatttgactgagggttgtgaactagttgtgatcactatgatcaagattttagagataaataaaaaggttggatattagcagactagctgttacactttgaccatctatctttccttatccctttttctaaggatatatatatgacttcatctttcttgattattacaatgactagttggtaataattttcttgataagctatgtccttttaaagaaatttcaaatatggtgatgatctaaaaaataaagatatttagatcattttctatataaattatagtatatctcgactccatgtcatattttatccataatttaatgctagcataccattaattattttctccataaatgagaaaatacatttccctttctattgaattgtatcataactttgatattaaaaccgtcttaattacctgagttgttcagttgatctagagattttttttttttttgcacaaggtattgagaaggtgtgtccaaagttggatcgaacttgatgaatgttatttgagtgacaatgtcatcattttttggcgatctacatgacagaaaaaaaagaaagatgttgtaagagttgtttataactaccacagatacaaacaaaagaaagagagatgctaaaaggagataaacaatatttttactctttaagacatcatttatcctctgtgtcctctaccacataaacattcctttgttggcttgagggtttcttgagttagcttcaccaaatactaattttctatagcttatacctttcttcttgttactggtttcaccggcccctacattgtggtaattgttggttcatatacttttgacgcattatttggcttaattacatataagattaatagatacaaaggacatgcatttgttgaacttacatgtgtttggacataagttggtatcgtatccaatccatcatccgcattaagcttcctttgcgcatcgctcttaaacaaccatagattctacgaacctataagggatctcaacctataaactcaacgaaacatgaatgagatcagagagagagagagagagagagagagagcaatggtaataagaatacaaaaccgatttctgatacggttttgcaacgtgaaaagatcatgtgagatattttagggatttctaaactgattatctatccgcattacaaaaatgtaccgtaaaacatatatctaaatacacaccacatttacgatgtataactttacgtaatagacatgatatctacgatgagttaatttttaaaataagatgtgtttgccatttttatcaactatcaccattcacccatcaaactattattttgacaagggaaattgtcaaaagtttgaatattatacgtagctcatgataacacaccgattaaagaactcatctactttgtgatatcaatttaagagtgatccatcattttcgattagcttgaatgatagaaaatactgattgttgaattgttttaaacgagctaataataataatttctacaaagtgatcggacaaaagaataaagtccaatgaggatgagacacatcagattatttaacataacacgtcagcaaattaagggatcgaagaaaatggtttagcttgacacaaccgccaaagcaaaaaggctgaagttttcctttttaggctctttctcttccacgcggaaattaataataaaaaagatccaaactttgaagatagcgaagagcaaaaagataatctctggctcgatttttgttggagtccttgattcgagcaagtttaaagactcgagggttttcttctggataacgtaattagatactcgtgtaagtgcaatttctctctttttcttctgttttatgggtgttggtgatttagggttttgcaaaatcgttttgtttgctgggtgattaagcttgggtgatttagaaagacgaattagatcaaggaacttatttcttgttatgagtcaatttgggttttaaagattcaatttttgatcagaatataatctaattgttgtgtgttgttactcgtaatgcaggttttctgaaagggtcatcactgctattgtcatagcttgagaaaggatctatttttaatatcagtgatattggtatctatgagatttggagtagttgtttggaggaacgtgtcctcttgcttgatgtgaagattgcttcttgttgtttgctgtttcttaatggagtggaggggaatcctctgctcgttgctttttattgtttccgtgggagagtcgtcaagtagatttgggataatg

SEQ ID NO: 34236 - DNA, 3003 bp, Unknown; identical to SEQ ID NO: 20664
  misc_feature (1)..( 3003): 2750-1469P.txt file - cDNA_ID_3075917; gDNA_ID_1620768; Annot_ID_167387

SEQ ID NO: 34237 - DNA, 3003 bp, Unknown
  misc_feature (1)..( 3003): 2750-1469P.txt file - cDNA_ID_3075949; gDNA_ID_1620769; Annot_ID_50171
taaacacgtccgtgagattttcagattgacctttaggtcacatttttgtccaccacatcaacatgagagggcttttctcaagcatttcaataatcggaatccaatcactgaccgccacgtggacatcatacgtctcaataaccaatcatagaatggttgtgacgacgttcacggtgagttgcagtacccgatcccttttaaggtccgtgacagaataattttgaaaccagcaagacaaatttagtcaaaccaaaaaaaaaaaaaaaacgaaagcgcaaagactaaggagaaaagaaattcttcgcttcttctccggtgtaatcatggtatagcccgcgatctcgattgtttcttattatcggtattcatgttatattagctagaattgtgttttgtacctccgatctgattcacagattcagtatgtgaaattcattattttgaggatttgatcgtcttatcaatgatttaatctatgtttgaatattgttgaatcacgggcaatttcgcatcacgccaaaagaattgtatctaacagatgcgaaaaagtttgaatctgttttcgaaatgtagttattcaaattagctgagtttttgtcttgatagtatgtattgtttcttgatttaaaatgcatggccaaatcttaccctggctttgcccagattaaatactttggtgagtgtaaacgaaagagattctgattttagtaatatggttgatctggagagaaccattaccaatgtgtattactgaatagggttgattttaaaaattgttgcagacaacctcaaaaagactagcagacaggaagattgagaaattcgacaagaacatattgaaaagaggatttgttcctgagaccaccaccaagaagggtaaggattaccctgttggtcccatcctcctcggcttctttgtctttgttgtcattggatcatgtgagtaacctcttcttctttgtgctccttgattttaagtccaaatttagacattggtttccagaatttcttctttgtcccccttttattgaaaattctttgtggaatctgaatgatttgattatactatgtgtatgtttattaaacttccttgtatatgcttttgttacagctctcttccagatcatcaggaccgcaactagtggaggaatggcttaaacccaatcacattcaagctggaagattgcaattctcaaattgatgaatcatcactttcttctcttctgacttgtctctttttttcccttatactgtagaatgtgactactttctgttgactacatgttattgaaagaatttttgagtctttttctaatatccactctttactattgtcttgataccaaatacaagcaccgttaaactatttaacgttgaattggtgaaactatttccctcggccaaattgttcggtgaacgaaagatctgatctgtgaagagtttagttgaatagattcggctgatggattggtagggagagacaccatgcggttggtggaaggtacccgtgatagagtcttgacgtgaacaacttagtccaagagttaggagacacaataatgataagtagccgtcaatatatcttttgatccgaatttgaacttattatatgctttacttggcaaatgatatgaaaaacttgttcattgttgaagaatctatcaactattgtattcaatcacttacctttttatcttttaccaatcatacttataactgaaccacaacaatctctctttagtcttattcttgaccaataacttgtattttaccgctttatagcagttgggccatatatatgtaagaatagtttgagaaaaagaaacaaagagagagaggttatgatgagttaaatcatgattaatctttaatatataggtaattgcaatgttaaatggaagtgacatgattgaacaaagcatatttgatgggatgagaaaaatgaacccccacgctttacgactactttacattctctgtggaatgattttgaaaaatataattattacaccaaaagaaaaagagaacaaggcaaaattatgcacatgcaatttattacattcgattcacattgattcagtgactttctttctttcttacaacaaataaaataaacttttggaatcaagttgttcgtagtcttcttctaacgatgatgacacaaaaataagattcaagttgtcttattcttacctagagttatttggttccaaaataaatgaagtcgtgatataatagtaatttggtttcatacttactcactcactcaattgtgtaaaaagccgaaatgcagtaaaaacagtgatacacaattgtatcaaaagataaaatgatggacgttaaatccgtaatttaaatatgttaaaagtaaaaaaaaaagttagatcttctttgtataattacaaaatatatatcataagcaaaggtggaagaaaccatgatttagtataattgccgcaacctcaatgatcctctttataaattaaaaagaaaaacccataattaccaatttattaccaaagcacgcgtctttctttattacaaaattgttttgttttattcttgttagaaacatttttatttttattacaataaaatggaactatagtgtatgttgtttagaataattgtattaaaaaaagtataacgtacaaaagaataaagtgaatgaggaaaaaaaagagaggggcaaaagtggaaaagagagagatagagaaggatggaataattggtaagaaataatcatatggggccaactgaccatggaaaaagatgaagcaaaaaaaaaaagagagagagaaaaagacaattcagagataatacaaaggaatggttttgttttaagagagaaagagaaagagagaactcgacgaagaatgatggtgggaggttaaattccccaaacccccagagctcttcattttcttcatatcgacgatatgctaaatggctgctgctaccattactgatctcttctcttaagctctctttgtttggggcatg

SEQ ID NO: 34238 - DNA, 3003 bp, Unknown; identical to SEQ ID NO: 34237
  misc_feature (1)..( 3003): 2750-1469P.txt file - cDNA_ID_3075949; gDNA_ID_1620769; Annot_ID_167425

SEQ ID NO: 34239 - DNA, 3000 bp, Unknown; identical to SEQ ID NO: 7833
  misc_feature (1)..( 3000): 2750-1469P.txt file - cDNA_ID_3075953; gDNA_ID_1621167; Annot_ID_173865

SEQ ID NO: 34240 - DNA, 3000 bp, Unknown
  misc_feature (1)..( 3000): 2750-1469P.txt file - cDNA_ID_3075963; gDNA_ID_1620769; Annot_ID_167437
ataacaatgttcatttcatcgttgctaatgacataaaacgatcaaaaactgaatcatagtacttcttttacagtgatctcaaatatattaatcgctaatcaatgaattatgtcacctataattgtcgtattaccaacaactataaaacatatatataaaaaattgttgtcgttaactagttgttgatagtggccactctaaaacgatcatgacctactacggaagttataactagtcaacgttggacgttagcaaggcccaatggacattaactcagcccataatagcacgcgccttgtgatgtgcaccagtttccgtctttggtcgttgaattcaaggaaaaaaaaagtacatcacaagcaatttcttacttatctgtgacttgaagctatttctccaatttcgttttccatcgacactctatttcattttcaccattcacgtcttccttctgaataaaataaaccctaaaacctaataccgaagtaaactcgtcaaccactgcgcccatgacctcccaacgatactcttcccttatattcttcctcttccttcttcctttctgcgatccaaaccttcaaacacatctccggtagatatgaaaatccactcttgcctctccgccattcttctgttcctcttcttctctgcttcttccgctaaacaaaatgttcggacagagcgaatttcaggtacttgttcttcttgctccagcagattggaatgtagagttgaattgattaatccttgagggtcgctcaaataagtttgaaatctgtcgtttctccagcatttggtttatagacatataatttgatttgcttaagaagtcaatgctattgattgaggaactatgtaacagctgtgtaagagagctcaaaaaggtgtgtttttgaaatgcaggaagtgctggtgatgttttggaggatgatccagtgggaaagcttaaggtttatgtatatgagcttccaagcaagtacaacaagaaattactgcaaaaggatcctcgatgtcttacacacatgtttgctgctgagatttttatgcacaggttccttttatctagtcctgttcgaacgcgtaatcctgatgaagctgattggttttacacgccaatttatcctacttgcgacctcactcctaccggcttgccattaccgtttaaatcgccgcgtatgatgagaagttcgatacaactaatctcatcaaattggccttattggaatcggactgaaggagctgatcacttctttgttgtgccccatgactttggagcttgcttccattatcaggtagattatctctgcattcaggaacaaactctattttttatatgcattgaatactttggtggttgctgttcatcaagaataccctgtgatcttacaatgatagatgatcattagcttaaaattagctgttgtatcatcacattagtacttagttacatggaaactgagaatctgtttatgagtttattgtataagattgtggaatattccaatgatttgtgtgggaattgaagatttgattgacattaaacaggaggaaaaagccattgaaagagggatacttccactactccagcgtgccactttggttcagacatttggtcaaaggaaccatgtctgtttggacgaaggctcgatcactattcctccttttgcacctccacagaagatgcaggcccattttattcctccagatattccacgctctatctttgtctacttccgcggtttattttatgatgttaacaacgaccccgaaggtggatattatgcaaggtacatattttgtagacttgtaaaactctcaagtgatgagttttctctagtcttacatagatttttcaaccaaaatggaactgcaaactctatagtatcatacaataaaagaagcacatatacatcaagatctacctattaagataacaattaagcattcctcattaggaagttaggttatatataaggttagctaagatcaaattgttttagaatctgctgactggaacttctctctttgtatagaggtgcaagagcagcggtgtgggagaacttcaagaacaaccctttgtttgacatctcaacagatcacccgacaacatactacgaagacatgcagagagccatcttctgtctatgtcctctaggatgggctccatggagccctaggttagttgaagcagttgtgtttgggtgcattccagttatcatagcagacgacatagtactgcctttcgcagacgccatcccctgggaagaaataggagtctttgttgcggaaaaagacgtccctgaactagacacgatcctaacctcaataccaacagaagtgatcctcagaaaacagagactcctcgcaaatccttcgatgaaacgagccatgcttttccctcaacctgcacaaccaggggatgcattccatcagatacttaacgggctagctcggaagttaccccacgacaaaagcatatacttgaagacaggtgagaaggcactgaactggactgctggtccggttgctgacctgaaaccttggtaaagtcagaaagagaggaatctttttgtatatcttgggtttcacctagagcatacgttgttgcctttctatagcacttcaaaaacattagaagtccaagtcctccgagtggattttttttgtagataacattagtacatttactcgaggtacatgtaccaagtttgttgtacattttctcttcgattgatcatataatactgtacactccttttgtcttggctaactccaatcatgtaagtttcaatgtccaataacctgaaaagttatgaaaacatgtggtaattaattttgttgtgaatcaaattagaatccttattaaaaaagaaaattatttattcaaaaaaagctcgtagatgaaatgggcctaaagtctactaaatgggctgattgaaggaaaaactcgaactaatctaagatctttgctcttgagagagaacgagagaggcggccatg

SEQ ID NO: 34241 - DNA, 3000 bp, Unknown; identical to SEQ ID NO: 20670
  misc_feature (1)..( 3000): 2750-1469P.txt file - cDNA_ID_3075971; gDNA_ID_1620769; Annot_ID_167433

SEQ ID NO: 34242 - DNA, 3000 bp, Unknown; identical to SEQ ID NO: 15679
  misc_feature (1)..( 3000): 2750-1469P.txt file - cDNA_ID_3075975; gDNA_ID_1620769; Annot_ID_167432

SEQ ID NO: 34243 - DNA, 3000 bp, Unknown
  misc_feature (1)..( 3000): 2750-1469P.txt file - cDNA_ID_3075981; gDNA_ID_1620769; Annot_ID_167426
gactttgtgcttacgatgataacccttagcagatgagagatccagttcacagccatcaatttggcaacgcgggactggcatgctctgaccacacaatttggatttcccagcgacaacagatggagttaacaacttcatagaaaccgctgaaatttcattattgtttctaccccagtattcttcagagtatgtccgctttcctagttttaaacaaagatctgattcagctgaggcaacggatacctcgagagctgtgggagccttcacctggacaaagtctatgttgctgcaagaatctccaggggaactttctgatgcaagcttgcatcgtttggcttcgggagatgatgagttgatagaggtcgactgtgagcttttcgatacagcagtgtgccagaagctggtggcagagccactactgactctctcaaggcctgagaaatgtggaactatagattcaattccttcacctttttcaatttcccactcagtaggtagctgtttgctgtcatcttcagtccttgacggattggacatgatcaaatgctcccaatcccactgggacgaagataccatgttgcagtccattcacgatatgggttgatttcatagacctaccaccagagccagagcaacaaatcctacaacaactacaagtttgcagaactttgattagtaaatgagaacaaaaatcatataagaaaagactagacaatcaatcctatatataactctggctaggcaaatagataccttatcgacgacaccctcaactaccaatactataagtaagatagaaaaagaaaattcaaaattccaaggaccagacaaggcttatcagcgtttattgctctcacccttttatcattaacttgagcaagagaaacttttctatgtttcacccagaccagcaaaaagggcaagagaggaagggtattacttttcatcttctcatctccatcacacaaaaactaagtggcatttattgaattggtcctacactcctcaaatcaaaaatttccccaaagtatctatcagtaacttgtcaagaaacacgatgtacacattgtaattgcaaacccttccctacccattcctcctttgtacttggagaaggttcctaactaacttcctcaaaaccaaagactaaaaagcttacaactttacacattgaattaactatatgtcaaagaaaacggcagcaagctcagccattagtggacctatctgcagcaataaagattgaacgataaaaaaagtgacagtaagttaggttacgatcccaatcaaggtccctccctcgcaagctagggttttcgatgaaagcaaatggtccccccaaaccaataagttcaactaactaacgaagagattaaaaaaagttaccaatgtttcaatcaaattcgtcattttgacaaattctctatacctagagaccattcaccttgaaggtaattttactgattcgtcgatctataactagtctaagaggcataaagctgaattttacaataaataacgaagacgcccaaatctaagaagcgcaagttttggaaaaatttgagggagtaaagagtacaaaacctcaagtatgagagggccgaagaaatctccggacgtcgatgatcggagaagatgctattgactaagaaatacagtgaaagggacgaccatacaccaaaatcgcctgaggaaaatcgaatgagagtagctcagaggagtctttcccactatttttcttcaactgttttgcctttttttgttttttgggctttcgtatttattttggtgtctaatttttaactaatactagtatatgaaacgaattatatttttaccaacacagattcgattctatatcgaaattggttatttatttcaggcctaatatgtaggtacaatcatatggacaacaaaatgatgaaatatttgtaagttgtaactaattttaggctctctaaaattagatgtaaaacaaacaaaaaatgcaagtaacaacattataagtaagaaaggtcaaatttatattgttggatctttcttcatattcttatcggtcgctaattaaacatgtaaaaagccgctgaaaaatcgaatttgtatgttcaaaacattaattcaaaaaggctgcaactcttttcatttgttagagaacctagtacctaccattcatacctagtacaattcgtgcaagttttaatatctataaacctctcttttactttcacaagtacactaatactaatattttagagtgtccatccccgagaacatcacaattaaatgaaaatttattagacgtacgatgaactgactaagattagtttaggggaactatatattttaaattaaattaaaagcattactaaacatgaaattatgagtttggtcgatataccgttagtacatagtacataacacatagtacattccattcatttgtacttttagtacacatggctctttgatagacacaaattttagcttttgtggaattacgtgagtcttgtttgctgtgatgatgtcaagagaaagtgatactaaaatatagtcatggggtttttacagttggacgagatttttacacattttgctttgtcattttacaaaacgaagtaaatatgtatttccaactataccattatcatatcatcaccaagaaaatccaatgttctgagattcctcttcatatccaccaaaacaatcatattcaagaaaaactattatcaatccgaatattatgagtcttcaagaccatatatgtgcgtttttgtggaagaccgtgcatcgtttgagatgccacactctatgagcctgcttcgaataatcgaatccttaaactctcactaaaaacacggatcatgtattcatatccaatcaaaatctatccaccaaagaacacaatgttcatgaacggtctaggaaaaacagtccgtaaaaccaagctctctataagtttataggttactactactagtagaaaattagaaatctaaaatg

SEQ ID NO: 34244 - DNA, 3003 bp, Unknown
  misc_feature (1)..( 3003): 2750-1469P.txt file - cDNA_ID_3075983; gDNA_ID_1620769; Annot_ID_167424
actaaaatgacaaaaacatctcttatcgaacaaatctagtaaagagcgttcaacactaaaaagagaaaacaatgtcttacggcagatgatacaaacactgcaagcatctcaaactatttagagttgagacaatttaatcaagaaggtggcatatctacaactacaacaagatcacatatgagcatagttgaaaaaaactagcagaatcatggcaaagcagtttcccaatactacattcacgaagtgcaaggagatagaagctccacaagacaaaatctaaatgacacaagattacatctactgatctacgcaatcatttgggggaaacctcttttatctccaaccttatcacagatctatcactaaatgcatcagggagggtctaaaatttcgagacaattccagatcattgaagcttttagtgacctaatacacacatcaatctacagagcagtaaggataaaaaccctatcgtacatgatcaacagcgaggaatacaaaggaaacactaaaaatcgaagtgatctaaacccaagggaaagagataaggcaaaaaaaaacctggctgaacttgagagcgtgttgttcaccagcgagctgaagattgccggagacaaagacgagcataccaccggcgggaccagaaggctgacaatcgacggtggtgatgttgtgcttacactgctggaaagggaggccggtgagcttagcgacgatgttctgagagccctggatcttctggccttcgaaggtcaacatggatccttcttggtatagagaaaccaaccctggacgatttgcatcgaaggtggagtagtagtgctcaacgaaagcctttgcaacagcgtctggatccatctctttcttcgtcttcctttttgatccttagctcttgcgtcgtgctttttcaacaggcgagagaggatcgagagggttagataatttactgaaaaattatacgaatggaccaagactagagatactgaaatgagtgtttgacgatactttaaatgggccttatatttttcaagttgggcccgttaatatatgggacaatcaacagtatagctcaattggtaaattgactaacttcatttgattcctacaccatttaaagatttttaatcaaattctgatataactaagataatattttaaagcatttaactaacatggaaaattatgaaatgaaatattaattttggatagaaaatttaaaacatttatctttgtgaaataaaaagaaagtctcttataatataacttgtaaagtaatcctttaaattctaaaagatctaaaacaaaatgagttaaatcctatgtctatgtgttgaatctggaagatcgaggtggaagaaaaaggatcatgattcatgggtgagagaacaaccgttgattggtgtgtttcaactttcaagcaatcccattttaaaaaaataaatttatgtaagcaattgcaaacaaaatgaaatgattatgctttaagatatcgacacgtgtaaaacagatgacgtaccaagaaaataaatgattctgtattttgttttagccatttgttttttctttaaaggaaagtgtatgttgaaattgaaaaaacaaaccgagttatatatatagagttatttgactaaagaaggaagctttggttaaactaacttgtataattcttttgtgtagtttagttttgataaaatggccaaacaattttggtcactttaccaactactgcaaaaaaaccattttcataataataaattgtaacacgccttttatttttattattggagggtgagaactgagaccatatatgcctttgttcccttcttgtgggtccctttagcctttttttttcttttgcctgcgccgtttagtgttttttcttttatatataaatagaggtaagttattttaccaatcatttggtgttattaatagtagtattaatgaggttctaaacttgtttataaaaatcagatcttactaaacaaactcaaagaatctcaactatgaacatttttcttctagaatcgagttttaacatcatcatcagcaggatataattttttgtgtttgaattttatctgtattttttttaggagtacataagcagcttaagattaaaatatatattaatggaagtatgaatgaaaaaagaaaagaaagataatcagataatagagagagagagagagagaaggaagcagacatttgtcttccaccatattcttctcatcttttccgatgatagattcttcttcttcttcttcttctactactacttctgctcctctttcttaagtttctccatttgataattcactcaagtctccagctcctcttcttcttctcgttgctttattcgctctctttcactcatcatcatcacactcaaagatttctgttgtattggagcaagctctagcgaattttcgtactccccttgtagaattttagtttcctgttttagatttcgaggaatctcgctttggaaactttaagctcctgttcaaagtttctacctttgtttattttgtttttgttttcttctctcttatctttcgtcatctttgattaagtaaccactttgatctctcaatttcagcctttgggttgtctaatctgacacgttcctctgtcttagctttccttttctcttctcgtttgtgggaagcctacaaggattaattattaaatacccaaccccaaaaaattcttcctttttgattctctgattcgtccctttttgtacatggtttctgtttggttgttagagcttcttgctgagttgaattgagctggttgcaatcactctgtttcttgggggttgatcgtgtattcaagtggtggatgagtctgttccatgtgctagggtttggtgtcaagattgggcatctcttctggatgctatgctgctggtttgtttcttggttcgttgataatgggatcgaggacaagtctggtcttttagttggctctgtcggtgatcttgagaagactaagatg

SEQ ID NO: 34245 - DNA, 3003 bp, Unknown
  misc_feature (1)..( 3003): 2750-1469P.txt file - cDNA_ID_3076048; gDNA_ID_1620770; Annot_ID_167504
tgatcactcacaatgtagaattgtcccaggtggtacctaacgacacaccgtgcttctttatgatcttcaccgcctcaagaaggacctcttgttgtgtattgtatagctcttcttttccctgagacaaatgaccaccattctaatgtaaaaagatcacatcaagctactaaactttgtctacatttgacgaagactgttacagagactaaagagagagtgtaccatgcgtatcagattgcaagactgttacagagactaaagagagagtgtaccatgcgtatcagattgcacccaatggtaagttcagcgaaagatttttccactcgcgataagtaacagtgtggagcttcttttcctaagaaaacttttgtgttggacctcaacatttccttgatttcatttgatatttgaggaatcatatccaagtcatcgatctgcagtgggatcttggatgctattgctcgccactgagcacgtgacttattcacaaaattaaatcattgcgagtgttaactcagtgtggcattatgaaagctagagaattaaatcattgcgagtgttaactcagtgtggcattatgaaagctagagcattagcttctgcaatatgaagatgaatagtgagaaacagataaactaacctgactcgaaaacagtgaattgggtaccaaaaccggaaatttttctgcattcaacaaagatgttgtcgtaagtcccatttcaataacttgaccttctacggatccagcctgcaaagtggggacaaggaagacactatatcttgagaaaaaagaagagagcagaaaagaaaaaaaggttcaactaactttgatagtatcacagaagagagcagaaaagaaaaaaaggttcaactaactttgatagtatcacccatagagaaaggccgcgagaattgcattgacagaccactcagcacattaccaaggatatctctggcagcaaatgcggtggctacccctgaaaacgcaaatcaaaattggtatgttatgagcaaatactatagaatcagtaggatatctaaaaatgttagcaacccctgaaaaagataagactatatgcttgtgatggccgagcaaaacgactaatatgaaatggagaacattagacagacctccaactcgagcaaaacgactaatatgaaatggagaacattagacagacctccaactccaccaactgtcaagatagattgaacagctacaccacatgcttcagcagaagccatcaaaccgatagcgaaaagaccaacagatgatactttgtctaaagtcaataccttctccctatcaagcccaccaaaactcttagccgacaacattcgggtaatcacattggtcttccaccgatataggaaccacacaagtgagagatggcgccaccattgcagcactgcagcatatcacattcatcaagtctatcttggcgccaccattgcagcactgcagcatatcacattcatcaagtctatctattttctacaacatacatgtcaaaggaataaagctagagagactcacatttgtgcaaaagcaatgaaggtcaccaagtaacgagcaggatcctctaaagctccccaaaagcttttctcataaggaacatcttcgttagagaagccaacgggaagcagtttagcggaactttgcatagcataagtgtgaaaccttctaagaaacaggaactataacatctttaagataagggttagagtcaaggaactgctaacaggaactataacatctttaagataagggttagagtcaaggaactgctgaacatgagggatcatctcatcagagacatctttagtcttctttgcagtctcagtaacagcatcgacactagtctgcaacacatctttagctttctcaacccaatcattcccattcccattcccatcaccagagccagtaacaccagaggctacaatacttccgaaatcatcagatttggagctgaaagctcgtgcgtacgttcgatgaaaaggagatcatcgaaggagaagcttttggtccatcaagaagttcgatgaaaaggagatcatcgaaggagaagcttttggtccatcaagaaggtttccgcaagtaaaggccctggcatgagagtttaggagaccagaacacgattttgcagtggcatgaggttttattgatctttgaattgacttgagaagcgataacctaactccggccattgatctacaaatcaaaatcaaaaatcaggatttagaagtcttaatcacattcttaaccaattgaagaagaacacagtgtaattgaagtcaatggaatgtgaagagatcatagaacttgtatattacctgaattgaagtcaatggaatgtgaagagatcatagaacttgtatattacctggagagacttgaaggtagctagattcttagccaaaattctcgctgagagataaagaaagaattctaaattttgcttggcaaagagggaaagaagatgaagaagaagaagagacaggtttatttcgtcaactctgcttcttattcggtaacatcgacgtcgttttagtcaccttcaacttctgggccttttgggcctaatgatattaagaaacacacacacacaaagttgtgaatttgtgaatttacttaactattaagaaacacacacacacaaagttgtgaatttgtgaatttacttaactacgtacatatatataatcattaattaatcacggtgtttgtcaaatatatatggttacaaattcaatatgttttggacaaaataatatgtgcctaaatctgcttataaatgacaaaatatatacaaccactaaaaatagaagagatatttatcatgaattgtactccaataaaaaaggtattgactttagacaaagtatcatagatttgtgtgaaaaacgctattttcagttattaattactgtaatcatatagatttgtgtgaaaaacgctattttcagttattaattactgtaatcattaatgttgaaatg

SEQ ID NO: 34246 - DNA, 3000 bp, Unknown
  misc_feature (1)..( 3000): 2750-1469P.txt file - cDNA_ID_3076055; gDNA_ID_1620770; Annot_ID_167497
gttcccacttggtactcatacccgagaatctgaaagaagaaaatccaatggctcctttggaaagtccagcaaccgcttcttcaagcgaagttgagagttcttctgaagagatctttaagtcttcttctgaagaaagcaaacccaaagatcctgtcacagttccttcctctaaaaccctaaaatctccttccgccgctgtgaattctaagacagattcttctgatgactaaaatctccttccgccgctgtgaattctaagacagattcttctgatgactgctgaatcaccggcggtgaagtcagggaagaagcgagctggtgaaggaagcacctcaagggacatgcatgtcaaaagagttaagaaagaggacgataacaaaaaggcgaatcctcagagagtatggagtgaagaagatgagatctctcttctacaggcagtgattgatttcaaagctgagacaggtacaagtccttgggatcataagaatgcgttttttgatatcgccaagaaatctataagctttgatatcataagaatgcgttttttgatatcgccaagaaatctataagctttgatttttgttaaccggaagaacaaaagtggtgaatcgaatcatgataagaaatgtttgggtttggctgttttgatttggggatctgatggtatgaacgttgaatctcctgtgaagaaagatgaatctattcttgttaagggtaaggctaatagcaaggagaagaaggtggagaaacctttggttatagaagatgagcaagtgattcttggagcagattcggagtggtttgaggagtcttttcttgttccggttttcttggagcagattcggagtggtttgaggagtcttttcttgttccggttggtgtctctggagactaagaagaagattcaagagaagatgaaggttgtggacgctaagaaatgtgagttgttgttggcggagatggatgttttgaaggatgtgacttcggtgcttgctcaaaccaactaagaagaagaagaagaagaagctatcttagggattgtatagggttaatctaaggatgtaatgccctcttttgttatctatcttagggtttatctttctatctacgtttatggatttttagtcttatctatcttagggtttatctttctatctacgtttatggatttttagtcctaacaaaccttttggtcgatggttgtaatgaacttttaggattttgtaaatgtgcttctttttttaatgtctctctactcaaaactcatgaccagagttattacaaaacaaagaaacacacaatagaatggattcacaaacatattcaacaagagttctaaatagcttatatggtgataggttcaacctcattaaacaaaatggattctgaaatgatgtttgtaaattgtatatttattgtttatgataaatggattctgaaatgatgtttgtaaattgtatatttattgtttatgatataccaaatgcaaccaaaataaaacatatacatttagttacaatctttcacagaagttattatgtctataataaaaaaattaagagattctgcatcttgaaactgcaaagtaggtgaggaaataaaaagaaacataaattgtgtttatgagcatgcttgttgttagagtcccaatatgtagtagagtagcttgcaagaaatcagagttaattatgcgtttaagagcatgcttgtgtgtgtaagtgtttcaacagagttaattatgcgtttaagagcatgcttgtgtgtgtaagtgtttcaaagttttattatcaagacatcatgctcttaaacgtgttcttgtttctctctaaagaaaacaaaagcaaaacagagtgacaagagagtgagagtgctgacctcaaaagaatgttggaagaggtagtttgagagtgaaagtgtgattttcaacagatatcttcctcacgtagaagaagttgaatggttaatatcaatattgttatgtataaccaagaaagctatagaattgcactatgatattgtgaagctgcatgtataaccaagaaagctatagaattgcactatgatattgtgaagctgcgttagtccgcgtacttgtcttaactcttatgcaggggtagccaagcaatatgaaacatttagtgtggcccattttttttttttcaaattctttaacaaaaattatttacaaaatggccccaattttattgattttaacgataattggccctaaattttaaaacctttcaaaataatcttggattttttgtttttttgtatgttgcccataaaaccgtcaggtcttaggtaaaacatctataaattaatatgttgcccataaaaccgtcaggtcttaggtaaaacatctataaattaatattgaaaccagtgtaagaattgatacaaatcgataaattaataaaataataactttttgtgaaaatcatatgtaaatatttggtcccatcaatattataaattcactaatttatatatatatatatatagatatatactaaaatatgaatatagtattcaatttgtattaattctttgtagaatttaattctaatatttttactaaatcgaaaaatttagttttggtttttaaacttgataattgtttaatactaaatcgaaaaatttagttttggtttttaaacttgataattgtttaataaccttttttgattgaatattataagaaattacataatttgtaaaatttctttataaattaatatctcttcaaattaataaattttatcaatcttaaaattattaatttatagagattttacctaatatgcatttttaactaaaagtcataatgttatatattttatttatatttagagaataatatatatattaaaaaaaaaaaaaaaaaaaggttgacaagtggaaatatgtgaccggcaatagtaagtaaaaaaaaaaaaggttgacaagtggaaatatgtgaccggcaatagtaagtttcccccaagcgaagaagcgatg

SEQ ID NO: 34247 - DNA, 3000 bp, Unknown
  misc_feature (1)..( 3000): 2750-1469P.txt file - cDNA_ID_3076071; gDNA_ID_1620770; Annot_ID_167485
aatgtttgtgtgtaaggtagattgagatatatgaatggtcaaatcggaaataaaattgtgtgtaaggtagattgagatatatgaatggtcaaatcggaaataaaaatttccgttacatgatttcgcgattaattactttttataattagtcaacttcgacgccttgtgtcgtcctcgattttaatgttctgtctttctctgcattcatagtttatcttatttcatttcatatccttacttcttttttctacaaacaataatttctagacgaattgaaacaaatttccaaaactttatgagtatatataggatatttttagtggcaaaggacgacttaaattgtaacgaaaagaatataggatatttttagtggcaaaggacgacttaaattgtaacgaaaagaatatcatatgaattgattacttaatgaagttaaatttttgaaaactctattagggacaatgtcccacatcggaagttgagtaggatcttaagtggtatatataagatatgagcctctccacctattgccaattagttttacgttggaagcccacagtctgatatggtatcagaccccgatccgcacatactcaacccgatccacatcggtccggcccaatacttggcccgccgatccatgcccaaacatatcacatcggtccggcccaatacttggcccgccgatccatgcccaaacatatcatatcccacatcggaagttgaataagatcttaagtggtatatataagatatgggcctcttcacctattgccaattggttttaggttggaaacccacactctaatatggtatcagagcctgatccgcacatactcaacccgatccacatcggtccggcccaatacttggcccgccgatccatgcccaaacatatcgagatcaatggctagaagaaccatcatctcgagggggcgtattagggacaatgtccaatggctagaagaaccatcatctcgagggggcgtattagggacaatgtcctttccatctattgccaattggttttatgttggaagcccacactctaataaactcaatacaaatactaaagttgcaaacaactatactatatttgcttgaagttctattgtgataggattttgacttacaaaaatcatattctatgtctacactatatattgtgaaaccggatagccataatatttacaaaaacttaaactaatttcagatataaataaatttaaatttcactatgacctagtaattatcaaatttcagatataaataaatttaaatttcactatgacctagtaattatcaagcgaaaccacacacttgcgggtaaaaataatgatgacaaaatgatatacattggaatgtagagaaagtatatacaaatactaataaatagaaaagggcatggaattgacgaggatcgagggaaagtgtggtgtggcagaaatgttattaagtgtgaaaacaactgatgaatgagcctttgcttaatcacttccatgcacaagtccctttcctcttcctctctctcccacttcatcgaactttgcgtcctaagtccctttcctcttcctctctctcccacttcatcgaactttgcgtccttaaccagattagatttaacttcgtttattttacattatcttcttcttcttattttgcggagaagacttgtacaatgacctcaatacgctgaagagttggattcactgcgagtgtatatgtgcatatagaaacaaaatatctagctatatgaccacttttaactctaaatatgggtgtaatatgccaaggactttctggagatccaccacaacacacattcaagttcaagttctgctgcttttaggtctatatccaccacaacacacattcaagttcaagttctgctgcttttaggtctattaagtatattttcatattgttccctctttattttcatgcttttagttgatattttttttgttattgtattatcattagtgcgacgacacaaagtcacaaaccatgtaacaaaatgcttaaccaaaatagaaaaccttaacaattccaatatattttctgttattgcattatcaattatcatcaaatttttttccactgttgcattatcatcattgcgacgacacaaggtcacaaaccatgtaacaaaatggcattatcatcattgcgacgacacaaggtcacaaaccatgtaacaaaatgatattatcttaatttttggatgttcgacattcaaataaactcctaattaaaccctatagatatggttaatcttctatacatgtgtcacgtacgacacttattagccaaattgaagttttgttttttccgcaaatatataagcggtttaaatagttggtaaaaaaaaaaaaaagttagcatgtttgtcgtatgtacatgtttgatgctgcacaaatcttgtcgttataaaactttgaaatctttatatctatgatgctgcacaaatcttgtcgttataaaactttgaaatctttatatctatagtcccaaagtagagtttttatctgattatatagaaacaaagactagttccggtttgatatatagaagaaagaaaaaggatggataggaataataaagaagataaaccggttcaaaaggtagtaaatgagaatgcaggtatgcagcttatctctacaatggcctcttcatcacatgtcgccaatttgtttaggtacagtgtctcttcatatttacataaatagatatctctctctctctctctctctaagtctcttcatatttacataaatagatatctctctctctctctctctctaacaacttctggagaagtacaagacatttataaagtactgctcatcacccaacactaaacacaattgtcaaaagggtgtggtggaaggagaatctacttctatctgaacatcgatcagtcatatcttttcaatcaaatcaaagccctcctctctctcttactccttttttgttttaaatcaagaaaaagactccatg

SEQ ID NO: 34248 - DNA, 3000 bp, Unknown
  misc_feature (1)..( 3000): 2750-1469P.txt file - cDNA_ID_3076079; gDNA_ID_1620770; Annot_ID_167483
gcatgtccatgtcgtcctcctcagctccagcttttccaccggaccacttctcatgtccatgtcgtcctcctcagctccagcttttccaccggaccacttctcttgctgtaaattttggattattcttatatctcatctcaatatttcaaatttataactctagctagggtttcacatgaattactagttaattaatgtgtgatattaattggcaggtgagtgttcctccgagtagtttgttcaagacggtgacggtcagatgcggccactgttcgaaccttttgtcggtgaccgtgagcatgagagctcttcttcttccatccgtttccaaccttggccattcctttttacgagagctcttcttcttccatccgtttccaaccttggccattcctttttactcatcgaaacaaattagggttctttcataaaaaaaacagagagtaataattagggcttttcttctcgagaaacgcaaaattgtgaaactcaatccaaaaatgtttaattttgttagcatcccgggatagatctaagtagtttggcaatggctagttaactagggtttctttcgaaaacatcatatcaaagtagtttggtttgattagtgttttaagttttttttgccaattagtttgctgatttcatttatgattagtgttttaagttttttttgccaattagtttgctgatttcatttatgagccatcacgcttcagctcaccacccgaacgagcatttggttatggcgactcgcaacggaagatcagtggatcatctacaagagatgcctcggccaccaccagccaatagacgtaaccttccatcttctactctttatttcaacatcttcatatatatatatataagaaaacaaaaaccctaattcacaaaaccttatccattcatttcttcaaccttttatatatacactccaaagaatctcgtttgccattcatttcttcaaccttttatatatacactccaaagaatctcgtttggacttctcgcatgcactttttttttggtcagaaaacaatttcgacaacaaaaggaaaattaataagtgatgtgtttatcccccggaaatctagctaaacctatagatgccaactgatatagttttgggggtagatcgtaagaaagataatgatgaagtgatgatgataacgagcaaagtgagagggagagggagagagagaaaggaggaagagtcgaagagtgattgtttttttttttttaattgtttttaaaggaggaagagtcgaagagtgattgtttttttttttttaattgtttttgttttttttaacaaaagggtttgatttggaattaaaattgaatatgttctgtttgtttgtttgtggaaaagcagccccagagaagcgacaaagagtaccatctgcatacaaccgattcatcaagtaataagtttattcctttgcttaaaatggcataattaaatttccctaattaaccattttactcatataattaagggtcgatagatgtgacagatttgatttcattatatgatataaaaataaaaattcgatagatgtgacagatttgatttcattatatgatataaaaataaaaatccacagagaagccttcagtgctgctgccaaaaacgtaccatttctttttttaatatataaaactaattttctatattgcattatatccataatcatacaatctcattttagtctttatgaattgaacctagctagattattgtggagctacattgatactcacattgctttaaattaaaaacataaaacaaaatagttaccgtaataatccataattcataagctttatccagcatacattagctaggaccgtaataatccataattcataagctttatccagcatacattagctaggacttttagtctggctttgtattcgtatatttttgaccaagtttttatgttatgtataagataaatacacattaatgttaaaagagctaagtatatgatgtaatatgtatgaaacagtgggctcatttccctcacatacactttggactcatggctgaccatcctcccacgaagaaggctaacgtgcgccaacaggttacttactactactacactatatttatttattcaaatgtatataatcaggagcatgctactactacactatatttatttattcaaatgtatataatcaggagcatgaaggaaggagaggatgggatgatgggaagagaagggttttacggttcagctgccaacgttggggtggcccataactagctacgaagactttcccaatcttttgtaatcttcaaaatgtggttactttcagctcaaacttaactttcttattactattttatgatatttgataatcgatcaggagaccttttttttttttcttaaagaaattttcggaactactagaattttctcttggaattgaaaatatttaaagaaattttcggaactactagaattttctcttggaattgaaaatatagctaagctagctaggctttaccatacgttaatgatactgtctttttctctttacaattccatattcgaatttgatttgtatataacatattgggaagaatcatcaatatgtattcagctcaaaagaattcaacaaaaaaaaatgcctattatcaataaaaattcactgggctttagaaggcccacaatagtataatggatcctttttgttgggcttatttcagtcagggaacaatagccttgattttgttcctttttgttgggcttatttcagtcagggaacaatagccttgattttgtaaatctagttacgtggcatttaatatttaaaactacaaaatttaccagtcttggctcaaaaaaatatttattcacttttcttcttctctgaccaaaatcaaaatttgttcgattctcattcttcttctcacagtcgtaaaccctaaaaaaaaaacagagaaatcaaatttcaatctcgaaggatctacaaagaagcatg

SEQ ID NO: 34249 - DNA, 3000 bp, Unknown; identical to SEQ ID NO: 5190
  misc_feature (1)..( 3000): 2750-1469P.txt file - cDNA_ID_3076083; gDNA_ID_1620770; Annot_ID_167481

SEQ ID NO: 34250 - DNA, 3003 bp, Unknown
  misc_feature (1)..( 3003): 2750-1469P.txt file - cDNA_ID_3076097; gDNA_ID_1620770; Annot_ID_167469
ttctcatagcccatattgttacacagctgtagaagttataatgttttgtctgctcttgcgatattgacaaacatacctcgtatgtcaataatgttttgtctgctcttgcgatattgacaaacatacctcgtatgtcatatgatcagtatccatccttaattcttggtagggatcagtatccatcctcaaaccctatatcaataccaaacatacagaaactcaggatcaaacaagcataaacccaattcaaatccagaaataagaaggaagatgctcttagtacgactgcaataaaaatttatatcatattaacaacaatttagctatggtttaattcgaatcaaacctataatatattaggaaaatttaaactaaaaatgtggataggaatcaaacctataatatattaggaaaatttaaactaaaaatgtggatagtttggtcaacaagagaggagccaggcgaatatattaacaagtgcgcaatgtgcatacattccaaaagagttgggtatcagatcctttttctatgaataacttcattcatgtcccgttacttttcccttacccttgtttctttcgagagaggggaactacaagaagcaaagaaaaaatcgaattttcccggaaataaaaacacaaaataagaagctaagaaattaggtagtttaagaatcaacgaagaagaacaaaataagaagctaagaaattaggtagtttaagaatcaacgaagaagaagtgaacaagccagtgaaatcttgttcccttatatcgatatccaaccttgagaaactcagaatcaaacaagcataaactcaagtcaaacccaaaaatatacaaaaaccctattctattcgagtaaacccttattagaaaacaaaaactaaatcgatatgaaaccctaatctattcggaaaaaaaactgaacaaaaactagtgtggcttgattacgtcgatggaggtggtctgtataaccttctgccgatttgtggcttgattacgtcgatggaggtggtctgtataaccttctgccgatttgacttctttgattgacatatcgaaaataaatggaaagtaattattacaatcatacatgcatgtcaaataaaaaaataaaataaaaattccatttatttaatataatgttcgtttgttttcgagatgtaatacgaacgtgaactagtcaatgggagctaattgagaaaaaataggaactaaaaattaatcactaacaaaccctagaaaaggcatagcttaatacaaaaaacaaatacctgcaaaatcttccctagaaaaggcatagcttaatacaaaaaacaaatacctgcaaaatcttcatcgctactgttaacagtttcttctcttggtgggattttatttaaatcaaacaaaaattcatctccatcatcactataaacagttttttctggaatttcatttaaatcaaacaaaaattcattctcttcacttagaagtgacatactcaaataaaaatttggaattgtgaagaaaattagaaatcatttttttttaaaaaaaatttttgaaattttttgtttaaaattaattatgtaatggttgcacaaaaaatttttgaaattttttgtttaaaattaattatgtaatggttgcacaaaaaaaataatcaattatgtaaaaagttgctccattttttcaagtaatttgggttgtttgagagtttaatgcgtaacgtttaatattactctttaattgttttaattactttacttgattgtttttattaaataatagttttgttaattactgtgctaaacctcaaaacatctgatatattgagtaatttatatatccaaatctctcataaaacctttgaaaaaagctattaaaaaaaatctttttttttttctctcataaaacctttgaaaaaagctattaaaaaaaatctttttttttttgagttatatatcttgatactgtctagcctaattatcaatgcttaattttcgtacttaaatactatcatcaattcatcatggatttcagagcggatactccaatcttctttgcattttatcttttttttaccgtttaaggttaacataaaaaaaaatatattctaaattttttttttactgaaaaaagattctattagaaaaattttgtcttcttgcatattaaaaatctaacctatattttacatgaacgaattttgtcttcttgcatattaaaaatctaacctatattttacatgaacgtaaatagatgattttatgagtggcaaaaacgaactcaccataaaaccattagtaacacatgtagtacaaacccaatattgaataggaaccgtactacttttctaattatttaaaattgcaggagtggtatgtcttggagaatcgaggagacacgcatcgagtttaaatgtgtggtcggagagaataaaagtgtgtgcagaacgagcttcttccttttcgtcttctccgccgcaccctttgggtcaacagtacgagcttcttccttttcgtcttctccgccgcaccctttgggtcaacagttaaaccctctccattacgcgtgtgaatatacacatataatattcacattatataagattatgtttcataacgtagatcctgcctgttctatatacaacaggttttggtatgagacgttagatactttaattcatctggtcaaatgcctagctagaataaatatctttaatcacgttcaaaattgattttatacgaatacatgtaaccttccttcaaactctagctgctcatcaattgaattaacaaacaatgtaaccttccttcaaactctagctgctcatcaattgaattaacaaacaaaaacaaatccaagtcaagtgatcttaaatccagctcattcttattcacgtgccatgcaaaatgatgcatacagtatatataagggacacacacaaagacatgtaaatattataccatccaccgattaagctacatatcctctcagttaattctctaattcgccatg

SEQ ID NO: 34251 - DNA, 3000 bp, Unknown
  misc_feature (1)..( 3000): 2750-1469P.txt file - cDNA_ID_3076113; gDNA_ID_1620770; Annot_ID_167465
gataatataattgtattttgattgttatatatatgatttcgcccgtggtataccgtctcgtattactatcgactcaaacccgtcctacaatctaatctcgttcagtgaatatcaaacatatcttatggatttcacccatgatatatcgtcttgtatttctatcgactcaatcttatggatttcacccatgatatatcgtcttgtatttctatcgactcatcatttttgtttaataatactttaatcgaaaagatatataattcaaatcaatataaaagttttctttcaaatggttatttaattgttctaaagttcatatattataatactctaaacccgtcctaccatctataccattcggtgaaattaaacattattttttattttttgttttaataatacttttattaaaagatttataattcaaaaatcaattaaaaagttttctttcaaatggttatttaattgttaattcaaaaatcaattaaaaagttttctttcaaatggttatttaattgtagttcggtgaaattaaatattattttttattttttgttttaataatacttttattaaaagatttataattcaaaaatcaattaaaaagttttctttcaaatggttatttaattgttctaaagttcatatattataatattctaaacccattataccatctaatccagttcggtgtaattaaacattattttttattttttgttttaataatactttattaaaagatttataatttaaatcaattaaaaaggttttaataatactttattaaaagatttataatttaaatcaattaaaaagttctaaacgttttttccgtgaaaatatttaataaactttaaataactaaaatatttacctttaataaagtatatattttttattggtaagggtttaataaagtataatattaataatgtcctaaaatttctctttttttaaataattagaattgatggagatatattagataaggaaatcctaataattaggaatattaattaattgataataataaaatgtcaatagcattgagttgtaaataagtctcttaattgataataataaaatgtcaatagcattgagttgtaaataagtctcagtgtgtcacactatgttacgtatgttcctttgctagaatcgagtgaatctttgaaagccagagaaaacgacatctgaattatgtaaggttgaaattactttttggatgcatgaagtaagatgccattgaagaatacttcaattatgtatataaacttactgtattgatgtatttctgtgatttaccattaaagaacaaaactaatgcaaccattacatgatgtatgtgtgttagcatcggttcctgtatactaatgcaaccattacatgatgtatgtgtgttagcatcggttcctgtattgagaaagccttcgaaagtgattcccggtccgaaagctaagcccagaccccactcttctccctctgtgcctttcttctcaagctcatctctgactttgtccattatgtagaagatggtgttgctgcttacgttcccataatccatcaacgcccttctgctgcattccagcttttccggcttcagcttcagctttgtctccagcccgctcaggatggctggtccaccaggatgaactgcccagaaaaggtcagcccgctcaggatggctggtccaccaggatgaactgcccagaaaaggtcactcctccacgttgtcttcgatcttctgagggaggtctcttcctagcttgaaggttatgccctcttctgacagccgcccgtcgatcaccccctgtgtttggggcaggaactgctgcatagcacagtgaagctccatgaaaggagattccgactctgtagggtctgctccgatgatcagggcagctgctccatctccaaagagtgcagccccgactaagttgtaaggacgagctttgttgggtgggcggaaagtgcagccccgactaagttgtaaggacgagctttgttgggtgggcggaatgttctcagcaatgtctttggccacgcgcagcccactcaaacctccatagcatccaagaaaatacagcatcactctctgaacctcgttgctaaggcccagctgtgccgagaggtaaagatcacctccgggcaaacggaactcactggaggaaacgtagacaagatgagtgatatcttccactgcccttccccattccttgatgcaaaccaagctcgcttcatatgccatctgcacaaccgcatcgtttgcatgcaaaccaagctcgcttcatatgccatctgcacaaccgcatcgtttgcggtatttgtgcagcgtctcccgtgacatgactgtgtagcgtgtcttgacagttgtgcttttgcctaacatcaccaagacacacaaacacgcttatctttgcacaagtgctcaaagaaaaaaagttgtcaaagaaagtagagggaagttacacaagtgttgcagcttgtctttgatagaaaggttatcgcatttgatttcacggagatactcctccacgagattctcctgggaaacaacattgctcggcaacggagatactcctccacgagattctcctgggaaacaacattgctcggcaatttgtttctctacccttgcggacaccaacatctttgtgagttcacaatgaaataagagacaaaggattagtgttggccttttaagtcatggattgtgaaaataacattaaaaaagggcatagaaaatgtgggtggtgtgtttgtaacaaacacagacaaaaaccctaaataaactcaaggatgacactttgaatgatccttcaaattcctcttcctcctcctccctatattcctgcatcatctatttgagtcaaattcctcttcctcctcctccctatattcctgcatcatctatttgaggcaaaaagcatcacaaattatacaaatgattcagtccagttataaggagcacgatcaacaattaagtagtctcctctgatg

SEQ ID NO: 34252 - DNA, 3000 bp, Unknown; identical to SEQ ID NO: 5193
  misc_feature (1)..( 3000): 2750-1469P.txt file - cDNA_ID_3076117; gDNA_ID_1620770; Annot_ID_167464

SEQ ID NO: 34253 - DNA, 3003 bp, Unknown
  misc_feature (1)..( 3003): 2750-1469P.txt file - cDNA_ID_3076125; gDNA_ID_1620770; Annot_ID_167461
gtgaagagacagacttgtccaaaacgcccaccacgaaggtgcatagtgagaagagtaagtcaagagatagacttgtccaaagaagagtaagtcaagagatagacttgttcaaaaagaaacagaagagaatagaagagtaagtcaagagatagacttgttcaaaaagaaacagaagagaatgcttggggttacactcacgaaggtgcatagtgagaagagtaagtcaagagacagacttgttcaaaaagaaacaaaagagaatgcttggggagatagaagtgtgagatagttctcaagctaagaaagttgtaaaagctaagaactagcatcaaatgatggatgaaacacaaggtagttgttgaaaagtcaaacacttggtgatgaaaactggtgattgttgcgaaaatcgtccaggattcctcgaccaggaatgaaaactggtgattgttgcgaaaatcgtccaggattcctcgaccaggacttgaaatcgtcgaggggaaaaaatcggttccgaggaatcgtcgatccggacttggaatcgtcgagaaaagtttaccgggtccgaggaatcgtcgagaaaagtttaccgggtccgaggatttgtcgaccaggagtggaaatcgtcgagaaaaatctatcgggtccgaggaatcgtcgaccaggacgaggaatcgtcgaccacttcatcgaccgggtccgaggagtggtcgagggtttgtcgaccaggacgacttcatcgaccgggtccgaggagtggtcgagggtttgtcgaccaggacgaggaatcgtcgaccgggtccgaggatttgtcgaccaggggttgaaatcgtcgaccacgtccgagacttcatcgaccgggtccgaggatttgtcgaccaggacgatgaatggtcgatgaaaatctatcgggttcgaggaatggtcgaccaggggttgaaatcgtcgaccaggtccgagacttcatcgaccgtgtccgaggagatttgtcgaccaggggttgaaatcgtcgaccaggtccgagacttcatcggatttgtcgaccaggggttgaaatcgtcgaccaggtccgagacttcatcgaccgggtccgaggaatcgtcgaccaggacgatgaatggtcgatgaaaatctatcgggttcgaggaatggtcgaccaggggttgaaatcgtcgaccaggtccgagacttcatcgaccgtgtccgaggagtggtcgagggtttgtcgaccaggacgaggaatcgtcgaccgggttcgaggaatggtcgaccaggggttgaaaggtttgtcgaccaggacgaggaatcgtcgaccgggtccgaggatttgtcgggtttgtcgaccaggacgaggaatcgtcgaccgggtccgaggatttgtcgaccaggggttgaaatcgtcgaccaggtccgagacttcatcgaccgggtccgaggaatcgtcgaccaggacgatgaatggtcgatgaaaatctatcgggttcgaggaatggtcgaccaggggttgaaatcgtcgaccaggtccgagacttcatcgaccgtgtccgaggagtggtcgagggtttgtcgaccaggacgaggaaatttgtcgaccaggagttgaaatcgtcgaccgggaccgagaattcgtcgaatttgtcgaccaggagttgaaatcgtcgaccgggaccgagaattcgtcgaccaggacggcggaatgctcgaccaggacgatgaatgggcgatgaaaatctatcgggttagaggaatggtcgaccagaagttggaatcgtcgaccgggtccgagaattcgtcgaccaggacgaggagtggtcgaggatttgtcgaccaggagttgaaatcgtcgaccgggtccgagaattcgtcgaccaggacggcggaactggtcgaccagaagttgaaatggtcgaccgggtccgagaattcgtcgacctggtcgaccagaagttgaaatggtcgaccgggtccgagaattcgtcgaccaggccgaggagtggtcgaggatttgtcgaccaggagttgaaatcgtcgaccgggaccgagaattcgtcgaccaggatggcggaaccctcgaccaggacgatgaatgggcgatgaaaatctatcgggttcgaggaatggtcgaccaggggttgaaatcgtcgaccaggtccgagacttcatcgaccgggtccgaggattcgttcgaaaatcattggatatgatgcaatgttttgtgatcgaatctcttaaattcgaaaatcattggatatgatgcaatgttttgtgatcgaatctcttaaaatacatcaataaagagtttaggatgtcaagtttgcatcaaatatgcccacggagccccaactagaccatgaaaatccgatgttgtatcaggtcaaatgacctagctagaggtgtcaaaaaattatgaaaatttaccagaaaataggatttagtatccttatgatgcatgccaaaaagaattttcaaattccaagtatttccaagagggaaaagggctattaagctatataggggggtgggtgttgagggacaagagggaaaagggctattaagctatataggggggtgggtgttgagggagtctgggcagtccgtggggaaccccctttttcggttcggacttgggtagcgatcgagggatggtatcggatatcggcacgaggaatgaccgaccgtccggccgccgggattttcgccggaaaacttttccggcgacttttccggcgatcggttttgttgcctttttccgagttttctcagcagttctcggacaaaaactgttcgaggcgttagggtggcggcggtataaaagtgtcggagttttttcagcttcgaggcgttagggtggcggcggtataaaagtgtcggagttttttcagcagttctcggacaaaaattgctgagtggccgagaagaatgggcgtgccatgcgtgggctgacatggattcttcgaggcctaggggtggcggtatataacttgttcgcatgatattaccgagatg

SEQ ID NO: 34254 - DNA, 3003 bp, Unknown
  misc_feature (1)..( 3003): 2750-1469P.txt file - cDNA_ID_3076129; gDNA_ID_1620770; Annot_ID_167460
aatgttttgtgatcgaatctcttaaaatacatcaataaagagtttaggatgtcaagtttgcatcaaatatgcccacggagccccaactagaccatgaaaatccgatgttgtatcaggtcaaatgacctagctagaggtgtcaatgccaaaaagaattttcaaattccaagtatttctttttttttggcaccgatgccaaaaagaattttcaaattccaagtatttctttttttttggcaccggtgtctcctcagacatttcaatgtctgttggtgccaagagggaaaagggctattaagctatataggggggtgggtgttgagggagtctgggcagtccgtggggaaccccctttttcggttcggacttgggtagcgatcgagggatggtatcggatatcggcacgaggaatgaccgaccgtccggccgccgggattttcgcccgagttttctcagcagttctcggacaaaaactgctgaatcgtcgaggagccgagttttctcagcagttctcggacaaaaactgctgaatcgtcgaggagaatgggcttgccttgcgtgggctgccattagttcttcgaggcgttagggtggcggcggtataaaagtgtcggagttttttcagcagttctcggacaaaaattgctgagtggccgagaagaatgggcgtgccatgcgtgggctgacatggattcttcgaggcctaggggtggcggtatataacttgttcgcatgatattacgtgtcatggcatgggctgacatggattctcctaggccgtttgggtggcgggtgtcatggcatgggctgacatggattctcctaggccgtttgggtggcggtatagttgtcttgcgtagaaataccgagatgtccccatgggcatcgattccacccgcctaggttggatgggcgtgcttcgttggaaagcatggatccgcctaggctgtcccgagtgtgagcgaggtgtgagtgtcgcccatgggcatcgacaccttgcggctaggaactggaacgagacgggtggcaaagatttcgagtatattccgagaattagcaaaccgtaacgaagatgttcttggcaaccatctttattccgagaattagcaaaccgtaacgaagatgttcttggcaaccatcttttgatgggagtccggctgttcgatagccggccaagggtgatgaacgaaatgtgaacccttgtctcgcctaggttggatgggcgtgcttcgttggaaagcatggatccgcctaggctgtcccgagtgtgagcgaggtgtgagtgtcgcccatgggcatcgacaccttgcggctaggaactggaacgagacgggtagcaaagttgttgatgttattccgagaattagcaaaccgtaacgaagatgttcttggttgttgatgttattccgagaattagcaaaccgtaacgaagatgttcttggcaaccatcttttgatgggagtccggctgttcgaaagccggccaagggtgatgaacgaaatgtgaacccttgtctcgcctaggttggatgggcgtgcttcgttggaaagcatggatccgcctaggctgtcccgaaggtatctcgcgcttgtacggctttggctcggattcgtccgtcttctttcttcttagccgagtacttcgtatgagtggtgatcggatagctagtgttcgtaggctccatgctcgcgccgtatgagtggtgatcggatagctagtgttcgtaggctccatgctcgcgcatcgaactacctaccacctatccttctcagttaattcacgggcgatgttacgctcgatgatgagttccggggcctgtgtttcgtacctaatttgaaggaattgttgagtttggtttacacctttgcccgcggcttctccttcgtggggaagtcgtgggcacaaacatcggcgcttgttcacctctcgtcatcgcatttgtaaaagttgtcgacggtgactcgaagtgattcagtcccgccaaagctcatcaaaagttgtcgacggtgactcgaagtgattcagtcccgccaaagctcatccgtccttcgggcaaaagatgacggtcaagacctcgtcctttctctctttccattgcgtttgagaggatgtggcggggaattgccgtgatcgatgaatgctacctggttgatcctgccagtagtcatatgcttgtctcaaagattaagccatgcatgtgtaagtatgaacgaattcagactgtgaaactgcgaatggctcagtaattctagagctaatacgtgcaacaaaccccgacttatggaagggacggtaattctagagctaatacgtgcaacaaaccccgacttatggaagggacgcatttattagataaaaggtcgacgcgggctctgcccgttgctctgatgattcatgataactcgacggatcgcatggcctctgtgctggcgacgcatcattcaaatttctgccctatcaactttcgatggtaggatagtggcctaccatggtggtaacgggtgacggagaattagggttcgattccggagagggagcctgacctgacacggggaggtagtgacaataaataacaataccgggctctttcgacctgacacggggaggtagtgacaataaataacaataccgggctctttcgagtctggtaattggaatgagtacaatctaaatcccttaacgaggatccattggagggcaagtctggtgccagcagccgcggtaattccagctccaatagcgtatatttaagttgttgcagttaaaaagctcgtagttgaaccttgggatgggtcggccggtccgcctttggtgtgcattggtcggcttgtcccttcggtcgctttgaagaaattagagtgctcaaagcaagcctacgctctggatacattactttgaagaaattagagtgctcaaagcaagcctacgctctggatacattagcatgggataacatcataggatttcgatcctattgtgttggccttcgggatcggagtaatg

SEQ ID NO: 34255 - DNA, 3003 bp, Unknown
  misc_feature (1)..( 3003): 2750-1469P.txt file - cDNA_ID_3076178; gDNA_ID_1620771; Annot_ID_167555
tgatctcattccaaaagtaattccaaaagtagttgatgttatatccatagatataacactatcagataatgtgtcaagttggttggaggaatataaaaccgatcattagacttgtagattacaagagcataaaggcctaacctatataataagtaaacacaagaaaaagcttaaatctctcttccaaacagttgatttcctaaggatcattctgggtaccacgtcaatttttgtttgcctaaataaaagaagaaggaaaaatacaaaagagaaggataaaaggggataactataccgggatggttctaattagcttagtagctatgtgggtggtctgatccaccggaatcgagttcttaagtacacttgaagccatggcaaaccgacaaaatgatgatgagaatcaaagcgacaatgatgccaaagactatgagctttatcttcatgttttcgaaccacaactttcttttcatctttgttccttgtgttctaaaatcttgtgcctattaacaaacagaagaagaagagcatgttaccactagataatagtgatgtagtgtctcttatactgtatttgagatgtggttattattaacctgtgagcgaaggttctcagttttgtctactaatagctcgattttctctccacggtcaaggacctgccataggattgaattgcagaaaacacattcagcttacaggtgaggagttgtcgatgaaaaacatggataatttagtctaaccttctcaatattctccatcataacacccttcacttcagtcacctgagccttaactttggaaagtttgctaatctcctcaggatgatccgcacagtactgcatgtgctccttcaatttagacctacattcattacaacaaaaccatttaaaacacacatccacaaagatggaattgaaaagaaatgctctgactaaaaatgttaaaagtacccgaattctttgttcaagctgttggctttagcagtggaagcttttccaccaccgtatctcttgttgaaatcctccttgactctctccaagaaagccattggtatctgcctcccagcagattcaataacaacaacacaataggctgcataacaacagagggaaatgagaaatcttattgtcacattccaactaaagcaaattcgtgcattggacaaccaaagctttccaaacataaaaatcttcacaataaacattccaaagaagccatgcataaagctgattaaaatcagaacgaaaacaacagattgcatatccaatcaagacatggcattgattagaagaaaatctgaatataacacaatgccacaagaatcgagagcaacgaatatcctacgaaattcaaagctacactgttctcgaacatttgatttcgaaactaagcattcataagaaaacagatgaaccaaggcataaacagagaaatacagagcaaaatcgacacagatcgggagatagagacttactgaagccattatcagcgagataattgaaagtgtgaccgtcgcaattgtaggtaaatttgttgttcgaggacggaagtttctggagacactgagcggcgacggaggtgaaattgcccttgaactcggtatactcggcgaggatcaccgtaccgcgagcgacgaagctgtagatcaacgattgttgtcccattcttccttttatccagatgagagaaagataaaaaaacgaaacctaagaacaccacaaaaatccgatcgaattgatgagagagattagtaagcgatgtaaaaatacacaagggaacgaggggtagcgatggagaaagcaggacgcagagatcggagaagagaaactatatgagagcgctggatttgcgcgagtaacagagacattattttccctttggtaacgttcaaattttgaatttttaaatataaaaagtaaataaaaagaaaaattcatcatttgtatagtcgaaaattgccttaataaactttattttggtaaataattcacgtctaattaataatagtatcttcatgtttttacaccacggtggctcgtttttcaattcaaatgtgaaatgtttatcaatgagcattttaaaaaacaaatatatatatatatatatatattatatattgattttttataaagaaaattgcgatgtgtaagggatatttgagttgttaaattttctataaattatatgttatgttacttaaaagaacgttcaattgataatgttgcaaaccttcctaccaaaaaaattaaaataatgttgcaaaccttttctttcattccaattcactaaccttctattctaaccacaacctaactacctaaatttcaattatttgattgttgatcaaaatctttaggaacacgttaaacaaattaattagcaggttctaaacaatgcagagcaattgtagatgacaagagataacggtagaagttcgaattttgttgctgtaacaagatactatgactatgagctccccccgtccattaagaattaagaaatttggttaattacaacatttgtttttatgtttaagccttttgttcgtaactgagctaatactggaatcactgatcaatgatgaatttggaaaaaaagatattttgaggaagacagagacagactctcttcgaccatgggacctgaacttgtcctaaagttggtaattactaatttgtgccatcggcagagtccacgagctttttggctggatccgggcgggtccaactttctcgacatttgtttgatctctccgttttgaaattgtttttttttagtccttaaattcaaggttttatactatttttgacccaatctgactaccttaaatgacaactttacccttgcccgcttttcaactttttcttctcccatgtccactttagtcctcgttttgttctttcatagtcttctagatctgtagtttttttccgcgaccgcccaaaaaattctctgatcagacggtcgattggatcggagatttaaggtaaagaaaaaatg

SEQ ID NO: 34256 - DNA, 3003 bp, Unknown
  misc_feature (1)..( 3003): 2750-1469P.txt file - cDNA_ID_3076180; gDNA_ID_1620771; Annot_ID_167543
atccgatatcgaagatcagtgctcaggaagtggcagtatcactagtgatatcaaactagaaggtgctgtgaccagtgatatagaagcaagagatggttatgttgtgcgaggtttagttaaccttgggaacacatgtttctttaattcgataatgcagaatcttctttctttggatcggttacgcgatcacttcttgaaagagaatgggtctggggtcggtgggcctcttgcgtcttccctgaggaaattattcactgaaacgaaaccagaggcaggcttgaagagtgtgataaatcctagagccttttttgggtctttctgttctaaggcaccccagttccggggatatgaccagcatgatagccacgagttgctacgctgtttgctagattcgttgagcaccgaagaatcggccttgagaaagaagcgtggtgtttctgataatgatgagaaatctactactctcatagaatctgtatttggaggcgaaacgtcgagcattgttagttgtatggagtgcgggcattcctcaaaagtctatgaaccatttttggatctctccttacccgtaccattcaagaaaagccctcctaaaaaaccacaacctgtttctcgagcaaaaaaagctaagcttccacctaagagagtcccaaagaatgtgtcaaaagtaagtaaggtttcaaaagttctcccaggtatggttctttcggaactgaactcttccggaaaatctatggctgtcacagctgattcggatacatcctgttccagtttagcaccccttgataatggtccggttttagaaactccttcagttctaacccttgacaataatcaggcctcagaaagtgcatcacaaagtgatactggtttcgatggctcctggttggattttatcggaccagaaacctctggagatgagacgaatttggatatgcaagaagatggtattgataatgtcattacagctgaggttaatcaaattgttcccagtccaaatattgtggcgaatagctcagtttcatcgggtgatcagactttggaaggtaatacagagaggctgatgcaagattatgaagaaattgcaaaggcggaagccaatttggatgaaaaagatgtacaagctatgcagtctgatgaatgcccagctacaagtggtatttctgctgaattcagtcaagctagttgcattggttgtgatcctggtataggggaaagttcttcctcggtgaatccttgggacgaggaagagcttcctttggtggttgcagattcgcaaattttgtacatgccatacaaagaaatatcctgtaatgataaatcagttgaaggtgagtgtgaagcttcatcttcatttgttactggtgatcatgaaccacaaaacagtgattttgttgattttggcggtttatttgatgagcctgagactactgagggacctgtttttggacctccttccaaggctgaagcctcgggagttggttttatggcgttcagcagcgagtctgatcctgaagaaatcgatgattcggatttaccggtgtctgtagagaggtgtttgggtcatttcacaaaacatgagatactgtcagatgacaatgcttggaactgcgagaactgttcaaagaacctgaaactccaacggttgagagaaaagcgaaaatccaatgaagatgaatcgagatcaagcaacaccagcaacggatgggtgaaagaaaatgaagatgaaggttttggagaaaccgaaattttggctgttaaacaagatccaaatgatactagttgtgtcaaggatcatagctctgatggaagaaaagctgcgaggattcactcagctgatgaaagtgaatccaaaggaactcaagatgaagacgaagattctgagaaggtgattacagtgaagagagatgcaactaaaaaagtacttataaacaaagccccacctgtcctaaccattcatctaaaacgattcagccaagatttgcgtggtaggctaagtaaattaaatggtcatgttgctttcaaagaggtcatcgatcttcgacaatatatggactcaaggtatcatcatctctcatcttcttttatataaccacattttgatctgtcttatatcttaatctccatgaaagcgattcttcaatcttttggttcattcaggtgtagcggagaagacccgcccgtttacagactggctggattggtggagcattcagggacgatgagaggaggtcattatgtggcgtatgttagaggaggtcagcgggttaaagagactgattcctcctccactgcgtggtataacgtaagcgatgcatatgttcgtcaggtttcattggaaaaggttctgcattctgaagcgtatatcttgttctatgaacggatcttctcacaagaatgagaaattattttgtttccattacgaaaggaaagaagaaaaccagttttgatcttcttccttacaatagcttttgctgggaaagtttttgacgatcacattagatcaaataccattaattttgttttttcttattatattttggagtcatgaaatttcattatatgtatcatcagaaacatttctgaaagtatttgagcctctccaatgagttacattcttttatacagaaaaagagttggttctagattcgcagaatttgaagcttcttgcaatggagagatatcgacagagtaccgggcgggtatttgtttttaaagcgggtcgaaacaatatggatcgtccgattcaaactggtgtgatcttaacggaagctccgtttaccaaaccgttacttacgtgcctaatctaaaccgattaaatcaatttatatcaatgtcagaaccggaaacaactgaaccggtactgaaaacgattgaaccgaccctatgtcttccttcctctctacccaagcaacgaacggacttccccattaaagggaaagaaagacaatcgagtctcgagtctgtgaaaccaagtctcgcgagtgggagattgtagccatg

SEQ ID NO: 34257 - DNA, 3003 bp, Unknown
  misc_feature (1)..( 3003): 2750-1469P.txt file - cDNA_ID_3076184; gDNA_ID_1620771; Annot_ID_167542
acccattggtctctctgtctttcttgtggtattaatagtttgaattgttgtttctgtaatgtgatgaagactgttttagacgtgggcaccgggagtggaattcttgcaatttggtcagctcaagctggtgccaggaaggtttatgccgttgaagctactaagatggctgatcatgctcgtgcccttgtcaaagccaataaccttgaccatattgtagaagtcattgaaggatctgtcgaggatatttcattgcctgagaaaggtattattcactttcccttttcttctctttcactgcgattagaaaagagtagtaatcagggtttaacttagtggctattgattgagacattgcaatttggttgagttgaacatgtttcttttgataatttttactctactcgacattgcgctaatatctacatattcaatttaatgggcagttgatgtaattatctcggagtggatgggatacttccttctgcgggagtccatgtttgattctgtgattagtgctcgtgaccgatggttaaagccaacaggtgtcatgtaagtggattttctgttattttatttctattctttgttgtaacattaaaatttcatgatgcatgattgttacttatgagcctatggcacttgagagcttgatgctgtgtagctatactgttaatatcttgatagcataatcttttcctccagtgccagttatagaatttcttatcaaattccatgcataaattttgatatcatgtggcacatgttactaatattgaaaacaattgggtaaagatttggttgatgttggcactgtgtgtatctaagcattacaaataacctttgtatacaataggtaccctagtcatgctcgcatgtggcttgcacccatcaagtccaatatagcagatcggaagaggaatgatttcgatggggcaatggcagactggcataacttttcggatgagatcaaaagttactatggggttgatatgggagttttaacaaaaccttttgctgaagagcaagaaaagtattacatacaggtgatttcagaactctttttttctgcaatttaatttatctttagataagttcctcagctgacagttgaacaattaacaaattgacttacagaccttttgctctgacatttcatggaactcataaaattttgtcttttgtgcacagactgctatgtggaatgacttgaatccacaacaaatcataggcactcccacaattgtcaaggagatggattgtttgacagcatctgtcagtgaaatcgaggaagtcagatcaaatgtaacgtcagttatcaatatggagcatacaaggctatgtggttttggtggatggttcgatgttcagttctcggttagttcgtacagattactgtgttgcatcatgttgaagaaactcgtatacttactcgttgcttgtttgtttttgtaactaggggagaaaagaagaccccgcacagcaagaaatcgagttgaccacagctccaagtgagcagcactgcacgcactggggacaacaggtatattactccccaatctctggcctatgatggttaaggcttcgattgtttcaaacgctaatttccgcgtaatggtctgaaactggcaggttttcattatgtcgaatcctataaatgttgaggaaggtgataatctgaatcttggtttgttaatgagccggtccaaggaaaatcaccgactaatggagattgagcttaactgtgaaataaaagaagcatctggtaaccccaaagaatctttcaagaagacttacttcatagagtgattgattgattatagagaagctttccttggggcttgctggttcttgtatcccatgtatgaaccccaaatgtaatgttttattgcttcttgccttttttttctatgtaaacgagattgttataccaattttcaatagatttttatatgggtgatataatttattatttttggtatttgattaaacatccaaaaatttcttcggtattaattttgaagagattttttttctgtgaagattgtttaacttttttgaacatttttcagtggtttagaatatttgttaaagtctaaaaaaacatttttttggtttaattaatatcgaactaaatgtttaaagatttgttttggagtaattattaatatttacgaaccaaatatttggtcgatagagttgtgttgggagagcctatgtcactaacccctttgtctgcccctctttcggagcgattcttttctcattctttcgtcggactctctgtctccttttgacggcggcaccaacgacaaagcaagcaagcagtgataacatctatctatctctccgtctaaaccaattgattaggctagatcccaattcttcgagtatcgattcttcttcaatcctttttatgtgaatattctcctaaagcagcaacctcttgggttcttcttcttctgggtaaaattctctggattctgcttttgctttgatacgattgttttgagctacttgttttttttggttcctgattgcgttaagggtcaggaggcttagtagaactaagatatgaaatcttaatctgagttatttcgatgcatagactttggattctggatctttgagtactagtcattaaaaagtcggataatttctctgtagggtacttcttagaatactgatttgatttgattttatggttaattctcagttcgtgataattcttaagacttttttagtggtatgtcttagaatcatggaattgaaatgggcaggttcgatttttgaaggtggatattgattttgaatccatatatgcgttgatggatgtggattagtttcttgttgtctttatctgtgcattggtgatagttccaaagtttatctgttggtatacacttcgttgctttgctcagttgtatttgattatgtagatgcagtaacaactttagtaacccactctcctttttctggctttgaattttattatagtaactgatg

SEQ ID NO: 34258 - DNA, 3003 bp, Unknown
  misc_feature (1)..( 3003): 2750-1469P.txt file - cDNA_ID_3076196; gDNA_ID_1620771; Annot_ID_167534
ttccttagtaggaggaaccgagggatcttctcctaaagcggttccaactatctggtctgaagtgagttttcctaggcagcttcattaacttctttcgaggtttgtattttagattgtgtttgatgtttcgttgcgtatatttggcaggttatgaggttttttacaaatcctcacaaacctatgatcttggcattatctagaccagacccaaagaagaacataaccactcttctgaaagcctttggcgaatgtcggcctctacgggagctagctaatctcgtaactgttaaatagctgtatttattccagagcatgaaaccaagaatcctctgtttctgaaattctttttcctgtgtgtttgcagactttgattatgggaaatcgagatgatatagatgagttgtcatctggaaacgctagcgttcttacaaccgtcttgaaactcatcgacaaatatgatctttacgggtctgtcgcatatccaaagcatcataaacagtctgatgttcctgatatataccgacttgctgcaaatacaaagggtgttttcataaatccagctttggttgagccttttggccttacactcattgaggtaaagtatgcatatgtgatatatatatatatagtccttcttactcgtttccaatcctgtttaacctaaatagtatccagaaatctattcacaaaccaaactagacaagaaattaatcaatctggtttaaccaaaattaaaaatgcaggctgcagctcacggacttccgatggtagcaacaaagaatggaggaccagttgatattcatagggttagcaacgtgtcctgaaactgaaaatcatttaaattggtaatgcttatttctttctcatggtatttaacttcaggcattgcacaacggtttgcttgtggatccacacgatcaagaagcgatagcgaatgcgttgttgaagctggtatctgagaagaatttatggcatgagtgcaggattaacggttggaagaacattcacctcttctcatggcctgagcattgccggacttaccttacacgtatagccgcgtgccgtatgagacatccgcagtggcagacagatgcggacgaagtggctgctcaagacgatgaattttcactcaacgactctcttaaagacgttcaagacatgtctctgagactctctatggatggagataaaccatcgttgaacgggtctcttgaaccgaattctgctgatccggttaaacaaatcatgagccggatgaggacacctgaaatcaagagtaaaccagaattacaggggaagaaacaaagtgataacttgggtagcaagtatccggttttgaggcgacgggaacggttggtggttttagcggttgattgctatgacaatgagggagctccggatgagaaagcaatggttccgatgattcagaatatcatcaaagccgtgcgatcggatccacagatggctaaaaactctggttttgcgatttccacttctatgccgcttgatgaattaactcgcttcttgaagtctgccaagattcaggtgagtgagttcgacacattaatatgcagcagcgggagcgaagtgtattatccaggaggggaagagggaaagcttcttccggatcctgactattcctcgcatatcgattaccgatggggcatggaagggcttaagaacacggtgtggaaactgatgaacactactgctgttggtggtgaggcaagaaacaagggctctccaagtcttattcaagaggatcaggcatctagcaattcccattgcgttgcatatatgatcaaagatcgttccaaggtaaagtttgattttcaacaactgtaccaatcattaatgcagactgcagagtatctaatcagggtttctacaggtgatgagagtagatgacttacgtcagaagttacgactaagaggccttcgttgccatccaatgtattgtcggaattcaacgagaatgcagatcgttcctcttcttgcttctcgatctcaagctctcaggtacgttaactaaaccacattttgctacggaaatgctacaaaacaaaattatatttttgaacatgtttgtttccttattatcgcgatttaattgttgcggtgaaggtacttgttcgtgcggtggaggctaaatgtggcgaacatgtacgtggtggttggagatcgtggcgatacggactatgaggaattgatatccggcacacacaagactgttatcgtcaaggggctcgtcacattgggttctgatgctcttctccggtcaacagacctccgagacgacatcgttccatcagagagtccttttatcggttttctcaaggttgattcaccggttaaggagataaccgacatttttaagcagctctcgaaagccactgcttgattccactaatatccaattctcccggttcaaccatgtagattaatttgtttatttattttctacttgttttgggacttttaagttttggtattttggccgatcgaacattaggatttaacaggcttctatacataaaataaaattttcaaatagtgaagtcgaggctattatattttttttgtaaaaattatgcaacttgtgttcccatccgagaatggttggggaaaaaaagaagataagcctaattcaaaaaacaaattgtaaaatttgaaaaatcttaactgtaaaatggcgcctataatatgggaaatatggatcacataaaataattagattttaatgttcgttcttttaaatgcaggtttaataatcaaccggtcggtttgattgcaagacccgacgccggtttgttgctggtgtgactcgcgcggctgcgacggtgattcgaagcagctataattaattaccttaattaacgaaaattcagaaatctacatctcgccagtgagaaagactccaaggagagagagctcatacagagtattagaaattctcaaatcactagagaagatctcgtcttcttcctgattttaaacgcgatg

SEQ ID NO: 34259 - DNA, 3003 bp, Unknown
  misc_feature (1)..( 3003): 2750-1469P.txt file - cDNA_ID_3076203; gDNA_ID_1620771; Annot_ID_167526
tttgatcatcgtttataactctcattgtgatttcagcaaatttttgtagcatttcggaattttgatctcttgatgagttttatttacgttttctgtttgctttttttatctagtgatcaagttttgagatttatgttgttgttgttatgatgatcttgtagatgcctttaggaagatgaaagtaaatgagaccggcgtggaggaactgaatccgtatccagatcgtcccggtgaaagagattgccaattctatttaagaactggtctctgtggctatggaagcagttgccgttacaatcatcctactcatcttccacaggtcagaaactaaacttcatttattttggctgagtcttacttaagttgcaattttggcctcatgggtttactgcttttaaacatcttaataggatgttgcttattacaaggaggagctccctgagagaattggacagccggattgtgaggtgcagtttcttgtatctctcactatctcaaatcttggttgttgtttggatgagtacattgtaaacagttaaaaagaaaacgagatttttgttcagaataaagctaaagtaagagaactgattctagtttgtaacttcacataagagaggtagcaagaatatacattgaaactgcagaagatattcctcatctggtttagtctttcctccaaatgttttccacaaacaactttttcttctacatgcaattttcgctgcagtattttctgaagacaggagcttgtaagtacggcccaacttgtaaatatcatcatccaaaggacaggaacggtgcacaacctgtaatgttcaatgttatcggtttacctatgcgtctggtaatttccatcgttgtagctaaattctttttctttagtcgaatgtggaagacttatttgaatttcttctccagggtgagaagccatgtccatattacctgcgaacgggaacttgcagattcggagttgcttgcaaattccaccatcctcaacctgataatggacattctactgcatatggaatgtctagctttcctgctgcagatttacgatatgctagtggtttaacaatgatgtctacatatggaactttgcctcgtccgcaagttccccagtcctatgtgccaatcctggtttcaccctctcaaggctttttacctcctcaaggctgggccccttacatggttagtctgaattgaagctgccaataacgtaaacctgttctttactgttgatatcacattttatgttgcaggctgcatctaactccatgtacaatgtgaagaatcaaccttattactccggtagtagtgcatccatggccatggctgtggcattgaaccgtggtttgtcagaaagttctgaccaaccagaatgtcggttttttatgaacaccgggacatgtaaatacggagacgattgcaaatacagccatcccggagtaaggatttcacaaccaccaccaagtcttataaacccttttgttcttccagcgagacctgtaagtctcttactaaactgaaagaagagctttggttacaaacaaatgtggtcttacaggtcactagtaaaacttttacaaagattttgaacatctaatgagctactgttttgatttttgctgtctagggacaaccagcttgtggtaacttcaggtcttatggattctgcaagtttggaccaaactgcaaattcgaccaccctatgctgccatatccgggcctgaccatggctacttctctgcctactccttttgcttcacctgttacaacccatcagaggatctcaccaacaccaaaccgctctgattcaaagtctctttctaatggtaaacctgatgtgaagaaagaaagctcagagactgagaaaccagacaatggagaagtgcaggatttgtctgaggatgcgtcatcaccatgatcatgattcttaaaaaccccaatgatctctctctgcccttttttgtggaagaggaggggaggtgaaaagtgtttctcttttctttttttttttggcttggagatggccatggctgaaaacaatataggatgaaaccagtgatgttgtcacaggtttctcttctgtttttgactctgttaataaattttaatcagacttatcagaggaaaaatagagtttgtgttgtgacactcactaagagctctttatgaatgacaactcgaacgtaaaattacatcttttgcttttgtcaagtgtttacatcagtaatatccccaatttcaagcttatttttttttttcaattttaaaactaaaaaggttccaaattttttttatcgatgagtcatatttcatttgaacattccaaaagtaaagaaaagagttgaaaactttcctcagcctattacaattgcctttagctgttaatgagttttagagattcgattagttttaaccaacagttcctgaataattggattttactctcttgttgagtttaattattccaatatttcttcatggtgctgttttgctattgctggtgataaacagttgatctaccgacgatttgcattcgacggtggtttcttcaccagaaatcgatatctccgatggcgaaggatgacgatgggaatcttttttggctcatcttacacgtgtattattacgtgtctttggatgatctttcttgatgcaatcttcttctgtaaacggtgtattattgggctcttcttgagcttgcttttgttcgcaatctgtttatgtgtgttgggctgtaattggccttgtagcaaacggtttattgaataaagtccactattgagaaaaaaaaaaaaaaaaactgaaaagggttgtttttaggcattttttgtcggagaaaaatctgggaagaagcttcgtcctttgcgtgacagggaatctctccgttggggttttgtggctgcctacgatttctgcaagcaaaaccacagaactcaatctaattaattagccgagtcgactcaatccgagtttctacagccgcacgagggaatcatg

SEQ ID NO: 34260 - DNA, 3003 bp, Unknown; identical to SEQ ID NO: 20686
  misc_feature (1)..( 3003): 2750-1469P.txt file - cDNA_ID_3076244; gDNA_ID_1620773; Annot_ID_167586

SEQ ID NO: 34261 - DNA, 3003 bp, Unknown; identical to SEQ ID NO: 20686
  misc_feature (1)..( 3003): 2750-1469P.txt file - cDNA_ID_3076244; gDNA_ID_2926216; Annot_ID_202997

SEQ ID NO: 34262 - DNA, 3003 bp, Unknown; identical to SEQ ID NO: 20927
  misc_feature (1)..( 3003): 2750-1469P.txt file - cDNA_ID_3076247; gDNA_ID_1620773; Annot_ID_167577

SEQ ID NO: 34263 - DNA, 3003 bp, Unknown; identical to SEQ ID NO: 20927
  misc_feature (1)..( 3003): 2750-1469P.txt file - cDNA_ID_3076247; gDNA_ID_2926216; Annot_ID_202988

SEQ ID NO: 34264 - DNA, 3000 bp, Unknown; identical to SEQ ID NO: 6090
  misc_feature (1)..( 3000): 2750-1469P.txt file - cDNA_ID_3076251; gDNA_ID_1620844; Annot_ID_170136

SEQ ID NO: 34265 - DNA, 3003 bp, Unknown; identical to SEQ ID NO: 20924
  misc_feature (1)..( 3003): 2750-1469P.txt file - cDNA_ID_3076251; gDNA_ID_1620773; Annot_ID_167576

SEQ ID NO: 34266 - DNA, 3003 bp, Unknown; identical to SEQ ID NO: 20924
  misc_feature (1)..( 3003): 2750-1469P.txt file - cDNA_ID_3076251; gDNA_ID_2926216; Annot_ID_202987

SEQ ID NO: 34267 - DNA, 3000 bp, Unknown; identical to SEQ ID NO: 20688
  misc_feature (1)..( 3000): 2750-1469P.txt file - cDNA_ID_3076288; gDNA_ID_1620774; Annot_ID_167633

SEQ ID NO: 34268 - DNA, 3003 bp, Unknown
  misc_feature (1)..( 3003): 2750-1469P.txt file - cDNA_ID_3076311; gDNA_ID_1620775; Annot_ID_167680
gtgaaccttgtattggtatacaaagatgtgaagagaggaggcacagaggcattgtgaacagtaacagtctctgtgaaattggaaagaaagtaagaaatcgcataaggcatctcgtcggatcctatgaatttacccgaaattccggatttccagtatctcattgatcttttccaaatgatgaactgtttgtcttcttcttgatccatctgaaaggtgaaatttccatgtgatggatcgttgaagcttctccatgatgataaagtcatattctcatccatcctcatccctgggagaaatgtatcagtaggattctgaaaactctgccaaaccacatttgcttcatttccatcactaatcaacacaagattaccattatccatcagctttaccattctctccgcagatactgaggaaggtttaacaccggtgtcccaatacactcttccctttgaatcaataacttcaagattcccatctttagagatggtgaaaatgcaggaacggtcaagaaccggagattcacgatttgcaacccagacaacagtcagtggatgtaaattgtaaaaccaaatccctaagtaccttctttcgtcggagcttccattaggagtgaagaagccaagctcaaatctctgaccagctgaaacaagagtctctccatggctgtcattgatcaatgttgaacctttgaacaatgttttggagtcttgaactgcaacaaaacaatctaatcgacgaatatgcagcaaaaacatatagaagaagacagaaagaatcattctctgaccagtactagcttttttttactcatctgatatctccattatttctgcttaagaactcaactcaaaacgtgtctaacgaaaaaagaaaaagtttgcctcaacgtcaacgaaagacccacctgaaaagtaaatatgtggaacgcagctaatcatgtgttttaagatgtttccaagaaaaagcagaacaagtctcacttgagcatctgaaccaaaagccatgaaagtagtagatactatttacactctcttagccactgtatgtagatacacatgtgaccaattcacgcactttgtgtcaactttttccgcgatggatctctaaatagttcaaaaagatccaacattttttgaataatacgtacttttagagtattttttgacaatgagagagacataggggtacctaaacgtgaattactggaaaaaggggacaatgatgttgaagaagtcaatcttttgtccttattggtgctttcgaagaagtggagattgaccctgcaaacattgttaaccaacttttttccgaaattattgtgagattcgaggagttttgacaaatgtaggacttttgtcgttcaaaagaaatgttttcatctaaaacgcgtaaacctgtaaaaggcagcttcagctctgattaaacaaagagacttgcaacaatgtcactatgagacattactgtttaaaaatagattcagaaacactaatcagttttcacactaaaacaactttgtcttctgccttgtttgtttattcctctggatgtttcatagatatacctttaacagggtatagcagtttcaagttcatagatgaaaccctttcgctcacaaatattgttttaaagccttctttatgagagttggattggttcaccacatagattctctaactcctcttccaggagtttatgcaactttgcttcagttcgccgatatatccacgcattagcatcacggtcccagtcaaatctagaagggccactgcaccgagacaaaaggaagaatgaagattacattaatgtgaatctaagatgtggaagcacaaagtcaagagcaacaacactatacagtcataaacagtttcatttctccaaatatcatgagtacaaaaatcagaagagagagcagaacatgataatccagatgcgaaattcaatctaggcgcctaaagttagcaactttcaaaaggcaagaaagaatctttacctcacaggtgaagacatccagatttgtcgatttggagtttgcttattcagtacataagtgcctaaagatccaagcttaagggtaagaacttcattctgttggaaacagccaaaaggactgactataataagtacacatagatttccagaaatatgaacaagatcttaaattgcttaaaagagtttaatccttaccccataatctatgtcgaaaccatcaatctgaacattatcaccataatcctgaacatgaatcatgcaagtagaacatagtgtaagctattgcaatctcaagtaaaacgaagaaccctagagagaaaaaggttccagcttcaaatacctcaattttctcaagaaggtgattaattgtgaagttggctaatttgtgaaactcttcctcctgcaaaaccgaactgtttttttcttccactttgttcatattctcatgaaattaacgattcagatacaataaaggagatcaaaatggagaatattaaagtacctgtaatcgacagaagcaggaccttgagaagagaagcttctggtagtcaaagaatcatggcggattcgagatcctattctccagaaggaatccaacggttctatggaatcttgaatcagattgcttgaaactcttacgccattgctacggagaagagttggagacagcttgagaaacctcggcaatttccgtagaagaaaccttgaagctgtagccatggcggttctgtcacaagaaacattcgacgcctctcttcttcttattccttcgttgtccaatttaggcccacaataaggcccaaatttagatttacccggttcacgtatttcccatgttccggtttactgaaaccggtatggttctcaagagatttgtcatttgtgtgcgaagaagagttttcttctcctctcataagaaaaaaccagaattttgaagaaggagaaagaaaaaaatctgggtttttgggagctgattaggttttgttccttcaatctctgggaattttcgctatg

SEQ ID NO: 34269 - DNA, 3003 bp, Unknown; identical to SEQ ID NO: 34268
  misc_feature (1)..( 3003): 2750-1469P.txt file - cDNA_ID_3076311; gDNA_ID_2926205; Annot_ID_202139

SEQ ID NO: 34270 - DNA, 3000 bp, Unknown; identical to SEQ ID NO: 5257
  misc_feature (1)..( 3000): 2750-1469P.txt file - cDNA_ID_3076317; gDNA_ID_1620775; Annot_ID_167678

SEQ ID NO: 34271 - DNA, 3000 bp, Unknown; identical to SEQ ID NO: 5257
  misc_feature (1)..( 3000): 2750-1469P.txt file - cDNA_ID_3076317; gDNA_ID_2926205; Annot_ID_202137

SEQ ID NO: 34272 - DNA, 3003 bp, Unknown
  misc_feature (1)..( 3003): 2750-1469P.txt file - cDNA_ID_3076323; gDNA_ID_1620775; Annot_ID_167674
cttcaagtttggagatctgctcacaagacgctctaaatccgagattttaacctcagaatctaaacaagagaagtcaagagagaccaaagaagttgaactctctggaaaatagctaagccaatctcctcctaaatcttcaacaatacactctcgtagttccaacactctcaagttcctatattgaaaatcagacaacaacaaaaaacaaaccaaagctacttactactatgagatataacttgcagccaaagaaaagattgtttttgtatttggttggaaccgaacctgcaagtagctgcaatagcagcgataccatcagtagagaaaccttcacaagaagtcaacacaaggactttaaaatccttaaacgaagcagcaattttctctaagcactcatcagtcaccaccatcctcttcattctgatctcttcaagagacgaacttttcgccgccatagcttcaatccacggccaagcataaccaccccaaccatcaggaacgagattatagtcagcgaagtgtggcttccccttcaaagtcaaagatctcatctccgggaaccgtcgtgtaaccgcagcaggactgaccgcgtaacagtttccgacaaagactcgcttcctagtcttccgttctgtctcaaaccatgacttgcagaccagagaaacagagttccggtcctcgttggaatcaatgaaggagaggatatgttccaacaccttaggtgggaatcggagacccatcagaaacagagtgagagagagagaggggggaagaaatgaagaaaaaggtttgagattttgattcgatatgagtgtgatctaaatcgaaagattgaagcttttgatatatataaacagagcaagtggaagacaagaaagagtatgacaagacaagagaatcgaaggagacagtgtccatgtgagaccattaataaagttgagcttgcacccatgtgagcctactgtgtatagctcactaatataattagtttccttaatcataattagtttactctgtgatccatcacatgtaagtctgtgtgagaactcgtggatctaatcatttatggtattacccagttcacacatgatgtcagattcgttaattagtattttacttatgcttcagtttcaaagtaaaaatatattttatctttggtaccaaatatcaattcatattgttaccaatcaaatgttacaactgaatctcttcaaacaatcaacgtttttggacgtgaaaaacatttttatgattaaagcttcgaatggcaactcattatcaaaacggtacagtttatacagttttgacaattatcatttacaaaaagaatttcaaaaacgttacaatttttttttattttcaatttttttatacagtttttttttacagttttgcattattctataacagtttaccgcgtcagttaacaacttatcgctctagctaacagctaaagttttgttaccaatcagactcttaaatcttaagaaatggagtaatccatctcagtgcataagtgtcacaaaatgatcgagactcgttggttacaaactctttatcacatttgaagaagcttaacttaagttgttttgattttcgagaaaccgatagagtaacaaagaagttaacatcccaattaattatgttcctaagctttattttcttagtgtcggattggttagattttctcatagacgctattccgctaaaaaactatgactctacacaattacacaagatgtgggttagtaaaaatttgaagtctgaaaaaaaaacagaaaattcagattcaagagccatcttcttgtcttatctacacgtgtcacatactgaactcctccaacaagagaaagatgtgtccgaagctccctcgctcgaatggcgaatcctctacaccttgagttcgtttagccaatctcaacaaacgctaaagaacgacgtcgttttgttgatcgtaattctaaaaaatcaatcagcaatgctgatgaaaagtcttcacttgttgtcttcctcaatcctcctccaccgctttgcttctcgcagcattgcatctttgtctactctacccagaagaagaaatatcgtccgtatacataacccttcgttttctagccctttcccgccgattctctctagacccatttcctcaggcaaggtcttagccatggcggaagagtcttcttcttcttcgacctcgtcaacatctcagaaacataccaaccgtttagccgctgaacacagtccttatcttcttcaacacgcgcataatccggtgattactctcttttataaaagtattcgtctttagataaaattgataagagaagaacacctctcgtttcaattagggagctttcttgcaatttgctaagtcacaactggtttagattgtagctaaccggttcttagtctaaaagtttggaactttttttattttttagattgatttcatggtttatgtcaaaaaggttgattggtacccatggggagaagaagcttttgaagaagcaaggaagagagacgtgcccatcttcttatcaagttgtttactttatcctcttttgatcgttttaattactgcttgattagattccattaatgacttttagtttgtgaaactaatttggttccttttgttttcaaaatctcttttatatggaatcttgaagttggatacagtacctgtcactggtgagactttcaattgttttcttggatttgagtttgacttcttctttttactgaattggaggattaagagaatgaatgacagattcaaagactctggatctgttagtatcattactcttctctcctcataggtgtaactctaatgaaggatttaaggattttataaattgaaagtggaaagaagtcttatagcctaagaactaagtgttattgtttgaaatgttaggagtagagaagcagataatcttatattcctattttgaaatgtatgtttaagtaacagttaactcttttgtcaggtgccatgtcatg

SEQ ID NO: 34273 - DNA, 3003 bp, Unknown; identical to SEQ ID NO: 34272
  misc_feature (1)..( 3003): 2750-1469P.txt file - cDNA_ID_3076323; gDNA_ID_2926205; Annot_ID_202133

SEQ ID NO: 34274 - DNA, 3000 bp, Unknown
  misc_feature (1)..( 3000): 2750-1469P.txt file - cDNA_ID_3076331; gDNA_ID_1620775; Annot_ID_167664
ttgtgcctaaacatccaaatagtgagaaaatcaacatgtttctcgagcttataactcttcacgaaattcttccatcccgacgtcaaaacaggtgtgcccttaatccatatcttcaacaccatcttatgattctctccgtttggtccatacaccgaaacattaagccctttagtcccaagtttctctgtttttcccagagcatccatcatctttttcaccggctccttccctaacatgagcctgtattggttgtccttcacgtcgctatccatcaactgctttcacattggtttgctgcaagctcccatagcatctggatcacggacaatacttctcggaggattacttttcggcctagtgtctcccaaccgcgcatgcactctagggtttcttcggaattgtctacctcagcgacttttctcttcttacccttattttcatttgtttgcatacacgattttacttccaaatcatcctcacatacggattcttcatcatattcttcttcttcgtcttcttcttcttcttcttgatcaaagaaaacagggtttggtagtcgtaacaatactgacacagcctcaagttcgtctggagttacatcatccatctcctcaatctcttgttcgttagatcatgtacataggtgatatttatagaatatcacaagtccaaaaattatttttatattgataaaataattagaatgaccttgatcaatatcagtccagtgatgtttttgatataagtatcatctgacgtgacatcctcagattggtcgcatttgcgaaaagaaagaaaaatatatatatatatatatatattaaacaaacattataaataatattaaaattttcttaatgacttttatgaatatcacctatgaaagaagaaactgtttattttccttgatatagtttagtttttccattcttcaaacggttgcatagtttagttttttcattttatttttttcatcaatagtttagtttttccatgtatatctcaattatgaattaattcaatatatagtccaagtactaagactatgtccatcagtgtttctaatgggcttcttatctgaaatcctaaagaataaaagcccaaaattaaagaaaaacccaacaaaattattaggatcgatcctaattttaggttttttagaagtgtttagaaactcaaacgtggttgcttctaaggatgaaaatttaggcaaaacaaaaaaaaatcatgctccgcgtgtttttctttcctcttctcctatctcttttctttggttactctaacgacgaaatcaggcgatttgaatcgatttgataagaaactatggtgtatcgatcatgaaattgggagacagtctctttgctccaatctctttctcatggtaagaatctctctgtattcatgtgaggattatttgatgatggtttcgagtcatctaatcagcaatttagggttaatatatgtggttatatgcttgaaatttcactcgattacaagtctgttttgatctgagacttgttctactatgtgttcaagtttgactctgaaattttgttccggaatgaatcttaagtatacaattttgttttagttgctaaggtttgatgatgaggatgtggaagagagctatgtaaggtctgagggaaagatatgacgatgttgaatcacatgtatatttctcctacattttatcatcaaacttgctactcttttccttcgatttcgttaagctaaattttgttctgttttacagcttggcaatggaggagatggtgtgtttaatggaccagatgaggctcctatgtcgtcacttaacgatcacgtgcctgagttaatggagaaaggtgggtttgatgagattgttgataaagagattttgaatgatttgggtggggatgatgatttggttctgagacggtcacatgttaaagtgttctgaaaccctcttaattagttttatttttcttgttagttaatgtattcttgaaagaatgataacctctgagaagttttagtgatgtctcactgtgtttgagttcttttataatgtgatcaatgtaacattgctttaagattttctatgtggaaatgatgccttaagctcaccattgtagtgtacattcctttgaagcttccttataagaatgtgtgatggaatcgagaactcgagactgtctttctctgatttttttttgctctcacttgttcttgtgcatgagttccctattacttttggcgaaatataaccattgtagttcaatctgtacctaagaggacgacactttgaattgatgttttatgatgttttgcttgacgataatagtgtcacttcaaatgcaggacttggcacgaaatagtaaagttagtacacatatgttttcaagcatctgtggtagtagtgaagacagttgcagcaacaacaaccatgaagaggaagatggaagaaacttaatgaaagaacagaacaacacagagaataagaacgatagctgaggaagatggtcagattctagctaagacagaaagtctctctttcttggaaacatctgctcttgaagccaccaatgtcgagaaagcattttaaactgttttagcaaagatttaccacatcatcagcaaaaaaagctttggctgctgaagctttgataatttttatttgtaagaattattaagttatatcaaattataattatatcaaaaatatttttttatttttaaaaaaactcatttaaagattctaccattggacattaaaaactgtaaggattcatcaacaatcctaaactataaaattatcaaaatttagtattataaaatgttaaggattccttttaagaaactaaccaatggacatgctctaacacaccacctttaaaccataaagagagagaggccaaagagagaaaagaggattgatacgtcacccttgaaatctctatttgcattaattaaactgtcaaaaatcttgaagtaggtgcaaaattacaagtgaagacgatg

SEQ ID NO: 34275 - DNA, 3000 bp, Unknown; identical to SEQ ID NO: 34274
  misc_feature (1)..( 3000): 2750-1469P.txt file - cDNA_ID_3076331; gDNA_ID_2926205; Annot_ID_202124

SEQ ID NO: 34276 - DNA, 3003 bp, Unknown; identical to SEQ ID NO: 20919
  misc_feature (1)..( 3003): 2750-1469P.txt file - cDNA_ID_3076358; gDNA_ID_1620775; Annot_ID_167708

SEQ ID NO: 34277 - DNA, 3003 bp, Unknown
  misc_feature (1)..( 3003): 2750-1469P.txt file - cDNA_ID_3076379; gDNA_ID_1620775; Annot_ID_167691
ttagttgcatatggtgccttgttgacagcttggtgttcgtaatggcagggatctatcgtctgattcatgtaatctgtgccacattcaattggccggttttgagatccttgttttactactctttcgttgttttgaaagaattatttcttttttattgtaagctaagaatttgcgaattttgcttgggcatgtgtagttttgtcataatggtttcttcgtttaaataatagttttttttttaatatgtatttatttcttgttagagcatctccaatgcagggctctcttgataatttgagagagttttgttgattttattgattaaaaaataatcaaaactagtcaaatttgagagaaacgactctctaaagagaggttttgggagctgagagagccggacacgtggcactacgtgataggttgattgtttttaacaaaaaggaaaaaaagatcctttttttctttgctcaggacatctcgttcccgatttcgacaaaaagctctatctctcctgaatttttccggtttcgttcagtgtggtgagttaaatcgtctgaaatgtggtgtatgtgattgtaaacgaatttttttaaagattgattgatttatggttgatagtttcggaaattttgttgaatctagtgaatcgatctatttactgtgatgtttgtttctgatgagatcgtttgctgtacttgggaatacagattacagaggaagaaattctcaaggtttctttgatatggagatgaacacttacatgtgctatgatctcttgtacaatgccacttgactgatttgctttgtttggctgattactttgcttggtcttgtatagttgatgtttatgggctatttcagcacttcttagtttatcttgtctcagattttgtgatttttttaatgtcataaattaagaaactttaatggctaatttatttcagattaggagatttcatccataaatggaaaaaccaatttcagtgtttatgttttgagctctcgaatgatcataatcttttgctgcatcagataatgtgattcttgagatgttactggcctttgactgtttgttttcatgaaaactgttttcttttccttgtgtgtgttgtttatgagacttccttgatggtgttttaggctactggtagctcggttgatcacatgacttgctttggagatgcagtggtggagagggatttttatccggagatgattcagtgagaatgtcggtgttgatgccggaattatgattttctccagaggatgctgataggcttgtggcttcgtttagtggtggatggcaaatgagaatgtcacttggaaagaaattgcttcaggtatatgagtaatctgattccttaaagttttatcttttcattgattttgaactgaaagctaatgtgaattgtgtatggctcttatctaggagtacatggcagtgacaacttgaaagatgatcaattattcttcatgtctctcattctttctcaatttatggtaacttatctttgatcattcaatttacaacatctatgtttgattctataattctatttcttccacttttgcctgtaagtcttttttttttttttggtaagccaagggagacaatgtctcccaagattaattaatgaaaaataaaattacattcgcacttaacgtgaaaccgtagctccactagtgtaatccaacaaaataaagcgtaaagaatctggaaccaaactaagcaaatgaaaacctaatggtaacgaaaaggcatagttggctaacccgtcagcaagacggttagcttccctataaacgtgtgaaatacggactctccagtcccttgatatgaagccatggcacaatcgtaccaggaaagacagcggatgtacctcgtttatccctgtcttcaacaaacccacaacaatctctgagtccacctcaatctctagccgtgtgactcgtcgctcccaagcaatgtagaggccatagtacactccccatagctctgccaaaggtgctgaacaaactccaatgttcagagcaaaacctcctctccaagctccttcctcatctcgtagcacaccaccagcagacgctaaacccggattacctctggaagccccatccgtattaagtttccaccaaccttcctcgggtttcgacctgtaagtcttttaatcaaagacacaaacaacatttattcttgttttacaaagatacaaacacacttctaatttttattttttttccaaagaaccccatttgagagaaactaccattgtactatcattttcttctaaaaataaatacaagctctcttcttacaaattttcacaatttatattaaacaatgggagagagccccatgagggactctcaccattggagatgctctaagagagtcattggtgcatagagttaactctacaactatttccatcttattttggtttttgtaaatctattttcatcttgttatcggtttaatgtgaaacccgaatgttgtacgatttaggctttgtgtaaaaagaaattttcacggaagtggacgaaaaaaattttgctctcaccgtttgtcaaagtgagaactggttttcacggtttgtcttttcattcaattttggaccaaattaccctgagaaaacttaataatggcacaaaccaaaccgtgcagcagttcgtatcggttaagttgatggcataaaccaaaccctacagcagttcgtttcggtttagtttatgcggttcagttttgaaaaagacaaaaaaaaaactgaaacgaagaaaccgaagaaaaagaaaaagagaagagagtaacagagagattcgagagagaattagaaagcgaaacgaaattcagtatccattgcttcaaaattcgacataacttcgaattgttgggtagttgaattgagccactgaactcccacaaccggggaaagttactgtttctcccggcgaagccaagagaaagttactgtttattccggcgagatagcaactttagctatg

SEQ ID NO: 34278 - DNA, 3003 bp, Unknown; identical to SEQ ID NO: 34277
  misc_feature (1)..( 3003): 2750-1469P.txt file - cDNA_ID_3076379; gDNA_ID_2926205; Annot_ID_202148

SEQ ID NO: 34279 - DNA, 3000 bp, Unknown
  misc_feature (1)..( 3000): 2750-1469P.txt file - cDNA_ID_3076411; gDNA_ID_1620776; Annot_ID_167747
cacaagctgtggagatatgaaagaaaataaatttcgattctaaatataattgacatatctataataaaattctagcaataaaaagcacaatcagttaagttcataatgttgaaagctattataaattgtcactcttattgtatatatatactatattaatgacatgtgattgttgtagatgtgagtagtaagacatgtatttatgaaaataaacacacaattaaataaaaatatgtagaaatttttattagagagaaaactaaagtgtcatgttcgacacctaaacatgtttgtctaacatcttaaattaaattgtcctgtttgtttatacatatgaatttatgatctgaagatggaccgaattttttatttctttgatttattcagtttacatattagaaaagaaaattttcactattacatatcctttctttgtgcaaagactgatttttccattcatacgataagaggaattagagagaataagggttcatcacaaccaagacttaagacaacaaaatttaatacactgattagagcataatataaactgaatagataccttgacgataaatccaactttcggagacatgagcgataaggcacatagacaaaagcgagaaaatcgtaagtcgatactacatccacaagcaagtcgtaaataatcatagtcgattgacaatttgactttgaaaaggaatccaagacctcaattctcaccggcatgagacgtattacttcttctccaaaagatagtaacaactggaagaatggacggttccagaccggagaccacattgtaacagttttcttcatgaaggagggtaaggagcaaattgttctctttgtaaaggaggagggttgcagcagtatgctcttcacaacggaaagagttgcaagatggggacccataaggtcagtatcagagtcgagttcgaagtatacaatatggttcatacacttgaagaaagcattccaaaattttcaaaatattagaaggccaagtcagagactgaacatatctcgcttgatacgtatggaatagggagacgacgatatgttgcagattgcaaatataagccggtagacgagaggcaagagccacaaatcgggataatcgttttttcaattggtgaaacaagtttagagacgaaaagtagataaattttagcaaggattgtcaaaggataaaaatatcggcgaaatgatttctattttataataacatttttactttccattttattacggtaaaatatcttcaatctgtgtgaccagttagtttaaaaagtgaataatagtattatctaatatggtatgcatgtttgctttggattatgtatttcaaaaaaaattatcctcgtcaatgtttttcttgacctttttcggttcgatctgttgattccttaaagtttggctatagtgttgttgttgggcagtttttgttagtctcctccaccagaaatttttgaccaaataaatctaaatttggtctgattttacttcttttatactaaatccatgttgttttcactcgacaaattgatcatggatcctttagacggtttatctttgtctctttcgaagctccgtcaaaccaattcatgaaatatatattattagttttgaagtctaactatcatcaacggaggacaaaagatttgaagactacattttgaagattctatagtgatatcaatttttcaaatctttgaaaaatattgatgcatgaaagttgttataaatttaaaaattatataatcgtagctttcaattttttttttgctatttctcatatctgatttgtgtaactggttaaatttcttgggtttatgtttataatgttgttgatgttgtgtaaaatcctctctttctaataaatattaataaaaatagtacaatttaatatatatatatatatacatatatactaagacgaatgaagatatataattcaactacagataaaatatattgcagttcaaataataatcatatatataatagcagagttttctctcctctaaaagtgtccacgtcactacatctttttaatgtggagcccacatgtttttactctgtcttcacatttttttctatgcgtgagatagatttagtgatgtttatggggcacgatttagtgatgtttatggggcacgatttggtcaaaaagcccatgagccaaagaaccaaatagacttagtgaggtgtatcgggccaagatttagtcaaaagaaccaaataaaccagtatactccttctgtgtagtcaatggacgaactggcagctaggcgaggagatagatgagttgtgcacttgagggacgagctgacgagtaggtgaggaattggacgagctgactagctgacagctaggcgaggagatggtcgttgagtgatgtggagcttgaagacgagctgaagaacttaaagacgagctggagtatggggcacgatttggtcaaaaagcccatgagccaaagaaccaaatagacttagtgaggtgtatcgggccaagatttagtcaaaagaaccaaataaaccagtatactccttctgtgtagtcaatggacaaactggcagctaggcgaggagatagatgagttgtgcacttgagggacgagctgacgagtaggtgaggaattggacgagctgactagctgacagctaggcgaggagatggtcgttgagtgatgtggagcttgaagacgagctgaagaacttaaagacgagctggagctttccgtatttttcttccccagaagctcaaacatcaacagttattcactaaaaggtacttaaatacatggcttaattcctacaaaattccactacttgcaatttaattcatacttttaatatctcaaatcgaaactgtaactggagaaaagcaaaaacctcctatacatcttcctttaaactactataaaatcatcatctcccatcacccccaaacacaattatcactttccaccagaaaatattacacactctgaaaatg

SEQ ID NO: 34280 - DNA, 3000 bp, Unknown; identical to SEQ ID NO: 5275
  misc_feature (1)..( 3000): 2750-1469P.txt file - cDNA_ID_3076415; gDNA_ID_1620776; Annot_ID_167742

SEQ ID NO: 34281 - DNA, 3000 bp, Unknown; identical to SEQ ID NO: 5276
  misc_feature (1)..( 3000): 2750-1469P.txt file - cDNA_ID_3076419; gDNA_ID_1620776; Annot_ID_167741

SEQ ID NO: 34282 - DNA, 3003 bp, Unknown; identical to SEQ ID NO: 20711
  misc_feature (1)..( 3003): 2750-1469P.txt file - cDNA_ID_3076433; gDNA_ID_1620776; Annot_ID_167737

SEQ ID NO: 34283 - DNA, 3003 bp, Unknown
  misc_feature (1)..( 3003): 2750-1469P.txt file - cDNA_ID_3076437; gDNA_ID_1620776; Annot_ID_167734
tgttaccaaagctggttgacaatatagtgaaaaaaattaagaacttacttgttacatttcttttagatgtaattttacatctaaatagtaaatgttgcaaaaagttaccaagctaaatcattcgcctgactgatggatgatgatatattgactaattttaattcattgtaatcaacattaagataacaaataaactttattctttatgctaaaaatcaacaccaagtatgtagcatatgagtacatgtgaatagcatacttctatatctctgttttgttatatttttgaatagaaatgtgaatagcatactatatctctgggatattccgtaccatcgacaatgatttcttgccgccaataaaagaacacgagcaaatctacaaatctgcaaatggttcataaaccggtttgatttatgcatcagaccataaaacttcgctcatgtccggtttagctctcggttctcgctttgtattgtcatggaaggtcatcatcattcaattcacaaagcaaattttattgataaactcacactacaagtacaaatgcataccaaaagttgatacatttatatatacgctcataagcaaactattagattatttttttgacacaatacataataaaagcattaatacatttaagtaatggtttataaattccttttgggactggctgatcccgtaaatacaagctgaacaaggagtatctctagaattgctcaaaaaccatggatttttatgttatccttcttcacaagcccagcctgatgattcaaaacatttctaagatcaggatagatacaatgcttccatcttttcactacaaaaccaacttcaaaaccaataaccgatagaacgaaaaaatgatgattacctgaacaaggaacgtagatacgttcttcctctgatcaccttgaagctgaataacctacaccaaagatattaagtcatttagcaactaaaagcaatccaaaatgtatcttgagagctatggtagctttcttgatacctgtcctaattcagagtcctggacgacggtgccattgcagcagaattctttcttaaggtctttaagtatcttgctatagctatactctttcttaagcccctggacagttgtcaagctttttctaccattacgctgctgaacacgaatgtgcacgtattcctttgttcccgccccagagtcctcagcatttgcatcagcgaacggatctttttatcaccaaaaaaaacacaaagcataagaagatcatataacagaagaagatactccattccaaaaacaagaatgctgtggaatcatctaataatcatcatattctcaacaaatttaaccgccaaatttcagaacaatccttaccaaaggcagtggggacttgaacttcaagatcagacatgaaccttaagttgatacaagggacagtaaatcgacaaggcctgagaacaaaaacagaatgttagaattacgagtccaaaaatgatttcaagttacataacgtaaaaaaaagtgacactggttatcctagcaatgtcttattcagataatcaaagattcatataacaaataataaagaaaccattttctgcaaaagtctccattgcgtaaacatatcacaagattccaaaatcaaaaatcaaaacaaaaaatatagtatctgtatctaaaattcgataccattttctacagaataaataacatatctagttttggagtcaatttcttctgaaagaaaaaacaatcaaacattatcattttgcgaagaaacaaaacccagagtatatattttgaaccaaaaagagctgcattcagatcagaaaataaaatgacctacaaatctctaaataaaaactttttcgaacaagcaaatcaacaggaaacaatcattcagcagaaagagagaaagtatcacctgatcaagaagagattagggtttcgagtatttgattgaaggaagaacggaaagaaaaatggaaaccctaaattcggacaaaggcaagcttctgtctgaaagaagaagaagaggaaattacgagaggaagagctacaaaatcgaacaagttttaattcgaaccaatattcttctttttttatattttaaatcggcaaataatagtcggcgagtcggcacggcatcgattccctcccactcatctagttgcgtctttatctggaaatacgtattgggccttaacaaagcccaaatatttgttacggcgtaacaaagcccaactaaatggagccgatggggagatgctgaaatcgccaagcagagaagcccaaattacaatcagttgttcccgcccgatcacctctttttcagttgttcccgcccgatcaactctctggaattacttagcctcaaaatcctcacaacaactcttctcttgtagctacatctactttgctcttccctctctgttgtctcgcgtttcctctgctgtctcgtgctctctttttcgttctgttttgttctttctttagtaattttttcagatagttttaagtctcttctgaagaagaattagggttttagggtttagaaaaaattctctaaatatatttggttttagatctaatttaagattcattcacaaaatagaaaacgtttgtttcttcgtcatcttcttcttcaacgttggatctgttagttatgttttttcagggaccacatctaaacttgtctctaacaaaaagtccggaacttatcaacaagattgaatcttacctcaacggacactgcacatgtcctcatcaacaaacagagaactcatcaaagagatcaactcttcctaagagccctgagaaactaaaagctatgaatttcccaatctccacgatcaggattggcggatgggtcgtcgttgccaaaaaccctgatgacattgtggccaaattctattttgcaaagaagaaacttatatgggagtttctcttcggagaaccagagactaacacgctgaggctgaaacgtaagatcgagattcaatggaatgatg

SEQ ID NO: 34284 - DNA, 3003 bp, Unknown; identical to SEQ ID NO: 21354
  misc_feature (1)..( 3003): 2750-1469P.txt file - cDNA_ID_3076443; gDNA_ID_1620776; Annot_ID_167729

SEQ ID NO: 34285 - DNA, 3000 bp, Unknown; identical to SEQ ID NO: 5299
  misc_feature (1)..( 3000): 2750-1469P.txt file - cDNA_ID_3076484; gDNA_ID_1620832; Annot_ID_169707

SEQ ID NO: 34286 - DNA, 3000 bp, Unknown; identical to SEQ ID NO: 5299
  misc_feature (1)..( 3000): 2750-1469P.txt file - cDNA_ID_3076484; gDNA_ID_1620777; Annot_ID_167804

SEQ ID NO: 34287 - DNA, 3000 bp, Unknown
  misc_feature (1)..( 3000): 2750-1469P.txt file - cDNA_ID_3076492; gDNA_ID_1620832; Annot_ID_169702
gttgtgcaattattttactcgttcatttaatgttttagccatgggattagggtgttggagtgtggtggggatttcctcttcttcttgttgttgatctttgtgctaatcatacaaattttactttatatctttttctcttctttctctgtcagaaagaaaatggtgtagaaagcaataaacttttgtggtagagattctgattttgacgtttcagaggcttgttgcgtactgaatgttttttcaacttgttgcttttttctagtgaaaaaccaattgacagaaaaacctagtcataactttttaacaatatgtgtagttgatttttcatgagcttcttttgcttcacttctcgtttaacaataagtaagtataagtactagtcataactcataagtcgcttcactcttgtttatgggtaacaaccttattaggttaccagtttttctaagacttcaacttcttttggtcagatgattattaataaccaataagccataagagttattagctgtaattcctctttaagctcattcacagattctctggatcggaattaataagcgtgtttagataattttacgattaaatttctgttatatcttaataacacaccatataatttttctatctaattaaataggttaaaacaataaagttaaaattgtattttaaatttaatatagaagtctacaaaacgacattctttgtgaaataaaaatttaatcctgaattcgacatttattatgaagaacgtaactttggtctatttcaagtttcaatgatctgagaacaagagtagggagatttttgttgatcatcggaaatagtatcattgccaagtggccactcttatctgcatgttcttgttggagtcttgttggacttatatgtaagtaataaaccaaaactgactcaattttgaagcgatttaaaagtctaggttttatgcttatacatgaatgaaatgcttcaaataagtgactttctttgtggtttactgatattatctctttagaccacatattgtactacaactagcaaaaacattgtggccataacaaatcaaccgatcaggttagctagaaatactgatccttaggagttttttttttaatacaataaaatagaagaaaaactccagctgaaagagttagctgtaaagaaatgaaactccatagattggtagactttttttcagctttgcaggagttttccattatcgtggtcgatctcaaatgcaggttccacttgtactttggtaatattgtttattggggaaaaaagctgctgatatataaaaacatatcagcttatctttataaactaatcgagagttagcatagagtatcaactggaaaagttgaaaatagatcgatgcaggttttccataatggacgaatgtttatgattaataattttaaaatttgttcaaagtacaacttgcctttttgaatgatctcatctgttttttttttctttggttgtgtgctttatttaaccatctttttctttcacctgaatgaaatcataaactaataaagaaaaaagaagcttacaattgttagacaatattcacatgggatgcgatgttatctactagtttctcagttcaatcacatgcttggtttctttcatgttgatctgatttagtaatacaagttgatcacatagacttttgatttctcacttcttggttgttgtgatacggtaatgcaacttagcgaaagcccttctttggactagctaaaaaagcaacacattcttttcttctaatgcgtggttatcttgctacttagagtggatggtctcttattgacttttatagtcaacatttgtcttgttgcatgcaatatcatcaatgttacatgtttgcatatttgatctagaagataagaatactgcaacgagaagaataggaacatagtgcatgattagcttgaattagaggttcttttggtttttgttataaagtaaaaggtggaaaagtcacatgggactcccgtggattccgctaatgaccccaccaactttctctcctaagattttatttttgatttggttattaaaaaaaaaaggagacatagggttctctacacaccacaatcaaatcatctataagactgcgactatgcttcttctctatctttctcaactcttttgccatgccctctggttgcgttgttcccttggtgggtcgtattatgtctctctgaggcacgctactagcacgtgtctacttgcatgttaccttcttcagtgaaccctattttcaaagcagtcaatgcattgctgaaaatgtaaataataatcccaaccatacaaactatcgttttttgccattaaactgttaccctaactactcatatgtgtgtaatgtgaacgtaatggtctctataatatatgatcagttcatgttttatgcattttagtatatttttattggcctatttaacatctctatttccttcataattactgtggctgctgtagaaatcttttaacttttataatatgtttataaaactgactgaattgcgtgaattataaattgactgaaattaccttggctgttgtagaaatcttttaactttttttaatatatgtttataaactgactgaaattgcgtgtatatattatgtagtccagtattttgtgtgactgactaaatattttgactaagcacggttgcttggtccgactatatattctgtcacataggcaaaactattgtaaaatcaggtaatgttcttgaatcgtctttgggttgagttttggtgtcagagaagctgggtaagtgggtcagtagagtcgttggggcatatatataaatgtccaaatacattaaagaaagagagagagaaaaggaaattgagttttggggtatcgtggagaacataaatgagaggtgtagcgttatttccgggggttcacacaacctctaaatggtatttacacgtgtcatattgagattgggtaattagtaggcctaaggggggatg

SEQ ID NO: 34288 - DNA, 3000 bp, Unknown
  misc_feature (1)..( 3000): 2750-1469P.txt file - cDNA_ID_3076492; gDNA_ID_1620777; Annot_ID_167798
gttgtgcaattattttactcgttcatttaatgttttagccatgggattagggtgttggagtgtggtggggatttcctcttcttcttgttgttgatctttgtgctaatcatacaaattttactttatatctttttctcttctttctctgtcagaaagaaaatggtgtagaaagcaataaacttttgtggtagagattctgattttgacgtttcagaggcttgttgcgtactgaatgttttttcaacttgttgcttttttctagtgaaaaaccaattgacagaaaaacctagtcataactttttaacaatatgtgtagttgatttttcatgagcttcttttgcttcacttctcgtttaacaataagtaagtataagtactagtcataactcataagtcgcttcactcttgtttatgggtaacaaccttattaggttaccagtttttctaagacttcaacttcttttggtcagatgattattaataaccaataagccataagagttattagctgtaattcctctttaagctcattcacagattctctggatcggaattaataagcgtgtttagataattttacgattaaatttctgttatatcttaataacacaccatataatttttctatctaattaaataggttaaaacaataaagttaaaattgtattttaaatttaatatagaagtctacaaaacgacattctttgtgaaataaaaatttaatcctgaattcgacatttattatgaagaacgtaactttggtctatttcaagtttcaatgatctgagaacaagagtagggagatttttgttgatcatcggaaatagtatcattgccaagtggccactcttatctgcatgttcttgttggagtcttgttggacttatatgtaagtaataaaccaaaactgactcaattttgaagcgatttaaaagtctaggttttatgcttatacatgaatgaaatgcttcaaataagtgactttctttgtggtttactgatattatctctttagaccacatattgtactacaactagcaaaaacattgtggccataacaaatcaaccgatcaggttagctagaaatactgatccttaggagttttttttttaatacaataaaatagaagaaaaactccagctgaaagagttagctgtaaagaaatgaaactccatagattggtagactttttttcagctttgcaggagttttccattatcgtggtcgatctcaaatgcaggttccacttgtactttggtaatattgtttattgggggaaaaaagctgctgatatataaaaacatatcagcttatctttataaactaatcgagagttagcatagagtatcaactggaaaagttgaaaatagatcgatgcaggttttccataatggacgaatgtttatgattaataattttaaaatttgttcaaagtacaacttgcctttttgaatgatctcatctgttttttttttctttggttgtgtgctttatttaaccatctttttctttcacctgaatgaaatcataaactaataaagaaaaaagaagcttacaattgttagacaatattcacatgggatgcgatgttatctactagtttctcagttcaatcacatgcttggtttctttcatgttgatctgatttagtaatacaagttgatcacatagacttttgatttctcacttcttggttgttgtgatacggtaatgcaacttagcgaaagcccttctttggactagctaaaaaagcaacacattcttttcttctaatgcgtggttatcttgctacttagagtggatggtctcttattgacttttatagtcaacatttgtcttgttgcatgcaatatcatcaatgttacatgtttgcatatttgatctagaagataagaatactgcaacgagaagaataggaacatagtgcatgattagcttgaattagaggttcttttggtttttgttataaagtaaaaggtggaaaagtcacatggactcccgtggattccgctaatgaccccaccaactttctctcctaagattttatttttgatttggttattaaaaaaaaaaggagacatagggttctctacacaccacaatcaaatcatctataagactgcgactatgcttcttctctatctttctcaactcttttgccatgccctctggttgcgttgttcccttggtgggtcgtattatgtctctctgaggcacgctactagcacgtgtctacttgcatgttaccttcttcagtgaaccctattttcaaagcagtcaatgcattgctgaaaatgtaaataataatcccaaccatacaaactatcgttttttgccattaaactgttaccctaactactcatatgtgtgtaatgtgaacgtaatggtctctataatatatgatcagttcatgttttatgcattttagtatatttttattggcctatttaacatctctatttccttcataattactgtggctgctgtagaaatcttttaacttttataatatgtttataaaactgactgaattgcgtgaattataaattgactgaaattaccttggctgttgtagaaatcttttaactttttttaatatatgtttataaactgactgaaattgcgtgtatatattatgtagtccagtattttgtgtgactgactaaatattttgactaagcacggttgcttggtccgactatatattctgtcacataggcaaaactattgtaaaatcaggtaatgttcttgaatcgtctttgggttgagttttggtgtcagagaagctgggtaagtgggtcagtagagtcgttggggcatatatataaatgtccaaatacattaaagaaagagagagagaaaaggaaattgagttttggggtatcgtggagaacataaatgagaggtgtagcgttatttccgggggttcacacaacctctaaatggtatttacacgtgtcatattgagattgggtaattagtaggcctaaggggggatg

SEQ ID NO: 34289 - DNA, 3000 bp, Unknown
  misc_feature (1)..( 3000): 2750-1469P.txt file - cDNA_ID_3076507; gDNA_ID_1620777; Annot_ID_167783
tacaacttcctaatgttatagtcttgtttgagaatatatatatgtccgccaaaaacagttgatgattattttaataaacctcatctctactttctcttcttagttctttacatgagtcctaagttgttctttggattccccagtttgctgtgaaaaagagggttagtttttgctgctgttatttcactgatgaagacagaacatttaaggtcagattgatgaatgaacaaggagaatttgagtagagattggtaccgtgtaattgaagaaagggataatagtgaaataaaaatggaaagtaacaagaaatctaaactgtaaaagagactcacattttctgatccttttggtatgaaatgtggaatgcgtctacgcatgagaagacatgtccaagacacatacataaagagagacacacacacaaacgcctctatccacattttattttccgatcgaatctttgtttatgtatcacctaagctgataagaaagcttatgtgttaattttagtgttgtgtaatctctcctaaactccaatctctgataaatttctcatgtctcaacagcctgaagcgccttcctctgtttcctccaagtccaaaggttattcatgaatcaatttgaacatggctccaatctgatattatttacttttaaggattctgtaacacatcaactatacatttagtaagataagaacaacaaataggttgaaatgttagttaataatgtagttttcttgttctttttataagttgaaattaagaaagggtctatgcatggaaacatatttttggggttatattgttctgtaggaagataaacagttgaggaaggaaagactgcattggagaaacatgtgtccttctttgaccgaaacggtgacggcattgtttatccatgagaaacctaccaaggtaacatacataattaagtcataaaatatgaacaagattttgatgtgttgcttattcttatctttaacttaaacaaacataattaaatcgttgatgtatacccaaaaagggatttagagcactcgggacagggcgtttcatgtcggcttttgttgctgtcttcttcaacatgggactcagccagaaaactcgtccggtactaactaatactacttctctttttttgtttctccactcttggttttgcatgcgatcaaggataccataagttaagaaattcaacggctaaaccggaatatactaataaaagaagaaggaaatatgaatgaatattttgattttgtttctagggttgattatgcaaacaatctatataggttcaactattcggatatatcttaccattgtttttgaaaccatttgtatgcacggtagtgacaaccgacgtctacgacaaagacggaaggtttcttaatttccttgacatcttttgttaaaagttaaaacctaattacaaaatctaactttacaaaagtgtaattacttctatctcctaaattttacagatttgtggaatcaaaattcgaggagatattcaacaagcatgctcgcacacataaagatgctctcactgcaaaggaaattaaacaaatgcttaagactaacagagaaccttacgatttcatcggatggttcgttgtttataaattaaacaaattaaattataatcacaacgtaacgtatcattcagattttcattgtaaaaaaatatacatattgcacgatatgcttatacctaattatatcacaggctttcagattttatagaatggaaaatattacatacgttagctcaagacaatggtttgttgacggaagatgcagtaagaggcgtctacgatggtagccttttccaacaactggagaaaaaaagatcatcttcttcatctcgtggcaagaaacaaaaactaccttaaatgcgtgaatcttcttatattactatgtggagatcaaatgacttgtggtttatataatttggagatcaaataaattttgtaatgaataaatttgtataatttggatatcaaatcatatttaaatcattatattgacaaaaatatgcgatcaacaacaacaacaaaaaatcattcaaacacttatgaaaaagtacacttcatttagattaaaatacatggttgtataagcccgttttatcatctaacgataatttaaattctaaaatttctaaactagagaaacaaaatgttatcatttttagctatatatatatatatatatatatatagctaagaataaatgacataaagaggatttaagtagatagtaccgtgtaagccaagaaaggggttataatgtcaattaaatttataagaggggaaaaaatcagtaagagtctcacactttgtgatcttgttgttataacaaggaatgcgtctacgcatgtcaatacatgtccaagacacataaatacaaacacacacacaaaaacctctatcgactttatcttggatcgaatctttggtttatgtataagtataactaacacaacacctaacaatagatataaaaaataagtaaccaagaaaataagtaacggcttcttcgatcatttatatgtttatcctaaactaataagaaagcttgtgataatttcagtgttctcactctcatctccaatctgtgatatatttctcatgtctcatcagacagtagcgctagcctctaaggctaagtctcctaaacccaaaagtaaagtgttcacgacccatttagcatgcccacatgtatcatttgagcatggctccaatttttcaaattaatttagaaaatttaaatatgcatataacttggttgatatatatacatataagaataacaaagtatgcataagatttacgtataggttgaaaaggtccttatatattttttcttttaaattcttaacatttttggaatgtttttttgtttttgtttttgtgagtcgaaaaagggtctatgcatggaaacatatttgtgggattatgttgtttatgtaggaggaaagttagataaggaaaaaatg

SEQ ID NO: 34290 - DNA, 3003 bp, Unknown
  misc_feature (1)..( 3003): 2750-1469P.txt file - cDNA_ID_3076511; gDNA_ID_1620777; Annot_ID_167781
gcgggaaatttattttggaatattttaggcaaaaaatattaatatttcattttgtaaacctaaaacaatttccaaataagagtaaaatggtcgttaaaaatttaaagagggtagaaataaaaatggataaaataaaagagtatagttgaaaaggggcatcataaaaaaggcattagaaataatttttcatgttttaaatgacaataatttaaaagttaactaaaagagtctataatgggtaataacaaacgtataacactagtgaaaataggacttgtcaatccatgaattaaatattttcatggatacggtcgtagggaaataaatctttccgtcagtcctaaaaagcctaaattattggatagacaaaaatctgaaaatcttaaatcacacgtaaatcaaacgtatttacccccacatggaacttaatccaatctattaaattcaggtggcgaccgttcattggttcttgtctctagaatcccaaaggactcgtttccgagtataaaaatacgttcctcaattcaaagtacaaaccaaaaacagaaccgaaacagaaaatggcgggaaaatcctttatgactccggcgattatgctcgccatgcttctccttatttcaccggagacttacgccggtcacgactaccgcgacgctctccgcaagagcatcctcttcttcgaaggtcaacgctccggcaaacttccaccagatcaacgccttaagtggcgccgtgactccgccttacgcgacggttcttccgccggcgtggatttaacgggagggtactacgacgctggagacaacgtaaaattcggattcccgatggcgttcacgacgacaatgatgtcatggagcgtcatagatttcggtaaaacaatgggaccggagcttgaaaacgccgtgaaagctatcaaatggggaacggattatctcatgaaagcgactcagattcccgacgtcgtctttgtccaagtcggagacgcttactccgatcataattgttgggaacgccccgaggacatggacacactacgaaccgtttataaaatcgataaagaccattctggttctgaagtcgccggagaaaccgccgccgcactagcagccgcatcaatcgtgtttgaaaaacgcgatccagtatactccaaaatgctcctggaccgagcaacaagggtacttttctttaaagtttctttaatttcgtctttttgaaatgatagggaaaaaaaatcgtgattttgtcaaaaaagtgttaacaattggttatatactttgcttgtgtgataaatattctcttcattagtttctaataatgtttgtttccgtactttcgtgacccacatgcattagtttagacctaatatgaagtatggaactactttgtttttgttagaaacgtatgaaccatttcacattacttaatgtaaagaacttttgacttgtgtatattttcgacatctacgaaaataaactaagtttatggaaaatgtgaatggacataggtgtttgcgttcgcccaaaagtaccgaggagcgtacagtgatagtctttatcaagcagtgtgtcctttttactgcgatttcaacggttacgaggtaattatacaaattttaccacagtttgatatatctttcataaacatttgttgatgaaaatgttgcgtgtaggatgagttgctatggggagcggcttggctacataaagcgtcgaagaaacgagtgtatagagagttcattgtgaagaaccaagttattctaagagctggagatacgatccacgaatttggttgggataataaacatgccgggattaatgtcttagtctccaaaatggtattgatgggaaaagcagagtattttcagagttttaagcaaaacgctgatgagtttatctgttctttattgcctggaatttctcaccctcaagtccaatactcacaaggaggattattagtgaagagtggaggaagtaatatgcaacatgtaacatctttgtcttttttgttactaacatactctaattacctaagccacgcaaataaggtggtgccatgtggcgaatttacagcttctcctgctcttctccgtcaagtcgccaagcgtcaggtaactaaactaaccaacattcctctgttttagcataatagagagattcattaacgtaagtgtttggtggcgtacgttaacataggtggactacatactaggagataatccaatgaaaatgtcgtacatggttgggtatggttcgaggtttccacagaagattcatcatcgtggcagctcggttccttcagttgtggaccatcctgatcgtatagggtgcaaagacggatctcgttatttcttcagcaataatcctaatcctaatttgctaattggcgccgtcgttggtgggcctaatatcaccgacgattttcctgattcgagaccttactttcagctgactgagcccactacttatatcaacgcacctcttttgggcctacttggttatttctcggcccattattgatttcacacctcgaactcgaacgaagcatgaaagtctatttttgttgtgaaacatttttagttgattgttaccgattagtagattcactagattctctaaatctacgaacaaataattgtataaattaatcgagtacacaataatcaatttttaatcatatgggagttaggaaaaacaaagagtaataatgagagaaagggggagacaagagtaattaatattttgatgaccaaactaatcaaaaatcaggaatttgtcttttggactttggtcggctgctttacgcttaacacaaaagaacgctattttgtctcctccacgcaattacctcttctcactctcagacattttgtcaaacagatggtgctcgtttctgaatcagcttaagaactaacaaggagacagacactaagcttggtttttctctccgattagacggaggaaaaagtgaaaacgaggggcttagacgagtgatgtgatagagatg

SEQ ID NO: 34291 - DNA, 3000 bp, Unknown
  misc_feature (1)..( 3000): 2750-1469P.txt file - cDNA_ID_3076511; gDNA_ID_1620748; Annot_ID_166700
ggaaatttattttggaatattttaggcaaaaaatattaatatttcattttgtaaacctaaaacaatttccaaataagagtaaaatggtcgttaaaaatttaaagagggtagaaataaaaatggataaaataaaagagtatagttgaaaaggggcatcataaaaaaggcattagaaataatttttcatgttttaaatgacaataatttaaaagttaactaaaagagtctataatgggtaataacaaacgtataacactagtgaaaataggacttgtcaatccatgaattaaatattttcatggatacggtcgtagggaaataaatctttccgtcagtcctaaaaagcctaaattattggatagacaaaaatctgaaaatcttaaatcacacgtaaatcaaacgtatttacccccacatggaacttaatccaatctattaaattcaggtggcgaccgttcattggttcttgtctctagaatcccaaaggactcgtttccgagtataaaaatacgttcctcaattcaaagtacaaaccaaaaacagaaccgaaacagaaaatggcgggaaaatcctttatgactccggcgattatgctcgccatgcttctccttatttcaccggagacttacgccggtcacgactaccgcgacgctctccgcaagagcatcctcttcttcgaaggtcaacgctccggcaaacttccaccagatcaacgccttaagtggcgccgtgactccgccttacgcgacggttcttccgccggcgtggatttaacgggagggtactacgacgctggagacaacgtaaaattcggattcccgatggcgttcacgacgacaatgatgtcatggagcgtcatagatttcggtaaaacaatgggaccggagcttgaaaacgccgtgaaagctatcaaatggggaacggattatctcatgaaagcgactcagattcccgacgtcgtctttgtccaagtcggagacgcttactccgatcataattgttgggaacgccccgaggacatggacacactacgaaccgtttataaaatcgataaagaccattctggttctgaagtcgccggagaaaccgccgccgcactagcagccgcatcaatcgtgtttgaaaaacgcgatccagtatactccaaaatgctcctggaccgagcaacaagggtacttttctttaaagtttctttaatttcgtctttttgaaatgatagggaaaaaaaatcgtgattttgtcaaaaaagtgttaacaattggttatatactttgcttgtgtgataaatattctcttcattagtttctaataatgtttgtttccgtactttcgtgacccacatgcattagtttagacctaatatgaagtatggaactactttgtttttgttagaaacgtatgaaccatttcacattacttaatgtaaagaacttttgacttgtgtatattttcgacatctacgaaaataaactaagtttatggaaaatgtgaatggacataggtgtttgcgttcgcccaaaagtaccgaggagcgtacagtgatagtctttatcaagcagtgtgtcctttttactgcgatttcaacggttacgaggtaattatacaaattttaccacagtttgatatatctttcataaacatttgttgatgaaaatgttgcgtgtaggatgagttgctatggggagcggcttggctacataaagcgtcgaagaaacgagtgtatagagagttcattgtgaagaaccaagttattctaagagctggagatacgatccacgaatttggttgggataataaacatgccgggattaatgtcttagtctccaaaatggtattgatgggaaaagcagagtattttcagagttttaagcaaaacgctgatgagtttatctgttctttattgcctggaatttctcaccctcaagtccaatactcacaaggaggattattagtgaagagtggaggaagtaatatgcaacatgtaacatctttgtcttttttgttactaacatactctaattacctaagccacgcaaataaggtggtgccatgtggcgaatttacagcttctcctgctcttctccgtcaagtcgccaagcgtcaggtaactaaactaaccaacattcctctgttttagcataatagagagattcattaacgtaagtgtttggtggcgtacgttaacataggtggactacatactaggagataatccaatgaaaatgtcgtacatggttgggtatggttcgaggtttccacagaagattcatcatcgtggcagctcggttccttcagttgtggaccatcctgatcgtatagggtgcaaagacggatctcgttatttcttcagcaataatcctaatcctaatttgctaattggcgccgtcgttggtgggcctaatatcaccgacgattttcctgattcgagaccttactttcagctgactgagcccactacttatatcaacgcacctcttttgggcctacttggttatttctcggcccattattgatttcacacctcgaactcgaacgaagcatgaaagtctatttttgttgtgaaacatttttagttgattgttaccgattagtagattcactagattctctaaatctacgaacaaataattgtataaattaatcgagtacacaataatcaatttttaatcatatgggagttaggaaaaacaaagagtaataatgagagaaagggggagacaagagtaattaatattttgatgaccaaactaatcaaaaatcaggaatttgtcttttggactttggtcggctgctttacgcttaacacaaaagaacgctattttgtctcctccacgcaattacctcttctcactctcagacattttgtcaaacagatggtgctcgtttctgaatcagcttaagaactaacaaggagacagacactaagcttggtttttctctccgattagacggaggaaaaagtgaaaacgaggggcttagacgagtgatgtgatagagatg

SEQ ID NO: 34292 - DNA, 3000 bp, Unknown; identical to SEQ ID NO: 5310
  misc_feature (1)..( 3000): 2750-1469P.txt file - cDNA_ID_3076533; gDNA_ID_2926146; Annot_ID_197728

SEQ ID NO: 34293 - DNA, 3003 bp, Unknown
  misc_feature (1)..( 3003): 2750-1469P.txt file - cDNA_ID_3076533; gDNA_ID_1620845; Annot_ID_170185
aacaaacagaacatcttgaagatctaaagaagagcctaactgaacactgccttgttttgtagcggttgtaaaacgtccatcaggaagtttaatcaaaacaggaggcatatcacaaacattacggagaaatgcaagagaaccagtcatatgatttgtggctccagaatcaattatccaagattcaagaaaatacttaccagactgatgatcatttaaggtagatttccgttcctcaagaatcgtttgtaaaattttccattgtgaatcattcagcccactaagtcctatgcgatcatctgatgtcaatggagaagtgagcgatgaattcgtaacaacattggcagccattccagaagaagcgacatgattaatagaagatccacgaccatgactctgttttcctttgaacgaacttaaaccaccacgtgaagaagatgcagtgtttttaagacgcaatttttcttcgagccaaggaggatacccgattaatttgaaacattgttcggcgagatgaccaacacggccacaattactacagactctgttttctgaagaatctcgaggtcgtgaagtagtttggaccgcgaagctaacaccgtcaaccctctcgttatgtaagcgactcaaggatttggattcttcgtcttgtgtcaaagcattgtaagcttcctcgagagaaggtagtggcactcgagagagaagagccgacttgacagctccgtacacagattcatcaagtcccataagaaactgatgcaatttgtcttcttcacgttcttttctgacgtcgtccatggttttagcttgttggtaatccgccaagctacaccacagttgagagagacagccgtagtaagtttcaatggccactcctttttgacgacaggttgctaactctgttttgagtcgctgaacatgttgtccattcttgacaccaaagcgtttctgaatgtgtgtccagagctcatgagaatcgtcgagatgagacatagatgtggaaacagtttcatcgatggtgagcttcatccatgaaaccacaagagcattgttggcagtccaatcttcgaaatcgggatctgtctcaactggttgtggaatagatccatcagcaaacccaaatttctttctagcttttaacgccaaacgaagatttgtggcccattcgtcgtagttgggtccacgaagcaacggtttggagatgagagttccgggattatcaccggatgtgagatcatatggcgagattgtacgccttgtttcagtcctagctggtgtggtggagctagcgagagccaattcagtactcatgatgaacggagagtttgatgcaagtattaagtagagaagttagaaggaataagaaagcgatctcttatagcggaaggagagatcacagaatcgatcacaaaaaccttttagtagttaggtattgtgctctgataccatgtcaagaatcaatcgaggttgtgaaaagaagattcttattgattacggcaagaggcaatgcctttatatacacgataagtttagacctagttaatctatacaatataaatgggctaaggccacacagcccaacatatattgctcataaacaaacttttcaattgaggcaagtctcaacatgttttgatcaaatcgacgcttttctaaaccactttgttttctctttttgcatcgtgaaccttccttgatttggaccaaacttggaatataagagataacatattgtttacagtttccgtctacaagattcagtttttctaagtatccatcctctccgacgatgctaataaatgttttgagacaattagagtcggggtcaaggtttctaccgaaacccatgaagactttcttctcttcgtctacgaagaaactatgtgatatctttatcttaggtctcgtatcaattctaaataacttgctccacgacaccgtttcggcatcaatcttagtcgtaatccatatctccaactcagataacgctgaaataaagctgcaagcttctcttctttaacacaagataaagtcacatctacagcgctgcacggtagagggagaagcggcccgaatctctctcttgtaaaatcaaaacagataatgtgatctttgtgaccctgtgacctcctttctttagcacaccagtaagtgtttcccttaatagaaacgccactggaagaacaatgtacaccccagtgtggagtgacatcaagagttgtctataaacccgagtcaaaatcatagatttcataccaaaaagattgtgtttcgggtgtattgtagaaataatctagaaacctcaggaacttaaaggtacgacaagattccttatcttcgtatccaagagcataactaaacctatcaaatccattcggaggttgagaatatcggaggttgatccaccttgtatgcccccaatacggattccaaaccaaaaccctagtaacgtcgtctttcaagatgcataacaacaaaccctcaaagtggaaaatattagatatactcacttgattgtgaatgaaaagttgacctttaacctctatagatggatcaaagtcgacgacaccgctcattaaacaaagtttgtgaggcatcatcatgatcatcatagtctctccatctcttgttggtgttgtcactttaccaatgtgcatcttcgtaaaaccctcacttttggataaattgttccaagttttgcaagttaatctcaccgctttcatagatttcaaaggaaccctagaaatgatctcctcgatcaaatcccttggaagattgtagatcatcgtcgtcattgtttcaactttcacaacgaatgatttcttgcagcttagggaaaggaaaaaggtatacacgacgacaaattataaccctaaataaatttgggccactagtgggctttcagaatctaattgggcttaagcagacccaatttgtatctggcgcgaggttttagtttctgcggaggaggagatgatcgacgattcgtctcttacggcggagatg

SEQ ID NO: 34294 - DNA, 3000 bp, Unknown; identical to SEQ ID NO: 5310
  misc_feature (1)..( 3000): 2750-1469P.txt file - cDNA_ID_3076533; gDNA_ID_1620778; Annot_ID_167840

SEQ ID NO: 34295 - DNA, 3000 bp, Unknown; identical to SEQ ID NO: 28514
  misc_feature (1)..( 3000): 2750-1469P.txt file - cDNA_ID_3076537; gDNA_ID_1620778; Annot_ID_167832

SEQ ID NO: 34296 - DNA, 3000 bp, Unknown
  misc_feature (1)..( 3000): 2750-1469P.txt file - cDNA_ID_3076542; gDNA_ID_2926145; Annot_ID_197699
tccgtcacagatatcagaaagttccgtttcgattttgcttctgtagtcacggatcaacgaaacgtggtcatcgttaccgcgagactcctccttttgttcgatcgatgaaatgattctccacgaagcacgacgagctccgatgacgtttttgtaagcgacggagaggagattacgttcttcgacggtgagttcgtctttgtcaacagctttcgcgactttctccatgaattcaaccatttcttcgtaacgctctgcttgttcggcgagtttcgccatgtatacgaattcatctcttgctgaggaagctcctggtgtcgccattgttgtttagatcggagaagaagatgatgaacaaagtgaggaagaagaagaagaaatgattctcagatctgagagagtttttttttttttttatcggctccgtggatttttgtttttgtttataatgaatgagtggggagcgatgattacggattgtgagaagaaaggagagccgttggattgaaagctggcaaaaacacggattcgtaacgaaaaaaggcgctggcttttcagatactttttaggtcaagtttgaattttcaatgattggaaaagggtatttctggaaattacttatttaatgggcttttttcctgcgaaacgggtttattgaatgggctttaaagcctattttacggattaactcatttgcgcgtgggtgaattaattattgaatggcccgaataggcccaataaatataacgcttgtattttggtatacttactgatttcatttttaatcggatatccgatatgaaatatgaaaaatagaaaatttaaaacccaaagatggcaatatttcattaagatttctttagctgttaatctttagtatttaaatatttaatttaatgaacgtaatttcataaaatttacaaacaaatacgtcaatcatcgtaaatctagtgagccgacatcgttaatttacaaatattattataaacatttaattatctctttttaaaaaaaaattaagaggaccaactgttataataagatattattataaacatctaattattttttttattttttttatttaagaagaccaactgttctgttttggatactcataattactatatttctaaggctataagtcctcatcactttagtaaaaataaattttgtggattggtttcatcccctctattaggaacatggacaacatccatttgcatgtcaagaaggctttgcatgtctatgtaagtaagttttatatttatttgaagatctcggttttttttttcttttttgtgagatcataattataatattcgtgtatttactaaaatttaatttctctatgaaaaaaactatttgctgaaaatagtatgcacaaaacgtacacacatatcgttgttaaacaagcaaacatgtagagtatcgattaaacgacatatgtatatacacaattttcctgaagttaggattttatcaagatttctttcaagtttgatcttgcaaggtagagagaaagcctcataatttggagtcacactaaagacaatgataggtctttgagtcagagataatggagttttaggttgaataactaatgctctaacccctcatattggagtttcagctaggaaccaaaacattcaaaaggaatcaaacacatggagaatacacaaacggtgtttaggatggatataatagagattacaaccttatcgagattcgctttaggatgcataaaatagtaggaggcaagaagtcaagagactttcatgggcatcgatgtagaaaaagttctctgccacagaggaaaaacaattttaaggtcctagaatctacatttcattaaggatatatagtagaaccgcgaatgtggttaaaattaaccgttggagtgaagaattggataggcttttgcttttcaaacatgaaatcaacaaagtcctttgtagttgggcatataagatagattcatctcagaacttcctggctccatcccaaacaagatgttgtaggacttattccaacgtgttcgttgtttatcatctagaagcgtaaacatgagaaaagagtaagcatagattataaacaaaatcacaaagtttctagattccacataacgctaggaactcatcaatagagaagcagcaactaaaaaaaaagctcaccttttaatttccatgtttctttccaaaaacgatcagtgaaattacgtatagctttaatttttccccaaagcaaggattgaatcttgcgctaacaacaaaaatgttcaaattttaataattatggaacaaataatcaaaatattcataatttaataggtcttgcgcaaaactatctatttttacccacaataatagcatgtatatgggtgatactcatatggtatcataaggaatttttaagtattatttataatgtttgagattttttatgatactcctactaaatatgtttgcactagatattaacccgcggtataccgcgggtaagtttatattttagttaaactaaaaatctttttttgtaaagatgattaataaatttatgatattattttatttgattttaaatatataatacactgcgagttgtatatgttttgttgatattttttatattctttaatgttgatattctatgttttgttgtatatgttgtgttgttctttttagtcgcatatggggggtggtggcgacggagagagcaaaaatgtttctttggttagtcgggaatcaagctctaatgacggatgctgagcgatttagaaggcatctgtgtataacagatgtttgccaagtctgtaaggggggaagtgagacgattattcacatccttcgggattgtcccgcaatggcaggactttgggatcgtatcattccccagcggcggaggagatccttctttgcacagtcgttgatcgaatggtagcatgataacctaggtgatgaccgggaaatatatgagagtgtatggtctacggttttcacgatg

SEQ ID NO: 34297 - DNA, 3000 bp, Unknown; identical to SEQ ID NO: 34296
  misc_feature (1)..( 3000): 2750-1469P.txt file - cDNA_ID_3076542; gDNA_ID_1620778; Annot_ID_167823

SEQ ID NO: 34298 - DNA, 3000 bp, Unknown; identical to SEQ ID NO: 5319
  misc_feature (1)..( 3000): 2750-1469P.txt file - cDNA_ID_3076589; gDNA_ID_1620779; Annot_ID_167855

SEQ ID NO: 34299 - DNA, 895 bp, Unknown
  misc_feature (1)..( 895): 2750-1469P.txt file - cDNA_ID_3076593; gDNA_ID_1620779; Annot_ID_167854
gaattccacaacagacctgaaagaggctgcaatagttgtcataagaatcaatcctctgcttcaacgtcggagacaacctcgcatacaaatgtcgaaaccacatctcacggtacagaagacagaacacatggtcgttgtctacgtaaggagcaatcgcttccacacttggccacggcgtgtccttgaacagacgctccgatatgctctggaacgatgtctcacacatctggtggatctcgtacacgttcttatcccttatgtgtctgtacatgtgtgacacgaacgacttcaccgaatccggcaccatatttgggtcgtacccactctccctctcccccggaccttcctcatactcattgctgctcgccattctcgccggatcaattcttagcggccgcaacaatgttagctcttaactcactaccaccgcctagggtttccttattaccaccggttctatcatccggtttcgtttccttattaccaccggttctatcatccggttatgtttttttataaagtcattttaataaaactttctatggttcggaaaaaaaaaacttcacataatcatcgctattctctctctctctctctctctctctctctctcgctctcatatttgcaggtaaagcttcgttgattcgtcctctttatgttcaattatagtttcgcatccctcctatgtctttctttctagatcttaaagcagagtcattgcttaaccctaattatcactgttcttgtataaaacacttttcacctaatcattgagattgttacgggatctgataattgcgtctgtgaattacaagaaattagggtttatttcttcttgattttagattgatctttttgcagttgacaattcgttctctttgggaaattagagatg

SEQ ID NO: 34300 - DNA, 1123 bp, Unknown; identical to SEQ ID NO: 5342
  misc_feature (1)..( 1123): 2750-1469P.txt file - cDNA_ID_3076607; gDNA_ID_1620780; Annot_ID_167919

SEQ ID NO: 34301 - DNA, 3000 bp, Unknown; identical to SEQ ID NO: 5327
  misc_feature (1)..( 3000): 2750-1469P.txt file - cDNA_ID_3076619; gDNA_ID_1620780; Annot_ID_167914

SEQ ID NO: 34302 - DNA, 3000 bp, Unknown; identical to SEQ ID NO: 5328
  misc_feature (1)..( 3000): 2750-1469P.txt file - cDNA_ID_3076623; gDNA_ID_1620780; Annot_ID_167913

SEQ ID NO: 34303 - DNA, 3000 bp, Unknown; identical to SEQ ID NO: 5330
  misc_feature (1)..( 3000): 2750-1469P.txt file - cDNA_ID_3076627; gDNA_ID_1620780; Annot_ID_167909

SEQ ID NO: 34304 - DNA, 3003 bp, Unknown; identical to SEQ ID NO: 20721
  misc_feature (1)..( 3003): 2750-1469P.txt file - cDNA_ID_3076631; gDNA_ID_1620780; Annot_ID_167907

SEQ ID NO: 34305 - DNA, 3000 bp, Unknown; identical to SEQ ID NO: 20724
  misc_feature (1)..( 3000): 2750-1469P.txt file - cDNA_ID_3076642; gDNA_ID_1620780; Annot_ID_167897

SEQ ID NO: 34306 - DNA, 3000 bp, Unknown
  misc_feature (1)..( 3000): 2750-1469P.txt file - cDNA_ID_3076654; gDNA_ID_1620780; Annot_ID_167892
aaaaggaccttcagctcaccaattgcttctaaagttttacgccacaagcctccgcagaagaatcgaggcctttctcccttcatgtttgacttgcccaaacacgtttcctgctactctctctaagcttgttttctctaacatctcagtggctacaaaagaatccgcagccatgtttggtgacgatgataatcccgcatattccaacaaagttgttcaatgggcagagagggaagttgaatatttggtgcggttggttaaagaaaacgcttctccttccgaaacagcttctgcattgcgggcagccagtatatgtcttcaagattgtcttaactattgcaaagtgttggaaccacaaggcttatttctgtctaagctatttttggtgctgttccgaccttatgttgaagaagtgttggagttgaattttagacgggctcgaagggttatctttgacttgaatgaaactgatgagggcttggaatcaccctctgactttgtgacaatattatctgaattcgctatcgcttcagatactatgatgactgattgtagcattcgattcatgcaaattgtgcaagtaagttgattttgaacactgatcttactattttctttgattctgttggcataaatttatagaagctttatttgttctttcaggacatacttgagcagttaacacacctagttgtgttacactttggtgagagtgtactaacgaggatattgcaactatatgataaatacatcgactttctgatcaaagccttgcctggccattcagatgaggatggtctacctgagctccaagataataccgtactcgctagagctgagacagattctgagcagcttgcgcttcttggagctgcgtttacaatacttgacgaacttttaccaagatcacttgttaaagtctggaaactccagattgaaaatggcggaggagaaggtgagaatagtgccgctctaaacagtagtgctgcaccggaactgaaagaatggaaacgccatatggttcaagcatttgacaaactcagaaactacttctgtctgcagtttgtcttgagcttcatctactctagggaaggactaacgcgattagacgcactcatttatttaaccgaaacaccagatgacttgcatctgccgtctttaccgtttcaggtctcgccctcttctttgatctagttttatagttcccagtttataagttttagcacacagaatcatctgtgtctgttcttatgcaggcattgttttctaagctacaacagttggccataattgctggggatgttctgcttggtaaagagaagctgcaaaagattctactagcgagattaacagagacggttataatctggctatcaaacgagcaggagttttggagtgcattcgaggacgagtcaaatccacttcagccatctggattgcaacaggtagaaacactctctttcaccactcttatatacctcagctattctctgatctcaggctcagcagtcaaagattgaaaatttgaaatgggaaacaattgaaacttgatgttgaagttcatttcttgagaagattggggttgaaagttgaagttttgttgtcacgtgttgcagttgatcctcgacatgaacttcacagtggagatagccaggtttgcaggttatccatttaaagtagttcagaaccatgcatcagtggtgatcaatcgagccatcaacatattctcggaaagaggcatcaacccacaaaggtaattgaaacaacactctttttgaattttcttccaactcggtctcaacataacgaattacctaaaaagtgtattattctctttcaccagctcactcccgaagacagagtggttcacagaagccgccaagtcagctatcaacaggctactcatggggtctgaggatgcttcagaaccggaagaatatgagtgtgaagaagaagaagaagacgatcatcacatcgtcctccctgagatggatgacgactcagattccgaagatacatcttcactctccacagtggactcgttcgagtcatttgcctctgcaagcatggctgacctagagagtccatctttcaccgattctgagtcttgaccactttctttgtagtttgtatcctgtagtcaagtctctcaaaactctcaagttaatatatataaagttaaccgaaatcatctgcaaattaaattactggtttagattggtttaagtcaattagtataggcccattgttagcccattagggatgaggcggttcttgagggtttgtcaagcataaaataattcagacaagccggtgaaaaagaaaagtcgtacgcgactctctctctctatcttttatttcctttgggagcaaggcggtctatcactttcagtcgctatatataatcttcctcatcgctccattttctcctacagtctctttctctctctccctgagaaaacaagggagactaatcggaatctcctgcgtatttgattcttccggcgattgtttccttctttatacgctttcgtatattcttgtcaggtaccaaactttttccccctctttggttgtgagcttctaatcatttgttttatcgttctctttgattcagcaatatcgaagccaaaatttgtgtgttggttggtgttggtcaccaaaatttcttagatatgataaaatagggcactttgattttacccccttttttagatcccaaagaaggaggaatagtttaggcgtcttgctatcaattttcgattcgtttgatttggctttagttaatttcaacatcgttgtagctgtgtaagattttattgttacgtagattggtttgctcgtattttcgtgtgtggtgaatttatctgggccatcaatgtttgacattgctagaatctgaatgtttctcatttgcttttctttttgtacagaagcaccattgctccaacagtgacgggtacaggatctagttctgtgtttgtggagtcaaggcagaatatg

SEQ ID NO: 34307 - DNA, 3 bp, Unknown
  misc_feature (1)..( 3): 2750-1469P.txt file - cDNA_ID_3076662; gDNA_ID_1620780; Annot_ID_167887
gaa

SEQ ID NO: 34308 - DNA, 3003 bp, Unknown
  misc_feature (1)..( 3003): 2750-1469P.txt file - cDNA_ID_3076684; gDNA_ID_1620781; Annot_ID_167956
gtgactgttgctttttgttgtgttcatatcattttggtaaaggtaattgcatggtgatgtttcgtctttccgtgattttgtttttgttcggtagatatgacgatccaaacagtgcacaatcttcattttcgatgcttcttggcaatgctcctcatcttgatcgccaggtcagattgctaattcagcgcagactattggctttatcttaagatgactagtagtaataagattggaggtattcaacagtatgctgtgtttggtaaagttactaaaggagatgaaacattgagtaagctagaagaagttcccactcgccgcgaggggatttttgttatggtatgttttcaagaaaaccagaatttcgttagcttagtcaatagttggatttcattcaactttggtcattcttttaccatttcttttgcagccgacggagcggatcacgattttgtcgacatactattacggtaaatatagtcaaatctcaacttgtttgttagctaaaacatttttgataacatcttctcctgacgtttgatgttgaaatgggacgacacctcaattatggttaactacagtccataaagagagatgtgactctagcctgaatttctttaaaatcaggtcattcatgttgtcctaggtgataagactcaggatctagcctttttgaaagatatggttatgttttggatcatagtaaaatttgatactgacaattaagaatctttattagtactcttaattaaacaagcagagatcccttaacatggaattcattgatttagttcttataatcttgtttctcagacactaaaatggagagctgtgaagaagagagatctgtcctgaaaagaaggcttcaagcatcttttgtggaggtcgaaagacaggtgattgaaatgtctatagataacgttttgatgagaaggctcgagacacatttatcgtaacatttatggtcccttgtgttttgacagagaatgaagtgcttcccgtgaatgaagttaacacataagaaactgttcaacaaaagccttaaaacgccagggaacacaaaggtaaatgtatgtctagtaaaaaaactcagaatgctagacagtttatgagtggtttatcagtgtgagagattgtagttaacagtgtaaacagtttgagacattgaatcatggattgtttccttcactgtctgcaaaaatctgatagtcaccgggacaaaatcccaggttctgagcaccaaatagtcaaatactgaactagtgaaataagcttggagcaaatagcaacaacacatgtgctctgcttttgtgctcttctctctccaaaaaaacaaagcatgtctctcaattcacacaattagtcttttcactttcgttgacttttgtctcttccgtcatcctcacttttgtcactttcctcttaattttacattttaatgtttgtttttgagtcttaaaatccaaacattactacctcttatgcattaaaggagatgggcttgttgtgtctgttgtttagggtttataaaagactcttaataaaattgagacctcaagttttttagttagaaacctatgggtttgtgtttgggaattgtagtggtgtgacaactttaggtgaccggtgacccacatactacttgtttagcccattggttgcaacttaacaaaaatttcatatccagagttttatacaaatttaatttgtctattacaaaacataatctgacacgtgattcacatacccactttatgaatcagaatcacatcgaattcgatttctttaccaatgcatttgcggtgtcgagttgcatgaatgtactggttttttgttcacatgatcagagaaactaaccacgtgagaacatagtattatcaagctttaggcttataacaatattgctcaaatagaaaatgaggcctaagacatgcatgcatatccaagatttgttatgaaattgttattgtctaatcaactcaactaggaatacatttataaaaattaaaaaataaaaaattatgtcggtacaaaacacacaatcttttttggccaacactgtttaaacaagatgccattgaaacaaaacaatgaaattaccaagttgctcaaaatgaaagaaccaagtagcacaaaagatagaaattttataacccgtaattctttattgtttacttacaatcccacaatatcataattttttatttatttaaacaaattgacattcatttataaaaattgttttgaaatttgatgagattcaaaattaacttacatgattaattcatcaaatagttgggattcttagtttgtcgaattctatagaattgacagcttatcaaaatttggttctggtggtatgtttaaaactctttttttttttttggtttttttttttttttgttgtttttttttttttgttgtgaactgtgatcatgtagtttatttatatttttgttgaatgaatacgttcgttaatagctctatagttcgataccgtttaattatgtttaattacgggaattggggttgaatcatcaaacttgaatcttttatctaactttggaatagtgatattatttttttaattgtacaatagatcaaatcaaccaaagttttgaatttttcgaatgtcagattttgtgaagaagtaaatttatatcatctacatggatatatttaaagtgtacattcaatttcttagtgtatggacatacattttaatatgtttttttaagaaacattttaatatatttagatgtcaaattagtgtaatttaatttaatggtcagttttctctattttgcccaaaccccgaataaaagacatttgttttggggattgaactgatttttctaaggaatattggtcaaagtcacaagataattactcgactgttttgttcaatgactttatccactttgtttccaagtgtttgaataactacaagttttctacgtttatatttgttttctaacgtattaatgtattggccaaatatttatg

SEQ ID NO: 34309 - DNA, 3000 bp, Unknown; identical to SEQ ID NO: 5358
  misc_feature (1)..( 3000): 2750-1469P.txt file - cDNA_ID_3076769; gDNA_ID_1620782; Annot_ID_167992

SEQ ID NO: 34310 - DNA, 3000 bp, Unknown
  misc_feature (1)..( 3000): 2750-1469P.txt file - cDNA_ID_3076781; gDNA_ID_1620782; Annot_ID_167977
agcagactaaacaactgacggatttgtccaccccgaccaccgtcaccattcaaaccctaagaattaaaagttagttaccttgtcatctcttaacaatgcaaggcacccagagtgctcattttctataagctgttttgcaaccactaccaacaattcattttgtactttctgcatgcatccaaaaacaagaattatcagtgtttacgtatatggttgtaaccaagtcaaaatgctcacaaaaaactcttatatatacctcaactagtttgggctcagtggtagaatgaaggtagttagtgactctttccttctccaatttaagacactcttcagcctttagcatgtaatcaggacaagaatcctcctggctccaccttgaggccttgcgagaatagtaagatgcagtatcttgaagcaagaagctttcaaaatcctcttcgtatattaccatctgtccaaccccattcccacaatagacatctattacgtttttcactagtgttctatcaatctgttcgccttcacgttctttatgaatctggcaaatacaaaatagtgttagaacaactaaaccagagatcgctactcaattagagattaataacatatacacttacaagtgctagtagcacatctttggcctcggactgtatctcttgataaactaggtcgtgaaaggatgtgaagccaacatcattcagtgttggaagacctctccgagcaacatagaaacggtcaagataaaagcagaagcgagataaccatctaaccagaattttatggttagcccatctcttaacaagctctctcagcatatattcaccatgcctctccctcatagacggcaaaacctaaccaaatatgtaaaaatattagttagaccctttgctcaagtcaaagaaacaaatatgtagttgttactcacagtttctttattgtaatgatcaaccactccacgatacttattataaagctcttgtgagtaatcattaggaggttgttggagacacatatcgtagataatcctgtgagaatccacagtggttagtataagttcgtgaaaaaacaagaaacatgattataacaaaacatacgtgtacagattgatatattgaccggggtcaaacggtggctcagacaaatcttctagaatcctttgtagctttgcaacaccagtcttcatgacagaccatccttcctccaataggattaactccttcatcattatgaccttgaacaagattctacagtaaagtaatactaagacatgagatatatcaaaataactacaacagaagaggttattatcattcaaaacacaaaactaaaactaatcagactaacaacgataacaagatattacgtagccatggcgatgaatccccaagagagaaaacaaagcgcaacacaataatcactgaaagcaaattggagaatcaacaaagtacagagaagccgacgtaaaccctaactcgtttaaaaacgagtatagaaacgtgacgctaaccctaactcgttgaaaatcttaaaccctaattttgtcacgtaccagaagatttagaagactatggaatccgatttcacagggattttggagagctttgggaacctaatagagaaacagaagatgtatatatagagttggtaacccgcggtgaaatttagttattatttttttcttttaagaaaatatatacacttttttttaatccttttttaatagtcaaagtagaagaaacataaaattaacatttttaaggaagtagaaatctggaaactataataataataataattattttattatacagaaagaaactggtgtagttgcctttcctagttcctatctctcatcgattgtgagactaaaattactcaaattttagagatgcaaagcatacaaagacttaaataatcagaaactaattctttgattttttaacgcatatgaaattctagaaacgaattaaattttaaaattagaagataaacatgactaaaaagatatagaataaaataggtagatgttttttttttggtaaaagattaaattttataccatttttgatttgtgacagaattataaagataacaaaaaaaatatcaaaacaatctacagaaaataaatataacataactacttaaatagctttggatcgcttctaattggaaaaagcatagttgcgaggtaaaacaccgattccgaactcgcaaaactcggaaatttgcgtggttgccacagtacctaagcactggaatccttatcttagttgtcatgagcaattctaatcgcgatcagtccacaaaacttcgaaaaacaagcctacagcttcttcgagaactaacgcaactataggtagatgttttgaatggttattatcggttgcaacataaattccgctgagatatagagtttctctatgagtctaggccagagattcatgtctctcaagtgtctctagaattttttcacatatccgaacttggccattcgttgatacatttagtaacaaagaaagctacttcattcgtagatacatttagtaacaaagaaagctactttaaaattcatcacatatttatgtcataactaagtaatacaaatattaaaattaaacaaaataattgtaagaaaactatagagataaaaaagatcttataatttattagatcagcaatttaaaaaaataaaatttcacatcgaattgcatgtattagaaattttagtcaactatataatttattttggtcacaatttctattcatgttaatattttgtaaaagaaaaaaaatagatcactatttggaaaagaagaaacggcgtttaaagtttttgatggatgacgtgtcgcagtttcagtcgttggattaagctgagtatagattacgtaaaggggtaacatagacccaaaaagatcttctaaggtcaaacaaaatcagagatctggtctgactaaaccagacgaagaaccaatttcaacctcctcgccggcaaaaatg

SEQ ID NO: 34311 - DNA, 3003 bp, Unknown
  misc_feature (1)..( 3003): 2750-1469P.txt file - cDNA_ID_3076789; gDNA_ID_2926107; Annot_ID_196648
cggtaacaaaagttacaagtgaaagaaatcagtaattttttatttattttagaagtgaatttggtttgagacaaacacgaacaataaacttataaatctacttaattaattttctgcttgctgatgagttctaaaaatttggtgctattaaagattaaacaaatgccgattgcagatctttcacgtggttaatcaatttataaatttttaaaacaaaacaatcgaagttcaattttatttttgtcgtaatcgaagttcaattgttggatacaggtctgacgcgatcgtgataagattttatatgctatttaaaagaaatcatgtggcctggccaaacacacaagtgttattagtaaaaaactatcttcagacttgtcttatataaatacatttatttgtatcacctattatgaattgttttttctccatatatatacgttgggttatatcttatttcaagtgggtagcttatactctctctgttcctttttgtttgattgtttagaaaaaacacacatattaagaaaatatattaaatgttgattataaatgtattatttttagtgttttacagttttctataactctaaaccaatgatagttaactatttttcttgaaaattacaattcaccaatactaaccaataaatattacatagaaaacttaaaaaattaatcttttagaaacaatttttttttctaaacaatcaaacaaaaaggaacagagggagtatttaattgcatcagttacaattttgagaaactctcttactaaaaataatataaacaattaataaataagtagagagaatgacaaaaataaaaaatagtttctctgcagagaaactttggagtaatgatggaaaaactatatgtataggtatgtgtttataattggacagaaactaaattatattaaatatatattttttttttttttgaaaaacttttaaagtatatgtaaatctattggtgagatggctaagtttctcttcttctattttttccttctggatattaagatctattatctcattattatatgtttaatccaagataatcacttacctgccggaattgattctcgttatatgtaaatcatcatgttaaacagttaaaaaaattgtgatatgatcaagtcctataaaagtttgaaatgatgatcaaacccaaacaaaattaagcttacaaaaagagaaaaaaataatatataagccttatgtttaacaaaatgtttagttgatataagtcgtttttaggatctgattggtgcacattttagctgaagaaaatgactcttaacgtcagctcaaaacataccaatcaagtaaaaagacaagagaaaataactatgctagctctactcttcatataactgtaaaaagaaagagatgttttcaccaatacaataggatgaaaatacttttcttttttgtttactccatttaaaagagttacttttactctatatttattatttataccaatgaaatcagacatttatatcagtttataagaggaaataaaactttaaagaaaagagagaaacatagcttttcgccaattttcactgtgtatctgtattcaaataattagagtaaaacagaaaaaaattatacccaatcttaacataattattttcagcctttatttttcagctaagatgatttaccaatcaatttttaggtgagatagttatgatgcctaataaattggaggtgcaaagttcaacaaaaattttacttttatgtttaattgaaaaagactgcttctcagtttaagaactatggcccatttatagatactgattaaaacgtggattgtaaaatgtgggcaatcaatattattttaaaaatgtggagccatagttattaactgtgattaaatttccccctcctccactttcacgcaaactaatatttaaaacagtcttaactgtgattcaagtaataagatttttcttttattattatttgacagtacttcctccgtatcattttaagtgatattttaggaaatgtttttagaatgtagagttgtagaggaaaaactagcagaaaaacaaaaatgcaatttatatatagtacagaaggttagtttaattgtgtttcgagttaaatctcttttttgatatggaaaattattctttaaattaaaatatttaacatttgactttggataggagaagattaaaagctgaaaagctggaacttcaacacttttgagaaaagtgagctacaatagtattaatcttaccatttactgataaataaatatatactttctgttcaattttaatagttttcaaatttattcttgttgcacataaacaacataggatatataatttttttagttaggaaatatatgcttttacgtttctatgaaaattctagatatgattataatttactcttaaaatatgaaatagaaaaatggagtggaatattattatttagaaagatatatatatatatatatatatatatatttgtttgtatgcagaatgttagaccaatataattagtggacatttctataaaaaaacaaaaaattgtggaatggatgggataaaaaaaaaagagagatcaaagataacattttaagatgtttttctttctttaattttcaacaattttaggcaatttagtagtagggggaaatgtatttctatgaaaatccaaatatatgctaatgtatgcaacaaggaaagatatagtaaccaaaactccacttcatattacaaacaataattatttttataaaagtattgacttgtcgtctgcaaacgtgattacgtgaaccttactggtaataatacaaaaatcacagctctaatttgccaacccaatccagatctctctagttctcaacttctcatataattattcattaatatatttattttgagattttggttgattttttgatatataaatattggacttgccattttctattacaaccatcaaatctcaataaagcaaaacgaacaagaaaatg

SEQ ID NO: 34312 - DNA, 3003 bp, Unknown; identical to SEQ ID NO: 34311
  misc_feature (1)..( 3003): 2750-1469P.txt file - cDNA_ID_3076789; gDNA_ID_2926107; Annot_ID_138553

SEQ ID NO: 34313 - DNA, 3003 bp, Unknown
  misc_feature (1)..( 3003): 2750-1469P.txt file - cDNA_ID_3076789; gDNA_ID_1620808; Annot_ID_168931
aaagttacaagtgaaagaaatcagtaattttttatttattttagaagtgaatttggtttgagacaaacacgaacaataaacttataaatctacttaattaattttctgcttagctgaatgagtttctaaaaaaatttggttgcttattaaagattaaacaaaatgccgattgcagatctttcacgtggttaatcaatttataaatttttaaaacaaaacaatcgaagttcaattttatttttgtcgtaatcgaagttcaattgttggatacaggtctgacgcgatcgtgataagattttatatgctatttaaaagaaatcatgtggcctggccaaacacacaagtgttattagtaaaaaactatcttcagacttgttttatataaatacatttatttgtatcacctattatgaattgttttttctccatatatatacgttgggttatatcttatttcaagtgggtagcttatactctctctgttcctttttgtttgattgtttagaaaaaacacacatattaagaaaatatattaaatgttgattataaatgtattatttttagtgttttacagttttctataactctaaaccaatgatagttaactatttttcttgaaaattacaattcaccaatactaaccaataaatattacatagaaaacttaaaaaattaatcttttagaaacaatttttttttctaaacaatcaaacaaaaaggaacagagggagtatttaattgcatcagttacaattttgagaaactctcttactaaaaataatataaacaattaataaataagtagagagaatgacaaaaataaaaaatagtttctctgcagagaaactttggagtaatgatggaaaaactatatgtataggtatgtgtttataattggacagaaactaaattatattaaatatatattttttttttttttgaaaaacttttaaagtatatgtaaatctattggtgagatggctaagtttctcttcttctattttttccttctggatattaagatctattatctcattattatatgtttaatccaagataatcacttacctgccggaattgattctcgttatatgtaaatcatcatgttaaacagttaaaaaaattgtgatatgatcaagtcctataaaagtttgaaatgatgatcaaacccaaacaaaattaagcttacaaaaagagaaaaaaataatatataagccttatgtttaacaaaatgtttagttgatataagtcgtttttaggatctgattggtgcacattttagctgaagaaaatgactcttaacgtcagctcaaaacataccaatcaagtaaaaagacaagagaaaataactatgctagctctactcttcatataactgtaaaaagaaagagatgttttcaccaatacaataggatgaaaatacttttcttttttgtttactccatttaaaagagttacttttactctatatttattatttataccaatgaaatcagacatttatatcagtttataagaggaaataaaactttaaagaaaagagagaaacatagcttttcgccaattttcactgtgtatctgtattcaaataattagagtaaaacaaaaaaaaattatacccaatcttaacataattattttcagcctttatttttcagctaagatgatttaccaatcaatttttaggtgagatagttatgatgcctaataaattggaggtgcaaagttcaacaaaaattttacttttatgtttaattgaaaaagactgcttctcagtttaagaactatggcccatttatagatactgattaaaacgtggattgtaaaatgtgggcaatcaatattattttaaaaatgtggagccatagttattaactgtgattaaatttccccctcctccactttcacgcaaactaatatttaaaacagtcttaactgtgattcaagtaataagatttttcttttattattatttgacagtacttcctccgtatcattttaagtgatattttaggaaatgtttttagaatgtagagttgtagaggaaaaactagcagaaaaacaaaaatgcaatttatatatagtacagaaggttagtttaattgtgtttcgagttaaatctcttttttgatatggaaaattattctttaaattaaaatatttaacatttgactttggataggagaagattaaaagctgaaaagctggaacttcaacacttttgagaaaagtgagctacaatagtattaatcttaccatttactgataaataaatatatactttctgttcaattttaatagttttcaaatttattcttgttgcacataaacaacataggatatataatttttttagttaggaaatatatgcttttacgtttctatgaaaattctagatatgattataatttactcttaaaatatgaaatagaaaaatggagtggaatattattatttagaaagatatatatatatatatatatatatatatttgtttgtatgcagaatgttagaccaatataattagtggacatttctataaaaaaacaaaaaattgtggaatggatgggataaaaaaaaaagagagatcaaagataacattttaagatgtttttctttctttaattttcaacaattttaggcaatttagtagtagggggaaatgtatttctatgaaaatccaaatatatgctaatgtatgcaacaaggaaagatatagtaaccaaaactccacttcatattacaaacaataattatttttataaaagtattgacttgtcgtctgcaaacgtgattacgtgaaccttactggtaataatacaaaaatcacagctctaatttgccaacccaatccagatctctctagttctcaacttctcatataattattcattaatatatttattttgagattttggttgattttttgatatataaatattggacttgccattttctattacaaccatcaaatctcaataaagcaaaacgaacaagaaaatg

SEQ ID NO: 34314 - DNA, 3003 bp, Unknown; identical to SEQ ID NO: 20729
  misc_feature (1)..( 3003): 2750-1469P.txt file - cDNA_ID_3076789; gDNA_ID_1620783; Annot_ID_168050

SEQ ID NO: 34315 - DNA, 3000 bp, Unknown; identical to SEQ ID NO: 5371
  misc_feature (1)..( 3000): 2750-1469P.txt file - cDNA_ID_3076797; gDNA_ID_1620783; Annot_ID_168045

SEQ ID NO: 34316 - DNA, 3000 bp, Unknown; identical to SEQ ID NO: 5375
  misc_feature (1)..( 3000): 2750-1469P.txt file - cDNA_ID_3076811; gDNA_ID_1620783; Annot_ID_168029

SEQ ID NO: 34317 - DNA, 3003 bp, Unknown; identical to SEQ ID NO: 20736
  misc_feature (1)..( 3003): 2750-1469P.txt file - cDNA_ID_3076827; gDNA_ID_1620784; Annot_ID_168084

SEQ ID NO: 34318 - DNA, 3003 bp, Unknown; identical to SEQ ID NO: 20739
  misc_feature (1)..( 3003): 2750-1469P.txt file - cDNA_ID_3076846; gDNA_ID_1620784; Annot_ID_168075

SEQ ID NO: 34319 - DNA, 3000 bp, Unknown
  misc_feature (1)..( 3000): 2750-1469P.txt file - cDNA_ID_3076855; gDNA_ID_1620784; Annot_ID_168057
tttttttagataagtaaaatttttgcaatctttatcttgattagtatttaaaatcaattaatttatgttttaagtgtaaactaaaataaggtagaaaaaagagataaaaacaataatgtgtgatacacttaaccatgattggtactttggatccactaatttatgttttaagaaaatgatattccattataatgtttcccggaaacaaaccgtgatttgcggatgttacaacgtcaattagttcaacatggctttacttaaggcaaaagactacaaattcaaatagtgagactatacagataataatattattaaaaattaagtggattgtttttcaaatcattaacatggtacaaaaattatttaaatatatgtatatttgaaataatcacaatttttcacaaaacacaactcattgctaaccagctcatatgctaaaaaagacaactcatttctccactcttttgacaaaaacagagcaccaaacattaaacccttcaaaaacacaaatctcaccatcacacgtaaaaaaagaaaatatgtctatgcttcttcttcttcttcttcttgtcccattcattactccatcttcgcaatcttccattcgaaacctcctcgaagctcgcggtttaccaggtggtttgtttccagacaacgtggagagttatagtctagatgataagacaggagagctcgaagttcagctacaaaatccttgtttcgctcggttcgaaaacagagtatattttgatcgtgtgattaaagcaaatttaagctatggtgggcttgttggacttgaaggtttaacacaagaagagctttttctttggttacctgttaaaggcattgcagtgaatgatccttcttctggacttgttctcttcgatatcggtgttgctcataaacaaatctctcgttctctctttgaagatcctcctgtttgttatcctcctggtgagtcaaagtttgttcctcaaaacgttttagtgtttaatgccaagtgttttatttattggtaacatatatatgatcttgaacagaatatttttgtagtaataattgtatgtttttatttgtaggatctataatggagaagttagaaaaaagcaagatggatattcagctcaagagatgaatgagtttttttttttttggggttgtgtaagattcaaaactcaaacttgtctctttgaaacttgaacaaaaaatgtgtttttttctttcttcttttacctttttgttcggggttgtttgggaaaccgtggaaagtgtcgggagatatgtgtaaaatctggaaagaagggaggaaaattttggaactttgtataaattatggggtccataaagtaatcaattttgtcacttgtcaattatttttcttttctttatatagagggaatatagagtactttagatatttgtttaacttttgctttaatttttgaggaatgatgttttcgtttaatcattatcctctagcataatcattgacatagaattattctttgaatggaagctcaaagctgcatttgttaccaaacaggcaatcacagctgttaacctaaacacaactgacggattataaaattctagcactgaaatacctatttaaaactttcactcatttttacacaagaagtttaaaaaaaaaaaaaatcaggtagatatttcgggtaaaataaatactcccatttgtaccaaaataaatgatgtttaacttttttacacaaagatcagaagttattatatttttttccgaaataaaaacgtaatttatttatttatacatattcaataaatgataaaataaaatataaatagtcataaggaaaaaatataaaaattttgcatagaaaaaaaagaacacgggtcaatttcaaaccaccaattattctgatatcacagatgtcaatacgcgtcagagtgtgatatatgttagttatatgcgattttagtaacatttttggaattttcagtgttgaatatcacatgtatatcgttgatcaaattattttagtaaacatgttttcaccagttttatttgaatttatagtcatttcaccaattgattctagaatatatttaaaattcttaaatgatataaaggtagttgaaattagataacctaacattttttatgttaaccaaactttttaattaaaaataatatatttataggcacaacctattgtaaattttttaatttacatagttttaagtaaacgagataaaagaatcagttggtgatcttcaaatcggataaagtgttatgagtgtataggagattttgatacaaattgaattctttttggagtcatatattttgtctatgctcaccacagcatcggaagatcttccatcacaaaacagttcacatttgtggtggacacgagagatgaagaatctgtctcaaggtttaatcactgtggtattatatagtaaaaattttatgatgatattaaatcatgattttggctatgttaaaatttgaggtttttggttctaaggattttttttgctagatttatgttaatatctaaagtttaagaaatttgataataattatagttacgtgacataattcaaatttatgatgaactacatttactatatatagccctcgagataataatgttatacatttatttagtagatatattattagataattcaaaacttaaattacattattttgtttatatatttcatattatgttaaagtttaattgataaatgatatttttacgaaaaatttgtataatactaaagataaattttaaaaacatcaatttcgttttatttttattaatagtacataaagaaaaataaataaattaaattaatttgtgactattttggtatatgatcaatgctcgtctttttaagtagtaatcgtgtctgttacaggtgaatgaacccaacaaaaatcttcgacgagcatcttctgctttcttcatctctgaatgatcaatttctagaatcagatcggatatttcgatg

SEQ ID NO: 34320 - DNA, 3003 bp, Unknown
  misc_feature (1)..( 3003): 2750-1469P.txt file - cDNA_ID_3076862; gDNA_ID_1620784; Annot_ID_168061
gcatgaatctcattgttcgtgatcaagttttactccaacatccgaaagtgttcgtatacttgcattgtgaaaagcggtatatttcaaaactagtcgttgattcaactatatatgttgccaccatgaatatactaaacagaaaatggaagaaagctgaataagattggggactataaaatttagcatatgtgtccgataataataaaatccaaatatcgaccgacaagagcttagaggagtgtcggtgtacatatcgatgggatcgaccagaccgttagagaaaacaaccgatgggctgacaaagattcttcggatttaacttatgttgtcatacggtggctgtgacacattcttttgacgttcatttcataacttttattttatcgatatcaacctaaacgaaacaagtgttttcataaataaataaaaagttagtcacgttgcaataatgaattattatttttttcatttttggcggagtggactggtgggcttaagcaaattgatcaaatttgttttgacactttcttagtttatattaaaattaattttaattgcacgatgaaaacttactagtcagtcgcatggatctgacctaactgtctctgtatttcagtgcttcaaagctcttttaagttttaagtcaaaatgcattgtgtcgcatagagagaccattaagaaaaaaattcaattagttcttaattaatattttaataataattagataaattggggcctttatagtcttcatttgtcctcaatagccattatccaataaaatattaccagtttcatttgatatttttgtgtcatatttttaccatttaagacttttcacaattcgaatagccatgaacaataaaaatctacgagtttcatttgatatttttttttttttgccgaatacatttaagactttcacttctactaaccatgaacaatggtctcccaattacaaaatatatttttgaatcattggactaccataaatgattagtgtcttttttgtattacatgtaacgtaaaaataccattcttcaagcattcataacaattttttttttgtcaagatacataacgtaaatttgaatttcgtaataacgatactagcacaatttagcttagaatatgtccaatttttttttttattttgaaaggagatagatatataaatattatatacatggatatcggtgaaattatgtttattatctatgcctatcgtttgataaaacttgtatattttatggacggtgacacagcccggttcactatgcctcgagccgtataatgatcataaagaacagaactggttactattatcaggttcaacaaatccattttttgatattttgtgtggctatcagtctatcacataaaatggaaaaagaattaagagaaagaagaaaaacaaaacaatgacttgtaattaaagtgcaataattgattgacttatcaaatttattagaagaataaaatatttacggaatttagaaaaagctagttgaaaagaataaggaccgtttggtataaagagattgtgaaaaaagtcacaaacacaataggtccagaaacggtgacgtgacacacagatcgaaactcagcatcgatcgacgatcgtcatcatataccatttatccctttagcctcaagccacaagaacaaatcttattttatagtactatttttaaccgaaagaatccgatcgacaatgaaataaatatcgaactcatatcaagtgctaactctaggttttgccattaattttgcgttttccaatcgagctaaaaacaattgatcgtctattaaaaaaataaaaattcctatgatcgctttttcgatctaaaactaatttttagtaatagtaatacctgttaaagtataaatatccctcccaagtactgaaaactcaaacctgaacgagctagcctaggactcaacttttatctcgaaagaatctttgaatattacttttgaaaataagtgagtctaatccttgaagatatatgttttaaagttttttttagcaaatgcgattgagaaaacatatattttaacttcaagataatcattactgtatgaaagtatggataattaattagaagaaacgttgttcaaaaattggttagtcgtttataattaccaaaataataaaacaattattaatacgcttgcatagactaattagtttttttttttcctaagcttactaaagtgatctgataaaaatcatgtatggaagcatgaaagtaataaaaaaatatcaagtttcaaaattttagtctttcatatttatgtacatttatatatatacgcatgcgtagactataatcagtcattttcgtgttttgtctatacaattactaaaaactgatttaatcaaaatcgtgatatgttttctatttctgaccacttaatataaacgatcgatttgtagaatttgatggcaaccaatcaaaggttaccgttagatataatgtctatatataaatagtatccccttttggcatcttgcataatagtaccaaacacctatctaatctcaaattaaatatttaaatatttataaaatgaggatcattatcacttcttcgaaaagctaagcagcaaagaaacaaatctcacaaagacagttgttcttataataatagaagaaaattgagggattaggaacactattattacaacatctttctgtcaaataaaatatttagcttaaggaaaaaatttaaaatcaagattatttaattaaaaaaatcacataggaatgttatgatgatataagtttttgtcttcaaatgtcaactaaattccggtaatttccacacacttgtccgtacttgcctatataaacatacacaccctcataaacatatatcaaaattttacacttatgctcttcatatcacatacaacaaactcatatatataaaaactttaaccttcgtatagcaacgatctagtagaaagcttatactaaaactttctgattctcttaatatg

SEQ ID NO: 34321 - DNA, 3000 bp, Unknown; identical to SEQ ID NO: 5405
  misc_feature (1)..( 3000): 2750-1469P.txt file - cDNA_ID_3076862; gDNA_ID_1620785; Annot_ID_168098

SEQ ID NO: 34322 - DNA, 3000 bp, Unknown; identical to SEQ ID NO: 5398
  misc_feature (1)..( 3000): 2750-1469P.txt file - cDNA_ID_3076886; gDNA_ID_1620785; Annot_ID_168108

SEQ ID NO: 34323 - DNA, 3000 bp, Unknown; identical to SEQ ID NO: 5403
  misc_feature (1)..( 3000): 2750-1469P.txt file - cDNA_ID_3076890; gDNA_ID_1620785; Annot_ID_168104

SEQ ID NO: 34324 - DNA, 3003 bp, Unknown; identical to SEQ ID NO: 20746
  misc_feature (1)..( 3003): 2750-1469P.txt file - cDNA_ID_3076894; gDNA_ID_1620785; Annot_ID_168103

SEQ ID NO: 34325 - DNA, 3003 bp, Unknown
  misc_feature (1)..( 3003): 2750-1469P.txt file - cDNA_ID_3076908; gDNA_ID_1620793; Annot_ID_50482
gaattggtctgcttttcagtgaatttcaaagatattctaatgattgttaacaaaaggcttttcgattgagtgtggttttataaactgctaaggagaattttggtatcaaagttagatacccctacacggctagtgatgaagaagacaacactaagaaaaccctgtgaattgtgaaaaagatttgttacctgcattattgttccatcactatctcacaacataaaatgtgtaagaataataacaaaacgtcttgcgtctccaatctccaaagctaaccaaaaaaaacaatcagaagaagaggaggaaagaggagtagagacgccaatagatctcacggactctcacctattgttaaaataacgccaataatttgttagtacgagatctagtaatagtagttttatttaaatacaaaaccctgtgaaagagatttgttaacttcaaaattgtacttttatttaaatactaaactgcagtaatagtggaaagactgaacaagagatcaaagtaagaatcagagcttaaacgagattatgagaaatatgagaacatgagacctgcacgattgaatgatgatgagacatgaaagggtttcggttcctttttttttacataccttaaatgttgtctactttttttttttttttcaccaaattcttatattaaaattaaaaagatacatgaagattagttttcatcggacaaacccgaataacaaacccgaataacaagtttgaaaattgaaaagttgaccaaacataactcaaacatagagacactagctgaagtaagtttgataggagaccatgagacgtttcgaaactaactaacacaagcatgcccatgagagaaatcgtaaacaacacaaaaacctcgactggtaagaaaatagtcaccgtaactagtgacattaaaacgaaattcaaaccatcaaacgtggttctaggttggaaacaacgtggatttgccttagacgcagacatagagacgtcggagaagtattcggtaaacaagcttcgctgacgatgggtgagatccaaatcaaaaaatgtggtactgaatcgggagtgaaatgggcctacaggagaagtatccggcgtaagcagagggaacccggaaaagtattcggtgaactgttgagagatgaaacgggaaaaggcaaaaggttggcaaagggagagacaaatgtatcccaagacgatgaaggcagatgatgagcgttgcacaatattaaggcagaccaaaataatatgcgtacaacccaataatcttaacgagcctttacgaaatctagaagttcccaagatgggacaagcccaatttaaagtcttcttccaaaaatgtgaagtgaggatttgacctaatccaagcgaggccaagaacaagaggcggcgacagttgacggaggtgacaaggtcatcgaccacaaagattaagagagggcaaagatcactagaaagaggagacgaggagacaacaaccatcagcttcacacataagagtcgattctcgtggctggggaaggagaggagaacagattcaacaacgaagtagccgctggttcttccaataggaggtggagcatgtcgggccggtgggccaaagatcttcagaaaagagatgccaccagatctgcactcgacgagatgcaacaacgagatggaaaatgatgagaggcggaaagacgggatacaaacttgaaaatttcgggacaaaacgcgtttggattcttcgggagatgagcagagaatcaaaaagaagacaacgtccgacgccgacgagccatagctacaccagcgtcgaaagacagaagtttttgaagtgtttcgagaatagcgtctgggagagtttcaacttttatggttaatggtctttttttttattatacctcttttataaggttttttaaagatttcttttttaataagtttttttttggttttaaaaggttttaaaagttaccataaagatgactaggggtccaaacctccataagcccgcatatacatcaaggagcatttttgaaaaagatatttttataaatattttatggtaaaagacgtttttgaaaaaagtaccgtgaaaaggcatttctcaaaatattacaaacttataatcattaaataatttcttttagtattttagtaaattttattcattgacttttaataaatccatgccaccacatcaatgtgtttgctttttttgatcgattgataaagaagactcggaaaaaactctttttttttggattttccatttgcataatttttagattatccaattaatatacaaattatctgccatttggaattatacttatattaataactatcgtccaattttaaatttcatttgctctacaaacttgaaaaaaaaaacttgaatatataaccctaaaagtagagttcaaatgtgagcatccacattagttatttttttcagtgtctattgatgattatttttaaatatcaaagaataaaaaagcaaaagaaagaaatatagatgtctttaaaatgaaaattatgtttttctagaactatttgagacatctatttttgaaatgtctttacttttaatattattttatgtgaaaacatctgaaaagttgttagaatgagaatggtctaatattttcaactgcacgcttatgtaattgaaacgtcaccacagcgccaaatgctctataaataattaaatatgaaatcgtcacaacacaaagccacaacacaaagccacaaaacaatctctatcttatccatctaattttctttggtcatcactatcttatccatctctccctctctaattcatcaggacagagcataagaattgaaggtaatcctacggatctcggcttctatgatgttgcaatattgtagaagaaactctttaaattctcgaatactttaattttaactatatgtgttcttaaactaagaatcaaagtaagtgatcaaattcaaaattgtactcttttttttctgtgtaggtagcaaaatg

SEQ ID NO: 34326 - DNA, 3003 bp, Unknown
  misc_feature (1)..( 3003): 2750-1469P.txt file - cDNA_ID_3076908; gDNA_ID_1620786; Annot_ID_168156
tagcaaatgtgagaagattttcaaggcaatggatgcattttttgatcaatctataaagcatcatctagaagatgagagtattaaggatgatatcattgacttgctcctcaagatggaaaggggagagattgaacttggggagtttcaacttactcgagacaacaccaaaggaattcttttcgtaagtaatatgaacctctcactttgtaatatactttcattcttcacatgttgcataaattttaaaaatatgtactctttgattattacagaatattcttaacgctggaatagacacttctgcacaagttatgacatgggtgatgacatatttgatttcaaacccaagagttatgaagaaagcgcaagccgaggtgagagaagttataaaaaacaaagacgatatcattgaggaagatatagaacgactcgaatatctgaaaatggtagttaaagaaacgtttagggtattaccgctcgttccacttctaattccaagagaggcttcaaaagatgtaaagattggaggttatgacattccaaagaaaacatggatccatgtcaacatatgggctattcataggaatccaaacgtttggaaagatccagaagctttcatccccgagaggtttatggataaccagattgattataagggtttgaactttgagtttttgccgtttggtagcggaaggagaatgtgccctggtatagggatgggtatggctttggtacacttgactcttatcaatcttctttaccgatttgattggaagcttccggaaggaatggaggtagaagatgttgatcttgaagaatcatatggacttgtctgtcctaagaaagttccacttcagcttatcccggtccttacccaatggagttgattttatattttcatagttctaaatgtaacccttaagaagtatcctaaagttcttatccttatcactagatgagtatccacgctatgttgcgtttgtttttaatattcgtttttctaaatttcatatttatggaattatgtgtagacattagattattaaagacttatgttgagaaagttaactacaatgctaccatatgaaatgaacattaaaaaatagctgaaagaagtaatgtaaaacggttttttgaagtgttatgtgtctttacatttagcatgatgtacgtatcttatgttttttttggattgaggagaggcattatcatagttcgattatgcaatgtagcattgggagattttcaaaactgccgatatagaagccactacttcattttactgtttcgtgcaaaaacaagtacattcccagatgtcgtttacactctagctactgtatgatatcttgataatcatcaattgtcgatttacaaatgagcaatataatatgcacgagacacaacaatggttgatgactaaacttcagagaactttgaatccacttgtagttgtagagtatatttgcatattcaggaacttatatatatatatatatatatatatatatatatatatatatatgtataaactaaggaaatactacataaatatattttctttttgagtttaactacatgaataagtaaaatatttacaaaacatacctggagttattctacaatggccagtaaaaaacattaaaaaaaaacttacacaaatccaatatatttatagaaatatcttattcataaaatatcataaaaagaatagcttaaaagatactaatagaaaaacatttcaaactttaagtttatgaagttttttatttataattagttagtgtttctaaataaaaaaaatgttgaaaaaacataaactttcatatttggaacgaaacaaacataaaatttaaaatgccatgtcaaaagcaattgtttttattgttttaaatttgaaaattcatgttgttttggatattattttttcatttctaaatcattcaaggagtgtatttgattattttggtggattttagaattggtctgcttttcagtgaatttcaaagatattctaatgattgttaacaaaaggcttttcgattgagtgtggttttataaactgctaaggagaattttggtatcaaagttagatacccctacacggctagtgatgaagaagacaacactaagaaaaccctgtgaattgtgaaaaagatttgttacctgcattattgttccatcactatctcacaacataaaatgtgtaagaataataacaaaacgtcttgcgtctccaatctccaaagctaaccaaaaaaaacaatcagaagaagaggaggaaagaggagtagagacgccaatagatctcacggactctcacctattgttaaaataacgccaataatttgttagtacgagatctagtaatagtagttttatttaaatacaaaaccctgtgaaagagatttgttaacttcaaaattgtacttttatttaaatactaaactgcagtaatagtggaaagactgaacaagagatcaaagtaagaatcagagcttaaacgagattatgagaaatatgagaacatgagacctgcacgattgaatgatgatgagacatgaaagggtttcggttcctttttttttacataccttaaatgttgtctactttttttttttttttcaccaaattcttatattaaaattaaaaagatacatgaagattagttttcatcggacaaacccgaataacaaacccgaataacaagtttgaaaattgaaaagttgaccaaacataactcaaacatagagacactagctgaagtaagtttgataggagaccatgagacgtttcgaaactaactaacacaagcatgcccatgagagaaatcgtaaacaacacaaaaacctcgactggtaagaaaatagtcaccgtaactagtgacattaaaacgaaattcaaaccatcaaacgtggttctaggttggaaacaacgtggatttgccttagacgcagacatagagacgtcggagaagtattcggtaaacaagcttcgctgacgatg

SEQ ID NO: 34327 - DNA, 2835 bp, Unknown; identical to SEQ ID NO: 5489
  misc_feature (1)..( 2835): 2750-1469P.txt file - cDNA_ID_3076908; gDNA_ID_1620793; Annot_ID_168365

SEQ ID NO: 34328 - DNA, 3000 bp, Unknown
  misc_feature (1)..( 3000): 2750-1469P.txt file - cDNA_ID_3076916; gDNA_ID_1620786; Annot_ID_168151
cattctcattacgatctcttgatctataacaatgtcgcattttcaatacagttacacaattagttatctctaattgtcatgattagcttataatcgagaacaaatcgtagtggtgatttgaagttttggtttatggtttatgtagggagatgaattgaaagtgaaagtaaacaagttgacatctataaagactcagcttccatattcgtattactctcttcctttttgtcgtcctaagaagattgtggacagtactgagaatcttggtgaagttcttcgtggtgaccgaatcgaaaatgctccttattcggtttgtctctgttttgatacatttatgtatttctctttacttgactgctaacttgtggagtttggaataatgtagtttaaaatgcgtgaggcgcaaatgtgtaatgttctcggtcgtgttatgcttgatgcaaagtctgccaaagcgtttaaagagaagattgatgatgagtatcgagttaacatgtaggacattgacttttgtttaatagtagtgctctctctgttactgttctcatggtgtgcttgtgtatgtgtgtgtgttaggatccttgataatcttcctctagtggttccgatcgaaagaattgatccgggtcagggttctccttctgttgtgtatcagctaggatatcatgttggtcttaaaggccagtatgaaggggtaagtaggcttggattcttcactatttgcgttgcatgtgatagcatgattttctaaaccgttatttgcatttacagagcaaagagcaaaagtattttatgcacaatcacttggcattcactgtccggtatcatagagatatgcaaaccgatgctgcaaggattgtgggatttgaggtcaaaccatacaggtgcaatttttgttaacagattggactcttgggatctcctctattttgcagaactaaatattttatacttgatttgtagtgtcaagcatgaatacgagggacaatggagtgagaagacccgtttgactacctgtgatccccacactaagcgactggttgttagctcagctacccctcaagaagtcgaaaataagaaagaaattatcttcacatatgatgttgactttcaggcaagttcttgtttgactaatcagtttatcaccagatagttttgtcttagtgagatactattgtgttcctgttctcactgttttgatttttgcgctgatgtcttcaggaaagtgaagtgaagtgggcgtctagatgggatgcttatcttttgatgagcgacaatcaaattcactggttttctattgtcaactctcttatgatcgtcctcttcctctctggtatggtagcgatgattatgctaaggaccctttaccgtgacatttcacggtacaacgagcttgagactcaagaggaagctcaagaagagactgggtggaaactcgtccatggtgatgttttcaggcctccagccaattcagatcttctctgcgtctatgttggcacaggtgtccagtgtttaggcatggtacttgtcactatgatcttcgccatgctcggatttttatcaccttccaaccgtggaggtcttatgacagccatgctcctcctctgggtcttcatgggactctttgccggttacgcctcttcacgtctctacaaaatgttcaaaggaacagaatggaagagaattgccttcagaacagccttcttgttccctgcagtcgtctcagccatcttctttgtcctaaacgctctcatctggggacaaaaatcatccggagctgttccctttggaacaatgtttgctctgatcttcctctggtttggaatctcggtccctcttgtctttgtcggcgcttacctcggattcaagaagccaccgctcgatgaccccgtgaaaaccaacaaaatcccacgtcaaatcccggagcaagcttggtacatgaacccaattttctcaatcctcattggaggaatcttaccgttcggtgcagtcttcatcgagctcttcttcatcctcacatccatctggctcaaccagttctactacatcttcggtttcctcttcctcgtctttgtgatccttatggtcacctgcgccgagatcaccattgttctctgctacttccagctttgcagtgaagactatctctggtggtggaggtcttacctcacctcaggctcttctgcggtctatctcttcctctacgcagccttctatttcttcacaaagctccagatcactaagctcgtctcagctatgctctactttggatacatgctcatcgcctcttacgcgtttttcgtgctgaccggaacaatcgggttctacgcttgtctctggttcacaagactcatctattcctcggtaaagatcgattgattcagaaaaacattcaagagaagtacgaaagaaagaaggaaggtaatatagttaatgattttcacaagtttgtttttgctcaataggggtctcttcttgtttcgctctggttttggtttacaagtaacaaaagaaaaggttttatatgtaaaccttttctttttttagagtgtattctgtttgattttcccaaatgtcactttggattatcttccttaattgacaattatgtgattctttcatttctatttatatttttatactctcttgtaaactttactttagcattttcttgattacatcaaattctaagcactctcttcccgttaattgcgttttgcggacatcaataaattctgtctctgaccgttattaagaaaatgaaattactgtatatctaatttcttggaacctgagtctcaatggtaaggacttgacacgtttaaaataacaaccgttgggaccaacagagagtagctgcaaaacaacattcacttccaacggctagtttctcttcttcccctatataaagacccaatcaatcacaaaagagcccaaataagcaacataaaatctttctctttatctctatatagctcatacacaaacttcattctaatg

SEQ ID NO: 34329 - DNA, 3003 bp, Unknown
  misc_feature (1)..( 3003): 2750-1469P.txt file - cDNA_ID_3076918; gDNA_ID_1620786; Annot_ID_168150
catccaagaacatcccactttgttacttacagcgagagccagacatttcgacggagaggtgtcataagactactcaagtccaatacaaataaaaattcaaaacagaattgccataacgagccaagtttacaatttttaaattacaatgactagtaagacaacaatgtttacctaccaaatcaacagtttgatctaaagtaaacagagaaacaaagaaagtatattccaacaaaaaaaagttcctggtgtttctatcctcgtaacattttgaatagaataagctttctctcttttctttgaacaaccaaatcgatcaacacatggatcccaaaaacaaccaaacaaaaaccatatacgtggactgcgttatggagcttaatgttgttgatagatttacaaaaccaaccattcggttcttttccttgatgattcaggacattcctgtagtccctaggattgaacctgaagcagtttcagagttaagatggaacagattccaccagttcttgtaattttttcagaccaacggtggctatgagttccatcgagacaaaaacttcattagattttgctttctcttcttcctcttcctcttctttgagaccgcctgtgagtttaagcttctctgcctcggattctgcttcttgcgcttcctcaagtagaagattagcttcttcaaggtcgctcagttccagagcagctgatctctcagcttttgcagttccactgtcaatccgcaacctctggaatctactaatagccaattctttttctttcgacaaaatcaacttctctatctcttgtagcctcttgatggtttcttcaatctcatgctctgctttttcgagctcagcgttagcttttcctgtttccatctgtgtcttatccttttctaaatttaaagacttggcttctgcagctattcttccagcttctttaaaatttctcgttgatgcagccactttcttctctgcttcaagctccggcatccttttctctatgaacataattttatccatgaaagatgtaatgttctgttggatgatcgactttttagaagatcgctccttaagtaactctcgggtactggaaacctcctcttgtagcttctgtacttcctcagaaagcttctcttcgatatttacaagcttagctctctcttctctagttttagacacatatgacatcaaacctttccgcaatttaataacttcctcatattcacaagcttcatccgctgaaacacgggcaagatcacgaagtttggctcctctctccttctcagatgtcatgaactcgtccacgtctttcttcttccttgataaatcttcagtttccttgtcaacctcagtgagaccagcttgcacatcgtttaacattttatccatacttgtttgcaattccttgaagccagtcaccacattgttaattctttcctcaactgcctctatttgcgaatcgttctcgtcaatctccttctcctttgccttcaccaaagcaagcagctcctcaagttcatttgccaaatgttctttcttcttctgcagtatctccttctctttcatatcttgttcaacagatccctcaagaataccattcaacgacaaccgaacgttatcaacaacaacagattctatatccaattcgacttttctaacctcaacatcttcagaacatgaatgccatttctccatttcatctgaataaaaagcttctgctttctccagaatcgatccagcatcattctcagcatccgtgccaaaactacgaagcagacaggcagattcttcttcagctgcaatctgagaaagaagaacctcttccattttcgactcaatagcatcgcaatcagattccgcttggcgaagcaatgccaacaatgctagcctatctctttccttagcagcgaggctttcgctaatcctctcagccgcatcgaaatcctctgtctcgatcgcttcctcaagctgcttctcgagctcttcgtgcgtcgtagaagctaatctgagattctcagatgcttgccttttcttcctaatcgcattcttacgagcagaagtaaccgaagcagccaaatcacgagaacgatttagcttcgcttcgatctgagccttaactaactccaaccttgagctaccattaccaacaaccacagtaacaacaggagagtctaaagattgattaccggaatcaaacacttgcgcgacggaatcagatatttgactaactgaatctgatacttgactaacggaatcggattgttgactaacggcatcatcttcgtcttcgtcgagattgttggtttcgtgcctaccgtatccaattcttaatccagccgctctcttcttcctccgtgacacctgacgtccataattcttcgccggagattgatgagtagtgataactgcctccatcggctcaggttggtgttgaaccggagtcacaatcgttaagtctgaaaacagattctcgtccaaagcctccgtaatatctggctgagaagtagccgtgatcagtgtcgcctccgtcacatctggttgagaaggagccgtgatcagtgtcgcctccgccgccttggtttcttcagattgaggcggtgagcttaccttgctgtcaccggagaactgagacgccggtgtaaaaagctccatcccttcgaacagggaatccatatcgtcgccaccatccatcgccgccgatctgatcaatcaccgatctgatctacatttgagtttgaaaccttttaataattcataaaaataaattcactagtttaatgggccttaaatgtttgacttgtcttgggcctattaacggcccatatttgataatgctgacgtcactctttcccgattgtgttagcgcctcttcatctccataaagataaaaatttcaacacttgtcggcgactcagagaatctaaccggaaacctaatctctttacctctgagtctatctacgccggatttttcaattttcaaattctcgattcgattgaagatg

SEQ ID NO: 34330 - DNA, 3003 bp, Unknown
  misc_feature (1)..( 3003): 2750-1469P.txt file - cDNA_ID_3076928; gDNA_ID_1620843; Annot_ID_170107
cggctgcatttctcgagactatctcaccggactgcattgtcaggtactaacttagttttgggtggaatcatattgaaagtgactttatggatggaattattcggaccgttgtagaattagggctaaatacctctatgacggattcaagggataataaatgttaaggaaagtgatttgcactacatgattttccaaacctatgagattcatatgagatgagagatgcgagaaataatggagagatgtgttgagtcatatattttatttcatctgttaagaaaaattgaaaaaagttttaaaaaaaactaaaactttatgttctatttctaaaatcaaaaaaattgaaccgttatccggcatcacgggtcaaagaaaagtttttatggacgtgaaaacactgactaacacaaaacaatcgtaggttgtgttggggtacaatgggttttaccactagtagctaattactacccatgttggttctcttgattcgaaatgttttttcctgttgtggatctgttgggctctttgcggctttgcctattagatttagacgtttcggctttgtaaaattttctttcttatgcaaccaatagcaaatcttttaagaaaaaaaaaaaaaaaaaaacccgtaattaatatcgtaagtttgactttatttgcttatatgccagcgtcaaatccgattgagcacgtataacaatatccaaacaaaaactaataccattatttatacatacatgttgcatcacgatgaaataaacaccttaatggcagtttaaaagtttgtgtgtatcaccagatctgttaccaacacgtaaatctattacgagatctattacgacttacaagagagaaacaaattgtttaataattcaagttggattgctttcaagtagttaaagtgagttgtggaaataaaagaggattgtttaatggttcctcggtaggaggcaacacataaatatatatcacgagtgagagaaactggatttttttatgttcaaagaaagaaatggaaatgataatcatctctctctgcctagcaacaatcctagcccttcttctcctaaaacaatttctgaatcgaacgtacactgccaaagtcaacctaccaccgtctccgtggcgagttccggtaatcggaaacctccatcagctaagcctccaccctcaccgctcccttcgttcccttagccaccgctacggtccactcatgctccttcattttggccgtgtcccggtcctcgtagtctcttcctctgacgtagctcatgacctcatgaaaacacacgaccttaaggttgcgaaccgcccgcaattaaaagtggtggagaaaattttcaacggtgggcgagaaatggttttctccccttacggagaatattggaggcagattaaggtattattttttttgttttgaaaagtcatttattttttatacaataatactttcctatatatatatatattttttttttcgaaatttaggaagggttattggtttatagatttatctatatatacattttttcagccattttagcaaataaatcctaaaatttgacttatttacaactcaatgctattagcattaaatctttttctaaaataattatattttttaaaattcttaatttaaattgtcaatcacattatcaatcaaatttaatccaaacaaacttcacatcaatcccttaaaattagcataaacgtattttgttaacaatattttaaaacaaagttttttgtttaaataaatattgttcttactaaatgttttttgtttaaataaataaatcatgtatttgaacttatttacaaagtcatgctactgaaattaattatttaggaatgaaaatatttaattaaagatttaaatcgtctaaattctttgcttttagagttattatgtcattacctaaaaaataaaaaatattataatttttaaatgttataatttatatatttcaactttataaaactttattaatatttaaacttataaaaagtttaatatatcaaaaaaatttaacatcattatataatatatagagttgtttttttacgtcatattttacggttcgaaattttaaaaatgaacatatattaaccacttggcgaaaaatatgtgggttcaacgtcccgcatcgattaaaatatttagacaatgattcataaacatatcataaataagattaacattaataaaataaatagttttttttgtggacgggtttggcgggacgggtttgacaagacgttacttaataacaattgtaaactataaagtaaaaatattttatagataaatacaatttgcaagtttttatatatactaactttaaaaaatgaattgtccctgcggtgtaccgcgggttaaaatctagtaaggaattgaaaatccaaacaaaaatcatttgttatttaatcattgattttaaaattctaattaaaaccatgtgttattgattcgatgatttataaatactagttaaaatcctttgttattcgtgtagtcatttgtttttggatttgggaatccaaattatgttttaaatggaattgaatggatttgaaagagaaaaatagaaggattcaaatccatgagtaaacacatgttatttcaaaatcaatatatcttgatttcataattaatagagattttcaaattctatatagatttacaaatcaataaaccaataacaccttagtttctgtttagctctcttgatttgctatatgtgcctacaacataaatatgaaagttcagatttgatttagtttacatgagcttgatagttacttggtgaagaaaaagaaaaatatctatttaatatttgagtcatgtgatctatataaattgaaactagaatatgattaattaactgatgaaaatatcaactctgtcttgtgaggaagagtgtatgcatcgtcaatctactcaataaaaaaaaggtacaatcctttgaaaaggtaagagaagaggagataagtgaaatgatg

SEQ ID NO: 34331 - DNA, 3000 bp, Unknown; identical to SEQ ID NO: 5409
  misc_feature (1)..( 3000): 2750-1469P.txt file - cDNA_ID_3076928; gDNA_ID_1620786; Annot_ID_168138

SEQ ID NO: 34332 - DNA, 3000 bp, Unknown; identical to SEQ ID NO: 5428
  misc_feature (1)..( 3000): 2750-1469P.txt file - cDNA_ID_3076986; gDNA_ID_1620788; Annot_ID_168212

SEQ ID NO: 34333 - DNA, 2104 bp, Unknown
  misc_feature (1)..( 2104): 2750-1469P.txt file - cDNA_ID_3077011; gDNA_ID_1620788; Annot_ID_168191
gaattcaggaagctgctatatagtatttttaaaatcctaaatcagcaatgaatttagcaacttttatatttttagatctgggttgttaacatagaatagaaactgcagagcaaaagctaaatataaattctaatcgttttctatattttgtttgtaaggaaacattttggtgtcaagaaagtactcgttactttggaacaaagaaaacaatacccataaatataagataaggtttgagaatgtgagaatcgaggtggaatacaacagaagaagcacaatctcacgtggaacttaggcgtgaagatcctcttcctagaaatagtaagccaccaatttagaatctttctcactttcttattgtttataaaaaaaatgtcttcaaaaagtctttttggttttagcttttttcagcacatttagtccctttttcttgaaatcttagtatgcattgattaatctatatatggttttaaaataacagtttcagtttcattgaactatattcaggtcaatatctagtgtagttacaattgattagaaaagtgcatgcataattttgttttaaaaacttataattcaatgaacacatataatgtacattcatttcgaccaaagtaataaactcactaaaccaactgaaatgttaatgagcttaggcttactactttgttcttaacttaaatatcgaaacccattagcattatgggccttaataagattcatggcccaatgatctttttgcttcatcttctgctttcttctacgacaacctaactcatccacttcttctcctttcacaactcttcttctcttctttacccctataaattttacatattagtttatttttaatgtaaatttgattgaatttgaaaaaatacttggttaaaattagggtttgacccctataaatttgttctaacttccaaatgacccctttagttgatataactttttaatttatcgtccatcataaatttttttgtttatttgaccgctataaaacttgtttgtagatccgccactggtatatacatacattttaatggagctgtgagaatacttttgaggttcaactctcgttacaataccttttgtgaccgatatggtatcaccacctgtatttgcgcataacataactataataactcattttctttaagtgaatcatggttgctattcttttctcaataccacatatgtcaaagcttttttcttgccagctaatttgtactcagtgcgaaaaaaatttagcattgttcaagacgtaccacgaggataacctaaagcgtagacagtttcaccgataaaaggtatgcctccgagctccaaaggatttatatcctcccaaaactcttcactatcaatacctaagatagctaagtcacatccatacctaaacgctttaacttcagctttgtatttagtgggtgaaccatgttttctcacttgcaggtataagtgatcacccacaacatgagcgtttgtaagaatcctcctcccggagattgcaaatcctaacatagatattccaaagccgaacaataccatacgattttttaaaatttggaagtctaataaagaaatcacacgagagagagagaaagagagatgtttatgaataccagagcttgagtattctttctcagttgtttgccaaggttgaacaacatttggctctctagaaaaggagaagatcttcaccaccgcgtctcgagccacatcaacatcgctcacagaagaacaacaacgagatatcaaagaagcattaaaagacgaacgacgacgaagaagggaaggagaatagaaaaatcgatgaatcggagtgctcgtggagttgctgaacctagccacaatatgatgaacagaccggaacaacatgttcttgttaagtactatgtttactcgtattaacgatacataaatatatcatttacttgatactcatattttcgatccataataattacactacaaatctttttaaagattttaatggaaattgttaacattttaatataaggcttttatataatcaaatgaaactatagattctggtagcacataattaatctgttaagctctctcttttttttttactatg

SEQ ID NO: 34334 - DNA, 3003 bp, Unknown; identical to SEQ ID NO: 20755
  misc_feature (1)..( 3003): 2750-1469P.txt file - cDNA_ID_3077043; gDNA_ID_1620790; Annot_ID_168256

SEQ ID NO: 34335 - DNA, 3000 bp, Unknown; identical to SEQ ID NO: 5447
  misc_feature (1)..( 3000): 2750-1469P.txt file - cDNA_ID_3077049; gDNA_ID_1620790; Annot_ID_168246

SEQ ID NO: 34336 - DNA, 3003 bp, Unknown; identical to SEQ ID NO: 16902
  misc_feature (1)..( 3003): 2750-1469P.txt file - cDNA_ID_3077053; gDNA_ID_1620790; Annot_ID_168241

SEQ ID NO: 34337 - DNA, 3003 bp, Unknown
  misc_feature (1)..( 3003): 2750-1469P.txt file - cDNA_ID_3077073; gDNA_ID_1620791; Annot_ID_168310
aaattgatattgtttatttttgtgatactatgtaagtgctgcaatcaaccatttttcttgtattgtatgaaaatgatttgcctaaaatcatatatcagctaatcaaagagatagatgcatatgtgctaattaattaaacaatacatatgaaattatacctcttatataaaaccatcgacaaagagttgtgatgaatgatgatttctgtatattaatgatttttggtgaaacatataaatgattttataaatatgaatggtttgcaatacaatatgcttttatgaattatagtcgtgataaataaagtaaaagcatatctgagacactaacatatacgatatagtctagaatgtggtaaaagtttttattatccttagcttaacatggccatgcatattattgtgagatgaccacctcatgcgtatgaggtagatagatgaagaattggtaaaaatctatgaattgattttacatgactaacttgaacttgggtgcaacactaatctagatcttggtccaatatacgttctactaaatgagaaacaaaacattaaaacatttgaaacacataatttacaagcaagaggaaaataaaatgttggtaacctaaaccacccaaccttgtgtcaacgactcaacgtacacaaatacaattcctcttggctttaatctattatattacacattcctaagacaataataaatattttctttaaaacggaaacagaccgaccaaataaacgaaataataaatctcatacaatgcgatccatttgctatggcctcttgtgacgtatttgaagttcatttaacacagacggtagaaatttattgtcttcttcatggcttacctaatactattttaaaatagatatctttcattgcttaacaaatttataccattcttcttttattcggcacaaatctatgttttgctatcatttgctttgttcggatacaaatgtaaaagagatagttatgtagtaaactaaatgtagtaaacttttaaataagaaaattatgaaataaactcaaatcagcattttcttgatactttctaatagtcttaaatatacacaagaacaaaacataagtatataaccataaattgaagttagctaaagagaacataaatctaaagatggtaaaggaataatatttcttgatttggcctgcgaatatattgagaaaaaagtttccaacaagttaaatgtatcttatataaagcattaagaatggtatatattaatttaaatataacctagaaaaactatgcaaaagatttgtttgggtttgaagattatccacttaaatttggcaattaaattcaagaaactattggtaaattatatatgccaaaaactaaactggcaaaaaatattgaaatctccggagataaccgaaaaacctaagttttatcgattaaatctaatcatattctctagattttctctgaaattaaaaattattctgatgtctataaaaaatcacaaattccatataaaatttcctgtaatcatatatttttggtttggttaaaatttttttttttccaaaacttgaaataaaactttgtataataatactatgcaatagatttgttcgggttagaagattatccatctaaatttagcaactaaattcaaaaaacaattgataacataatatatctctgtaaactatatatgccaacataaaaaatatttttttctgcaaaataaactggcaaaaattattgaaatcttcgaaaatgaccgaaaaaccgaagttttatcgattaaatcttgtcatattctctagatcttctctctgaaataaaaattgttttgatgtctataaaaaatcacaaattccatataaaatttctacagtattcaattttttttttgttttggtaaataaaaaaacttggttctaaaactggaaataaaacttgaaataaaactttgtataatactacaatgagaagcattgggaaataatatagcggaaaaaacaagagtggggggatgaaatgaggtagctgaggaacaagtacggcgcctcctaacaaaaagggatcgaaaaaaaacaatggaggtgtggagtgtggcggaggcagagaccacgtgctctctcttctcttcttctccttcatcttcttcctctcttcatcatctcccattattaactcttctgaccccactttccttctcctcttctaactccaacctaccctcttctctcttccctctcttaaaaccctttctctctccctcattctcttccatgtcctcctctctgttattctttagctaaacacccacaattctggccttctctgatgcctctttaagccaatttgtatctctgcttccttacaaggtttaaagttttctgcttttgctgattttgttatttgggtgttttaaagttttgatttttatggtttagcaatcggaatttggacttgtttttgtgattttttacttgttgttggagttgggttttgttgagtttttgttatttgggtgttttaaagttttgatttttatggtttagcaatgagaattttgcacttgtttttgtgattttaacttgttgttgaagttgggttttgttgagttttcgacttcaatattgtagaattttagtgggtttggggagtttataatcattagttctgagatctctcagatttctaaaggaactcattattattgggtaatgatgctttcttacttgcaagatctttgcttatgattgcgttttgctttttctatactctttttttcttcatgtgattacgcaaaagcattgctgtcatctttgttaattccaccttgtaatctgaagcatctttgtttgttagattaagcaaccagattaggaattgttttaatattcctgttatgttctttcaagtcattttggtagatagcatcagtttctttgtaaagtgattcagtatgtgtttatggctgttttgtagatatatctgaagcttaaagggcagtgacaatg

SEQ ID NO: 34338 - DNA, 3000 bp, Unknown; identical to SEQ ID NO: 5465
  misc_feature (1)..( 3000): 2750-1469P.txt file - cDNA_ID_3077087; gDNA_ID_1620791; Annot_ID_168303

SEQ ID NO: 34339 - DNA, 2359 bp, Unknown; identical to SEQ ID NO: 14249
  misc_feature (1)..( 2359): 2750-1469P.txt file - cDNA_ID_3077109; gDNA_ID_2684093; Annot_ID_190035

SEQ ID NO: 34340 - DNA, 3000 bp, Unknown; identical to SEQ ID NO: 5462
  misc_feature (1)..( 3000): 2750-1469P.txt file - cDNA_ID_3077109; gDNA_ID_1620791; Annot_ID_168287

SEQ ID NO: 34341 - DNA, 3000 bp, Unknown; identical to SEQ ID NO: 5470
  misc_feature (1)..( 3000): 2750-1469P.txt file - cDNA_ID_3077139; gDNA_ID_1620792; Annot_ID_168342

SEQ ID NO: 34342 - DNA, 3003 bp, Unknown
  misc_feature (1)..( 3003): 2750-1469P.txt file - cDNA_ID_3077164; gDNA_ID_1620792; Annot_ID_168320
ttagccattttgacacccctacatattgtatacaagtctaacttacaataataattgtagagtctattttctacagcgagtttgctaacacaatactattatcaaataccttcgattatgaaaaaaaaacattacttataataatattaaaacgtaaagttttaaaattaaactattcttgatatttttgcaatatagtttttcttctttggatttattatatgttacgtaatcgttgaagctttttttttttgaatggtgacaaaaatatcaattttcaatcaaccaaaaatgaaaatatcaatttccattataactttcaaaaagttttgagttccacagtacctatttatatacattcttcgtaaatgtcaaaacaaatcattgtagtcacacttcaacgtctttcactgaattataatcgatttgtggctatgtaaaacaatattaaaacagctgactaaaccgaaaataaaaccttacctattttgtgtatacttttttaaacaaaaaaaataatttgaaaactatgactaagggtccgaatagtgactgcgttttgtggtgtgggagaagtgtggtgcggttcaaatagtaacgaaaatacatatatatatatatatatatatatatatagaaattttgatactgttacaatactgttgcagtgcggttttgtgtacggtctatatcaccatttatagcctaatttaagtgataaaaaaccagaaaagatggcggctaaaaagctagaaaaagagtgactgtaaaaaaatttattttcacatatagattttagcaagaagactgcgacccaaatctaaacaggctgacacataattgtgttgaagtcacgctccctcacagctgggaacattatcattcatcaccaccatgtgcatttatgtgctcatcatcaatttttacattttatatcgtcaagtaaacattattaataagaaaataatgaattatctagttaattatacaaaaatacagtaagttgttttgttcaaagtcagcaaagtcgaacccatatttggctgcggaaacttcatgcgtttttgtcgcaattgccacataacgttggaagattatttcatagtcaatggacgaagttggaagttaatttgtaaaattttaccaagagcaacgaaaactataatatgtcggtaaaggcaatgatttgtaatgacaacttccacatatattgcatagtcatatattaggttacatcaaattttgtaatgactatggaactatggcgtgactaatccgttgttggacacgtacaaatgaacaaaatttggaggatagtcatatatgatataaaaaaaaaagattgttgccaatatgatacatttcactggatttatagattgtgacatccttttaccgacttatgaactacatatttttgtattttgttgtatcagtatgttaggggtcctacgttgacaacaaaatattttcatacgtctaacaaagcaaaaaatgtatttataatatgtaaacacgtcgatggttcgccgacctttcaaaccgaaagaagttgatagcactattatgaagaccgattaattaagtttgaatcggaatttgaattctaaaaagccggtttatttaaatgattaaaatgcaacctacgtcgtacttagttgattatagtttaatatgtttatggtagtcacaaaaattgtctaattagtcgcatttttatgaattcttttttctttccttgttggacaagggatgcttaactattattattcgtagggttttatgttcagagacaatgtttccaaacgattcatctacatttgacagtagaaaatcaaaatatcacaacaaaacgtgtgctttttgctttgtagctagactgtgaattagcattttcttaagttttattaattttaaaactgtgaaaggaagctaaaagtctaaaaccatatgccaccaaaatgatcctattataacttactgaatttaaacatgcattataaaccataattttgtaattgatctaaaaataaaataataattattcctctttgaagttgttacgttttggttttggtttctttatgttaaatttgatttgcttctcgaagtttgaagacaacttttacctctaaaatgactcttaaattctatgttttttgttgaaaaatatagtttgattccaattaaagtttagatatattgcgatgtattttaaatctagttatgattgatattaattttttgaatctagttatggttgatattattttactaagtacattattatcatttctttttacaaactgtattccgacacttaattttcacggtatgttttataagagaaaatatccgcaaaacatattacagagtagaataaatcctttctcctttatatttatattatttaatacttaactctatcaaaatatcctcaacatttataaatatgaaaaacaaaatcagtagtcagtgaacataaaaaaaattatcgaaaattttacgatgagtaaagatcctctctttatttctcaagtaaagcaataatcagaaaaagctaaattgagttatcaaaagcagtttatctaacaaatgttaattaactttttctggtttaatattattgttcactaaccatgcataatcgtataacaacaaaaataatctcattggtaccattacatcaaataataaatagcgggaagataaacatagaaaaagtgataaaacaatctgcttcaagaaaaagataccccagtggacgactagggtcaatgaaaatgaaaacagagacaaatggcaattcgtaattattcacatttatttcagggtactttcgtaaatccccaacctgaccgtttctcgaatctgattacgtggcagtcatcacaaatgcccacaaaagcacttcgctgaaactcaatctcagtcgttagatcagaatccaattcttttcaatacggcaagttgagatccccaaacccatcatgtgtaaccatg

SEQ ID NO: 34343 - DNA, 3003 bp, Unknown; identical to SEQ ID NO: 34342
  misc_feature (1)..( 3003): 2750-1469P.txt file - cDNA_ID_3077180; gDNA_ID_1620793; Annot_ID_168391

SEQ ID NO: 34344 - DNA, 3000 bp, Unknown; identical to SEQ ID NO: 5467
  misc_feature (1)..( 3000): 2750-1469P.txt file - cDNA_ID_3077184; gDNA_ID_1620792; Annot_ID_168315

SEQ ID NO: 34345 - DNA, 3000 bp, Unknown; identical to SEQ ID NO: 5467
  misc_feature (1)..( 3000): 2750-1469P.txt file - cDNA_ID_3077184; gDNA_ID_1620793; Annot_ID_168388

SEQ ID NO: 34346 - DNA, 3000 bp, Unknown; identical to SEQ ID NO: 5480
  misc_feature (1)..( 3000): 2750-1469P.txt file - cDNA_ID_3077188; gDNA_ID_1620793; Annot_ID_168387

SEQ ID NO: 34347 - DNA, 3003 bp, Unknown
  misc_feature (1)..( 3003): 2750-1469P.txt file - cDNA_ID_3077200; gDNA_ID_1620793; Annot_ID_168380
catcaggacctggtgaactttcagcattaatggaaaagacagcattatagatttcttgttctgtaattttctgagtgagatcatgattcatatcttgtgtaactttcgtttgaaaaccttccaagactgaatccatatttgcaggataagaagaggtgaacagatcctcaaaaaactgttctgctatttttcctttttccttattgagagtgtgctcaataccattttcatccaccagaaaactcaagcagtttttaattctattagcttttacagaggcctgaaaaaacttagaattcttatccccaccagccatccatttatccctacttttcaatctccagaaagattcctcctctctaaaggcaatacccaactgattttgaataacagaaatcttgttccaacacggaaattggtaactcttttcttcatccaattcaaaccttaatctcttaattcgattctcagcattataatccttcccttttttccaatgactaatagatttcctacagtcaaccagtcgatgcatagaagaagaattatgagaagaaatattacctatccatgctttgtgaataacgtcttggtattgagggtcttcagcaaatcttttatcaaatctaaaagttcctcggaaaagctcctgatcattgacaaatttcaccaaaaccggtctgtgatctgatccaagcttctccaaaaaccattgatgtgaattaggaaacaaagaaaaccactgtgaatttccaaaacagcgatctaatttacattgaatccattctccatttcttttccctccccaagtgaaactattcccagttctgcccagttcatgcatatcacaggttgataacatattcttgaagtcctgaaaggaggattctactctagatgggccacctatcttctccttattagacaagatatcattaaaatcccctatcagactccaagctgccattcgattcacaccaatgttactgattttatccagaagcaagtgtctgagattctgccttggattaccataaacacaagagataaaccatctcttacatccttgagatatttccaaatccagcaaatttttgtcttcataaagaaactctatatgaagatgttgtttccaaaatattgataatccaccactctttccttccggttcaatagtatgaaagtaatcataacccaaccacctaaaaactttcaaaataaacaggtcagaattcatggtctccatgaggaacaagatgtcagggaaatattcctttttcatttctctcaagtgccgaattgtccaagggttcctcagtccttggcaattccaactaaggatgccttattgatactgcggtggttcttgaggaaccaccgtaatgagagactttactgtactatcagatctttccgagtctgcaattttcttattccttttgatagcagaagcaaactcaatattaagactaacctctttctcttttataccagcgaaagaatcttgcctcttgtgaactaaaggagcttttctttttcttggattcttctgcttaatacttaatccagatgaaccagactcattaaacccaaagaggaatcctttagatgtaggatagtccagattaccagaaggatgactagatctttttggatcaccagtctcatggtttggaatatcatttacctccggcaatattgaatattcttggtgagtggagatagacgataactttgtaggaacaatcatctctcctggtttcagtaagcatttctttccaaaaagaaaacctgagtctacactcctatgatcttcctctgaatctctagtgtttcctacagtagcaaaggggcaaacacttttctcatgagtgagacgttgacaaaggaaacatcttttccgaatcctttcaaaatcaaaagacactgatatcatttcacccgatgggagcagaacttccttaaagttacgcaaaggatttcgaacatcaaggagcacctgaaccctaatatagtcttgtgcttgagatttttccaaatctagttccacagtcatcactttcccaacacaacctacgatttctttgatagtatcttctgtgtagtagtttatcgggatatttctgagtcgaatccaaactggaagaaacaagagtgaatcaacagaaggtttttccacccaacgctccatcaagacacatcactcatcctgagtccatactccagtttttaagatttcaattaaatcatcttctgatttgaaaaagaattgaaatctctcttgggataaagcaacacctcttacccttgaatacaatctccaaattctaggcatgtctaatatccaattagacatcctttggtgagacggattcaaaaacctgcccactatactgcagttatttctttcaatggagcaaaactgtgcttgattagacaatatcagagggctatcatcgttaattgacatttcttttatcgcttgatctaaatccatggtcatctccactactagaagaagaaagtactttcctgatacaaaaacttgatgaaacagctatgccgacagaaaacggggatatcttcggttcttggctcctctcaattatcaaaggaatgatgttgagggagaagttcttatgcccaaagcaaacgggacggcttaattaacggcaagggagaagttcttcaatagagctactatgaaagagaagagagaaaacctcttgttttttaccgagggaaatctaaacaagtcaaaatttgaataagactaaagtattaattgcttctgtcccacttaattctcccacatcttcacacgtactaatatattatacatatatatcaactaaataaaaatatcacaaataaagaactaaaacaaataaaaacgaactttaataaaatcccatatcttgtttctctctctctctcaaagttagtatctcagtacctttacgctttgtttgtctctatcttcttcctgatattcagagaatg

SEQ ID NO: 34348 - DNA, 3000 bp, Unknown; identical to SEQ ID NO: 5486
  misc_feature (1)..( 3000): 2750-1469P.txt file - cDNA_ID_3077207; gDNA_ID_1620793; Annot_ID_168376

SEQ ID NO: 34349 - DNA, 3003 bp, Unknown
  misc_feature (1)..( 3003): 2750-1469P.txt file - cDNA_ID_3077249; gDNA_ID_2926140; Annot_ID_197449
agtaatcaagatgtatttattaactactagagaaaatatttgggctacgcccgggtaattttgataattgatatagtattttaaagttagataacatagtttttgtttaataacatttcttattttttatatgctaagaaatagttttgttctatcctgtgttttcttagatcatatggaataatttcaactcttatgagattggtatatagtttgatacctagcatcgtaggtaggcgactatcatattattttatatagtaatattaagcacattttcgtaactttgtggaatagtttagcaaaagaatattgatcagtatggttttctacgtgaaagattcataatctcaaactgttaagttccagcagaagtggtgtatatgccatcatgctttgatgataagaattagaaggtacgtggtgaagttatacgtccgtttaatatatgcattttttgttaaaagttatgtctgtttaattatgattggtaactatagcttaagatttgaagtttactaaaatctgtgaatgacagcaaaaatttgtaaattattattgaatgatcatttagtgtaaatattttgctggatggccctctctcttctccggacaacatttttatatctatttaaaacttaatttttaagaaagagctcaatattagaaggacacagttgggcaaaaatttagagtcatagcacaaaactactaatacaatggcaaagagaaagtgaagatagggctagaaagtgaaaatattgctggccttattgatgcttatctaaactcatatattttctttgttttcttttccattcctttaattttacctcattacctcatatatttgaactatatattgtgttttccattttaaaaagtagaagacatgggaagagaagaagatagaagttagatagctggatcttcgagttttctttcacctgatttggtatctaggaaaatgttgttctcaagaagatggaagattgtaacagtttggtgagaagcctggaatttggatgatgtagatgattcacctctcgataatcacatattctacatgtagaatggccaaaagatgattatattaactattaagaaaacatattgaccttaacgtatgtagatatatctctaagaaattatgtaaatcatgagaagtaacacttactttgtcgaagtcgtcggagaaacttaaaaccaattataatcttttttcttggaatctctttctttttttctggtaatagaccaagatgtaggttcgcttcaaggaaaaaatcatctttaaaggttcgcttcaaggacgtctttttcacaccataccctctacttattttgtcttctcctcgtcttgtataaactccacactcatctttgatactattgatttggataccctagtttacaggaaaagttgattgtaaaaggaatactaactttgacgcgcaaacacaaaccaaaatatcttcattatagaataatggaacaaacttgattgcaaaagtttattgaaaaatagaatctatcattacaaatttgtttacagaaggatacgaagagatcagttagatttggttacgactcttcgattttggtatgccacatgacttttgttgagaataagaaaattatggtagaaaaataagaaaattatggtagaaataacgattttttatgtgtccaaatgaaatgaatcaagtctctatttatagagtttaaaaagttataaactttatataaatatatgttttaaaaaattttgtttggtatgcaataaatgattgtaaatagataaaagaaaataaaaatctcccaaaatctcaatatccaataaaaatatagcaagtgtcaacatcttaataatctctttttttcaaggaaaaaaaagttttggacaatacactctcattttcttgagtttgaaacacacattccactcacttattgacacgtggcatacacatgcccaaaatttatcttttcaacatgttgaatagtttcaaccaagttgaatccacgtaagattttttaattattcggcaggtgcaatgtggagattcaactattgaataaataattcaacacgggcattgtggatagtcttacactatgaacaatggtcttttcattaaacaccctccacattatcttctttctcttccacatcctttcctttttctttcacagaataattcaatacccactcaaattttatactctacaatggtattttataagagaatttatctctaataattcaaagaaaaataaaatatcagaaatttcagtaacaaataaaagcataacacatgtcccatctacatttaattcgcctccacaatttctatctctaactatttaataacaagtggcaatgaggggtccatttttaacaataaaacattattgaatccgttcaacaccatttaatggacgtaagagttatttctttatacaatatctcattgtaagcattcagttattgaattaattttctcaatatatcattgtagatagtcttataagtatgcagacttggcagattgagggagatttttataaggctgatgtggatagcttgagaggcctcaatgagcttcttttattagtatgagattttatctatgtaaagtttgagcttcatatccaataatttgccatctaattttgacatattttgaaattttaatccttaagtttacaaactaaacttgatatcagttcttgcattagttttgtatttatatttcaaaaacagattgaaaacttaaaatttaacgtacgttatttattaatttatcaagatgttaagaaattttcattaatttatgaagttaattttataataatttaattaagttacgttggatattcagtcacctataaatagtttacatatcttcatgtctagataaccaaataaaaatatattttattacattcttctcatacaggaaaaataagtcagtaatctccaagcataagaaaaatatg

SEQ ID NO: 34350 - DNA, 2902 bp, Unknown
  misc_feature (1)..( 2902): 2750-1469P.txt file - cDNA_ID_3077249; gDNA_ID_2926141; Annot_ID_197455
tttgtttaataacatttcttattttttatatgctaagaaatagttttgttctatcctgtgttttcttagatcatatggaataatttcaactcttatgagattggtatatagtttgatacctagcatcgtaggtaggcgactatcatattattttatatagtaatattaagcacattttcgtaactttgtggaatagtttagcaaaagaatattgatcagtatggttttctacgtgaaagattcataatctcaaactgttaagttccagcagaagtggtgtatatgccatcatgctttgatgataagaattagaaggtacgtggtgaagttatacgtccgtttaatatatgcattttttgttaaaagttatgtctgtttaattatgattggtaactatagcttaagatttgaagtttactaaaatctgtgaatgacagcaaaaatttgtaaattattattgaatgatcatttagtgtaaatattttgctggatggccctctctcttctccggacaacatttttatatctatttaaaacttaatttttaagaaagagctcaatattagaaggacacagttgggcaaaaatttagagtcatagcacaaaactactaatacaatggcaaagagaaagtgaagatagggctagaaagtgaaaatattgctggccttattgatgcttatctaaactcatatattttctttgttttcttttccattcctttaattttacctcattacctcatatatttgaactatatattgtgttttccattttaaaaagtagaagacatgggaagagaagaagatagaagttagatagctggatcttcgagttttctttcacctgatttggtatctaggaaaatgttgttctcaagaagatggaagattgtaacagtttggtgagaagcctggaatttggatgatgtagatgattcacctctcgataatcacatattctacatgtagaatggccaaaagatgattatattaactattaagaaaacatattgaccttaacgtatgtagatatatctctaagaaattatgtaaatcatgagaagtaacacttactttgtcgaagtcgtcggagaaacttaaaaccaattataatcttttttcttggaatctctttctttttttctggtaatagaccaagatgtaggttcgcttcaaggaaaaaatcatctttaaaggttcgcttcaaggacgtctttttcacaccataccctctacttattttgtcttctcctcgtcttgtataaactccacactcatctttgatactattgatttggataccctagtttacaggaaaagttgattgtaaaaggaatactaactttgacgcgcaaacacaaaccaaaatatcttcattatagaataatggaacaaacttgattgcaaaagtttattgaaaaatagaatctatcattacaaatttgtttacagaaggatacgaagagatcagttagatttggttacgactcttcgattttggtatgccacatgacttttgttgagaataagaaaattatggtagaaaaataagaaaattatggtagaaataacgattttttatgtgtccaaatgaaatgaatcaagtctctatttatagagtttaaaaagttataaactttatataaatatatgttttaaaaaattttgtttggtatgcaataaatgattgtaaatagataaaagaaaataaaaatctcccaaaatctcaatatccaataaaaatatagcaagtgtcaacatcttaataatctctttttttcaaggaaaaaaaagttttggacaatacactctcattttcttgagtttgaaacacacattccactcacttattgacacgtggcatacacatgcccaaaatttatcttttcaacatgttgaatagtttcaaccaagttgaatccacgtaagattttttaattattcggcaggtgcaatgtggagattcaactattgaataaataattcaacacgggcattgtggatagtcttacactatgaacaatggtcttttcattaaacaccctccacattatcttctttctcttccacatcctttcctttttctttcacagaataattcaatacccactcaaattttatactctacaatggtattttataagagaatttatctctaataattcaaagaaaaataaaatatcagaaatttcagtaacaaataaaagcataacacatgtcccatctacatttaattcgcctccacaatttctatctctaactatttaataacaagtggcaatgaggggtccatttttaacaataaaacattattgaatccgttcaacaccatttaatggacgtaagagttatttctttatacaatatctcattgtaagcattcagttattgaattaattttctcaatatatcattgtagatagtcttataagtatgcagacttggcagattgagggagatttttataaggctgatgtggatagcttgagaggcctcaatgagcttcttttattagtatgagattttatctatgtaaagtttgagcttcatatccaataatttgccatctaattttgacatattttgaaattttaatccttaagtttacaaactaaacttgatatcagttcttgcattagttttgtatttatatttcaaaaacagattgaaaacttaaaatttaacgtacgttatttattaatttatcaagatgttaagaaattttcattaatttatgaagttaattttataataatttaattaagttacgttggatattcagtcacctataaatagtttacatatcttcatgtctagataaccaaataaaaatatattttattacattcttctcatacaggaaaaataagtcagtaatctccaagcataagaaaaatatg

SEQ ID NO: 34351 - DNA, 3003 bp, Unknown; identical to SEQ ID NO: 34349
  misc_feature (1)..( 3003): 2750-1469P.txt file - cDNA_ID_3077249; gDNA_ID_1620794; Annot_ID_168417

SEQ ID NO: 34352 - DNA, 3000 bp, Unknown
  misc_feature (1)..( 3000): 2750-1469P.txt file - cDNA_ID_3077260; gDNA_ID_1620794; Annot_ID_168411
tacgagacatgccaaacggattgaacccatcagtacacaacccgagataaacgttacgaggttcttccgcaaaccggggatgtaactcttggaaatatctccactctgccgcatctgaaggatgattcatttctccctcctttgattgatgctcagcatgccatcgcattgctgcagctgtcttgtggctctgatacattctttttaaccggtctccaataggtagataccacatacgactatatggtactttggttcgtcgacggtcatctttaggcttccatctttgtgcgccacaaaatcgacaatgatcttcttgttcgtcttctttccagaaaagcatacaattgttcgaacaaacatcaatcgtatgatatggaagtcctaaattgcgcatcaacttttcggtttggtaatgtgaactggtagcctggtttccttctggtaaaaattctgtaaacatttcgcaaacggaatccaccaacttttcactcatattataatccgccttgttctacatgagtcgagatgctaaggataactgcgactggccttcacgacaacaatcgtacaatggagtatttgcaccttctaacaagtcgtaaaatttctttgaatggttacgaaccggttcttcgacattttgataactactatcctgatgataactatcctgatgatagttatcatcaaaccccacgttaaaattaaatgcatcgttcaccatatccacatatggattttctacaacattacccacttcttcatgattctcactaaaatacgtcatatccgtgtaactagttcctatatccatattcaatcttctccatgcttataccaaacataataatcaggcataaatccttgactaaacaaaggactactaactcttctacccgagatgatgtgtttttcattcttgcatacactacaaggacaatgaaatttacctcgactactctgtactataggctgactattagcgaatgtcatgaactcctctactcttgcaacgtattcggttgactaatttcccgttacttcatcaaatctcttgtacatccaatctcgatagaaaccgccaccaccgccattattgaagtttcccgccattataccataaactaaacttatatttttttcttcgaaatcgttttttatttcttttgatgttgttttgatttgttggtgaatgagaatgaagagtgtcgtggattatatagaggattttttacaactattttacgactaaacactgtagacgctcagaaattaggtgtacctacccagcaacgcgaaaaacattttccaatggtattatacgacaactatgcgactattggacgacaaagtgaaaatagtcgtagtatcgtcgcctgttttgcgactaatgtttaaagtcggatatgtagtcgtcaatatacgactactttacgactacttatttttttcagtaatgtcgtcgtcaaatagtcgtacttggacgactatttaccgactaaagcttgtagtcgctaaaatacgactatggaacgaccaatttgtctattgtcgtaacgtcgtcgtccatcagtcgtaatatagtcgcaaaaaaggacgaatacattgttagtcgccttgcgtagtcgtcgtttgcctattttcttgtagtgattgactcattctctccatacatgagccaagctttgtaccccggcataaacccatccccatataaatgcatccaaacttaagataccagaataactcttaaaattagttatgtagaacacggacaatacatttgttttgatttgatggttactggttggtttgtcgcaaatgccatgaattgtttaagaccttctgtatattctggcgttagcaactccgtcaccggatcacgcatgggctggtccatccatgatcaaaaataattaaacggattcgaagaaaccatttctctctggttctattttgttgcttggacgattttgtcaatgagggtagaaaaaataaagatgagaattatcaatttttccgacgagtttttgacggatgtcagacgagttttcgactgattttcgttggagatttgatgatttttttataaataactatacgcacggctatttgaccggacggctacttaaccgagtgtattttgttggaattttgtcggaaaggtacaacatattctgacgaatattagaggtgtcaaaacggatatattttggtcggaaatccgtcgaaatatttggtcggagtttcgttggaaatcactgacgaattgtcgaccattttgaatccataggaaagtttcgacggtgttttgacgggaaacatgtcgtcagaaatccgtcggaatatcattacgaagccgtcgaaaatttctgactatttatttaacgtcggaaaatttgtcaaaaaagtctttcagcacaaagaagagctatacaatggattttgactcggttcctctcaacaagacaaataaggcttttgtgcgtcgatcccttagctcctaattcagattttttttctagattctctttatttctaatcaatttacttattaattcgttcttttgtttatctccctatgtttttttagtttttgaaggttaaaatcctgccaactttagtattatactatatatttcttccttgtatttcacctttggataatttcatgaattattcagacgaaaaaaaaaaaaaaaaacaatattcgttctttgtttgggaaagaggcccaataagggcccaactatttctcacctatcgaaaacaaaaaattctgaaaattgttcgtcgtcggtacgacggagagaaaacgtcttccaaagacgaattgaggcggtggaagaagaaaaaaaaaaatcaaaatccaatttgatcttcaaagtagtgaagaaagaagagaagcaatcgaaattctctgacgatgttgttacaaccccaaagatcctcttatcgattatcgtaattcgtagaaaacgaagcagagagaaaatg
